United States Patent 9,828,416 (MODIFIED POLYNUCLEOTIDES FOR THE PRODUCTION OF SECRETED PROTEINS) - sequence listing, part 5

SEQ ID NO: 9063 - DNA, 2871 bp, Artificial Sequence
  Description of Artificial Sequence: Synthetic coding sequence
atggagacccaggagctgcggggcgccctggccctgctgctgctgtgcttctttacaagtgcgtcccaggacctgcaggtcatagacctccttacggtaggcgaaagccgccagatggtagccgtcgccgagaaaatccggacagcactgctgacggctggggacatctacttgttgtccacgttccggctgccccccaagcaggggggcgttctgtttgggctctattccagacaggacaatacccggtggctggaggcttctgttgtggggaaaataaataaagtgctcgtccggtatcaacgcgaagacggtaaagtacatgctgttaatctgcagcaagctggactcgccgatggacggacccataccgtacttctgcggctgaggggcccatccagaccatctcccgcactccacctgtacgttgattgtaagcttggggatcagcacgcaggcttgcccgcccttgctcctattccaccagcggaagtcgacggtctagaaatacgcacagggcagaaggcttacctgcggatgcagggctttgtggagtctatgaaaatcatactggggggcagcatggctcgagtcggagctcttagcgaatgtcccttccagggagacgagtctatccatagtgcagtaacgaatgctttgcacagcatcttgggcgaacagacaaaagctctggttacccagctcacactgttcaatcaaattctcgttgagcttagggatgatatcagggaccaggtcaaggagatgagtctgattagaaacacaattatggaatgccaggtctgtggcttccacgagcagcggtcacactgttccccaaacccttgcttcaggggtgttgattgtatggaagtctatgagtatcccggttataggtgtggcccctgtccgcccggcctccagggtaacggcacacattgctctgatatcaatgaatgtgctcatgcagacccttgtttcccaggatcctcctgcattaacacaatgccaggatttcattgtgaagcatgcccccggggctacaaaggaacacaggtgagcggcgtaggcatcgattacgcccgcgccagtaaacaggtatgcaacgacatcgatgaatgtaatgatgggaataacgggggctgtgaccctaattctatctgcactaataccgtggggtcctttaagtgtggaccctgtaggctgggcttccttggtaatcaatcccagggctgcctgccggcgaggacctgccactcccccgcccacagcccttgtcacatacatgcccattgcctcttcgaaagaaacggcgccgtgtcttgccaatgcaacgtcggatgggctgggaatggcaatgtatgtgggacagacaccgacatcgacggctatccagaccaggccctcccctgcatggataacaataagcattgcaagcaggataactgtttgttgacccccaactctgggcaggaggacgcagataacgatggtgtgggggaccagtgcgacgacgacgcagatggggacggcatcaagaatgtcgaagataactgtcggctgtttcctaacaaggatcagcagaactccgatacggattcattcggggatgcctgtgataattgccctaatgtcccaaacaacgatcaaaaagacacagatggaaacggggaaggtgatgcgtgcgataatgatgtcgacggcgatgggattccgaacgggctggataattgcccgaaggtgcccaatcccctccagactgacagagacgaagacggggtaggcgacgcttgcgactcatgtcccgaaatgtctaatccaactcagactgacgccgatagtgatctggttggagacgtttgcgataccaacgaggactcagatggcgacggacaccaggacactaaggataactgcccccagcttcctaattccagtcagctggatagtgacaacgatggactcggcgacgagtgcgacggtgacgatgacaacgacggaatccctgactacgtgccaccagggcccgataattgccgtctcgtccctaatcctaaccagaaggacagtgatggtaacggagtgggcgatgtgtgtgaagatgatttcgacaacgatgccgttgtagacccactggacgtatgccctgagtcagcagaggtgactcttaccgactttcgtgcataccagactgtggttcttgacccggagggagatgctcagatcgaccctaattgggtggttctcaaccagggtatggaaattgtgcagacgatgaattctgatcctggtctggcagtgggttacacggctttcaatggtgtggactttgaaggcaccttccatgtgaatacggtcacggacgatgactatgccggttttctgttctcttaccaggattctggtcggttttatgtggttatgtggaaacagacagaacagacttattggcaagccaccccatttagagccgtggcgcagcctggcctacagctgaaagccgttacctccgtgtcaggacctggcgaacatcttcgcaacgccttgtggcatacaggacacactcccgaccaggtgcggctgttgtggactgatccccgaaatgtgggctggcgcgataaaacgtcctacaggtggcagctgctccaccgaccccaggtcggttatatacgggtcaagctgtatgaaggcccccagttggtggctgactccggtgttattatcgacacatcaatgcgcggcgggcgcctgggcgtgttctgcttcagccaggagaacattatttggtccaacctgcagtaccggtgcaacgataccgtccctgaggattttgaaccatttagacggcagttgctgcaaggccgcgtatag

SEQ ID NO: 9064 - DNA, 1110 bp, Artificial Sequence
  Description of Artificial Sequence: Synthetic coding sequence
atgctgccctggctgctggtgttcagcgccctgggcatccaggcctggggcgacagcagctggaacaagactcaagcaaaacaggtcagcgaaggattacagtatttgtttgagaacatcagccagctcaccgagaaagacgtctcaaccacggtgtcaaggaaggcgtggggtgctgaagcagtcggctgcagtattcaattgacaacacctgtgaacgtgctggtgatccaccatgtacctggactggaatgccatgaccagaccgtttgctcacagaggctccgcgagcttcaggctcatcatgtccacaataactccggctgtgacgtcgcatataacttcctggttggcgacgatggtcgcgtgtacgagggagttggatggaacatccagggcgtgcatacccagggctataacaatatctcactgggattcgcattttttggtactaaaaaggggcatagtccttctcctgcagcattaagcgcaatggagaacttaattacatacgccgtccaaaaaggccatctgtccagcagttatgtacagcccctgctgggaaaaggcgaaaattgcctggcaccgcggcagaagacctcccttaagaaggcgtgcccaggggtcgtaccacgaagcgtctggggtgcgcgcgagactcactgtcccagaatgacattgccagccaaatatggcattatcatccatacagccggacgcacctgcaacatctcagatgaatgtcggctgctggtgcgcgatattcagtccttctacattgaccgcttgaaaagttgtgatattggatataacttcctggtgggccaagacggcgccatctacgaaggtgttggttggaacgtccaagggagcagcacacccggctacgacgacatcgcactcggaatcacgtttatggggacgttcactggaattcctccgaacgccgcggctctggaggcggcccaggatctgatccagtgtgcaatggttaaagggtacttgacaccgaactatctcctggtgggccactccgacgtcgctcgcacactgtctccaggtcaggccctgtacaatataatttccacatggccccactttaagcactag

SEQ ID NO: 9065 - DNA, 675 bp, Artificial Sequence
  Description of Artificial Sequence: Synthetic coding sequence
atggagaagatccccttcgtgctgggcggcaacctgcagggcggcgaactcgtggttgcgtatccatatgatctcgtgagatctccttggaagacacaggagcatacccccacacccgatgaccacgtgttccggtggctcgcctactcttacgcgtctacacatcggttaatgacagatgccagacgccgagtgtgccatactgaagacttccagaaggaagaggggacagtgaatggggcctcttggcatactgtggcaggctcgctcaatgatttctcctatctccacactaactgcttcgagctgtccatctatgtggggtgtgacaaatacccccacgaaagtcaactgcccgaagagtgggagaataatagggagtcccttatcgtcttcatggaacaggttcatagagggattaagggccttgttagggactcgcatgggaagggcataccgaacgccataataagcgttgaaggcattaaccacgatattaggacaggcagagtctcactacagaaattaagcttggcctgtcggcgggttagatgcgcattcgctctgtcctcatcctcaacaatgattgtccgcccaccccagccatatgggaccgtccctcactcatcaccagacccagttacgactaagatttcacccttgaggaatttctag

SEQ ID NO: 9066 - DNA, 285 bp, Artificial Sequence
  Description of Artificial Sequence: Synthetic coding sequence
atgcccgtgatcgccggcggcatcctggccgccctgctgctgctgatagttgtcgtgctgtgtctgtattttaagatccataacgctctgaaggcagccaaagagcccgaggccgtagccgtgaagaaccacaatcctgataaagtgtggtgggctaagaattctcaggctaagaccatcgcaactgagagctgcccagcacttcagtgctgcgaaggctatcgcatgtgtgcttctttcgactccctgcccccatgctgctgcgatataaatgaaggactgtag

SEQ ID NO: 9067 - DNA, 285 bp, Artificial Sequence
  Description of Artificial Sequence: Synthetic coding sequence
atgcccgtgatcgccggcggcatcctggccgccctgctgctgctgatcgtcgttgtgttgtgcctctactttaagattcacaacgcacttaaagctgcaaaggaacctgaagcggtcgcggtgaaaaatcacaatccagacaaggtttggtgggccaagaacagccaggctaagaccatcgccactgaatcttgtccggccttgcagtgttgtgagggttataggatgtgcgcgtcgttcgacagcctcccaccatgttgttgtgatattaatgagggcctgtag

SEQ ID NO: 9068 - DNA, 1026 bp, Artificial Sequence
  Description of Artificial Sequence: Synthetic coding sequence
atggtgcccgccgccggcgccctgctgtgggtgctgctgctgaacctggggcctagagccgccggtgcgcaaggcttgacacagacaccaacagaaatgcagagggtatcccttcgctttggaggtcccatgactagaagctacaggtcgactgcgagaaccggcttgcctcggaagactcgtattatactcgaagacgaaaatgacgcaatggcagatgcagacaggctggcaggaccagctgctgccgagttgctggccgcgacagtgtctaccggtttctcaaggtccagcgccatcaacgaggaagacggatcctcggaagaaggtgtagttataaatgccggtaaagacagcacttcgcgggagttaccaagtgccaccccaaacaccgccggctcttccagcaccaggtttattgccaattcccaggagcctgagattcggctgacttcttcccttccaaggagccctgggcgctcaaccgaggatctgccagggagccaagctacactctcccaatggtctacgcccggaagcaccccctccagatggccaagtccttcccctaccgccatgccctcacctgaggaccttcgcctggtcctcatgccttggggtccttggcattgtcattgcaagagtggtacaatgagcaggagccgcagcgggaaactgcatggcctgtccggccgacttcgggtcggcgcactaagtcagctgagaactgagcacaagccctgcacctaccagcagtgtccttgtaacaggctgcgtgaggagtgcccactggacacctctctttgcaccgatactaactgtgccagccagtccactaccagtacgagaaccactaccacccccttccccactatccatctgagaagttcaccgagccttccccccgcctccccatgcccagccttggccttctggaaacgggtgaggattggtttggaagacatttggaacagtctctcatcagtcttcactgagatgcagcctattgatagaaaccagaggtag

SEQ ID NO: 9069 - DNA, 366 bp, Artificial Sequence
  Description of Artificial Sequence: Synthetic coding sequence
atggacgtgctgttcgtggccatcttcgccgtgcccctgatcctggggcaggaatacgaggatgaggagcggctgggcgaggatgaatactaccaggttgtctattactacaccgtaacgccctcgtacgatgactttagcgcggattttacaatcgattatagcatattcgagtcagaagaccgccttaaccggctggataaggatatcactgaggcaattgaaactacaatctcactggagacggctagagccgaccaccccaagccagtgacagtcaagcccgtgactactgagcccgtcgaagagggatgctatgatagcctggacggttctctcgcccgcgggaactggaaaatcaagtag

SEQ ID NO: 9070 - DNA, 396 bp, Artificial Sequence
  Description of Artificial Sequence: Synthetic coding sequence
atggacgtgctgttcgtggccatcttcgccgtgcccctgatcctgggacaggagtatgaagatgaggaacgactgggcgaggacgagtactatcaggtcgtgtattactacacagtgacacctagttatgacgacttttccgctgactttaccatcgattattcaatttttgagagtgaggaccgactcaatcgacttgacaaggatattacagaggccattgagacaaccatcagccttgagactgcaagagcagaccaccccaagcccgtcacagtaaagccggtgacaactgaacccagccccgacctaaacgacgcggttagctccttgcggtcgcccatccctcttctcttatcatgtgccttcgttcaagtggggatgtactttatgtag

SEQ ID NO: 9071 - DNA, 396 bp, Artificial Sequence
  Description of Artificial Sequence: Synthetic coding sequence
atggacgtgctgttcgtggccatcttcgccgtgcccctgatcctgggccaggagtacgaggacgaggagagactgggagaagacgagtactaccaggttgtgtactattatacagtaacccccagctatgacgacttttcagccgattttacaatcgattactccatattcgagagtgaggatcggcttaatcggttggataaggacattaccgaggccattgaaaccactatcagtcttgaaaccgcgagggccgaccatcctaagcccgttactgttaagccagtgaccacggagcccagtcctgacctaaatgacgctgtttccagtctccgttccccgatccccctgctgctcagctgtgctttcgtgcaagtcgggatgtactttatgtag

SEQ ID NO: 9072 - DNA, 312 bp, Artificial Sequence
  Description of Artificial Sequence: Synthetic coding sequence
atgagcggccggggcaagggcggcaagggcctgggcaagggcggcgccaagcggcacaggaaggttctgcgagacaacatacaggggattaccaagcctgctatccgtcggctcgctaggcgtggcggagtcaagcggatttcaggtctcatctatgaggagacccgcggtgtcctgaaagttttccttgagaacgtaatccgtgacgctgttacgtacaccgagcatgcgaagaggaaaacagttaccgcaatggacgtggtgtatgctctgaaaagacagggacgcacactgtacggctttggcggatag

SEQ ID NO: 9073 - DNA, 312 bp, Artificial Sequence
  Description of Artificial Sequence: Synthetic coding sequence
atgagcggccggggcaagggcggcaagggcctgggcaagggcggcgctaaacgacacaggaaagtgttaagagataacatacaggggattacaaaacccgcaattcggcgcctcgcacgtaggggaggcgtgaaacggatctcaggcttgatctacgaagagacacgcggagtgctcaaggtgttcctcgaaaatgtgatcagagacgcggtgacctatacagagcacgccaagagaaagacggtcactgcgatggatgttgtctacgctttaaagagacagggccgtacgctctatggatttggcggatag

SEQ ID NO: 9074 - DNA, 1404 bp, Artificial Sequence
  Description of Artificial Sequence: Synthetic coding sequence
atgctgggcatctggatcgtggccttcctgttcttcggcaccagcaggggaaaagaggtctgctatgaacggctcgggtgttttaaagacggtcttccttggacacgaaccttttcaacagagctggtcggactgccctggagccccgagaaaattaatacaagatttctcctgtacaccattcataatcccaatgcttatcaggagatctccgcggtaaactcttctacaatccaggcatcatattttggaacggacaaaattacacggatcaacatcgcaggctggaaaaccgacggaaagtggcagcgcgacatgtgcaacgtcttattgcaactcgaagacatcaactgcattaacctagattggattaatggtagccgagagtatatccatgcagtgaacaatttacgagtagtcggtgccgaagttgcatactttattgacgtgttgatgaaaaaattcgaatactcgccgagcaaggtacacctgatcggccactcgcttggggcccacctggctggagaggcaggctctagaatccctggactaggaagaatcacgggtcttgatcccgccggcccattttttcataacacaccgaaggaagtcaggcttgatcctagcgatgctaactttgtcgacgtcatacacacgaacgccgcccgaatcctgtttgagttgggagtgggtaccatcgacgcctgcggccacctggacttctaccccaacggcggcaagcatatgccagggtgtgaagacctcataacgcccctgcttaagttcaattttaatgcctacaaaaaggagatggcctcttttttcgactgtaatcatgcgcgttcgtaccagttctatgctgagagcatccttaatcctgatgccttcattgcctacccttgcagatcttacacatcatttaaggctggaaattgttttttctgttccaaggagggttgcccaacgatgggacactttgccgatcgttttcacttcaagaacatgaagaccaatgggagccattacttccttaacactggctcattgtctccatttgcccgatggcgccataagttgtcagtgaaactgtctgggtctgaggttacacagggcaccgtgtttttgagggtcggtggggctgtacggaagacaggggagtttgctattgtttccggcaaacttgaacctggcatgacatacacaaaactgatagatgccgatgtaaacgtgggaaatataacctcggtacaattcatctggaaaaagcatctcttcgaagacagccagaacaagctcggggcggagatggtcattaacacttcggggaagtatgggtacaaaagtacattctgctcccaggatataatgggcccgaacattctgcagaacctgaagccttgctag

SEQ ID NO: 9075 - DNA, 1287 bp, Artificial Sequence
  Description of Artificial Sequence: Synthetic coding sequence
atgatcaccggcgtgttcagcatgcggctgtggacccccgtgggcgtgctgacatcactagcctattgcctgcaccagaggcgcgtggctctggccgaactgcaggaagctgatggccagtgtcccgtggacagatcgctgctgaagctcaagatggtacaggtcgtcttcaggcacggtgcaaggagtccactcaaacccctacctctggaagagcaagtggaatggaatccccagctgcttgaggtaccgcctcagacacagtttgattatactgttaccaaccttgccggaggtccaaagccatattctccatacgattctcagtaccatgaaacaaccctcaagggcgggatgttcgcaggccagctgactaaggtgggcatgcaacagatgtttgcactcggcgagcgacttcgcaaaaattacgtggaagacataccctttctctcacccactttcaacccacaggaggtgttcatacggtcaaccaacatcttccgcaacctagagtctactaggtgtttgcttgctggcttatttcagtgtcagaaggagggcccgattattatacacaccgatgaggcagactcggaggtgttatatcccaattatcagtcatgttggtcattaagacagcgcacccgcgggcggcggcagactgccagtctgcagccaggaatctctgaggacctgaagaaggttaaagatcgcatgggcatagactcttccgacaaggtcgacttttttatcctgttagacaacgtggctgccgaacaggcacataatctcccttcttgtcctatgctgaagcggtttgctcgtatgattgaacaacgggcggtggacacgtccctgtatattctgcctaaagaggacagggaatccttacagatggcagtcggcccattcctgcacatactggagagtaatctgctcaaagccgttgactcggctacggcaccggacaagatcagaaagttatacctgtacgccgcccacgatgtgaccttcataccattgctgatgaccctgggtatcttcgatcacaaatggcccccattcgccgttgatcttacgatggaactataccaacacctagagtccaaggaatggttcgtgcagctctactatcatgggaaggaacaagtgcctcgaggatgcccggacggtttatgccctctggacatgtttctgaatgccatgtccgtgtataccctgtcgcccgagaagtatcatgccctatgcagtcaaacacaggttatggaggtaggcaatgaagaatag

SEQ ID NO: 9076 - DNA, 711 bp, Artificial Sequence
  Description of Artificial Sequence: Synthetic coding sequence
atgtgcgtgacctaccacaacggcaccggctactgcaagtgccccgagggcttcttgggggaatattgccagcatcgagacccctgtgaaaagaatcgctgtcagaacggcgggacatgcgttgcgcaggccatgcttgggaaagccacctgtcgctgcgcttctggttttacgggtgaagattgtcaatacagcacctcccacccatgctttgtgagccggccttgcctcaatggcggcacctgccacatgctgtcccgggacacctatgagtgcacctgtcaagtgggctttacaggcaaggagtgccagtggacagacgcatgtcttagtcacccctgcgccaatggcagtacctgtactactgttgccaaccagttttcctgcaagtgccttacgggctttactggtcagaagtgtgaaacggacgttaacgagtgtgatatccctggacactgccagcatggaggaacgtgtttaaatctccccggatcttaccaatgtcagtgtttgcagggctttaccggccagtattgcgacagtctctacgtgccatgtgctccttccccttgcgtcaacgggggcacctgtagacagacaggggatttcacattcgagtgcaactgcctcccagagacggttcgccgaggcactgaattgtgggaacgcgacagagaagtttggaatggaaaggaacatgacgagaactag

SEQ ID NO: 9077 - DNA, 990 bp, Artificial Sequence
  Description of Artificial Sequence: Synthetic coding sequence
atggtgaccaaggccttcgtgctgctggccatcttcgccgaggccagcgccaaaagctgtgcgccaaacaaggccgacgttatcctggtcttttgttatcctaagacaattatcaccaagattccagagtgcccgtacgggtgggaggtgcaccagctggccttgggcgggctctgttacaacggagtccatgagggcggctactaccaattcgtgattccagacctgagtccaaagaataaaagttactgcggcacccagtccgaatacaagccccctatctatcacttctactcccacatcgtgagtaacgacaccacagtaattgtaaagaatcaacctgtcaactattccttttcctgtacataccacagtacctaccttgtgaatcaggctgcattcgatcagcgagttgctacagttcatgtgaaaaacgggtctatggggacctttgaaagccaactgagcttaaatttctacacgaatgccaagttttccatcaagaaggaggctccgtttgtactcgaggcctcggagattggctcagatctgttcgccggcgttgaagcaaagggcctgagtatacgcttcaaagtggttctgaacagctgttgggctactccctctgccgactttatgtatccgctccaatggcagctgatcaataaaggttgccctactgatgagaccgtcctggtacatgaaaacggcagggaccatagagccaccttccagttcaacgcctttcggttccagaatatccccaagctttccaaagtctggctccattgcgagactttcatctgtgatagtgagaaattatcttgtccagtgacttgtgacaagcggaagagactcttacgtgaccagactgggggcgttctggttgtcgagctgagtctcagaagccgggggttctctagcctttatagttttagtgacgttcttcaccatctgatcatgatgcttgggatctgcgccgtgctctag

SEQ ID NO: 9078 - DNA, 1161 bp, Artificial Sequence
  Description of Artificial Sequence: Synthetic coding sequence
atggcccagtggcactgcagccagcggacccaggccggcggccacggggtgggcgagcggctcgcccagtgtcaggatcagtcatccagacacgccgccgagctacgggacttcaagaacaaaatgttaccactgttggaggtggcagaaaaggaacgggaagcattgagaacagaggctgacaccatcagcggcagggtcgatagactggaacgagaggtggactacctggaaacccagaatccagcgctgccctgcgtcgaatttgacgagaaggttacggggggtccagggaccaaagggaagggacgacggaatgaaaagtacgatatggtaacagactgtggctatactatctcccaggtacgttcgatgaaaatcctgaaacgcttcgggggacccgctggattgtggaccaaggatcccctgggacagactgagaagatctacgtactggacggaacacagaacgatactgcgttcgtgttccctaggctgcgagatttcactctggctatggcggcccgaaaggcatcccgggtgagggtgcctttcccgtgggttggaactgggcagttagtctacggcggtttcctatacttcgcgcgccggcccccagggcggcctggcggaggaggcgaaatggagaacactttacaactcatcaagtttcatctcgcaaaccggactgtggtcgactcttccgtgttcccagctgaagggctcattccaccctatgggctcacggccgacacatatatcgacctagccgcagacgaggagggattgtgggccgtctacgcaacccgcgaggatgaccggcacctgtgtttagctaaactcgacccgcagacactggacaccgagcagcagtgggacacaccatgtccgagagaaaatgccgaggcagcctttgtgatctgcggcactttatatgtcgtctacaatacccgtccagccagcagagctcgcatacagtgctcctttgatgcctcaggaacactaaccccagagagggccgccctaccgtactttccccggcgttatggtgcgcatgcgtctctgagatacaacccccgggagcgccagctgtacgcctgggacgatgggtaccagatagtatataaactagagatgaggaagaaggaggaagaagtctag

SEQ ID NO: 9079 - DNA, 510 bp, Artificial Sequence
  Description of Artificial Sequence: Synthetic coding sequence
atgagcgagcgggtggagcggaactggagcaccggcggctggctgcttgccctgtgtctggcatggctgtggacgcacctgacattggctgccctccaaccgcccacggctacagtgctagtccagcaggggacgtgcgaagtgattgctgcccatcgctgttgcaaccggaaccgaatcgaagagcgttcccagactgtgaaatgctcttgcttttctggccaagtggcagggactaccagggctaagccttcttgcgttgacgacttactgctcgctgcccattgcgcacgacgggatccgagagccgccctgcgtctgctcttgccacaacccccgtcttcttgtcgcgacggtggggtaaggtggagccctgcctgcaggggcaggagcgtgcggtgttccaggacatgccgagatggcgcagccgcagttgatactaaatcaaaacccccaaggtcccacgactcgtcgtggggaagccggcccggccaggagcggctggattag

SEQ ID NO: 9080 - DNA, 693 bp, Artificial Sequence
  Description of Artificial Sequence: Synthetic coding sequence
atgcggctggccggccccctgcggatcgtggtgctggtggtgagcgtcggcgtgacatggattgtggtaagcatactcctgggagggcctgggagtggattccccagaatccagcagctgttcacctctcctgagtccagcgtgaccgcggccccgcgtgcacggaagtataaatgcgggctgccccagccgtgtcccgaggagcacctcgccttccgggtggtatccggggcagcaaacgttatcgggcccaagatttgtttagaagacaagatgttgatgtcctcagttaaggacaacgtcggtagagggctcaatattgccctcgtgaacggggttagcggggagctgattgaggcaagggcgtttgacatgtgggctggagatgttaacgacttactgaagtttatccgacctttgcacgaggggacattggtattcgtcgcctcgtatgatgaccccgcaaccaaaatgaatgaggagactcgcaaacttttttcagagctcgggtcaagaaacgccaaggaattggccttccgcgacagctgggtgtttgttggggctaaaggggtgcagaacaagagtcctttcgagcagcatgtgaaaaatagcaaacacagtaataaatacgaggggtggcccgaagccctagaaatggaaggctgcattcctaggaggtctactgctagctag

SEQ ID NO: 9081 - DNA, 1176 bp, Artificial Sequence
  Description of Artificial Sequence: Synthetic coding sequence
atgctgcggcccggcggcgccgaggaggccgcccagctgcccctgaggagagcatccgcacccgttccagtaccgtctcccgctgctccagacgggagcagagcctccgcccgactgggcctggcttgcctcttactgctgctcctgcttacactgcccgcaagggtggacacatcctggtggtatatcggagctctcggcgcccgggtaatttgtgataacatacccgggctcgtgtctcggcaaagacagctgtgtcagcggtatcccgacattatgaggagcgtgggcgagggcgccagagaatggattagggagtgccaacaccagttccgccatcatcgctggaactgcacaacgctggaccgcgatcatacggtgtttggccgggttatgttaagatcttcacgcgaagccgcatttgtgtacgccatctcctcagccggggtagtgcacgccatcacccgcgcctgctctcagggggagctctcagtgtgcagctgcgatccctacactaggggacggcatcatgaccagaggggtgatttcgactggggcggttgctccgacaacatacattatggcgtacggtttgcgaaggcatttgttgacgctaaagaaaagcgcttgaaagacgccagagccttgatgaacttgcacaataatcgttgcggaaggacagcagtgagacgcttcctgaagcttgaatgtaagtgccacggagtgagtggatcctgcacattacgcacatgttggagggccctttccgatttccgacgcactggggattacttgagaagaagatacgatggcgcggtacaggtgatggccacccaggatggagccaacttcacagccgcgcgccaggggtaccggagggccacacgaaccgacctggtgtatttcgataatagccctgactattgcgtgctggacaaggcagctggaagcctcggaacagccggccgagtttgctcaaagaccagtaaaggaactgacggatgcgagataatgtgttgtggtaggggttatgacacaactcgcgtgacaagagtcacccagtgtgagtgcaagtttcattggtgctgtgctgtgaggtgcaaagaatgccggaataccgtggatgtccatacttgtaaggctcccaagaaagcagaatggctagaccagacttag

SEQ ID NO: 9082 - DNA, 1119 bp, Artificial Sequence
  Description of Artificial Sequence: Synthetic coding sequence
atgctggacggcctgggcgtggtggccatcagcatcttcggcatccagttgaaaaccgagggcagcctgcggacagcagttcccggcattcccacccaatctgcatttaacaaatgcctacaacgatacattggcgcgctgggcgctagggtgatatgcgacaatattcccggtctggtgagtaggcagcgacaactttgtcagcggtacccagatattatgaggtctgtgggggagggggcacgggaatggatccgagaatgtcagcatcaattcagacatcatcgatggaactgtaccacactggatcgtgatcataccgtcttcggtagggtaatgctaagatccagtcgggaggcagctttcgtgtatgctatttcctctgctggtgtggtgcacgctattacacgtgcatgtagccaaggagagctgtctgtgtgtagctgtgatccttatacgcgaggacggcaccacgaccagcgaggggattttgactggggtggttgcagtgataacattcattatggagtgaggttcgcaaaagccttcgtcgacgctaaggagaagaggctaaaggatgccagagctctcatgaatctccacaataatagatgtggccgaaccgccgtgcgacgcttcctgaagttagagtgcaaatgtcacggtgtttcaggcagttgtacactccggacatgttggagggcgttgagcgatttcagaagaaccggagactatctgaggcgccggtacgacggagctgttcaagtcatggcaacacaggatggggcaaacttcaccgcggctcgacaaggttataggagggccacccgaaccgatcttgtatattttgacaacagcccagactattgcgtgctagataaggcagccggctctctgggcactgccggtcgagtgtgttccaagacttctaaggggaccgacggctgcgagattatgtgctgtgggagaggctacgacacaacccgcgtgacacgtgtgacccagtgtgagtgcaagttccactggtgctgtgccgtccggtgcaaggaatgccggaatacagtggatgtccatacctgcaaggcccctaaaaaggccgaatggttggaccagacctag

SEQ ID NO: 9083 - DNA, 1242 bp, Artificial Sequence
  Description of Artificial Sequence: Synthetic coding sequence
atggagaacatgctgctgtggctgatcttcttcacccccggctggacactgattgatgggagtgaaatggagtgggatttcatgtggcatctgcgcaaggtgccaagaatcgtttccgagcgaacatttcatttaacaagcccggccttcgaggcagatgcgaaaatgatggtgaatacagtctgcggaatcgagtgccagaaggagttgccaaccccctcccttagtgaactggaggattacctctcttatgagactgtctttgagaacggaaccagaacactcaccagggtgaaggtgcaggacctagtgttggagcccacccaaaacatcacgaccaagggggtgtccgtgcggaggaaaagacaggtttacgggactgacagcagattttccatactggataaacggtttctgacgaactttccatttagtacagctgttaagctttctacagggtgtagcggaatcctcatctcaccccagcacgtattgacagccgcccactgcgttcacgacggtaaagactatgttaagggctctaaaaagctcagagtgggcctcctaaaaatgcggaacaagagtgggggtaaaaagcgcagagggagtaagagatctcggagagaggccagcggcggagatcagagagaaggaacgcgtgaacacctgcgtgaacgggctaagggagggcggcgccgaaagaagtctggccgtggtcagcggatcgccgaaggtcgcccttctttccaatggacccgcgtcaagaatactcacatccctaaagggtgggccagaggcgggatgggagacgccactctggactacgactacgccttactcgaattaaaacgcgctcacaagaaaaagtacatggaactcggcatatcgccaactatcaagaaaatgccagggggaatgatacactttagcgggtttgataacgacagagccgaccagttggtctatcgtttttgcagtgtctctgatgagagcaatgacctgctgtatcagtactgtgatgccgagagcggctctactgggagtggagtgtatttaagacttaaagatcctgataaaaagaattggaagaggaaaattattgctgtctactccggacaccagtgggtagatgtccacggggtacagaaagactataacgtagccgtacggattacacctctcaagtacgcgcaaatttgcctgtggatacacggcaatgacgcaaattgtgcatatgggtag

SEQ ID NO: 9084 - DNA, 1143 bp, Artificial Sequence
  Description of Artificial Sequence: Synthetic coding sequence
atgggcgccaccaccatggaccagaagagcctgtgggccggcagcgcttacaagttggtgtgttatttcactaattggagccaggacagacaggagcccgggaagttcactcccgaaaatatagatccgtttctatgttcgcacctgatctatagcttcgccagtattgaaaacaacaaggtgattattaaagacaagagtgaagtgatgctgtatcagacgattaactctctaaagacaaagaatccgaaactgaagatcttgttgtccattggaggatatctttttgggtcaaaaggctttcaccctatggttgacagtagtaccagtcgcctggaatttataaactccataatcctatttctgcgaaatcataattttgacggcttggacgtcagctggatctacccagaccagaaggaaaacacccatttcacggtgctgatccatgagcttgccgaggcatttcagaaagatttcacaaagagcacaaaagagaggcttttgctgactgctggtgtcagtgcaggcaggcagatgatagataattcataccaggttgaaaagctggccaaggacctggacttcattaatttgctgagtttcgattttcatggtagctgggagaaacccctgatcacagggcataattcacccttgagtaaggggtggcaggaccgcgggccctctagctactacaacgtggagtatgctgtagggtactggatccataagggcatgccaagcgaaaaagttgtcatgggcattccaacatacggacactcgttcaccttagccagcgcggagaccaccgtgggcgccccagcctcagggccaggagctgctggacctatcactgagtcctccggatttctggcttactacgaaatttgtcagtttctcaagggagcaaagatcaccagactccaagatcagcaggtgccatacgcagtgaaaggaaaccagtgggtggggtacgatgacgtcaagagtatggagaccaaagtgcagttcttgaaaaacttgaatctgggtggggcaatgatatggtctatcgatatggacgacttcacagggaaaagctgtaatcagggcccctatccactggttcaggccgtgaaaagaagtttgggatccctgtag

SEQ ID NO: 9085 - DNA, 1173 bp, Artificial Sequence
  Description of Artificial Sequence: Synthetic coding sequence
atgggcgccaccaccatggaccagaagagcctgtgggccggcgtggtggttttactgctgctgcaaggcggctccgcgtacaagctggtctgctacttcaccaattggagtcaggatagacaggagcccggtaagttcacccctgaaaatatcgaccctttcctctgctcccatctgatctacagtttcgcgagtattgagaacaacaaggtcatcataaaagacaaaagtgaagtgatgctataccaaacaattaatagcctaaaaacaaaaaaccccaagctgaagatcctgttatccatcggcggctatttgtttgggagtaagggcttccacccgatggtagactcttccacaagcaggctagagttcattaactccattatactttttctgaggaaccataatttcgacggcctagatgtgagctggatctatcccgatcagaaagaaaatacccactttaccgtgctaatccacgagctggccgaagcctttcagaaggatttcacaaaatcgaccaaggaacgcttattgctcaccgccggggtgtctgctgggcggcagatgattgacaactcttaccaagtggagaaattggccaaagacttggatttcattaatctcctgtcctttgatttccacggctcctgggaaaagccacttattactgggcacaatagcccgctgagtaagggctggcaggatcgtggaccctcatcatactataacgtggagtacgccgtgggctactggatccataaaggaatgcccagcgaaaaggtggtgatgggcattccgacatatggtcactcattcactctcgcctctgcagaaactacagtgggagcacccgcaagcggtccaggtgccgctggacccataaccgaaagttcagggtttctggcatactacgagatctgtcagttccttaaaggggctaaaatcactcggctgcaggatcagcaggtgccatacgcagtgaagggaaaccaatgggtcggctacgatgatgttaaatcaatggaaacgaaagtgcaatttctgaagaatcttaatctgggcggtgccatgatttggagcatcgacatggacgattttaccgggaagagttgcaatcagggcccctatcctctggtacaagctgttaagcgaagcttggggtcactgtag

SEQ ID NO: 9086 - DNA, 2202 bp, Artificial Sequence
  Description of Artificial Sequence: Synthetic coding sequence
atggccggcggccgggagacctgcctgcccctgatcggcttcatcctcatctgtctaaagatggtggcatcagccaaaagtgcccccgagatcccaacaattgatcaggcctacagcaaattgtctaattccattaccgttgaatgggctacggtgcccggcgccacgagctacctcctgacagctgaggatggggacaccgtgatcgagacaactgtcgccaattcccccggaactgtgacagggttgaaagccgcaacctggtacgaaattacaattaggagtatctctgccgcaggccgttcacaggccagcccgccgaagcaagccaagactgtgctggccgctccgatcctcgaggtttcttcacccagttccgatagtattttggtgcagtgggaagcagtttatatggccatagcattctccgtgagcatcatgagggccaacggacttggctcaatttggaaggagaacactaccaatacatccctgacctttacttccctcgaggccggaacattgtacactatcaaagcttacgcatggaatgccaatcggataccaggagatgactcaacctgcaatcaacggacttcacccagggcacccgccaatattcaggtctcttttgattccggggctctgaaggcatctttttcctgggccagagccgaaggtgcctttaattacaccgtgatggcactctccgatagctctgagctcacatgtagcaccacattctcttcctgtactatatcttccttacagtgtggcactgaatatctcattagtgttctcgcctccaatgacgccggcagttcaaagagcagttccgccatgacgctgaagaccgtggcttgcgcgcccgggcgagtcacgatccaggaggaccccccgggccacctgtctgttgcatggtcatccgtcgatctgggcgattattatgtggtctttgttaaaagtgacgatgggctcgaggtgcattgtaatacctctctgacccagtgtaactttctttcagaatgtggcttcacctattttatcagcgtcttcgtttataacaaagccgggcagtccccactgggcgatatttttaactacactaccgctccctgctgtccctctgacattaaccccgtccttgtgagctccgatagggtggaaattgtctggagcccagtgcgcggtgcagagttgtacgaaacaaaagctgttgacggctacaacatggttgaatgtaacgacactactccggcttgcaccctcagcgctctcgagtgcgacacaaaatataatattactgtgtacagttttaacgaggtccgagggtcaaatatgagttgcacaccccagtttataactaccgccccctgtagccccgagatcaaaaacgtgtcccgcgatgctttctctatgattaatgtgcactggaggtcgactaacgacgatgcgacctataccgtgactgcccaaggggaaaaggggttatatcagtgcagctctacaggggaatcttgtaccatgcgtggtcttccctgtgggagcgtgttctctgtcacagcagttgctgagacccaggcaggacgctccctcccttcttatagtgtccctttggagacagttccctgctgccccacaggattgactgtgacacagattacccagtctgttataaatgtgtcctggactatcggaagggtggcccagacacacgttgctgtgctagaaagccacacaggccagtccaaatgccacacacaccagaaccattgcctgttaggctgtataacatgcgggattaattatacagtgaccctaaaggccatatctgctaccggactgactgccgactgcagctaccaatcctacttttctggagcttgctgcccattaggcgttaagttatatagactggggcccaacggtatcagaatctactggcaggcctcccggggctccgctaattatagcaccgatctctatggcagtaaaggcattttcacatgcacccctagtgctggcctttctttctgcgatgtgactgagattccatgcggggatgtgtatactgttatggtttcaccagtggcaaaaacgggcttaaaattgactttctgtccgaaaaagatttactctgtaacctgttctggcagcaccttgggaatggtcatctataggggtaagcggaacgaggagtag

SEQ ID NO: 9087 - DNA, 555 bp, Artificial Sequence
  Description of Artificial Sequence: Synthetic coding sequence
atgcggggccagggccggaaggagagcctgagcgacagccgggacttggacggctcttatgatcagctgaccgattcggtggacgacgagttcgaattgagtaccgtctgtcaccgcccagaaggcttggaacagctgcaggagcagactaagttcacccgcaaagaacttcaggtgctctacagagggttcaagaacgagtgcccctcaggtatagttaacgaagagaacttcaagcagatctactcccagttttttccccagggagattcatctacttatgctacattcctgttcaatgcctttgacactaatcacgacggttctgtctcctttgaagagatgctggatattatgaaatcgatctatgacatgatggggaagtatacgtatcccgcccttcgcgaagaagcacccagagaacatgtggagagttttttccagaagatggacagaaacaaagacggtgtggtcacaattgaagagtttatagaatcttgccagaaggacgagaacatcatgcggagcatgcagttatttgacaacgtgatttag

SEQ ID NO: 9088 - DNA, 759 bp, Artificial Sequence
  Description of Artificial Sequence: Synthetic coding sequence
atgcggggccagggccggaaggagagcctgagcgacagccgggacctcgacggaagctacgaccaactcacggggcacccgcccgggcccaccaaaaaagcgctgaaacagaggtttctgaaactgctgccctgttgcggaccccaggcgctcccctccgtgtcagagtctaacgtggacgatgaatttgaactctcaaccgtgtgccatagacccgagggcctggaacagctgcaggagcagactaaattcaccagaaaagaactgcaggtcttgtatcgagggttcaaaaatgagtgtccttccgggatcgtaaacgaggagaactttaaacagatctacagtcagttctttcctcagggcgattcaagcacttatgccacctttctgttcaacgcttttgacaccaatcacgacggctccgtaagcttcgaagactttgttgctggcctttctgtgattctccgcggaactgtcgatgacagactgaattgggctttcaatctgtatgacttgaacaaagatggatgtatcaccaaggaagagatgctcgatataatgaagtcaatctatgatatgatgggaaagtatacctaccccgctctgagagaggaagcaccacgggaacacgtggagtctttttttcagaagatggacagaaataaagacggggtggtcaccatcgaagaatttatagagagctgtcagaaggatgagaatattatgcgtagcatgcagttgttcgataatgtgatttag

SEQ ID NO: 9089 - DNA, 1377 bp, Artificial Sequence
  Description of Artificial Sequence: Synthetic coding sequence
atgcaggccaccagcaacctgctgaacctgctgctgctgagcctgttcgccggcctagatccttcaaagactcagatcagccccaaggagggatggcaggtgtacagctccgcccaggaccctgacggcaggtgtatttgtactgtcgtagctccggaacagaatttatgcagtagagatgctaaaagcagacagttgagacaactgctagagaaggttcaaaatatgtcacaatccatagaggtgctcaatctcaggacccagagggattttcagtatgtcctaaaaatggaaacccaaatgaagggactgaaggctaagtttcgacagatcgaggacgaccgaaagaccctgatgacaaagcacttccaggagctaaaggaaaaaatggatgagttgttgcctttaattcctgtgcttgagcagtataaaaccgacgccaaactgatcacccagttcaaggaagagattcggaacctgagcgccgttttgaccgggattcaagaggaaatcggggcctacgactatgaggaactccaccagcgcgtactatccctggaaacaagactcagagactgtatgaagaaacttacatgcggaaagctgatgaaaataactggtcccgtgacagtgaaaacatccggtacccgtttcggcgcctggatgactgacccgttagcttctgaaaagaataaccgggtttggtacatggatagctataccaacaataaaatagtgcgtgagtataaaagtatcgccgactttgtgagcggcgcagagtctaggacttataatctgccctttaaatgggcagggaccaaccacgtcgtctacaatgggtctctgtacttcaataaatatcagtctaatattattattaagtacagcttcgacatgggacgcgtgctagcccagaggtcccttgagtacgccggcttccacaacgtgtatccatacacatggggaggcttttccgacatcgatctgatggctgacgaaattggcctgtgggccgtgtatgccactaaccagaacgcaggaaatatcgtcatatcccagctcaatcaggatacactcgaggtgatgaagagctggtcgaccggatacccaaagaggagtgccggggagtcgtttatgatttgcggcactctgtacgtgacaaattcacacttgacaggcgccaaagtctattacagctatagcacaaagacttccacatatgagtacaccgacatcccatttcacaaccagtactttcatatttccatgctagactataacgctcgcgacagagctctgtacgcatggaacaacgggcaccaggtcctctttaatgtgaccctttttcacattatcaaaaccgaggatgacacttag

SEQ ID NO: 9090 - DNA, 915 bp, Artificial Sequence
  Description of Artificial Sequence: Synthetic coding sequence
atgctgccccccccccggcccgccgccgccctggccctgcccgtgctgctgttactcctcgtggtacttacacccccacctacgggagcccggccgagtccagggcccgattatttgcggcgggggtggatgagactcctcgccgaaggggagggatgtgcaccatgccgaccggaagaatgtgctgcgcctcgcggatgtctagccggcagagtgcgggacgcatgtggatgttgctgggagtgtgctaacctggagggccagctgtgcgatctcgacccctccgcccacttttacgggcactgcggggagcaactggaatgtcggctggacacggggggagatttaagtcgtggtgaggtgccagaacccttgtgcgcttgccgttctcagagtccactgtgcgggtcagacggtcacacctattcccagatctgcaggttacaggaggcggcccgcgcacgacccgacgcaaatctcacagtggcccatcccggcccctgcgagtcaggacctcaaatcgtgagtcatccgtacgacacttggaatgtgacagggcaggacgtcatctttgggtgcgaagtgttcgcgtaccccatggctagtatcgaatggcgtaaggatggattagacattcagctgccaggggatgacccgcacatcagcgtgcagtttcgcgggggccctcagcgctttgaggtcacaggctggcttcagatccaggcggtgcgtccgagtgacgaaggcacgtatagatgtctcggcagaaatgcgctgggccaggtcgaagcaccggcttccctgactgttctcactccagatcagttgaatagcacaggcattccacagctgaggagtctcaatctggtgcccgaggaagaggccgagtcagaagaaaacgatgactactactag

SEQ ID NO: 9091 - DNA, 327 bp, Artificial Sequence
  Description of Artificial Sequence: Synthetic coding sequence
atgacccccagccggctgccctggctgctgagctgggtgagcgccacagcttggcgtgccgccagatcacctcttctctgccactcgctccgcaagacctcttccagtcagggaggcaagtcagagttggttaaacagtctctgaaaaagccaaagctgccagaggggcggtttgatgcccctgaggacagccatctggagaaagagccattagagaagtttccagatgacgtgaacccagtgaccaaggaaaagggcggtcctcggggcccagaacccaccaggtatggagactgggagcggaaggggagatgtatcgatttctag

SEQ ID NO: 9092 - DNA, 663 bp, Artificial Sequence
  Description of Artificial Sequence: Synthetic coding sequence
atggccggcctgagccggggcagcgcccgggccctgctggccgcccttttagcctccacattattggccctcctggtgtccccagcacgcggacgaggagggcgggatcacggtgactgggatgaggccagccggcttccacccttgcctccccgcgaggatgccgcacgtgtagcccgattcgtaacccatgtgagtgattggggcgccctggcaaccatctctactctcgaggcagtacgagggcggcccttcgcggatgtgctgagcctgtcagacgggccccctggcgcgggctcaggggtgccttacttctatctctctcccctgcagttgagcgtatccaacctgcaagaaaacccatacgcaacgctgaccatgactttagctcagaccaatttttgcaaaaagcacggtttcgacccacagtcaccactgtgcgtgcacattatgctgagtggaacagtgacaaaggtcaatgaaaccgagatggatatcgcaaaacactccctgttcataagacaccccgagatgaagacatggccgtccagtcacaattggttctttgcaaagctaaacattacaaatatctgggtgttggactatttcggcgggcccaaaatcgtcacaccagaagagtactacaatgtcaccgtccagtag

SEQ ID NO: 9093 - DNA, 2760 bp, Artificial Sequence
  Description of Artificial Sequence: Synthetic coding sequence
atgggcctgttccggggcttcgtgttcctgctggtgctgtgcctgctacaccagagtaacaccagcttcatcaaactgaataacaatgggtttgaagatatcgtgattgtgatcgatccgagcgtgcccgaggacgagaaaattatcgagcagattgaagacatggtaaccacggcatccacttacctttttgaggctacggaaaagaggttctttttcaaaaacgtctcgattttgattccggagaattggaaggaaaatccacagtataagcgccctaaacatgagaaccacaagcacgctgacgtcatcgttgcacctccgaccctcccaggtagagacgagccctacacgaagcagtttaccgaatgcggtgagaagggtgaatacatccactttaccccagatctcttgttaggcaaaaaacaaaatgagtatggtcctccgggcaagctgtttgtgcacgagtgggcacacctgagatggggcgtcttcgacgagtataatgaggaccagccattctatagggcaaagtcaaaaaagattgaggccacacggtgttctgctggaatatccggaagaaatcgcgtgtataaatgtcaaggcgggtcatgtctgtctcgggcttgtagaattgactccacaacaaagctgtacgggaaggactgtcagttcttccctgacaaagtgcagactgagaaagcgtctattatgttcatgcagtccatcgattccgttgtggagttttgtaacgagaagactcacaaccaggaggcgccttccctccagaatatcaaatgcaatttcagatctacctgggaagtgatttcgaactccgaagatttcaaaaataccatacctatggttacacctccccctcctcctgtttttagtctgctgaagataagtcagcggattgtctgcctggtgttagataaaagcggaagcatggggggaaaggatcggctaaaccgtatgaatcaggccgcaaagcactttctcctacagacagtcgaaaatggttcatgggtgggcatggtccacttcgactcgactgcaactattgtcaacaagctcatacaaattaaatctagcgacgaacgcaacaccctaatggcaggcctgccgacctaccccctggggggcacgagtatctgcagcgggattaaatatgcttttcaggtcatcggagagttacattcccaactggacgggagcgaagtactgttgctgacagacggcgaggacaatacggctagttcctgtattgacgaagtgaagcagtctggcgcgatcgtccactttattgccctcggccgcgccgctgacgaagccgtaattgagatgagtaagatcactgggggcagccacttttacgtgtccgatgaagcacaaaacaacggcctcatagacgccttcggcgctctcacatccggcaatacagacttgtcccagaaatccctgcagcttgaatccaagggtcttacccttaactctaacgcctggatgaatgatacagtcattatcgacagcaccgtaggcaaggacacattttttttgattacctggaattccctccccccttcgataagcttgtgggaccctagcggcaccatcatggaaaacttcacagtggacgcaacctctaaaatggcctacctgtcaattcctggcactgccaaggtgggcacatgggcctacaacctgcaggccaaggcaaacccagagactcttaccatcaccgtgacatcaagagcggccaactccagcgtaccacccatcactgtgaacgcaaagatgaacaaagacgtgaatagcttccccagccctatgattgtgtacgccgaaatccttcaaggatacgttcctgtcttgggtgctaatgtcaccgcgtttatagagagccagaatgggcacaccgaggttttggagctcctggataacggcgcaggggccgactccttcaagaacgacggagtgtactcacggtacttcacggcttacaccgagaacgggcggtactccctcaaggtgagagcccatggaggggccaatactgcaagactaaagttaagaccccctctgaacagagctgcctatatcccagggtgggtggtgaatggagagattgaggccaacccacctcgccctgagattgatgaggacacacagacaaccctggaggacttttcccggacagccagcgggggcgccttcgtggtttcacaggtgccatctctaccattaccagaccagtaccccccctctcaaattaccgatcttgacgccaccgtgcatgaggataaaatcattttgacttggactgctcctggcgacaatttcgatgtgggaaaagtgcaaagatatatcatccggattagtgccagcatcctagacctgcgagactcattcgatgacgcattgcaggtcaatacaacagacctgagtcctaaagaggccaatagtaaagagtccttcgctttcaagccagaaaacatcagtgaggagaacgctacacatatcttcatagccattaagtcgatcgataaatccaacctgacatctaaggtttctaacatcgcacaagtcacactctttattccacaggccaatcccgatgatatagatccaacacccactccaacaccgactcccacccccgataaaagtcacaactccggtgtgaatatctctacgttggtcctttccgtgataggctcggtggttatcgttaatttcatcctgtccaccaccatttag

SEQ ID NO: 9094 - DNA, 1938 bp, Artificial Sequence
  Description of Artificial Sequence: Synthetic coding sequence
atggcccccagcgccgaccccggcatgagccggatgctgcccttcctgctgttgctgtggtttttacccatcaccgaggggtctcagagggccgaaccaatgtttactgccgtgaccaactcggtgctcccccctgattatgacagcaatcccactcaactcaactacggggtggccgtgaccgacgtagatcacgacggcgactttgaaatcgttgtggccggttacaatggccccaacctcgtgttgaaatacgatagagcccaaaagcgcctcgtgaacatcgcggtagatgagcggtccagcccttactacgccttgcgcgatagacagggcaatgcgattggagtgactgcgtgcgacatcgatggggatggccgggaagagatctacttcctgaatactaacaacgccttctcaggagtggctacttatacagataaattgttcaaattccggaacaatcgctgggaagacatcctgtcggatgaggttaacgttgctcggggcgtcgcctcactcttcgccggaaggtccgtggcatgtgtggatcgcaagggtagtggccgatactcgatctatattgccaactacgcttatggaaatgtgggtccagatgcccttattgagatggatcccgaggcatctgatctttccagggggattttagctctgcgcgatgtggcggctgaggctggcgtaagcaaatatacgggaggacgaggcgtctcagtcggtcctatcctgtcttcctctgcctcggacatcttttgtgacaacgaaaatgggccgaacttcctgtttcataatcggggtgacgggacgtttgtcgacgccgccgcctcagctggagtagacgatccacaccagcatggcagaggtgtggctctggcagattttaaccgtgacggcaaggtcgatatcgtgtatggtaattggaacggaccccacaggctgtatttacagatgagtacacatggaaaggtaagattccgcgatatagccagtcctaagttttcgatgccctcaccggtgcggactgtcattacggccgactttgacaatgaccaagaacttgaaatcttcttcaacaatatcgcatatagaagctctagcgcaaacaggctatttcgggtgatacgcagggagcacggtgatcctcttattgaagaactgaatcctggggatgcattggagcctgagggccggggaaccggcggagtggttactgactttgacggtgacggaatgcttgatctcattctctcccatggggaatccatggcccaacccctgtcagtgttccgcggcaaccagggcttcaataacaattggctccgggtagttccgaggacccgcttcggcgcctttgccagaggggcaaaggttgtgctgtatacaaaaaaaagtggagcccacctgagaatcatcgacggcgggtccggatatctttgtgagatggaacctgttgcacactttggactgggaaaggatgaagcatcaagtgtggaagtgacttggccagatggaaaaatggtttcacgcaacgtggccagtggagagatgaactccgttctagagattctttacccgcgcgatgaggacaccttgcaggatcccgctcctctggagtgcgggcagggcttttcccaacaggagaacggccactgcatggacactaatgaatgtatccagttcccgtttgtatgtcctagagacaaacccgtgtgcgttaatacatatggtagttaccgatgtcgcactaataaaaaatgctccaggggatacgagccgaacgaggacgggaccgcctgtgtcgctcaggtggcctttctgggcgggtactcatcagcggccagcaggatcagtgagcctttgtcgagagcctcttacttgagtctcgggcttggcctgtgcctgcagctctacgctctctag

SEQ ID NO: 9095 - DNA, 1986 bp, Artificial Sequence
  Description of Artificial Sequence: Synthetic coding sequence
atggcccccagcgccgaccccggcatgagccggatgctgcccttcctgttacttctgtggtttttacccatcactgagggatcgcagcgtgccgaacctatgtttaccgcagtcactaactccgtgttgccccccgattatgattctaatccaacacagttgaattatggggtggcagtgacagatgtggatcatgatggagacttcgaaatcgtcgtggcagggtacaacggccctaacctggtgcttaagtacgatagggctcaaaagcggctcgtaaacatcgcagtggatgagcgtagctctccttactatgcgttacgcgaccgccagggtaacgctattggcgtgacagcgtgcgacattgacggcgacggaagggaagaaatctatttcctcaatacgaacaatgccttcagcggggtggccacatacactgacaagctgttcaaattcaggaataaccggtgggaggacatcctgtccgacgaagtgaacgtagctcgtggagtcgcctcactgtttgctggccgaagtgtggcttgcgtcgacaggaagggttccgggagatatagcatttatatcgcgaattatgcttacggtaacgtaggcccagacgcccttatagagatggacccagaagcttcagaccttagcagaggcatcctcgcactccgcgatgtggcagcagaagccggcgtctccaaatatacggggggtaggggcgtctcagtgggacctatccttagcagtagcgcatccgacatattctgtgacaatgagaacggtcctaactttttatttcacaacaggggggatggaaccttcgtggacgccgccgcttccgcgggggtcgacgatccgcatcaacacggtcgcggcgtggctctggcagattttaatcgagacggaaaagtcgacattgtatacggcaattggaatggacctcataggctgtatctgcaaatgagcacccatggcaaggtgaggttccgggacatcgcaagtcctaaattctccatgccctcccctgtgaggacagttatcactgccgacttcgacaacgatcaggagctggaaatcttcttcaacaacatcgcatacaggtcatctagcgcgaacaggctgttccgggtgatcaggcgcgaacacggcgatccgttgattgaagagctgaatcccggtgacgctctggaacctgagggtaggggtactgggggggtagtgacagactttgacggagacggtatgcttgatctgattctctcccacggggaatccatggcgcaacccctgtcggtgttcagaggaaatcagggatttaataataactggttgcgcgttgtccccaggacacggtttggggcatttgctagaggtgccaaggtggtgttgtataccaagaaaagtggcgcacatctcaggattattgatggcggaagcggatatctctgcgagatggaacctgtcgctcatttcggcctcggaaaggacgaggcttctagcgtggaagtgacttggcctgacggcaaaatggtatcacggaacgtggcctctggggaaatgaattccgtgcttgaaatactttatcctagggatgaggacacacttcaagatccagctccacttgagtgtgggcaaggcttttcccagcaagaaaacggtcactgcatggacaccaatgaatgcatccagttcccatttgtctgccctcgcgacaagccagtgtgtgttaacacttacgggtcctataggtgccgcacgaataaaaagtgttcaagaggatacgagccgaatgaggacggaactgcatgtgtagggacacttggtcaatcgcccgggccacgccccactactccgaccgccgcggccgcaacagctgccgctgccgctgccgcaggcgccgccactgccgcccccgtgctggttgatggagacctgaatctcggctcggtcgttaaggagtcctgcgagccctcctgttag

SEQ ID NO: 9096 - DNA, 1230 bp, Artificial Sequence
  Description of Artificial Sequence: Synthetic coding sequence
atggccctgacccccggctggggcagcagcgccggccccgtgcggcccgagttgtggctattgctctgggccgccgcttggcgactgggggcctccgcttgtcccgcgctctgcacgtgtaccggcacaaccgtggattgccatggcacggggctacaggcaatcccaaagaacatcccaaggaacactgaacgcctggaactgaatggaaataatattactcggattcacaagaatgactttgccggcctgaaacagcttcgtgtcttacaactgatggaaaaccagatcggggctgtggaacggggggcctttgatgacatgaaggagctggaacgccttcgtctcaatcggaatcagctgcacatgctccccgaactgttattccagaacaaccaggcactgagcagattagacttgagcgagaacgctatccaggcaattcctagaaaagcattcaggggggccaccgatctcaagaacctgcaactcgacaagaatcagataagctgcatcgaggagggggctttccgggctctcagaggtctggaggtcctgacccttaacaataataatattaccacaattcccgtcagtagctttaaccacatgcccaaactccggacctttcggcttcatagtaatcacctgttctgtgattgccaccttgcttggctctctcagtggctgagacaacgtccaacaattgggctgtttacccaatgctcagggcccgcctccttgcgggggcttaatgtcgccgaagtgcaaaaatctgagttctcgtgcagcgggcagggagaggccggacgggtgccaacatgtaccctgagcagtggttcatgccctgctatgtgtacgtgtagcaatggtattgtggattgccgcggcaagggattaacggcgatccctgccaacttgccggagactatgaccgagatccgacttgaattgaatggaattaaatccattccccccggagccttttcaccatatcggaagcttagacggattgacctgtcaaacaaccagattgcagaaatagctcccgacgcctttcagggcttgcgaagtctgaactcactccacacggggccggtcacgtgcccacatactaccgggacgcactctagtcactgcagggctttcgctgtcgcggtcccacacagtaggaacgatctggaagcaatgtttgaggaggaagtgccacgcattttctatagcgcgtag

SEQ ID NO: 9097 - DNA, 1143 bp, Artificial Sequence
  Description of Artificial Sequence: Synthetic coding sequence
atggccctgacccccggctggggcagcagcgccggccccgtgcggccggagttgtggctcctcctgtgggcagccgcatggcgcctaggagccagtgcatgcccggcactttgcacctgcacaggtacgactgtggattgccacggaactggccttcaggcaattccgaaaaacatacctcggaacacagagagattggaacttaacgggaacaacattactcgcatacataaaaatgactttgcaggactgaaacagctgcgggttctgcagctgatggagaatcaaattggagccgtggagcgcggcgcattcgatgacatgaaggagctggaaaggttagatctctcagagaacgctatccaggcaatccctcggaaggctttcaggggggcaactgatctgaaaaacctgcagctcgataaaaaccagattagttgcatcgaagaaggcgcctttcgggctttacgcggtctggaagttcttacgttgaataataataacatcactaccattcccgtatcaagcttcaaccatatgcccaagctacgcacctttcgcctccacagtaatcacctgttttgcgactgccacttggcctggctgtcccagtggctgagacagcgaccgactattggactgttcacacagtgctcagggccagctagccttagaggcctaaacgtggcagaggtccagaagagtgaattctcgtgtagtgggcagggagaagccggacgtgtgcctacctgtaccctcagctccggatcttgccccgcgatgtgtacttgtagtaacggcatagtggactgcaggggtaaaggcctcacagccattcccgctaacctccctgagaccatgactgaaatacggctcgagttaaacggaattaaatcaattcctcccggggcttttagcccttacaggaaactgcgacgtatcgatctgtccaacaaccagatagccgagatcgcccccgacgccttccagggcttaagatccttaaacagtctagtgctctacggtaataagattacagatctgccccgtggggtgttcggcggactttatacactccagctgctgctgttgaacgcaaataagatcaactgtatccgtccagacgcatttcaagacttgtag

SEQ ID NO: 9098 - DNA, 2448 bp, Artificial Sequence
  Description of Artificial Sequence: Synthetic coding sequence
atggccctgacccccggctggggcagcagcgccggccccgtgcggcctgaactctggctcctcctgtgggcagccgcgtggcgactcggtgcaagtgcctgcccagccctgtgcacttgtaccggcacaaccgtagactgtcacggaacgggactacaggcaattcccaagaatatccctcggaatactgaacgcctcgagctgaatggtaacaacattactcggatccataagaatgatttcgccggcctgaaacagttgagggtactacagttgatggagaaccagattggagccgtcgaacgcggtgcgtttgacgatatgaaagaattggagcgtcttcggctgaaccgtaatcagctgcatatgctgcccgaactgctttttcaaaacaatcaggctctcagtaggctggacctcagtgaaaacgcgattcaggccataccgaggaaagcgtttcgcggtgccactgacttaaagaacctgcagctggacaagaatcagatcagctgcatcgaggagggcgctttccgtgcactccgagggctggaagtgttaacactcaacaataacaacatcaccacaatccctgtcagctccttcaatcacatgcccaagctgcggacatttcgcctgcattccaaccacttgttctgtgactgtcatttagcctggctttcccaatggttgaggcagcgacctacaatcggcttgttcacacagtgttccgggccagcatccctgcgtggactcaatgtggctgaagtccagaagagtgagttttcatgcagcggccagggcgaggctgggcgagttccaacctgcactctgagcagcggttcctgtcctgcaatgtgcacctgctccaacggtattgtggactgtcgggggaaaggtcttacagccatacctgcaaatctgccagaaaccatgaccgaaatcaggctggaactcaatgggattaaatccattccaccgggggcgttcagcccttatcggaagttacgaagaatttgcccgctgagcttttgctccccatgcagggacctgagcaacaatcagattgctgaaattgctcctgacgcgtttcaaggattgcggtccctgaattcacttgtgctgtacgggaataaaatcaccgacctgccacggggagtatttggtggcctgtatacactacaattgttgttgttaaatgccaataaaattaattgcatacggcccgacgcattccaggacctgcagaacctctcccttttgagtctctacgataataaaatccagagcctggccaaaggtaccttcacttcactgcgggctatacagactcttcacctcgcgcaaaaccccttcatttgcgactgcaacctgaaatggttagccgactttctgcgcacaaaccctatcgagacgtccggggctcgctgcgcctcccctcggaggttggctaataagaggatcggacaaatcaagtctaaaaaattccgctgcagcgcaaaggaacagtacttcattcctggtactgaagattaccagctgaacagcgagtgcaattccgacgtagtgtgcccccacaagtgtcggtgtgaagccaatgtcgttgagtgctcttcactaaaattaactaaaatccctgaacggataccgcaatccacagcagagctgaggctaaacaacaatgagatctcaatactcgaggctactggtatgttcaaaaaattaactcacctgaaaaagattaacctgtctaacaacaaggtaagcgaaattgaagacggagcgtttgagggggctgcatcggtaagcgagcttcatctgacagctaaccagctcgagagcatcagaagcgggatgttccgggggctggacggcctacggacgctgatgctcagaaacaatcgaatatcttgcatccacaatgacagttttacaggcctgagaaacgtgcggctgctctcactctacgataaccagattaccactgtatcaccgggagccttcgatactctccaaagcctttccactctcaacctgctggcaaatccctttaattgtaattgtcagctggcatggctcgggggatggttaaggaaacgcaagatcgtaacaggtaatccccgatgtcaaaatcctgatttcctccggcaaatccccctacaagatgtcgccttcccggacttcaggtgcgaggaggggcaggaggaaggtggctgtctgcctcgcccccagtgcccacaagagtgcgcgtgcctagacaccgttgtccgttgtagcaataaacacctgagggctttacccaagggtataccaaagaacgttaccgagctctacctggacggaaaccagtttactctggttccggggcagctgagtacctttaaataccttcaattggtgatcctaagctacaatgctctgcaatgcatcccacccttagcatttcagtag

SEQ ID NO: 9099 - DNA, 4386 bp, Artificial Sequence
  Description of Artificial Sequence: Synthetic coding sequence
atggccctgacccccggctggggcagcagcgccggccccgtgcggcccgagttgtggctcctgctgtgggccgccgcttggcgcctaggggccagcgcatgtcctgccttatgcacttgcactgggacaacagtggattgccatggaaccggactgcaggccataccgaagaacatacctcggaacactgagcgcctggaactaaacggcaataacataacccggattcataaaaatgattttgcaggcctgaagcagcttagggttcttcagcttatggaaaaccagatcggcgcagtagaaaggggcgctttcgacgacatgaaagagcttgaaaggttgcgccttaatcgcaatcaactgcacatgttacccgagctcttgtttcaaaataatcaggcactgagcagactggacctctctgaaaacgctatacaagccatcccacgtaaggcctttcgcggggctactgaccttaaaaatcttcagctggataagaatcagatctcctgtatcgaagagggcgcattccgcgctctcagaggcctggaagtgctgactctaaacaataacaatatcaccacaattcccgtgtcatctttcaaccacatgcccaaattgaggacctttcgcctgcattcaaaccacctgttttgcgactgtcacttggcctggttaagccagtggcttcggcagagaccaacaatagggctgtttacccagtgtagtgggcctgcctctctgcgtggccttaacgtggctgaggtgcagaagtctgagttttcttgctctggacagggggaagccggacgggtccctacttgtactttaagttccgggagttgccccgcaatgtgtacttgctctaatggcattgtggactgtcggggaaaagggctcactgccatcccagctaatcttccggaaaccatgaccgagattcggttagagctcaatggaattaaatcaatcccacccggggccttcagcccttaccgaaagttgcggcgcatagacttgagcaacaatcagatagccgaaattgctcctgacgcattccagggcttgcgcagtctcaactctcttgtcctgtatggcaacaagatcacagacctgcctaggggtgtttttgggggtctttatactctgcagctgctcctgttaaacgccaataagatcaactgcattcggccagacgcctttcaagacttacagaacctgtctctactttcactgtacgataacaagatacagtcactcgccaaagggacctttacatcactgcgcgctatccagacacttcatctggctcagaaccccttcatttgtgactgcaatctgaagtggctggcagattttcttcgtacaaaccccatcgagacttcaggagctagatgcgctagccctaggcgtctcgccaacaagcggataggccaaatcaagtctaagaaatttaggtgcagcgccaaagaacagtattttataccaggcacggaagattaccagctgaatagtgagtgcaactcggacgtggtgtgcccacacaaatgtagatgcgaggccaacgttgtggagtgttcttcattgaagctcaccaaaattcccgagcgcattccacagagcacggctgagcttcggctcaataataatgaaataagcattctggaggctaccggaatgttcaaaaagctgactcaccttaaaaagattaatttatctaataacaaagtgtctgaaatagaggacggagcatttgaaggcgcagcctctgtctccgagcttcacctcaccgcaaaccagttggaatccattcggagtggaatgttcaggggcctagacggtctgcggaccctgatgcttcgcaataataggatttcctgcattcacaacgactcctttacaggcttgaggaatgtgaggctgttgagtttgtatgacaatcagattaccacagtctctcccggggcattcgacaccctgcagtccttgagtaccctgaacctgctcgccaatcctttcaactgtaattgccagctggcctggctgggcggctggctccggaagagaaaaatcgtcacaggaaacccacgatgccagaatccagacttccttcgccagatccctctccaggatgtggcctttccagattttcgctgcgaggagggacaggaggaaggaggctgcctgccaagaccacagtgtccccaggagtgcgcctgcctggataccgtcgtccggtgctcaaacaaacatttacgggcgttgcctaaagggatcccaaaaaacgttaccgaattgtatttggatggaaatcaatttaccttagtgcccgggcagctgtcaaccttcaagtacctgcagttagtggacctgagcaacaacaagatcagtagcctgtcgaacagctcctttactaatatgagccagcttacaacactcatactctcctacaacgcattgcagtgtattccccccctcgcattccagggactccggtctttacgcctcctctcactgcacgggaatgacatttcaacgttgcaagaaggcatctttgcggacgtcacatctctgtcacatctggcgataggcgctaaccctttatactgcgactgccacctaagatggctgtcctcctgggtgaagacagggtataaagaacccggcattgccagatgcgcggggccccaggacatggaaggtaaactgcttctaacgacgccagccaaaaagttcgaatgtcagggcccacccactctagccgtgcaggccaagtgcgacctctgcctctctagtccctgccagaaccagggtacttgtcacaatgaccctctcgaagtctacagatgcgcctgtccgtctgggtataagggaagggactgtgaggtctccttggactcctgctcctccggcccttgtgagaacggcggcacttgtcacgcccaggagggtgaagatgctccgttcacgtgttcttgccccaccggcttcgaaggacccacctgcggcgtcaacaccgatgattgcgtggaccatgcttgtgcaaacggtggagtctgtgtcgacggtgttggcaattatacgtgccagtgcccacttcagtacgaaggaaaagcctgcgaacagttagtggacctgtgcagccccgacctgaatccatgtcagcatgaagcccaatgcgtcggtacccccgacggacccagatgtgagtgcatgcccggctacgccggggacaattgcagtgagaatcaggacgactgtcgggaccacaggtgtcagaacggggctcagtgtatggatgaggttaactcctatagttgcctgtgcgccgagggctatagtggccaactttgtgagattcctcctcatctgcccgcgccaaaaagcccgtgtgaggggacagaatgccaaaacggtgcgaactgtgtggatcagggcaaccggcctgtgtgccagtgtctgccgggttttggtgggccagaatgcgagaaacttctttctgttaatttcgtggatcgagatacttacctgcagtttacagatttacaaaactggcctcgggctaacattacgctccaagtaagcactgccgaagataacggcattttgctgtacaatggggacaatgaccatatcgcagtcgagttgtatcaagggcacgtaagagtgtcttacgacccgggctcttaccccagcagtgccatatactccgcggaaactataaacgacggccagttccacacggttgagctggtggctttcgatcagatggtcaacctgagcatagatggcggatccccgatgacgatggacaatttcgggaaacactacacgctgaactcagaagccccgttatatgtgggcggcatgcctgtggacgtgaattccgcagcctttcgcttatggcagattctcaatggcactggctttcacggctgcatcaggaatctttacattaacaacgaactccaggacttcacaaagacgcagatgaagcccggggtcgtccccggttgcgaaccctgtagaaagttatactgtttgcatgggatatgccagccgaacgccacccctggacccatgtgtcactgcgaggctgggtgggttggactccactgcgaccagccagcagacgggccttgccacggacacaagtgtgtacatggccaatgcgtgccactggatgctctttcgtattcttgtcagtgccaggatggttattctggggctctatgtaatcagagccctagtgccggtgggactctgtcaggaacctttacccgatccagaggcgctatgccaagcgcaaggcctcgtgccccgtgccatgggtggtccgctggcgcaagggctcaggctcgcgcagcagctagagcctttggttag

SEQ ID NO: 9100 - DNA, 570 bp, Artificial Sequence
  Description of Artificial Sequence: Synthetic coding sequence
atggaggccaccggcaccgacgaggtggacaagctgaagaccaagttcatctctgcatggaataatatgaaatatagctgggtgctcaagactaaaacatacttcagtcgtaatagtcccgtgctactgttgggaaaatgttaccacttcaaatatgaggacgaggacaagactctccctgctgagtcaggctgcacgatcgaggaccacgtaattgccggcaacgtcgaggaatttcgaaaagactttatctctaggatatggctcacctatcgggaagagtttcctcagatcgaagggagtgcactgactacggactgcgggtggggatgtacgttgcgtactggacaaatgctcctcgcccaggggctgatactgcattttctgggccgcgcctggacctggcccgatgcactgaatatagagaactctgattccgagtcttggacatcccacaccgtgaaaaaattcacagcaagtttcgaggcttcgcttagcggagaacgggaattcaaaacacccaccatctcattgaaagagaccatcggtaagtatagtgatgaccactag

SEQ ID NO: 9101 - DNA, 1377 bp, Artificial Sequence
  Description of Artificial Sequence: Synthetic coding sequence
atggaggccaccggcaccgacgaggtggacaagctgaagaccaagtttatatcagcctggaataatatgaagtactcctgggtactaaaaacaaaaacttactttagtaggaatagtcccgtattactcctgggtaagtgttatcattttaaatacgaggatgaggacaagacccttccggctgaatccgggtgcaccattgaagaccacgttatcgcaggaaacgtggaagagttcagaaaggatttcatcagccggatttggctcacatatcgcgaagagttccctcagattgaaggctctgcactgacaacagactgcggctggggctgtactttgagaactgggcagatgctcctagcccaaggactgattttgcattttctcgggcgtgcctggacctggccagatgctctgaacattgagaattctgattcggaaagctggaccagccacactgtcaagaagttcactgcctcttttgaggccagtctgtctggagaacgggaatttaaaaccccaacaattagcctcaaagaaaccatcgggaaatatagtgatgaccacgaaatgcggaacgaagtgtaccatagaaaaattatctcatggttcggggacagtccattggccttgttcgggttacaccagctcattgagtatgggaagaaaagcggcaagaaagcaggtgactggtacggcccggcggtcgtggcccatatactgcgcaaggccgtggaggaagcgcgccatccagacttgcaggggatcactatctatgtggcccaggactgcacagtctacaatagtgacgtgatcgataagcaaagcgcctccatgaccagcgataacgccgacgacaaggccgtgatcattctcgtcccagtgcgcctcggtggagaaaggacgaacaccgattatctggagtttgtgaaagggatcctgtccctagagtattgtgttgggatcatagggggtaaacccaagcaaagctactacttcgcgggatttcaggatgactccctaatatacatggaccctcattactgccagtcgttcgtagatgttagcatcaaagactttccgctcgaaactttccactgtccttccccgaagaagatgtcctttcgtaaaatggaccctagctgtacaatagggttttactgcaggaatgtacaggattttaaacgcgcttccgaggaaattaccaaaatgctaaagttttctagtaaagagaagtatcccctttttacatttgtcaatggccacagcagggattatgatttcacgtctaccacaactaacgaggaggaccttttttccgaagatgagaagaaacagctgaagcggttcagcactgaggagtttgtcttactgtag

SEQ ID NO: 9102 - DNA, 8178 bp, Artificial Sequence
  Description of Artificial Sequence: Synthetic coding sequence
atggagcagaccgactgcaagccctaccagcccctgcccaaggtgaaacacgagatggatctggcctacacttcatcgagcgatgagtctgaggacggccgcaaaccccggcagagctataactctagggagaccttacatgagtacaatcaggaactgcgaatgaactacaactctcagtctcggaagagaaaagaagtagagaaatcaacccaagagatggagttttgtgagacaagtcacaccctgtgcagcggataccaaaccgatatgcattctgtctctcgtcatgggtatcaactcgagatgggctctgacgtggacacggaaacagaaggcgccgcctcacctgaccatgctcttcggatgtggatccgtggaatgaaatcagagcactctagttgtctgtcttcacgggctaacagcgccttatctttgaccgacaccgatcatgagcgtaaatcagacggagaaaatggtttcaagttctcccctgtgtgttgtgatatggaggcacaggccggaagtacacaggacgtgcagtcctccccacataaccagtttacctttcggccactgcccccgcccccacctccgcctcacgcgtgcacttgtgcgagaaaacctcccccagcagccgactcactgcaaagacgttctatgacaactcgaagccaaccttcccctgcagcccctgcgcccccgacctccacccaggattcggtgcacctgcataacagctgggtcctgaactctaatatccctctggaaaccaggcactttcttttcaaacatggatctggttcgtccgccattttctctgcagcttcccagaattacccactgacctccaataccgtatactctccacccccccgccccctcccaaggagcaccttttcccgtcccgctttcacctttaataaaccctatcgatgctgtaactggaaatgcaccgccctctcagccactgccatcaccgttaccctggctttactcctggcgtatgtaatagcggtacatcttttcggactgacctggcaactgcagcccgttgagggagagctgtatgccaacggggtgagtaagggaaaccgtggaactgagtcaatggacactacatattcaccaattggcggcaaggtctccgacaaatccgaaaagaaagtgtttcagaaaggtagagcgatcgacacgggggaagttgatataggagctcaagttatgcaaactataccacccgggttgttttggagatttcagattacaattcaccacccaatctatttgaagtttaatatttcattagccaaggatagcctgcttggcatttacggcagacgcaacattccacctacccatacccagtttgattttgttaaattgatggatggtaaacagctggtcaaacaagatagcaagggatcagatgatacacagcacagtcctcggaatctgattctgacatccctgcaggagaccgggttcattgagtacatggaccaaggcccatggtacctggcgttctacaatgatggtaagaagatggagcaggtcttcgttcttactactgcaatagagatcatggacgattgtagtacgaattgcaacgggaatggagaatgcatatcaggtcattgtcactgttttccggggttcctaggccccgattgcgcgcgcgacagttgccctgtgctgtgtggtggcaacggcgagtacgagaaaggacattgcgtgtgccggcatgggtggaaggggcccgagtgtgacgttcctgaagagcaatgtatcgatccaacgtgttttggccacgggacctgcatcatgggggtgtgcatctgcgttcctggctacaaaggagagatctgcgaagaggaggactgtttagatcctatgtgtagcaaccatgggatttgtgtaaaaggggaatgtcattgtagcacagggtggggcggggtcaactgcgagacacccttacctgtttgtcaggaacagtgttccgggcacggaaccttcctgctagacgccggcgtttgcagctgcgatccaaagtggacagggtccgattgttccaccgaactctgcaccatggagtgcggatcgcatggggtgtgctctcgcgggatatgccagtgtgaggaggggtgggttgggccaacgtgcgaggagcgctcctgccacagccactgtaccgagcacggacaatgtaaggatggaaagtgtgagtgtagccccggatgggaaggggatcattgcacaatcgcgcactacctcgatgccgtgcgcgatggctgtccaggcctgtgtttcggcaacgggaggtgcacgttagaccagaacggatggcattgcgtttgccaagttggctggtcaggcacaggctgcaacgtcgtgatggagatgctgtgtggagataatctggacaatgacggcgacgggttgaccgattgcgtggaccctgactgctgccaacaaagcaactgttatatatctcctctctgtcagggttccccggatcctttagacctcatccagcaatcacagacactgttcagtcagcacaccagccgactgttttatgataggatcaaattcctgatcggtaaggactcaacccacgtgatccctccggaggtgagctttgattcgaggcgcgcatgtgtgatccgggggcaggtagtggccatagatggcacacctctcgtgggagttaacgtgtcatttctgcatcacagcgattatggcttcactatcagccgccaggatggtagcttcgatttggtggccatcggaggcattagcgtgattctcatctttgacagatctccttttttgcctgaaaagcgcaccctctggctgccctggaatcaattcatagtggtggagaaagtgacaatgcagcgggtagtatccgacccacctagctgtgatattagcaactttatctctcctaatccaatcgttcttccttctccgctaaccagttttggagggtcttgccctgaacggggtacgatagtaccagaactccaagtcgtccaggaggagattcctattccaagctctttcgttcgactgtcctatctaagctcccgtactcctgggtacaaaacactactgagaatccttcttactcattctacaatacccgtcggcatgattaaggtgcacctgaccgtggctgttgagggcaggctgacccaaaagtggtttcctgccgctatcaacttagtgtacacctttgcatggaataaaacagatatctacggccagaaggtttgggggctggccgaggcccttgtgtctgtggggtacgaatacgaaacctgtcccgattttattctgtgggaacaacggacagtggtgctacagggcttcgagatggatgcaagcaacctggggggatggagtcttaacaaacatcatatcctcaatccgcagtcaggcatcatccataaaggtaatggcgagaacatgttcatcagccagcaaccgcctgtgataagcaccattatggggaacggccaccagagaagcgtggcttgcactaactgtaatggccccgcacataataacaagttgtttgcccctgttgcgctagcaagcggacctgacggctcagtctacgtgggcgatttcaactttgtgcgaaggattttccctagcggcaactcagtttctattctggagttgtctactagtcctgcacataagtattatttagctatggaccctgtatcagagtctctgtacctctctgacactaatacacggaaagtgtataagttgaagtctctggttgaaactaaggacctctctaagaacttcgaagtggtggccggaactggggaccagtgcctacctttcgatcagtctcactgcggagacgggggccgcgcttctgaggctagcttgaactctcctcggggtataactgtagatcgccatggctttatatacttcgtggacggtactatgatccgcaagattgatgaaaacgcagttattacaactgttataggctctaacggactgacaagcacgcaacctctaagttgcgatagcgggatggatatcactcaagtgcgtttggagtggcccacagacctggccgtgaatccaatggacaattccttgtacgtcctggacaacaatattgtgcttcagatctctgagaatcgccgcgtaaggatcattgccggcagaccaatccattgccaggtgcctgggatcgatcatttcttggtgtctaaggttgccatccatagcacattggaatcagctcgtgcaattagcgtgagccactctggccttctttttattgctgagaccgatgagagaaaggtcaatcgcattcagcaagtcacaacaaatggcgagatttacattatcgcaggcgcgcccacggattgtgactgcaagatcgatcctaactgtgactgcttttccggcgacggaggctatgcgaaggatgcaaagatgaaagccccgtctagcttagcagtcagtcccgacggcactttatacgtggcagatctggggaatgtgcgcatcaggaccatcagccgaaaccaggctcatctgaatgacatgaacatctacgagattgcgagccctgctgatcaggagctgtatcaatttacagttaacgggacacacctgcatacattgaatctcataaccagagactacgtgtataactttacctataactccgagggcgacctaggggctatcacctcctcaaacggcaactctgtccacatccgacgtgacgcagggggcatgcccctttggctggttgtgccgggcggccaggtttactggctgactattagtagtaatggagtgctcaagcgggtatccgcccagggatacaatttggccctgatgacctaccctggcaatacaggattgctggctacaaaatctaacgagaacggctggacaactgtgtacgagtacgatccagaaggacaccttaccaatgctacctttccaacaggcgaggtgtcatccttccactccgacttggaaaagctgaccaaagtggaactcgacacttctaatagggagaatgtgcttatgtctacaaacttaactgccacctctacaatctacatcttgaaacaggagaacacgcagtcaacatacagggtgaaccctgacggatctttacgcgtgacctttgctagcggcatggaaattggattatcaagcgagccacatatcttggcgggagctgtgaaccctacgctcggcaagtgcaacatttccctgccaggggagcataatgctaacttaatcgagtggcgtcagagaaaggaacaaaataaagggaacgtttcagcgtttgaacgacgcctcagagcccataatagaaacttactcagtatagattttgatcacattactaggactggcaagatctatgatgaccacagaaaattcactctgcggatcctttatgatcagaccgggcgccccatactctggtcacctgttagccggtataatgaggtcaatattacttatagtccctccggccttgttacgttcatacagaggggaacctggaatgaaaaaatggaatatgaccagtccggcaagattatctctcgtacctgggcagatggtaaaatctggagttacacttaccttgaaaagagtgtaatgctcctgcttcacagccagcggaggtatatcttcgagtacgaccagccagattgccttctgtctgtgactatgccttccatggtgcgacacagcttacagactatgttatcggtgggatactatcggaatatctatacacctccagacagcagtacaagtttcattcaggattactcaagggacgggcgacttctgcaaaccctccatctgggcactgggcgacgcgtgctctacaagtatactaagcaggctcggctgtccgaggtgctctacgacactacacaggttaccttgacatatgaggaaagctctggagtaataaagaccatccatcttatgcatgacggatttatctgcacgatccgttatcggcagacaggcccattaatcggccgacagatctttcggttctccgaggaaggattggtcaacgcccggttcgactattcgtataacaacttcagggtcaccagcatgcaggccgtcataaatgagacgccactgccaatagacctctataggtacgttgatgtgagcggaaggactgaacagttcggaaagtttagcgtaattaactatgacctgaatcaggtgattacgactacagtcatgaagcacaccaaaatctttagcgcaaacgggcaagttatcgaagttcagtatgagatcttaaaagcaatagcctattggatgaccatccagtacgacaacgttggcaggatggttatctgtgatatccgcgtgggagtcgatgccaacattacaaggtacttctatgagtacgatgctgatggacagttgcaaacggtctccgtcaacgacaaaacccagtggaggtactcttacgacttgaatggcaatattaacttgctgagccatggaaagtccgcaagactgaccccactgcgctacgacttaagggatcgtatcactcgcctgggtgagatccagtataagatggacgaagacggctttctgcggcagagggggaacgacattttcgagtacaattccaacgggctgctgcagaaggcttataacaaagccagcgggtggacagtgcagtattattacgatggtctcggaaggcgcgtggcctccaaaagtagcttgggccagcaccttcagtttttctatgcggacctgacaaatcccatccgcgtgactcatctttacaatcacacaagcagcgaaattactagcctgtattacgatctccagggccatctcattgccatggagctgagctctggtgaggagtactacgtggcctgtgacaatacaggaaccccccttgctgtcttctcttctagggggcaggtcattaaggagatcctgtacacaccctatggtgatatctaccacgatacctacccagattttcaggtgattattgggtttcacggtggcctgtatgacttccttaccaagttagtgcacctcggacagcgagattatgacgtcgtcgccgggagatggacaactcctaaccatcacatatggaagcagttgaacctgttaccaaagcccttcaacctgtattcatttgagaataactaccctgtgggtaagatacaggatgtcgccaaatacaccaccgacatccgttcatggctcgagctctttggattccagctgcacaacgtgttgcccggattccccaaaccagagctggagaacctggagctgacctacgaactgctcaggctacagaccaaaactcaggagtgggatcccggcaaaactatacttgggattcagtgcgagcttcagaaacagctcagaaactttattagtctcgatcagctgccgatgaccccccgttacaatgacggcagatgcttggaagggggcaaacagcctaggttcgctgcggtgccatctgtcttcggaaaaggaattaagttcgccataaaagatggcatagtgacagcagacattattggtgtggccaatgaggattctagacgactcgctgccatccttaataacgctcattacctcgagaatttgcactttacgattgaagggagagacacccattatttcatcaagctgggcagcttggaggaggatctagtcttaattggaaatacgggggggaggcggatcttagaaaatggcgtgaatgttacagtctcacagatgacctctgttcttaatggtcgcaccaggagattcgccgacatccagctgcagcacggcgcactttgctttaacataagatatggaacaactgtggaggaagagaagaatcacgtactggaaatcgcacgtcaacgggccgtggctcaagcatggacgaaggagcagagaagattgcaggagggggaggaaggcattcgggcctggacagaaggagagaagcagcagctgctgtctaccggccgggtccagggatatgatggctacttcgtcctgtcagtggaacagtacctggaactgagcgactcggcgaacaacatacattttatgagacagtccgaaatcggaaggcgatag

SEQ ID NO: 9103 - DNA, 204 bp, Artificial Sequence
  Description of Artificial Sequence: Synthetic coding sequence
atgaagatccagctgttcttcttcatcctgcacttctgggtgaccatcctccccgccaaaaaaaagtacccggaatacggttcactagatctgcggcgagagtgccgcatcggcaatggccagtgcaagaatcagtgccacgaaaacgaaatccggatcgcatattgtatccgaccggggacgcattgttgcttacagcagtag

SEQ ID NO: 9104 - DNA, 831 bp, Artificial Sequence
  Description of Artificial Sequence: Synthetic coding sequence
atgaagcagatcctgcaccccgccctggagaccaccgcctgcaccaatcactttaacgcggatccatgctccaccgggttcgtgttcccggctatgaccctgttccccgtactactctttctggttgctggcctgctgccctcctttccggccaatgaagacaaggatcccgccttcaccgcactgttgaccacacagactcaggtgcagagggagattgtaaacaaacataacgaactccgtcgcgccgtgagcccccccgctcgaaatatgctgaaaatggagtggaacaaggaggccgccgccaatgcccagaaatgggccaaccagtgtaactacagacactccaatccgaaggaccggatgactagccttaagtgcggcgagaacttatatatgtcatcagccagctcatcctggagccaagctatacagagttggtttgacgaatataatgattttgatttcggcgttggccctaaaaccccgaatgcagtggtcggacattatacccaggttgtgtggtactcctcatacttggtgggctgcggaaacgcgtactgccctaaccagaaagtgctcaagtattattatgtgtgccagtactgtccagccggaaactgggccaatcgactttacgttccttatgagcagggagccccttgtgctagctgtcccgacaactgtgacgacggattgtgcacgaatggatgtaagtacgaggacctgtatagcaattgcaaatccctcaaattaactctcacctgcaagcatcagctggtgagagatagctgtaaagcatcctgcaactgctccaatagtatctactag

SEQ ID NO: 9105 - DNA, 1350 bp, Artificial Sequence
  Description of Artificial Sequence: Synthetic coding sequence
atgctggccgagtggggcgcctgcctgctgctggccgtggccctgttgggaccaggtctgcaggctcaagccatggagggcgtaaaatgtggaggagtgctctcagcaccaagcggaaatttttcatccccaaacttccccagactgtatccatataacaccgagtgttcctggctcatcgtcgtggctgaaggatcttcagtcctccttacctttcatgcctttgatttggagtaccatgatacatgctctttcgacttcttagagatctacaacggagctagcccagacaaagggaatttgttgggacggttttgtgggaaggtgccccccccaccatttaccagttcttggcacgtgatgtccgtgattttccattctgataagcacgtggctagtcacggcttctccgccggataccagaaggacgtttgcggtggtgtgctgaccggactgtctggggttctgacctcgcctgagtatcctaataattacccaaactccatggaatgccattgggtgattagggccgctggccccgcccacgtcaagcttgtgttcgttgacttccaggtggagggcaatgaggagtgcacatatgactacgtcgcagtattgggcggccccggacccactcgcgggcatcactactgcggttccacccgcccgcctactctcgtgtctctgggccacgaattgcaggtcgtgttcaaatctgatttcaacatcggcggcagggggtttaaggcctactatttttcaggggaatgccaggaggtttacatggcgatgagaggtaacttctcttcccctcagtatcccagctcttaccccaataatatccgatgccattggacaatccggctgcccccgggctaccaggtcaaggttttctttctggacctagacctggaggagcctaactctctcactaaaacgtgcgacttcgaccacctcgcagcatttgatggcgcttccgaggaggctccactgctggggaattggtgtggacatcatctccccccacctgtcacctcaagccacaatcagctgctccttctgctgcacaccgaccgctctaccactcgacggggatttagcgtagcgtacattggcggccagctcggatgtggttcaggctccaccgaaggcgagggggaagctctgcagccccagtccttacagagcccgtcctcaatcccacctgtgtgccctgcccctcccatgaacgggctcttacagctgctccttcactggttacacccttgccctctcagcggcccactgaggctggacggaacagctcctgcttgtttccactattgccgcgcttctttcccctccttctag

SEQ ID NO: 9106 - DNA, 1434 bp, Artificial Sequence
  Description of Artificial Sequence: Synthetic coding sequence
atgaccagcaagttcctgctggtgagcttcatcctggccgccctgagcctctccactacgttctcattacagcctgatcagcagaaagtactactcgtcagtttcgatggtttcagatgggactatttgtacaaagtgccaaccccgcacttccactacattatgaagtatggcgtgcatgtgaagcaggtgacaaatgtgttcattaccaaaacatatccaaatcattacacactggtgactggcctctttgcagaaaaccatggtattgtggctaatgacatgttcgatcccatacgcaacaaatccttttccctggaccacatgaacatttatgattcaaaattctgggaggaagccacgcccatctggattacgaaccagagggctggacatacaagcggcgccgcaatgtggccaggtacagatgtcaagatccataagcgctttcccacccactatatgccttataatgaatccgtgagctttgaagaccgagtagccaaaattatagagtggtttacatctaaagaaccgattaatcttggattactgtattgggaagaccccgatgatatgggacatcacctcgggcctgattcaccactgatgggacctgtgatcagtgatatcgataagaaattagggtaccttattcagatgctcaaaaaagcgaagttatggaatacactgaacctgattattacgtcagaccacggaatgacacagtgctctgaggagcgactcattgagctagatcagtatctggataaagatcactacactctgatcgaccagtctccagtggccgctattctcccaaaggagggtaaattcgatgaagtgtacgaagcgttgacacatgcacacccgaacctgacggtttataaaaaagaagacgtacctgagcggtggcattataagtacaattcacgcatccagccgatcattgccgtggcagacgaggggtggcacatcttgcagaacaagtcggacgacttcctgctgggtaaccacgggtacgacaatgcgctcgccgacatgcaccccattttcctggcacacggtcctgcattccggaagaatttttctaaggaggccatgaatagtaccgatctgtacccccttctttgtcatttgctgaatatcacagccatgcctcataacggatccttttggaacgttcaggatctgttgaattctgccatgcccagggtggtgccatacacacagtccactatcctcctgcccgggtccgttaaacctgccgagtatgaccaggaaggatcctatccatactttatcggagtgagcctgggtagtatcatagtaatcgtcttcttcgtaattttcataaagcatctcatccactcccaaattccggcattacaagatatgcacgctgaaattgcacagccactccttcaggcgtag

SEQ ID NO: 9107 - DNA, 1479 bp, Artificial Sequence
  Description of Artificial Sequence: Synthetic coding sequence
atgggcagcgccccctgggcccccgtgctgctgctggccctgggcctgcgggggttacaggctggagctcggcgggcacctgatcccggattccaggagcgatttttccagcaacgacttgaccatttcaactttgagaggtttgggaataaaactttccctcaaaggttcctggtcagcgatcgattttgggttagaggagaaggccctattttcttttatacaggaaatgagggcgatgtgtgggccttcgcaaataacagtgccttcgtggccgaattggcggctgagcgcggtgccctgctggtcttcgcagagcaccgctattacggaaagtccctgccatttggtgctcagagcacccagagaggccatactgagctgctcacagtggagcaggcgttagcagactttgccgaacttctccgagcgctgcgcagggaccttggcgcccaggatgcccccgcaatcgcgtttggcgggagctatggcgggatgctctccgcctatttgcgtatgaaatacccgcaccttgtggcaggcgccctagccgcctccgcacccgtgctcgccgtggccgggctaggcgatagtaatcagttttttcgagatgttaccgctgacttcgagggtcagtcccctaaatgtacacaaggtgtgagggaggctttcagacagattaaggatctgttcctgcagggcgcatacgataccgtgcgctgggagttcggtacttgccaaccccttagtgatgagaaggatctgactcagctgtttatgtttgcaaggaacgcctttaccgtgctggcaatgatggactatccttatccgacggatttcctgggacctctcccagcaaatcctgttaaagtaggctgcgatagactgctgagcgaggctcagcgcataaccggcctgcgtgccctcgctggcctggtctataacgcctccggttccgaacactgctatgacatctatcggctataccattcctgtgccgacccaacaggctgcgggactggccccgatgctcgagcttgggattatcaggcctgcaccgagatcaatctgacttttgcttcaaacaacgtgacagacatgtttccagatctgccctttaccgacgagctcagacagcgttattgtcttgatacctggggcgtttggccacgtcccgattggctgctaacatcattctggggcggcgatttgcgggcagcctcgaacattattttctccaacggtaacctggacccttgggctggcggtggcatcagacggaatctgtctgcaagcgtgattgctgttacaatacaggggggcgcacaccacttagatctgagggcatcccacccagaggatccagcaagtgtggtagaggctcggaagctggaggcgactatcataggggagtgggtgaaggccgctcgcagggagcaacagcccgccttgaggggaggtcctaggctgtcattgtag

SEQ ID NO: 9108 - DNA, 2850 bp, Artificial Sequence
  Description of Artificial Sequence: Synthetic coding sequence
atgatcctgagcctgctgttcagcctgggcggccccctgggctggggccttctgggagcatgggcacaggcatcatccacatcactttccgacctccaaagctccaggaccccaggtgtgtggaaggctgaagcagaagatacaggaaaagaccctgtgggccgcaactggtgtccctacccgatgtccaagttggtgaccctgcttgcactgtgtaaaaccgaaaagtttcttatacactctcagcagccttgtccgcagggggctcctgattgccaaaaggtgaaggttatgtaccggatggcccataagcccgtttatcaggtgaagcagaaggtactgacgtcactcgcctggcgatgctgccctggatataccggccccaactgtgagcaccatgactccatggcgatccctgaacccgctgatcccggtgattctcatcaggagccccaagacggtcccgtctctttcaagcctgggcatctggcagccgtgatcaatgaggtggaggttcagcaggagcagcaggagcacctgctgggcgatctccagaatgatgtccatagagtggccgacagcctgcctgggctttggaaagcgttacctgggaacctgactgcagcagtaatggaggcaaatcagactggccacgagtttcccgacagatccttggagcaagtgctgctgccacatgttgatacatttctgcaagttcactttagcccgatttggcgttctttcaatcaatctcttcatagcctcacccaggccatccgcaacctatcccttgatgtagaagccaacagacaggccatatctcgcgtgcaggactccgccgtggccagagcagattttcaggaattgggagctaaattcgaggctaaggtgcaggaaaacacgcagagggtggggcagctcaggcaggacgtggaggaccggctgcacgctcagcattttacactgcataggtccatctcagagttacaagctgacgttgataccaaattaaagcggctgcacaaagcacaggaagcccccggcaccaacggcagccttgtcttggcgactcccggagccggagcccgccccgaacctgactccctccaggctagacttgggcaattgcagagaaacttaagtgagttacacatgacaactgctcggcgcgaagaagaactgcagtataccctggaggatatgagggctacgctaactcgccacgtggacgaaatcaaagaactgtactcggagtccgatgaaacattcgaccagatatctaaagtggaacgccaggtagaagagttgcaagtgaaccacactgccttgagagaactgagggtgatcctgatggagaagtccctgataatggaggaaaataaagaggaagtggagaggcagctgctcgagctcaatctgaccctacagcatctccaaggcgggcacgccgatctaatcaagtacgtaaaagactgcaattgccagaagctgtatttagacttggatgttatcagggagggtcagcgcgatgctacgcgggcactggaagaaacccaggtgtctttggacgagcggaggcagctggacgggagttctcttcaagcactgcagaacgcggtcgatgccgtgagtctagctgtggatgctcacaaggcggaaggcgagcgcgcaagggctgccaccagtcgtttaagaagtcaggtgcaagcactagacgacgaagtcggggcgctgaaagcggcggccgccgaagctaggcacgaggtgagacagctacatagtgcttttgctgccttgttggaagatgctctcaggcacgaggccgtcctggccgctttattcggcgaagaagtgcttgaggaaatgtccgagcagacccctggccctctgcccctgagttacgagcagatccgggtcgccctgcaggacgcagcatcaggcttgcaggaacaggcactcgggtgggacgagctggcggccagggtcacagctctcgagcaagcaagtgagccccccagaccagctgagcacttggagcctagccacgacgctggccgcgaagaggcggccaccaccgccctggccggactggcccgggagcttcagtcactgtctaatgacgttaagaatgtgggcagatgttgtgaggcagaggctggagcaggggccgcgtctttgaacgccagtctccacggcctgcacaacgcactttttgctacacagcggtcccttgagcagcatcagcggttatttcacagtctcttcgggaatttccaaggcttgatggaagccaacgtgtccctggacttgggtaagctgcagacgatgctgtcccgcaaggggaagaaacagcagaaggacttggaagcccctaggaagcgcgacaagaaagaagccgaacccctcgtggacattcgggtcactggacccgtccctggagctcttggagcagcactctgggaagccggctcccctgtagctttttacgctagtttctctgagggaaccgccgcactgcaaaccgtcaaatttaatacgacctatatcaatattggatctagctacttccccgagcacggctatttcagggcccccgaacgtggagtgtatttatttgccgtttcagttgaattcggcccaggaccgggcaccggccagctcgtcttcggtgggcaccaccggactcccgtttgcaccaccggccagggctctggttccaccgcaacagtatttgctatggctgaactgcagaagggcgagagggtctggtttgagctgactcagggatccattaccaagcgctcgctgagtgggactgctttcgggggctttctgatgtttaagacatag

SEQ ID NO: 9109 - DNA, 246 bp, Artificial Sequence
  Description of Artificial Sequence: Synthetic coding sequence
atgcggctgctggtgctgagcagcctgctgtgcatcctgctgctgtgtttctcgatctttagcacggagggaaaacgtagacctgcgaaggcctggagcggaaggcgaactcgactctgctgccacagggtcccatcgccgaattcaaccaacctaaagggacaccatgttagactgtgtaagccctgcaaattggagcccgagcctcggctatgggtagtccccggtgctctgccacaggtctag

SEQ ID NO: 9110 - DNA, 690 bp, Artificial Sequence
  Description of Artificial Sequence: Synthetic coding sequence
atgagcttcctgcaggaccccagcttcttcaccatgggcatgtggtcaataggcgcaggtgctttaggggccgctgccttggccctgctcctggcgaataccgacgtcttcctgtcaaaaccccagaaggcagctctcgagtatctggaagatattgatctcaagactcttgagaaggaaccaagaactttcaaagctaaagagctgtgggagaaaaatggcgccgtgatcatggctgtaagaaggccagggtgttttctgtgccgggaagaggccgcagatttgtcctctcttaaatccatgctcgatcaactcggggtgccattgtacgccgtcgttaaggagcatatccgaactgaggtaaaggacttccagccttatttcaagggcgagatcttccttgacgagaaaaagaaattctacgggcctcagcggaggaaaatgatgttcatgggcttcatacggctcggcgtgtggtacaacttttttagagcctggaacgggggattttctggcaatcttgaaggcgaagggtttattctcggaggcgtgtttgttgtgggttcgggtaagcagggaattctgctagaacacagggaaaaggagttcggggataaagtgaacctgctgagcgtgctggaggccgccaagatgattaaaccacagactctcgcatcggagaagaaatag

SEQ ID NO: 9111 - DNA, 657 bp, Artificial Sequence
  Description of Artificial Sequence: Synthetic coding sequence
atgggcatgtggagcatcggcgccggcgccctgggcgccgccgccctcgcgctgctgctggctaacaccgacgtattcctaagcaagccacagaaggcggccctggaatatctcgaggatatagacctgaagacactggaaaaggaacctagaaccttcaaagccaaggagctgtgggagaagaatggggccgtgatcatggcggtgagacgacccggttgcttcctttgtagggaagaggcggctgatttgtcctctctcaagagtatgctcgaccagctgggggttcccttatacgcagtggtaaaggaacacatacggacagaggtcaaggactttcagccctattttaagggggagatctttctggatgaaaaaaagaagttctacggtcctcagaggcgcaaaatgatgttcatggggtttattaggttgggcgtctggtacaatttctttcgcgcctggaacgggggattttctggtaacctggagggcgagggctttattctgggtggggtcttcgttgttggcagcgggaagcagggaatactattggaacacagggagaaggaatttggcgacaaagtgaacctcctttcggtcctggaggcagcaaaaatgattaaaccccagacccttgcatccgagaaaaagtag

SEQ ID NO: 9112 - DNA, 690 bp, Artificial Sequence
  Description of Artificial Sequence: Synthetic coding sequence
atgagcttcctgcaggaccccagcttcttcaccatgggcatgtggtccatcggtgccggggctctcggggccgccgcattggctctgctattggctaatacggacgtcttcttaagtaagccccaaaaggcagcactggaatacttggaggatatcgatcttaaaaccctggaaaaagaacccaggacctttaaagcaaaagaattatgggagaagaacggagcggtgataatggccgtgaggcgccccggctgcttcttatgtagagaggaggcagcggatctatccagtctcaagagtatgctcgaccagctgggcgtcccgttatatgcagtggtgaaggagcatatcaggaccgaagtgaaggacttccagccgtattttaagggggaaatctttctcgatgagaaaaagaaattttacggaccacagcggagaaaaatgatgtttatgggctttattcgcctgggtgtatggtataatttctttcgggcctggaatggaggattctctggcaatcttgaaggggaggggtttattctcgggggggtctttgtagtgggtagtgggaaacagggtatcctcctagaacacagggagaaagaattcggcgacaaagttaatctcctgtcagtgttggaagctgccaagatgattaaaccacagacccttgcttccgaaaaaaagtag

SEQ ID NO: 9113 - DNA, 690 bp, Artificial Sequence
  Description of Artificial Sequence: Synthetic coding sequence
atgagcttcctgcaggaccccagcttcttcaccatgggcatgtggtctatcggggccggcgccctcggcgcggccgctttagctcttctgctagccaatactgatgtgttcctgtcaaaaccccaaaaagccgctttagaatacctggaggacattgacctgaagacactggagaaggaaccaaggacgtttaaggcgaaagagctttgggagaagaatggggctgtcatcatggcagtcaggagaccgggttgctttctctgtcgggaagaagccgcagatttgtcttctctcaagagtatgctcgaccaattgggtgtgcccctatatgcggtggtaaaggagcacattcgaacagaggtgaaagacttccaaccatattttaagggagaaatcttcctcgatgagaagaagaagttttacggtccccagaggcgtaaaatgatgttcatggggttcatccgcctcggggtctggtacaatttctttagagcatggaacggggggttctctggcaacttagaaggcgaaggcttcatactaggtggggtgttcgtggtgggttccggtaaacaagggatcctcctggaacaccgcgaaaaagagttcggggacaaagttaacctcttgtccgtgttggaagccgccaaaatgattaaacctcagactctagcctcagagaagaagtag

SEQ ID NO: 9114 - DNA, 1248 bp, Artificial Sequence
  Description of Artificial Sequence: Synthetic coding sequence
atgagccccttcctgtacctggtgctgctggtgctgggcctgcacgcaaccattcactgcgcaagtccagagggaaaagtgactgcttgccattctagccagcccaatgctacactgtacaaaatgagctccattaatgccgacttcgcgtttaacttatacagaaggtttacggtcgagacgccagataagaacatcttttttagccctgtgagcatatcagccgctttggtgatgttgtcatttggggcctgctgtagcacccaaacagagatagtggagacactgggattcaatctgactgatactccaatggttgaaatccagcacggctttcagcacctgatatgctctttaaactttcctaagaaggaactggagctgcagatcggcaatgcactgttcattggcaaacatctcaagccattggccaaatttttaaacgacgtcaagacactgtacgagactgaggtgttctccacagactttagcaacatctctgccgccaaacaggaaataaattcgcacgtcgagatgcaaactaaaggcaaggtagtcggcttgattcaggatctcaaacctaatactatcatggtcctggttaactatatacacttcaaagcccagtgggctaaccctttcgacccatccaaaaccgaagacagtagttcatttctgattgataagacaaccaccgttcaggtgcccatgatgcatcagatggagcaatattaccacttggtcgatatggaattaaactgtaccgtgctgcagatggactatagtaaaaatgctttagcgttgtttgtgctcccaaaggaggggcagatggagagcgtagaagccgccatgagtagtaagaccctcaagaagtggaaccgtctgttacaaaagggctgggtggatctattcgtcccaaagttctcaatcagcgccacatatgacctgggggccactctcctgaagatgggcattcaacacgcctatagcgagaatgctgatttttcgggactgactgaggacaatggcctgaaactttctaatgcggctcataaggctgtactgcacataggcgagaaagggactgaagccgccgccgtcccagaggtggaactctctgatcaacccgaaaacacctttctgcacccaattattcagatcgatcggtcctttatgctgttgattctggagcgttctaccagaagtatcctctttttgggtaaagtcgtaaacccaaccgaggcctag

SEQ ID NO: 9115 - DNA, 240 bp, Artificial Sequence
  Description of Artificial Sequence: Synthetic coding sequence
atggccccccagaccctgctgcccgtgctggtgctgtgcgtgctgctcttgcaagctcagggcggttacagggacaagaagcggatgcaaaaaacacagttgtcccctgagatcaaggtgtgccagcagcagcctaagttgtatctttgtaagcacctctgcgagtctcatcgggattgtcaggccaataacatatgctgctctacttattgtggtaacgtgtgcatgagtatcttatag

SEQ ID NO: 9116 - DNA, 486 bp, Artificial Sequence
  Description of Artificial Sequence: Synthetic coding sequence
atgggcctgagcggcctgctgcccatcctggtgcccttcatcctgctaggggacattcaggagccagggcacgccgagggcatcctgggcaaaccttgcccgaagattaaggtggagtgcgaagtggaggaaatcgaccagtgcaccaagccccgtgattgtccggagaatatgaaatgctgtccctttagtcgcgggaagaagtgcttagacttcagaaagatctatgcagtctgccaccgtcgacttgccccagcctggcctccttatcatacaggcggcaccataaagaaaacaaagatatgttcagaattcatttatggtggctcccaagggaacaacaacaacttccagacagaagccatctgccttgtgacatgcaaaaagtatcacaagtcagccctgttatacacaatccggagatctctgaacaatctgcaagatttggcccataatccaggactgtcccccagagttcccgactag

SEQ ID NO: 9117 - DNA, 261 bp, Artificial Sequence
  Description of Artificial Sequence: Synthetic coding sequence
atgggcctgagcggcctgctgcccatcctggtgcccttcatcctgcttggcgatatccaggaacccgggcatgcagagggaattcttgggaaaccctgccctaagatcaaagtggaatgtgaagtggaggagatagatcagtgtacaaagccccgggattgtcccgaaaacatgaaatgctgccctttcagtcgaggtaaaaaatgtctcgacttcagaaaagtctctctgacgctataccataaggaagagcttgaatag

SEQ ID NO: 9118 - DNA, 375 bp, Artificial Sequence
  Description of Artificial Sequence: Synthetic coding sequence
atgcccgcctgccggctgggccccctggccgccgccctgctgctgagcctgctgctttttggctttaccctggtttcgggcaccggtgcggaaaagacaggtgtttgcccggaactgcaggccgatcaaaattgcactcaagaatgcgtgtcggactcagagtgtgccgacaatctcaaatgttgctcagcaggctgcgctactttctgttctctgcctaatgacaaggaagggtcttgtcctcaggtcaacatcaacttcccacaactcgggttgtgtcgtgaccaatgccaagtcgactcccaatgcccaggccagatgaagtgctgcaggaatggatgcggcaaggtctcttgtgttacacctaacttttag

SEQ ID NO: 9119 - DNA, 1428 bp, Artificial Sequence
  Description of Artificial Sequence: Synthetic coding sequence
atggccgacatgcagaacctggtggagcggctggagcgggccgtgggacgcctcgaagcggtgagccacaccagtgatatgcacagaggctacgccgattcaccatctaaggctggggcagcgccgtatgtgcaggctttcgattcactgctggctggccctgtcgcagagtatctgaaaatatcaaaagaaatcggaggcgacgtgcagaaacacgctgagatggtgcacacaggactgaagctcgagcgcgctttgctggtcactgctagtcagtgtcagcagcctgcagagaacaaactgtccgacctattggccccaatcagcgagcagataaaggaggtgatcacattccgcgaaaagaaccggggctcaaaattgtttaaccatctgagcgccgtgtctgaaagtatccaggccctgggttgggtcgctatggcaccaaaacccggcccatatgtaaaggaaatgaatgatgctgccatgttttacacaaatcgggtgctaaaggagtataaggatgtggataaaaagcacgtggattgggttaaagcttacttgtccatttggactgagctgcaggcatacatcaaagaatttcataccaccggcctggcctggagcaagacgggacctgtcgcaaaggaactctcgggcctaccatcgggaccatcagccggatcgtgccctcccccgccacccccatgtccacctcctcctcccgtctccacaatcagttgtagttacgagtccgccagcaggtccagcctgttcgcacagatcaatcaaggggaatcaattacccacgcacttaaacatgtctctgacgacatgaaaacccataagaacccggctctgaaagcacagtcagggcccgtacggtctggccctaaaccattttccgcaccaaaaccacagacaagccccagtcccaaacgcgcaacaaagaaagaacccgccgtgttggagctggaggggaagaagtggagggtcgaaaatcaggagaatgtgtccaatctggtcattgaggacacagaactgaaacaagtggcgtacatttacaaatgcgtgaacaccaccttgcagataaaaggaaaaataaactcaataaccgtagacaactgcaagaaactcggcttggtgtttgatgatgttgtgggtattgtggaaatcatcaactcaaaggatgttaaagtgcaagtgatgggcaaagtcccaacaatcagcatcaacaagaccgatggctgccatgcatatctgtcgaagaattctctggactgcgagatcgtgtctgcaaaaagctcggaaatgaacgtcctgatcccaaccgaggggggcgattttaacgagtttcctgtgccagagcagttcaaaacattgtggaacggacagaagctggttaccacagtgaccgagatcgccggctag

SEQ ID NO: 9120 - DNA, 438 bp, Artificial Sequence
  Description of Artificial Sequence: Synthetic coding sequence
atggccgacatgcagaacctggtggagcggctggagcgggccgtgggcagactcgaagcggttagtcacaccagcgatatgcaccgtggctacgccgacagcccgtctaaggctggcgccgccccatatgtgcaggcttacattaaagaattccacactaccggtttggcctggagcaaaactggacctgtagctaaggagctctcaggattaccatctggcccatccgcaggctcctgtcctcctcctccgcctccctgtccccctccaccccccgtaagcacaatctcttgcagctatgagtcggcttctaggtcttctctgtttgcacagatcaaccagggagagagcatcacccacgcactcaagcacgtgtctgacgatatgaaaactcacaagaatcccgccctgaaggctcagtccgggccagtgagatag

SEQ ID NO: 9121 - DNA, 1428 bp, Artificial Sequence
  Description of Artificial Sequence: Synthetic coding sequence
atggccgacatgcagaacctggtggagcggctggagcgggccgtggggcggctcgaagccgttagccatacctccgacatgcaccgaggttatgcagatagcccctcaaaggcaggagccgctccctacgtgcaggcttttgacagcctgctggcgggcccagttgcggagtatctcaaaatctctaaagagataggtggcgacgttcaaaagcacgccgagatggtgcacactggtctgaagctcgagcgcgcactattagtaaccgcttctcaatgccagcagcccgcggaaaacaagttgtcagatttgctcgccccaatatctgaacagatcaaagaagtcatcacttttcgggagaagaatagagggagcaagttgtttaatcatctttcagccgtatcagagagcattcaggccctggggtgggtcgccatggcacccaagcctgggccctacgtgaaagaaatgaacgacgcagccatgttttataccaaccgagtcctgaaggagtacaaagacgtcgacaagaagcatgtagattgggtcaaagcctacttaagtatttggaccgaactgcaggcatacataaaagaatttcatactacaggactcgcatggtcaaaaactgggcccgtggctaaagaattgtcaggccttccaagcggcccctccgcaggcagctgcccgccaccaccacctccgtgcccaccacctccgcctgtatctacaatcagctgctcatacgaatctgcttcgcgatcatcgttgttcgcccagattaatcagggtgagagcatcacacacgccctcaagcacgtttcagatgacatgaagactcataagaatcctgctcttaaagcacagtcgggtcccgtgcgctcaggcccaaagccgttctccgcaccaaagccacagacctctcctagccccaagcgcgcaacaaagaaggagccggctgtgcttgaactggaaggaaaaaaatggcgagtggaaaatcaggaaaatgtgagcaatctcgtgatcgaggacacagaactgaaacaggttgcatacatctataagtgcgtgaacacgacactgcagatcaaaggtaagattaatagcatcacagtagataattgcaaaaagcttggattggtgttcgatgatgtcgtaggcatcgttgaaattatcaatagtaaagacgtcaaggtgcaagtcatgggcaaagttcccacaatcagcattaataaaaccgatggctgtcatgcctatctcagtaagaattccctggactgcgagattgtgagtgccaagagtagcgagatgaatgtgctgatccccactgagggcggtgacttcaatgagtttcccgttcccgaacagtttaaaacactgtggaacggccaaaaattggtgaccacagtcacagagatagctggctag

SEQ ID NO: 9122 - DNA, 1425 bp, Artificial Sequence
  Description of Artificial Sequence: Synthetic coding sequence
atggccgacatgcagaacctggtggagcggctggagcgggccgtgggacggcttgaagcggttagccatacaagtgatatgcacaggggatatgccgattcaccatccaagggggccgccccctatgtccaagcattcgattccctccttgcagggcctgtcgcagagtacctcaagatctctaaagagataggcggcgacgtacaaaagcatgccgagatggtccataccggactaaaactggagagggcgttgctggtaaccgctagccagtgccagcaacctgcggaaaacaaactgagtgatttactagccccaatctctgagcagatcaaagaagtcatcaccttccgagaaaagaatcggggctcaaaactctttaatcacttatccgccgtttctgaaagtattcaggccctggggtgggtggctatggcccccaagcctggcccttacgtgaaagaaatgaatgacgcagcaatgttttatacaaatagagtccttaaggagtataaggatgtggataagaaacatgtggactgggttaaggcatacctgtctatctggaccgagcttcaggcttacattaaagagttccacaccactggccttgcatggagcaaaactgggcccgtagctaaggagttgtctgggctgcccagcggtccatccgcaggcagttgcccaccaccgcctcccccatgtccacctccaccacctgtatccaccatctcatgttcttacgaaagtgcttcacggagttctctctttgcccagattaaccagggcgagtctatcacgcacgcactcaagcacgtgtcagacgacatgaaaacccacaagaatccagctctaaaggcccagtcagggcccgtcagatctggacctaagcccttcagcgcccccaaaccacagacatcccctagtccaaaacgagcgacaaaaaaggagccagccgtgctggagctcgaggggaagaaatggcgggtcgaaaatcaggagaatgtgtcaaatcttgttatcgaggacaccgagctcaaacaggtcgcctatatttacaagtgtgtgaacaccactctccaaataaaggggaaaattaattctattactgtggataactgcaagaagctcgggttggtgttcgacgatgtggtcgggattgtcgagattattaacagtaaagacgtgaaagtccaagtcatggggaaggtgcctacaatttcaatcaacaaaacggatggatgtcatgcctatctcagtaagaattctctggactgcgagatagtttcggcgaaatccagcgaaatgaatgttctaatcccaacagaaggaggggactttaatgagtttccagtgccagaacagtttaagacgctttggaacggccagaagctggtgactacagttacggagatagccggctag

SEQ ID NO: 9123 - DNA, 1425 bp, Artificial Sequence
  Description of Artificial Sequence: Synthetic coding sequence
atggccgacatgcagaacctggtggagcggctggagcgggccgtggggaggttggaggcggtgtcccacacaagtgacatgcacagaggttacgccgacagtccatctaaaggcgccgccccctacgtgcaagcattcgactctctgctggccggaccagtggccgagtacctgaaaatttccaaggagatcgggggtgatgtgcaaaagcacgcagagatggttcataccggtcttaagctagaacgggcattactcgttaccgcatctcagtgtcagcagccggccgagaataaactgtcagatctcttagcccccatcagtgagcagataaaggaggtgatcacattcagagaaaagaatagaggatctaaattgtttaatcatctgtcagccgtgagcgaaagcatacaggcactgggttgggtcgctatggcccccaagcctggcccttacgtaaaggaaatgaatgatgccgccatgttttataccaacagggtcctgaaagagtacaaagatgttgataaaaagcatgtggactgggtgaaggcatatttgagcatctggaccgagctccaggcgtacatcaaagagttccatactactggcctggcatggtcaaaaaccggaccagtggcaaaggaattaagcggcctgccatcagggcccagtgctggatcatgtccaccaccaccgccgccatgcccaccacctccaccagtgtccaccatctcttgtagctatgaaagcgccagccggtcgtctctgtttgcccagattaatcagggcgagagcattacacatgccctgaaacacgtctccgacgacatgaagacccacaaaaacccagctctgaaagcccagagtggtcccgtgcgctctggccctaagccattttcagcacctaagcctcagacatctccgtcccctaaacgggctaccaagaaggaacccgccgtcctggaactagagggaaagaaatggcgcgtggagaatcaggagaatgtgtcaaacctggtcatcgaagacaccgagctgaagcaggtggcctacatttataaatgtgtgaatacgaccttgcaaataaaggggaaaatcaactcaattacagtggacaactgcaagaaattgggactggtatttgacgatgtggtcgggattgtggaaattataaatagcaaggacgtaaaggtgcaagtcatgggcaaagttcccacaattagcatcaacaagacagacggatgccacgcatatctgtcgaagaattctttagactgcgagatcgtttccgccaagagtagtgaaatgaatgtgcttatccctaccgagggaggcgatttcaatgaattcccagtgcccgagcagtttaagacgctttggaatgggcagaagcttgttaccacggtaacagaaatagctggatag

SEQ ID NO: 9124 - DNA, 1428 bp, Artificial Sequence
  Description of Artificial Sequence: Synthetic coding sequence
atggccgacatgcagaacctggtggagcggctggagcgggccgtgggtaggctggaagctgtcagtcacaccagtgatatgcataggggttacgcggactcaccttcaaaggcgggggccgccccctatgttcaggccttcgattccctcctggccggccctgtggctgagtatttgaaaattagcaaggagatcgggggcgacgtccaaaaacacgccgagatggtacacacaggtttaaagctggaaagggcattgctcgtgactgcctcccagtgccaacagcccgcagagaacaagctgagtgatctgctggcacctatctctgagcagatcaaagaggttatcacttttcgggaaaagaacagggggagcaagctcttcaaccacctgtcagctgtgtcagaatccatccaagcattgggctgggttgcaatggcacccaaaccagggccatatgtgaaggaaatgaatgacgccgcgatgttttacaccaatcgggttttaaaggagtataaggacgtggacaagaagcacgtcgattgggtgaaagcctatctgtccatatggaccgagctgcaagcctacattaaagagtttcacacgacggggctggcatggtccaagaccggacccgtcgcgaaggaattgtccggcttaccctctggaccaagtgcggggtcctgtcctccccctccgcccccatgtccccctcctcctcccgtctccacaatcagctgttcctacgagtccgcatcacgctctagcttgtttgcccagatcaatcagggggaatccataacgcacgccttgaagcatgtgagcgacgatatgaagacgcacaaaaaccccgctttgaaagcccagagcggccctgtgcgctcaggaccaaaaccattttccgcccccaagccccagacatcaccaagtccaaagagggccaccaagaaggaacctgccgtcctcgaactggaggggaagaagtggcgggttgaaaatcaggagaacgtgagtaacctggtaatagaggatacggagctcaagcaggtggcttacatttataaatgtgtgaacaccaccttacaaataaagggcaagattaattctatcaccgtcgataactgcaagaaattgggcctggtcttcgatgatgtggtgggcatcgtggagataatcaacagtaaggacgtaaaggttcaagtgatgggcaaggtgccgaccatctccatcaacaaaaccgatggctgccacgcctacctcagtaaaaactcgctggattgcgaaatcgtgtccgcaaaatcttccgaaatgaacgtccttattcccaccgagggtggagatttcaacgagttcccagttcccgagcaattcaagactctgtggaacggtcagaagcttgttacaaccgttacagaaatagcgggttag

SEQ ID NO: 9125 - DNA, 1209 bp, Artificial Sequence
  Description of Artificial Sequence: Synthetic coding sequence
atgaccgccctgcccggccccctgtggctgctgggcctggccctgtgcgccctcgggggaggcggacctggtttgcggcccccaccaggctgtccccagcgcagacttggagcccgtgagcgtcgcgatgtgcagagagagatcctcgcagtgctgggcttgcctggtcgcccccggcctcgtgctccccccgccgcgagtaggctgcctgcatctgccccactgttcatgctggacctttatcacgccatggccggggatgacgacgaagacggagcgcccgctgaaaggcggttaggacgcgcagacctggttatgtcatttgtcaacatggtggaacgagatagggccctcggccaccaggaaccacactggaaggaattccgcttcgacctgacacagatccctgctggcgaggctgttacggccgctgaattccgaatctacaaagtcccatctatccacctgctgaaccgaaccctacatgtgtcaatgttccaggttgttcaagaacagagtaatagggagagcgatctttttttcctggatctgcaaaccctccgcgcgggggacgaagggtggcttgtgctggatgtcacagccgcgagcgactgctggttgcttaagcggcataaggacctggggctgagactgtacgtcgagacagaggacgggcacagcgtggatcccggtctggccggcttgctgggccagagggcccctcgaagtcaacagccatttgtggtgactttcttcagggctagccctagcccaattcgtacaccacgcgcagtgcgccctttgcggcgacgtcagcccaagaaaagcaacgagctgccccaggcaaatagactcccaggaatctttgacgacgttcacggctcccacgggaggcaggtatgtaggagacatgagctgtatgtgtctttccaagacctgggttggctggattgggtcatagctccacagggatactccgcgtactactgcgagggagaatgttccttccctctggactcctgcatgaatgccaccaatcacgctattcttcagtcccttgtccatctgatgatgccggacgcagtgcctaaggcgtgctgtgccccaaccaagctttctgccacaagtgtgctctattacgattccagcaacaatgtcattctgcggaagcacaggaacatggtggtcaaggcgtgcggatgccactag

SEQ ID NO: 9126 - DNA, 804 bp, Artificial Sequence
  Description of Artificial Sequence: Synthetic coding sequence
atggccgccatccggatgggcaagctgaccaccatgcccgccggcttaatctacgcctcagtgtctgtacatgccgcaaaacaggaagagtccaagaagcagttagtgaagccggaacagctaccgatttacaccgcccctccccttcagtcaaagtacgtggaggagcaacctgggcacctgcagatgggcttcgcttccatccggactgcaacgggctgttacattggctggtgtaagggggtttatgtctttgtaaaaaacgggatcatggacacagtccagtttggaaaggacgcctatgtgtatctgaaaaatccgccccgggactttcttccgaaaatgggcgtaataacggtctcggggctggctggattggttagtgcccgcaagggctccaagttcaaaaagatcacttacccgctcgggcttgccaccctcggggccacagtatgctatccagtgcaatcagttatcattgcaaaagtgacggctaaaaggtacatgctgcaggcgtctaaattccttgagcagctcaaccactgtgggcagaaggcagctaaaaagtcgcacagccttaacttaaagaagacaaaattaggatcaagctcagagatcgaggtacctgccaagactacccacgtcttgaagcactccgtgccgttgccaacagaactctcctctgaggccaaaacaaaatccgagtcaacctccggagctacccagttcatgcccgacccaaagctgatggatcatggtcagagtcacccagaggatatcgatatgtattccacccgctcttag

SEQ ID NO: 9127 - DNA, 807 bp, Artificial Sequence
  Description of Artificial Sequence: Synthetic coding sequence
atggccgccatccggatgggcaagctgaccaccatgcccgccggcctcatttacgccagtgtgtcagttcacgctgctaagcaggaagagtcaaagaagcagcttgtaaagccggagcagctccctatctatactgccccacccctgcagtccaaatacgttgaggagcagcccggccacctccagatggggttcgcctccattcggaccgccactggctgctacatagggtggtgcaagggagtttatgtgtttgtcaaaaatggaatcatggacacagtccaatttgggaaggacgcctatgtctaccttaaaaaccctcccagggactttttgcctaagatgggagtgattaccgtgagcggactggctgggctggtaagcgcacggaaaggatcaaaattcaaaaaaattacatatccactgggcctggccaccctgggagccacagtgtgttacccagtgcagtcagtgataattgctaaggtcaccgccaagaaggtgtatgcaacgagccagcaaatattcggcgctgtcaaatcactttggactaagagttctaaggaggagtcgctgcccaagcccaaagaaaagaccaagctcggctcttcctccgagatcgaagtgcctgctaaaaccacacatgtgctgaaacattctgtccccctcccaactgaactgtccagcgaagcaaaaacaaaatctgagtctacgtctggagccactcagttcatgccggatccgaaattaatggaccacgggcagagccaccccgaggacattgacatgtatagcacgcggtcgtag

SEQ ID NO: 9128 - DNA, 3672 bp, Artificial Sequence
  Description of Artificial Sequence: Synthetic coding sequence
atggcccccctgcgggccctgctgagctacctgctgcccctgcactgcgctctatgcgctgctgcaggcagccggacgccagagctgcacctgagcggtaaactaagcgactacggagtcacagttccttgctcaaccgacttcagagggcgattcctgagtcacgtggtcagcggacccgcggccgcgtccgccgggagcatggtggtcgatacaccgccaacgctgcccaggcactcttcccacctacgggtggcgcggagccccctgcacccaggcgggaccttatggcctggtcgggttgggaggcacagcctttacttcaatgtcacagtgttcggcaaggagctgcacctgagactcagacctaaccggcgccttgttgtgcccggatcctctgtcgagtggcaggaggacttccgagagcttttcagacagcccctgcgtcaggaatgtgtctacaccggtggggtgactggcatgccaggggccgctgtggcaatctctaactgcgatggtcttgcgggtctgattcgaactgactccaccgacttttttatagagccccttgagcgcggtcagcaggaaaaagaggcaagcgggcgtacacacgtcgtgtacagaagggaagccgtgcagcaggaatgggcagagccagacggcgatctgcacaatgaggcatttggtcttggggatctcccaaacctcttgggtctggtcggggatcagctcggagacacagagcgaaaaagacgacacgcgaagcctggcagctattctatcgaagtgctgctggtggtcgacgactctgtggtacggtttcacgggaaggagcacgtgcagaattacgtgctcacactgatgaacatcgtagatgaaatctaccacgacgaatctcttggcgtgcacatcaacatagccctggtgcgcctgatcatggtgggctataggcagtccttgtcactgattgagagaggcaaccctagtaggagccttgaacaggtctgccggtgggcccacagtcagcaacggcaggatccttctcatgccgagcaccacgatcacgtcgtgttcctcacaaggcaagactttgggccgtcagggtatgcccctgtcaccgggatgtgtcaccctcttcgttcctgtgctctgaatcatgaagacgggttctcgtctgcctttgtgatcgcccacgagacgggccatgtgctcggaatggaacacgacggccaaggtaatggctgcgcagatgagactagcttgggttcagtgatggcccctctcgtgcaggccgcctttcatcggtttcactggtcccgctgcagtaaactggaactgtcaagatacctccctagctatgactgtctgctggacgatccattcgacccggcctggcctcagccacccgagcttcctgggataaactatagcatggacgagcagtgccgctttgactttggatccggatatcaaacgtgccttgcctttcgaacctttgaaccctgtaagcagctctggtgctctcacccggacaatccctacttttgcaagactaaaaaaggcccaccattggatggcaccgaatgtgcacctggaaaatggtgtttcaagggccactgtatctggaaatctcccgaacagacgtatggccaggacggtggatggtcctcctggacgaaattcggctcttgttctcgctcctgtggaggtggcgtgaggtcccgctctaggtcttgcaataacccgagcccagcatacggaggcaggctgtgcttaggcccaatgtttgagtatcaagtctgtaattccgaagaatgcccagggacctacgaagacttcagggcacagcagtgcgccaagcgaaactcttactacgtgcaccagaacgccaaacacagctgggtgccgtatgaaccagatgatgacgcccagaagtgtgaactcatttgccagagcgccgatactggtgatgtggtttttatgaaccaggtcgtacatgatggtacccggtgctcctacagagatccttatagtgtctgcgctcgcggggaatgtgtgcctgtgggatgcgacaaagaagtggggtcaatgaaggctgatgacaagtgtggcgtgtgtggaggagataacagccattgcaggaccgtgaagggcactctcggaaaggcatcaaaacaagccggggcattgaaactggtccagatacctgccggggcccgccacatccaaattgaggccctcgagaagagtccccacagaatcgtcgtgaaaaaccaggtgaccgggtcctttatcttgaatcctaagggtaaggaagccacatcgagaacctttaccgctatgggcctggaatgggaagatgctgttgaggatgctaaggagagcctgaagacttctggccctcttcccgaagccattgcgatcctcgcgctaccccccacggagggcgggcccaggagctctttggcctacaaatatgttatccacgaagacctgctccccttgatcggcagtaacaatgtgctcctggaggagatggacacttacgaatgggctctcaagagctgggccccttgctctaaagcttgtgggggaggcatccagtttaccaagtatggatgccggaggcgccgggaccatcacatggtccagcgacatttatgcgaccataaaaaaagacccaagcccattaggcgtcgttgcaatcaacatccgtgttctcagcccgtttgggtgacggaagaatggggcgcttgttcacgcagttgcggcaagctgggtgttcaaactcgtggcattcaatgtctgctgccactgtccaatggcactcataaggtgatgccagccaaggcttgtgctggcgacaggcccgaggcgcggagaccctgtttgagagtcccttgtcccgcgcagtggcgattgggggcctggtcccaatgttccgccacatgcggcgagggtattcagcagcgtcaggtcgtgtgtagaaccaacgccaacagtcttggccactgtgaaggtgatcgacccgatactgtgcaggtatgtagtctcccggcctgcggtggcaatcaccagaactcgacagtaagggcagatgtctgggagctaggcacccccgagggacaatgggttcctcagagcgagccccttcacccgatcaacaagatcagtagcactgaaccctgcacaggggatcgttctgtattctgccagatggaggtcctcgaccgctattgcagtattccgggttatcatcgcctttgctgtgttagttgcatcaagaaggcttccggacctaaccctggccccgaccctgggcctacctccctgcctcccttctcaacccctggttcaccactacccggtcctcaagatccagcagacgccgcggagccacccggcaaaccgaccgggtccgaagaccatcaacacggccgggcaacccagcttcccggcgcattggataccagttcgcctgggacgcaacacccctttgcgccagagacaccaataccaggagcctcgtggtctatctctcccactacgcctgggggcctcccgtggggctggactcagacaccaaccccggtgcctgaagacaaggggcagcccggcgaagatcttagacaccccggtactagcttgcccgctgcgtcacccgtcacttag

SEQ ID NO: 9129 - DNA, 3681 bp, Artificial Sequence
  Description of Artificial Sequence: Synthetic coding sequence
atggcccccctgcgggccctgctgagctacctgctgcccctgcactgtgccctgtgcgcggctgctgggtcccggacaccagagctgcatctgtccggcaagctttcagactacggagtgacggtaccctgtagcactgacttccgcggtagattcctttcgcatgtggtgtctggtcccgccgccgcgtctgccggatcaatggtcgttgacaccccacccaccctcccgagacacagctcccatctgcgggtggctcgcagtccactgcaccccggtggcaccctgtggccaggaagggttggccgacacagtttatatttcaacgttacagttttcggcaaagagctgcacctgcggctgaggcccaacaggcggcttgttgtacctgggagctctgtggagtggcaggaagattttagagaactgtttcggcagccactgcggcaggaatgtgtgtacaccggtggcgtaactggaatgcccggcgccgctgtcgccatttcaaactgcgatggactcgccggactgatcaggaccgactccacagatttcttcattgagccactggagcggggccagcaggaaaaggaggcctcggggcggacacatgtggtctaccgaagggaggccgtgcagcaggaatgggcggagccagatggggatcttcacaatgaagcatttgggttaggtgatcttcctaacttactgggcttggtgggcgaccagctcggggacacagaacggaaaagaaggcacgcgaaacctgggtcctacagcatcgaggtgttgctcgtcgttgacgactccgtcgtccgcttccatgggaaggaacacgttcagaactacgtcctcaccctgatgaacattgtcgatgaaatctaccatgacgagagtttgggagtccatattaacatcgcactggtgcgcctgatcatggtcgggtaccggcagtctctctctctgattgagaggggtaacccctccaggtcattggaacaggtgtgcaggtgggcccatagccaacagcggcaggacccctcccatgccgagcaccacgaccacgtagttttcctgaccaggcaagactttggtccgagcgggatgcaaggatatgcccccgttactggaatgtgccatcccctgaggtcttgcgctctaaaccacgaagacgggttctcttccgcatttgttatcgcccacgaaaccggccatgtgttgggtatggaacatgacggccagggaaatggctgtgctgatgagactagccttggctccgtgatggccccccttgtgcaggccgcttttcacagatttcactggagcaggtgctcaaaacttgagctgtctagatatctgccttcatatgattgtctgctggacgatccgtttgacccagcatggccccaacctccagagcttcctgggattaattacagcatggacgagcagtgcaggttcgactttggctccggctatcaaacctgtcttgccttccggacattcgagccgtgtaaacaactgtggtgctctcaccccgataatccatatttctgcaagacaaaaaaggggcccccactggacgggactgagtgcgctcccggcaaatggtgctttaaaggacattgcatctggaaaagtcccgagcagacctatggccaggatggtggctggtcgtcttggacaaagttcggatcgtgctccagatcctgtggagggggagtacggtcacgatcccgatcatgcaacaacccgtctccggcctatggcggaagactgtgcttgggccccatgtttgagtatcaagtctgcaactcagaagaatgtccaggcacatatgaggattttcgcgctcagcagtgtgccaaacgcaacagctattatgtccatcagaacgccaagcacagttgggtcccttatgagcccgacgatgatgcccagaaatgtgagctaatttgccagagtgctgataccggagacgtggttttcatgaatcaggttgtgcatgatggcacccgatgttcatatcgcgacccttactcggtctgcgcccggggagagtgtgtgcctgtgggttgcgataaggaagtggggtcaatgaaggctgacgacaaatgtggagtgtgtggaggagacaacagtcactgtcgtaccgtgaaaggcaccctgggcaaagcaagcaagcaggctggagccctcaaattggtgcagataccagccggcgccagacacatccaaattgaggccctggaaaagagtccccacagaatagtagttaaaaaccaagtgactggctctttcattctgaatcccaagggaaaagaggcaacatctcggacttttacagcaatgggcctagagtgggaggacgccgtggaggatgcgaaagaaagtctgaaaacttccggtcccctgcccgaagctatagccattctggcattgccacccacagaaggcggtccgagaagctccctcgcgtacaagtatgtgattcacgaggatctcttgccactgatcggctccaataacgttctacttgaagagatggacacctacgaatgggccctaaagtcttgggctccatgttctaaagcctgtggaggcggtattcagttcactaagtatgggtgccgacggcgacgtgaccaccacatggtgcagcgtcatttgtgcgaccataaaaaacgtccaaaaccgatccggcgccgatgcaaccagcatccctgctcccagccagtatgggtaactgaagaatggggagcttgtagccggtcctgcgggaaactcggcgtgcagacccgtggtattcaatgcttactgcctctgtcaaacgggactcataaagttatgcccgctaaagcctgcgcgggcgatagacctgaggctcgcaggccctgcctcagagtaccgtgtcccgcccaatggaggctgggagcttggagccagtgcagcgcgacgtgcggagaggggatacagcagcgacaagtggtgtgcagaacaaatgccaacagtctgggacactgtgagggggataggccagacactgtccaggtctgcagtcttccagcctgtggtgggaaccaccagaactcaacagttagggctgacgtgtgggagcttggcacgcccgaagggcagtgggttccacaaagtgaacctctccaccccattaacaaaatcagttctactgagccctgtacaggcgaccggtccgtgttctgccagatggaggttctcgacagatattgttcaatcccaggataccacagactgtgttgcgtctcatgtatcaagaaggcatcaggtcccaatcctgggccggatccgggtcccacaagcctgccccccttttctaccccagggtcacccctgcccggtccccaggatcccgcagacgccgctgaacccccaggcaagccaacgggcagcgaggaccaccagcacggacgggctacccagctcccaggcgccttggatactagctcacctggaacacaacaccccttcgccccagaaacccccattccaggcgcctcttggtctataagccccactaccccaggaggccttccatggggctggacacagacccctactccagtaccggaagacaaaggacagccgggggaggaccttagacatcccgggacatctcttccagccgcctctccagtgacttag

SEQ ID NO: 9130 - DNA, 762 bp, Artificial Sequence
  Description of Artificial Sequence: Synthetic coding sequence
atggccgccgccacccggggctgccggccctggggcagcctgctgggcttacttgggctggtgagcgcagccgctgccgcttgggacctcgcctcccttcgttgcactctgggcgccttctgcgaatgcgattttcgacccgacctgccaggactggagtgcgaccttgcacaacacctcgccggtcagcacctggctaaggctcttgtcgtgaaggccctgaaagccttcgtgagggaccccgcacctacgaagcccctggtgctgtcacttcatggctggacaggtacaggtaaatcttatgtctcctccttgttggcccattacctgttccaaggcggattgaggtctccaagagtccatcatttttctcccgtgctccatttcccccacccaagccatatcgaacgctacaagaaagatctgaaatcctgggttcaaggcaatctaacagcatgtggcagatcattatttttatttgacgaaatggacaaaatgcctcccgggctcatggaggtgctaaggcctttcctgggcagttcatgggttgtctatgggaccaattatagaaaagccatcttcatcttcatcaggtggggcccggctctacagtgggcccaatggggaggccatttcagcgaagtacagctgtattccctgagcctctgctctcagcagaaccccgtcccccacgggcttagctgggcattcccagtgccctccgccaccttacgtgacgatatcgtaattccgcctggatag

SEQ ID NO: 9131 - DNA, 966 bp, Artificial Sequence
  Description of Artificial Sequence: Synthetic coding sequence
atggccgccgccacccggggctgccggccctggggcagcctgctggggctgctggggctggtcagcgcagcagctgctgcgtgggacttagcaagtctgagatgtacccttggtgcattttgcgagtgtgatttccgccccgacctaccgggcttagagtgcgacctcgcacaacacctcgcaggacagcacctggcgaaggctctggttgtgaaagccctcaaggcctttgtgcgggacccagcgcccacaaaaccattggtgctgagcctgcatggctggaccggcaccgggaaatcttacgttagtagccttctggcccactacctgttccagggaggccttcgttctcctagagtacatcacttcagcccagtccttcacttccctcacccgagccacatcgaacgatacaaaaaagatttaaaatcttgggttcaggggaacctgacagcatgcgggagatctttgttcctgttcgacgaaatggacaagatgccgcccggtctgatggaggtgctcagaccttttcttggctcctcctgggtcgtatacggcactaactaccgcaaagctatttttatctttatttcaaacactggcggtaagcagataaaccaagtcgcattggaagcctggcgatcccgccgcgatagagaggagatcctcttgcaagagctagagccagtgatcagccgggccgtactggataacccgcaccacgggttctccaactcggggattatggaagagaggctcctggatgccgttgtccctttcttgccactccagcggcatcacgtccggcattgtgttctgaacgagctagcccagttgggattggagccccgcgacgaagttgtccaggcagtactggatagcaccactttcttccccgaagatgagcagctgtttagctctaacggctgtaagacagtggcttccagaattgccttcttcctgtag

SEQ ID NO: 9132 - DNA, 576 bp, Artificial Sequence
  Description of Artificial Sequence: Synthetic coding sequence
atgcaggtgtggtgcgaccagcggcacgaccccggcggctggaccgtgattcagcgcagactggacggctctgtgaactttttccgcaactgggaaacatacaagcagggctttggcaacatagatggtgagtactggctcggcctggagaatatctattggttaactaaccagggcaactataagctgctcgtgacaatggaagattggagcggtagaaaagtatttgcagaatacgcctcattcagactcgagccagagtccgaatattacaagctgaggttaggccgttaccacggaaacgctggcgattcctttacctggcataacgggaagcagttcactaccctggatagggaccatgacgtttacaccggcaactgcgcccactatcaaaagggtggatggtggtacaacgcatgtgcccactcaaacctgaacggcgtctggtatagaggggggcattatcgctctaggtatcaggacggggtctactgggccgagtttcggggcgggagttatagtttaaagaaggtggtcatgatgataagacccaatccaaacacttttcactag

SEQ ID NO: 9133 - DNA, 1482 bp, Artificial Sequence
  Description of Artificial Sequence: Synthetic coding sequence
atgcggcccctgtgcgtgacctgctggtggctgggcctgctggccgccatgggggccgtcgccggacaagaggatggcttcgagggcacagaggaagggagccctcgagagttcatctatttgaatagatataagcgggccggggaatcccaagataaatgtacgtacacatttattgtgccgcagcaacgagtgactggggctatttgcgtgaatagcaaggagcctgaggttctcctcgaaaatagagtccacaagcaggagctagagctccttaacaacgagcttttgaagcagaaaaggcagattgaaaccttgcaacagctggttgaagtcgatggtggtattgtgtccgaggtcaaactcctgcggaaagagtcccggaatatgaactccagggtgactcagctttatatgcagttactgcatgagatcatcagaaagagagataatgccctggagttgagtcagttagagaacaggattctcaaccaaactgctgacatgctccagctcgctagtaagtacaaagatctcgagcacaagtatcagcatctggcaaccctggcgcataaccaaagcgaaatcattgcccagctcgaagagcattgtcagagagtgccctccgcccggccagtaccacagcccccacccgcggcccctccccgcgtgtaccagcctcctacttacaatcggataattaaccagatctcaaccaacgagatccaaagtgaccagaatctgaaggtcctcccgcccccactgcccactatgccaaccctcactagccttcccagttccaccgataaaccgtccggaccatggagggattgcctgcaggcccttgaagacggacatgatacatcttcaatctacctcgtaaaaccggagaacactaaccgcctaatgcaggtgtggtgcgaccaaagacatgaccctggtgggtggaccgtgatacagcggcggctagacggtagcgttaatttctttcggaactgggagacttacaaacaggggtttgggaacatcgatggagagtactggctgggactcgagaatatctactggttaacgaaccaggggaactataagctgctggtgaccatggaggactggtcaggcagaaaagttttcgccgagtatgcctctttcaggctggaacctgagagcgagtactataagctgagactcggccggtatcacggcaatgccggagattcttttacctggcacaatggcaaacagtttactacgctggaccgagatcacgatgtctacacaggtaactgcgctcattatcaaaagggcgggtggtggtacaacgcttgtgcgcattcgaacctcaacggcgtgtggtataggggtgggcactaccgatccaggtatcaagacggagtctactgggccgaatttagggggggaagctacagtcttaagaaagtggtcatgatgattaggccgaaccctaatacattccattag

SEQ ID NO: 9134 - DNA, 1959 bp, Artificial Sequence
  Description of Artificial Sequence: Synthetic coding sequence
atggccgccgccgccctgcccccccggcccctgctgctgctgcccctggtgctgttactcagcggacgacccactcgcgctgattcgaaggtgttcggggatcttgaccaggtgagaatgacatccgaaggatccgactgcagatgtaagtgtatcatgagacccctgagcaaggatgcatgctccagagttagaagcggacgggccagggtagaggacttttacacagtcgagactgtatcgagtggcaccgattgcaggtgctcatgtacagcccctccttcctccctgaatccttgcgagaacgaatggaaaatggaaaagctgaagaaacaggcaccagagctcctgaaattgcagagcatggtcgatttgttggaggggaccctgtacagtatggacctaatgaaggtgcatgcgtatgtgcacaaggtggcctcccaaatgaacaccttggaagaatctataaaggctaacctctctagggagaacgaggtggttaaggactccgtgcggcatctgtccgagcagcttcgtcactacgaaaaccattcagctatcatgcttgggatcaaaaaagagctgtctcggctgggactgcagctcctgcagaaggatgcagccgccgccccggcaacacccgccacgggaactggttccaaagcacaggacacagcgcggggtaaaggtaaagatataagcaaatacggatcagtgcaaaaaagcttcgctgaccgcgggttacctaagcccccaaaggagaaactgctccaagtcgagaagctcaggaaggagagtgggaaaggcagtttcctacagcctacggctaagccacgcgcgctcgctcagcagcaggcagtgatcaggggattcacatattacaaagccggcaaacaggaggtcactgaggcagttgcggataataccctgcaggggacttcgtggctcgagcagctaccgcccaaggtggaggggcggagcaatagtgcggagcctaacagcgcagaacaggacgaagccgagcctcggtcctctgagcgggtggatctggccagtggaactcctacatccattcctgctactacgaccaccgcgacaacaacccccactcctacaacctctctgctgccaactgagcctccctcaggccccgaggtgtcgagccaagggcgggaggcatcctgtgagggaacgcttagagccgtggacccacccgtcagacaccacagctacggccggcacgagggtgcatggatgaaggaccccgcggcgagggatgaccggatctatgtgacaaattactactatggtaacagtctggtagagttccgaaacctggagaactttaaacaggggaggtggtctaacatgtacaagctgccctataattggattggtacaggccacgtcgtgtatcagggagcgttctactataacagagccttcactaagaacatcattaaatatgacctgcgccagcggttcgttgccagctgggcgcttttgcctgacgttgtgtacgaagataccaccccctggaaatggagagggcactctgacatcgactttgctgtggacgaatctggcctttgggtgatctacccggcagtggacgacagggacgaggcccagcctgaagtgatagtgctttctcgcctggatccaggcgacctctcggtacatcgggagaccacatggaagacgcgacttcgtaggaattcctatggcaactgtttcctggtctgcggcatcttgtacgctgtcgacacatacaatcagcaggaagggcaggttgcatatgctttcgacactcatacaggcaccgacgctagaccacagctgccttttctaaacgagcatgcctacacaacacagattgattacaaccctaaagaacgtgtcctatatgcctgggataacggacaccaactcacttacactctccactttgttgtatag

SEQ ID NO: 9135 - DNA, 1641 bp, Artificial Sequence
  Description of Artificial Sequence: Synthetic coding sequence
atgaagaaccaggacaagaagaacggcgccgccaagcagagcaaccctaaatcatcccctggtcagccggaagctggtccggaaggagcgcaggagaggccatcacaggccgctcctgcggtcgaggcagaaggacccggcagctctcaggctcctcgtaagcccgaaggcgcacaggctcgcacggcacaaagcggggccctgagggatgtctctgaggagctcagtagacagctggaggacatcctcagtacctactgtgtggataataatcagggcgggcccggggaggacggagcccaaggggagcctgctgagcctgaagacgccgaaaagtcccgtacttatgtcgctcgcaatggtgaaccagaacccactccggttgtgaacggagagaaagagccatctaagggggaccccaacaccgaggagattaggcaatctgacgaagtcggagatagggatcacaggcgtccacaggaaaaaaaaaaggcgaagggactgggtaaggagattaccctgctcatgcaaaccctgaatactctttccaccccagaggaaaagctcgcagcactttgcaaaaagtacgctgaattattagaagagcatcgcaactctcaaaaacagatgaaattactgcagaagaagcagagccagttagtgcaggagaaggaccatctccgcggcgagcactccaaggcagtgctggccagatccaagctagagtcgttatgccgggagttacagcgacacaaccgctccctgaaagaggaaggcgtgcagcgagctagagaggaagaagagaaacgaaaagaggtgacgtcccactttcaagtgacactcaatgatatacagctgcagatggaacaacacaacgagcgcaattccaagttgcgtcaggagaatatggagctcgcggaacgattgaagaagttgatagaacagtacgagcttagggaagagcatatagacaaagtctttaagcacaaggatctccagcaacagctggtagacgccaaattgcaacaagcccaagagatgttgaaagaagcagaagagagacaccagcgcgagaaggacttcctgcttaaggaagccgtcgagtcccagaggatgtgcgagcttatgaaacagcaagaaacccatctgaaacagcaactggcgctatacacagagaaatttgaggaatttcagaacacattgagcaagagctcagaagtttttactacattcaagcaagagatggaaaagatgactaaaaaaatcaaaaagctcgagaaggaaacaacaatgtatcgatcgcgctgggagtccagcaacaaggccctactggaaatggcagaggaaaagacagtacgggataaagagctcgagggactgcaagtgaagatacagcgcctcgagaaactgtgtcgagccctccagaccgagaggaacgacctcaacaaaagggtgcaggacttgtctgcaggaggccagggctccctgactgactctggaccagaaagacggcctgaaggtcccggcgcccaggccccaagcagccccagggtcaccgaagctccgtgctaccccggcgctccatcaaccgaggcctcaggtcagacaggaccacaggagccaacctcagctcgcgcttag

SEQ ID NO: 9136 - DNA, 1641 bp, Artificial Sequence
  Description of Artificial Sequence: Synthetic coding sequence
atgaagaaccaggacaagaagaacggcgccgccaagcagagcaaccccaaatcatcacccggtcagcccgaggctgggcccgaaggtgcccaggaaagaccctcccaggccgctccagcagttgaggccgagggccccggctcctcccaggctcctaggaagcctgagggagctcaggctcgaacggcacagtccggggccctccgcgatgtgtcggaggaattgtcacgacagcttgaggacattctttccacctactgcgtcgataacaaccaaggaggacccggggaggacggggcacagggtgaaccagccgaacccgaggacgccgagaaatctcggacatatgtcgccaggaatggtgaaccagaacccaccccggtggtgaatggtgagaaggaaccgtcgaaaggtgacccaaacacggaggagattcgccagagcgatgaagtgggggacagagaccatcgccggcctcaagagaaaaagaaggcaaagggcctgggaaaggagatcaccttacttatgcagactttgaatacactgtccacccctgaagagaagctggcagccctgtgtaagaagtacgcggaactcctcgaagagcatagaaacagccaaaaacagatgaaactgcttcaaaagaagcagtcccagcttgtgcaggagaaggatcatttacggggtgaacattcaaaggccgtgctggcccggagcaagttggagtcactatgcagggaattacaacggcacaacagatcactgaaggaagagggggttcagagggctcgagaagaggaagagaaacgaaaggaggtaacctcccatttccaagtcacgcttaatgacattcagttgcagatggagcagcacaatgaaaggaactctaagctaaggcaggaaaatatggagttggctgagcgtttaaaaaaacttatcgaacagtatgagcttcgggaagaacacattgacaaggtattcaaacataaagacctccagcaacagcttgtggacgccaagcttcaacaggcccaagagatgctgaaagaggctgaagagagacatcaacgggagaaagacttcctgctaaaggaagccgtagagtctcaacgcatgtgtgaattaatgaagcaacaggaaactcacctcaagcagcagctggcattgtacaccgagaaattcgaagagtttcagaacaccctgtctaaatccagtgaggtgtttacgacctttaagcaggaaatggaaaaaatgaccaagaaaatcaaaaagttagaaaaggaaacgactatgtatagatcccgttgggaaagcagtaacaaggccctgcttgagatggcggaggaaaaaaccgtgcgtgataaggagttggaaggattacaggtgaaaattcagcgcctggaaaagctttgccgggctctacagacggagaggaatgatctgaataaaagggtgcaagatctgtcagccgggggccagggttcgctgaccgatagcggccccgagcgaagacctgagggccctggcgctcaggctccttctagtccacgggtgaccgaggcaccttgctatcccggagcaccgtctacagaggcatctggccagaccgggcctcaggagccaacctccgcaagagcctag

SEQ ID NO: 9137 - DNA, 1392 bp, Artificial Sequence
  Description of Artificial Sequence: Synthetic coding sequence
atgcacggcagctgcagcttcctgatgctgctgctgcccctgctgctactgctggtagctaccacaggccccgtcggggcactgactgacgaggagaaacggctaatggtggagctccataatctttatcgtgctcaagtatccccaaccgcaagcgacatgctccacatgcggtgggacgaagagctcgccgcttttgccaaggcgtatgctaggcagtgtgtctggggtcacaataaggagagagggaggaggggcgagaatttgttcgcgataaccgacgaaggtatggacgtcccattagccatggaagaatggcaccatgagagggagcattacaatcttagcgcagcaacttgcagcccgggacagatgtgcggacactacacacaggttgtctgggctaagactgaacggattgggtgtgggtctcacttctgcgagaagctgcaaggcgtggaagaaacgaacattgaactgctggtttgcaactatgagcctccggggaacgtcaagggcaaacggccttaccaggaaggcaccccttgttcacagtgtcccagcggataccattgcaaaaactctctgtgcgaacctattggtagcccggaagatgctcaggatttgccttatctcgttacggaggcgccttctttcagggccacggaagcaagtgattctcgcaaaatgggaacacccagttccctcgctaccgggataccagcattcttagttacagaggttagcgggagcctggcaactaaagcacttcccgctgtggagacccaggccccaactagcctcgccaccaaggaccctccctctatggccacggaagctcccccgtgtgtaaccactgaggtgcccagcatcttggcggctcacagcctgccttcgctggacgaggaacctgtgacatttcctaagtctacccatgtgcctattcccaagtctgccgacaaagtcactgacaaaactaaggtgccaagccgtagccctgaaaatagtcttgatcctaagatgagtctgacgggggcccgggagctcctgcctcacgctcaggaagaggcagaagctgaggctgaactacctccatcatctgaagtgctggcatcggtatttccggcgcaggacaagcctggcgagttgcaggctaccctagaccacactggacataccagctccaagagcctgccaaatttccctaatacctcagccacagccaatgctactggcggccgtgccttagccctgcagtcctccctaccgggcgccgagggaccagacaaaccatctgttgtctctgggctgaattctggccccgggcacgtctgggggcccctactgggcctgctgctgctgcctcctctggtcctcgctggaattttctag

SEQ ID NO: 9138 - DNA, 459 bp, Artificial Sequence
  Description of Artificial Sequence: Synthetic coding sequence
atgatgctgccccagtggctgctgctgctgttcctgctgttcttcttcctatttcttctaacaagagggtctctgtccccaacaaagtataacctgcttgagctcaaggagagctgcataagaaaccaggactgcgagacgggctgctgccagcgagctccagataactgcgaatctcactgtgctgagaaagggtcagagggctccctgtgtcagacacaggtgtttttcgggcagtatcgagcatgcccctgccttaggaatctgacctgcatatattctaagaacgagaagtggctcagcattgcttacggcagatgtcagaagatcgggcgacaaaaactggccaaaaaaatgtttttggttctgccaccatcttgttgccttctcctcctgcacctcctgtcctctctgccccgagcactctgttcgccctgtagccctgaaccccccccctag

SEQ ID NO: 9139 - DNA, 366 bp, Artificial Sequence
  Description of Artificial Sequence: Synthetic coding sequence
atgatgctgccccagtggctgctgctgctgttcctgctgttcttctttctgttcctgctcactcggggatccctgagtcctacaaaatacaatctgctcgagctgaaagagtcgtgtattcgcaatcaggattgcgagaccggctgctgccagagagccccagataactgtgagtctcactgcgcggagaagggttctgagggcagtttatgtcagacacaggtcttttttggccagtacagggcctgtccctgtcttcgaaacctcacatgcatttattctaagaatgagaagtggctgtcgatcgcgtatggtagatgccaaaaaatcgggagacagaaattggcgaaaaagatgtttttttag

SEQ ID NO: 9140 - DNA, 1122 bp, Artificial Sequence
  Description of Artificial Sequence: Synthetic coding sequence
atgcggctgctggcctggctgatcttcctggccaactggggcggcgctagggctgagccgggcaagttctggcacattgctgacctccatctcgatccggattataaagtctcaaaggacccttttcaagtttgtccatccgccggctcacagccggtgccagacgcggggccatggggtgattatctctgtgactctccttgggctctgattaatagctctatatatgcaatgaaggaaatcgaacctgagccagacttcattctgtggacgggggacgatacaccccacgttccagatgagaaacttggagaggcagctgtgctggagattgtggaaaggctgacaaaactgatccgcgaagtttttcctgacaccaaagtctatgcagctttgggtaatcacgactttcacccaaagaatcagtttcccgctggatcaaacaacatttacaatcagattgctgagttatggaaaccttggctcagcaacgagagcatcgccctgttcaaaaagggggcattttactgtgagaagcttcctggcccgagtggtgccggcagaatcgtcgtgctgaatacaaacttgtattacacctccaacgccctgacagcggacatggctgatccagggcagcaatttcaatggctcgaagacgtgcttaccgatgcttctaaagcaggcgatatggtatacatcgtgggccatgtgcctccggggttctttgagaagacccagaataaggcctggttccgggaaggctttaacgaaaaatacctgaaagtggtccgcaaacatcacagggtcattgctggccagtttttcggacaccaccataccgattccttccgtatgctgtacgacgacgccggggtccccatatccgccatgttcataacacccggggtgacgccatggaagaccacactgccaggagtggtgaatggcgctaataatccggccatcagggtgtttgagtacgatagggccaccctgtctttaaaggtgcgctcaccagccgaggctaggggcggcgggtgggaaggactgaagtgtataacaacatttccccacagccagctcatccatttgccgttaaccactgaaccccaagaaggctag

SEQ ID NO: 9141 - DNA, 810 bp, Artificial Sequence
  Description of Artificial Sequence: Synthetic coding sequence
atgcggctgctggcctggctgatcttcctggccaactggggcggcgctagagccgagccagaggaagcccagggcccatgcgcccaggaaaaagggaagggaccccccccgacgtcgattctggccagtctcgctcccgggctggaagccggcaaattctggcacatcgctgacttgcatctcgacccagattataaagtctcaaaagacccatttcaggtgtgcccctccgccggcagccagcctgtccccgacgccggaccatggggcgactatctctgcgacagcccttgggcccttatcaactcctccatatatgcgatgaaggaaatcgagcccgaaccagactttatcctctggacaggagatgacacgccccatgtgccagatgagaaattgggcgaggctgctgtgctagaaatcgtggaacggctcacaaagctgatccgcgaagtattccccgatacaaaagtctatgcggcactgggcaatcatgactttcacccaaaaaatcagttccccgcaggatccaacaatatatacaaccaaatcgccgagctttggaaaccatggctgtccaacgagtccatcgctctgttcaagaaaggcgcattctactgcgagaagttgccaggcccctcgggagctgggaggatcgttgttctgaatacgaacttatactacacctctaatgccctaacagccgatatggccgaccccggtcagcagttccagtggctggaggacgtattgacagacgcttccaaggccggagacatggtttatatcgtcggtcacgtgcctccatag

SEQ ID NO: 9142 - DNA, 1368 bp, Artificial Sequence
  Description of Artificial Sequence: Synthetic coding sequence
atgcggctgctggcctggctgatcttcctggccaactggggcggcgccagggctgaaccaggaaaattctggcatatagctgatctgcacctggacccggattataaagtgtcgaaggaccccttccaggtgtgcccttcagccggatcacagcccgttcctgacgctggaccgtggggtgattacctctgtgacagtccctgggccttgatcaacagcagcatttacgctatgaaggagatcgagccggagcccgactttatcctatggaccggtgatgataccccccatgttcccgacgaaaagctgggggaggctgcagtgctcgaaatagtcgagcgtttaacaaagttaataagagaagtgttccctgacaccaaggtgtacgccgcactgggtaatcatgactttcaccctaagaaccagttccctgccgggtcaaacaatatctacaaccagattgcggagctatggaagccctggctctctaacgaaagcattgctcttttcaaaaagggtgcgttctactgtgagaaactacccgggccctctggcgcgggaagaatcgtagtgctgaacacgaacttatactacacgtcgaatgcgctgacagccgacatggccgatcccgggcagcaattccaatggctggaggacgtcctcaccgacgccagcaaggccggtgatatggtgtacattgtggggcacgtgccacccggtttcttcgagaagacacagaacaaagcatggtttcgggaagggtttaacgagaagtacctcaaggtcgtgcgcaagcatcatcgtgtcatcgcaggacaattttttggccatcaccacaccgactccttcagaatgctgtatgatgacgctggagtgccaattagcgccatgttcatcactcctggagtgacgccttggaagaccaccctgcccggggttgtgaacggggccaacaaccccgctatccgcgtgttcgaatacgaccgcgccacactcagtttgaaggatatggtcacctactttatgaatctgagtcaagccaatgcccaaggcactccaagatgggaactggagtaccagctgaccgaagcctacggggttccagatgcctccgcacattccatgcataccgtccttgacaggattgcaggagatcagtccacactgcagcggtattatgtgtacaattccgtgtcatattctgccggagtctgtgatgaggcctgttcaatgcaacacgtgtgtgccatgaggcaggtcgacatcgatgcatataccacctgcctgtacgcgtccggcaccacccccgtaccacaattgcccctccttttgatggctctactgggcctgtgtaccctggtgctgtag

SEQ ID NO: 9143 - DNA, 867 bp, Artificial Sequence
  Description of Artificial Sequence: Synthetic coding sequence
atggccctggccccccccccccggggcctgtggcaggccaaggacatatccccaattgtaaaagccgcacgcagggacggcgaacttctactctccgcccaactggactctgaggagagagaccctggcgtgccacgacccagcccctatgccccatatattctcgtctatgccaatgatctggctatttctgaacctaacagtgttgctgttactcttcaacggtacgatccatttcccgctggagatcctgaaccaagggcagcacctaataacagcgccgatcccagggtgcgccgtgctgcgcaggcaaccggtcccctccaggataacgagttacccggactcgacgaaaggcccccccgggcccatgcccagcactttcacaaacaccaactgtggcctagccccttccgcgcactgaagccgcgccctggtaggaaggacagacgcaagaagggccaggaggtgttcatggctgccagccaagtgttggattttgatgagaagaccatgcagaaggcccgtagaaagcaatgggatgagcctcgagtctgttctagacgatatcttaaagtggatttcgctgatatagggtggaatgagtggattatctcgcccaagtcattcgacgcatactattgcgcaggcgcttgtgagtttccaatgcccaagattgtgagaccctctaatcatgctaccattcaaagtatcgtgagagccgtcgggatcattccgggcatcccagagccctgctgtgtgcccgataaaatgaactcactgggggttttgttcctggatgaaaatcggaacgttgtgctgaaagtgtaccccaacatgtctgtcgacacatgcgcttgccgatag

SEQ ID NO: 9144 - DNA, 1626 bp, Artificial Sequence
  Description of Artificial Sequence: Synthetic coding sequence
atgcccttccggctgctgatccccctgggcctgctgtgcgccctgttacctcagcaccacggcgctcctgggcctgacgggtccgcgccagatcccgcccactattcatttagcctgactttgatagatgccctcgacacactgctgatcctgggaaatgtcagcgaatttcaacgagtggttgaggtcctgcaggacagcgtggattttgacatagatgtaaacgcatccgttttcgaaacgaacatccgcgtagtgggcgggctgctctccgcgcatctccttagcaaaaaggcgggcgtggaggtggaggcggggtggccgtgtagtgggcctctgttacgaatggctgaagaagcagccaggaagctcctgcctgccttccaaacgcccacagggatgccctacgggactgtcaacctgttgcacggtgtcaatcccggtgaaaccccggtgacctgcaccgccggcatcggtactttcatagtggagttcgctacacttagctctctgactggagacccagtgttcgaagacgtggcgcgtgtggccctcatgagattgtgggagagccgtagcgacattggtctggtaggaaatcatattgacgttctgactggtaaatgggtggcacaggacgctggaatcggcgcgggcgtggactcttactttgagtacctggtaaagggggctatactcctgcaggacaagaaacttatggccatgtttttggagtacaataaggctatccgaaactatactcggttcgatgattggtacttgtgggtccagatgtataagggtaccgtctcaatgccggtcttccagtccctggaggcctattggccagggctgcaaagtctgattggagacatcgataacgctatgcgaacatttctgaattactacaccgtttggaaacagtttggcggcctgccagaattttacaacattccgcagggatatacggtagagaagcgcgaaggttatcccttacggcccgagctcattgagtccgccatgtatttataccgcgccacaggtgatccaacattgctggaacttggccgagatgccgtcgagtcaatcgagaagatctcaaaggtggagtgtggatttgccacaattaaagatctcagggatcacaagctcgacaacaggatggagagcttcttcctggctgagacagtcaaatatctgtacttgctgtttgaccctacgaattttatccataacaacgggagcacgttcgacgcagtcatcacaccctacggagagtgcatcctgggcgcgggggggtacatttttaacaccgaggctcatccaatagaccctgccgccttgcattgctgccagcggctgaaggaggagcagtgggaagtggaagacctcatgagggagttctatagcctgaagaggtcacggagcaaattccaaaagaacactgtgtcctcagggccttgggagcctcccgcccgtccaggaacacttttctctcccgagaatcatgatcaggctagggagagaaaaccagcaaaacagaaggtacctcttctttcttgtccgtcccagccatttacctcgaagctcgcactgctgggacaggtgtttctagactccagttag

SEQ ID NO: 9145 - DNA, 1737 bp, Artificial Sequence
  Description of Artificial Sequence: Synthetic coding sequence
atgcccttccggctgctgatccccctgggcctgctgtgcgccctgctgccccagcatcacggtgctccaggaccagatggctctgctcccgatccagcgcattaccgcgagcgggttaaggccatgttctatcatgcttatgacagttacctggagaacgcttttcccttcgatgagcttagaccacttacttgtgatggccatgatacatggggttccttctctctgactttaatcgatgcactcgacaccctcctgatactggggaacgtatcagaattccaaagagtcgttgaagtcttacaggactcagtggacttcgatatcgatgtaaatgcaagcgtgttcgaaacaaatatacgagtcgtgggagggctcttgtcagctcatttactctcaaagaaagccggagtggaggtggaggcagggtggccctgttccggtcctctcttgagaatggccgaagaagccgcccggaaattgctcccagcattccaaactcctaccggcatgccgtacgggacagttaatttgctgcatggcgtgaatccaggggaaacacctgtaacctgtaccgcgggaataggaaccttcatagtggagtttgccaccctgtcttctctcactggcgatcctgtttttgaagacgtcgctagagtagcactcatgcgcctctgggagtcaaggtcagatatcggcctggtgggcaaccatattgacgtgctgaccggcaagtgggtagcccaagacgccggcatcggtgccggagtggattcctacttcgagtatctggtgaaaggggccatcttattgcaggacaagaagttgatggctatgttcttggaatataacaaagcaattcgaaattatacacgctttgatgattggtatctttgggtccagatgtataagggaactgtctcaatgcccgtatttcagtcacttgaagcttattggccaggcctgcagagcctgatcggtgatattgacaacgcgatgcggacctttctgaactactataccgtatggaaacaattcggcggtctgcccgaattctacaatatccctcagggctacactgtagagaagcgagaaggctatcctctccgacccgaactgatcgaatctgccatgtatctgtatcgagctaccggcgacccaactttgctcgagcttgggagggatgccgtcgaaagtatcgagaaaatctctaaagtggagtgcggtttcgcgactataaaggatctcagagaccataagctggacaatcggatggaatctttttttctggcagaaactgtgaagtacctctatctgctgttcgacccaaccaactttattcataataatggttcaacgttcgatgcggtgatcacaccctatggcgagtgcatcctgggcgcgggtgggtatattttcaacacagaagcccatcctattgaccccgctgcactgcattgttgccagagacttaaggaggaacagtgggaggtcgaagatctgatgcgagaattttattctcttaaacgatcgcgcagtaaatttcagaaaaatacagtgagttccgggccctgggagcctccagcacgtccaggtactctctttagcccagaaaatcacgaccaggcccgggaacgaaagcccgcaaaacagaaggtgccactcctttcatgtccctctcagccctttacatctaaactcgccttgttgggacaggtgttcctggacagcagttag

SEQ ID NO: 9146 - DNA, 495 bp, Artificial Sequence
  Description of Artificial Sequence: Synthetic coding sequence
atgcggagctgctacgtggcccaggccggcctgaagctgcccggcagcagcgatccgccagcatctgcctcacagtccactcggatcaccgctagcggatatggccccccaagctcaaggcctagtagcagagttgtcaatggtgaagacgctgtgccctatagttggccttggcaggtgtctctgcagtatgaaaagagcggctccttttaccatacatgtggcggaagcttgattgctcctgattgggtggtgaccgccgggcattgcatcagctcttctcgcacttatcaggtcgtcttgggcgaatacgatagggctgtaaaagaaggcccggagcaagtcatacctattaactctggcgatctcttcgtgcatcctctttggaatcgctcttgtgttgcctgcggcaacgatatcgccctcattaaactgagccgctccgcacagttgggtgacgcagttcaactggcatctctgccaccggccgggtag

SEQ ID NO: 9147 - DNA, 3663 bp, Artificial Sequence
  Description of Artificial Sequence: Synthetic coding sequence
atgcccggcctgctgaactggatcaccggcgccgccctgcccctgacggcttccgatgttactagttgtgtcagcggatatgcgctgggcctgaccgcatcactcacttacggcaatctggaagcccagccgtttcaggggctgttcgtgtatccactggacgaatgcactaccgtaatcggctttgaggctgtaatcgctgatcgcgtggttacggtccaaatcaaagataaagctaaactggagagcggccacttcgacgcttctcacgtgagatcaccaactgtcacaggtaatattctccaggacggtgtttcaattgcaccacattcctgcacccccggaaaggtcaccctcgatgaggacctcgagaggatcctgttcgtcgcgaatctggggacgatcgcccccatggagaacgtgactatatttatcagcactagctcagagctgcccacccttccgagcggagctgtcagggttctactgcctgctgtgtgcgctcctaccgtaccacaattctgcaccaaaagcactgggacctcaaatcagcaggcccagggcaaggaccgacattgtttcggggcctgggctcccggttcttggaacaaactgtgcctcgccacattgttgaatacggaagtctctaacccaatggagtatgagttcaacttccagctggaaatcaggggcccatgccttctggctggcgtggaatcccctacccacgagattagggccgacgcagcaccaagcgcacgttccgcaaagagtatcatcattacacttgctaacaagcacacgtttgacaggccagtagaaattctcattcatccgtcagagccgcacatgccgcatgttctgatagaaaagggggacatgactttgggggagtttgaccagcacctcaaggggcggactgactttatcaagggcatgaagaagaaaagtagagccgaaaggaaaactgagatcatccgtaagcgccttcataaggacatcccacaccattccgtgataatgttaaacttttgcccagacttacagagcgtgcaaccctgcctgcgcaaggcacatggggaatttattttcttgatagacaggagctcctccatgtctggtatttcaatgcaccgagttaaagacgcaatgttggtggccctcaagtcactgatgcctgcttgcctgtttaatataatcggtttcggaagcactttcaagtcactgtttccatcttcacagacttactccgaagatagtctcgcaatggcttgtgatgatatacagaggatgaaggccgacatgggtggcacgaacatcctgagtcctctgaagtgggtgattcgccagcccgttcacagaggccatcctcgccttctcttcgtcattactgatggcgctgtgaacaatactggcaaggtcttagaactggtgcggaatcacgccttctccacgcgatgctattctttcggcattggccccaatgtgtgtcaccggcttgtcaaggggttggccagcgtgagcgagggaagcgcagagctgttgatggaaggggagcgcctgcagccaaaaatggttaaaagcctgaaaaaagcaatggcccctgtgctctcagacgttactgttgagtggatcttccctgagactacagaggtgcttgtctctcccgtgtccgcgtcctccctgtttccgggagagagattagtgggctacggaattgtgtgtgacgcctccctccacatcagcaaccccaggagcgataagcgtcgacgctatagcatgctgcattctcaggaatccggatcaagtgttttttaccacagccaggatgacggccccggcctcgaaggaggcgattgtgccaaaaacagtggcgccccgtttatcctgggccaggccaagaacgctagactagcttccggagattccactaccaagcacgatctgaatctatctcagagaaggagagcctacagcactaaccagatcacaaatcacaaacctctgccacgcgctactatggcgtctgatcccatgcccgccgccaaacgctaccctctgaggaaggcgagactccaggacttgacaaatcagacaagtctggacgtgcagcgctggcagatcgatctccagccattgctgaattctggccaggatctgaaccaaggtcctaaactgcggggcccgggcgctaggcgcccaagtcttctgccccagggttgtcaaccctttcttccctggggccaggaaacacaggcctggtctccagttagggagcgcacctcagattccaggtctcctggcgacctcgagccctctcaccacccatcggctttcgaaactgagacatcctctgattgggatcctcctgctgaaagccaagagcgtgcaagccctagcaggcccgccacacccgcacccgttctgggcaaagccttagtgaaggggctgcatgatagccagaggttgcagtgggaggtaagcttcgaactgggaaccccaggccctgagagaggcggcgcccaggatgccgatctgtggagtgagaccttccaccacctcgccgcgcgagcaatcattcgggactttgagcaattagcagaacgtgagggggagattgagcagggttcgaacaggcggtaccaggtctcagccctccacacgagtaaggcttgcaacattatatctaaatatactgctttcgtcccagttgatgttagcaagtcacgttaccttccaacagttgtcgagtaccccaactccgccgcacttaggatgctggggagtagggcgctggcacagcagtggaggggtacaagtagcggcttcgggcgtccacagaccatgcttggagaggatagtgcccctgggaatggtaagtttcaggcgctcaacatggaagccagccctacagctctcttctctgaggcgagatctccggggagggaaaagcacggggccagtgagggcccccaaagatctttggctaccaacacgttgtcaagcatgaaggcaagcgaaaatctttttgggtcttggctgaatctaaataaatcacgccttctcacccgcgcggcgaagggatttctgagcaagcctctaattaaggcggtggagtcgacctctgggaaccagtctttcgattatatccctttggtgtctcttcagttagcatccggcgccttcctcctgaacgaagccttctgcgaggcaacacacatccctatggaaaagctgaaatggactagccccttcacatgccacagggtcagcttgactactcgcccatctgagagtaagaccccatcaccacagctctgtaccagctctcctccccgtcatccttcgtgtgatagcttctcgctggaacctctggctaagggcaaattgggactcgagccccgggctgtagttgagcacaccggaaagctgtgggccacagttgttggactcgcgtggttagagcattcatctgccagctacttcaccgaatgggagttggttgctgccaaggccaatagctggctggagcaacaagaagttcccgagggccgcacacagggaactctgaaggctgccgcccgccagctttttgttctgcttcgccactgggacgaaaacttagagttcaatatgttgtgttataaccctaattacgtgtag

SEQ ID NO: 9148 - DNA, 3051 bp, Artificial Sequence
  Description of Artificial Sequence: Synthetic coding sequence
atgcccggcctgctgaactggatcaccggcgccgccctgcccctgacagcttctgacgtgaccagctgtgtgtccggctacgcgttagggctcactgcgtctctcacctatggcaatctggaagcccagccattccagggactgtttgtctatccgctggacgagtgtaccaccgtcattggctttgaggcagtcatcgctgatcgagtggtgaccgtacagatcaaggataaggcaaaactggagtctggacacttcgatgcgagccatgtcagatcccccactgtgacagggaatattcttcaggatggagtgtccatagcaccccatagttgcacacccggcaaggtaacactggatgaggaccttgagcgaattctattcgtcgccaatctgggcactattgctccgatggagaacgtgacaattttcatcagtaccagcagtgaactccctacactgccatccggtgctgtccgggtgctcctgcctgccgtctgtgcacctaccgtgcctcagttttgtactaagagtacaggtacctccaaccagcaagcccagggtaaagacagacactgctttggagcctgggctccgggctcttggaataaactgtgcctggctacactcctgaacaccgaggttagcaatccaatggagtatgaattcaacttccaattagagatccgcgggccatgcctgctggcgggggttgagagtcccacgcatgaaatacgcgccgatgctgctccgtctgctagaagtgcaaagagcattattatcacactggccaataagcataccttcgatcgtcccgtcgagatactgatacacccttccgagccgcacatgccgcacgtcctcatcgagaaaggcgatatgactctgggagagttcgatcagcacctcaaagggagaaccgatttcatcaagggcatgaaaaagaaatcgcgggctgagagaaagacggagattattaggaaacggctgcacaaggacatcccacaccatagcgtgatcatgctcaacttttgtccagatttacaatctgtccagccatgcttgaggaaggcacacggcgaatttatctttcttattgatcgctccagctctatgtccgggatctccatgcaccgtgtgaaagacgcaatgctcgtggcccttaaaagcctcatgccagcctgtctgttcaacatcatcggcttcggaagtacctttaagagtcttttcccttctagccagacgtacagtgaggattctctggcgatggcatgtgatgacatacaacggatgaaagcagacatgggcggtacaaacatcctatcacctttaaagtgggtgataagacaacctgtacacagggggcatccacgtctgctattcgtgattacagacggagctgtcaataatactggaaaagttctagagctggtgcgcaatcacgccttctccacccggtgctattcctttgggatcggcccaaatgtgtgccatcgactggtcaagggtctggccagtgtctcggaaggatcggcagaacttctcatggagggcgagcgcctacagcccaagatggtgaaatccctgaaaaaggctatggcgccagtcctctctgacgtgacagttgagtggattttccctgaaaccaccgaagtgttggtaagcccagtgtcagcatcaagcctgtttcctggtgagcgcctcgtggggtacgggatcgtgtgcgacgcctctctccacattagcaacccaagatccgataagaggagacgatactcaatgctgcacagtcaggagtcagggtcctctgtgttttaccatagtcaagatgatgggcccggattggaaggtggcgactgtgccaagaactctggagccccatttatcctcggacaggccaaaaacgcaaggttggctagcggcgactcaaccaccaaacatgatctgaacctgtctcagcgcaggagagcctattccacaaaccagataactaaccacaagccgctgcctagggctacaatggcctctgatccaatgccagccgccaagcgatatccgctgcggaaggcccggctgcaggacctgactaaccagactagtttggacgtacaacgctggcaaatcgacttgcagcccttgctgaacagcggacaggacctcaaccagggccccaaactgcgaggtcccggtgcaaggcggccctctctgctgccccagggatgccagccctttcttccctgggggcaggagacacaagcttggtcacccgtgagggaacggacttccgacagcagaagccccggagacctggaaccctcgcaccacccgagcgctttcgagactgagacatcatctgattgggatcccccagcagaatctcaggaacgggcctctccgagccgtcccgccacccccgcaccggttctcggaaaagccctggtgaaagggctccatgacagccagcgtctgcaatgggaggtcagttttgagttggggacacccggaccggagaggggtggtgcacaagacgctgacctctggagcgagacctttcaccacctagccgctcgggccatcattcgcgacttcgagcagttggccgaacgtgagggggaaatcgagcaaggaagtaataggcgttatcaagtgagcgcactacacacttcgaaggcatgtaatatcatctccaagtataccgcattcgtccccgtggatgtgtccaaatcccggtacctcccaaccgtggtggagtatccaaattctgccgcactacgaatgctagggtcaagagcgctcgcccagcagtggcgcggaacatcttccggctttggtagaccccaaacgatgttgggagaggatagtgctcctggaaacggccctcgaaagtgctctcagaccctgatgggattcaaaactaaaaccgagacggagcatagtgtgcgcgggtggaagccacggggagccctgcagaatcagtcggtgctgtctacaagctggtcgcattggccaccgaaacctcgccggacatcctcaacgccagagccctcctag

SEQ ID NO: 9149 - DNA, 3663 bp, Artificial Sequence
  Description of Artificial Sequence: Synthetic coding sequence
atgcccggcctgctgaactggatcaccggcgccgccctgcccctgactgcttccgacgtcacaagctgcgtttctggctatgctttggggttaactgcaagcctcacctacggcaacttggaagctcagccattccaaggactgttcgtctatccgctagatgaatgcaccacggtaatcggctttgaggcagtaatagctgacagggtggtcactgtgcagattaaggacaaggcaaagctcgaaagcggccactttgacgcttcacatgtgagatctcccaccgttactggtaatatcctacaggacggggtgtctattgccccccatagctgtacccccggaaaggtgacccttgatgaggatctcgaaagaattctttttgtcgcaaatctgggcacaatcgctcctatggaaaatgtcaccatctttattagcacctctagtgagttgcctactctgccatctggggcagtgcgtgttctgctcccagccgtgtgtgctcccacagtcccgcaattctgcacgaagtctaccggaaccagcaaccagcaagctcaaggcaaggacaggcactgtttcggcgcttgggcaccaggttcttggaataaactctgcttggccactctcctgaacacagaagtgagcaatcccatggaatacgaattcaattttcaactggagatcagaggaccctgtcttttagcaggcgttgaaagccctacccatgaaattcgcgctgacgccgcacctagtgcacggtctgccaagtccatcattattacactggccaacaaacacaccttcgaccgacctgtcgaaattctgattcacccttccgagcctcacatgccgcatgttctaattgagaaaggcgatatgactctaggtgagttcgaccagcacctgaaaggccggactgatttcattaaaggcatgaaaaaaaagagccgcgcggaaaggaagaccgagatcatcaggaagagactgcacaaggacatcccccaccactccgtaattatgttgaatttctgcccagacttgcaaagcgtgcagccttgtttgcggaaggcacacggcgagtttattttcctcatcgatcgatcaagttccatgtcagggatttcaatgcaccgggtgaaggacgcgatgctcgtggcactgaaatcgctgatgccagcttgtctgttcaacattatcggatttggcagtacctttaaatctttgttcccaagttcacagacatattcagaagactccctggccatggcctgcgacgacattcaaaggatgaaggccgacatgggcgggactaacattctgagcccattgaaatgggtcatacgtcagcccgtgcatagaggacatccgagattgttatttgtcatcaccgatggggccgtcaataatactggcaaagtgctggagttagtgaggaaccatgccttcagtacaagatgttattcttttgggatcggccctaatgtgtgtcacagattggtgaaaggcctggcctccgtgagtgaaggcagtgctgagctcctcatggaaggagagaggctccaacctaaaatggtcaagtcccttaagaaggcaatggcccccgttctctctgacgtgacagtggagtggatcttccccgaaacgacagaggtcttggttagtcccgtttctgcctcttctctgtttcccggcgagcgcctggtagggtacggtatcgtgtgcgacgcttccttacatatcagcaatccgagatctgacaaacgcagacgttacagcatgcttcacagtcaggaatccggctcctcagttttctaccactcccaggatgatgggcccgggctggagggcggggattgcgctaaaaatagcggagctcctttcattctgggtcaagctaagaacgctagattggccagtggcgactccacaacgaagcatgaccttaatctcagccagagacggcgggcttattctacgaatcaaattactaatcacaagcctctcccacgcgcgaccatggccagcgaccccatgccggcggcaaagagatatccacttcggaaggcgcgtctacaggaccttacgaatcagacatccctggatgttcagaggtggcagattgatctgcagccattacttaactcagggcaagatcttaaccaaggtccgaagctgcgaggccccggtgccaggcggccctcgctgctgccccaggggtgtcagccatttctgccatgggggcaggaaacccaggcttggagtccagtacgtgaacggacttctgactcccgaagcccgggggatcttgaaccaagccaccacccctctgccttcgagactgaaacttcgtctgactgggaccctcctgccgagagtcaggagcgcgctagcccctcccggccagctacccccgctccagtcttgggcaaggcactggtgaagggactgcacgattcccaacggctgcagtgggaagtttcttttgaattgggtacaccaggaccggagcgggggggcgctcaggatgcagacctttggagtgaaacatttcatcacttggccgccagagccatcatccgcgacttcgagcagctggctgagagagaaggcgagatcgagcagggttctaaccgccgataccaggtgtccgcacttcatacttctaaagcctgcaacatcatttccaaatatacagcatttgtgccagtggatgtctcaaaaagccggtatctccctaccgtggtggagtaccccaactctgccgccctgcgcatgctcggaagcagggccttggcccagcagtggcggggaacatcatctggctttgggagaccccaaaccatgctgggcgaggatagcgcgcccggcaacggtaagttccaggcattaaatatggaagcaagccctactgcattgttcagcgaggccaggtccccgggccgtgaaaagcatggcgctagcgaaggcccccagaggagtcttgccacaaatacgctttcttcaatgaaggcatcagaaaacctgttcggctcctggctgaacctcaacaagtccagactactcacccgagcagcaaagggtttcctgtcaaaacccttaatcaaagctgtggaatcaacatcaggtaaccagtcatttgattacataccacttgtgagcctgcagctcgccagcggcgcgtttctactcaatgaggccttttgcgaagcgacccatatcccaatggagaaacttaaatggacctctcccttcacttgccatagggtttctcttactacccggccctcagagagtaagaccccctcaccacaactttgcacatccagcccaccgcggcatcccagctgcgactcattttctcttgaaccactcgccaaggggaaactgggactggaacctcgggccgtcgttgagcatactggaaagctgtgggccaccgttgtgggacttgcttggctcgagcattcctccgcatcttatttcaccgaatgggaactggtcgcggcaaaggccaactcatggctggaacagcaagaagtcccagagggccgcacccaaggtactcttaaggccgccgctagacaactgtttgtcttactgcgacactgggacgaaaacctcgaattcaacatgctctgctacaaccccaattacgtgtag

SEQ ID NO: 9150 - DNA, 5235 bp, Artificial Sequence
  Description of Artificial Sequence: Synthetic coding sequence
atgcggctgctgtggggcctgatctgggccagcagcttcttcaccctgtccctgcagaagcctcgcctgcttctcttcagtccctcggtggtacacctgggcgtccctctgtctgtcggggtccagttgcaagatgtaccaagggggcaagttgtcaaaggttctgtcttccttagaaaccccagccggaacaatgtcccctgtagccccaaagtggacttcacactttcgtctgaaagagacttcgccttactgagcttacaggtgcccctcaaagacgcaaagtcttgcggcttgcatcagttactgaggggaccagaagtgcagctcgtggcccactcaccgtggctgaaggatagtctgagtagaacaactaacatccagggtattaacctgctcttctcgagtaggcgtggccacctttttcttcaaactgaccaacccatttataatcctgggcagcgcgtgagatatagggtttttgcgcttgaccaaaagatgagaccctcgaccgatactataacggtaatggtcgaaaattcccacggattacgggttaggaagaaagaagtgtacatgccatcttccatcttccaggatgacttcgtgattcctgatatcagcgagcccggaacatggaagatcagcgcacggtttagcgacgggcttgagtctaattcttctacacagttcgaggttaagaagtacgtgctgcctaacttcgaagtgaagattacacctggtaaaccctacatcctgactgttcccgggcatctggacgaaatgcagctggatattcaggctcgttatatatatgggaagcccgtgcagggagtggcttatgtgcgctttgggctgctcgacgaggacggaaagaagaccttctttagagggctcgagtcacagaccaagttggtgaatgggcagagtcatatttcactgagtaaggcggagtttcaggacgctctggaaaaactcaacatggggatcacagaccttcagggactgaggctgtacgttgcagctgccattattgagtaccctggtggggaaatggaggaggcggaactgacatcttggtactttgtgtcaagcccattttcacttgatttatccaagactaagagacatttggttcctggcgctcccttcctcctccaggctcttgttcgtgaaatgtctggctcccccgcgtccggcattcctgtgaaggtgtcagccaccgttagctcacccggatctgttccggaggtccaggacattcagcagaacaccgatgggtccggtcaggtgagcatcccaatcatcatccctcagacaatctccgaattgcagttatctgtatctgcagggtctccacatcccgccatagctcgactgacagtggcggcaccgccatccggcggtccaggattcctgtcaattgagagaccagatagtcggcctccgcgggtgggtgacaccctcaatctgaatttgagggcagttggtagcggagccactttttcgcattattattacatgatcctctctcgggggcaaattgtgttcatgaatcgcgaaccaaagcgcactctgacttctgtcagcgtattcgtggaccatcatctggcccccagtttctactttgtggctttttattatcacggggatcatcctgtggccaacagcctgagagtggatgtgcaggctggagcttgcgaggggaagctcgaactctccgtcgacggcgctaagcaatatcggaacggggagtctgtgaagctgcacctggagaccgacagcttggcactagtcgccctgggtgccctcgacaccgccctgtatgctgctggctcaaagtcgcacaagcctctgaacatgggcaaagtgtttgaggcaatgaattcttatgatctcggttgcggacccggcggcggcgacagcgctctgcaggtgtttcaggcggccgggctagcattctccgatggtgaccagtggactcttagtcgaaaacgcctgtcctgcccaaaggagaaaacaactaggaagaagaggaacgtgaacttccaaaaagcgataaacgaaaagttgggccagtacgcttcgcctactgctaaacgatgctgtcaggatggcgtgaccagactgcccatgatgcgatcctgtgagcagagggccgccagagttcaacaacccgactgtcgggagccttttctgagttgctgtcagttcgccgaatcattacggaagaagtcaagggacaaggggcaggccggactgcagcgcgcacttgagatattgcaagaggaagatttaattgatgaagacgacatcccggtgcgctcttttttcccagaaaactggctgtggcgcgtggagaccgtagatcgttttcaaattctgaccctgtggctccccgactcgttgactacatgggaaatccatggactctcactttcgaagactaaggggctttgcgtcgccacaccagtccaacttagggtattcagggaatttcatttgcatctgaggctgcctatgagtgttagacgttttgaacagctcgaactgaggcccgtgctctacaactacctcgacaagaacttgacagtatcagtgcacgtgagtccagtggagggattgtgtttggcgggcgggggcggactagcacagcaggtcttggtgcccgcaggaagtgctcgccccgtggcgttctccgtggtgcctaccgccgctgccgccgttagcctgaaagtagtggcccgagggtcatttgaattccccgtgggcgatgcagtaagcaaagtgctgcagatcgagaaggaaggtgcaatacatcgggaggagctggtctacgaactgaacccactggaccatcggggcaggacactagaaatccccggcaactcggatcctaacatgatcccagacggtgactttaattcttacgtgagagtcaccgcaagcgatcctcttgatactcttggcagtgaaggtgctctcagtcccggaggggtggcttcacttctgcgcctaccccggggctgcggcgagcaaactatgatctatcttgccccaacccttgccgcttctcgatacctagacaaaacggaacaatggagtactctcccaccggagacaaaggaccatgccgtggatctgatccagaagggttacatgaggattcaacagttccggaaggcagatggaagctacgcggcgtggctgtcccgagggtcgtctacctggctgacggctttcgttcttaaagtgttgtccctagcacaggagcaggttgggggatctccagaaaaactccaggagacctcgaattggttgcttagccagcagcaggcggacgggtccttccaagatctttctcccgtcatccatagatcgatgcagggggggctggtcggcaatgatgagaccgtcgctctgacagcgtttgtcaccattgctctccatcatggactggcagtgtttcaggacgagggcgccgagcctctgaagcagagagtggaagcttcaatctccaaagccagcagcttccttggggagaaagcatcagccggactgttgggcgcacatgccgccgccattactgcgtacgcgctgacactgacaaaggccccggccgacttacggggcgtggcacataacaacctgatggccatggctcaagaaaccggagataatctgtactggggctcagtgacaggctcgcagtccaacgccgtgtcacctactccggcaccccgtaatcccagcgaccctatgcctcaggccccagccctgtggatcgaaaccaccgcgtacgcccttctgcatctgctgctgcatgagggcaaagctgagatggcagatcaggccgcagcatggttaacacggcagggctcatttcaggggggctttagaagcacgcaggatacagtcattgctctggatgctttgtctgcctattggatcgcctcacacacaactgaggagcggggcctgaatgtcaccctgagttccacaggacgcaatgggttcaagtcacatgcgctgcagctcaacaacagacagattcgcggcctggaggaagaattacagttcagtctcggttctaagatcaacgtgaaggtgggaggcaactccaaagggactctgaaggtcttacgtacctataacgtgctggacatgaaaaacactacttgtcaggatctacagatagaggtcacggtgaaaggacatgtagagtatactatggaagccaacgaggattacgaggactatgagtacgacgagcttcctgcgaaagatgacccagacgcaccgctgcagccagtcacccccctgcagctgttcgaaggaaggagaaaccgacgaagacgcgaggcacccaaggtggtggaggaacaggaatcacgtgtacattatacggtttgtatatggaggaatggcaaggtgggactgtccggtatggctattgctgacgttacactactgtctggtttccatgccttgcgtgctgatcttgaaaagctcactagtctctcagaccgctatgtgagtcacttcgagacagaaggcccacacgtgttgctgtacttcgatagcgtccccactagtagagaatgcgtgggatttgaagccgtccaggaggtcccagtcggtctcgtccaacctgcgagcgctacattgtacgattactacaaccctgagagacggtgcagcgtcttctacggcgccccatccaagagcaggctacttgctacgctttgtagcgccgaggtttgtcagtgcgcggaagggaagtgccctaggcagcgccgcgccttagaacggggtttacaggacgaggatggctaccgaatgaaattcgcctgttattacccacgggtggagtacggtttccaggtcaaggttctgagagaggattcgagagccgcatttaggttatttgagacaaagattactcaggtgttgcactttaccaaggacgtgaaggccgccgcgaatcagatgcgcaacttcctcgtaagagcgtcctgcaggcttcgtctcgagccaggcaaggagtatcttattatgggactggatggagccacctatgatctggaaggccacccacaatacctgctggacagtaatagttggattgaggagatgccaagtgagagactgtgccgctcaacaaggcagcgcgcagcctgtgcgcaactgaacgacttcttacaggaatacgggactcaaggctgtcaggtgtag

SEQ ID NO: 9151 - DNA, 1242 bp, Artificial Sequence
  Description of Artificial Sequence: Synthetic coding sequence
atgaagggcgccctgggcagccccgtggccgccgccggcgccgccatgcaagaatcttttgggtgcgtcgtcgctaacaggtttcatcagctgttagatgacgaatctgacccatttgacatcctgcgggaagccgaacgccgccgtcagcagcaattacagaggaagagacgggacgaggcagcagccgccgctggagctggaccacgggggggacgatcccctgcgggcgcgtctggccatcgcgctggtgctggcggacgccgcgaatctcaaaaggagcgcaaaagtctgccggcccctgtagcccagaggcctgacagcccgggcggcggtttacaggcccccgggcagaaacggaccccaagaagaggtgagcaacagggctggaatgattcccgcggaccagagggaatgcttgagcgggccgaaagaagaagctatcgagaatatagaccctacgagactgagagacaagcagatttcaccgcagagaaatttccggacgagaagccaggagatcgttttgatagagacagacccctaaggggtagaggcggcccccggggcggtatgcgtgggcggggtagaggcggcccaggaaatcgagttttcgacgcatttgatcagagaggcaagagggagttcgagcgatacggcgggaacgacaagatcgctgtgcgaacagaggacaacatgggagggtgcggcgtgcgcacatggggatctggtaaagacacaagtgacgtcgagccaactgctcccatggaagagcccaccgttgtggaggagtcccagggcaccccagaagaagaatcccccgctaaggttcctgagctcgaagtcgaggaggagacacaggtccaggagatgactcttgatgagtggaagaacctgcaagaacagactagacccaaacccgaattcaatattcgaaagccggaaagtactgttccgagtaaggccgtggtgatccacaagtcgaagtaccgagacgacatggtgaaggatgattacgaggacgacagccacgtttttaggaaacccgccaatgacataacaagccagctggaaattaactttggaaatctgcctaggccagggcgcggggcccggggcgggacacgaggtggacgtggtaggatccgcagggctgagaattatggccccagagccgaggtcgtaatgcaagatgtggcgcccaaccctgatgaccctgaagattttccagctctcagctag

SEQ ID NO: 9152 - DNA, 927 bp, Artificial Sequence
  Description of Artificial Sequence: Synthetic coding sequence
atgaagggcgccctgggcagccccgtggccgccgccggcgccgccatgcaggaatcatttggctgcgtggtcgccaaccggttccatcagctgctggacgatgagtcagatccttttgatatcctgagggaagctgagagacggagacagcagcagctgcagcgtaaacgaagggatgaagccgccgccgctgccggagccggcccccgggggggacgctctcctgctggggcctccggacatcgcgctggcgcgggcggcaggcgggagagccagaaggagcgtaagtccctaccagcaccggtggcacaaaggccagactcacccgggggcgggctccaggccccagggcagaagcgaactccccgccgaggtgagcaacagggttggaacgattctagaggcccagaaggcatgctggagcgcgctgagagacgcagctaccgggagtatagaccatacgaaaccgaacgacaggccgactttacagctgagaagttccccgacgagaaggtgcctgagttagaagtggaggaggagactcaggtccaagaaatgactctcgatgagtggaaaaatctgcaagagcagacgcgaccaaaacccgaatttaacattcgcaaaccagagtctaccgttcccagtaaagcggtggtcatccataagtcaaaataccgtgacgacatggtgaaggacgactacgaggacgactcccacgttttcaggaagcccgcaaatgacatcactagccagcttgaaattaattttggcaatctcccacgcccggggagaggggccagaggtggcacacggggaggtagaggcaggatcaggcgagccgagaactacggcccccgtgctgaggtggttatgcaggatgtcgcacccaacccagatgatcccgaggactttcccgcgctcagctag

SEQ ID NO: 9153 - DNA, 1437 bp, Artificial Sequence
  Description of Artificial Sequence: Synthetic coding sequence
atgccccggcggggctacagcaagcccggcagctggggcagcttctgggccatgttaaccttggtggggcttgtaacgcatgctgcccagagggctgacgtgggcggggaagccgccggcacaagtatcaatcatagccaagcagtgctacagcggcttcaggagctgttacgccagggtaatgccagcgatgtcgtgttacgggttcaagccgccggaactgacgaggtccgcgtctttcacgcccatcgtctgcttttggggctgcactctgaactcttccttgaattactgagcaaccagtcggaggcggttctgcaggagcctcaggattgcgcagccgtattcgataaatttatacgctatctgtattgtggagagctcaccgtcctgctgactcaagccatccctctacacaggttggcaactaagtatggcgtgtcaagtctgcagaggggggtggcagattacatgagggcgcacctggctggcggcgccggccccgccgttggctggtaccattacgccgttggaaccggggacgaagccctaagggagtcctgtcttcagtttctagcctggaatctttctgctgtggccgccagcacggaatggggggcagtgagccctgagctgttatggcagttgctgcagaggagcgatctcgtgctccaggatgaattggagctgtttcatgccctggaagcctggctcggacgcgccaggcccccccccgctgtggctgagagggccctccgggctataaggtatcccatgattcctccagcccagctatttcagctccaagctagaagcgctgccctggctcggcacgggccggcagtggctgacctcctgctccaggcctaccagttccacgctgcatccccgcttcattacgctaaattcttcgacgtcaacgggtccgctttccttcccaggaattacctggcccccgcttggggcgctccttgggtgatcaataacccggcccgggacgaccgatcaaccagtttccagacgcaactgggtccaagtgggcacgacgcaggtcgacgggtcacttggaacgtgctgttctcgcccaggtggttaccagttagcttgaggcccgtgtatgccgacgccgcgggaacagccctgccggctgcccgtcccgaagacgggaggcctcggctggttgttaccccagccagcagtggtggggatgctgccggtgtgtcctttcagaagaccgtgctcgtgggggcccgacagcaggggagattgctggttcgccacgcctactcctttcatcaatcctcagaggaagcaggcgactttctagcccatgccgacttacagcgcagaaattccgaatatctggtggaaaacgcactgcatctccatctaatagtgaagccagtgtatcacacgcttatccggaccccaaagtag

SEQ ID NO: 9154 - DNA, 477 bp, Artificial Sequence
  Description of Artificial Sequence: Synthetic coding sequence
atgtgctgccccggcggccactacaccctgatcctgcggcggggcaatcggtttaggcgggagaagcggcctgcaaaagttacaggtgcccaaaccgaagtccagctggctcctccactgccgagagggcgagcaaggcgaagtccatggagcgtcccaatcagcctctctatcgatcggttggagttcgacctcttgtatcccgccattaaaggcgataccatccagttatacctgggagcaaagctcctggatagccagggcaaggtgacaaagtggttcaataactccgctgcctcgcttactatgcctaccctggacaatatcccgttctcattaattgtgtctcaggatgtagtcaaagccgccgtagcagcagttctgagccccgaagaattcatggttttactcgactcggtgctccctgagagcgcccacagactgaagagcagcatcggacttatcaacgagaagtag

SEQ ID NO: 9155 - DNA, 771 bp, Artificial Sequence
  Description of Artificial Sequence: Synthetic coding sequence
atgttccagaccggcggcctgatcgtgttctacggcctgctggcccaaacgatggctcagtttggtggtttgcctgtgcctctcgatcagaccttgcctttgaacgttaaccccgcacttcccctgtcccccacgggactggcaggatctctcacaaatgccctgtcaaatggactgttgtcgggcgggttactcgggatactcgaaaacctgcctctgctcgacatcctcaagccgggcggggggactagcggtggactgctcgggggtcttctcggcaaagtgacatccgttatcccgggcctgaacaatatcatcgatatcaaagtgaccgaccctcagcttttggaactgggcctggttcagtcacctgatggccacagattatacgttacgattccactgggaattaagctgcaggttaatacacccctggtgggggctagcctgctgcgcctggcggtgaagcttgacatcactgcggaaattctggccgtgcgggataagcaggaaagaatccatttggtgctcggagactgcacccattcacctggctctctacagatttcactgctggacgggctagggcccctccctattcaaggtctgcttgactctctgactggaattttgaataaagtgctgcctgagctcgtgcaaggtaacgtgtgccctcttgtgaatgaagtcctgcgaggattggatatcactctggttcacgatattgtcaatatgctgatccacggcctgcaattcgtaatcaaggtgtag

SEQ ID NO: 9156 - DNA, 771 bp, Artificial Sequence
  Description of Artificial Sequence: Synthetic coding sequence
atgttccagaccggcggcctgatcgtgttctacggcctgctggcccagaccatggcccaattcggcgggttgcctgtgccccttgatcagacccttccgctcaatgtcaatcctgctttacccctgtcacccacaggactcgcgggatctctaacgaatgccctgtctaatggactgctgagcggcggcctgctcggaatcctggagaaccttcctctcctagatatcctcaagccgggcggcggcactagcggcgggctgctcggcggacttctaggcaaagtgacatccgtgatcccaggccttaacaacattatagacatcaaggttaccgacccgcaattgctggaactaggactggtccagtcgccggacggccaccgactgtatgtgactattcctctggggatcaaattacaggtgaacacacctttagtgggggctagcctcttgaggctagctgtgaagctggatattacagcagaaatcttagccgtccgggataagcaggagcgcattcacttggtgctcggagactgtacacactcacccggcagcctgcagatcagtctgctggatgggctgggccctctgccaatacagggtttgctcgattctttaacgggcatcctgaataaagttctgccagagctcgtacaaggaaatgtgtgccccctcgtgaatgaggttctacgtggcctagacatcactctggtgcatgacattgtcaatatgctaatccacgggttgcagttcgttattaaagtgtag

SEQ ID NO: 9157 - DNA, 657 bp, Artificial Sequence
  Description of Artificial Sequence: Synthetic coding sequence
atgatgtgccccctgtggcggctgctgatcttcctgggcctgctggcattgccccttgccccacacaagcagccatggccaggtctggctcaggcccatcgggataataaatctactctggctaggatcattgcccaggggctcatcaagcacaatgcggagagtcgcattcaaaatatacacttcggggatcggttaaacgcatccgcccaggtagcccccggactggtgggctggctaatatctggaaggaaacatcaacagcagcaggaaagccgctcctttgacaataatatcgttaaaatgtgcgcgcacatgtctatcgtggtggaattttggttagaaaaggatgaatttggacggagagatctggtcatcggcaaatgcgatgcggagccaagcagcgttcatgtggcgattctgaccgaagccattccgcctaaaatgaaccagttcctgtataatctcaaggagaacctgcaaaaggtgctgccccatatggttgaatctcaggtttgcccgttaatcggggagatcctcggacaactggatgtaaagcttctgaaatcattaatcgaacaggaagcggctcatgagcctactcaccacgaaacatctcagccaagcgcttgccaggcaggggagagcccttcatag

SEQ ID NO: 9158 - DNA, 765 bp, Artificial Sequence
  Description of Artificial Sequence: Synthetic coding sequence
atgatgtgccccctgtggcggctgctgatcttcctgggcctgctggctcttcctctcgcaccccataaacagccatggccaggcctagctcaggcccatagggacaacaaatccacccttgcccgcataatagcacagggtcttattaaacacaacgccgagagcaggatccagaatatccacttcggggaccggctgaatgcatctgcccaagtggctcctggtcttgtgggctggctcattagcggtaggaagcatcagcagcagcaagagtcttctattaacattaccaatattcagctggattgtggaggcatccaaatcagtttccacaaggaatggttcagtgccaatatatctctggaatttgacctcgaactgcgtcccagctttgacaataatatcgtgaagatgtgtgcacacatgagcatagtggtagagttttggctggaaaaggatgagttcgggaggcgggacctggtgatcggcaagtgtgacgctgaacccagctccgtacatgtggcaattctcaccgaggctatcccccccaagatgaaccagtttctctataatttgaaagagaatttgcagaaagtgctgccccacatggtcgagtcccaagtttgtccattgataggcgagatcttgggtcaattggatgtcaagctacttaagtcactgatcgaacaggaggccgctcatgaacccacccatcacgagacctctcagcctagtgcctgtcaggcaggagagtctccgagctag

SEQ ID NO: 9159 - DNA, 1635 bp, Artificial Sequence
  Description of Artificial Sequence: Synthetic coding sequence
atgaagatcagcatgatcaactacaagagcctgctggccctgctgttcatcctggctagctggatcatcttcaccgttttccagaacagtacaaaggtgtggagtgccctgaacctttctatctccctccactactggaataattcaactaaaagcctgttccccaaaacccctctgattagcttaaagcccctgaccgaaactgagctgcgtataaaggaaattattgagaagctagaccagcagatccctccaaggcctttcacccacgtgaataccaccacaagtgctacacactcaaccgccaccatcctgaatccgagggatacgtattgtaggggggaccagttacatatcctactggaggtcagagaccatcttggaagacgaaagcagtatggcggtgattttttgcgggctaggatgtcttcccccgcacttatggccggcgcgtcaggcaaggtgacagacttcaacaacggtacttatctcgtctcctttactctcttttgggaagggcaggtgagcctgtcactactgttgatccacccgagcgaaggggtgagtgccctgtggtctgcgcggaatcaagggtatgatcgggttattttcactgggcagtttgtcaacggcacctctcaggtgcacagtgaatgcggtctgatcttaaataccaatgcggaactctgtcagtatctagataaccgcgaccaggagggtttctactgcgtgagaccccagcacatgccatgtgccgctctaacccatatgtactctaagaacaagaaggtctcgtatctttcaaagcaagaaaagagtctctttgagcggtcaaatgtcggcgtggagataatggaaaagttcaacaccatctccgttagcaaatgcaataaggagaccgtcgccatgaaggaaaagtgtaaattcggcatgacaagcacgattccaagtgggcatgtgtggaggaatacgtggaacccagtttcttgctcattagccacagttaaaatgaaggagtgtctccggggcaaacttatctatcttatgggcgactccaccattaggcagtggatggagtacttcaaagccagcattaatacactaaaatccgttgatctgcacgagagcgggaaactgcagcaccaactggccgtggatctcgaccggaacattaatatacagtggcagaagtattgttaccctctaatcgggtctatgacctactcagttaaggaaatggagtacctgactagagctatagacagaaccgggggcgaaaagaacacagttattgtgattagccttggtcaacattttcggcctttccctattgatgttttcatccggagggctctcaatgtgcacaaggcgattcagcatctgctcctgcgtagccccgacaccatggtcattataaaaaccgaaaatattcgtgagatgtataatgacgccgagcgcttctctgacttccatgggtacattcagtacctgatcattaaggatatatttcaggacctgtccgttagcatcattgacgcttgggacataactattgcgtatggaacgaataacgtgcacccaccccagcatgtggtgggtaaccagattaacattctcctcaactacatctgttag

SEQ ID NO: 9160 - DNA, 1845 bp, Artificial Sequence
  Description of Artificial Sequence: Synthetic coding sequence
atgtggatggcctggtgcgtggccgccctgagcgtggtggccgtgtgtggcacctctcatgaaaccaataccgtgttgcgagtcaccaaagacgtgctctccaatgccatcagtggtatgttacagcagtctgatgcgctgcattcagccctgagagaagtcccgcttggggtgggcgacataccctacaacgacttccatgttcgaggcccccccccagtctacactaacggaaaaaagctcgacgggatctaccagtatggccacatagagaccaacgataacactgctcagctcggcggaaaatatcgttacggtgagatcttggagagcgaggggtcaatcagggacctacggaacagcggataccggtcagccgagaatgcctacggtggtcacaggggactcggccgctacagggctgcgcccgttgggaggttacaccgacgggaactgcagccaggagaaatccctccaggcgtcgcgaccggagccgtgggtcccgggggcttgctcggcaccggtgggatgctggccgcggatggcattcttgctggtcagggaggtctgttagggggaggcggcctcctcggcgacgggggactcctggggggtgggggtgttctcggggttttaggtgaaggtggtatattgtctaccgtccaggggattaccggactgaggattgtcgaactcacacttcctcgcgtgtcagtccgcctgctccccggggttggggtgtacctcagtctctatactcgcgtcgccattaacggcaaatcgctgattggctttttagacattgctgtagaggttaacattactgccaaggtgagattgaccatggaccgaaccggttacccacgattagtgatcgaacgctgtgatacgttgcttgggggcataaaggttaagctgctgagggggctgttgccaaacctagtggataatcttgtgaaccgggtcctcgcagacgtcctgccagatctcctttgccctatcgtcgatgtggtcctggggctcgtgaacgatcagctgggcctggtcgatagccttattccgcttggaattctggggtcggtccagtacactttttcaagcctacctctggtgactggcgaatttttggagttggatctgaatactttggtgggcgaagccggggggggcctgattgattacccactgggctggcccgccgtctccccaaaacctatgcctgagctcccaccgatgggcgacaacaccaagagtcagttagccatgagcgccaatttcctaggatcggtactcactctgctccagaaacagcatgccctggacctagacatcactaatggcatgtttgaagagcttccacctctgaccactgcgacattgggagcgcttatcccaaaggtctttcagcagtacccagaatcgtgcccacttattatacggattcaggttctgaacccaccatctgtcatgctccaaaaagacaaagccctcgtcaaggtactagctaccgccgaggtcatggtctcacaacctaaagatctcgaaaccacgatttgcctcattgatgttgacaccgaattcctggcctcatttagtacagagggtgataagctgatgattgacgcgaagttggagaaaacatcactgaatctgcgaaccagcaatgtcggtaattttgacatcggcttaatggaggttctcgtagagaagattttcgacctcgccttcatgccagccatgaacgccgtgctggggtcaggagtacctctgccgaagattctcaacattgatttcagcaacgccgacatcgatgtcctggaagatttgttggtgctgtccgcctag

SEQ ID NO: 9161 - DNA, 1431 bp, Artificial Sequence
  Description of Artificial Sequence: Synthetic coding sequence
atgcagcccgtgatgctggccctgtggagcctgctgctgctgtggggactcgcgactccctgccaagaactgttggagaccgtcggcacgctcgccaggatcgacaaggacgagctggggaaggcgatccagaacagtctggtcggcgagcccatcctccagaatgtgctaggatccgtcacggccgtcaatcggggtctgctgggaagtgggggcctgctggggggaggcggtttacttgggcatgggggggtcttcggagtggtggaggaactctcgggccttaagatcgaggagctcactctacctaaagtgctcctaaaactactcccaggttttggtgtccaactgtcattgcacacaaaggtcggcatgcattgttctggtccattgggcggactccttcaactggccgccgaagtaaacgtgactagccgagtggccctcgcggtgtcatcacggggcactcccatcttgatcctgaagcgttgcagtactctgctgggccacataagtctgttctccggattactgccaacacccttgttcggcgttgttgaacagatgttatttaaggtgctgccaggtctgctgtgtcccgtcgtggatagcgttctgggggtcgttaatgaattgctcggtgccgtgctgggactcgtgtcattgggagcactcgggtctgtcgagttttcattagctacactcccgttaataagcaaccagtacattgaattggacatcaatcccattgtgaaatcagtcgctggtgacatcatcgacttccccaaaagtagggccccagccaaggtcccccctaaaaaggatcataccagccaggtgatggtgccactctatctgttcaataccacgtttggactgttgcagaccaatggggccctggatatggacattactcctgagttggtgccatctgacgtgccacttaccaccaccgacctagcggcactgctgcccgaggccctcggaaagctccccttgcaccagcaactcctgcttttcttgcgtgtcagagaagccccaacggtgacactgcacaacaaaaaggccctggtgtcactgccagccaatattcatgtcttgttttacgtgccaaagggtactcctgaaagtctgtttgagcttaatagtgtgatgactgtgagggcccagctggcaccttctgccacaaagctgcatataagcttatcccttgaacggctctctgttaaagtggctagctcattcacccatgccttcgatggatccagacttgaagaatggttgtcccatgtcgtcggggccgtgtacgcaccaaagctgaatgtggctttagacgtgggtattccgctccctaaagttctcaacatcaacttctcaaattccgtactggagatcgtcgagaatgcggtcgtgttaacggtagcttcttag

SEQ ID NO: 9162 - DNA, 585 bp, Artificial Sequence
  Description of Artificial Sequence: Synthetic coding sequence
atgcaggacgcccccctgagctgcctgagccccaccaagtggagcagtgtgagttctgcagacagcaccgagaagagcgcaagtggggccggtacccgaaatttacctttccaattctgtttgcgccaggcgctgagaatgaaggctgctggcattctgactctgattgggtgcctggtcactggtgcagaaagtaaaatctatacccggtgcaaactggccaagatcttcagtcgggctggcctggataattattggggatttagccttggaaattggatatgtatggcatactacgagagcggttataacaccaccgctcagaccgtgctggacgatggaagcatcgattacggcatcttccagattaattcatttgcatggtgtcggaggggtaagctcaaagagaacaaccactgtcacgtggcctgctccgcattaatcaccgacgacttgaccgatgccataatatgtgctcgcaaaatagtgaaagagactcaggggatgaattattggcagggctggaagaagcattgtgaaggacgcgacttaagcgaatggaagaagggttgtgaggtatcatag

SEQ ID NO: 9163 - DNA, 1266 bp, Artificial Sequence
  Description of Artificial Sequence: Synthetic coding sequence
atgggcttcctgagccccatctacgtgatcttcttcttcttcggcgtaaaggtgcactgtcagtacgagacatatcagtgggacgaggattacgaccaggaacctgatgacgactaccaaacgggttttccttttagacagaacgttgactatggtgtacccttccatcagtatacgcttggctgtgtttccgaatgcttttgcccaaccaatttccccagtagtatgtattgcgacaatcggaaacttaagactatcccaaatataccaatgcacatccagcaattgtatctgcaattcaatgaaatcgaagctgtcacggcgaattccttcataaacgctacccatttaaaagagatcaatctgtctcataataagattaagtcacaaaagattgactacggcgtgttcgcaaagctcccgaacctcctccaattgcacctcgaacacaacaacctggaggaattcccctttccactgccgaaaagcttggagcgtttgctgctgggatacaatgaaattagtaagctgcagactaacgcaatggatgggttggtgaacctcactatgctcgacttatgttataactacttacacgacagtctgttgaaggacaagattttcgcgaaaatggagaaacttatgcagctcaacctgtgcagcaaccgcctagagtcaatgcctccaggccttccgagcagcctcatgtacttgtctctggagaataacagtatcagcagcataccagaaaagtacttcgataaactccccaagctgcataccctgcggatgtcacacaacaagttacaggacattccatataacatattcaatctcccaaacatcgttgagctgtctgttggtcataacaaactcaaacaggcattctacataccacgcaatctcgaacatctgtatctccagaataacgagatagaaaagatgaatttgactgtgatgtgcccgtccattgacccgctgcactaccaccacctgacgtacatacgggtagatcagaataaactgaaagagcccatttccagctacatttttttctgttttccacacattcacactatatactatggggaacaaagatccacaaacggccagacgattcagctgaaaacccaagtattcaggcgctttcccgatgatgacgatgagtcagaggatcacgatgatcctgataatgcacacgagtcgcccgagcaagagggtgcagagggtcactttgatcttcattactacgaaaaccaagagtag

SEQ ID NO: 9164 - DNA, 252 bp, Artificial Sequence
  Description of Artificial Sequence: Synthetic coding sequence
atgctgtgctgctgccccctggccgacgccctgctgatcttcctggagaccggctcatgttttcagccgggccagcagagcgagactctttcacagaaacagaataaaaccaataataagaagtgggctggcggggccggatgtcgtccatttcgactttggtgggtgggccgctcccgcggcgctggagtgcagttgtatagcacgaagaagggatggatcctgcggggcaaggggggaacagaggcttag

SEQ ID NO: 9165 - DNA, 2559 bp, Artificial Sequence
  Description of Artificial Sequence: Synthetic coding sequence
atgctgcccaccgaggtgccccagagccaccccggccccagcgccctgctcctgctgcagctcctgctgccccccacaagcgccttctttccaaatatttggtccctcctcgccgcacctggcagcatcacgcaccaggacctgaccgaggaggctgccttgaatgtaacacttcagctgttcctggagcagccccctccggggcgaccacctctgaggctcgaggatttcctgggccgcacacttttggcggatgacttatttgccgcgtatttcggccctggaagctcgagacgcttccgcgcagcactgggtgaggttagccgagccaatgccgcccaagacttcctgccaaccagccgcaatgaccccgacttgcattttgacgccgaacgtttgggccaggggcgcgcacgcctcgtgggggccttgcgggagacggtggtggccgcacgcgctctggatcacaccctcgcacgacagaggcttggagctgccttgcacgccctccaggatttttactcgcattccaattgggtggagctgggggaacagcagcctcacccccatcttctttggccgcgccaggaactgcagaacctggcccaagtcgcagaccctacctgctccgattgcgaggaactctcttgccctaggaactggctgggcttcactttacttacctccggctactttggcacccacccacctaagccaccgggcaaatgctcacacggcggacattttgaccggtcaagttcacagcccccgagagggggaattaacaaggactccacctcccccggctttagcccacatcatatgcttcatctgcaggccgcaaaactggcccttctagcttctattcaagcattcagtctgcttcgctcacggctgggggacagggacttctcccgcttgctagacattacgccagcctcatccctgtcctttgtgctggacaccacaggcagcatgggcgaagagattaatgccgcaaaaatccaggcccggcatctagttgaacagaggagggggtctcctatggaaccagtacattatgtgctggtgccttttcacgaccccggattcgggcctgtctttactacttccgacccagactcattctggcagcagcttaacgagatacatgcccttggcggaggggacgagcctgagatgtgtctctctgctttacaactggcccttctgcacacacctcccttatctgacattttcgtcttcaccgacgcaagcccgaaggacgccttcctaactaatcaggtggaatctttgacacaggagcggaggtgtcgggtcaccttccttgtcacggaggatacatcacgcgttcaagggagggcgcgacgcgagattctctcgcccctcagatttgagccttataaagctgttgctctggcctcaggaggagaggtgatttttactaaagatcaacacattcgtgacgtggccgcgatcgttggggagtctatggctgctctggttacactccccctcgatcctcctgttgtggtaccaggccagccgctagtattcagcgtggatggattgctccagaagataacagtcaggatacatggcgacattagttcgttttggatcaagaatcccgccggggtatcacaggggcaggaagagggtggaggaccactcggccacaccaggcgatttggccagttctggatggtgactatggatgaccccccacagacaggcacttgggaaattcaagttacggctgaggatactccaggggttagggtccaagcacagacttccctggactttctctttcacttcgggattcctatggaagatggcccccatcccggcctatatccactcacgcagcctgtagcaggtctgcagacacagctcttggttgaagtcactgggttgggatctagggcgaaccctggcgatccccagcctcacttttctcacgtgatcttacgtggagtaccagagggcgcggagcttgggcaggtgccactggaacccgtcggaccaccagaaaggggcctgctggcggcaagcctgagccctacactgctgagcacaccccgtcctttttctctagagcttatcggacaggatgcagcaggccgacgcctgcatagggcagcgcctcagccatctactgtcgtgccggtattgctggagctgtcaggcccctctggtttcctagcccccggctccaaggtgccactgagcctgagaatcgcgtctttttccggtccgcaggacctggatcttcgtacgttcgtgaatccctcattctcgctgaccagtaacctgagcagggcccatttagaattaaatgagagcgcatggggccggctgtggctggaggtgccagatagtgccgccccagatagcgtggtaatggtcacggtgacagcgggaggccgggaagccaaccccgttccccccacacacgcgttccttagactgctggttagcgccccagctccacaggtaaggaaccactactttcctagccaaggccccgcacaccacccatatcggctgatctag

SEQ ID NO: 9166 - DNA, 2676 bp, Artificial Sequence
  Description of Artificial Sequence: Synthetic coding sequence
atgctgcccaccgaggtgccccagagccaccccggccccagcgcccttctactgctgcagcttctgctaccacctacatctgctttctttcccaacatttggagtctactagccgctcctggaagcatcacccatcaagacttaaccgaggaggccgccctcaacgtcaccctccagctctttttagagcagccaccacctggccgacctcccctacgtctggaagacttcctcgggagaacactgctggccgatgacttgtttgctgcatactttggtccaggtagctctcggcggttccgagcagccctaggcgaagtgtcacgagcgaatgccgcccaagatttcctccctaccagcagaaacgatccggacctgcacttcgacgccgagcggttaggccaggggcgggctcgcctagttggagccctccgcgagacggtggtcgccgcccgggctttggaccacacgcttgccagacaaagattgggcgccgccctgcacgccctccaggacttctacagccacagtaattgggtcgagctgggcgagcagcagcctcacccgcatctcctctggcccagacaggaattgcagaacttggctcaggtcgccgacccgacatgctccgattgcgaagaactgtcatgtccgagaaattggctggggttcaccctgctgacatctggctacttcggtacgcaccctccaaaaccacctggcaaatgttcccatggagggcactttgatcgctctagctcccagcctccccgcggtggaatcaacaaagactctactagccctggattctccccccaccatatgttacacctgcaggccgccaagctggcccttctggcaagcatccaggccttttccctactgcgctcccgcctgggcgacagagacttctcacggttgctggatattacaccagccagtagcttaagtttcgttctggacacaaccggctctatgggagaggagatcaatgctgcaaagatacaggctcggcatcttgtagagcagcgccgaggcagtcctatggagcccgtccactacgtactggttccgtttcatgatccaggattcggccccgtttttaccacctccgatcccgattcattctggcagcagctgaacgaaatccatgctcttggcgggggtgacgagcctgagatgtgcttgtctgctctccagctggccttgctacatactccgcccttgtccgatatcttcgttttcacggacgcttctcccaaagatgccttcctgacgaaccaagtggagtcacttactcaggagcgaagatgcagagtaacgttcttagtgaccgaagacacctctcgggttcagggtcgggctagaagagagattctgtcacctcttagatttgaaccctataaagcggtggccctggcgtccggtggagaagttatctttaccaaagaccagcatattcgggacgtggccgctattgttggagagagcatggcagctctagtaaccctgcctttagacccgccagtggtcgtgcctggccaacccctggtttttagcgttgatggcctcctgcagaagataacagtgaggatccacggggatatctcctccttttggattaagaatccagccggagtgtcccaggggcaggaagaggggggaggaccactcggacacacacggcggttcggacagttctggatggtgacaatggatgatccaccccaaacaggcacctgggagatacaggtcaccgccgaagacacccccggggtgcgcgtacaagcccagacatcactggactttctgttccacttcgggattcctatggaggacggtccacaccccgggctgtaccctctcacacaacccgttgctggtttgcagactcagctgttagtagaagttactggtctgggaagcagggctaatcctggagatcctcagcctcacttctctcacgtgatcttacgcggtgtccccgaaggcgctgagcttggacaagtgcctctggagcccgtgggccctcctgagaggggactgctcgccgctagtctgtctccaaccctcctctcgaccccaagacccttttccttggagctgataggccaagacgcagcgggccggaggttgcatagagcagccccacagccatcaacagtcgtccctgtcctgctcgaacttagtggcccctcgggctttctggcacccggtagcaaggtccccctttctctgcgaatcgcttcattttccggacctcaggatctggatctccgaacctttgtcaatccgtccttcagtcttacaagcaacctgagtagggcccaccttgaactgaatgagtcagcctggggccgcctttggctggaggtccctgactccgccgctcccgatagtgtggtgatggtaacagtgacggccggaggcagggaagccaatcccgtccctcccacacacgcatttctgagattgctagtgagtgcccctgctcctcaggatcgtcatacgactcccactggaagttccgaccctatacttacaactgctacacccgccttttccccctttactttggtgacacaggggcgagcgggggctggattagccgctgggagcccgtggtgggggacagtgggcggcgtgctcctgctgttaggtttggctagctggtag

SEQ ID NO: 9167 - DNA, 552 bp, Artificial Sequence
  Description of Artificial Sequence: Synthetic coding sequence
atggtgcggatctggaccaccatcatgatcgtgctgatcctgctgttgcgcatcgggcctaataaaccttccttgtctggccggcaggcacccgcccaggcccaaacgtcagatctggtcccctccctgttcccattaggattgtgggcaccggggttttgtacatggagttccccagatgaggataaacgcccaagaaagcccgtaccaggcaccggcaatcgagactccgggactcggagaagactgcaggatgccactgagcaggacccacggccagggaatgatgtcgccagcgctgaaaccgccggacccccttctccttcaggaataagggctcaggaccgggcccctaggcaccgtagggccccgccagcccgcatgcccgtagccccagcaccctcagcagacggagagcccctgcaggagcaggggggcgggctattccaccggacaagatcagtgtacaacggcctcgagctgaacacatggatgaaggtcgaacgactgtttgttgaaaagttccaccagagttttagtttagataactag

SEQ ID NO: 9168 - DNA, 444 bp, Artificial Sequence
  Description of Artificial Sequence: Synthetic coding sequence
atggccggccccgccggcagccagagcctgggccccctgtgcttccacagctctccgcaagcgttgtatacagtcctcttgattgtccttgtcatgatgtctcttgtcttcggaaagttcgtacctgtgaactgggagcctccgcagcccctcccattccccaagtacttacgatgctacaggtgtctcctcgaaacgaaggagttgggatgcctgctgggctcagacatttgcctgacccccgccggatcctcgtgcattacactgcacaagaaaaattctagcggatccgacgtgatggtcagcgactgccgttcaaaggaacagatgagtgattgctctaatacaagaactagtcctgtgtcaggtttctggatattctcacagtattgcttcctggacttttgcaatgatccacagaatagagggttgtacaccccatag

SEQ ID NO: 9169 - DNA, 447 bp, Artificial Sequence
  Description of Artificial Sequence: Synthetic coding sequence
atgcagaccttccccgtggccggcgccctggaccccgccatcctggatacttcctctcctcaagctctgtatactgtcctgctgattgtactggtgatgatgtccctggtgttcggaaaattcgtgccagtgaattgggaaccgccccagccactgccattcccaaagtatctacgttgctaccgctgtctcctcgaaaccaaagagctgggctgccttctgggtagcgacatttgcttgaccccagccggctcaagttgtataactctgcataaaaagaacagctctgggagcgatgtgatggtgtccgattgtcggtcgaaggagcagatgtctgactgtagtaacacacggacctcaccagtaagcggattctggatcttctcacagtactgcttcctggatttttgcaacgacccacagaacaggggactgtatacgccctag

SEQ ID NO: 9170 - DNA, 606 bp, Artificial Sequence
  Description of Artificial Sequence: Synthetic coding sequence
atgaaggtgcacatgctggtgggcgtgctggtgatggtgggcttcacagtaggcaaagtgcccgttccagacattagaacctgccacttctgtcttgtagaggacccctcagtcggctgtatttctgggtctgagaaatgcaccatcagtagctcttccctgtgcatggtgattacaatttattacgacgtgaaagttcgctttatcgtgcgcggctgtgggcaatatatctcctaccgatgtcaggaaaaacgcaacacctactttgcagaatactggtatcaggcccagtgttgccagtacgactactgcaacagctggtcctctccacagctgcagagttctcttcccgaacctcacgataggccgttggcactgcctctgagcgattcccagattcagtggttctaccaggctctgaacctcagcctcccactacccaacttccacgccggaacggaacctgatgggttggatccaatggtgactttatccctgaatttgggcctgtcgtttgcagaattacggaggatgtacttgtttctaaactcaagcggactgttagtcttaccccaggctggtctgctcaccccccacccaagctag

SEQ ID NO: 9171 - DNA, 345 bp, Artificial Sequence
  Description of Artificial Sequence: Synthetic coding sequence
atgctgggcggcgaggaggcccggcccaacagctggccctggcaggtatctttacagtatagctcaaatgggcagtggtatcatacttgtggggggagcctcattgctaattcttgggtgctgactgcagcacattgcattcgccagatcattaaagcccacaaggtattgcagaggtgctcattgatcctctttttcgtaagagatctgtgctcaagccagctggagcttaccggcgtctctgcgggtagttcgggaatttatagagtgatgcttgggcagcataacctatatgtggccgagtccgggtctctggccgtctctgtgtccaagatcgtggtttag

SEQ ID NO: 9172 - DNA, 810 bp, Artificial Sequence
  Description of Artificial Sequence: Synthetic coding sequence
atgatccggaccctgctgctgagcaccctggtggccggcgccctgagctgtggggtcagcacttacgctccagatatgagccgcatgttgggcggagaggaggctcggcccaacagctggccctggcaggtcagcctgcagtactcctctaacgggcagtggtatcacacctgtggtgggagcctcattgcgaacagttgggttctgaccgcagcgcactgtatcagttcaagcggcatctaccgcgtgatgctgggacagcacaacctctatgttgccgaatcaggtagcttggctgtcagcgtctccaagatcgttgtacataaagattggaattctgatcaagtgtctaaaggcaatgatatagctctgcttaagctcgccaatcccgtcagcctcaccgacaaaattcaactggcctgcttacccccagcaggtaccattctgcccaacaactacccatgctatgtaacggggtggggtcgcttgcagaccaacggcgctttgccagatgatctcaagcagggccagttacttgttgttgactatgccacttgctcatctagcggatggtgggggagcactgtcaagaccaatatgatttgtgctggtggcgatggggtcatctgtacctgcaacggggactccggcggccctctcaattgccaggcctccgacggaaggtgggaagttcacggaattggctctcttacaagtgttttggggtgcaattactattacaagccctccattttcaccagggtgtcaaattacaacgattggatcaacagtgtgattgctaacaactag

SEQ ID NO: 9173 - DNA, 567 bp, Artificial Sequence
  Description of Artificial Sequence: Synthetic coding sequence
atgttccaccagatctgggccgccctgctgtacttctacggcatcatactgaactcgatttatcaatgtcctgaacatagtcaactgacgacactgggggtggacgggaaggaattccctgaggtccatctgggtcaatggtacttcatcgctggggccgctcccactaaagaggagctcgcaacctttgacccggtagataatatcgtgtttaacatggcggctggcagcgctccaatgcagttacacctcagagctaccatccggatgaaggatggactgtgtgtaccacgaaaatggatataccatctgacagagggctcgacagatctacggaccgagggccgccccgacatgaaaaccgaactgttctcgtcctcctgccctgggggcataatgcttaatgaaacaggtcagggctatcagcgctttctcctgtacaacagaagcccacacccccctgaaaagtgtgtggaagagttcaagtctctgacctcctgcctggacagcaaggcatttctcctgaccccgaggaatcaggaggcctgcgagctaagcaacaattag

SEQ ID NO: 9174 - DNA, 390 bp, Artificial Sequence
  Description of Artificial Sequence: Synthetic coding sequence
atggccgccggcagcgcccccatgcagctgcacctgcgggccaccataaggatgaaagacggattatgtgtcccacgtaagtggatatatcacctgactgagggatctactgatttacggacggaaggacgacccgatatgaaaaccgaacttttctcgtctagctgtccaggggggatcatgctgaatgagactggtcaggggtaccagaggtttttactgtacaacagaagtccacaccctccagagaagtgtgttgaggaatttaaaagtttgacgagctgtttagattccaaagccttccttctgacgccaaggaaccagggtaaagggctgaagtcacacaagacagggctgggactgacaaagagtagcggagtgaccggctag

SEQ ID NO: 9175 - DNA, 351 bp, Artificial Sequence
  Description of Artificial Sequence: Synthetic coding sequence
atggccgccggcagcgcccccatgcagctgcacctgcgggccaccattagaatgaaggatggactctgtgtgccgcggaaatggatttatcatttgacagaaggatccacggacctccggaccgagggtagacctgatatgaaaactgaattatttagctcctcttgtcctggaggcattatgttaaatgaaacaggacaaggctatcagaggtttctcctgtataacaggtcccctcatcctccggagaagtgcgtggaagaatttaagagtttgacatcctgtctggattccaaagcatttttgctaaccccccggaaccaagaagcctgtgaattgtctaataattag

SEQ ID NO: 9176 - DNA, 435 bp, Artificial Sequence
  Description of Artificial Sequence: Synthetic coding sequence
atgatccggaccctgctgctgagcaccctggtggccggcgccctgtcctgcggagacccaacttatcccccatacgtgactagggttgttgggggcgaggaggcgcgaccaaattcttggccatggcaggtatcactgcaatattcaagcaatggcaagtggtaccacacctgcgggggaagccttatcgctaattcatgggtgctgacggcagctcactgcatctcccagagcatggttcagtgcgcacataaggttcttcagagatgcagcctgattctgtttttcgtgagggatctgtgcagcagccagttggaactgactggcgtctccgccggttcctcccggacctacagggtaggactagggcggcataacctgtatgttgctgaatcagggtcacttgctgtgtccgtttccaagatagtggtttag

SEQ ID NO: 9177 - DNA, 204 bp, Artificial Sequence
  Description of Artificial Sequence: Synthetic coding sequence
atgaagctgctgctgctgaccctgaccgtgctgctgctgctgagccaactgactcccggaggcacacagaggtgctggaacctttacgggaaatgccgctacaggtgttcaaaaaaggagagggtgtacgtttactgtatcaacaataaaatgtgctgcgttaagcctaagtaccagcccaaagaacgctggtggcctttctag

SEQ ID NO: 9178 - DNA, 231 bp, Artificial Sequence
  Description of Artificial Sequence: Synthetic coding sequence
atgaagctgctgctgctgctgctgaccgtgaccctgctgctggcccaggttacccccgttatgaagtgctggggaaagtctggccgctgccgcaccacttgcaaggagtcagaagtgtactacattctttgcaagacagaggcaaaatgttgcgttgatccaaaatacgtccctgttaagcccaagttgaccgacactaatacaagtctcgagagtacttcagccgtgtag

SEQ ID NO: 9179 - DNA, 267 bp, Artificial Sequence
  Description of Artificial Sequence: Synthetic coding sequence
atgaagctgctgtacctgttcctggccatcctgctggccatcgaggaaccagtgatatccgtcgagtgctggatggacggccactgcagattgttgtgcaaggacggcgaggacagcatcatccgctgtcgcaacaggaagcgatgctgcgtcccatctagatacctgactattcagcccgtgacaattcacgggatcctgggatggacaactccccagatgagtaccactgcccctaagatgaagaccaacatcaccaatcggtag

SEQ ID NO: 9180 - DNA, 255 bp, Artificial Sequence
  Description of Artificial Sequence: Synthetic coding sequence
atgaagctgctgtacctgttcctggccatcctgctggccatcgaggaacccgtaatatccggaaagaggcacattctgaggtgcatgggaaactccggcatatgtagggccagctgcaagaaaaatgagcagccatacctttactgcaggaactgccagtcctgctgcttgcagagttatatgcgcatttccataagtggaaaagaagagaataccgactggtcgtatgaaaagcaatggccacgccttccgtag

SEQ ID NO: 9181 - DNA, 2631 bp, Artificial Sequence
  Description of Artificial Sequence: Synthetic coding sequence
atgggccccgaggccctgagcagcctgctgctgctgctgctggtggcttccggtgacgcggacatgaaaggacactttgatccggcaaagtgtcggtacgcactgggtatgcaggatcgtaccatccccgactcggatatatccgcctccagcagctggtccgacagtaccgccgcccgccatagtcgactggaatcaagcgatggggacggcgcttggtgcccagctggatccgtctttcccaaggaagaagagtatctgcaggttgatctccagcgtctacaccttgtcgccctcgtgggaacacagggccgtcacgctggaggcctgggcaaagaattcagtcgctcttaccgcctccggtattcccgagacggccgcagatggatgggatggaaagataggtggggacaggaggtaatctccgggaacgaagatcctgaaggtgtcgtactgaaagacctgggtcccccgatggtggcccgcttagtgaggttttatccgcgcgcggacagggtcatgtctgtgtgtctacgggtggaattgtacggatgtctttggagggacggcctgttgagttacaccgcacctgtcggccaaacaatgtacctgtcagaggcagtgtacctcaatgatagtacctacgacgggcatactgtaggtggcctccagtatggtggattaggccagctggcagatggcgtcgtaggtctggacgatttccgcaagtcacaagaactgagggtgtggccaggttacgattatgtgggctggtccaaccattcatttagcagcggttacgtggaaatggagtttgagttcgacagactcagagccttccaggctatgcaagtgcattgcaacaacatgcacaccctcggggctaggctgccagggggggtggagtgtcggtttcgtcgaggaccagctatggcatgggagggagaaccgatgagacataacctcggtggtaatctaggtgacccaagggccagggctgtttcggtgccgcttggtggcagggttgccaggtttttgcaatgtaggttcctgttcgccggaccttggctgctgttcagcgagatcagctttatcagcgatgttgtcaataacagtagtcctgccctgggaggcaccttcccacccgctccttggtggccaccggggcccccgcccacaaacttcagtagtttagaactggagcctcgcggacaacaaccggtggccaaagcggaagggtccccgacggccattctgattggatgtttggttgccattattctgcttttattgctcatcatcgccttaatgttgtggaggctccattggagacggttgctgagcaaagccgaaagaagggtcctcgaggaagaactgaccgtccacctcagcgttcccggggataccatcttaattaacaatcgcccggggccaagggagcctcctccataccaggagcctcgcccaaggggcaatccaccccattccgccccatgcgtgcccaacggtagtgcttactctggagactatatggaacctgagaaaccaggagccccccttctgccaccacccccccaaaacagcgtgcctcattacgccgaagcggatatagtgaccttacagggagtcaccggcggcaatacatacgccgttccagccttgcctccaggagctgtgggagacgggccaccaagagtcgacttccccagatccagactgcgtttcaaagaaaaactcggcgaaggccagtttggcgaggtgcatctctgtgaagttgacagcccacaagatctggtcagcctagactttccactgaatgtccgcaaagggcatcctctcctggtagccgtgaaaattcttcgccccgatgccaccaaaaacgccagaaacgattttctcaaggaggtcaaaattatgagccggctgaaggaccccaatatcatccggctacttggggtttgcgttcaggatgatccactttgcatgattacagactatatggaaaatggtgacctgaaccaattcctcagcgcccatcaactggaagacaaagccgcagagggagctcccggggatggacaggcagctcagggccccacaattagttaccccatgctgctgcacgtggcagcgcaaatcgcatccggaatgcgatatctggctacattaaactttgtccatcgggatctcgctacgaggaactgtcttgtcggagagaactttacaattaagatcgcagacttcggaatgtcccgaaatctctatgccggagactactaccgtgtccagggccgtgccgtgctccctatccgatggatggcttgggaatgcattttgatgggtaagttcaccacagcctcagacgtgtgggccttcggcgtaacgctgtgggaagttttaatgttatgtcgcgctcagccctttggccaactcactgacgaacaagtcattgaaaacgctggggagttctttcgggaccaaggcagacaggtgtatctgagccggcctcccgcctgcccccagggactttacgagcttatgcttaggtgctggagtcgagaatctgagcagcgacccccatttagtcaactgcacaggttcttggccgaggacgccctcaataccgtgtag

SEQ ID NO: 9182 - DNA, 2742 bp, Artificial Sequence
  Description of Artificial Sequence: Synthetic coding sequence
atgggccccgaggccctgagcagcctgctgctgctgctgctggtggccagcggggatgctgatatgaaggggcacttcgacccggccaagtgccgttatgcgctcgggatgcaggacagaaccatccccgattctgacatttcggcgagttcctcctggtccgattccaccgcagcccgccactctaggctcgagagctctgacggcgacggagcttggtgtcccgccggctctgtgtttccaaaagaggaggaatatctgcaggtggatctccagcgcctgcacctcgtcgcccttgtgggaacgcagggacgacacgccggagggctcgggaaggagttctctaggtcctaccggctccgctacagcagggatgggcggagatggatgggatggaaagatcggtggggacaggaagtgatttccggaaacgaagacccggagggagtcgtattgaaagacctcggtcctcccatggtggccaggctggtcagattctatccccgggccgaccgcgtcatgagtgtgtgcctgagagtagaactctatgggtgtctctggagagatggtctgctttcttacactgctccagttggccagactatgtacctttcggaggccgtttacttaaacgacagcacctacgacgggcacacggtaggagggctccaatacggaggattagggcagcttgcagatggcgtggtggggctcgacgatttcagaaagtcccaagagcttcgcgtctggccgggatacgactacgtgggttggtccaatcacagcttctcatcaggatatgtggagatggaattcgaatttgatcggctcagggcctttcaagcaatgcaggtgcactgcaacaatatgcataccctgggggcaagactgcctggcggagtggagtgccggtttcggcggggacctgcgatggcttgggaaggggaacccatgagacataacttaggaggaaatctcggcgaccccagggcaagagcggtcagtgtgcctttaggaggacgcgtggctcggttcctccagtgtcgattcctctttgctgggccctggctcttattcagtgagatttctttcatctccgatgtggtaaataacagtagtcctgcccttgggggcactttcccgccagctccctggtggccccctggccctccccccaccaatttcagcagcctggagctagagcctcgggggcagcagcccgtcgctaaagcagagggatccccaacagctatccttatcggctgccttgtcgccatcatcctgctgttgcttctgatcatcgcccttatgctatggaggctgcactggaggagactattgtctaaggccgagcgaagggttctcgaagaggagctgacagtacacttgagcgtacccggggatacaattctcatcaacaatcgtccaggacccagggaaccccccccctatcaggagccgagaccgaggggaaaccctccccactccgctccttgtgtgccaaatggttccgccttattgctcagcaatccagcatataggctgctcctcgccacctacgccaggccgcctagggggcccggcccaccaacccctgcatgggccaagcctaccaatacgcaggcctatagtggggactacatggagccagagaagccaggcgcacccttgttgcctcctccccctcagaactcagtccctcactacgcagaggctgatatcgtcacgctgcagggggtaactggcggcaatacctacgccgtcccagcgctgcctcctggagccgttggagatggcccgccaagagtagattttcctcgcagccgactcaggtttaaggagaaacttggggagggacagttcggtgaggtgcacttatgtgaagtcgattcccctcaggatctcgtcagcctggacttccccttaaatgtccggaaaggtcacccactcctggtggctgtgaagatcctgagacctgatgctaccaagaatgctcgcaacgactttctgaaagaagtgaaaattatgtcacggctgaaagaccccaacattattagactgctcggagtgtgtgtgcaggacgatcccttgtgtatgattaccgactacatggagaacggagacctaaatcaatttctctccgctcaccagttggaggacaaggccgccgaaggtgcccccggtgatgggcaagccgcacaaggacccaccattagttacccaatgcttttacatgtggcggcccaaatagcaagcgggatgcgttatcttgctactctgaactttgtgcatcgcgatctcgcaactcgtaattgcctagtaggggagaacttcactatcaaaattgcagacttcggaatgtcaaggaatctctacgccggggattattaccgagtccaagggagggccgtcctccccatacgttggatggcctgggagtgtatcctgatggggaagttcactactgcttcggacgtttgggccttcggcgtgaccttgtgggaagtgctcatgttatgccgggcacaaccgttcgggcagctgacagacgaacaagtgatcgaaaacgctggtgaattttttcgcgatcagggcaggcaggtgtacctgagcagacctcctgcctgccctcaagggctctacgagttgatgctgaggtgttggtccagggaatccgagcagagacccccctttagccagttgcatcgctttcttgccgaagacgccctgaacactgtctag

SEQ ID NO: 9183 - DNA, 2631 bp, Artificial Sequence
  Description of Artificial Sequence: Synthetic coding sequence
atgggccccgaggccctgagcagcctgctgctgctgctgctggtggcctcaggcgacgccgacatgaaaggccatttcgatccagctaagtgtaggtatgcgctaggtatgcaggacagaaccatccccgatagcgacatttctgcatcatccagctggtctgatagcaccgctgcacgacactcacggctcgagtcctctgacggtgacggtgcatggtgtccagccgggtctgtctttcccaaagaggaggaatatctgcaggtggacctgcagagacttcacctggtggccctggtgggaacacagggaagacatgccggcggtctggggaaagagttctcccggtcatatagactgcgctatagcagggatggtaggcggtggatgggctggaaggaccgttggggacaagaggtcatctcaggcaacgaagatccagagggcgtggtgcttaaggacttaggccctccaatggtggcccgcctagtcaggttttatccacgcgcggacagagtgatgtcagtttgcttgagagtggagttgtatggctgcctttggcgggacggcctcttgtcttacactgcccccgtagggcagaccatgtacttatcagaagcagtttacctcaatgatagcacctatgacgggcatacagtggggggccttcagtatggcggcctgggacagctggctgacggtgttgtgggccttgacgattttcgcaaatcacaggaactccgggtgtggcccggatatgactacgtgggctggtctaatcacagtttctcgagcggctacgtagaaatggagtttgaatttgaccgcttgcgtgcatttcaggcaatgcaggtgcattgcaacaatatgcacactctcggggccagactgcctggcggcgtcgaatgtcgtttcagaaggggacccgccatggcctgggaaggcgaacccatgcgccacaacctgggtgggaatctgggagaccctcgggctcgcgccgttagcgtgcccctgggcggaagagttgccagattcctgcagtgccgctttctctttgccggcccatggctgctgttcagtgaaatttctttcatatcagacgtggtcaataacagtagtcctgccttggggggaacttttcccccagccccgtggtggcccccgggcccaccccccacaaatttttccagtctcgagttggaacccaggggtcagcagccagtagcaaaggctgaagggtcaccaacggcaatcctgatcgggtgtcttgtcgctatcattctgctcttgttgttaatcatcgctctcatgttgtggcggttacactggcggcggctgctctctaaagcagagcgaagagtgctggaggaagagcttaccgtgcatttatccgttccaggcgacacaattctcatcaacaaccggcccgggccccgcgagccaccaccttaccaggagccgagacctcgagggaatcccccacacagcgcgccctgcgttccgaatgggtctgcctacagtggagattacatggagccagagaaacccggcgcacccctgctacctcctcctccgcaaaactccgtcccccactatgcagaagcagacatcgtgactttgcagggcgttacagggggcaacacttatgccgttccagccctgcccccgggggcggttggtgatggaccaccgcgcgtggactttccacgaagtcggctccgattcaaagagaaacttggtgagggccagttcggtgaggtgcacctttgtgaggtggacagcccccaagacctggtctctctggatttccctttgaatgttaggaaaggccatcccctattggtggccgtgaaaatcctccgtcccgacgcgacaaaaaacgccaggaacgattttctcaaggaggtcaagattatgtcaagactgaaagaccctaacattatccggctgctcggcgtttgcgtccaagacgatccactctgtatgataacagactatatggagaatggtgatctgaaccagttcctgtccgcacaccaactcgaggacaaagcagctgaaggcgctccaggggatgggcaggcagcccaagggcctacaatctcctatccaatgctgcttcatgttgcagcccagattgccagtggcatgagatacctggccacgctgaatttcgttcaccgcgacctagcaaccaggaattgtctggtgggagagaactttacgattaaaattgcggactttgggatgagtaggaacctctacgcaggggactattaccgggtacagggtagggcggtgttaccgataagatggatggcctgggagtgcatcctgatgggcaagttcacaactgcctctgacgtttgggcttttggagtcacgttatgggaggtcctcatgctgtgccgggcccagccatttggccagcttaccgatgagcaggttattgagaacgccggcgagtttttccgggatcaagggagacaggtatacctgtccaggcctccggcttgcccccaaggtctttatgaactgatgttgcgatgctggagcagggaaagtgaacagcggcccccgttctcccagctacatagatttctcgctgaggatgcgctaaacacagtgtag

SEQ ID NO: 9184 - DNA, 2631 bp, Artificial Sequence
  Description of Artificial Sequence: Synthetic coding sequence
atgggccccgaggccctgagcagcctgctgctgctgctgctggtggcgtctggcgacgcagatatgaagggtcacttcgatcctgcgaaatgcagatacgccttaggaatgcaggaccgaaccattcctgattcagatatttccgcaagctccagttggtccgattccactgccgcacgccactctagattagagagttccgacggcgatggggcgtggtgccccgctggctccgtgtttcctaaagaagaggaatatcttcaagtcgatctgcagaggctgcatctggtggcgctggtcgggactcagggcagacacgcaggcggtttaggaaaagagtttagtcggagctaccggctgcggtactcccgcgacggccggcgatggatgggctggaaagatcgatggggacaggaagtgatctcaggcaacgaggaccctgagggcgtcgtgctcaaagacctcggcccccccatggttgcacgactagtccgtttctaccctagggctgatcgcgtcatgtctgtctgtttgcgcgtggaactgtacggatgcttatggcgtgacgggctcctaagctacaccgcacccgttggccaaaccatgtatctgtccgaggcggtctatctcaatgacagcacatatgacggccatacagtcgggggtctgcaatacggaggtctgggacagttggccgacggcgtggtgggcctggatgactttcgaaaatcccaggaactgcgagtgtggccaggttatgactatgtgggatggtccaatcattctttcagcagcggctatgtggagatggagtttgagttcgacagactgagggccttccaggccatgcaggttcactgtaataatatgcacaccttgggagcaaggctaccgggcggggtggaatgcaggttcagacgtggccccgcgatggcttgggagggagaaccgatgaggcacaatttgggcgggaatctgggtgacccacgggcccgggcggtgagcgtccccttgggggggcgcgtggccagatttctccaatgccgtttccttttcgctggcccgtggctacttttctccgagatatctttcatttcagatgtggtgaacaactcatcgccagccctgggaggaacttttccccctgcaccctggtggcctcctggccctcctcccactaatttttcttccctcgagttggaaccgagggggcagcaacctgtcgcaaaagcagaaggatcaccgaccgcaattctaataggctgtcttgtcgccatcatcctgttgttgctgctcatcattgctctgatgctctggaggctccactggaggagactactctccaaggctgaacgaagagtgcttgaagaagagctgaccgtgcatcttagcgtgccaggggacactatcctgattaataaccgacctggccctcgtgagccgccgccctaccaggaacctcgtccacgcggcaatccaccccacagcgcaccttgcgtgccaaacggaagcgcctactcaggggattacatggaacccgagaagcctggagcccccctgttaccccctcctccacagaatagtgtgccccattacgctgaggctgacatcgtgaccctgcaaggggtcacaggcggtaacacgtatgcagttccagcccttcccccaggcgctgtgggagacggcccacctcgcgtggatttccctcgtagccgcctgcgcttcaaagaaaagttaggcgaggggcagttcggggaagtgcacctgtgtgaggtagactctccgcaggacctcgtcagtctggattttcccctcaacgtaagaaagggtcaccctttgctagtggctgtgaagattttacgacccgacgctactaagaacgctaggaatgacttcttgaaggaagtgaaaattatgagtcggttgaaggaccccaatataataagattattgggagtgtgcgtccaggacgacccactgtgcatgatcactgattatatggaaaatggagacctcaaccagtttctgtctgcacaccaactagaggacaaagctgccgaaggcgcaccaggggatggacaagctgctcagggaccgacaatctcctatcccatgctgttacacgtggccgcccaaatcgccagtgggatgcgatatctggccaccctgaatttcgttcacagggatctggccacacggaactgtctcgtaggcgaaaatttcaccatcaagattgctgacttcggaatgagtcgcaacctgtatgccggagattattatcgcgtgcagggcagggcagttctccctatccgttggatggcttgggagtgcattttaatgggtaagtttacaactgcatcggacgtttgggcctttggcgttacactctgggaagtcctgatgctgtgtcgcgctcagcccttcggacagctcaccgatgaacaagtgattgaaaacgccggtgaattcttccgcgaccaggggaggcaggtttacttatccaggcctcctgcctgtccccagggactctatgagttgatgctgcgatgctggtcccgcgaatcggagcagaggcctccattctcccaattgcaccgctttcttgccgaggatgccctgaataccgtgtag

SEQ ID NO: 9185 - DNA, 2760 bp, Artificial Sequence
  Description of Artificial Sequence: Synthetic coding sequence
atgggccccgaggccctgagcagcctgctgctgctgctgctggtggcctccggggacgcagatatgaaagggcactttgacccagctaaatgccgctacgctctggggatgcaggaccgcactatacctgacagcgacatctctgctagttcaagttggtccgactcaaccgctgcccgtcatagtcgcctggaatcctctgacggggatggcgcctggtgccccgcaggctcggtgtttcccaaggaggaagagtatttgcaggtcgacctccaacggctgcatctcgttgcgctcgtcggtacccaaggacggcatgcgggtggtctgggcaaagaattctcaaggtcctataggttacgttatagtcgtgatggtcggcggtggatggggtggaaggataggtggggccaagaagtcataagcgggaatgaggaccccgagggcgtggtcctgaaagacctggggccaccaatggttgcccgacttgtgcggttctacccaagagctgatcgggtgatgagcgtatgcctccgcgttgaactgtacggttgcttgtggagggacgggctgctgagctataccgccccagttgggcagaccatgtacctttcagaggcagtctatctcaacgattcaacatatgacggccacaccgtgggcggtcttcagtacggtgggttaggccagctggctgatggcgtcgtcgggctagatgattttcgaaaatcccaggaacttcgcgtgtggcccggctacgactatgtaggttggtcaaaccactccttctccagcggatatgtggagatggaatttgaatttgatcgcctgagggctttccaggcaatgcaggttcactgcaataatatgcatacattaggcgcccgtctgcccggtggagtggaatgcagattccgcagaggaccagccatggcgtgggagggcgagcccatgcgtcacaacctaggcgggaacctgggagatccacgggccagagccgtaagcgtccccctcggaggtagggtggcaaggtttctgcaatgtagattcctgtttgccggaccttggctgctgtttagcgaaattagttttatctctgacgtggtcaacaactccagccccgccttaggggggacctttcctccggccccctggtggccacccgggccaccccccacaaacttcagcagtctggagctggaacctaggggtcagcagccggtagcgaaggccgaggggtctccaaccgccatcctcataggctgcctggtcgccattattttattactgctattgatcatagctctgatgctctggagactccattggcggaggctgttgtctaaggctgaacgtcgggtgctcgaagaagaacttaccgtacacctgagcgtccctggggatactatcttgattaataatcgtcctggcccccgggagccacccccataccaggagccccgcccccgaggcaatccaccacatagcgcaccttgcgttcctaacggctccgctttactcctctccaatcctgcctatcggctcctgctggcgacttatgctagacctcctaggggtcctgggcctccgacgccagcgtgggctaaacctacaaacacgcaagcgtacagtggcgactatatggagcctgaaaaacccggggcacccctgctgccacctccaccacagaacagtgtaccccattatgccgaggctgatatagtcacccttcagggtgtgaccgggggcaatacctacgcagtgcccgccttgccaccaggggcagtaggtgatggacccccaagagttgatttccctagatcaaggctgcggttcaaagaaaagctgggggaggggcagtttggggaggtgcacctctgtgaggtcgattctcctcaagatctggtctctctagatttccctttaaacgttcggaaggggcacccgctgctggttgctgtgaaaattctccgacccgacgccactaaaaatgcctctttcagtctcttctccaggaacgactttcttaaggaagtgaaaatcatgtcaaggctgaaggaccccaacatcatccggttacttggggtctgcgttcaggatgatccactctgcatgatcactgactatatggaaaatggggacctcaaccagtttctgtctgcacatcagttggaagacaaggcggccgaaggggcgccgggggacggccaggctgcccagggccctaccatcagttatcccatgctcctacacgtggcagcacagattgcatccgggatgcgatatctcgccacccttaacttcgtgcaccgtgatttagccaccagaaattgtctggtgggggaaaatttcaccatcaagatcgctgattttggaatgtctaggaatctatatgctggagattattatcgcgtgcagggcagagccgtcctaccaatcaggtggatggcctgggaatgcatacttatgggcaagtttacaaccgcctctgatgtgtgggcgttcggggtcaccctgtgggaggtcctcatgctgtgtcgtgcccagccattcgggcagcttactgatgagcaagtaattgagaatgcgggggagttttttcgggaccagggtcggcaggtctatctgtcccgaccacccgcatgcccgcagggactgtatgagctgatgttacggtgttggagtcgggagagtgagcaacgtccacccttctctcagctgcacaggtttcttgcggaagatgcactcaatacagtgtag

SEQ ID NO: 9186 - DNA, 1041 bp, Artificial Sequence
  Description of Artificial Sequence: Synthetic coding sequence
atgctgaagaagcccctgagcgccgtgacctggctgtgcatcttcattgtagccttcgtatctcacccggcctggctgcaaaagctgtcaaagcacaagactccagcgcagccgcaattgaaggccgccaactgctgcgaggaggttaaagagcttaaggctcaggtcgctaacctaagttctctcctatctgaattgaacaagaagcaggagcgcgactgggtctcagttgttatgcaagttatggagttagaaagtaactctaaacgtatggaaagcagattgaccgatgccgagagcaagtacagcgagatgaataaccagattgacattatgcaattgcaggccgcccagacagtcacacaaacctcagccgatgcaatttatgactgctcatcactctaccagaagaattatagaattagcggagtctacaagctgcccccggatgattttcttggatcccccgagctggaggttttctgcgacatggaaacctcgggtggcggctggacaataatccagcggcggaagagtggcctggtatccttctacagggattggaaacaatacaagcagggtttcgggagcatcagaggtgatttttggctcggaaacgagcatatccacaggctttctaggcaacctacaaggctgagagttgaaatggaagattgggagggaaaccttcgatacgccgaatattcccactttgtgttggggaacgaactaaactcttaccgccttttcctcggaaattacacaggtaatgtggggaacgacgccctacaatatcacaataacactgcgttctcgacaaaggataaagacaatgataactgtttagacaagtgtgcccagctgcgtaagggtggctattggtataattgctgcacagactctaacctaaacggagtatactaccgcctgggagagcacaacaagcatttggacggcatcacatggtacggatggcatgggagtacctattcactaaagcgggtagaaatgaaaatccgacctgaagacttcaagccttag

SEQ ID NO: 9187 - DNA, 1056 bp, Artificial Sequence
  Description of Artificial Sequence: Synthetic coding sequence
atgaagggccgggccgtgagcttcgaccccctggcctgccagggccttaacgcatctccaggtagccttacgagccccctgaggagaattaggagtctgactggccgtgaagtgctcacccctttccccgggctgggcacggccgctgctcctgcacaaggcggcgcacacctgaagccccatagcctcgtgcttccaattacagcgctccctccacccccactggccttgcgtggaagacaggccacgtccaaactgccccctttcctgtcatcaccctttccccctagtctgtgtccctgggtacccgatccagggtttaaggagaccgcttttctgtatgcggtgagtagtgctgcgttaacccacaccctcgcccgggcttgctctgccgggagaatggaacgatgtacatgcgacgacagtcctggcctcgaaagtagacaggcctggcagtggggagtctgtggcgacaatttaaaatatagcacgaaatttttaagcaacttcttggggagcaaacggggcaataaggatctgagggcgcgtgcagacgcgcataacacgcacgtcgggatcaaggctgtgaagtcaggacttagaaccacctgtaagtgccatggggtcagcgggagttgcgcagtcagaacatgctggaagcagttatccccattccgagaaactggccaggtgctgaagttgaggtatgacagcgcggttaaagtaagtagcgccacgaacgaggcccttgggcgtttagagctgtgggctccggctcgccaggggtcactgaccaagggactcgcgccacgttccggggatctcgtttacatggaggactcaccgagcttctgccggcctagcaaatattcccctggtaccgctggaagagtctgtagcagggaagcttcttgcagctccctttgttgtggccgagggtacgacactcagtcacggctcgtcgcttttagttgccattgccaggttcagtggtgttgctacgtcgagtgccaacagtgcgtgcaagaagagttggtctatacctgtaaacattag

SEQ ID NO: 9188 - DNA, 462 bp, Artificial Sequence
  Description of Artificial Sequence: Synthetic coding sequence
atgaagcacctgcggccccagttccccctgatcctggccatctactgcttttgcatgctccagattcccagcagcgggtttcctcagccactcgccgatccatccgatgggctcgacattgttcaactggaacaactcgcctattgcctaagccagtgggcccctctgagcagacagcctaaggataaccaagatatctacaagcgatttttgtttcactattcacggactcaggaggcaacccacccagttaagacaggcttcccaccagttcacccactgatgcatctggccgccaagctggcaaatagaagaatgaaacgcatactccagcgtggttctggaaccgctgcagtggactttacaaaaaaagaccacacagcaacatggggccggccattctttcttttcaggccaagaaacggaaggaacatagaagatgaggcccaaattcagtggtag

SEQ ID NO: 9189 - DNA, 765 bp, Artificial Sequence
  Description of Artificial Sequence: Synthetic coding sequence
atggccgccgccagcgccggcgccacccggctgctgctgctgctgctgatggcagtggcagccccgtcgcgggcccgaggctcagggtgtagagcagggacgggcgctcgcggcgccggagctgagggacgggaaggtgaagcatgcggtactgtgggactcctattagagcacagttttgaaatagacgattccgccaactttcgcaagagagggtctcttttgtggaatcagcaggacggtactctttctctttctcagcgccagctgtcggaggaagagaggggacgcctgagagacgtcgccgctttgaatggtctctacagggtaagaattccaagacgacctggggccctggacggccttgaagcgggggggtacgtatctagtttcgtgcccgcctgcagtctggtcgagtcacatctgtcagatcagctcaccctgcatgttgatgtagccggaaatgtggtgggcgtgtcggttgtgactcatccaggcggctgccgcgggcacgaggtagaggatgtggacttagagctctttaatacaagcgtacagctccaacctcctactacagctcccggtcccgaaacagccgccttcatcgagcgccttgagatggagcaggcgcagaaagcaaagaatccgcaggagcagaagagttttttcgctaagtactggcacataatcttgggcggtgctgtgctcctaacggccctgaggccagcggctcctggtccagcgccaccacctcaggaagcctag

SEQ ID NO: 9190 - DNA, 810 bp, Artificial Sequence
  Description of Artificial Sequence: Synthetic coding sequence
atggccgccgccagcgccggcgccacccggctgctgctgctgctgcttatggccgtggccgcaccgtcccgcgccaggggcagcgggtgcagggccggaaccggcgctcgcggggccggggcagaggggcgagaaggtgaggcctgtgggacggtcggcttactgcttgagcacagcttcgaaatcgatgattctgccaactttcgtaagagaggttctttattatggaatcaacaggacgggactctctccctcagccagcgccaactgtccgaagaggaaagaggccgactcagggacgtagctgccttgaatggcctctaccgcgtacgaattccacggagacccggagcactggatgggctcgaggccggcgggtacgtatccagctttgtcccagcatgttcactggttgaatctcacctgagtgaccagctgaccctccatgtggatgtggcgggcaatgtcgttggcgtgtctgtggtaacgcatccaggagggtgtaggggccacgaagtggaggatgtggatctggaactttttaacacaagcgtccagctgcaacctcctacgaccgcacccggccccgagactgccgcttttatcgaacggctggagatggaacaggcccagaaggctaaaaacccccaggagcagaagtcttttttcgccaagtattggatgtacattattcccgtggtgctgttcctgatgatgtctggagccccagacactggcggccagggcggcggcggcgggggcggcggaggtggagggagtgggcggtgctgtgtgccaccaagcttgtag

SEQ ID NO: 9191 - DNA, 480 bp, Artificial Sequence
  Description of Artificial Sequence: Synthetic coding sequence
atgagcagcccccagcggcggaaggccatgccctgggccctgagcctgcttctcatgggattccagctcctagtcacttacgcatggtgctcagaggaagaaatgggggggaataacaagatcgtgcaggacccaatgttcttagccacagtggagttcgccctgaataccttcaatgtacagtcgaaggaggagcacgcgtacagattattgcgcgtcctatccagctggagggaggatagcatggaccgcaagtggcgtgggaaaatggtgttctccatgaacttgcagctcagacagaccgtgtgtaggaagtttgaggacgatatcgacaactgtccgttccaggagagcttagagcttaacaatgttcgacaaggaatatctttcccccaagtacactcttgtggttgctgcatggggtgtggggtgggcacaggagcagccgacaaggctatccctcgggataagggcaagtag

SEQ ID NO: 9192 - DNA, 1737 bp, Artificial Sequence
  Description of Artificial Sequence: Synthetic coding sequence
atgctgctgctgctgctgctggcccccctgttcctgcggccccccggcgccggaggcgcccaaactcccaatgctacgtcggaaggatgccagatcattcaccctccctgggaaggaggtattcgctaccgggggctgacccgggaccaagttaaagcaattaatttcttaccggtggattatgagattgagtacgtgtgccggggagaaagagaagttgtgggccctaaggtccgaaaatgccttgccaacgggagctggaccgacatggacaccccttcccgttgcgtgcgcatttgtagcaaaagctacctgactctcgaaaacggcaaggtctttttgaccggaggagacctccctgccctcgacggcgctagggtggattttcgttgcgacccagactttcatttggtgggttcttcccgaagcatatgcagtcaagggcagtggagcacaccgaagccacactgccaggtcaatagaaccccccacagcgagagaagggcggtgtatattggtgccctctttccaatgtccggaggatggccaggggggcaggcctgtcagcctgccgtcgaaatggcgctggaggacgtcaattccaggcgggacattctgcctgattacgaactaaagctgatccatcacgactctaaatgcgatcctggacaggctactaaatatctgtacgaactgctctataatgaccccataaaaattatcctgatgcccgggtgctctagtgtttcaaccctggtggcagaagccgctagaatgtggaatttgattgttctgtcctatggcagtagctctcccgcactttctaatcgtcagagattcccgacctttttcagaacccatccatctgccactcttcataacccaacccgggtcaaactcttcgagaagtggggttggaagaaaatcgcgaccatccagcagactactgaggtgttcacatcgactctggacgacctcgaggagagagtaaaagaagccggaatagaaataactttccgtcagagctttttctctgatcctgcagtgcctgtcaagaatctgaagcgccaggatgcccgcatcattgtgggcctgttctacgagacagaagctcgtaaggtattttgtgaggtttataaagagcgactgtttggaaagaaatatgtttggttcttgatcgggtggtatgcagacaactggttcaagatctatgatcccagcattaactgtaccgtagacgaaatgactgaagctgtagagggtcatattacgacagagattgtgatgctgaatcccgcgaacaccagaagtattagcaacatgactagccaagaattcgtggaaaagctgacaaaacggttgaaaagacacccagaggaaaccggcggttttcaggaagctcctctggcctacgatgcaatttgggcccttgctctggcactgaacaagacatccggaggtggaggtcgcagtggcgtccgactcgaggatttcaattataacaatcagacgatcactgaccagatttatagggctatgaactctagtagtttcgaaggtgtctccggacatgtggttttcgatgcgtccgggtcacgcatggcctggaccctcatcgagcagcttcagggcggcagctataaaaagattggttactatgacagcactaaggatgacctgtcatggagtaagaccgacaagtggatcgtgattagcagaacacatagccccacttag

SEQ ID NO: 9193 - DNA, 444 bp, Artificial Sequence
  Description of Artificial Sequence: Synthetic coding sequence
atgctgggcctgccctggaagggcggcctgagctgggccctgctgctcctccttctcggaagccagatcctcttgatttacgcatggcactttcacgagcagcgggattgtgacgaacataatgtgatggctaggtacctccctgctaccgtggagttcgccgttcatacgttcaatcagcaaagcaaggattattacgcctaccgcctgggccatatcctgaattcatggaaggagcaggtggaaagtaaaaccgtgttctccatggagctgcttctgggacgaactagatgtggcaagttcgaagacgatatagacaattgccacttccaggaatccaccgaactcaataacacatttacatgttttttcaccataagtacccgtccttggatgacccagttttctctgctgaataagacgtgtctggaggggttccactag

SEQ ID NO: 9194 - DNA, 444 bp, Artificial Sequence
  Description of Artificial Sequence: Synthetic coding sequence
atgtggagcctgccccccagccgggccctgagctgcgcccccctgttactgttgttttcttttcaattccttgtaacttacgcgtggaggttccaagaagaggaagagtggaacgaccagaagcagatcgctgtgtatctgccccctactctcgaattcgcggtttacaccttcaacaagcaatccaaggactggtatgcctacaagctggtccccgtgctcgcatcttggaaggaacaggggtacgacaagatgaccttctctatgaacctccagttagggaggacaatgtgtggaaaatttgaagatgatatcgacaattgtccgttccaggagtcaccggagttgaacaacacttgtacatgttttttcacaatcgggatcgaaccttggagaacaagatttgatctctggaataaaacttgttcaggagggcattcttag

SEQ ID NO: 9195 - DNA, 2535 bp, Artificial Sequence
  Description of Artificial Sequence: Synthetic coding sequence
atgggccccggcgcccccttcgcccgggtgggctggcccctgccccttctggttgtgatggcggccggcgtggctccggtgtgggcatctcacagcccccacctgccgagaccccattctagggtgcctccccacccctctagcgagagaagagcggtttacatcggagcattgttccctatgtctgggggatggccggggggacaggcatgccagccagccgtagagatggctctggaagacgtgaattcccgaagggatattcttccggattacgaattgaaacttattcatcacgactctaagtgcgaccccgggcaggcgactaaatatctctacgaactgttgtacaatgacccgatcaaaatcattctgatgcccggatgcagttccgtcagcactctcgttgccgaggccgcccgaatgtggaatttgatcgtgctctcttatggctcatcttctccagcactcagcaacagacagcggttcccaacattctttcgcactcatccctctgccaccttgcataatcctacaagggttaagttattcgagaaatgggggtggaagaagattgctacgatccagcagactacagaagtgttcacgtcaacactggatgacctcgaggaacgcgtgaaagaggcagggatcgaaattacgtttcggcaaagtttcttcagcgatccagcagtgccagtaaaaaaccttaagcggcaggatgcaaggataatagtaggactgttttacgagaccgaggctcgcaaggtattctgtgaagtctataaagagagattgttcggaaagaagtacgtgtggttccttattggatggtacgcagacaactggttcaagatatatgacccatccatcaattgtactgtcgacgagatgacagaggccgtcgagggccatatcactacggagattgtcatgctgaatcctgccaatacgcgcagcatcagtaatatgactagccaagagttcgtggagaaattgacaaagaggctcaaaagacacccagaagagaccggaggatttcaggaggccccactggcatacgacgccatctgggcactggcgctggctctgaataaaacctctggaggagggggccggagcggtgtgagactcgaagacttcaattataacaaccagacaatcactgaccagatatatagggcgatgaactcctcatcgttcgagggcgtgtcggggcatgtagtgttcgatgccagtggcagccggatggcgtggactttgatcgaacagcttcagggggggtcctacaagaagataggctactacgactccacaaaagatgatctgtcatggagtaaaactgataaatggattggaggttctcctcccgctgaccagacgctggtgataaagacattcaggtttctctctcagaaactcttcatctccgtttcagtgctcagctctctcggcatagtgttggctgtcgtgtgtttgtcttttaatatttataactcccatgtccgctatattcagaactcccagccaaacctgaataaccttactgccgtcgggtgcagcctggcccttgctgctgtttttcccttggggctcgacggatatcacatcgggaggaaccagtttccatttgtttgccaggcacgcctctggttactgggcctgggctttagtctcgggtacggctctatgttcacaaaaatttggtgggtccatactgtgttcacaaagaaggaagaaaagaaagagtggcgaaaaacattggagccatggaaactttatgccacagtaggtctgttggttgggatggacgtgctgaccctggctatctggcagatagtcgatcctctgcaccgtacaatcgaaacctttgccaaggaggagcccaaggaagatatcgacgttagcatcctgccgcagctcgaacattgttcttcacgaaaaatgaatacttggctggggatcttttacgggtacaaaggactactcctgttattgggcatcttcctggcatatgaaacaaaatcagtgagcaccgaaaagataaatgaccatcgcgccgtgggcatggcaatctataacgtggctgtcctatgtctcattacggctccggtaacaatgatcctgtcatcacaacaggatgccgccttcgcatttgcgtccttagccatagtgtttagctcctacattacactggtggtcttattcgttcccaagatgaggagattgatcacacgaggagaatggcagtctgaggcacaggatacgatgaagaccgggagctctactaataataatgaggaagagaaatcaaggctgttagagaaggagaacagagaactggagaaaatcattgctgaaaaggaggaaagagtctccgaactccggcatcagctacaatccaggcaacagttacggagccggcggcacccccccacccctcctgagccttcagggggactgcctaggggacctcctgagcctcccgacaggctgtcctgcgatggaagccgcgtgcatctgctgtataaatag

SEQ ID NO: 9196 - DNA, 2700 bp, Artificial Sequence
  Description of Artificial Sequence: Synthetic coding sequence
atgctgctgctgctgctgctggcccccctgttcctgcggccccccggagctgggggtgcccagacaccgaacgcaacttctgagggttgccagatcattcacccaccatgggaaggcggcataaggtataggggccttaccagggatcaggtgaaggctataaatttcctgcctgtggattatgaaatagagtatgtctgccgaggtgagagggaagtggtgggcccaaaggtgaggaagtgtctcgcaaacggatcttggactgatatggataccccatcccgctgtgtcaatagaacgccacacagcgagaggagggccgtctatatcggggcgctgttccctatgtctggcggctggccaggaggtcaggcttgccagcccgcggtggaaatggccctagaagatgtgaacagccgtagggatattctcccagattacgaattaaagctcattcaccacgacagcaagtgcgatcccggccaagccaccaagtatctgtatgaactactgtataatgatcccattaaaattatattaatgcccgggtgtagctcagtgtcgacactagtcgccgaggccgctcggatgtggaaccttatcgtgttgtcctatgggagttcctcccctgccctgagcaatagacagcgcttccccactttctttagaacccatccctctgccactcttcacaaccctacacgagttaaactatttgagaagtgggggtggaaaaaaatagccaccatacagcaaaccaccgaagtgttcactagtactttggacgatttggaggagcgcgtcaaagaagccgggatcgagatcaccttcagacaatcctttttcagcgatccagccgtccctgtgaagaatttaaagagacaggacgccagaataattgtgggcctcttctacgagaccgaggcccgcaaggtgttctgcgaggtgtacaaagagcgtctgtttggcaagaaatatgtatggttcctcatcgggtggtatgccgacaattggtttaagatttacgacccctcaattaattgcaccgttgatgaaatgacagaggctgtggaaggccacatcacaaccgagatagtaatgttgaatcctgcaaatacacgatctatctccaatatgacttcacaagagttcgttgagaaattgaccaagcgcttaaagaggcatccggaggagactggcgggttccaggaggctccactggcttacgacgccatctgggccctcgcactggcgctgaacaagacatctgggggcgggggccgcagcggcgtgcggttggaagacttcaactataataatcagactattactgaccagatctaccgggcaatgaacagttcctcttttgagggagtgtccgggcatgttgttttcgatgcctcaggttctcggatggcttggacactgatagagcagctccaaggcggcagttataagaaaatcggatactatgatagcacgaaggatgatttatcatggtccaaaacagacaagtggatcggcggttcccccccagccgatcagaccttggttataaaaaccttcagatttctgtcacaaaaactgtttattagcgtttcagtcctctcttccctggggatcgtcctggctgttgtctgtctgagcttcaacatttacaatagtcacgtgcgttacattcagaattcccaaccaaatttgaataatctcactgccgttggatgctcactggcactggccgctgtctttccgttgggattggatggttaccatatcgggcgaaatcaatttccattcgtttgtcaggcccggctgtggctgcttggcttaggcttctccctaggctacggatccatgtttaccaagatttggtgggttcatactgtgttcacgaaaaaggaggaaaagaaggagtggaggaaaactttggagccctggaaactgtatgcaacagtcggccttctcgttggcatggacgtgcttacactggcaatttggcagatagtggatccactgcatagaacaatcgagacattcgccaaagaagaacccaaagaagacattgacgtcagtatcctgccacagctggaacactgtagctcccgcaaaatgaatacgtggttaggaattttctacggatataaaggcctgctgttgctgctgggtattttccttgcatacgagaccaagtccgtctcaactgagaagatcaacgaccaccgcgcagttggaatggcaatttacaatgtggcagtcttatgcctcattacggcacctgtgaccatgattttatcatcccagcaggacgcggcctttgccttcgccagcctggctattgtgttcagctcatatattacactggttgttctttttgtgcccaaaatgcgtagattgattacacggggcgaatggcaatccgaagcccaggacaccatgaaaacgggtagcagcaccaacaataacgaagaggagaaatccagactactggagaaagagaatagagaactggaaaaaatcattgctgagaaagaagaaagagtaagcgagttaaggcaccagctgcaatcccgacaacagctccgctcacgtaggcacccacccacccctccagaacccagcgggggacttcctcgcggacctccagagcctcccgataggctgtcgtgtgatggaagtcgggtgcacttactctacaagtag

SEQ ID NO: 9197 - DNA, 2886 bp, Artificial Sequence
  Description of Artificial Sequence: Synthetic coding sequence
atgctgctgctgctgctgctggcccccctgttcctgcggccccccggtgcaggtggagcgcagacaccgaatgcgacctctgaggggtgtcagattattcatcctccctgggagggagggatccggtacagaggtctgactcgcgaccaggtgaaggctatcaattttctcccagttgactatgaaattgagtacgtgtgccggggcgagcgcgaggtggtcggccccaaggtacgcaaatgtctggctaatggcagttggacagatatggatacgcccagtagatgtgtgcgcatatgtagcaagtcttatttaacattggagaacgggaaagtgtttctaaccggtggtgatctgccagctttggacggcgctcgtgttgatttccgttgtgacccggacttccatcttgtgggtagctcgcgaagtatctgcagtcagggacaatggtcaacccccaagccacattgccaagtaaacagaactccacattcagagcgacgagcagtgtatataggcgcattgtttcctatgtcaggagggtggcctggcggccaagcatgtcagccagctgtcgagatggcactggaggacgtgaatagccgacgcgatatcctccccgattacgaactgaaactgatccaccacgacagtaaatgtgatcccggccaagctactaagtatctctatgagttactttataacgatcctattaaaatcatcttaatgcccggctgctcctccgtgagcaccctggtggccgaagccgctaggatgtggaacctgattgtgctgagctatggtagctcgtctcccgcccttagtaacagacagcgattcccaacttttttcagaacccatccaagtgccaccctccacaatcccacaagagtaaagctgtttgagaagtggggctggaagaagatcgcaaccatacaacaaaccacagaggtgtttacttccacattagacgacctagaagaacgggttaaagaggcaggaatagagatcacgttccgccagtcattctttagtgacccagcggttcctgtcaagaacctgaagagacaggacgcccgtataattgtaggtcttttttacgagaccgaagctcgcaaagtgttctgcgaggtctacaaggagaggctgttcggtaaaaaatatgtatggttcctcattggatggtatgctgataactggtttaaaatatacgacccttccataaactgcaccgttgacgagatgactgaggcggttgaagggcacattacgactgagattgtgatgcttaatccagcgaacacccgctccatctcaaatatgactagtcaggagtttgtggagaaacttacaaaacggttgaaacgccatcccgaggaaacaggagggttccaggaagctcccctggcttacgacgctatttgggctctcgccctcgcgctgaacaaaacatcaggaggcggtgggcgttcaggggtcaggttggaggactttaattacaataatcaaactatcaccgaccagatctaccgggcgatgaatagctcttcctttgagggcgtcagcggacatgtagtctttgacgcgagtgggtcacgcatggcgtggacactaatcgagcagctccagggcggctcttacaagaagattggatactacgactcgactaaagacgatctgtcctggtcaaaaaccgacaagtggattggcggcagcccacccgctgaccaaacactggttatcaaaacattcagattcctgtcccagaagctgtttatatccgtcagtgtgctgtcgtcactggggattgtcttggcagtcgtgtgtctaagcttcaatatctacaattcccatgtccggtacattcagaacagccagcctaacctcaacaatctcaccgcagtcggctgctccctggcccttgccgctgtatttccactgggcctggacgggtatcacatcggccggaaccagttcccatttgtatgtcaggctaggttgtggctgctcggcctaggcttcagtcttggctacggttcaatgttcactaagatatggtgggtccataccgtgttcactaaaaaggaggagaaaaaggagtggagaaaaacactggaaccatggaagctgtatgccaccgttggtttactagtggggatggacgtgctaacgcttgctatttggcagattgttgaccctctccatagaaccattgaaacgtttgccaaggaggagcccaaagaagatatcgacgtttccattctgccccagttagagcactgtagctccagaaaaatgaatacctggttgggaatcttctacgggtacaaaggtctgctcctcctgcttgggatttttttagcctacgaaacaaagagtgtgagcacagaaaagataaatgaccaccgggccgtcggtatggcaatttataatgtggccgtcttgtgtctaatcacagcccccgtcaccatgattcttagctcccagcaggatgcggctttcgcattcgcttccctcgcaatcgtgttctcatcatacattaccctggtggttctgtttgttccaaagatgaggcgcctcattactaggggcgagtggcagtccgaggcccaggataccatgaagactgggagctctactaacaacaacgaggaggagaagtccagactgctggagaaagaaaatcgcgagctggagaagatcattgccgagaaagaggagcgagtctccgagttgcgccaccagttacagtcccgccagcaattacggagccgcagacatcctcccactcctccagagcctagtgggggcctccctcggggccccccggagccccctgaccgcctctcatgcgatggcagcagggtgcacctgctttataagtag

SEQ ID NO: 9198 - DNA, 882 bp, Artificial Sequence
  Description of Artificial Sequence: Synthetic coding sequence
atgaacaacctgagcttcagcgagctgtgctgcctgttctgctgccccccatgtcccggcaaaattgccagtaaactggcctttctgccaccagaccccacatatacactcatgtgcgatgagtcaggatcacggtggaccctacatctgagcgagagggcagattggcagtacagcagcagggaaaaggacgcgatcgaatgtttcatgaccagaacaagcaagggcaatcggatcgcctgcatgttcgtccggtgctcccctaatgccaaatatactctattattcagtcacggaaatgccgtggatttgggtcagatgtcgtctttttatattggacttggatctcggataaactgtaatatcttctcctacgattactctggttatggagcctcatcaggtaagccaacagagaaaaatctctacgccgacatcgaggcggcctggctggcactgagaactaggtatggaataaggccagaaaacgttataatctatgggcagtccattgggactgtcccatcggtggatcttgccgcaaggtatgaatcggccgcggtgattcttcacagtcccctcaccagcggaatgagagttgcatttcccgataccaaaaagacatactgttttgacgcctttcccaatattgacaagatcagtaagatcacatcccccgtgttgataattcacgggacagaggatgaggttattgacttctctcatggtctcgcactctttgagcggtgtcagaggccagttgaacctctctgggtggagggggcaggacataacgatgtggagttgtacggccaatacctagaaaggttgaagcagtttgtcagccaggagctagtccaaaaacacaaggaaggaaagtag

SEQ ID NO: 9199 - DNA, 1155 bp, Artificial Sequence
  Description of Artificial Sequence: Synthetic coding sequence
atgtggtacgtgagcacccggggcgtggccccccgggtgaacttcgaaggggccctgttctctgggtatgccccggacggaggcctgtttatgcctgaggagttaccacagctggacagaggtacgctttgccagtggtcgaccctgtcatatcctggcttggtgaaggaactgtgcgccctgttcattgggtcagagctgcttcccaaagatgaactgaatgatctgatagatcgcgcgttcagtagatttcgacaccgcgaagtggtgcatctgagccgccttaggaacggcctcaacgtgttagagctttggcatggggtgacatacgcgttcaaagatctgagtctgtcgtgcaccactcaattcttacagtactttctggagaagcgggagaagcacgtaacagtggtggtcggaaccagcggggacaccggatcagccgcaatagaaagcgtgcagggtgcgaagaatatggatataatcgtccttttgcccaagggccactgcaccaaaattcaggagctgcagatgaccacagttcttaaacaaaacgtgcatgtgttcggcgtggaagggaactctgatgaattggatgagccaattaaaaccgtgttcgccgacgtcgccttcgtcaagaaacataacttgatgagtctgaatagtattaattggtctcgagtgttggttcagatggcccatcatttcttcgcttactttcagtgcactccatctctagacacacatccgctgcctctcgtcgaggtggttgtgcccaccggagcagccggtaacttggcggcgggttatatagctcagaaaatcggactgcccattcggcttgtggtcgctgtcaaccgaaatgatattatccataggaccgtgcagcagggagatttcagcttatctgaggctgtgaagtcaactctggcttcagccatggacatccaggtgccttacaacatggaacgggtattctggcttctctccggcagcgacagccaggtgactagggctctcatggagcaatttgaaagaactcagtccgtgaatctccctaaggaacttcactcaaagcatagccctgtgttgcctcgaccgtgtctctgtagccaagtccctggcagttgccctgggtgctggcccgacccttag

SEQ ID NO: 9200 - DNA, 2889 bp, Artificial Sequence
  Description of Artificial Sequence: Synthetic coding sequence
atgctgcggcggcccgcccccgccctggcccccgccgcccggctgctgctggcaggtctgttatgcggcggaggcgtatgggccgctcgggtgaacaagcacaaaccctggctagaacccacgtaccatggcatagtgactgagaatgacaatacagtacttctggacccaccgctgatcgctctggacaaagacgctccgctccggttcgccgaaagcttcgaagtgacggttaccaaggagggagagatctgcgggtttaaaatccacggacaaaacgtgccgtttgacgcagtggtggtcgataagagcacaggagaaggcgttatacgctcaaaggaaaaattggactgtgagctacagaaggactactcatttactattcaagcctatgattgcgggaaaggacccgatggtacaaatgttaaaaagtcccataaggctaccgttcatatccaagtcaacgacgtcaatgagtacgctcccgtgttcaaagagaaatcctacaaggccacagtgatcgagggaaagcagtatgacagcatcctgcgcgttgaagctgtcgatgccgactgcagtccacagttttctcaaatctgctcatatgaaattattacacctgacgtcccatttacagttgacaaggatggctacatcaaaaatacggaaaaactgaactacgggaaggagcaccagtacaaacttaccgtgactgcttatgactgcggaaaaaaaagagctacagaggatgttctggtgaaaatcagcattaagcccacttgtacgccgggatggcagggttggaacaatagaatcgaatatgagcctggcacgggtgcccttgccgtctttcccaacatccatctggaaacttgtgatgaaccagttgcctcggtgcaggccacggtcgagttggagacatctcacattggaaaaggctgcgatcgggatacatactccgagaaaagcctgcatcgtctatgtggcgctgcagctggaacggcagagctgcttccatctccgagcggatcccttaactggacaatgggcctgcccacagataacggtcacgattccgatcaggtcttcgaatttaacggtactcaggccgtaaggattcccgacggggtcgtcagcgtctctccaaaggagcctttcactatctcggtctggatgcgccatggtccttttggccgaaagaaggagaccattctgtgctcatctgacaagactgacatgaaccggcaccactactccctgtacgttcatgggtgccggttgatttttcttttcaggcaagatccatccgaagaaaagaagtacagaccagcagaattccactggaagctgaatcaggtatgcgacgaagaatggcatcattacgttctgaacgtggagtttccttccgtgacactttatgtggatggcaccagccacgagcctttttccgtcaccgaggattatccactccacccctctaaaattgaaacacagctggtggttggtgcgtgctggcaaggaggcgacttacatatgacgcagttttttcgcggaaacctggcgggcctgactctgcggagtgggaagcttgcagataagaaggtgatcgactgcctgtacacctgtaaggaaggcctggacctgcaagttttagaggactctggtagaggggttcagattcaggcacatcccagtcagcttgtattgaccctggaaggggaggaccttggtgagttagataaagctatgcaacacatcagttacctcaatagtcgccaatttccgacgccgggcatcaggaggctgaaaattacaagtacgataaaatgcttcaacgaggcaacatgcattagcgtgcctcccgtcgatggctatgtcatggtgctgcagcctgaggagccaaagattagcttgagcggagttcatcattttgcacgtgctgcttctgaattcgagtcgagcgagggtgtgtttctgtttcctgaactccgcataattagtactattaccagagaggtggagcctgaaggagatggcgctgaggatcccactgtgcaggagagtttggtgtcagaggagattgttcatgatctggacacgtgtgaggtgactgtggaaggcgaggaactgaatcatgagcaggagtccctggaggtggacatggcacgactgcaacagaagggcatcgaagtcagctctagtgaactaggcatgactttcaccggcgtggacactatggcatcttacgaagaggtattgcacctccttaggtataggaattggcatgccaggtctttgttagatcggaaatttaaactgatttgcagtgaattaaacggcaggtatatatccaacgagttcaaagtcgaagttaatgtaatccatacagccaacccaatggaacacgctaaccacatggcagcacaaccgcagtttgtgcatcccgagcatagaagcttcgttgacttgtcagggcacaacctggccaatcctcatccttttgccgttgtcccatctacggctactgttgtcatcgtggtgtgtgtctccttcctggtgtttatgatcatccttggggtgttcagaattcgcgcagcgcacaggcggaccatgagggatcaagataccggaaaggaaaacgagatggactgggatgattcagctctgacgatcacagtgaaccccatggaaacttacgaggaccagcactccagtgaggaagaagaggaggaggaagaggaggaggagtcagaggatggggaagaggaggacgatatcacctctgctgagtccgaatcatcggaagaggaagagggcgagcaaggggacccacaaaacgccactcggcaacagcagctcgagtgggacgattctactctcagttattag

SEQ ID NO: 9201 - DNA, 2946 bp, Artificial Sequence
  Description of Artificial Sequence: Synthetic coding sequence
atgctgcggcggcccgcccccgccctggcccccgccgcccggctgcttctggccgggctattgtgcggtggtggcgtttgggccgcgagggtgaataagcataaaccatggctagagccaacttaccatggcatcgtgactgaaaatgataatactgtcctcctagacccgccactgatagcactggataaagacgcgcctcttaggtttgccgagagttttgaggtgactgttacaaaggagggcgagatctgtgggttcaaaatccatgggcaaaatgtcccctttgacgccgtggtcgttgataagtccacaggcgagggggttatcagaagcaaggaaaaattggactgtgagctgcagaaggattactccttcaccatccaggcatacgactgcggaaaaggaccggacgggaccaacgtcaagaagtctcacaaggctacagtccatattcaagttaacgacgtgaatgaatatgctccagtgtttaaagagaagtcctataaagccacagtgattgaaggtaaacagtatgatagcatcttgcgggttgaagctgtggatgcggattgctccccacagttctctcagatttgtagttacgaaattattacccccgatgtcccctttactgtggataaggatggctatattaaaaataccgagaaattaaactacgggaaagagcaccagtacaaattaaccgtcactgcctacgactgtggcaagaagagggcaactgaggacgtgttagtgaagatcagcattaagccaacctgcaccccaggctggcaaggctggaacaaccggattgagtacgagcctggaaccggcgctctagctgtattcccaaacattcatctggagacttgtgacgaacccgttgcctctgtgcaagctaccgtcgagctggaaacatctcacatcggcaagggttgtgaccgtgatacatattctgaaaaaagcctgcacaggctttgtggagcggctgctggaactgccgaactcctcccttcgcctagcggctctctcaattggaccatgggcctaccaactgacaacggccacgattcagatcaggtgttcgaatttaatggcacccaggcagtgaggatccccgatggtgttgtcagcgtgtctccaaaagaaccttttaccatttccgtgtggatgcgccacgggcccttcggacgaaagaaagaaacgattttatgctcctcagacaagacagatatgaataggcaccattattccctgtacgtgcatggctgtcggctgatcttcctcttccgccaggatcccagcgaggaaaaaaagtacagaccagctgagtttcattggaagttgaaccaggtctgtgacgaggaatggcatcactatgtcctgaacgtggagtttccctccgtgactctatacgtggatggaaccagccacgaaccatttagcgtaacagaagattaccccctgcaccccagcaagatagagactcagcttgttgtcggagcgtgttggcaggagtttagcggagtggagaacgataatgaaaccgagccggtcaccgtagcgtctgcaggcggtgacctccacatgacgcagttctttcgagggaacctggccgggctcaccctccggtcgggtaagctggctgataaaaaggtcatcgactgcctgtatacttgcaaggaaggactggacctgcaggtcctggaggactccgggcgtggtgtccagattcaggcacaccctagccagctggtgttgacactggaaggagaggatctgggcgagttggataaagcaatgcaacacatatcataccttaacagccgccagttccccacacccggcatacggagactgaagattacaagcacaatcaaatgctttaatgaagcgacctgtatatctgtgcctccagtggatggctacgtgatggtgctgcaacctgaggagcccaagatatccctctcgggagtgcatcatttcgctcgtgccgcttcagagtttgagtctagcgaaggcgtgtttctatttcccgagcttagaatcatttctaccatcacaagggaggtggaaccagagggggatggagccgaggatccaaccgtgcaagaatcattggtgtcagaggagatcgtccacgatctggacacttgcgaggtcactgtggagggcgaggagctgaaccacgaacaagagtctctggaggtggatatggcccgactccagcagaagggcattgaggtctcttcttccgagttaggtatgacctttacaggtgtggacaccatggcctcctatgaggaggtgctgcatctcctcagataccgcaactggcatgctcgctccctcctggaccgtaaatttaagctgatttgttctgagctcaacggcaggtacataagcaacgaatttaaagtggaagttaacgtgattcatacagccaatcccatggagcatgctaaccacatggccgcccagcctcagtttgtgcatccagagcacagatcatttgtcgacttatctggacacaacttagcaaacccacacccgttcgccgtagtgccttccactgccacggtcgtgattgtggtctgcgtgagctttttagttttcatgattattctgggggtgttcagaataagagcagcccatcggagaactatgagagaccaggacactggcaaagaaaacgagatggattgggatgattcagccctaacaatcacagtcaaccctatggagacctacgaagaccaacacagctccgaagaggaggaagaggaagaagaggaagaggagagtgaagacggtgaggaagaggatgatatcacaagtgcagagagtgagagttcggaggaagaagagggcgagcagggagaccctcagaacgccacacggcaacagcagttagagtgggacgactcaacgctgtcgtattag

SEQ ID NO: 9202 - DNA, 678 bp, Artificial Sequence
  Description of Artificial Sequence: Synthetic coding sequence
atgagcggctgcagcaagcggtgcaagctgggcttcgtgaagttcgcgcaaaccatcttcaaactcatcaccggaacattgagcaaggataagatcgaggacgagcttgaaatgaccatggtgtgccaccgacccgaaggacttgagcagctggaagcccagaccaatttcaccaagagagaattgcaggtgctgtaccgcggctttaagaacgaatgcccatcaggcgttgtgaacgaagatacgttcaagcagatctacgcacagttttttccccacggtgatgcctcaacatacgcccattacctgttcaatgcctttgataccacccaaacaggctccgttaagtttgaggactttgtgaccgccctctccatccttttgagaggtacagtacacgagaagcttcgttggacattcaacctgtacgatatcaacaaagatgggtatattaataaagaggagatgatggatattgtaaaagcaatttacgacatgatgggcaaatacacatacccagttcttaaggaggacactccgaggcagcatgtagacgttttcttccagaaaatggataagaataaggacgggattgttaccctggatgagttcttggaatcctgccaagaggacgacaatatcatgcgcagtctgcagctttttcagaacgtgatgtag

SEQ ID NO: 9203 - DNA, 420 bp, Artificial Sequence
  Description of Artificial Sequence: Synthetic coding sequence
atgtacaagctggccagctgctgcctgctgttcatcggcttcctgaacccgctgctcagcctgccactgctcgatagcagagagatttcctttcagctgagtgcccctcacgaagacgccaggctcacccccgaagaacttgaacgagccagcctactgcagatactgccagagatgctgggtgctgaaaggggtgacatcctgaggaaggcagactcatccactaacatctttaatcccagggggaatttgagaaaattccaagatttttctggacaagatcccaatatcctcttgagccacttactggcccggatttggaaaccctacaagaaacaacgacggaagcttcggcaggatctgagattatggaaaaaagaacccggcttgcgcatatttaagaactacgtgtgggtgtag

SEQ ID NO: 9204 - DNA, 879 bp, Artificial Sequence
  Description of Artificial Sequence: Synthetic coding sequence
atggaggtgaccgccgtggccacccagggcggctacggcagcagcgattgggtgactagttacctcttgatgttcagcgacggcggccgcaactggaaacagtacagacgagaagagtctatttggggctttccagggaatacaaacgctgacagcgtggttcattaccgtctccagcctccattcgaagcacgtttcttgaggtttttgcctctcgcttggaatcctagaggcagaattggaatgcggattgaggtgtatggctgtgcttacaaaagcgaagttgtttactttgacggccaatctgcactcttgtaccggctggacaagaagccactgaagcccataagggacgtaatttccctaaaatttaaagcgatgcagtctaacggaattctgctgcaccgtgaaggccagcatggaaatcacatcactctcgaactcataaaaggcaagctggtattttttctgaattctggcaacgctaaactgccaagcacgatcgccccagtcacattaactctgggctcactcctggatgatcagcattggcactccgtgttaatcgagttgctagacactcaggtgaatttcaccgtcgataagcacacacatcattttcaggcaaagggggattcctcctatttagacctgaacttcgagatttccttcggtggcattcctactccaggtagatcccgcgccttccgaaggaagtcatttcatggctgtcttgaaaatctgtattataacggagtggatgtgacagaattggcaaaaaagcacaaacctcagattctgatgatggagctggcccacggcctccaagatcagaacttgaagatctctcttacggtttgtcatcagaccacacagtag

SEQ ID NO: 9205 - DNA, 783 bp, Artificial Sequence
  Description of Artificial Sequence: Synthetic coding sequence
atgaagaccagcgacggcttcaccctgaacgccgagagctacgtgagctttacaaccaaactggacatcccaaccgcagcgaaatacgagtatggggttccactgcaaacaagtgattcttttttgcggttcccctcctctttgacctcttccctttgcactgacaataacccggccgcattcttggtcaaccaagctgtgaagtgtacacgtaagattaatctggaacagtgcgaagagatcgaagcactgtccatggccttctacagctctcccgagatcctgcgtgttcccgactcccgaaaaaaggtgccaattaccgttcagagcattgttatccagtcactaaataagaccctcactaggcgcgaggatacggacgtgcttcaacccaccctggtcaatgctgggcatttttcgctatgcgtgaatgtggtccttgaagtaaagtattctctcacatacaccgatgctggagaagtcaccaaagctgatctatcatttgtgctcgggacagtgagcagtgtggtggtgcctcttcagcagaagttcgaaattcactttctccaaacggactggtcctctccggtgagcgccagatccacggaaggagaggagcccgccgtcggacccggcctccccaggctgcgcgggcccttctggaagtttcccgggcctggccatgccggacttggagcccaccctctgcatcaccccgtcatccagcaagaaggttttctaccagccccacgaggcttcggctaccgttcagaggtggattag

SEQ ID NO: 9206 - DNA, 3624 bp, Artificial Sequence
  Description of Artificial Sequence: Synthetic coding sequence
atggccagcgtggcctgggccgtgctgaaggtgctgctgctgctgccgacccaaacatggtcacccgtgggagcggggaacccacccgattgcgacgccccactggcttcggccctgcccaggtccagtttctcctccagcagcgaattatcatcgagccacggtcctggcttttctaggcttaatcggcgggacggcgccggcggctggactccactagtgagcaataagtatcaatggctgcaaatagatctaggggaaagaatggaagtcacggcagtcgccacacagggcggctatggaagcagcgattgggtgactagctacttgctaatgtttagtgatggcggaagaaactggaagcagtataggagagaggagtcaatatggggattccccgggaacacaaacgccgactctgtcgtgcattacaggctccaaccacccttcgaggcacgttttttgcgctttcttcccctcgcctggaatcctcggggaagaatcggtatgcgaattgaagtatacgggtgtgcatataaatctgaggttgtctacttcgatgggcagtctgctctgctttatcgtctggataagaagccgctgaaacccattcgcgatgtcatctccctgaagtttaaagccatgcagtcaaacggaatcctgctccatagggagggccagcatggcaaccacattaccttagagctgatcaagggtaaacttgtgtttttcctgaacagcgggaatgcaaagttgccctccactatcgcccctgtgactttaactctggggagcctgctcgatgaccagcattggcactctgttctgatcgagctcctggatacccaggtgaattttaccgtcgacaagcacactcatcacttccaggccaagggagactcgagctatttggacttgaacttcgaaatcagctttggtggtatccctactccgggtcggagccgcgcattcagaagaaaatctttccacggctgcttagaaaatctatactacaatggcgtggacgtcaccgagttggctaaaaagcacaaaccccagatactaatgatgggcaatgtgtctttcagctgcccacagccacagaccgtcccagttaccttcctgtcaagtcggagttacttagcccttccaggaaacagtggcgaagataaagtttctgtgactttccagtttagaacctggaaccgcgctggacacctgctcttcggggagcttagaagagggtccggttcctttgtcttgttcctcaaagatgggaagctaaagttgtcgctgtttcagccaggccaatcacctagaaatgttacagcaggagccggtttgaacgacggccagtggcactccgtcagctttagtgctaagtggagtcatatgaatgtagtggtcgacgacgacaccgctgtgcagccactggtggccgtattaattgactccggagacacttattacttcggcggctgtctcgataattccagcggttctggttgcaagtcacctttgggggggttccaaggttgcctcagactcatcacaataggtgataaagcagtggaccctattttagtgcagcaaggggccctcgggtctttccgcgatctccagatcgattcctgcggcatcactgatagatgcttaccaagttactgcgagcacggtggggagtgctcccaatcatgggacaccttctcctgcgactgtctaggaacaggttacactggtgagacttgccactcttctctatacgaacagtcttgtgaggcccataagcatagggggaatccctccggactgtactatattgacgccgatgggagtgggccattgggcccctttctcgtctattgtaacatgactgatgcggcatggactgtggtgcaacacgggggtcctgacgcagtgacactaaggggagccccttcagggcaccccaggtctgctgtatcttttgcatacgcagccggtgcaggccagctccgctctgccgtaaatcttgcggagcgctgtgagcaacgcttggccctccggtgtgggactgccaggcggccggactccagggatgggacccctctcagctggtgggtgggcagaactaacgagacccacacttcttggggcggaagcctgcctgatgcacaaaagtgcacgtgtgggctggaaggaaactgcatcgattctcaatattactgtaactgtgatgcgggccggaatgagtggacaagcgacaccatcgtcttgtcacaaaaggaacacctccctgttacacaaattgttatgacggatgcggggcgacctcacagcgaggctgcatatacactcggcccattgctgtgccggggtgaccagtccttctggaactctgccagtttcaataccgagacctcttacctgcacttccccgccttccacggtgaactaaccgctgatgtgtgctttttctttaaaactacagtctcgagcggcgtctttatggagaaccttgggatcaccgacttcatcagaattgaactccgcgcccctacagaagtcaccttttcatttgacgtggggaacggtccgtgcgaggtcacggtgcagagcccgactcccttcaacgacaatcagtggcaccatgtccgggcagagcggaatgtaaagggagcatctttgcaggtggaccaacttcctcagaagatgcagcctgccccggctgacggacatgtgcgtctgcagctgaattcccagctgtttatagagattagtgcttacttcgccaccggcagttcaatgacctatcacttccaggaacattatactctgtctgaaaatagtagtagcctcgtctcctccctgcatcgggacgtcaccctcacaagagaaatgattacactctcttttaggaccacgcgcaccccttcactgcttctgtacgtatccagcttctacgaagagtatttgtcagttatcctcgcaaataacgggtcgctacagattcgttataaactggaccggcaccaaaatcctgatgcgtttacatttgactttaagaacatggccgatgggcagctccatcaggtcaagatcaatagagaagaagcggttgtgatggtggaggttaaccagagcaccaagaagcaggtgatcctgtctagcggaaccgaattcaacgccgtcaaatccttgatcctgggaaaggtcctcgaggctgcgggcgccgacccagatactaggagggctgccaccagcggatttactggctgcctcagtgccgtgaggtttgggagggccgcacctctcaaagctgcgcttcgtccgtctgggccctcaagggtgactgtgcgcgggcacgtggcaccgatggcccggtgcgcagccggcgccgcatccggttctcctgcccgggagctggcccctcgattagctggcggagccggccggtccggcccagccgatgagggtgagcccctggtgaatgctgaccgcagggacagcgcggtcatcggaggagtcattgctgtcgttatcttcatactcctgtgcatcactgcgattgctattagaatctaccaacaacggaagctgcgcaaggagaatgaatctaaggtgtcaaagaaagaagagtgctag

SEQ ID NO: 9207 - DNA, 2238 bp, Artificial Sequence
  Description of Artificial Sequence: Synthetic coding sequence
atggccagcgtggcctgggccgtgctgaaggtgctgctgctgctgcccacccagacctggtcaccggttggagccgggaatcctcccgactgcgacgccccgcttgcgtcggcgctcccaaggagtagcttctcaagtagcagtgaactgtcctcttcccacgggcccgggttcagtcgccttaacaggagggacggagccgggggatggacccctctggtctcaaataaataccagtggctgcagatcgacttgggagagcggatggaagtgaccgccgtggcgacccaaggcgggtatggctcctctgattgggttaccagttacttgttaatgttcagcgacggaggccggaactggaagcagtacaggcgcgaagaaagtatctggggctttcccggaaataccaatgcagattctgtagtacactacaggctgcaaccaccatttgaggcccggttcctcagatttctcccattggcttggaaccctagaggacgcattggcatgcgtatcgaagtgtacggatgcgcctacaagtctgaggtcgtgtacttcgatgggcagtcggccctcttgtaccgcctcgataagaaaccccttaagcctatcagagatgtgatcagccttaagttcaaagcgatgcagtccaacggtatcctgctccacagagagggccaacatggcaaccatattactctggagttaatcaaagggaaactggtgttcttcctaaactccggaaatgctaagctgccctcgactattgccccagtaactctgaccctgggcagtctcttggatgaccagcactggcactctgtgcttatcgaactgctagacacgcaagtcaatttcaccgtcgataagcacacacatcactttcaggccaagggagactcgtcctatcttgatctgaacttcgagatttccttcggtggcatccccacacctggccgctccagagcattcaggagaaaatcctttcatgggtgtctggagaacctatactataacggcgttgacgtaacagagctagccaaaaagcacaagcctcagattctaatgatgggtaatgtaagcttctcctgtccgcagccccagaccgtgcccgtcacgtttctatccagccgaagctatctggccttgcctgggaacagtggcgaagataaagtctctgtgacattccagtttcgaacgtggaatcgcgcagggcacctcctttttggcgaattgaggcggggttccggcagctttgtgctgtttctgaaagacggtaagctgaagctgtccttgtttcagcctggtcaatcaccacgaaatgtcaccgccggcgcaggactgaacgatgggcagtggcactcagtgagtttttccgctaagtggagtcacatgaacgttgtcgtggacgacgatactgccgtgcaaccgcttgttgctgtcctcattgatagcggggatacatattatttcggcggttgcttggataactcttccggttctggttgcaaatcgccccttggcggcttccaaggttgccttcgcttaattactatcggggataaggctgtcgaccccattctcgtgcagcagggcgctcttggcagtttcagagaccttcagatcgactcttgcggcatcaccgatcgttgtctgccttcttactgcgagcacggcggggaatgttcccagtcttgggatacattctcttgcgattgtctgggcactggctacacaggtgagacatgccatagcagcctatatgaacagtcttgtgaggcccacaagcatagaggtaaccccagcggactgtattacatcgatgccgacgggtccggtccgttgggtccgttcctcgtctattgcaacatgaccgatgcagcctggaccgtagttcagcacggagggcccgatgctgttactctgcgcggggcaccatccggtcaccctcggtctgcagtgtctttcgcgtatgctgcgggcgctggtcaactccggtctgcagttaaccttgccgagcgctgtgagcaacggctagcgctgaggtgtggcactgcacgtcggccagacagccgtgatggaactccactaagctggtgggttggccggactaatgagacccatacctcatggggaggctcactgccagacgcacaaaagtgcacgtgcggacttgagggcaattgtattgattctcaatactactgcaactgtgacgccggacgtaatgaatggtag

SEQ ID NO: 9208 - DNA, 549 bp, Artificial Sequence
  Description of Artificial Sequence: Synthetic coding sequence
atggagccccagctgggccccgaggccgccgccctgcggcccggctggttggctttactcctgtgggtttccgccctctcatgctctttctctcttcctgcttcctctctcagctctctagttccacaggtccggactagctataacttcggaaggacgttcctcggcttagacaagtgcaatgcctgcatcggaacgtcaatatgcaagaagtttttcaaagaagagattcggtccgacaactggctggctagccacctgggtctgcctcccgattctctcttgagctacccagctaactactccgacgactcgaaaatttggcgccctgttgaaatttttcggctggtgtccaagtaccaaaatgagatttccgacaggagaatatgcgcctcagcgtccgctcccaagacgtgttctattgagcgggtgctacggaagactgagcgctttcagaagtggcttcaggctaagcggctgactccggatcttgtgcaggactgtcatcagggacagcgtgagctgaaatttctgtgcatgctccgctag

SEQ ID NO: 9209 - DNA, 282 bp, Artificial Sequence
  Description of Artificial Sequence: Synthetic coding sequence
atggacagcctgcggaagatgctgatcagcgtggccatgctgggcgcaggtgccggtgtggggtacgctctgctcgtcatagtgacacctggggaacgaaggaagcaagagatgctcaaggaaatgcctcttcaggacccacggagtcgggaagaggcagcccggacccagcagttgctgctggcaactctgcaagaagcggccacgacacaagagaatgtggcttggcgcaagaactggatggtgggtggtgaaggaggggctggcggacgttccccctag

SEQ ID NO: 9210 - DNA, 387 bp, Artificial Sequence
  Description of Artificial Sequence: Synthetic coding sequence
atgggcaagagcgccagcaagcagttccacaacgaggtgctgaaggctcacaacgagtatcgacaaaaacacggcgtgccacccctcaagttgtgtaagaacctaaatcgcgaggcccagcaatattccgaggctttggcttcaaccagaatcctgaagcattctcctgaatcatcccgcgggcagtgcggtgaaaatctggcttgggctagctacgatcagacagggcactttaccgctatggtgtggaagaataccaaaaagatgggcgtgggcaaagccagcgctagcgacggctcatcattcgtagtcgctcggtactttcccgcgggaaatgtggtcaatgaggggtttttcgaagaaaacgtcttgcccccaaagaagtag

SEQ ID NO: 9211 - DNA, 465 bp, Artificial Sequence
  Description of Artificial Sequence: Synthetic coding sequence
atgggcaagagcgccagcaagcagttccacaacgaggtgctgaaggcccacaatgagtaccggcagaaacacggggtccctcctctcaaactgtgcaaaaacctgaacagggaggctcagcaatactccgaagccctggcctcgacccgcatactgaaacacagtcctgaatcctcaaggggccaatgcggcgaaaatctggcttgggcttcctacgaccaaaccgggaaagaggttgctgatcggtggtactctgaaataaaaaactataactttcagcaacccgggttcacttctggaacgggacactttacggcaatggtttggaagaatacgaagaaaatgggcgtagggaaggctagcgcttccgacgggtcatcattcgtcgttgcccgatactttcccgccggaaatgtggtcaacgaagggttcttcgaagagaacgtgctgccgccaaaaaagtag

SEQ ID NO: 9212 - DNA, 831 bp, Artificial Sequence
  Description of Artificial Sequence: Synthetic coding sequence
atggacagcagccgggagcccaccctgggccggctggacgccgccgggttttggcaggtgtggcagcggtttgatgcagacgagaagggttatattgaagaaaaggaactggacgctttcttcttacacatgttgatgaaattagggaccgatgacacggtcatgaaggctaacctgcataaggtcaaacagcagtttatgactacacaggatgcctctaaggacgggcggattcgtatgaaagaactggcaggaatgttcttgagtgaggatgagaacttcctactgttgttccggcgagaaaatccattagactcgagtgtggaattcatgcagatctggcgcaaatatgacgctgattcatctggcttcatctcagccgccgagttgcgtaattttctacgcgatctattcctgcaccacaaaaaagctatttctgaagcaaagctggaggagtacaccggaactatgatgaaaattttcgaccgtaacaaggatggcagattagacctcaatgatctggcacggatactggccttgcaggaaaattttctgcttcagtttaagatggatgcctgcagcaccgaagaacgcaaacgggacttcgaaaagattttcgcatattatgatgttagtaaaacaggagccctggagggtcccgaagtagatggtttcgttaaagatatgatggagctcgtgcagccatcaatttccggggtcgacctggataagtttagggagatcctgctgcgccattgtgatgtcaataaggacgggaaaatacagaaaagcgagctcgcactttgtctgggcctgaagattaatccctag

SEQ ID NO: 9213 - DNA, 216 bp, Artificial Sequence
  Description of Artificial Sequence: Synthetic coding sequence
atgcccgccggcgtgcccatgagcacctacctgaagatgttcgccgcttcacttctggctatgtgcgccggcgcagaggtcgtacatcgctactataggccagacctcacaatacctgaaatcccccctaagcggggtgagctgaaaaccgaactactgggcctgaaggaacgcaagcacaagccccaggtctcacagcaggaggaactcaaatag

SEQ ID NO: 9214 - DNA, 1287 bp, Artificial Sequence
  Description of Artificial Sequence: Synthetic coding sequence
atgaagcccatgctgaaggacttcagcaacctgctgctggtggtgctgtgcgactacgtgctgggtgaagcagagtacttgctgctgagagagcctggccatgtggctctgtctaacgacaccgtgtatgtggatttccaatactttgatggggccaacgggacgctcaggaacgtgagtgtcttgctgctggaggcaaatacaaaccaaacagtgaccactaagtatctgctgacgaaccagtcccagggcacattgaaattcgagtgcttttacttcaaagaagctggtgattattggttcacaatgacaccggaggccacagacaacagtacacctttcccttggtgggagaagagcgcattcttgaaagtagagtggcccgtgtttcacgttgatctaaacagaagcgcaaaggctgctgaaggaaccttccaagtcggtctgttcactagccagcccctgtgccccttccctgtggacaaaccaaatatagttgtcgacgttatcttcaccaactctcttccagaagcgagaaggaatagcagacagccactggagattcgtacttctaagcggactgaactggctcaagggcagtgggtcgagtttggctgtgcgccgttgggtcccgaggcgtacgtgactgtggttttaaagctgttgggacgggattcagtgataacgtccacgggaccgattgatcttgctcagaaattcgggtacaagctagtcatggtaccagagcttacttgcgagtctggggtggaagtcaccgtcctgccaccaccctgcaccttcgtgcaaggggtggtcacagtatttaaagaagcgccaagataccccggcaaaagaaccattcatctagctgagaattccctgcccctgggggagcgacggaccatttttaactgtacactatttgacatgggcaagaacaagtactgcttcgatttcggaatttcttctcggtctcatttttctgccaaggaagagtgcatgctgattcagaggaacacagagacctggggactgtggcagccctggtcccaatgttcagctacctgtggagatggggtccgcgaacggaggagagtttgtcttacttccttcccttcctccccagtctgtccagggatgtccttagaagcatctttgtgttcattagaggaatgcgctggacgctttcggagttgttgcccaggctggtccgccatggtgaggtctaggctgactaattctgcaagtcgcgtccaggccatactgctgccacagcctcttgcttag

SEQ ID NO: 9215 - DNA, 312 bp, Artificial Sequence
  Description of Artificial Sequence: Synthetic coding sequence
atgaagctgtgcgtgaccgtgctgagcctgctggtgctggtggccgccttttgctcactggccctctcagccccaatgggctcagatcccccaactgcatgctgcttcagctacacagccaggaagctgcctcgaaatttcgttgtcgattactatgagacctcaagcctatgctctcagccggctgtagtgtatcgcgagagcgcaagttcggcagcccctgggcgcatcccttccacgagagcagccccacacggaccatggtccggcaggggcagatgccttccccaggcaagggataaggcccgatag

SEQ ID NO: 9216 - DNA, 279 bp, Artificial Sequence
  Description of Artificial Sequence: Synthetic coding sequence
atgaagctgtgcgtgaccgtgctgagcctgctggtgctggtggccgcgttctgttcactggcactgtccgcaccaatggggtctgacccacccaccgcgtgctgctttagttacacagcccggaaactccctaggaattttgtggtcgactactacgaaacaagctcgctttgttcacagcctgcagtgccatgggattccaatctcggaaaacaggtgtgcgctgatcccagtgaatcctgggttcaggaatatgtgtacgacttagagctaaactag

SEQ ID NO: 9217 - DNA, 282 bp, Artificial Sequence
  Description of Artificial Sequence: Synthetic coding sequence
atgcaggtgagcaccgccgccctggccgtgctgctgtgcaccatggcattgtgcaaccaggtcctgagcgccccactcgcagctgatactcccaccgcatgctgttttagctatacttccagacaaatcccacagaacttcattgcagattactttgagaccagttctcagtgcagcaagcctagtgtgatctttctcacaaaacggggtaggcaagtgtgcgctgacccaagcgaggaatgggtgcagaaatatgtctcagacctggaactctcagcatag

SEQ ID NO: 9218 - DNA, 1869 bp, Artificial Sequence
  Description of Artificial Sequence: Synthetic coding sequence
atgggcaagagcgagggccccgtgggcatggtggagagcgccggccgtgcagggcaaaagcggccaggctttctggagggcggccttctcctcctgctgttgctggtaaccgccgctctggtcgcactcggcgttctctatgccgacagacgcggaaaacagctcccccgtctggcctcacgtttatgcttccttcaggaggagcgcacctttgttaaaagaaagccgcgcgggatccctgaggctcaggaagtcagcgaggtatgcaccacgcctgggtgcgtgatcgctgcagccagaatcctgcagaacatggatcccaccacagagccatgcgatgacttctaccaatttgcctgcggagggtggctgagacgccacgtcattcctgaaaccaatagtcgctattccatttttgacgtgcttcgagatgaactggaggttattttaaaggtggagctggaaacacagcttgccaaggccacagtgccccaggaggaacgacatgatgtgattgcattgtaccaccggatgggtctcgaggagctacagtcccagtttgggctgaagggctttaactggacgctctttatccagaccgtcctaagtagcgttaaaattaagctactccccgacgaggaagttgtggtctatggcattccgtacctgcagaatctggaaaatatcatcgacacttattcggctcggactatacagaactatttagtttggagactcgtcctggacagaatcggatcactgtcacagcggtttaaagacactagggtgaactatagaaaagcactctttggaacgatggtggaggaggtcagatggcgggaatgcgtgggctatgtgaactccaatatggagaatgccgtaggctccttgtacgtccgcgaagctttccctggggattccaagtctatggttagggaactaatagacaaagtccgcaccgtgtttgtcgagaccctggatgagctgggatggatggacgaggaatcaaagaaaaaggctcaggaaaaggccatgagcattcgagaacagatcggacaccccgactacatcctggaagaaatgaatagaaggttggatgaggagtatagtaatttgaattttagcgaggacctttacttcgagaattccctccaaaacctcaaggtgggcgcccagcggtctctgagaaagcttagggagaaagtggatccaaacctgtggatcatcggtgccgccgttgttaacgctttttatagccccaataggaatcagatcgtctttccagccggtattctgcagcctccatttttcagtaaggagcagccccaggcactcaacttcgggggaatcggtatggtaattggacatgagatcacacatggctttgacgataatggacggaattttgacaagaatggtaacatgatggattggtggtcaaactttagcactcagcactttcgcgaacagagcgagtgtatgatttatcagtacggaaattattcctgggacctggcagacgagcagaacgtaaacggctttaacacgctgggtgagaacatagctgacaacggcggagtgcgccaagcctataaggcttacctcaaatggatggcagaaggcgggaaggaccagcagctgccgggcctagatctgactcatgagcagctcttcttcattaactacgcccaagtgtggtgtgggagctaccggcctgagttcgctattcagagcatcaagacagatgtccactctcctttaaagtacagagttctgggctctctgcagaatttagctgcatttgccgatacatttcactgtgcacgcggtacaccgatgcatcccaaggagcgctgtagagtgtggtag

SEQ ID NO: 9219 - DNA, 2340 bp, Artificial Sequence
  Description of Artificial Sequence: Synthetic coding sequence
atgggcaagagcgagggccccgtgggcatggtggagagcgccggccgggcaggccagaagcgaccaggtttcctggagggaggactcctccttctgctgttgctggttacagccgctctggtggctctcggcgtcctatatgccgaccgccgaggaaagcagctgccccgcctggcctctaggctgtgtttcctgcaagaagaacgcaccttcgtgaagcgaaagcctcgcggtataccggaggcccaggaagtgtccgaagtctgtactactccgggctgcgtcatcgctgcagctcgaatcttacagaacatggatccgaccacagagccttgcgatgacttctatcagttcgcatgtggaggctggctgcgcagacacgtcatccccgaaacgaactcgcgatacagtatcttcgatgtgctccgtgatgagctcgaagtgattcttaaagcagtgttggaaaactcaacagctaaggataggcctgcagtggagaaagcacggacactatatagatcatgtatgaaccaaagcgtcattgaaaaacgggggtcccagcctctccttgacatcctggaggtcgtcggcgggtggcctgtcgccatggaccgctggaatgagacagtgggcctggagtgggagctggagcgacaattggcgctgatgaatagccagttcaacagaagggtgcttatcgatctctttatctggaacgacgatcagaactcgtcccgccacatcatttacatcgaccagcctacactcggtatgccaagtagagaatattattttaacggtgggtctaacaggaaggtgagagaggcataccttcaattcatggtctcagtggcaacacttttgagggaagatgccaacctgccccgagactcctgtctggtccaggaggatatggtgcaggtgctcgagctggagacccagctggccaaagcgacagtcccacaagaggaacggcacgacgttatcgccctttatcatcgtatgggcttggaagagctccagagtcaatttggtctaaaggggtttaactggactctgttcatacagactgtgttgtctagtgtcaagatcaagctgcttccagacgaagaagttgtggtatatgggatcccttatctacagaacctggagaatatcattgatacctacagcgcaagaactattcagaattaccttgtgtggagattagtgctggatagaatagggtccttgtcccagagatttaaggatacccgcgtcaattaccggaaggcgctcttcggtactatggtcgaggaggtgcgctggcgcgagtgcgtcgggtacgtaaactccaacatggagaacgctgtgggcagtctctacgttagggaagcattcccaggcgactctaaatccatggtgcgggaactcatcgataaagtcagaactgttttcgttgagacactggacgaactgggatggatggatgaggagagcaaaaagaaagcccaagagaaagccatgagcatacgtgagcagattggtcaccccgactatatcttagaagagatgaaccgaaggctggacgaggagtattccaaccttaatttcagtgaagatctgtattttgagaattcgttgcagaacctcaaggtgggagcccaacgcagtcttcggaaactccgtgagaaggtcgatcccaacttgtggatcataggagccgctgttgtgaacgcgttctattcaccgaacagaaatcagattgttttcccagctggcatcctacagccccctttcttttccaaggagcagccgcaagcattaaactttgggggtattggaatggtgatcggccacgaaattacacacggttttgatgataacggcagaaattttgataaaaacgggaatatgatggactggtggagtaatttctcaactcagcatttccgagaacagtccgaatgcatgatctatcagtatgggaattactcctgggatctggccgatgagcagaatgtgaacggcttcaacactctcggcgagaacatcgcggacaacggtggagtcaggcaagcctataaggcctatctgaagtggatggcggaaggcggtaaggaccagcaacttcctggcttggacttgacccacgaacagctgttttttattaattatgcacaggtgtggtgcgggtcttatagacctgaatttgccatccagagcatcaaaactgacgttcacagtccactgaaatacagagtgctgggcagcttacaaaacctcgctgcattcgcggataccttccattgcgcgaggggcactcctatgcatcctaaggaacgttgccgggtatggtag

SEQ ID NO: 9220 - DNA, 258 bp, Artificial Sequence
  Description of Artificial Sequence: Synthetic coding sequence
atgagcgtgcacatgcccgccatgaagatctgcgagaagctgaagaaattggactcacagatttgcgagctcaagtacgaaaaaacgttggatctagcctccgtcgatctgagaaagatgcgagtggcagaactgaagcaaattttgcactcatggggtgaagagtgcagggcgtgtgcagaaaagacggactacgtgaacttaatccaggagctggctccaaagtacgcggccacacaccccaagaccgaactgtag

SEQ ID NO: 9221 - DNA, 657 bp, Artificial Sequence
  Description of Artificial Sequence: Synthetic coding sequence
atgggccgggtgttcctgaccggcgagaaggccaacagcatcctgaaacggtacccaagggcaaatgggttcttcgaggaaattagacagggaaatatcgagcgagaatgcaaggaggaattttgcacctttgaagaggcccgggaagcctttgaaaacaacgaaaaaactaaagagttctggtccacatatacaaaagcccagcagggagagagtaatcgcggatccgattggttccagttctacctgacattccctcttatcttcggcctcttcattatcctgcttgtgatttttctcatttggcgctgcttcctcaggaacaaaactagaagacagacggtcaccgaggggcacatcccgttcccgcagcacttaaatattataacccccccaccaccgccagacgaagttttcgatagtagtgggctgagtccggggtttctgggatacgtggttggtcgttctgatagcgtctctacgaggctgtccaactgtgaccctcctcctacgtacgaagaggcaacagggcaggtgaacctgcagagatccgagaccgagccgcacctggacccaccgccagagtacgaagatattgtgaactccaacagcgcctcagcgattccaatggttccagtcgtgaccactatcaaatag

SEQ ID NO: 9222 - DNA, 1365 bp, Artificial Sequence
  Description of Artificial Sequence: Synthetic coding sequence
atggcccggcccaacaagttcctgctgtggttctgctgcttcgcctggctgtgcttccctatctctcttggaagtcaagcgtcaggaggcgaagcccagatcgcagcaagcgccgagttagaaagcggagccatgccttggagcctgttgcaacacattgatgagagagacagggcagggctgctcccagccctctttaaggtcctgagtgtaggacgaggggggagtccacgacttcaaccagatagtcgcgctttgcactacatgaagaaactgtacaaaacatacgcaaccaaagagggtatccccaaatccaaccgcagccacctctacaacactgtgcgcttgtttaccccttgtacgcgtcacaagcaagcccccggcgatcaggtgactgggattctcccaagtgtagagctgctatttaatcttgacagaattacgacagtagagcatctactgaaaagtgtcttgttatataatattaataatagcgtctccttttcaagtgccgtaaagtgcgtttgtaaccttatgattaaggagcccaaaagttcttctagaacactgggacgtgccccttactcctttactttcaacagccagtttgagttcggaaaaaaacataaatggattcaaattgatgtcacctccttgctccaacctctcgtggccagcaataagcgcagcatccacatgagcattaacttcacatgcatgaaagatcaactggaacaccccagtgcacagaatgggctatttaatatgaccctggtctcaccttcactaatactttatcttaacgatacctctgcccaggcttatcattcttggtacagcctgcactataagcgaaggcctagtcagggccccgatcaggaacgtagcctcagcgcttaccccgtgggagaagaagcagcagaggacggcaggtcttctcaccacagacacaggcgggggcaggagactgtctcctccgaactgaagaagccccttggccccgccagcttcaacctcagcgagtatttccggcagttcttattgccacagaacgaatgtgagttacacgattttcggctctccttctcccagctgaaatgggacaattggatcgtcgccccacatcgttataatcctcggtactgcaaaggcgactgtccacgagccgttgggcataggtatggttccccggttcatacgatggtacaaaacataatttatgagaagttagactcttctgttccacgcccctcttgcgtcccagcgaagtattctccactgtccgtcctgacaatagagccagatggcagtattgcatacaaagaatatgaggatatgatagccacgaagtgcacatgcagatag

SEQ ID NO: 9223 - DNA, 417 bp, Artificial Sequence
  Description of Artificial Sequence: Synthetic coding sequence
atgacctggcggcaggccgtgctgctgagctgcttcagcgccgtggttcttttgagtatgcttagggagggcacttctgttagtgtgggcacaatgcagatggccggagaagaagcaagcgaagacgccaaacagaagatcttcatgcaggaaagcgatgctagcaactttctaaagcgccgcggaaaacggagcccgaaatcgagggacgaagtaaacgtagaaaatcggcagaagttgcgagttgatgaattgagaagggaatactatgaagagcaaaggaacgagtttgaaaatttcgtagaggagcagaacgacgagcaggaggaacgatcccgcgaggcagtggagcaatggcgccagtggcactatgacggactgcaccctagctacctgtacaatcggcatcacacatag

SEQ ID NO: 9224 - DNA, 729 bp, Artificial Sequence
  Description of Artificial Sequence: Synthetic coding sequence
atggccctgaagaacaagttcagctgcctgtggatcctgggcctgtgtctggtcgccactaccagctctaagattcctagtatcaccgatccccactttatcgacaactgtattgaagcacacaacgaatggagaggcaaggtgaatccacctgcggcggatatgaagtatatgatttgggacaagggactcgcaaaaatggccaaagcctgggcaaatcagtgtaaattcgaacataacgactgcctcgacaaaagctacaaatgctacgctgcattcgaatatgtcggcgagaacatctggttggggggaataaaaagcttcacccccaggcatgctattactgcttggtataatgagacccaattctacgatttcgacagcctttcctgtagtcgagtatgcggccactatacgcagctagtgtgggctaactcattctacgtgggatgcgcggttgcaatgtgccccaatctaggtggggcttcaacagccatattcgtgtgcaactatggcccggcaggtaattttgctaacatgcctccttacgtgaggggagaatcatgctcactttgctctaaagaagagaaatgcgtaaagaacctctgcaggaccccgcagttgatcatcccaaaccaaaatccatttcttaagcctactgggagagcaccccaacagactgcctttaaccctttctccctgggctttctgttgcttaggattttctag

SEQ ID NO: 9225 - DNA, 813 bp, Artificial Sequence
  Description of Artificial Sequence: Synthetic coding sequence
atgctgcggcagctgctgctggccgccctgtgcctggccggccccccggcacccgcgagagcatgtcagttgccgagcgagtggcgtcccctttctgagggctgccgtgctgagttggcggagaccatagtctacgctagagttctggcgctgcaccctgaagccccagggctgtataaccacctgccttggcagtatcatgctgggcaaggaggcttattctactctgccgaagtcgagatgttgtgcgaccaggcatggggatccatgctggaggtgcccgccggaagtaggctgaacctcactggcctggggtattttagctgtcatagccacaccgttgtccaggactactcctacttctttttccttcgcatggacgaaaattacaacctgctacctcacggcgtcaacttccaggacgctatcttccccgacactcaagagaatcgcagaatgttttctagtttgtttcaattcagcaactgcagtcaggggcaacagcttgctacctttagctcagactgggagattcaagaggacagtcgtcttatgtgttcatcagtgcagaaggccttattcgaggaagaggaccatgtgaagaagttacagcagaaggtggctacccttgaaaaaagaaacaggcagctgagggagcgggtcaaaaaagtgaagaggagtcttcgccaagcccgcaaaaagggacgccacctggagctcgccaatcaaaaattatccgagaaacttgctgcgggggccctgccgcacatcaacgcccggggtcctgtgcggcctccctacctgcgaggttag

SEQ ID NO: 9226 - DNA, 438 bp, Artificial Sequence
  Description of Artificial Sequence: Synthetic coding sequence
atggacgagaactacaacctgctgccccacggcgtgaacttccaggacgccatctttcccgacactcaagagaaccggcgtatgttttcttctttattccaattctccaactgttcccaggggcaacaactggccacgttctcatccgactgggagatccaggaagatagtcgcctgatgtgctcctctgtgcaaaaagccctgttcgaggaagaagatcacgtcaagaagctgcaacagaaggtggcaacactagagaagagaaaccggcaactgcgagagcgggtaaagaaagtgaagcgctcactccggcaggcccgcaagaaaggacgccacctcgaacttgctaatcagaagctaagcgagaagctggctgccggcgccctcccacacattaatgcgcggggccccgtgcgaccgccatacttaaggggatag

SEQ ID NO: 9227 - DNA, 1830 bp, Artificial Sequence
  Description of Artificial Sequence: Synthetic coding sequence
atggagctgggctgctggacccagctgggcctgaccttcctgcagctgctcttaatctcatctctccctcgggaatatacagttattaatgaggcatgccctggagctgaatggaacatcatgtgcagagagtgctgcgaatacgaccagattgaatgtgtgtgccctggaaagagagaagtggtaggatacaccatcccatgctgtcgtaacgaggaaaacgagtgtgattcatgcttaatccacccgggatgtactatatttgaaaattgtaaatcttgtagaaatgggtcgtggggaggaacccttgacgacttttatgtgaaaggcttctactgtgcagaatgtcgggccgggtggtacggaggggactgtatgccttgctcaagcagtccttgcttccacgacggcacttgtgtgctggataaagctggcagttataaatgcgcttgcctcgctgggtatacaggtcagaggtgtgagaatctactggaggaacggaactgctccgatcctgggggcccagtgaacggatatcagaagataaccggtggcccgggcctgattaatgggcgacacgcgaagatcggaactgtggtgtccttcttctgcaacaacagctatgtcctgagcgggaatgaaaagaggacctgtcagcagaatggagagtggtccgggaagcagccgatatgcatcaaagcttgcagagaaccaaaaatctccgatcttgtgcgtcggcgcgtgctgccgatgcaggttcaatccagagagacgcctctacatcagctctactcagctgcattctccaagcagaaattgcaatcagcccccaccaaaaagcccgctcttcccttcggcgacctgcctatgggctaccagcatctgcacacccagttgcagtacgaatgcatttcgccattttatcggcgcctggggagttccaggagaacctgtctccgcacaggcaagtggtccgggagggccccttcatgtatccccatttgcgggaaaattgagaatatcactgcacccaaaacacaaggtctccgctggccatggcaggctgccatttacaggcgcacaagtggcgttcacgatgggagtctacataagggcgcctggtttctcgtctgctctggcgccctggtgaacgaacggaccgtcgtcgtcgctgcacattgcgtgactgatctggggaaagtaaccatgattaaaaccgcagatctaaaggtagtgttgggtaaattctaccgagacgatgatcgagatgaaaagaccatccagtccttacagatcagcgccattatactccaccctaattacgatcccattttgttagacgccgacatcgccattctaaagctgctagataaggcccgaatcagtacacgcgtgcaacctatttgtctggccgccagccgggacctgagcacctctttccaagagtcacatataactgtggccggatggaacgtcctggctgatgtgcggagcccaggctttaagaacgatacccttagatcgggcgtggtaagtgtcgtggactctctcctgtgtgaagaacaacacgaggatcatggtataccagtgtcggtaacggacaatatgttctgcgcaagttgggaacccacagcccccagcgacatttgtacggcggaaaccggcgggattgccgctgtttcattccccggcagagcctctccagagccaaggtggcatctcatggggcttgtttcttggagttacgacaagacatgttcccacagactgtctaccgcttttactaaagttctgccctttaaagattggatcgaacgcaacatgaaatag

SEQ ID NO: 9228 - DNA, 2163 bp, Artificial Sequence
  Description of Artificial Sequence: Synthetic coding sequence
atggagctgggctgctggacccagctgggcctgaccttcctgcagctcctcctcatctcttctctcccacgggaatatactgtgattaacgaagcctgtcccggggctgaatggaatatcatgtgccgcgagtgctgcgagtacgatcagatagagtgcgtctgccctggaaagcgggaggtggtgggatacacaatcccatgttgtaggaacgaggaaaacgagtgtgatagctgtctgatccatccaggatgcacaatcttcgagaactgcaagagttgtcgcaatggatcctggggaggaacacttgacgacttttacgtgaagggcttttattgtgctgagtgtcgagcaggctggtacgggggggattgtatgcggtgcgggcaagttctccgcgcaccaaaagggcaaatcctgctagagtcttatcccctcaatgcccattgtgagtggacaatccacgccaagcccggatttgtcatccagttgcgcttcgtaatgttgagccttgaatttgattatatgtgtcagtatgactatgtagaagtgcgtgatggggataaccgcgatggacagataataaaacgggtatgtggaaatgagcggcccgcaccaatccaaagtataggttcgtctttacacgttctctttcacagtgatggatccaagaattttgatggctttcatgccatctatgaggaaatcacggcatgctcgagctccccgtgttttcacgacggcacctgcgtgctcgataaggctggttcatacaagtgcgcatgcttagcgggctatactggccagcggtgcgaaaacctccttgaggagcgtaattgtagcgacccgggcggtccagtcaatggttaccagaaaataactggcggccctggtcttatcaatggtaggcacgctaagatcggtacagtagttagcttcttttgtaacaactcctacgtgttatccggcaacgaaaagcggacctgtcaacaaaatggcgaatggagtgggaaacagccaatttgcattaaagcctgtcgggagcccaagattagcgatctggtgcggcggcgcgtgcttccaatgcaggtgcagagcagagagacacctttgcaccagctctatagcgcagcattcagcaagcaaaaactgcaaagcgcccctacaaagaaaccagctttgccctttggagacctacccatgggttaccagcaccttcatacccagctccagtatgagtgtatctcaccattttacagacgcctggggtccagcaggaggacatgccttcgcaccggaaaatggagcggacgcgctcctagttgcattcccatttgtggcaaaattgagaatatcactgctccaaagactcaaggactgcgttggccatggcaggccgcaatctacagacgcacttcaggggttcatgacggctcactccacaagggtgcctggttccttgtctgttctggcgccctagttaacgagagaacagtcgtcgtggcagcccattgcgtcacagatctcggcaaagtcaccatgatcaaaacggcagacctgaaggtcgtgttgggcaaattttacagagatgacgaccgggacgaaaagactattcagtccctccagatctcagccatcatactgcaccctaattatgaccccatacttctcgatgctgatattgctattttaaaactgttagataaagcccgaattagcaccagagtccagcctatctgcctggcagcctcaagagatcttagcacttcgttccaggaaagccatataacagtcgctgggtggaatgtgctcgccgacgtccgatcacccggctttaaaaatgacacacttaggtctggggtcgtgtcagtcgttgacagcctgctttgtgaggaacagcacgaggaccatggaataccggtcagtgtgactgataatatgttctgtgcatcttgggaacctacagcaccatctgatatttgtacggccgagactggagggattgccgccgtttctttccccgggcgcgcttccccagagccacgctggcacctgatgggcttggtgagctggtcctacgataaaacgtgttctcatcgcctgtctacagctttcactaaagtgttgccgttcaaggactggatagaacgcaatatgaagtag

SEQ ID NO: 9229 - DNA, 1134 bp, Artificial Sequence
  Description of Artificial Sequence: Synthetic coding sequence
atggaggccctgctgctgggcgccggcctgctgctgggcgcctacgtgttggtgtattataacctggtcaaggcgcctccttgcggggggatgggcaatcttcggggacgaacggccgtggtgaccggtgcaaactctgggatcggcaagatgactgccctggagctggcaaggcgcggagccagagtcgtgttggcctgccggtcgcaggaacgaggcgaagccgctgcctttgaccttcgccaggagtcaggaaataacgaagtaattttcatggccttggatttagcatcactagcgtctgtgcgggcattcgctacagcctttctaagcagcgagccccgtctggatattttgatccataacgcaggaatctcctcctgcggacggacccgcgaggctttcaacctcctgcttagagtaaatcatattgggccgtttcttctgacacaccttctactgccgtgtcttaaagcctgcgcgcccagcagggtggtggtggtagccagtgctgcgcactgccgggggaggctggatttcaaacgcctcgaccgacccgttgtcggctggagacaagagctacgggcatacgccgatactaagcttgccaacgtactatttgccagagagcttgcaaatcagctcgaggctactggcgtgacctgttacgctgcccaccctggccctgtgaattccgaattattcctcagacacgtacctggctggctgcggccactactgcggcccctcgcatggctggtgctccgggcacctagagggggcgcgcagacgcccttatactgcgccctacaggaggggatcgagcctctgtcgggcagatactttgcaaactgtcatgtggaggaggtaccccctgcggctagagacgacagggctgcccatagactatgggaggcatccaaacgcctggcaggactcgggcctggggaagatgcggaacctgacgaagacccacagtcggaagattcggaagctccaagctctctgagcaccccccatcccgaggagcccaccgtgtcacaaccctatccctctccccagagctcaccagacctgagtaagatgactcaccgcatccaggccaaagtcgagccagagattcaattatcctag

SEQ ID NO: 9230 - DNA, 381 bp, Artificial Sequence
  Description of Artificial Sequence: Synthetic coding sequence
atgatcagcttccacgtgatcttcctgagcctgggccggggcaagctgttcctgcctgttaacttctgctttttaaaactcaaaaattctcaggtgcggattcctaaagatttcacctgtaacctccacgtgttatttcggaccgtgcaaggggaggacagaaatactatgtttagagggcattggtctatctacagcaggaactttcctcttgctgttgtgccagcctacgtgactgaagacggcaagaacacatcccatagagccagtggacagttctgcaatgcactgtctcagggtgagatccctagcagtctccaattggtgaatagctacgcactggaacctaggacagacatgccatgcaactttctgacatag

SEQ ID NO: 9231 - DNA, 876 bp, Artificial Sequence
  Description of Artificial Sequence: Synthetic coding sequence
atggccgtgaccctgagcctgctgctgggcggccgggtgtgcgccgccgtgacgcgctgtggatttgcaactagaggggttgccggtccaggacctattggcagagagccggatccagatagtgattgggagcctgaggaacgggagctgcaagaggtggaatctaccttgaaaagacagaagcaggctattagattccagaagatccgcaggcagatggaggccccgggggcacccccccgcaccctgacctgggaagctatggagcaaatccgttatctgcatgaagagttcccagaaagttggtcagtgcccaggctggcagaaggattcgatgtgtctactgatgttataaggagggtattaaaaagcaaattcctccccactctggaacaaaagctgaagcaggatcagaaagtcttaaaaaaggcaggcctggcccatagccttcagcatctgcgcgggagtgggaatacaagcaagttactgcctgccgggcattcagtcagtgggtcactgctgatgcccggacacgaggctagttctaaggatccgaatcactctactgccttgaaagtgatcgagagtgatacacaccggactaacacgccaagaagaaggaaggggcggaataaggagattcaggatcttgaagaaagcttcgttccagtcgcagctcccctggggcatccaagagagctgcagaaatattctagcgacagcgaatcacccaggggcaccgggtccggagccttgccaagcggccagaagttggaggagcttaaagcagaagaaccggacaacttcagtagcaaagtcgtgcagagaggcagagagttcttcgactctaacggtaattttctgtacagaatctag

SEQ ID NO: 9232 - DNA, 2541 bp, Artificial Sequence
  Description of Artificial Sequence: Synthetic coding sequence
atgttcaagtgctggagcgtggtgctggtgctgggcttcatcttcttggagtctgagggtaggcctacaaaagagggcggctacggtctaaaatcttaccagcccctcatgcggctcaggcacaaagagaagaaccaggaatccagcagagtaaaaggttttatgatccaagatgggccgttcggctcttgcgagaacaaatattgtggccttgggcgccactgcgtgacaagtagggagacggggcaagcagagtgcgcctgcatggacctctgcaagcgccattataagcccgtctgtggctccgacggcgagttttacgaaaaccactgcgaggtgcatagggccgcttgccttaagaagcagaaaattacaattgtccacaatgaagactgtttttttaagggagataagtgcaagaccaccgagtattccaaaatgaagaatatgcttctggacctccagaaccaaaagtacatcatgcaagaaaacgagaatccaaacggtgatgacatcagccggaagaaactgctggtcgatcagatgtttaaatacttcgacgcggacagcaacggtctggtggacataaacgagctcacccaggtcataaagcaggaagagctggggaaggatctctttgactgtactttgtatgtgctgcttaagtatgatgattttaacgccgataagcatctggccctcgaggagttttatagagctttccaagtcattcagcttagcctccctgaggatcagaaacttagcattacagctgccaccgtgggacagtctgccgtgctgtcctgcgctatccaaggaacactccgacctcctattatttggaagaggaacaatatcatcctgaataatctcgatctcgaagacattaatgattttggcgacgatggctccctctacatcactaaggttacaacgactcatgtaggcaactatacatgctacgctgacggctacgaacaggtgtatcagacgcatatattccaggttaacgtccctccagtaatacgggtgtaccctgaatcgcaggctagggaacctggggtcaccgctagcttaagatgccacgccgaggggatacccaagccccagcttggatggctaaagaatggaatcgacatcacgccaaagctgtcaaagcagctcactctccaggctaatggtagtgaggtacatatctctaacgtgcgatatgaggatactggcgcttacacctgcatcgcaaagaatgaggcaggagtggatgaggacatcagttcactttttgtcgaggattcagcccgcaaaaccttagcgaatattctctggcgggaagagggactcgggatagggaatatgttctacgttttctacgaagatggcattaaggtcatccagccgatcgagtgtgaattccagaggcatataaagccatctgaaaagttgctcggattccaggatgaagtgtgccccaaggcggaaggtgacgaggtgcagcggtgtgtgtgggctagcgccgtgaacgtgaaggataagtttatttacgtggcccagcccacactggaccgtgtgctcatcgtcgatgttcagtctcagaaagtcgtacaggcagtaagcactgatccagtgccagtgaagttacactacgacaagagccatgaccaggtatgggtcttgtcctggggaacgctggagaaaacctcaccaacactccaagtcattactcttgcaagcggaaatgtaccgcatcataccattcacacgcagcccgtgggtaagcagttcgacagggtcgatgattttttcattcctacaacaaccctcattataacccacatgagattcggattcatcctgcacaaggatgaagctgctctgcagaagatcgatctggaaactatgagttacatcaagaccatcaatcttaaagattacaagtgcgtgccccaatccttggcctatactcacctcgggggctattatttcattggctgcaagcctgactctaccggtgccgtgtcacctcaggtcatggtcgacggggtgacagacagcgtcatcggattcaatagcgatgttaccggcaccccgtatgtgtctcctgacggtcactacctggtgtcgataaatgacgtcaagggcctggtgcgggttcagtacattactatccgcggcgagatacaggaagcttttgatatatatactaatctgcacatctccgacttagcgtttcagccaagcttcacggaagcccaccagtacaatatttacggaagctcatctacacagacggatgtactgtttgtggagctcagttctgggaaggttaagatgattaagtctctaaaggagccactgaaggcagaggaatggccctggaaccgcaagaacagacagattcaggattccgggttgtttggccagtatctcatgaccccatctaaggactctctcttcattttagatgggcgccttaataagctcaactgcgagatcacggaggtcgagaagggaaacacagtgatctgggttggggatgcttag

SEQ ID NO: 9233 - DNA, 291 bp, Artificial Sequence
  Description of Artificial Sequence: Synthetic coding sequence
atgcgggtgaccagcgccacctgcgccctgctgctggccctgatctgttccgtccagctgggagatgcatgcctggacatcgataaacttttagccaacgtggttttcgacgtgtcccaggatttgctaaaagaagaacttgctcgttataacccctccccgctcactgaggagagtttcctcaatgtgcagcagtgcttcgctaatgtctcggtgacagaaagatttgcccactcagtggtgatcaagaagatactgcagtcaaatgattgcattgaggcagcattctag

SEQ ID NO: 9234 - DNA, 1971 bp, Artificial Sequence
  Description of Artificial Sequence: Synthetic coding sequence
atgcggaccgtggtgctgaccatgaaggccagcgtgatcgagatgttcttggtgcttctcgtcacaggtgttcacagcaacaaggagactgcgaagaaaatcaagcggccgaagttcactgttccacagataaactgcgatgtaaaggcgggtaagatcatcgatcctgagttcattgtcaagtgtccagctgggtgccaggatccaaagtaccacgtgtacggaactgatgtctatgcctcctactcatcagtgtgcggggccgcagtccatagcggcgtgttggataacagcgggggcaaaatcctggtgcgaaaggttgcaggtcaaagcggctacaagggctcgtacagtaatggggtgcaaagcctgtccctcccaaggtggagagaaagctttatcgtgctggagtccaagccaaaaaagggtgtaacctatccctctgctctgacttattcttcttcgaagagtcccgcagcgcaggctggggagaccacaaaggcctaccagcggcctcctattcccgggacaaccgcccagccagtgactctcatgcagttgctggccgtgactgtcgctgtggctacccctaccacgctgccaagaccaagtccctcagcagcctcaaccaccagtattccacgcccccaatctgtaggtcaccgctctcaggagatggacctgtggagtacagcaacttacacttcttctcaaaaccgcccacgcgccgatcctggccttgtccccaaggaagaactgagcacacagagcttagagccggtgtccctgggcgatcccaactgcaaaattgatctgagctttttgatcgatggctcgacctcgatcgggaaaagacggttccgcattcagaagcagttgctggcagacgtggcccaggctctggacatcgggccagcaggtcccctgatgggcgtcgtacagtacggggacaacccagcgacccactttaatctcaagacacacactaattctcgggatctgaagacagccatcgaaaagattacacagaggggcgggctctccaacgtgggaagggctatctctttcgtcaccaagaatttcttttctaaagctaatggcaatagaagtggggctcccaacgtggtggtggtgatggtcgacgggtggcctactgacaaggtggaggaggccagtcggctcgcgagggagagtggcataaacatattcttcataacgattgaaggtgctgctgagaacgaaaagcagtacgtggtggaaccaaattttgctaacaaggccgtgtgtaggacaaacggattttacagtttgcacgtgcaatcatggttcggcctgcacaaaactctgcagcccctggtcaagcgtgtctgcgacaccgacagactcgcctgcagcaaaacctgcttaaatagcgccgatattggctttgtgattgacgggtccagttccgttgggactggaaactttcggaccgtccttcagttcgtcacaaatttaactaaggagtttgagatcagcgataccgacactcgtattggcgctgtgcagtatacatatgagcagagactggagtttggattcgacaagtatagcagtaagcccgacatcttaaacgccattaaacgtgtcggctattggtcaggcggcacttcgaccggcgcagccatcaatttcgccctagagcaactgttcaagaagagtaaacctaacaagcgaaagctgatgattctaattacagacggaagaagctatgatgacgtgaggatacccgcgatggccgctcatctgaagggagtgattacctacgccataggagtcgcctgggcagcccaggaggaacttgaagtgatcgcaacccaccccgcaagggaccacagtttcttcgtggacgagttcgacaacctgcatcagtacgtgccaagaataatccagaatatttgcactgagtttaattctcagccaagaaactag

SEQ ID NO: 9235 - DNA, 2082 bp, Artificial Sequence
  Description of Artificial Sequence: Synthetic coding sequence
atgcggaccgtggtgctgaccatgaaggccagcgtgatcgagatgtttctcgtgttactggtaactggagttcactcaaataaggaaaccgcaaaaaagatcaaacggccaaagtttacagtgcctcaaatcaattgtgatgtcaaggcaggaaaaattattgatcccgagttcattgtgaagtgtcctgcaggatgccaggatcccaaatatcatgtctatggcaccgacgtgtatgcatcctactcatctgtctgcggagccgccgtgcatagcggagtgctggacaactcaggcgggaagatcttagtgaggaaagtcgcaggccagtctggatataagggctcatattcgaacggagttcagtccctcagcctgcccagatggcgcgaaagcttcattgtgctcgaaagcaaaccgaagaaaggagtaacatacccaagcgcacttacatacagcagcagcaaatcacccgcggcacaggctggggaaacgacaaaggcctaccagagaccaccgatcccaggtactaccgcccagcccgtgactctgatgcagttgctagcagttacggtcgccgtggccacaccaaccaccctgccccgtccctcccctagcgctgcaagcacaacctccatccctcgcccccagagcgtggggcacaggagccaggagatggatctgtggtcaacagccacttacacctcttcacaaaaccgcccgcgcgccgaccccggaatacaaaggcaggatccaagcggggctgctttccagaagcccgtaggagctgacgtaagtctcggggaaatggatagctggaagcccgggtcagtgctgttggatgagggactcgttccaaaggaggaactcagcacccagtcactggagccagtttccttaggagatccaaattgtaaaattgatctctccttcctgatcgatggatctactagcattggtaagaggagattccgcattcagaaacagctcctggccgacgtggcacaggctctcgatatcggaccagctggacctctcatgggggttgtgcagtacggagataaccccgccacacattttaacttgaaaacacacactaactccagggatctgaaaaccgctatcgagaaaatcactcagcgcggaggccttagcaatgtgggtcgagctataagctttgtgactaagaatttcttctctaaagccaatggaaacagaagtggagcacctaatgtagtcgttgtgatggttgacgggtggccaactgataaggtagaagaggccagcaggctggctcgcgagtcaggaataaacatcttcttcatcaccatcgaaggcgctgctgagaacgagaaacagtacgtcgtcgagccaaactttgcaaacaaggcagtttgcagaaccaacggattctactccctgcatgttcagagttggttcggcttgcacaagactttacaacctttggtgaagcgtgtctgcgatactgatcggctggcctgcagcaaaacgtgtctgaacagtgccgacataggcttcgttattgatggcagctcctcagtgggcactgggaattttaggacagttttgcagttcgttacaaacctcactaaagagttcgagatctctgacaccgatactcgaatcggagccgttcagtatacttatgaacagaggctggagttcggatttgacaaatattcctcaaaaccagacatccttaatgcaatcaaaagagtaggctactggtccgggggcaccagcacaggagcagccattaatttcgctcttgaacaactgttcaaaaaatcaaaaccgaataagagaaagctgatgattctaatcactgacgggcgtagctacgatgacgtgagaattccagcgatggccgcgcacttgaaaggcgtgatcacttatgccattggggtggcctgggccgcacaggaggagttggaagtgatagctacccaccctgctagggatcacagcttttttgtggacgagtttgataacctccaccagtatgtgcccaggatcattcaaaatatctgtacagaattcaacagtcaaccccggaactag

SEQ ID NO: 9236 - DNA, 555 bp, Artificial Sequence
  Description of Artificial Sequence: Synthetic coding sequence
atgttctgcctgctgcacctgtgcttctacctggccaacttcgccagcagtatcaagaggactcatgcagtgaatggctgctgtgggctgcagatgattgcactgtgggcgcaaagttctggcaatgctgatgctcgtgtcgaagagattttagccggcgaagaaagacgactggcggcgctgttgggctcccaggggatgcggttttgggtctgcctggcggcctgccgagcaatgtgggggttagctgctcggcgtggcagagccgaagacagttcttcttcgcctgtggacgcttccaagttcccttggcgaggaggacagcacaggacaaccatgatgccatgccttttacgcgtgggagttttccgcccttgccacgtgaggccgaccggggatccctcttgcgatgttcagccacctcggctggggttttcacgggtgcccgatactcaggtggcattttacggcagcgggcactgggacccaactccattctctgtccacagctgctttttcaacttccaggtccgcaagatcatctttctgctgtag

SEQ ID NO: 9237 - DNA, 864 bp, Artificial Sequence
  Description of Artificial Sequence: Synthetic coding sequence
atgaccagcgccgcccactactaccccaagctgatgagcatcatgggcaatgtgctgcgctttctgcctgcttttgtgcgcatgaaacagcttattgaggagggctacgtgggggagccacttgtgtgcgaggtgcaggtccatggcggcagcctcctggggaagaagtacaattggtcatgcgatgatctgatgggcggaggaggcctgcatagcgtggggacgtatataattgacctactgacgttcctcacgggccagaaggcagtgaaagttcatggtctccttaagacgtttgttaaacagactgaccacattaaggggatcaggcagattaccagtgacgacttttgtacgttccaaatggtgctggagggcggcgtctgttgtaccgtgacgctgaacttcaatgtacctggggaatttaagcaggacgtgactgtcgtgggctcggccggtcgcctcctggccgtcggcacagacctgtacgggcagcgcaacagcgcacctgaacaggagctgctagtgcaggacgcgactccagtgtctaatagcctcttacctgagaaagcgttctccgatatccctagcccctatctgcggggaaccattaaaatgatgcaagccgtcaggcaggcgtttcaggaccaggatgacaggcgcacctgggacggaaggccactgacaatggcggccactttcgacgactgtctgtatgctctgtgcgttgttgatacaatcaaacggagctctcagacaggcgagtggcagaatatcgccattatgaccgaggaacctgaactgtctccagcctatctgatatcggaggcgatgcggagaagtagaatgagcctatactgttag

SEQ ID NO: 9238 - DNA, 1173 bp, Artificial Sequence
  Description of Artificial Sequence: Synthetic coding sequence
atgctgcccggcgtgggcgtgttcggcaccagcctgaccgcccgggttatcatcccattgctgaaggatgaggggtttgccgtcaaggccctgtggggtcgcacacaagaagaagccgaggagctggctaaggagatgtccgtgcctttctacacatcccggattgacgaggtgctgctccaccaggacgtggatctggtatgcatcaacctgcccccgccattgacgagacagatcgccgttaagactctgggaattggcaaaaatgttatctgcgaccgaacagccaccccattggacgcctttaggatgacctccgcggcacactactatcccaagctaatgtctatcatgggaaatgtgctgcggttcttgcccgcttttgtgcgaatgaagcaattgattgaagagggctacgtgggcgaacccctagtgtgtgaggtacaggtacacggaggtagtctgttaggcaaaaagtacaattggagctgcgatgatctgatgggaggaggaggcctgcactccgtcggaacatacattatcgatttactgacttttctcaccggacaaaaagcagttaaggtgcacggtttgttgaaaacatttgtgaaacagactgaccacatcaagggcattcggcagatcacttcggatgatttctgcaccttccaaatggtactggaaggcggtgtctgttgcacagtgacactgaatttcaacgtccccggggaattcaaacaagatgttaccgtggtcgggtctgcagggcgcctgctggcggtgggtactgacctctacgggcagcggaactccgcgccagagcaggaattgctggttcaggatgctacccctgtttcaaactcgttgctgccggaaaaggccttcagtgatatcccgtccccatacctgcgagggactatcaaaatgatgcaggctgtacgccaagcttttcaggaccaggatgataggcgtacctgggatgggagacccctgactatggccgcaacctttgacgactgcctgtatgccctttgtgttgtcgataccattaagagatcttctcagaccggagagtggcaaaacattgccattatgacggaagaacccgagctgagccccgcctacttaatctccgaggccatgcgccgatctagaatgtcattgtattgctag

SEQ ID NO: 9239 - DNA, 5718 bp, Artificial Sequence
  Description of Artificial Sequence: Synthetic coding sequence
atgcagagccggctgctgctgctgggcgcccccggcggccacggcggcccagcgtctcgaagaatgagactcctactgagacaggtagtgcagcgcagaccagggggtgaccggcaaagaccagaagtgcgactcctccatgctggaagtggagctgacacgggcgacacagtcaatattggggacgtgagctacaagctaaaaatacccaagaatccggagctcgttccacagaattacatttcagactcgctggcacagtcagtggtacagcacttgcgatggataatgcagaaagaccttctggggcaagacgtctttcttatagggccacccggtccgttaagaagatctatcgccatgcaatacctcgagctaactaaaagggaagtggagtatatcgctctgagccgggataccaccgagacggacctgaagcagcggcgggagatacgggccggcacggccttttatatcgatcaatgcgcggtgcgtgccgccaccgaaggccgcacgttgatcctggaaggattggagaaagctgaaagaaatgtcctgcccgtacttaacaatctgctggagaatagggaaatgcagctcgaggacgggaggttcctgatgagcgccgagaggtacgataagcttcttcgagatcacaccaaaaaagagttggatagttggaagattgtgcgtgtgtcggaaaactttcgcgtgatagcgttgggcctaccagttcctaggtattcaggtaatccactcgaccccccactaagaagccgatttcaggcccgagacatttattatctccccttcaaggaccagctcaaactgttgtactcaattggcgccaacgtgtccgcggagaaagtgagccagcttctgtcattcgcaacaaccctttgctcacaagaatctagtacgctaggattaccggatttcccattggattcactcgcagccgcagtgcaaattttagactcatttcccatgatgccaattaagcacgccatccagtggctgtacccctactccatcttgcttgggcatgaaggaaagatggcggtggagggagtattaaagcggtttgaactgcaggactcagggtccagcctgctccctaaggagattgtgaaggtggaaaagatgatggaaaatcacgtgagtcaggcttccgtgacgattcgcatcgcagacaaagaggttactatcaaagttccggcaggcaccagattactctctcagccctgcgccagtgacagattcatacagacccttagtcataagcaacttcaggccgaaatgatgcagtcacacatggtgaaggacatctgtttaattggaggaaagggctgtggcaaaaccgtgattgctaagaattttgccgataccttaggatacaacattgagcctataatgctgtatcaagacatgacagcccgtgatctcctgcaacaaaggtacaccctaccaaacggggacaccgcgtggcgctcatctccacttgtaaacgctgcgttggagggaaagctggtccttctggacggtatccatcgggttaacgccggaacactggcggtgctccaacgcctaattcacgacagggagctgagcctgtacgatggttcccgacttctccgagaagaccggtatatgcgcttgaaagaggagttgcaactgagtgatgaacagctccagaaaagatctatttttccaatccatccatcgtttaggattatcgctctggccgagccccccgtgattgggtccactgcgcaccagtggctaggcccagaatttcttacgatgttcttctttcactacatgaaacccttagtaaaatcagaagagatccaggtcattaaagagaaggtacctaacgtgcctcaggaagctttggacaaattactgtctttcactcacaagctgagggagacccaggatcctaccgcccagtccctggctgctagtttgtcaacccgccagctgttgagaatctcacgccgcctcagtcagtaccctaatgagaatttgcactctgccgtcacaaaagcatgtctctcgcggttccttccatcgctggcccggagcgccctcgagaaaaacctggccgatgccactattgagattaacaccgatgataacctggagcctgagctgaaggactataaatgcgaggttacgtctggtaccctcaggattggagcggtgagcgcaccgatttataacgcacacgaaaaaatgaaggtcccagacgttctgttctacgataatatccaacatgttatcgtcatggaggatatgctgaaggattttttgctgggggagcacctgctactggtgggcaatcagggtgtgggtaagaataagattgttgatcgatttctgcacttactaaaccggcctagagagtacatccagctccacagagataccacagtgcagacgctcactttgcagccctcagttaaggacggacttattgtatatgaagacagcccactggtgaaggccgtgaagctcggacacattctggtagtggacgaggccgataaagcccctaccaatgtgacctgcatcctaaaaactcttgtcgaaaatggcgaaatgatcctagctgatggtagaagaatagtcgccaattccgccaatgtgaatgggagggaaaatgtagtggttatccatcccgattttcgcatgatagttctggcaaacaggcctggattccctttcttgggcaacgacttctttggcacactgggggacattttttcttgtcacgctgtggacaacccgaaacctcattccgagctcgaaatgctgcgacagtatggaccaaacgtgcccgaacctatactgcaaaagctggtagcagcatttggagaactccgaagcttggctgatcaggggattatcaactatccatactccacacgagaagtcgttaacatcgtaaaacacctacagaagtttccaaccgagggcctcagcagtgtcgtgcggaatgtcttcgatttcgattcatataacaacgatatgagggagatcttaattaatacactacataagtacggcatcccaatcggagctaagccgacctctgtgcaacttgccaaggagctcacactgcccgagcagaccttcatgggttattggaccattggacaggctagaagcgggatgcagaaactgctttgtccggtggagacccaccacattgacattaaaggacccgcactgatcaacatccaggagtaccccatagagagacacgaagaaaggtcgctaaatttcaccgaggaatgtgccagctggcggatccccctcgacgagatcaacatcatctgcgacatcgccacctcccacgaaaacgaacagaacacgctgtatgtggtcacctgcaatcctgccagcttgtactttatgaatatgactggtaagtcagggttttttgtcgattttttcgatattttccccagaaccgcaaatggcgtctggcatccatttgtgacggtggcccctctgggatcccctttaaaggggcaagtagttttgcacgagcagcagtcgaacgtgattctgctacttgatacgacaggtagggctttgcataggctcattcttccttcagagaagtttacttcaaagaagcccttttggtggaataaggaggaagctgagacttataagatgtgtaaagagttcagccacaagaattggctcgtcttctataaggaaaaaggcaattcactgactgttcttgatgtgctcgaaggaagaacccacactatctctctcccaatcaatttaaaaaccgtcttcttggtggccgaagataagtggcttctggttgagagcaaaaccaatcagaagtacctgctgacaaaaccggcacatatcgaatctgagggatctggcgtgtgtcagttgtacgtgctgaaggaggaaccaccatccacaggatttggcgtgacccaggaaaccgagttttccatccctcacaagatttccagcgaccagcttagctcggaacacctatcctctgctgtggaacagaagatcgccagccctaatcggatccttagcgatgagaagaattacgcaactatcgtcgtgggattccctgatctcatgagcccatcagaagtctactcctggaaacgtccaagctcactgcataaaaggagcggcactgatacatctttctatcggggaaagaaaaagaggggcactccaaagcaatcgaattgtgtcaccctgctcgacaccaatcaggtggtacgtattctcccgcccggtgaggtcccactgaaagatatttatccaaaggatgtgacacctccacagaccagcggatacattgaggtcactgacttacaaagcaaaaagcttagatacatccccatccccaggtccgaatcactatccccttatacaacatggctgtctaccatttcagacaccgacgcactgttggccgaatgggataaaagtggggttgttacagtggatatgggcggacacataagactgtgggaaactggactcgaacggctccagcggtcactgatggagtggcggaacatgatcggacaggatgatcggaacatgcagattaccattaacagggacagcggggaggatgtcagttctccaaaacatggaaaggaagatcctgataatatgccgcatgtaggcggtaatacctgggccggaggaacaggaggccgggacactgccggtctgggaggaaagggaggaccttaccgacttgatgcgggacacaccgtgtatcaggtgtctcaggctgaaaaggacgctgtccccgaggaggtcaagagggctgcaagggaaatgggacagcgcgccttccagcagcgcctgaaggaaattcagatgtccgaatacgacgccgcaacctacgagcggttttccggagcagtccgcaggcaggtgcattcgctccggataatactggacaatctccaggctaaggggaaagagcgccagtggctgcgccaccaggctacaggtgagttggatgacgctaagatcattgacgggctcaccggcgaaaaggccatctacaaaagacggggtgagcttgagccccaactagggtcgccgcaacagaaacccaagagactgcggcttgtggtcgacgtttcagggagtatgtataggtttaaccgcatggacggacgactcgaaagaacgatggaggccgtctgcatggttatggaggcctttgagaactatgaagaaaagtttcagtatgatattgtgggtcactccggcgatggctataacattgggctggtacctatgaacaaaatcccaaaggataacaagcaacggctcgaaatcttaaagactatgcacgctcactcacagttctgtatgagtggggatcacaccctcgagggtacagagcatgccatcaaagagatcgtcaaggaggaggccgacgagtactttgtcatcgtcctgagtgatgctaacttgtctcgctatgggatacaccctgctaaattcgcccagatcttaactcgagacccccaagtcaacgccttcgccatcttcattggctctctgggggatcaggccacacgcctgcaaagaacacttccagcgggcagatcatttgtcgccatggacactaaggatatcccccagatcctccagcagatcttcacgagcacaatgttgagctctgtttag

SEQ ID NO: 9240 - DNA, 561 bp, Artificial Sequence
  Description of Artificial Sequence: Synthetic coding sequence
atggaggccctgcccctgctggccgccaccacccccgaccacggccgccacaggagattacttctcctgcccttactgctcttcctgttgcctgcaggcgcagtgcaggggtgggagactgaggagcgccctcgaacccgggaggaggaatgccacttctacgccgggggccaagtgtatccaggggaagccagtagggtgtctgtggctgaccactctctccacttgtccaaggctaagatctcaaagcctgccccttactgggagggcactgctgtgattgatggcgaatttaaagagctgaagttaaccgattaccgagggaagtacctggtcttctttttttatcccctggactttacatttgtttgcccaactgaaattatcgccttcggtgacaggctggaagagttccgctccataaatacagaggtggtggcgtgttcggtagactctcagttcacccacctggcatggtccgtttcctacacatacataaggcgcaagaagcgtatggacctcctgctgaagcacgggcagattacactcgatatgatctag

SEQ ID NO: 9241 - DNA, 816 bp, Artificial Sequence
  Description of Artificial Sequence: Synthetic coding sequence
atggaggccctgcccctgctggccgccaccacccccgaccacggcagacatcgtcggctcctgctactgccgctactgttatttctgttaccagcgggagctgtccaagggtgggagaccgaggaacggcctagaacaagggaggaggagtgtcatttttatgcaggaggacaggtgtaccccggcgaggcctcacgagtgtcagtcgccgaccattctctgcatctatcaaaagcgaagatctctaaacccgcgccctattgggagggtacagctgttattgacggggaatttaaagagctgaaactcactgactatcgaggcaagtatctggtgttttttttttacccccttgattttaccttcgtctgtcccacagagatcatcgctttcggggaccgtctcgaggagttcaggtccataaacaccgaagtggtggcttgctccgtcgattcgcaattcactcacctcgcctggatcaacacccctcggagacagggcggtctgggaccgatccgcattcctttgctgagcgacttgacgcaccagatcagcaaggattacggagtttaccttgaggatagcggacacactttgcgcggattgttcatcatcgacgacaaaggcattctgagacagattaccttaaacgaccttcccgtcggtcggtcagtggacgagaccctgcggcttgttcaggctttccagtatacagacaagcacggcgaagtgtgccctgcggggtggaagcctggatctgagacaattatccctgacccagctgggaaactgaaatactttgataagctgaactag

SEQ ID NO: 9242 - DNA, 558 bp, Artificial Sequence
  Description of Artificial Sequence: Synthetic coding sequence
atggaccaccggagccggctgcggggcaccggcctgaaccggatccctggcacacagtctagggccccaagagtgcctctgccattccacgtgcagcaggaggcccgcgaaggcgaggattgggaaagagagccaccacgccaacggccgcctatttatgagcccccagagagcgaggaactccctgataacgttatggtctcgaagccagccccgtactgggagggaaccgcagtgattgacggcgaatttaaagagctcaagctgacagactacagggggaagtatctggtcttttttttttatccacttgacttcactttcgtctgccccactgaaatcatagccttcggcgaccggctggaagagttccgctctatcaacacagaggtggtcgcatgctccgtcgactcccagttcacacacctggcttggattaacactcccagaagacagggcggcctcggaccaatccggatccctctgttgtctgacctgacacatcaaatttctaaggactacggtgtatacctcgaggactctggccacacactttag

SEQ ID NO: 9243 - DNA, 843 bp, Artificial Sequence
  Description of Artificial Sequence: Synthetic coding sequence
atggcccggttctgggtgtgcgtggccggcgccggcttcttcctggcttttctggtgcttcacagcagattctgtggttctcccgtgctgcggaacttcacgtttgcagtgagctggcggaccgaaaagattctctaccggctcgacgtgggctggccaaagcacccagaatatttcacgggtacgaccttctgtgtggctgtggactctcttaatgggctggtgtacataggccaacggggcgacaatataccaaagattctggtgttcaccgaagacggctattttcttagagcatggaattatacagttgatacccctcatggaatctttgccgctagcaccttgtatgagcagagtgtctggattactgacgtggggagtgatttcatgatcttgtggctgcatggcgaaaatggcaccggaccagcaaaattcaacataccccattccgttacccttgattcagctggaagggtgtgggtggctgataggggcaacaaacgcatacaagtctttgataaagatacaggagagtggttaggggcttggaataattgctttacagaagaagggccctccagtgttcggtttacccccgacggcaagtacttaatcgtggcgcagctgaacctgagtcgattaagtgtggtggcggcacctccagtgggatccataggagaatgtagcgtaataagtactattcagctggccgatcaagtgctgccacacttacttgaagtggacaggaagacgggcgccgtctacgtagcagaaatcggagccaagcaggtacagaagtacgtccctctgaattcttatgtgccctcgtttggatcttag

SEQ ID NO: 9244 - DNA, 1044 bp, Artificial Sequence
  Description of Artificial Sequence: Synthetic coding sequence
atggcccggttctgggtgtgcgtggccggcgccggcttcttcctggccttcctggtactccatagccgcttctgtggatcccctgtgctgcggaacttcacattcgctgtctcctggagaaccgaaaaaatcctttacaggttggacgtcggctggcctaaacacccagaatacttcactggcactaccttctgtgtggcagtggactcgctgaatgggttggtatatatcggacagagaggggacaacatacccaagatccttgtgtttacagaagacggctattttcttcgagcgtggaactatacagttgatacgccccacgggatctttgcagcgagcaccttatacgagcagtccgtgtggatcaccgatgtggggtccggattcttcgggcatacagtgaagaagtattccagcttcggggatctcgtgcaagtgctcggtacaccgggcaaaaagggtaccagcctaaatccgcttcaattcgataacccagctgaactgtatgttgaggacactggagacatctatattgtagatggtgacggagggctgaacaatcgcctgatcaagctgtctcaagactttatgatactgtggctgcacggcgagaatggcacgggtccggccaaattcaacattcctcactcagttacgttggactcagccggcagagtgtgggtggcagaccgcggcaacaagcggatacaggtctttgacaaggacacaggagaatggctcggggcgtggaacaactgttttacagaagaaggcccttcctctgtgcgttttactcccgacggtaagtatctgattgtagcacagctgaatctctccagattgagtgtggtcgcagcccctcccgttggctctatcggagagtgtagtgtgatttctacaattcagctggctgatcaagtgctgccacacctcctggaggtcgatcggaagaccggagccgtctacgtggcagaaattggtgcgaagcaggtacaaaagtacgtgccgctgaactcctatgtcccgagctttggctcttag

SEQ ID NO: 9245 - DNA, 1707 bp, Artificial Sequence
  Description of Artificial Sequence: Synthetic coding sequence
atggtgctgctgcactggtgcctgctgtggctgctgttccccctgagctctagaacacaaaaattacctacccgcgatgaagagctgtttcagatgcagattagagacaaggcatttttccacgacagcagtgtcatcccagatggggccgagatctcgagctacctgtttcgggatacgcctaagcgttacttcttcgtggtcgaggaggacaatacaccactatccgtaaccgtgacaccatgtgacgcccctctggagtggaaattgtctctgcaggagttgcccgaggacagatccggagaagggagtggtgatcttgagcccctcgaacagcagaagcagcagatcattaacgaggaggggaccgagttgttctcctacaaaggtaacgatgtagagtatttcatctcctcatcctcaccttctggcctttaccaactggatttgctttcaacagagaaggatacgcactttaaagtatacgcaacaaccacacctgagtctgatcaaccatacccggagctcccttacgatccaagggtggatgttactagcctaggccggactactgtgactctggcttggaagcctagcccgaccgctagcttgctcaagcagccaatccagtactgcgtggtcatcaacaaggagcataacttcaagtccctatgcgccgtggaagccaaactatccgcagatgacgcttttatgatggcccctaagccaggcctggacttttctcctttcgatttcgcccattttggatttcccagcgacaactccggaaaagagcgttccttccaagcgaaaccgtcccccaagctgggcagacacgtttattcccggcccaaggtggacatccagaagatctgcattggaaataaaaacatttttaccgttagcgaccttaaaccagacacccaatattatttcgacgtgttcgtggtcaatatcaattccaatatgtctactgcttacgtcggaaccttcgctagaacaaaggaggaggcgaaacagaagacggttgagctgaaagacggaaagatcaccgatgtctttgtcaagcgtaaaggggcaaaatttctgcgattcgcacccgtgtcatcgcatcagaaagtcaccttctttatacactcatgcttggacgctgttcagatccaggtgagaagagatggcaaattgttgctttcccagaatgtggagggaatccaacagtttcaactccggggcaaaccaaaggccaagtacctggtgcgcttgaagggcaataagaaaggggcatcgatgttgaagattttggccacaacccgtcctaccaaacaaagcttcccctccttaccagaagatactcgcataaaagctttcgacaaacttcgaacatgcagttccgctaccgttgcatggcttggaactcaagaacggaataagttctgtatctacaaaaaggaggtggatgataattataacgaagaccagaagaaacgtgagcagaatcaatgtcttggccctgacattaggaagaaaagcgagaaggtattgtgtaaatactttcattcccaaaatttacagaaggccgtgactacagagaccattaagggcctgcagccaggaaaatcctatctcttagacgtctatgtaataggacacggaggtcactctgtgaaataccaatctaaagtcgttaagactaggaagttctgctag

SEQ ID NO: 9246 - DNA, 489 bp, Artificial Sequence
  Description of Artificial Sequence: Synthetic coding sequence
atgaagggcttcaccgccaccctgttcctgtggaccctgatcttccctagttgtagtgggggggggggcggtaaggcgtggccaacacatgtcgtatgctctgactccggcttggaggtcctctatcaatcttgtgatcccctgcaggatttcggcttctcagtggagaagtgtagtaagcagctgaagtctaatatcaatattagattcggtattattctgagggaagacatcaaagaacttttcttggacctggctcttatgtcacagggcagtagtgtcttgaatttttcgtaccccatttgtgaggccgccttacctaaattctcattctgcggccgacggaaaggcgaacagatttattatgccggccccgtgaataatccggaatttacgataccacagggcgagtatcaagtcctccttgaactttatactgaaaagaggtctacagttgcctgtgccaacgcgacaattatgtgttcttag

SEQ ID NO: 9247 - DNA, 1698 bp, Artificial Sequence
  Description of Artificial Sequence: Synthetic coding sequence
atggacttcctgctggccctggtgctggtgagcagcctgtacctgcaagcggctgccgaattcgacggccgctggccaagacagattgtctcttccattgggctgtgtcgatacgggggcagaatcgattgctgctggggctgggcccgccaatcctggggccagtgccagccagtctgccagccccggtgcaaacacggcgaatgcattgggccaaacaagtgtaagtgccatcctgggtatgctggcaagacatgtaaccaggacttaaacgagtgtggtctgaagccgcggccttgcaagcacaggtgtatgaatacatacgggtcgtacaagtgttattgtttaaacggatatatgctcatgcccgacggcagctgcagttcggccctcacctgtagcatggccaactgccagtacggttgtgatgtggttaagggacaaatcaggtgccaatgtccttcaccgggactgcagcttgcgcccgatgggcggacttgtgtggatgtagatgaatgtgcgacgggccgagcctcttgtccgcgcttccgccaatgcgtaaacaccttcggatcctatatctgcaaatgtcataagggcttcgacctgatgtacatcggggggaaatatcagtgtcacgatatagacgagtgcagcttgggccagtaccaatgctcctctttcgcgaggtgctataacatccgtggatcctacaaatgcaaatgtaaagaaggctaccagggcgacggactgacttgtgtctacatacctaaggtgatgattgaacccagcggccctattcacgtgcccaaagggaacgggaccatactaaagggggatacagggaacaacaactggattcctgacgtcggatccacttggtggccccctaagacaccctacattccgcccataattacgaaccgccccacctctaaaccgacgacccgcccgactccaaaacccaccccaattccaaccccccctcccccgccacctttgcctactgaactgcgaactcccctgccaccaaccactccagagagacccacgaccggacttacaaccattgcccctgcggcatccacgccccctggtgggatcacagtcgacaaccgggtgcagactgatcctcagaagccacgaggagatgtgttcataccccgtcagccatccaacgacctcttcgaaatcttcgagatcgaacggggggtgagcgcggatgacgaggcgaaagacgacccaggagtactggtgcattcctgtaatttcgaccacggtttgtgtggatggattcgggagaaggacaacgacctccactgggagccaattcgggatccagccgggggtcagtacctgacagtgtctgccgctaaggccccggggggtaaagcagccaggctcgtgcttccgctagggagattgatgcactctggggacctgtgcctgagcttccggcataaggtcaccggcttgcatagtggaacactccaggtctttgttagaaaacatggagcccacggggctgcactgtggggcagaaacggagggcatggctggagacagactcagatcactctgagaggcgcggacattaaaagcgtagttttcaaaggagagaaacgacgggggcacactggagaaatcggcctggatgacgtgtcgttgaaaaaagggcactgttctgaagagagatag

SEQ ID NO: 9248 - DNA, 1413 bp, Artificial Sequence
  Description of Artificial Sequence: Synthetic coding sequence
atgaagcggagcgtggccgtgtggctgctggtgggcctgagcctgggagtgccccagtttggcaagggagatatctgcgatcctaacccatgtgaaaatggaggaatatgtctcccagggctcgccgatgggagtttctcttgcgagtgtcctgacggctttacggatcctaattgctcctctgtcgtagaagtgggcccttgcactccaaatccgtgccacaacggcggcacatgcgaaatctctgaagcctacaggggtgacaccttcatcggatatgtatgtaagtgcccccgggggttcaatgggatacactgccaacacaatatcaatgaatgtgaggttgagccctgcaaaaacggaggaatttgcaccgaccttgtcgcgaactattcttgtgagtgccctggcgagttcatgggccggaactgtcagtacaagtgctctgggccattgggaatcgaagggggaataatatctaatcagcagataacggcgtcctcaacacacagagccctgtttggtctgcagaagtggtacccttactatgctagactaaacaaaaaaggcttgatcaacgcctggacagccgctgagaacgatagatggccctggatacaaattaaccttcagcgtaagatgagggtgactggcgtaatcacccagggcgccaaacggatcgggagccccgagtacataaagagctacaagattgcctactctaacgatgggaagacatgggcaatgtacaaagtaaaaggcacgaacgaagacatggtgttccgaggcaacattgataataatacaccgtacgcaaacagctttacaccccctataaaggcccagtacgtccggctctatccacaggtgtgtcgtcgtcactgtacactcaggatggaactgctggggtgcgagctctctggctgctcagagccattaggcatgaagagtgggcacattcaggactaccaaattaccgcaagttccatatttagaaccctcaatatggatatgtttacttgggagccccgcaaggccaggctcgacaaacagggcaaggtaaacgcctggacgagcgggcataacgatcagtctcagtggctgcaggtagatctgctggtacctaccaaggttacaggcattatcactcaaggggcgaaggattttggccatgtgcagtttgtgggcagttacaagttagcctacagcaatgacggagagcattggaccgtctaccaagatgagaaacagcgcaaagataaggtgtttcaggggaacttcgacaacgacacccatcgaaagaacgtgattgacccgcctatatatgcacgacatatacgcattctgccttggtcctggtacgggcggatcactctcagatctgagctgctgggttgtacggaggaggagtag

SEQ ID NO: 9249 - DNA, 1254 bp, Artificial Sequence
  Description of Artificial Sequence: Synthetic coding sequence
atggccagctacctgtacggcgtgctgttcgccgtgggcctgtgcgcgcccatttattgcgtaagccctgccaacgctccatccgcataccctcgccctagctcaacaaagagcaccccagcctcacaggtgtattccctgaacaccgatttcgcgttccgattgtacaggaggctagtgctggagacaccgtcccagaatatttttttttctcccgtgtcagtgtcgacatccctggctatgctgtccttgggcgcccactcggtcactaagactcaaattctccaaggtttaggttttaatctgacccatacgccagagtccgcaatacaccagggcttccagcatctggtccacagtttaactgtgccatcaaaagatctcactctgaagatgggatcagctctgtttgtcaagaaggaattgcagctgcaagcaaacttccttggcaacgtcaagaggctgtacgaggccgaagtgttctcaaccgacttcagtaacccatcaatcgctcaagcaaggattaattcccacgtaaagaaaaagactcaggggaaggtcgtcgatatcatccagggattggatctgctgacagctatggtcctagtcaaccatatcttttttaaagccaagtgggagaaacctttccatcccgaatacacccgaaagaattttccctttctcgtcggggagcaagtgactgttcatgtaccaatgatgcaccagaaggaacagtttgcctttggtgtagatacagagctcaactgcttcgttttacagatggattacaagggggacgccgtggctttttttgtccttccctcaaaggggaaaatgagacagttggaacaggccctatccgccagaaccctcagaaagtggtcccactctctccagaagcgctggatcgaggttttcattcctagattttccatcagtgcctcatacaacttagaaactattctacctaaaatgggtatccaaaacgtgttcgacaaaaatgctgacttttcgggaatcgctaagcgggatagcctgcaagtgtctaaagccactcataaagctgtgctcgacgtttcagaagagggcaccgaggccactgcagcaacaactacgaagttcattgtgagaagcaaagacggccctagctactttacagtgtcattcaaccgaacttttctgatgatgatcacgaacaaggcaactgacggaattttatttctgggcaaagtcgagaaccctaccaagagctag

SEQ ID NO: 9250 - DNA, 486 bp, Artificial Sequence
  Description of Artificial Sequence: Synthetic coding sequence
atgctgatgcccgtgcacttcctgctgctgctgctgctgctgctgggcggcccccgcaccggactgccccataagttttacaaggccaagccgattttctcttgccttaatacagctttatctgaagcagagaaaggacagtgggaggatgcttccctcctgtctaagaggtcctttcactatctacgcagtagggacgctagcagcggtgaagaggaagaaggcaaagaaaaaaagaccttccccatatctggtgccagagggggtgctaggggaacccggtatcgatatgtgtcgcaagcccagcccagagggaagcctcggcaggatactgcaaagagcccacaccgcaccaagtttaccctgagtttggatgtgcccacaaatattatgaacttgctcttcaacatcgcaaaagcaaagaacctccgagctcaggctgcggccaacgcacacttaatggctcaaatcgggaggaaaaaatag

SEQ ID NO: 9251 - DNA, 2091 bp, Artificial Sequence
  Description of Artificial Sequence: Synthetic coding sequence
atggccatggcccggctgggcagctggctgggcgaggcccagtggcttgccctcgtgagcctttttgtcgcggctttggctacagtgggcctatacttagctcagtgggccctggcccgcgccaggccccaaccgcaacgcagggctgttgagccgggagagggcccccggcccggctccgacgcactcctcagctggattcttacgctgggcagctggaggtcccagtggcaggcagcttgggtaactgctctcaacgaagaggccgagcgcaaaggggggcctcccttcctaagctttgaggaggacccaaggcagcaagctcttgaactggttgttcaagaagtgtcttctgtgttacggtctgcagaagagaaggtggtggtatgccacgtagtgggccaggcgatccaattcctggtttctgagaccccagcgctgggagcaggatgccggctctatgatatgaggcttagcccgttccacctgcagctcgagttccacatgaaggaaaaaagggaggatctgcaaataagttggagctttattagcgtaccagaaatggccgtaaacattcaacctaaagcccttggagaggatcaggtggctgagacgagtgcaatgtcggatgtattgaaagacattctgaagcacctggccggatccgccagtcccagtgtggtcctcattactaaacctacgacagttaaggaggcgcagaatttacaatgtgcagcctcaaccgcccaggagtcttgcccaccaaaacctccaagagcacacgaactcaagcttctggtcaggaatattcatgtccttttgttgtctgaacccggagccagtggacacattaacgctgtatgcgtcgtgcaattgaacgacccggtacagcgtttctcttctacgctcactaagaatactccagacctgatgtgggaagaggagttcacatttgagctcaacgcaaaaagcaaggagcttcatctccagattagcgaagctggcaggtcctctgaaggcttgctggccaccgccaccgttccactcgatctatttaagaaacaaccttccggaccacaaagctttacgctcacctctggcagcgcttgcggttcctcggtactcggctccgtcactgccgaattcagctacatggagcccggagagcttaaaagctggcccatacccccacccgtgccagccgccaagatcgaaaaagataggacagtgatgccttgcggcacggtggttactactgtcacagcagtgaaaactaagccaagagtggacgttggaagggccagccccctgagttcggacagccctgtcaagacccccataaaagtgaaggtgattgaaaaggacatctcagtgcaggccatagcctgcagaagcgcgccagtctccaaaacactgtcctcaagcgacacggaattgcttgtactcaatggcagcgatcccgtggccgaagtcgcaattaggcagctctcagagtcttccaagctgaaattaaaaagcccaaggaagaaaagcactatcattatctcaggaatttcaaagacttccctcagtcaagaccatgatgccgccttgatgcagggctacacagcttccgtcgattctacgcaccaggaggacgcaccttcacacccagagcgagctgcggccagtgccccacctgaggaggccgaatctgcccaagcttctctggcccccaagccccaggaagacgaactggattcatgggatctggaaaaggagccccaggctgcggcttggtcttcacaggttctgctggatcctgacggagacgaattgtccgaatcttcaatgtcagtgttggaaccaggtactgccaagaagcacaagggcgggattttgcgcaaaggagcaaagctgttcttcagacgccggcatcagcagaaagaccccgggatgtcgcagagccacaatgacttagtctttctggaacagcctgagggcagtaggcgtaagggcattactctcacaaggatcctcaacaaaaaactattgtcacgtcaccgtaataaaaacactatgaatggggcccccgtcgaaccttgtacatag

SEQ ID NO: 9252 - DNA, 669 bp, Artificial Sequence
  Description of Artificial Sequence: Synthetic coding sequence
atgcccgccagcagccccttcctgctggcccccaagggcccccccggaaatatgggtgggcccgtgagggaacctgccctttcagtagctctttggctgagctggggtgccgctctgggtgccgtagcatgtgccatggcactgcttacccagcagaccgagttgcagagtctcagaagagaggtgagcagacttcagggcaccggcgggcctagtcaaaacggggagggctacccatggcagagcttgcccgagcagcactcagtcttgcacctggtacctattaatgctaccagcaaagacgacagtgacgtgacagaagtcatgtggcagccagcactgaggcgtggtcggggcttacaagctcagggctacggtgtgagaatccaggacgccggtgtttacctgctgtacagccaggtgctgtttcaggacgtgacattcacaatggggcaggttgtctccagagagggccaggggaggcaggagacattattccgatgtatcaggtcaatgccaagccaccccgatcgagcatataactcttgttacagcgccggcgttttccacttgcaccagggagacatcctgtccgtcatcatcccgcgtgcccgtgccaagctgaacctttcccctcatggaaccttcctgggcttcgtcaagctctag

SEQ ID NO: 9253 - DNA, 2205 bp, Artificial Sequence
  Description of Artificial Sequence: Synthetic coding sequence
atgtggggcctgctgctggccctggccgccttcgcccccgccgtgggcccggccctcggtgctccacggaactctgttctcggccttgctcagccagggaccaccaaggtgccgggcagcacccccgcactgcacagctcgccggcccagcctcccgccgagacagcgaacgggacaagcgaacagcatgtgcggatacgggtgatcaagaagaaaaaggtgatcatgaagaaacgcaagaagctcacactgacacggccgaccccccttgtcactgctgggcccttggttacacccactccggcagggacattggacccggcagagaaacaggaaactggctgcccgcctctaggcctggagagccttcgggtatccgactcgaggttggaagcctcatcctctcagagctttggtctcggccctcatagaggaaggttgaatatccagtcgggactcgaggacggcgacctgtacgacggcgcctggtgcgccgaggaacaggacgccgacccgtggtttcaggttgacgctggccaccctacccgatttagtggcgtgatcacacaggggcggaattctgtgtggaggtatgactgggtgacatcttataaggttcagttttcaaacgattcccgaacatggtggggcagtcgcaatcactcaagcggaatggacgccgtgttcccggcaaacagcgacccagaaacaccggtactaaacctgctccctgagcctcaagttgccagatttatacgcctattaccccaaacatggctgcagggaggggcgccttgtctgagagcagagattctcgcttgcccggttagcgaccccaatgacttattccttgaggcaccagcctcaggcagttctgatccacttgactttcagcaccacaattacaaagccatgcgcaagttaatgaaacaggttcaggagcagtgcccaaatatcactcgtatatatagcataggaaagtcctaccagggcctgaagttatacgttatggaaatgagcgacaagccaggagagcacgagctcggagaaccagaagtgagatacgtagccggcatgcacggaaatgaggcactcgggagagaattgttgctcctgttgatgcagtttctgtgccacgagttccttcgaggcaacccacgggtcacaagactgctgtctgaaatgaggatccacctgctccccagcatgaacccagatggatacgaaatagcctaccaccgcggaagtgagctggtcggctgggccgaggggcgctggaacaaccagtctatcgatctgaatcataattttgcggatctgaacaccccactgtgggaggcccaggatgacggcaaggtgccacatatcgtgccgaaccaccaccttcctctgccaacatactatacattacccaatgccactgttgctcccgaaacccgtgctgttatcaagtggatgaaacgcattcctttcgtgctgagcgcgaacttacacggcggagaattggttgtgagctacccattcgacatgactcggaccccatgggctgcccgcgagctgaccccaacccctgacgacgctgtctttaggtggctgtcaacagtgtacgcgggctctaacctggcaatgcaagacacgtcccggcgcccatgccattcacaagacttttcagtacacggtaatatcataaacggcgcagattggcataccgtgcctgggagtatgaacgacttctcttacctccatacgaactgctttgaggtgacagtggagctgtcttgcgacaagttcccccatgagaatgaactgccacaagagtgggaaaataacaaggatgctctgctgacgtacctggagcaggtgcgcatgggcatcgctggagtggtgagggataaggacacggagctcggcatagccgacgctgttatcgccgtcgacgggatcaatcatgacgtgacaaccgcctggggcggggactattggagactgttaactcccggtgattacatggtgaccgcgagtgctgagggatatcactctgttacgagaaattgtcgcgtgaccttcgaggaaggtccctttccctgcaattttgttttgaccaaaacgcctaagcaacgactgcgggagctcctggcagccggggcaaaagtgccccccgatctgcgacggaggcttgagcggcttcggggtcagaaagactag

SEQ ID NO: 9254 - DNA, 759 bp, Artificial Sequence
  Description of Artificial Sequence: Synthetic coding sequence
atgcgggcccccctgctgccccccgcccccgtggtgctgagcctgctgattctgggatctggccactacgccgccggcttggatcttaacgacacctactcaggcaagcgcgaacccttcagcggtgaccactcagcagacggttttgaggtgacctcacgctctgagatgagctctggcagcgagatttccccagtaagcgaaatgccttctagctcggagcccagctcaggcgcagattatgattactctgaggagtacgataatgagccccaaatccctggatatatcgtcgatgactccgtgcgggtggagcaagttgtgaagccgcctcagaacaaaaccgaaagcgagaatacatccgacaaacccaagcgcaagaagaagggtggaaagaacggaaaaaataggaggaacagaaagaagaagaacccttgtaacgcagagttccaaaacttctgtatccacggagagtgtaaatatattgagcacctggaagccgtgacgtgcaagtgccagcaggaatacttcggagagcgttgcggcgaaaaatcaatgaaaacccatagcatgatagactcttccttaagcaaaattgcactggccgctatcgctgccttcatgtccgctgtgattctgactgccgttgctgtaatcactgtacagctgcgccgtcaatacgtgcgtaagtatgaaggggaggccgaggagagaaagaaactacggcaggaaaacggcaacgtgcatgccattgcatag

SEQ ID NO: 9255 - DNA, 8487 bp, Artificial Sequence
  Description of Artificial Sequence: Synthetic coding sequence
atgcccaagcgggcccactggggcgccctgagcgtggtgctgatcctactgtgggggcaccctagagtggcgctggcctgtccacacccctgtgcctgctacgtcccttccgaagttcattgcacttttaggtctcttgcttccgtacccgcgggaatcgccaaacacgtggaacgaattaaccttggctttaattctattcaggctcttagcgaaacctccttcgcgggactcaccaagctggagttactcatgatacacgggaacgagatcccctccatccccgacggggcgctgagggatctgtcttcactgcaagttttcaaattctcgtataacaagcttcgcgtgattaccgggcaaaccctgcaaggcctcagcaacctcatgaggctgcatatcgatcacaacaaaattgagtttattcatccacaggcctttaacggcctcacttctctgcgcctgcttcatttggaaggcaaccttctgcaccagttgcacccgtctacgtttagcacatttaccttcctggattactttaggttatctactatacgacatctgtacttagccgagaacatggttagaaccttgccggcctccatgctcagaaacatgccactgctggagaacctgtatctgcagggaaatccatggacttgcgactgtgagatgcgttggttcctggaatgggacgccaagagcagaggcatattaaaatgcaaaaaggacaaggcctacgaagggggacagctttgcgccatgtgtttctcccccaagaaactttacaagcacgaaattcataaactgaaggacatgacttgtctgaagccctcaattgagtcgcccctgcggcagaaccgtagtcggagtatagaagaggaacaggaacaagaggaggacggcggcagccaactgatattagaaaaatttcagctgccacagtggagtatctccctgaacatgacagatgagcatggtaacatggtcaatcttgtttgtgacatcaaaaaacctatggacgtttataaaatacacctcaatcagacagatcccccagacatcgatatcaatgcaacagtggctctagatttcgaatgcccgatgactagagagaactatgagaagttgtggaaacttatagcctattactctgaggtcccagtgaaactgcaccgtgaactgatgcttagtaaggacccccgcgtgtcatatcagtaccggcaagacgccgacgaggaagccctgtactatacaggagtgagagctcagatactagcagaaccagaatgggttatgcagcctagcatcgatattcagctgaaccgaagacagtcaactgcaaagaaagtcctcctgtcatattacacacaatatagccagaccatctccactaaggacacaagacaagccagaggcaggtcctgggtgatgatcgaaccttccggagctgtacaacgggatcagaccgtgctggaagggggaccctgccagctcagctgtaatgtaaaagcctcagagtctccctcaattttttgggtcctccctgacgggagtatactgaaggctccaatggacgatcctgattccaaattttctattttgtcttccggttggctgcgtattaagagtatggagcctagtgactcagggctgtaccagtgcatcgctcaggtgagagacgagatggataggatggtgtacagggtgttggtgcagagcccttccacgcaacccgccgagaaagataccgtgacaattggaaaaaatccgggcgagagcgtgaccctgccatgcaacgctctggcgatcccagaggcccacctgtcgtggattctgccaaatcgtcggatcattaacgacttagctaacactagtcatgtatacatgttgcccaatggcacactatccattcccaaggtgcaagtgagcgatagcggttattatcgctgtgtggcagttaatcagcaaggcgccgaccatttcacagtggggatcacagtcactaaaaagggctctggcctgccaagtaagagaggtcgcagacctggtgcgaaagcactctcaagggtgcgcgaggatatagtggaagacgaaggcggatccggaatgggagacgaggaaaacacatctcggcggctgctgcaccccaaggaccaagaggtgtttctgaaaactaaggatgacgccattaacggagacaaaaaagccaaaaagggacgccgtaagcttaagctgtggaaacattccgaaaaggaacctgaaaccaatgttgccgagggccgcagggtctttgaaagccgccgccgcattaacatggctaacaaacagattaaccccgaaaggtgggcagacatactcgccaaggttcgaggaaagaaccttccgaaagggaccgaggttccacctcttatcaagactacaagccctccttcgttatcgctcgaggtgacgcctccattccctgcgatatcgccaccgagtgcatctcccgtgcaaactgtgacatccgctgaagaaagctccgcggatgttcccctgctcggggaggaagaacacgttctagggactatttcatcagccagcatgggtctggagcataatcacaatggagtgatactggttgagcccgaggtgacctccacacccctggaagaggtggttgatgatctatcagaaaaaaccgaagagatcacatcgaccgaaggtgaccttaaggggaccgccgctcccacactgatctctgagccatatgagcctagccccaccttgcacacccttgatacagtctacgaaaagccgacacacgaggagactgctacagaaggctggagtgccgcggatgtggggtcaagtcccgaaccgacttctagcgagtacgagcctcccctagatgctgtgagcctcgccgaatccgagcctatgcagtattttgacccagatctggaaacaaaaagccagcctgatgaagataaaatgaaggaagacacattcgctcatctgactccaactccgacgatatgggtcaacgacagctccacttcacagttatttgaggattcaactataggggagccaggagtacccggccaaagccacctgcagggtttaaccgacaatatccatctcgtcaagagcagcctgtccacccaggacacactacttatcaagaaaggtatgaaagagatgtcacagacactgcagggcggcaacatgttggagggggaccctacacactccaggagctccgagagcgaagggcaggagtctaaatcaattacgctgccagattccactctgggcattatgagcagcatgtcccccgtcaaaaagcctgccgaaaccaccgtgggcacactcttagataaagacacaaccaccgccacgaccacgcctaggcagaaggtggctccttcctccaccatgtcaacccaccccagccggcggcgtccgaatgggcgacgtaggttgcgccctaacaaattcaggcacagacataaacagactcctcccacaactttcgcccccagcgagaccttctccacccagcctacccaagcccccgatattaagataagttcgcaggtggagtcctcccttgtgccaactgcttgggtcgataataccgtgaacacaccaaaacaacttgaaatggagaagaatgccgaacccacgtccaagggtaccccgcgtcgcaaacatgggaaaagacctaacaagcatcgctacactccttctaccgtctcgtctcgggcgtcagggtccaagcccagccctagcccagaaaacaagcatcgcaatatagtgacacctagctctgaaaccattcttctgccacggacggtcagtctcaaaactgaggggccctacgactccctggactacatgaccaccacacgaaagatctattcctcataccccaaagtgcaggagactctgcctgtcacctataagcccacgtctgacggcaaagagataaaggacgacgtggctaccaatgtcgataagcataaatccgacatattagttaccggggaaagcatcactaatgccatccctacctctaggtcactggtgtctaccatgggagaattcaaggaggagtcatcccccgttggctttcccggtaccccaacttggaaccccagtcgtaccgcccagccaggcaggctccagacgggaattccagttacaacgtctggggagaatttaacagaccccccactccttaaggaactggaggacgttgacttcacatcagaatttctgtccagtctcaccgtgagcacacctttccatcaagaggaggccggaagtagcacgactttatctagcatcaaagtggaggtagctagctcacaagctgaaaccactactctggaccaggatcacctggaaaccacagtggccattctattatctgaaacacgcccacagaaccatacccccactgctgctcgaatgaaagagcccgcctctagctccccgagtaccattctcatgagtcttggccagactaccaccaccaagccagcactgcctagcccccggatctcccaagctagtagggattccaaggaaaatgtttttctcaactatgtggggaatcctgagacagaggcaacacccgtgaacaacgaagggacccagcatatgagtggtcccaatgaactctctacacccagctcggatcaggatgcatttaacctctcaactaaactggaactcgagaaacaagttttcggttccagatccctgccccgcggcccggattcccaacggcaggacgggagggtgcacgctagccatcagctcacgcgagtgcccgcgaagccaattcttccaaccgcaaccgtgcgcctcccggagatgagcacacagtccgcttcacggtattttgttacctcccagtctccgcggcactggactaacaaaccagaaataacgacttacccaagcggggcgcttcccgagaataaacagtttaccaccccacggttgtcttccaccacaattcctctgcctctgcacatgtccaagccatccattccatccaaattcacagatcggcgaactgatcagttcaatggttattctaaagtgtttgggaataacaacatcccagaagcccgtaatccagtgggtaaacctccttcccctcggatcccacactattcaaacggcagactccccttttttaccaataaaactctgtcatttccgcagctgggcgtgacccgccggcctcagattcctacgtctccagctcctgtgatgagggaaagaaaagtgatacccggcagctataatcgaatccattcccattcaacctttcatttagactttggaccacccgcgcctcccctccttcacacccctcagaccacagggtctccctcaacaaacctccagaacatcccaatggtgtccagtacccagtcctccatttcttttatcacaagttccgtccagagctcaggttccttccaccagagctctagcaagttttttgctggcgggcctccagcgagcaagttttggtctctgggagagaagcctcaaattctaactaaatcaccccagaccgtgtccgtgactgctgagaccgacaccgtgtttccatgcgaggcaactggtaaaccaaagccttttgtcacgtggaccaaagtctccactggcgcattgatgactccaaataccagaatccagcgatttgaggtgctgaaaaacggaactctggtgattcgaaaagtgcaggtgcaggatcgcggccaatatatgtgtaccgccagcaacctgcacggcttagaccgcatggtcgttctgctatctgtcactgtgcagcagcctcagatcctggcctctcactaccaagatgtgactgtctatttgggggacaccatcgcaatggagtgcctggccaaaggaactccagcgccgcagatatcttggatctttcccgaccggagagtgtggcagactgtaagcccggtggaggggagaattactttgcatgagaaccggaccctgtccattaaggaggcatctttttcggacaggggcgtatacaaatgcgtcgcatctaacgcagccggagctgatagcttggctattaggttacacgtggctgctttacctcccgtgatccaccaggaaaaactggaaaatatctcgctccctcctggcctgtccatccatattcattgtacagccaaagctgcacccttgcccagcgtgagatgggtgctgggagacgggactcaaatccgcccatcccagtttctccacgggaatctgtttgtgttccctaatggaaccctgtatatccgaaacctggcccctaaagacagcggacggtacgaatgcgtggccgcgaatctggttggttcagctaggaggactgtccagctaaatgtccagcgcgcggccgcgaatgcgcgcataactggtactagcccacgtcgtactgatgtacgatacgggggcactctgaagctcgattgtagcgcctccggcgacccttggccacgaattttatggaggctcccctctaagaggatgatagacgccctgttttcttttgacagtaggattaaggttttcgctaatggcacgctcgtcgtgaagagcgtaacagacaaggacgccggcgactacctctgcgttgcgcggaataaggtaggcgatgactatgtggttctcaaggtggatgtggtcatgaaacccgccaaaattgaacacaaagaggaaaacgatcacaaagtgttctatggaggcgatcttaaagtggactgcgtggctaccggcctccctaatcccgagattagctggtcactgccagacggtagtttggtgaactcgtttatgcagagcgatgactcaggaggacgcaccaagagatatgtggtgttcaacaacggcactctgtatttcaacgaggtgggaatgcgggaggaaggcgactacacctgcttcgcggaaaatcaggtgggcaaggacgagatgcgcgtccgggtgaaggtggtcaccgctcccgccacaatccggaacaaaacttacctggccgttcaggtaccatacggcgatgtggtcaccgtcgcctgcgaggccaagggcgaacctatgccgaaagttacgtggctgtcccccacaaataaggtcattccaacttccagtgagaagtaccagatttaccaagacggtaccttgcttattcaaaaagctcagcgaagcgactctggaaactacacctgtctggtgcgaaactcggcaggcgaagacaggaaaactgtatggatccacgttaacgttcaaccacctaaaattaacgggaatcctaatccaatcaccacagtgagggagatcgccgccggcggctctagaaagctcatcgattgcaaagccgaagggatccccactcccagggtactgtgggcctttccggagggggtcgtcttgcccgccccctattatgggaatagaataaccgtgcatggaaatggatctctcgacattcgatcgctgaggaaatccgatagcgtgcagctggtgtgcatggctaggaacgagggcggggaggccagactgatactgcaactgactgttttggagccaatggagaaaccaatctttcatgatccgattagtgagaaaattacggctatggccgggcacacaatcagtctcaattgctctgctgctgggacgccaacaccctctttggtatgggtccttcccaatggcaccgatcttcagtcaggccagcagctccagcggttttaccacaaagctgatgggatgcttcacatcagcggactgagtagtgtagatgccggagcctataggtgtgtggcccgtaacgcagctggtcatactgaacggctggttagcctgaaagtgggtctgaaacccgaagccaataagcaatatcacaacctcgtcagtataataaacggggaaaccttgaaacttccttgcacaccaccgggcgcaggacaagggcggttcagctggaccctgccaaatggcatgcatctggaaggacctcagactctgggcagggtaagtttgctggataacggcactctaactgtcagggaggccagtgtctttgaccgcggcacatacgtgtgtagaatggagacggaatacggacccagtgtgacctcaatccccgtgattgtcatcgcctatccccctcgtattacaagcgaacccacgccagtaatctatacgcgtcctggcaataccgtgaagctgaattgcatggctatgggtatccccaaggccgatattacctgggaactgcccgacaaatcccacctgaaagccggcgtgcaggcccgcttgtacgggaacagatttctgcatccgcagggctcattgactatccagcatgccactcaacgggacgccgggttttataagtgcatggcgaagaacattctcggaagcgactcgaaaaccacatatattcatgtcttttag

SEQ ID NO: 9256 - DNA, 3330 bp, Artificial Sequence
  Description of Artificial Sequence: Synthetic coding sequence
atgcggctgctgctgctggtgcccctgctgctggcccccgcccccggatcctcggcgccaaaggtgcggaggcagagcgacacatggggcccatggtcacagtggtcaccatgttcaaggacatgcggcggaggggtttcctttagagagagaccttgctattctcagagaagagatggcggaagttcctgtgttggtcctgcgaggagccatcgtagttgcaggactgagagctgtccagacggagcgcgggattttcgagcagaacagtgcgcagagttcgacggcgccgaattccaggggcggcgataccggtggctgccatactattccgctcccaacaaatgcgaacttaactgtataccgaagggagagaatttttactataagcacagagaagctgtggtcgacggcaccccttgcgaacctggcaagagagacgtctgtgtcgacggaagctgcagggtggttgggtgtgatcacgagctcgacagctcgaagcaggaggataaatgtctgcgctgcggtggggatggcaccacctgttacccagtagccggtactttcgacgccaacgatctgtctcgggggtacaatcaaatactaatcgtccccatgggagctacttctattctcattgacgaagccgctgcgtcaagaaacttcctcgccgtcaagaatgtcagaggagagtactatttaaacggacactggaccattgaagccgcccgtgctctacccgccgcatctaccatactgcactatgaacgcggtgccgaaggtgatttagcacctgagaggctccacgctcgggggcccacttccgagcccttggtgatcgagctcatctcccaggagcccaacccaggcgtacactacgagtatcacctgccattgcggcgtccctcaccaggcttcagctggtctcacggatcgtggtctgactgcagcgccgagtgtggtgggggacaccagtctcggcttgtgttttgcactattgaccatgaggcctaccctgatcatatgtgccagaggcagcctcgacctgctgatagacgaagctgcaacctccacccatgcccagagacaaaacgatggaaggccgggccctgggctccctgtagtgccagctgcggcggagggtcacagagccgctctgtgtattgcatctcaagcgatggagctgggatacaggaagctgtggaggaggctgagtgcgccggacttcctgggaagccccccgctattcaagcttgcaaccttcagcgctgcgcagcgtggtccccagaaccctggggtgagtgtagcgtgagctgcggcgttggagtgagaaagagaagtgtcacttgtaggggggagagaggttccctactgcataccgccgcatgcagcctggaggacaggcctcccctgaccgagccttgcgttcatgaggattgtcctttgctctcagatcaagcatggcacgtcggaacatggggtctttgttccaagtcctgttcctcagggacccggcggcgacaagttatctgcgcaattggcccgccttcccattgtggtagcctgcaacactccaagcctgtggacgtggagccatgcaatacccaaccctgccatttaccccaggaagttccatctatgcaggatgtgcatactccagcctctaacccctggatgcccttgggacctcaagaaagccccgcctccgattctcgcggccaatggtgggccgcccaagaacatccatctgctcgaggagatcataggggcgagcggggtgatccccggggggatcaagggacccacctgtccgcattaggtccggctcccagtctccaacaaccaccttaccagcaacccttgcggagcggatctggtccacacgactgccgccattctccacacgggtgctgtcctgatgggcacacggccagcctgggacctcagtggcaggggtgtcccggggccccctgccagcagagcaggtatggatgttgtcctgacagggtaagtgtggccgaaggtcctcatcatgctggttgtaccaagagttacgggggggattccacaggtggcatgcctagatccagggccgtggcatcaacggtgcacaacactcaccagccccaagcgcagcagaacgagccatccgaatgcagagggtcccagtttgggtgctgttatgataacgtcgctacagccgctggccccctgggcgagggctgcgtcggccaacctagccatgcgtaccctgtcaggtgcctcctaccctcagctcacggatcctgtgccgactgggccgctagatggtactttgtcgctagcgtgggtcagtgcaataggttttggtacggaggctgccacggcaacgccaataactttgcctcggaacaggagtgtatgtctagctgccagggctcattgcacgggcccagacgccctcaaccgggggcgtccggaagatcgacacacaccgacggtgggggatcttcaccagcaggggaacaggagcccagccagcaccgcaccggcgccgctgtgcagagaaagccatggccgtcaggtggcttgtggcgacaggatcagcagcccggacctggcgaggctccccacactcaggcattcggcgaatggccatggggccaagagctgggaagcagggcccctggactgggaggagatgccgggagcccagcccctccttttcattccagttcatatcgcatatccttagctggcgtggaaccgtcactggtccaagctgccctggggcaactggtgcgcctgtcatgctcagatgatacagcccctgagagccaggcagcctggcagaaagatggacaacctatttcctccgaccggcacaggctccagtttgatggcagtttgatcatccacccactgcaggccgaggacgctggcacatattcttgtggaagcacacgtccaggccgagattctcagaaaattcaattgagaattatcggcggggacatggcagtcctttcagaagccgaactgagccggttccctcagccaagagaccctgcacaagatttcggacaggccggggcagctggccccctgggggctattccttcgagccatccccagcccgccaaccggctgcggctggaccagaaccaaccgcgggttgtagatgcgagcccgggtcagcggatcaggatgacatgtcgcgcagaggggtttcccccgcccgcaatagaatggcagcgcgatgggcagcctgtctcctcccctagtactcatcgccccgcccaaggtccttggcagggcctgcgccgacccgcccgcgctggtcaactgtag

SEQ ID NO: 9257 - DNA, 405 bp, Artificial Sequence
  Description of Artificial Sequence: Synthetic coding sequence
atgaagagcgtgctgctgctgaccaccctgctggtgcccgcccacctggtagccgcctggtccaataactatgcggtcgactgcccacaacattgcgactcttccgaatgtaagagctccccaagatgtaagcgaaccgttttggacgactgtggttgttgtcgggtgtgcgccgctggcaggggcgaaacgtgctacagaaccgtttcgggcatggatgggatgaaatgtggccctggactgaggtgtcaaccaagcaatggcgaagacccattcggggaggaattcgggatctgtaaggagcatgatatggcttcaggggatgggaatatcgtgagggaggaagtggtaaaggagaatgctgccgggagcccggttatgcgcaagtggctgaacccacggtag

SEQ ID NO: 9258 - DNA, 555 bp, Artificial Sequence
  Description of Artificial Sequence: Synthetic coding sequence
atgaagagcgtgctgctgctgaccaccctgctggtgcccgcccacctcgttgccgcgtggtcaaacaactatgcagtagactgcccacagcattgtgatagttcggaatgtaaaagttctccacggtgcaagaggactgtgctggacgattgcggttgctgccgtgtgtgcgccgctggccgcggagagacctgttacaggaccgtttccggcatggatgggatgaagtgtggaccaggcctcaggtgtcagccttcgaatggggaagacccatttggtgaggagttcggcatctgcaaagactgcccttatggcacattcgggatggattgcagagagacttgcaactgccaatccgggatctgcgatagagggaccggcaaatgtctcaagttccctttcttccaatacagcgtaaccaagtcctcgaatcgcttcgtctccctgaccgaacacgatatggcttctggagatggaaatatcgtgcgcgaagaggtcgtcaaagagaacgcggcaggctccccggtgatgagaaaatggttgaaccctcgttag

SEQ ID NO: 9259 - DNA, 597 bp, Artificial Sequence
  Description of Artificial Sequence: Synthetic coding sequence
atgcccatccccgccagccccctgcacccccccctgcccagcctgctgctctacttgttactggagctggccggagttacacacgtgtttcatgtccaacagacagagatgagccagacagtcagcaccggagaatccattattctcagctgttcggtcccgaacaccctccccaatggacccgtcctctggtttaaaggcacaggaccgaaccgcaagcttatctacaattttaaacaaggcaattttccccgtgtaaaggaaataggagatacgactaagccagggaacacagacttcagcacaaggattagagaaataagcctcgcggatgctggaacctattactgtgtgaagtttatcaaaggacgtgctatcaaggagtatcagtctggcaggggcacacaggtcttcgtgaccgccgaacagaaccctcgccctcccaaaaatagaccggccggacgcgccggctctagagcacaccacgacgctcatacttgcctgagtgcgttgccggaaagaaactccaccaactatttcgttcagccatgctgctgcctccgcctgcttgggctcaccggcctgctcagcaaatag

SEQ ID NO: 9260 - DNA, 594 bp, Artificial Sequence
  Description of Artificial Sequence: Synthetic coding sequence
atgcccatccccgccagccccctgcacccccccctgcccagcctgctgctctatctcctcttggaactggccggggtgacccatgtgttccatgtgcagcaaacagagatgagccaaacagtttccaccggcgagtcgatcatcctctcttgcagcgtccccaataccctcccaaacggtcccgtactctggttcaagggaactgggccaaatcgcaagctgatatataactttaagcagggaaattttccccgagttaaagagataggtgacaccactaaacctggaaacacggatttcagcacccggatccgcgagattagcctagcagacgctggaacctactattgtgtcaaattcatcaaaggacgcgcgatcaaggagtaccagagtggaagaggaacccaggtttttgtcacagagcagaacccccgtccccctaagaataggcccgccgggagggctggaagtcgagcccatcacgacgctcacacatgcctgtctgccctaccagaaaggaactcaacaaattatttcgtacagccttgctgttgtcttaggctactcggacttactggcttactgagcaagtag

SEQ ID NO: 9261 - DNA, 1563 bp, Artificial Sequence
  Description of Artificial Sequence: Synthetic coding sequence
atgaccaccgacgacaccgaggtgcccgccatgaccctggcccccggtcatgcagccctcgagacacagacccttagtgccgagacgagcagtcgtgccagcacccctgccgggcctattcccgaggctgaaacacggggggcaaaaaggatatcccccgcgcgagagaccagatcattcactaaaacatcacccaactttatggtgttgatcgctacctcagtagagacctccgccgcctcaggctcccccgaaggggcaggaatgaccactgtacagactataacggggtcagacccacgggaggccatcttcgacacactgtgcaccgatgacattagcgaggaggcaaaaactctcactatggatatactgacccttgcgcatacgagcactgaagccaaaggactcagttcagagagtagcgcctcaagcgacggcccccaccctgtcataactcccagccgcgcatccgagagcagcgcctcttccgacggacctcacccagttataacaccttcacgagcgtctgagtcctctgcaagcagtgatgggccacatccagtgatcaccccatctcgtgcgagtgaaagtagcgcgagctccgatggacctcatcctgttataaccccaagctggtcccccggctcagacgtcacattgctcgccgaagccctggtcacagtaactaatatagaggtaatcaactgcagcatcacggaaatcgaaaccacaaccagctctatccccggcgcctccgatactgacttgattcccactgagggtgtcaaggccagcagtacatctgatccccctgccctcccagatagtacaaacacgaaaccccacattaccgaggtgacagccagtgctgaaacactatccaccgctggcactaccgagagcgctgcacccgacgcgacgattggtacccccttacctacaaactctacaattgagcgggaagttacagcaccaggggctacgaccttatcaggcgccctcgctacaggcaatccgttggaagagacaagcgcattgagcgtggagactccctcgtacgtgaaggtcagcggggcagccccggtatctatcgaagccgggtcagcggtcggtaagaccacctcctttgccggcagttccgccagctcttactcacccctcgaggccgctttaaagaatttcacgccctctgaaaccttgacgacggacatcgcaaccaaagggccctttcctaccagcagggatcccctaccttccgtgccccctacgactaccaacagctcccgcggaacaaactctacactagccaagattactaccagcgcaaagacaacgatgaaaccgccaactgctacccccactacagcacgaactaggcctaccaccgatgtgagcgccggggaaaacggaggctttttgctgcttaggctctccgttgcttcgcccgaagacctcaccgacccgcgggtggcagagcgtctcatgcagcagctccatcgagagcttcatgcccatgcaccacatttccaggtcagtctgctgagggttaggagaggctag

SEQ ID NO: 9262 - DNA, 600 bp, Artificial Sequence
  Description of Artificial Sequence: Synthetic coding sequence
atgctgtggcggcagctgatctactggcagctgctggccctgttcttcctgccattctgcctttgtcaggatgagtatatggaatcacctcagactggaggactaccccccgactgctcaaaatgctgccatcacgggaacaatggaaacaacggcgcaactgggcataagggagaaaagggatatcctggaataccgcctgagctgcaaatcgcattcatggcttcactcgcgacgcatttctcgaaccagaactccggtatcattttctcctccgtggaaacaaatatagggaactttttcgacgtgatgacagggcggtttggcgcaccggtgtcaggcgtctactttttcacgttctctatgatgaagcacgaagatgttgaggaggtgtacgtgtacttgatgcataatggcaatacagtattcagcatgtactcgtacgaaatgaaaggcaagagcgatacctcgagtaatcacgctgtgttaaaactggctaaaggcgatgaggtctggctgagaatgggcaacggagcactccatggagaccatcagagattcagcacattcgccggattcctactgttcgagaccaaatag

SEQ ID NO: 9263 - DNA, 960 bp, Artificial Sequence
  Description of Artificial Sequence: Synthetic coding sequence
atgctgtggcggcagctgatctactggcagctgctggccctgttctttctgcccttctgtctgtgccaggatgagtatatggaggtgtccgggcggacaaacaaggtcgtcgcaaggatagtgcagagccatcagcagactggacggtccggcagcaggagggagaaagtcagggagcggagtcaccccaaaactggtactgtcgacaacaacactagcacagacttgaaaagtttacggcctgacgaactccctcatcctgaagtcgacgatctagcgcaaattaccacgttctggggccagtcaccccagacaggtgggctgccaccggattgctccaaatgttgtcatggtgattacagcttccggggttatcagggtcccccagggccacccggaccaccagggattcctggcaatcatgggaacaacggcaataacggcgctaccggccatgagggtgcaaagggtgagaagggcgataaaggggacttgggtcctaggggcgaacgaggacagcatgggcccaaaggcgaaaagggatatccgggaatcccaccagaactgcagattgccttcatggcctcactggcgacacattttagcaaccagaattccggcattatcttttcctctgtggagactaacataggcaatttctttgatgtcatgacaggccgattcggagcaccagtgagcggggtctacttcttcactttctcaatgatgaagcatgaggatgtagaagaagtgtacgtgtatcttatgcataatggaaataccgtattctcaatgtattcctatgaaatgaaaggtaagagcgacaccagctccaatcacgcggtgctgaaactggctaagggggatgaagtctggttgaggatgggcaacggcgcgctgcacggtgaccatcagagatttagtacctttgcaggctttcttctgttcgagacaaagtag

SEQ ID NO: 9264 - DNA, 855 bp, Artificial Sequence
  Description of Artificial Sequence: Synthetic coding sequence
atgaccaagagcagcctgcggcccctgcagaagcagagcccccagaccggagggcttccacccgactgctccaaatgttgtcatggcgactattcttttagggggtatcaaggaccacccggaccacctggcccccctggtattccaggtaaccatggcaataacggaaacaatggcgccacgggtcacgaaggcgccaaaggtgagaaaggagacaagggagatctgggaccgaggggggaaagaggacagcacggccccaaaggtgagaagggctatcctggaattcctcccgaactgcagatagcctttatggcctctttagccacccacttcagcaatcagaactccggcatcatcttcagtagcgttgaaactaatattggtaatttctttgacgtaatgacagggagatttggcgccccggtttccggtgtctattttttcaccttttctatgatgaaacacgaagacgtggaggaagtatatgtgtatctcatgcacaacgggaacaccgtcttttcaatgtatagttatgaaatgaaaggtaagtcggatacctcctctaatcacgcagttctgaaactagctaaaggcgacgaagtgtggcttcgcatgggtaacggagccctacatggcgatcatcagaggttcagcacatttgctggatttctccttttcgaaacaaaatgccatggcgagaccccagcgggtccaagagattctgcggccggtaagtccaaggcctatctctgccaggccgaatggatatggcccgtgaggaagctgctcccagtgtcttggcccagataccaactgttcggcttcgtgcggtggaaggagcagcatatatag

SEQ ID NO: 9265 - DNA, 234 bp, Artificial Sequence
  Description of Artificial Sequence: Synthetic coding sequence
atggccacccggagcgtgctgctggccctggtggtgctgaacctgctcttctacgtccctcccggcagatctggcccaaacgtctacatccagaagatttttgcgtcctgctggcgtcttcagggcacgtgtagaccaaaatgtctgaagaacgagcagtacagaattctgtgcgatactatccacctctgttgcgttaaccccaagtacctacccatcctgaccggtaaatag

SEQ ID NO: 9266 - DNA, 237 bp, Artificial Sequence
  Description of Artificial Sequence: Synthetic coding sequence
atgaacctgtgcctgagcgccctgctgttcttcctggtgatcctgctgccaagcggaaaaggcatgtttggtaatgatggggtgaaggttcgcacatgtacctcacagaaggccgtgtgcttcttcgggtgccctccaggataccgctggatcgcattttgtcacaacatccttagctgctgtaaaaacatgacccgattccaaccgccccaagctaaggatccctgggttcactag

SEQ ID NO: 9267 - DNA, 627 bp, Artificial Sequence
  Description of Artificial Sequence: Synthetic coding sequence
atgggcgcccagggcgcccaggagagcatcaaggccatgtggcgggtcccagggaccacgcgtagaccagttacaggcgaatctcccgggatgcataggcctgaggcgatgttgcttctgctaaccttggcactactgggtggcccgacctgggccggtaaaatgtacgggccaggaggcgggaagtacttttctacaactgaagactacgatcacgaaattacgggtctccgggtgagcgtggggctcttattggtgaaatctgtacaggtaaaactcggggatagctgggatgtaaagctgggggccctggggggcaacacccaagaagtgaccctgcagcccggtgagtacattacgaaagtgttcgtggcatttcaggcatttctgagggggatggtgatgtatacctccaaggataggtatttctattttggcaagctggacggccagatctcctctgcatacccatcccaagaaggccaagtccttgtgggaatttacgggcagtaccagcttctgggcatcaaaagtattggcttcgaatggaactatccactggaggaaccaacaactgagcctccagtcaacttgacatactcagcaaattcaccggttggaaggtag

SEQ ID NO: 9268 - DNA, 288 bp, Artificial Sequence
  Description of Artificial Sequence: Synthetic coding sequence
atgaagttcctgctgctggtgctggccgccctgggcttcctgacccaagtgataccagctagtgccgggggttcgaaatgcgtgagtaacacacctgggtattgcagaacttgttgtcattggggcgagaccgccctctttatgtgcaacgcttctcgcaaatgttgcatatcatattctttcctcccgaaacctgatttgcctcagctgattggtaatcattggcagagtagacgacgcaacacacagaggaaagataagaaacaacaaacaactgttaccagttag

SEQ ID NO: 9269 - DNA, 339 bp, Artificial Sequence
  Description of Artificial Sequence: Synthetic coding sequence
atgttcgtgctgctgtacgtgaccagcttcgccatctgcgccagcggacagcccagaggcaaccagctcaagggcgagaactacagtcctcgctatatatgttcaatcccaggccttccaggcccaccagggcctcctggggcaaatggcagtcctggaccacacggccggattgggctgcctggaagggatgggagagacggaaggaaaggtgagaaaggtgagaagggaacagctggtttgcgcgggaaaaccggccccctgggtctggccggggagaagggtgatcaaggagagaccggcaaaaagggcccaattggccccgagggtgaaaaatag

SEQ ID NO: 9270 - DNA, 300 bp, Artificial Sequence
  Description of Artificial Sequence: Synthetic coding sequence
atgggcctgttcatgatcatcgccatcctgctgttccagaagcccaccgtcacagagcagcttaagaagtgttggaacaactacgtacaaggacattgtaggaaaatctgtcgagtgaacgaggtgcccgaggccctgtgtgagaacggccgctactgttgcctgaacatcaaggagctcgaggcctgtaaaaaaatcactaaacccccaagaccaaaacccgccacactggcactgaccctccaagactacgtgactattatagagaactttccaagcctgaagacacagagtacttag

SEQ ID NO: 9271 - DNA, 336 bp, Artificial Sequence
  Description of Artificial Sequence: Synthetic coding sequence
atgaagagcctgctgttcaccctggccgtgttcatgctgctggcccagctggtaagtgggaactggtatgttaaaaagtgtttgaacgatgttggcatctgtaaaaagaagtgcaagccggaggagatgcacgtgaagaacgggtgggctatgtgtggtaagcagagagattgctgtgttccagccgataggagagctaactaccccgtattttgtgtacagaccaaaacaactaggatatctacagttacagcaacgaccgcaacaacaactctgatgatgacgactgcctccatgagctcgatggcaccaacccccgtctcacctacaggttag

SEQ ID NO: 9272 - DNA, 1698 bp, Artificial Sequence
  Description of Artificial Sequence: Synthetic coding sequence
atggaggacagcgacagcgccgccaagcagctgggcctggccgaggcagctgctgtggccgctgcagccgcggttgcagcagctgccgccgctgcagctggaggtgaggcagaggagcccgttttgagtagggatgaggacagtgaagaggatgctgacagcgaggcggagcgagaaacgcctcgtgtcactgccgtggccgtgatggcggctgagccggggcacatggatatgggagccgaggctctgcccggaccagatgaagccgccgctgcagccgcttttgcggaggttaccacagtgacagtagcaaatgtgggggccgcagccgacaacgtctttacaaccagcgtggcaaacgcagcgtcaattagtggtcatgtgcttagtgggcgcactgctcttcaaatcggagacagtctaaacacagagaaagcaacactgatcgtagtgcacactgacgggtccattgtggagacgacaggcctgaagggacccgccgctccactgacacccggtcctcagtcacctcccactccgcttgcccctgggcaagaaaagggagggaccaagtataactgggaccctagcgtttatgactccgaactcccagtccggtgcaggaatatttcaggtactttgtacaagaataggctgggctcggggggccgagggagatgcatcaaacaaggggagaattggtactcgccaacagagtttgaggccatggcagggagagcttcctctaaggactggaagagatctattaggtacgctggaagaccactgcagtgcctcattcaggatggaattctcaaccctcatgccgcctcatgcacctgcgccgcatgttgtgacgacatgactctgagcgggccggttcgactgtttgttccgtacaagcgcagaaagaaagagaatgaactgcctacaacacctgtgaaaaaagatagtccaaaaaacataacgctgctgcccgctaccgccgccacaacttttaccgttactccgtccggtcaaatcaccaccagcggggccctgacatttgatcgggctagtaccgttgaagccaccgccgtgatatccgagagccccgcacagggggacgtgtttgccggcgccactgtgcaggaggcgtccgtgcagcccccatgtcgggcttcacaccccgaacctcattatccagggtaccaagattcctgtcagattgccccgttcccagaagctgctctccccacgtcccatcctaagatcgtgctgacctctctacccgctctggccgtccccccacccacaccaacaaaggccgcgcctcccgccctggttaacggcctggagctgtcagagccacgcagctggctatatttggaagagatggtgaactccttactcaataccgctcaacagctcaaaactctgttcgagcaggccaagcatgcttccacttatagagaagctgcaactaaccaggccaaaatccacgccgacgccgagaggaaggaacaatcatgtgtgaactgtggccgggaagccatgtcagagtgcaccgggtgccacaaggttaactattgcagtaccttctgtcagcggaaagactggaaggatcatcagcatatttgtggacaatcagcagcagtgacagtacaagcagacgaggttcatgtggcagagagtgtgatggaaaaagtcaccgtgtag

SEQ ID NO: 9273 - DNA, 471 bp, Artificial Sequence
  Description of Artificial Sequence: Synthetic coding sequence
atgaacatcctgatgctgaccttcatcatctgcggcctgctgaccagggtgacgaagggatctttcgagcctcaaaaatgttggaagaacaacgtggggcactgtcggcgacggtgtcttgacacagaaaggtacatactgctctgcaggaacaagctcagctgctgtatatcaattatctcccacgagtacaccagacgacccgcgtttcccgtgatacatttggaggacatcaccttggactacagcgacgttgattcttttacaggcagccctgtgtcaatgctgaatgacctgattacctttgatacgaccaagtttggcgaaactatgactccggaaacaaacactccagagactacgatgcccccttcagaggcaaccacaccagagacaacaatgcccccaagcgagaccgctacgagcgaaaccatgccgcccccaagccagaccgcactaacacacaactag

SEQ ID NO: 9274 - DNA, 837 bp, Artificial Sequence
  Description of Artificial Sequence: Synthetic coding sequence
atgggcggcccccgggccctgctggccgccctgtgggccctggaggccgctggcacagcagccctgcgcatcggcgccttcaatattcaatctttcggcgatagcaaggtcagtgatcctgcctgcggatccattatcgccaagattctcgccgggtacgacctggcactggttcaggaggttagagaccccgacctttcagctgtttcagccctaatggagcagatcaactccgtgtctgaacacgagtactctttcgtgagttctcagccactgggaagagatcagtacaaggaaatgtacctgttcgtgtacagaaaggatgccgtgtcagttgttgatacgtatctttatcctgaccccgaggacgtgttctctagagagccgttcgtggtcaaattctcagcgcctggaacagcacaaaacctcgtgctcatccctctacacgcggctccacaccaggccgtagccgagatagacgcactctatgacgtgtatctggatgtaatcgacaaatgggggactgatgacatgctgtttcttggcgactttaacgcagattgctcctacgtccgagcacaggactgggcggctattcgtctgagaagcagcgaggtcttcaaatggctgatccccgacagcgctgataccacagtgggcaattctgactgtgcctatgataggatcgtcgcctgtggcgcaagactccggagatctctgaagccacaatccgccactgtgcacgattttcaggaggaattcgggttggaccagacgcaagctctcgctatatccgatcatttccccgtcgaggtgacattgaaatttcaccgctag

SEQ ID NO: 9275 - DNA, 3039 bp, Artificial Sequence
  Description of Artificial Sequence: Synthetic coding sequence
atggccgaggccgccctggaggccgtgcggagcgagctgcgggagttccctgcggccgccagagagctatgtgtgccacttgctgtcccatatctcgataagccccccaccccgctgcatttttaccgcgattgggtgtgccccaaccggccgtgcatcatccgaaacgctcttcagcattggccagccctccagaagtggtcgctcccttacttccgagcaactgtgggatctacagaggtgagcgtggcagttactcccgacggctatgcggacgccgtgcgtggggatcggttcatgatgcccgcagagcgtagactcccgctgtccttcgtactggacgtcttagaagggcgtgcccaacaccctggtgttctttatgtgcagaagcagtgtagcaatttacctagcgagctgccccagctgctgcccgatctcgaaagtcatgtgccttgggcaagtgaagccctcggcaaaatgcccgatgctgtaaacttctggctcggcgaagcagccgccgtgacatccctacacaaggaccactacgaaaatttatactgcgtagtgtccggggaaaagcactttttgtttcaccctccatctgacaggccatttatcccttacgagctgtacacacctgcaacttaccagctcaccgaagaaggtacctttaaagtggtggacgaagaggctatggaaaaggccgaggtctcccggacctgcctgctgaccgtccgagttttacaggcacaccggctaccatctaaggacctggtgacaccttctgattgctacgtgactttgtggcttcccactgcctgttctcatcggttacagacgagaacagtgaagaactcctcttctcccgtgtggaaccagagtttccacttcagaatccaccggcagctgaagaacgtgatggagcttaaagtgtttgatcaggatctagtcacaggcgatgacccagtgcttagcgtgctgtttgatgcgggcacactgcgtgccggggaattccggagagaaagtttttctctaagcccgcagggagaaggacggctggaagtggagttccggttgcagtctttggcagacaggggagaatggctcgtaagcaatggagtcctggtggcccgggagctctcttgcctccatgttcagctcgaggaaacgggcgatcaaaaaagttccgaacacagggttcagctggtggtcccgggctcttgtgaagggccacaggaagcttcagtcggcaccgggactttcagatttcattgcccagcctgttgggagcaggaattaagtatcaggcttcaagatgcgcctgaggagcagctcaaggccccgcttagcgcactgccctctgggcaggtcgtgcgtctcgtgttcccaaccagccaggagcctctcatgcgggtggaactgaaaaaggaggcgggcctgcgtgagctggccgtgcgactgggtttcggcccctgcgcagaagaacaagcctttctgagcagaaggaagcaagtggtagccgccgcccttaggcaggccctgcaacttgacggggaccttcaggaggatgagatcccagtggtggcgataatggccactggcggcggaattcgggcgatgacctcgctctatgggcagctagccggcctgaaagagttaggtctactggattgtgtgagctatatcaccggagcaagtgggagcacatgggccctcgctaatctttatgaggatcctgaatggagccagaaggacctggccggacccactgagctgttaaagacacaggtaactaagaataagctgggggtgctcgcccccagtcagctgcaacgctatcggcaagaactagcagaacgggctcgtttgggctatccctcctgctttactaacctgtgggcactgatcaacgaggcgcttctgcacgacgaaccgcacgaccacaagttgtccgatcagcgtgaggctctatcgcacggacaaaacccgctgcccatctattgtgcactcaataccaaggggcagagtctgacaaccttcgagttcggcgaatggtgtgaattctcaccgtacgaggtgggtttccccaagtacggggcctttatacccagcgagctcttcgggtccgagtttttcatgggccaattgatgaagcgactcccagagtccaggatctgttttcttgaaggcatctggtccaatctctacgccgctaacctgcaggattctctttactgggccagcgagccttctcagttttgggaccgttgggttcggaaccaggccaacctggataaggaacaggtcccacttctcaagattgaagaacctcctagtaccgccggccgcatcgctgaattcttcactgacctacttacttggcggcctttagctcaggccacgcacaatttcctgcggggcctgcacttccataaggattatttccagcatccccattttagcacctggaaggctaccacattggacggcctacccaatcagctgactcccagtgagccacatttgtgtctcctggatgttggctacctgataaacaccagctgcctgccacttctacagcctactcgggacgttgacctaattctttccctggactacaacctgcacggcgcttttcagcaacttcaactgctcggacggttttgccaggaacaaggaatcccattccctcctatttcaccttccccggaggaacaactccagccaagagaatgccacacattctcagatcccacttgcccaggcgctcctgccgtgctgcatttccccctggtaagcgactccttcagggaatattcggcccccggggtccgaagaacgccggaagaagccgcagcaggcgaggtgaacctatcatcaagcgattcaccataccattacaccaaggtgacctattcccaagaagatgtcgacaagcttttacatctcacccactacaacgtttgtaataatcaagagcagctgttagaggccctgaggcaggccgtgcagcgaagaaggcagcgccgcccccattag

SEQ ID NO: 9276 - DNA, 1548 bp, Artificial Sequence
  Description of Artificial Sequence: Synthetic coding sequence
atggcctggccctacttcctggactgccaccggtacttcacccgggaagacgaaggatgttacgacccattggagaagctgagaggcggcctagaggccgatgaggccctcccctctgggctgccaccaacctttatccgattctcccaccactcttacgcccaaatggtgcgtgtcctgcgtagaacggccagcagatgcgcccatgttgcacggacgtacagtattggacggtccttcgacggccgcgaattactggttatcgaattctcatccagacctggacagcatgaactgatggaacccgaggtgaaactgatcggcaacattcacggaaatgaggtcgcaggcagagagatgttgatttacctcgcacagtacctctgctcggaatatctgttgggaaaccccagaattcagagacttcttaatacaacccgaatccatttgctgccatccatgaacccggacggctatgaggttgccgccgccgagggggcaggatacaacggatggacttcaggaagacagaacgcacagaatctggacttgaacaggaattttcctgatttgacctcagaatattatcgcctagcagagacaagaggcgctcggtccgatcacatccctattccccagcactattggtgggggaaagtcgcaccagaaacgaaagcaatcatgaagtggatgcagaccatcccgttcgtgctgtcagcttctctgcacggcggcgacttggtggtttcctaccccttcgactttagcaagcatccccaggaagagaagatgttttctcctacaccagacgagaagatgttcaaactgttgagcagagcatatgctgatgtgcaccctatgatgatggacaggtccgaaaataggtgcggagggaacttcctcaagcgggggtccataatcaacggagcagattggtattcattcacaggcggcatgagcgactttaattaccttcatactaattgcttcgaaatcacagttgagctgggctgcgtcaagtttccgcctgaggaagcgctctacatcctatggcagcataacaaggaatccctactgaattttgtggagactgtgcatcgaggcataaaaggcgtggtgacggacaagtttggcaagcctgtcaagaacgctcggatttctgttaaaggaatcagacacgatatcactactgcgccggacggagattattggagattgcttcctcccggtatccacattgttatcgcccaagccccggggtatgctaaagtcatcaaaaaagtgatcatccccgctcgcatgaagagggccggtagggtagacttcatcctgcaaccgctgggaatgggtcccaagaactttatacacggcctgcgcagaacaggtccccatgatcccctgggtggcgcatcatcccttggcgaagcaaccgagcccgaccctctgcgtgcccggcgtcagccaagtgccgatggaagcaaaccgtggtggtggtcctacttcacctcgctgagtacccaccgccctcgatggttactcaagtattag

SEQ ID NO: 9277 - DNA, 285 bp, Artificial Sequence
  Description of Artificial Sequence: Synthetic coding sequence
atgcggaccctggccatcctggccgccatcctgctggtggccctgcaggcgcaagccgagccgttacaagccagagcagatgaggtggcggcagcccctgagcagattgctgccgatatccctgaagtagttgtatcgctggcctgggatgaaagtttggcgccaaagcatcctggatccagaaaaaatatggcatgctactgccgtattcctgcctgcatcgccggtgagcggaggtacgggacttgtatctaccaggggcgactctgggcattttgctgttag

SEQ ID NO: 9278 - DNA, 420 bp, Artificial Sequence
  Description of Artificial Sequence: Synthetic coding sequence
atgggcaaccccggcggcgtgggcagcgagcggatgcgggtggcccgtagaacccgaaacgtctgccgctgtcccagagccgctgggcccggggtgccagagcccagggctgcaccactgccactgttagctatggcaccacccccggcttgccgttcgccgatgtccccaccacctccaccgttgctgctgctgctgctatccctggccctgctgggcgcacgggctagggcagaacctgccggcagcgcggtgccagcccagagccggccgtgcgttgattgtcatgcctttgaattcatgcagcgagcattgcaggatctgcgcaaaactgcatgctccctagacgcccggaccgagacccttctattgcaggccgagcgaagagcgctgtgtgcatgctggcctgcagggcattag

SEQ ID NO: 9279 - DNA, 471 bp, Artificial Sequence
  Description of Artificial Sequence: Synthetic coding sequence
atggcccccgccgtgacccggctgctgttcctgcagctggtgctggggcccactctggtgatggacatcaaaatgcagatcgggagtcgcaatttctacaccctgagcattgactaccctcgcgtcaattaccccaagggattccgtggatactgtaacggcctcatgagctacatgcgtggaaagatgcaaaactccgactgtccaaaaatccactatgtgattcatgcgccgtggaaggcaatccagaagttctgcaagtactcggacagcttttgcgagaactacaatgagtactgcacccttacgcaggatagtctgcctatcacggtgtgttctttatctcatcagcagccccccacctcctgctattacaactccactctgaccaatcaaaagctttatctcctgtgctcgagaaaatatgaggccgatcccatcggaattgcagggttgtacagcggcatttag

SEQ ID NO: 9280 - DNA, 444 bp, Artificial Sequence
  Description of Artificial Sequence: Synthetic coding sequence
atgatcatcatggtgatcatcttcctggtgctgctgttctgggagaatgaggtgaacgacgaagcagtgatgtctacactggaacatctccacgtcgattaccctcagaatgatgttcctgtcccagctcggtattgtaatcacatgataatacagcgcgtgatccgcgagccagatcacacttgtaaaaaggagcatgtgttcatccacgagcgacctaggaaaatcaatggaatctgcatcagccctaagaaggtggcctgtcaaaacttatcagcaatcttttgctttcaaagtgaaacaaaattcaagatgaccgtttgccaacttatcgaggggaccaggtatcccgcatgtcgctaccactacagtcctactgagggattcgtgcttgttacttgcgatgacctgcgcccagattccttcctgggttacgtgaagtag

SEQ ID NO: 9281 - DNA, 453 bp, Artificial Sequence
  Description of Artificial Sequence: Synthetic coding sequence
atgcggttcatggccggccccgccggcagccagagcctgggccccctgtgcttccactctagcccccaggcgctgtatacagtgttgttgatcgtgcttgtaatgatgagcctggtgttcggcaagttcgttcctgtaaattgggagccaccacagccacttcccttcccaaagtatctaagatgctaccgatgcctgctggagactaaagaactggggtgtctgttgggttccgacatttgccttacgccagctggaagctcctgcatcacactgcacaagaagaactcttcaggctccgacgtgatggtcagcgattgtcgctccaaagagcagatgagtgactgcagcaacactagaaccagccccgtgtctggtttttggatttttagccagtattgcttcctggacttttgcaacgatccccaaaatagaggtttgtatactccctag

SEQ ID NO: 9282 - DNA, 2742 bp, Artificial Sequence
  Description of Artificial Sequence: Synthetic coding sequence
atgggccccgaggccctgagcagcctgctgctgctgctgctggtggcaagcggggatgctgatatgaaaggccattttgacccagcaaagtgtcggtatgccctaggcatgcaggatcgcactatccccgactccgatatctccgcatcctcttcttggtctgacagcacagctgccagacactctcgactcgaatcttcagacggagatggggcctggtgtcccgccggctctgtgtttcctaaagaggaggagtatctccaggtagatctgcagaggctccaccttgttgctttagtgggtactcagggacgacatgctggcggactcggaaaagaatttagcagatcttacaggttgagatattcacgggacggtcggagatggatgggttggaaggatagatgggggcaggaagtgatctctggcaatgaagacccggagggcgtggtgttgaaggacctcggcccacccatggtggctaggctcgtccggttttatcctagggcagaccgcgtgatgtctgtgtgcctccgtgtggagctgtacggatgcttgtggcgggacggtctgctgagctacacggcgcccgtgggtcagactatgtatctgtctgaggccgtgtacttgaacgattccacttacgatggacatactgttgggggtctacaatatggtgggctaggtcagttggctgatggcgttgtgggacttgacgactttcgcaagtctcaggaactccgagtctggccaggttatgattacgtgggatggagtaaccactccttctctagcggatacgtggagatggagtttgaatttgaccgccttcgtgcatttcaggccatgcaggtccactgcaacaacatgcatacactcggagcacgcctacctggcggcgtggaatgcagattcaggcgtgggccagctatggcgtgggaaggcgagcccatgaggcacaatctgggcggcaatttgggggatccgagggccagagcagtgagcgtgccgctcggcggaagggtcgctagatttctgcagtgccggtttctgttcgcaggcccttggctgcttttttctgagatttcattcatcagtgacgtagtaaacaactcctcccccgccttgggggggaccttcccgccagccccctggtggcctcctggcccaccgccgacgaatttttcatccctcgagctcgagcccaggggccaacaaccggtagcaaaggccgaagggtcgccaacagcgattctcatcggctgccttgtcgcaatcattctgctcctcctgctgatcattgccttgatgctgtggcggcttcattggcggaggcttttatctaaagccgagcgcagagttctcgaggaggagctgactgtgcacctttccgtgcccggggatacaatcctcatcaacaaccgacccggaccaagggagccgccgccctaccaggaacccaggcccagagggaatcctcctcattcagcaccttgcgtgcccaacggaagcgccctactccttagtaatcctgcttaccgactgctgctcgccacctatgcccggcccccacgcggtcccggccccccaacacctgcctgggccaaacctactaacactcaggcctatagtggggactacatggaaccagagaagcctggcgcccccctgctcccgccgcccccgcaaaactcagtaccacattacgccgaagcagacattgtcactctccagggcgtcaccggcggtaacacctatgccgtccccgctctgccacctggggcggttggagatggcccaccccgggttgacttccctcggtcacggctgcgcttcaaggagaagctcggggagggccagttcggagaagttcacctatgtgaggtagattcgccacaagacctggtgagcctggactttcctctgaatgttagaaagggacaccctttgttggttgccgtcaaaatcttgcggcccgacgcaacaaaaaacgcgcggaacgacttcctgaaagaggtgaagataatgtctaggctgaaagaccccaatattatacgtttgcttggcgtgtgcgtgcaagatgacccgctgtgcatgatcacagattatatggaaaatggggacctgaatcaattccttagcgctcaccagctcgaggacaaagccgccgagggagctcctggagatgggcaggcagcacaggggccaacgatcagttaccctatgctgctgcacgtggctgcccagatcgcttcgggcatgcggtacttagccacactcaatttcgttcaccgggatctcgcaacacgcaactgcctcgtgggagagaactttacaatcaaaattgccgactttggaatgagccggaacctgtacgcaggcgactactatagggttcaaggcagggcagtgcttcctatcaggtggatggcctgggagtgtatcctgatggggaagttcacgacagcaagcgatgtgtgggcattcggagtcaccttatgggaagtgctcatgttgtgtagagcccagcccttcggccagcttacagacgagcaggtgattgaaaacgcgggcgagttcttccgtgatcagggccgccaagtttatctttccaggcctccagcctgtccacagggactctacgagctgatgctgcggtgttggtcacgagagagtgaacagcggccccccttcagccaactccaccgatttctggcagaagatgccctgaacaccgtgtag

SEQ ID NO: 9283 - DNA, 453 bp, Artificial Sequence
  Description of Artificial Sequence: Synthetic coding sequence
atgcggttcatggccggccccgccggcagccagagcctgggccccctctgctttcactctagtccgcaagcactgtacaccgtgctgctgatcgtccttgtgatgatgtctctcgtgtttggcaaattcgtaccggtcaactgggaacctccgcagcctcttcccttccctaagtaccttcggtgctaccggtgtctcttagagacaaaggagctaggttgtttattggggtccgacatctgtcttactccagccggcagctcttgcatcacactccacaaaaaaaattccagcggttctgatgtgatggtgtcagactgtcgctcgaaagagcaaatgagcgattgttccaacacaagaaccagcccagtgtccggtttctggatatttagccagtactgctttttggatttttgtaacgacccgcagaatagggggctctacaccccctag

SEQ ID NO: 9284 - DNA, 567 bp, Artificial Sequence
  Description of Artificial Sequence: Synthetic coding sequence
atgttccaccagatctgggccgccctgctgtacttctacggcatcatcctcaactccatataccagtgccctgagcactcccagctgacaactctcggcgttgacgggaaggagttccccgaggtgcatttagggcagtggtatttcattgctggggccgccccaaccaaggaagagctcgcgacctttgacccagtagataacattgttttcaacatggctgccggatctgctccaatgcaactgcacctgcgggctacaataagaatgaaggacggtctgtgtgtgccgcgcaagtggatctaccacctcaccgagggcagcacggatctgcgaactgagggaagacccgatatgaagactgagctgttcagctcttcctgtccaggaggaatcatgctgaatgagaccggccagggatatcagaggtttctgctctacaatcgcagtccacaccccccagagaaatgtgtggaggagttcaagtcacttacttcgtgcctcgactctaaggccttcctgctcaccccacgcaatcaggaggcttgcgaactgagtaacaactag

SEQ ID NO: 9285 - DNA, 2535 bp, Artificial Sequence
  Description of Artificial Sequence: Synthetic coding sequence
atgggccccggcgcccccttcgcccgggtgggctggcccctgcccctgctggtggtgatggctgccggtgtcgcgcccgtgtgggcaagccatagccctcacctgccgagacctcactcacgggtccctccacatccctcatctgaaagacgggccgtctatatcggcgccttgttccctatgtcagggggctggccggggggtcaggcttgccagcccgccgtcgaaatggctcttgaggatgtgaattctagacgggatattctgcccgattatgagttaaaactgatccaccacgactcgaagtgtgatccaggccaagccacaaagtacctatacgaactcctctacaacgacccgattaagattatcctaatgcctgggtgcagttctgtgagcaccttggtagcagaagctgctcgtatgtggaatttaatcgtgttgagttacggaagctcttcacctgccctgtctaacaggcaacggttccccaccttctttaggacgcacccctcagccacactgcataacccaacaagggtgaaacttttcgaaaaatgggggtggaagaaaatcgcgactatccagcagactacagaagtcttcacctccactttggacgatttggaagagagagtgaaggaggcaggtattgagattacatttagacagagcttttttagtgatccagccgtgccggtgaagaatctgaaacggcaggatgctcggatcatcgtgggcttgttttacgagaccgaggcacgcaaagtgttttgcgaggtatacaaagagcggttgttcggcaagaaatatgtgtggttcctaatcgggtggtatgccgacaactggtttaaaatttatgatccgagcatcaattgcactgttgacgagatgacagaggccgtggagggccacattactaccgagattgtgatgctcaatcctgctaatacccgctctatcagcaacatgacatcacaagaattcgttgagaagttaaccaaaagacttaagcgacacccggaggaaactgggggctttcaggaggccccgctggcttacgacgccatctgggccctggcactcgctctgaacaagacaagcggaggtggtggaaggtcaggggtgcgcttagaagacttcaattataataatcagacaattaccgaccaaatctatcgggcaatgaacagcagctctttcgagggagtatccggccatgtggtattcgatgcgtccggttcacggatggcctggaccctgatcgaacagctacaggggggaagctacaaaaagatcggctactacgatagtacaaaggacgacctgtcctggtctaaaactgacaaatggatcggcggtagccctccggcagatcagaccctggttattaagacatttcgattcctgtcccaaaaactgttcatttccgtctcagtcctgtcgtcgttaggtatcgtgctggctgtcgtgtgcttgtccttcaacatctacaacagtcatgtgcgctacatacaaaacagccagccaaacctgaacaatttgaccgctgtggggtgctccctggccctcgccgcagtgttccctctcggcttggatgggtatcacatcggccggaaccaatttccttttgtatgtcaggctagattatggctgctgggtttggggttcagcctgggctatggctcaatgttcacaaaaatatggtgggtgcatactgtgtttacaaagaaagaggaaaaaaaggaatggaggaagacactcgagccctggaagttgtacgcaaccgtgggcctgctggtgggcatggatgttctgacgctagcaatatggcagatcgtagatcctcttcacaggactatcgaaacattcgccaaagaagaaccaaaggaggacattgatgtctctatccttccacagctcgaacactgtagttctagaaagatgaatacatggctcgggatcttctatggttataagggcctgttgctcctgctcggtatatttctggcctacgagaccaaatctgtgagtacagagaagatcaacgatcatagggcagtgggtatggcgatctacaacgtggcagttctgtgcctcatcaccgcccctgtgactatgatactgagctcccaacaggacgctgccttcgcctttgcttcactggctatagtgttctcctcttatatcacactagttgttctgttcgtacccaaaatgcgaaggctgatcacgcgcggggaatggcagtccgaagcccaagataccatgaaaactggttcaagtaccaacaataatgaagaggagaaatctaggttactagaaaaggagaaccgggagctcgaaaagatcatcgccgagaaagaggaaagggtgtccgaactgaggcatcagctgcagagtagacaacaactgcgctctaggaggcaccctcctacccccccagagcctagcgggggacttccccgaggtccgcctgaacctcccgatcgcctgtcctgcgatgggtctcgagtgcatctgctttataaatag

SEQ ID NO: 9286 - DNA, 237 bp, Artificial Sequence
  Description of Artificial Sequence: Synthetic coding sequence
atgggcagcggcctgcccctggtgctgctgctgaccctgctgggcagttcacatgggaccggcccggggatgacactgcaactcaaactaaaagagtcatttctgacgaattcctcgtatgagagctcgtttctggagctcttagagaagctgtgcctgctgttgcaccttccaagcgggacctcggtgacactgcaccatgccaggagccaacaccacgtagtgtgtaatacatag

SEQ ID NO: 9287 - DNA, 2700 bp, Artificial Sequence
  Description of Artificial Sequence: Synthetic coding sequence
atgctgctgctgctgctgctggcccccctgttcctgcggccccccggggctggcggagctcagactcccaacgccacctccgagggctgtcagatcatccaccccccttgggaaggggggatccgttatcgcgggctgacacgggatcaggtgaaggcaataaattttttacctgttgactacgagatcgaatatgtatgccgcggagaaagggaagtagtggggccaaaggtgcgtaaatgcctggcgaacggatcatggaccgatatggacaccccctcaagatgtgtcaacaggacaccccacagcgaacgaagagccgtctacatcggagcactattcccaatgagtggcgggtggcccggggggcaggcgtgtcagccagctgtcgagatggccttggaggacgtgaattctcggcgggacattctgccagattacgaactgaagctcatacaccatgactccaaatgcgatcccggccaggctacgaagtatctgtatgaactgctgtacaatgaccccatcaagataatcctgatgcctggatgcagctctgtttcaacactggtggcggaggccgccaggatgtggaacctgatcgtccttagctatggatcctcatcaccggccctgagtaacaggcagagattccccactttctttcgtactcacccttctgccaccctgcataatcctacaagggtaaaactgttcgagaagtggggttggaaaaagatcgccactatccaacagaccacagaggtttttacttcaaccctggacgacctcgaagagagagtgaaagaagccggtatcgagattacgtttaggcagagcttcttctccgacccagccgttcccgtgaagaacctgaagaggcaggatgctcgaataatcgtcgggctcttctacgaaaccgaggcccggaaggtgttctgcgaggtgtacaaagaacggctgtttgggaaaaagtatgtgtggttcttaattggatggtatgcggacaactggtttaagatatatgaccctagcattaattgtaccgtcgacgaaatgaccgaagcagtggagggtcatataacaactgagatcgttatgctcaacccagccaatacacggtctattagtaacatgacctcccaagagttcgtggaaaagctgacgaagcggttaaaacgccacccagaagagactggaggatttcaggaggcaccccttgcatacgacgcgatctgggctttagccctagctttgaacaagactagcggcggcggcggccgatctggtgttagactagaggacttcaactataataatcagactattactgatcaaatctatcgggcaatgaactcctctagcttcgagggagtgagtggccatgttgtattcgatgcctctgggtcgaggatggcttggacccttatagagcagctccagggcggaagctacaagaaaatcggatactacgatagtacaaaagacgacctttcctggtccaagacggacaaatggattggcggctctcctcccgctgatcaaacccttgtcatcaagacattccgatttctgtcccagaaactcttcatcagtgtctcagtgctttcatcgcttggcatcgttctggccgtggtttgtctgagctttaatatttacaactctcacgtgcggtatattcagaattcccaaccaaatctgaacaatctgacagctgtgggctgtagcctagcactcgccgccgtcttccccctgggcctcgatggatatcacatagggcgtaatcagtttcctttcgtctgccaggcccgactgtggctcctgggtctgggttttagtttagggtacgggtcaatgttcacaaaaatctggtgggttcatactgtttttactaaaaaggaagagaaaaaggaatggaggaaaaccctggaaccatggaagctttatgctaccgtcggattgctggtgggaatggacgtgctgactttagcaatctggcagatcgtcgatcccttgcaccgcacgatcgaaacgttcgccaaggaggagcctaaggaagacatagatgtcagtattttgccccagctggagcactgctcctctcggaaaatgaacacctggttaggaatcttctacggatacaagggtctcctcctcctactcggcatcttcctggcatacgagacgaaaagcgtgtccacagagaaaatcaacgaccaccgagccgtcggaatggcgatctataacgttgctgttctgtgtctgatcactgctcctgtaacaatgatcctgagttctcagcaagacgcggccttcgccttcgcctccctggccatcgtgttttcttcttacatcaccttggtggttctcttcgtaccgaaaatgaggaggctcatcactagaggtgaatggcagagtgaggcccaggacacaatgaagactgggagtagtacaaacaataatgaggaagagaagtctcgattacttgaaaaggaaaatagggagctcgagaaaattattgccgaaaaggaggaacgggttagcgagttgaggcaccagctgcagtctagacagcaactccgaagcagacggcacccacctactccccctgagccttcaggagggttacctcgtgggcctccagagccacccgatagattgtcgtgcgatggaagcagggtgcacttactctataaatag

SEQ ID NO: 9288 - DNA, 2886 bp, Artificial Sequence
  Description of Artificial Sequence: Synthetic coding sequence
atgctgctgctgctgctgctggcccccctgttcctgcggccccccggagccggcggcgctcagacccccaatgccacatcagaaggctgccaaattatacaccccccatgggagggcggaattcggtatcgggggcttaccagagaccaggtgaaagccatcaactttttgccagttgactatgagatcgaatatgtctgccggggggagcgggaagtagttggccccaaagtgaggaagtgtctcgctaatggaagctggactgatatggacaccccgtctcgctgtgtgcggatctgcagcaaaagctacctgacgctggagaacgggaaagtgtttttgaccggtggggaccttcccgccctcgacggcgccagggtggattttcggtgtgaccctgattttcacttggtaggcagctctcgcagcatttgttctcagggacagtggtcaacccccaagccccattgccaggttaataggaccccccacagtgagcggcgtgccgtgtatataggggcactgtttcccatgagcggaggatggccaggcggacaagcctgccagcctgcagtggagatggccctcgaggatgtgaattcaagacgggacattcttcccgactatgagcttaagttaatccaccacgactctaagtgtgatcctggtcaggccactaagtatctgtatgaactcctgtacaatgacccgatcaagattatacttatgcctgggtgcagctcagtttccacactggttgctgaagccgcaaggatgtggaatcttatcgtcctgagctacgggtctagcagccccgccttgagtaacagacagaggttccccacattcttccgaacccatccttcagccacattgcataatcccacccgggttaagctttttgaaaaatggggctggaagaagattgctacgattcagcagacgactgaagtcttcacaagtacccttgatgatctcgaagaacgggtgaaagaagcggggatcgaaattacattccggcaatcctttttcagtgatcccgccgtgccagtaaaaaacctcaagaggcaggacgcccgcatcatcgtaggcttattctacgaaacagaggcacggaaggtattctgtgaagtctataaggagcgtctctttggaaaaaagtatgtgtggttcctgatcggttggtatgccgataattggttcaagatttacgaccccagtattaattgcacagttgacgagatgacagaagcagtcgagggtcatatcacaactgaaatcgtaatgctgaaccccgccaatacaagatctatctccaacatgacctcgcaagagttcgtggagaagctgaccaagcgtcttaaaagacacccagaggaaacggggggctttcaggaagctccactggcctatgatgcgatttgggccctggcccttgccttgaataaaaccagcggtgggggcggccgatcgggcgttaggttagaagacttcaactataacaatcaaactattaccgaccagatctaccgtgccatgaactcaagttctttcgaaggcgtgtcaggacacgtggttttcgacgcttcaggcagtcgcatggcatggacactcatcgaacagttacaggggggcagctataagaagatcggttactatgattccaccaaggatgatctaagctggtctaaaaccgacaagtggattggaggttcccccccagctgaccagaccctggtgatcaagacttttagatttctgtcccagaagctttttatatcagtgtcagtgctttcatccttgggcatcgtccttgccgtggtttgcctgtcttttaacatctataacagtcacgtccggtatatccagaactcccaacctaatctcaacaatctgactgcagtgggttgctcattagccctggccgctgtttttccccttggattggatggttatcacataggacgcaatcagtttcccttcgtctgtcaggcaagactgtggctactcggcctggggttctctctggggtacgggagcatgttcactaaaatatggtgggtccacaccgtctttacaaaaaaggaggagaagaaggagtggcggaagacattggagccatggaagctttacgccacagtaggcctactagtaggaatggacgtcctcactctggccatttggcagattgtagaccccctgcaccgaaccatcgaaacctttgcaaaagaagagcccaaagaagacatcgatgtgagtatattgcctcaactagagcattgttctagcaggaaaatgaatacctggttgggcatcttctatggatataaggggcttctgcttctcttgggaatctttctggcttacgagaccaagtctgtgtctacagagaaaattaatgaccaccgcgccgtcggaatggccatctataatgtggcagtgctttgcctgataactgccccggtgacaatgatcctctcatcacaacaggacgccgcattcgcctttgcgtctctggctatcgtgttttctagctacataacactcgtggtgctgttcgtaccgaagatgcggcgactcatcacccggggcgagtggcagagcgaagcgcaggacaccatgaagacgggatccagtaccaataataatgaggaagagaagagcagactgcttgagaaagagaacagagaactggaaaagatcatcgcggaaaaggaggagcgggtctcagagctcagacatcagctccagagcagacagcagctcagaagcaggcgtcatcctcccactcccccagagccttctggagggctccccagaggaccccccgagcccccggacagattaagttgtgatggcagtcgggtacatctcctctacaagtag

SEQ ID NO: 9289 - DNA, 2535 bp, Artificial Sequence
  Description of Artificial Sequence: Synthetic coding sequence
atgggccccggcgcccccttcgcccgggtgggctggcccctgcccctcctggttgtgatggccgcgggtgttgcccccgtttgggcgtcccactctccccacttaccccgccctcactccagggttccccctcaccccagttccgagcggagagcagtctatatcggcgctctgtttccaatgtctggtggatggcccggcggccaggcttgtcaaccggccgtcgagatggccttggaagacgtgaattctcggagggatatcctgcctgattacgaattaaagttgattcatcacgattcaaaatgtgacccaggtcaagccaccaaatacctttacgaattactgtacaacgaccccataaaaattattctcatgccagggtgttcctctgtgtctactctggtggcggaggctgcaagaatgtggaacttgattgtgcttagctacggctctagcagtccagccctcagtaacaggcagcggtttcctaccttcttcaggactcatcctagtgccactctccacaaccctacaagggtgaaactcttcgaaaagtgggggtggaagaagatcgcaactatccagcaaacaaccgaagtgtttacgagcacactggatgatctcgaagagcgggtaaaggaggcaggtatcgagattaccttccggcagtcttttttctcggatccagctgtgccggtgaaaaacttgaaacgccaggacgcccgcatcatcgtaggactcttctatgaaacagaggcacgaaaggttttctgcgaggtgtacaaagagagattattcggcaaaaaatacgtttggttcctcatcgggtggtacgcagacaactggttcaagatctatgatcctagcataaactgtacagtcgacgaaatgaccgaggcagtagagggtcacatcaccactgaaattgttatgctcaatccagcgaatacacgatctatctctaatatgacttcgcaggaatttgtggagaaactgaccaagcgcctgaagcgacaccccgaggaaactgggggattccaggaagccccccttgcctatgacgccatctgggcactggcacttgcactgaacaagacatcaggtggaggcggcagatccggcgtgcgattggaggatttcaactacaataaccaaaccatcacagatcagatctatcgagctatgaattcttcttcttttgagggggtgtcagggcacgtggttttcgacgcgagtggtagcaggatggcatggacactgatcgaacagcttcagggcggaagctataagaaaattggttattacgacagtactaaagacgacctgtcctggtctaagaccgacaagtggatcggagggagccctcctgcagaccagactttggttatcaagacatttcggttcctgagtcagaagctttttataagcgtgagtgtgttgagctccttaggcatagtgctggctgtagtgtgcttgtcattcaacatctacaacagccacgtccgctatatacaaaactcccagccgaatctgaacaatctgaccgcagtcggatgcagtttggctctggctgccgtattccctcttggactcgacggataccacattggtcgaaatcagttccctttcgtgtgtcaagcccggctatggctgctagggctcgggtttagccttggctatggaagcatgtttactaagatatggtgggtgcacaccgttttcactaaaaaggaggagaagaaggagtggcgcaaaaccctggagccctggaaactctatgccactgtaggcctgctggtggggatggatgtcttaaccttggccatttggcagatagtggatccactgcatagaaccatagagacgtttgccaaggaggagcccaaagaggatatcgatgtctcaatcctccctcaactggagcattgttcttcccggaagatgaatacctggctgggcattttttatggatataaagggctgttgctcctcttgggtattttccttgcctatgagacaaaatctgtgtcaactgagaaaattaatgaccatcgggcagtgggaatggcaatatacaatgtggctgtgctgtgtctgatcactgcacccgtgactatgatcctctctagccagcaggacgctgccttcgcattcgcctccttggcaatcgtgtttagttcttacattaccctggtggtcctgttcgttccgaaaatgcgcagattgatcacacgcggagagtggcaatctgaggctcaggacacaatgaagaccggcagctctaccaacaacaatgaagaggagaaatcgagacttcttgagaaagagaatagggagctggagaagattatcgccgagaaagaggagagagtaagcgagctgcgtcatcaattgcagtccagacagcagttgcggtctaggagacaccccccgacaccccccgagccgtctggagggctgccccgtggtccgcctgaaccacctgaccgcttatcttgcgatggatcacgagtacacctgctgtataaatag

SEQ ID NO: 9290 - DNA, 2535 bp, Artificial Sequence
  Description of Artificial Sequence: Synthetic coding sequence
atgggccccggcgcccccttcgcccgggtgggctggcccctgcccctcttagttgtaatggccgctggcgtggcacccgtctgggcctcacacagccctcatctaccgagaccccactccagggtccctccacacccctcatctgaaagacgcgccgtttatattggtgcattattccccatgtccggcggctggcccggcgggcaggcctgccaaccagctgtggagatggcccttgaagatgtgaattccaggcgcgacatactgcctgactacgaactgaagttgatacaccatgactcaaagtgcgatccgggtcaagctacgaaatacctctacgagcttctgtacaacgaccctattaagatcatacttatgcccggatgtagttctgtatctaccctggtggcggaagccgcacggatgtggaacttaatagtccttagttacggctcaagctctccagctctcagcaacaggcaaaggttccccacatttttcaggacccatccttcagccaccttgcacaaccctaccagagtgaagctgttcgaaaaatggggttggaaaaagatcgccaccattcagcagaccaccgaagtattcacatcaacattagacgatctggaggagcgcgtaaaagaagccggtatagaaatcacctttcggcagtcattcttctcagatcccgcagtcccagtcaaaaacctcaagcgccaagatgcccgtattatcgtgggactgttctacgaaactgaagcccggaaggtcttttgcgaggtgtacaaggaaagactatttggtaaaaaatatgtgtggttcctaatagggtggtacgctgacaactggtttaagatctacgacccctctatcaactgtacggtggacgagatgactgaggctgtggagggccacattaccactgagattgtcatgcttaatccagccaacacgcggtccatcagtaacatgaccagtcaggaatttgtggagaagctgacaaaaagattgaagagacatcctgaggaaactggcgggtttcaagaggcgccactggcctacgatgcaatctgggcattggcactggccctcaataaaacttcaggtggtggcggacggtccggtgtgcgtctggaagatttcaattacaataatcagaccatcaccgatcaaatctacagagcgatgaacagctctagtttcgaaggagtctccggacatgtagtgtttgacgcttccggctctcgcatggcctggactctcattgagcaactgcagggcggctcgtataagaagattgggtattacgactctaccaaagatgatctgtcttggtctaaaacagataaatggataggcgggagtcctccagccgatcagaccttggtcattaaaaccttccgttttctctctcagaagctgttcatctccgtatcagtactctcttcgctggggatcgtcctggctgtggtgtgtctcagctttaacatctacaattctcacgtcaggtatattcaaaactcacagcccaatttgaataatctgacagccgtcggatgttccttggccctggctgccgtattccctctggggttggacggctatcatatcggcaggaaccagttcccctttgtctgccaagccaggctctggttgctgggtctgggattttctttgggttatggctcaatgttcaccaagatttggtgggtacatacagtctttactaagaaagaggaaaaaaaggaatggcgcaagacgctcgagccatggaagctctacgctacagtgggcctcttggtcgggatggacgttctgacattggctatttggcagattgtggatcctttgcatcgaacgattgagacctttgcaaaagaagagccaaaagaagacatcgacgtctcaatcttgcctcagctggaacactgcagcagccgcaagatgaatacctggctgggtatattttacggttacaaaggcctcctgctcctgttgggtattttcctggcctatgaaaccaagagtgtaagcacagaaaagatcaacgatcacagggcagtgggtatggccatttataatgtggctgttctgtgtcttatcacagcccccgtgacaatgattctgtccagccagcaagacgctgccttcgctttcgctagcttggccattgtgttttcttcctacattactctggtcgttctgttcgttcccaaaatgcgcagactgattactcgaggggagtggcagagcgaagcccaggacaccatgaaaaccgggtctagcaccaacaataatgaggaggaaaaatcccgccttctggaaaaagagaatagggagcttgaaaaaataattgcagaaaaagaagagcgcgtgagtgaattaagacaccaacttcaaagcagacagcagcttagatcccgtcggcatcctcccactccacctgaaccatccggcggactccccagaggcccacctgaacccccagataggttgagttgtgatggaagcagagtgcacctgctctacaaatag

SEQ ID NO: 9291 - DNA, 2700 bp, Artificial Sequence
  Description of Artificial Sequence: Synthetic coding sequence
atgctgctgctgctgctgctggcccccctgttcctgcggccccccggagctggtggtgcgcaaacccctaatgcgacgagtgaaggctgccaaatcattcaccctccttgggaggggggcattaggtacaggggcctcacacgcgatcaagtcaaggccattaacttccttccagttgattatgagattgagtatgtgtgtcgaggggagagagaggttgtcggaccaaaggttagaaagtgcctcgctaacggaagctggacggatatggatactcccagtaggtgcgtaaatagaacgccacattctgaaaggcgggctgtgtatatcggagcgttatttcccatgtctggcggatggccaggagggcaggcctgtcagccagcagtggagatggccttggaggacgtcaacagccgcagggatattcttcccgactacgagctgaagctgatccaccacgactcaaagtgcgatccaggccaagcaaccaaatacctgtacgagctgctgtacaatgaccccattaagataattctgatgccaggatgctcttcggtgtcgaccctggtggctgaagccgctagaatgtggaatttgatagttttaagttatggaagctcctctcccgccctttctaacagacagcggttccctacgttcttcaggacccacccctcagctacgctccataaccctacacgggtgaagttattcgagaagtggggatggaaaaaaattgcaactatccaacagaccaccgaagtgtttacctctacgttagacgacctggaggaacgcgtgaaggaggccggcatcgaaattacctttcggcagagcttctttagtgatcctgctgtacctgtaaagaatttaaagcgccaggatgcgcgaattattgtgggccttttctacgagactgaggcgaggaaagtgttttgtgaggtgtacaaggaacgactttttggtaagaagtatgtgtggtttctcatcgggtggtacgccgataactggtttaagatttacgatccaagcataaactgtaccgtggacgaaatgaccgaagccgtggagggtcatataaccaccgagatcgtaatgctgaaccctgccaacacacggtccatatccaacatgacttctcaagaatttgtcgagaaactcacaaagcggctgaagcgccaccccgaggagacaggcggattccaggaggccccactggcctacgacgcgatctgggcactcgctctcgccctgaataaaacctctggcggcggcggacgctctggcgtaagactggaggattttaactataataatcaaaccataacggatcagatctacagggcaatgaactcaagcagttttgaaggggtcagcgggcatgtcgttttcgacgcctccgggagtagaatggcctggactctgatcgagcaactccagggggggtcctacaagaaaatcggctactatgactccaccaaggatgacttgtcttggagcaagactgacaagtggatcggcgggagtccaccagctgatcagaccctggtgatcaagacgtttcgattcctctctcagaaacttttcatttctgtaagcgtgctttcctcattggggattgtgctggcagtggtctgcctctcatttaatatctacaatagccacgtcaggtacatacagaacagccaacccaacctgaataatctgacagcagtcggttgttccttggcattggcggcagtatttccactggggctggacggatatcacatcggacgtaaccagttccccttcgtttgtcaggccaggctgtggcttctgggtttaggcttttctctggggtacgggtccatgtttactaagatctggtgggtccacaccgtgttcactaagaaggaggagaaaaaggaatggagaaaaaccttggagccttggaaactgtatgcaacagtaggccttctggtgggcatggatgtgctcaccctggctatctggcagatagtggatcctttgcatagaaccatcgagactttcgcgaaggaggagccgaaggaagacattgacgtgtccatattgccccagcttgagcactgctccagcagaaagatgaacacatggctcggcatattctacggctacaaagggctcttgcttctgctcggaatttttctggcatacgaaaccaagtcggtttcgactgagaaaattaacgaccacagggccgtgggtatggccatctacaatgtcgccgtcctctgcctgatcaccgcgcctgttactatgatcctgagcagtcagcaagacgcagcctttgcatttgcttccctcgctatcgtattttcctcttatatcactctggtggtactgttcgtaccaaagatgcggagactgatcactcgaggggagtggcaaagcgaggctcaagatacgatgaaaacaggttctagcacaaacaacaacgaggaggaaaagagtcggctgctagagaaagagaaccgtgaactggagaagattatcgcagaaaaagaggagagagtttccgagctgaggcaccagctacagagcaggcaacaactgcgtagtcgaagacaccctcctaccccccccgaaccgtcagggggactgcccagagggccgccagaaccacctgatcggttgtcctgtgatggctcgcgcgtccatctcctgtacaaatag

SEQ ID NO: 9292 - DNA, 2886 bp, Artificial Sequence
  Description of Artificial Sequence: Synthetic coding sequence
atgctgctgctgctgctgctggcccccctgttcctgcggccccccggtgccggcggtgcgcagacgccgaacgctacgtccgaaggctgtcagattatccatcccccttgggagggcgggatccggtatcgggggctgaccagagaccaggtgaaggcgatcaattttctgcccgtggactacgagatcgagtatgtctgccgcggtgagcgcgaagttgttggacctaaggtgcggaaatgcctggccaatggaagttggacagacatggacacaccttctagatgtgttaggatctgctccaaatcctatctaaccctggaaaacggaaaggtctttctgacgggcggagacttgccagcactggatggcgcacgagtggactttaggtgtgacccagattttcacctggtcggcagcagccgatcgatttgtagccaagggcagtggagtacaccaaagccccattgtcaggttaatcgcacaccgcactcagaaaggagagccgtgtacatcggggcccttttcccgatgagtgggggctggcctggcggccaggcatgccagcctgcagttgagatggcgctcgaagacgtcaacagccggagagatattctgcccgattatgaattgaaattgattcatcatgatagtaaatgtgaccctggacaggccactaagtatctttatgaattgctgtataacgaccctattaagattatactgatgcctggctgtagttccgtgtctactctcgtggcggaggctgcgagaatgtggaatctgatcgtactgtcttatggttccagctcaccagcgctcagcaatcgacagcgtttcccaacattcttcaggactcacccaagtgctacgctgcataaccctacacgcgttaaattgttcgaaaaatggggctggaaaaaaattgccaccatccagcagactacggaggtgtttacctccacgttggatgatctcgaggaacgggtgaaggaggccggcattgagatcacattccggcaatcttttttcagcgacccagctgtgcctgtcaagaatctgaaaagacaggatgctaggatcatcgttggtcttttttatgagacagaggctcgcaaggttttctgtgaagtatacaaggagcgcttattcggcaagaaatatgtctggtttctcatagggtggtatgcggataactggttcaagatttatgatccatcaataaattgtactgtggacgagatgaccgaggcagttgagggccacatcacaaccgaaatcgttatgctgaatccggccaacacccgctcgatctcaaacatgacgtcacaggagtttgtagaaaaactcacaaagagactaaagagacacccagaggaaaccggtggattccaagaagccccacttgcttacgacgccatatgggctctggctctggctctgaacaagacgagcggtggtggtggcagatccggcgttcgccttgaggattttaactacaataatcagacaatcacagatcaaatctaccgggcaatgaattcttcatccttcgagggggtgtccggccacgttgttttcgacgcttccggaagccggatggcatggacactcatcgaacagctccaaggggggtcatataaaaaaattggctattacgactctaccaaagacgacctctcgtggtcgaaaacagacaaatggatcggcgggagccccccagcagaccaaacgcttgttatcaagacttttcgcttcctgagtcagaagcttttcataagtgtaagtgtgctctctagcctggggattgttctcgcggtggtgtgtctgagcttcaacatttataattcacacgttaggtacatacagaacagccagccaaacctcaataacctgaccgcggtagggtgctccctagccctggccgctgtcttcccgctgggtttagatgggtaccatatcggtaggaatcagttcccatttgtgtgccaggcaagattgtggctccttggccttggcttctcacttggatacggatcgatgtttacaaaaatctggtgggttcacaccgtgttcacaaaaaaggaggagaaaaaggagtggagaaagaccttagaaccctggaaactctacgccactgttggactgctggttgggatggatgtgcttaccctcgccatttggcagatcgtggatcccctccacaggacaattgaaacatttgccaaggaagaaccaaaggaggatattgatgtctctatattgccacaactcgaacattgtagcagtcggaagatgaatacctggctgggtatattttatggttacaaggggctcctgctgcttctcgggatttttctcgcttacgaaactaaatctgtgagcactgagaaaatcaacgaccacagagcagtcggcatggccatatataacgtggcagtgctctgcctgataaccgcgcccgtcaccatgatcttgtcttcccagcaggatgctgccttcgccttcgctagcctggctattgtgttttcatcttacatcactctagtagtgctgtttgtaccaaaaatgcgacgcttaataacccggggagagtggcagagtgaggcccaagatacaatgaaaactggctcaagcaccaacaacaacgaagaagaaaagagccgcctccttgagaaggaaaacagagaactcgagaagataatcgctgagaaggaggagcgtgtgagtgaactcagacaccagttgcagagtcgtcagcagctgcgctcccggagacatccccccaccccccctgaaccatccggagggctgccaaggggcccacctgaacccccggacaggcttagctgcgatggctcaagagtgcatctgctctacaagtag

SEQ ID NO: 9293 - DNA, 2535 bp, Artificial Sequence
  Description of Artificial Sequence: Synthetic coding sequence
atgggccccggcgcccccttcgcccgggtgggctggcccctgcccctgcttgtcgtcatggccgcaggcgtggctccggtgtgggcaagccattcccctcatcttcctcgaccccattctagggtgccgccgcacccaagctcggaacgacgtgccgtttacatcggggccttgtttccaatgagcgggggctggcccggaggccaggcatgtcagcctgccgtagaaatggcgctggaagacgtgaacagcagaagagacattctgccagattatgaacttaagttgatccaccatgatagtaaatgcgacccggggcaggcgacaaaatatctctatgagttactgtataatgatccaattaagataattcttatgcccggttgttcatccgtttcaacacttgtcgccgaagctgctcgcatgtggaatctcatcgtgttgtcctacgggagcagctctcccgcgctcagcaacagacaaagattcccaacatttttcagaacacatccttcagctacccttcacaaccccacccgagtaaagctgtttgagaagtgggggtggaagaagatcgccaccatccagcagacaaccgaggtattcacatccacattggacgaccttgaggagcgggtcaaagaggcgggcatcgaaattacgtttcgacagagctttttctctgacccagctgttcccgtcaaaaatctcaagaggcaggacgcaaggattatagtggggcttttctatgaaactgaggcccggaaagtattttgcgaggtctataaggagcggctcttcggtaaaaaatacgtttggttccttatcgggtggtatgcagacaactggttcaagatttatgacccaagtatcaactgtactgttgacgagatgaccgaggcagtggagggccacattaccacggagatagtcatgctgaatcctgcaaataccaggtctatctcaaacatgacaagtcaagaatttgtggagaaacttactaagcgattaaagaggcatccagaggagactggaggctttcaagaggcccccctagcctacgatgccatatgggctttggccctggccctaaataagacatctgggggcggggggaggtccggagtccggctagaggatttcaattacaacaaccagactatcacagatcagatctaccgggcaatgaattctagttctttcgaaggagttagcgggcatgtcgtcttcgacgcaagcggcagcaggatggcctggactctcatcgaacagctccagggcgggagctacaagaagatcgggtattacgactctaccaaggacgaccttagttggagcaagactgacaagtggattggcggaagcccacccgctgaccaaactctggtgattaaaactttcaggttcctgagtcaaaagctgttcatctccgtctctgtgctgagttcgctagggatcgtgctcgcggtggtgtgcctgtcttttaacatttataatagccacgttcgatacattcagaacagccagccaaatctaaataatctgacggcagtgggttgctccctcgccctggccgcagtttttcccctaggtctggacggctaccatatcggccggaaccaatttcccttcgtctgccaggcacgcctctggttgttaggtttgggtttttctctcggctacggatcaatgttcaccaagatctggtgggtacataccgtttttacaaaaaaagaagaaaaaaaggaatggcggaagactctagagccatggaagttgtatgctactgttggcttgctcgtaggcatggacgtgctgacactagcaatttggcagatcgtcgatccactgcaccgcacaatcgaaactttcgcgaaggaagaacctaaagaggatatcgacgtcagcatcctgccacaactggagcactgcagctcacggaagatgaacacatggttagggatcttctatggctataaaggactcctgctcctgctgggtatattcctggcctacgaaacaaaatccgtgagcaccgaaaaaatcaacgaccaccgggctgtcgggatggccatctataacgtggctgtgctgtgtctgattactgcccctgtcaccatgattctgtcctcacagcaggacgctgcgtttgcatttgccagcctggctatcgtgttttcgagctacattaccttagtggttctattcgtgcctaaaatgaggcgcctgataacaagaggcgaatggcagtcagaagcacaggacactatgaaaactggaagttctactaacaataatgaggaagaaaagtctaggctactcgagaaggagaaccgcgaactggaaaaaataatcgccgaaaaggaagagagagttagcgaacttagacatcagctgcagtccaggcaacagttgagaagtaggcggcatccgcccacgcctccagaaccaagcgggggcctgccccgggggccaccagagccaccagatcgccttagctgcgacggatctcgcgtccacctgctctataaatag

SEQ ID NO: 9294 - DNA, 3090 bp, Artificial Sequence
  Description of Artificial Sequence: Synthetic coding sequence
atgccccccaccaagagcgtgagcgagcccgtgcccttcgagaccgaggccccatcgatgacaatcgtgccgaccacagacatcgaacccgtcacggtgcggaccgaagccacggtcaccacgctggccccaaagacctcccagcgcacgcgtaccaggaggccccgccccaagcacaagacaaccccacggcccgaaactctgcaaaccaaattggactttggacctatcactcccgggacttcatccgcaccaacaactacgacaaaacggacacgtagaccacacccaaagcctaagaccacccctcatccagaggttcctcagaccaaactggttcccgccaccattctggaacccgtgcttcgcactgaggccagcgggaccactgccgtccccgccacaatttttgaacctgtgtcgcctatcaaagaagcaccgggcaccacttttgtgcccgtcactgacctcgaacctgtcacctttagaaccgaaattccagccacaaccctcgcaacgaaaacttctaagcggactaggccacccagaccacggccaaagacaactccatcaccccaggctccagagactaagccggtccctgcaacagttcttgagcccgttacgctgagaccagaagcctctaccaccctggcttctaaaacctcacagagaacgcggaggcctcgcctgagaaccaagaccacaccgcgaccagaggcgcccgaaagtaaaccagtgccaaccgccgaactgaagccagttaccctcagaacagaaacttgggttacaacacaggcacctaagacatcccagcgcacccgacgaccccggccaaagaccaagaccacaccttcgcctgaggttccacagactaagctagtaccatccaccgacctggagcctggtactctgcggacagaggccccaaagaccatggttgtcacaactgtgctagaaccagacacctttcgcactaaattcccagaaaccactttagctcctaaaacccaacgcacacgccgtcccaggcccaggccaaaaacaactagctccccagaagtgccacagaataagagtgtaagtgttacagggtttgagccagtggtgcattcaactgacgccccaggtacaactttcgccttaactgaactgcaaacgcttatcctgaagcccgtgacctcccccagtttagaaatgacagagtctcaaccagtctcagacgttcttgaatccgtcacactcagcaccgaaagccctaaagagactatcgcccctgccaaaactgattatgtttacccaacagctaaggcgcccttatggccagaggaaccgaagaccgaagttgtggagagcataacctacgtgtcagagccaccagagacaaccctggagactagtcctctgccctcacagtcgattacattgcctagcccagatgaaccgcagacggagcccgcaccaaaacaaaccccacgtgcaccccctaagcccaagacttccccaaggccacgaatacctcagacacaaccagtgcccaaggtgccacagagagtaaccgctaagccaaagactagtcctagtccagaggtatcctatacaaccccagcgccaaaagatgtcttgctgccccacaaaccataccccgaggtgtcacagagtgaaccagcccccctagaaacccgcggcatcccctttatccccatgattagcccatccccttcgcaggaagaactccaaaccaccctagaggaaaccgatcaaagtacacaggagccttttacaaccaaaattccccggactacagagctggcaaaaactactcaagcccctcatagattttatactacggttcgccctcgaacgtccgacaagcctcacatccgcccaggagtgaagcaagccccgaggccatcgggtgctgatcgcaacgtgagtgtggattcaacccaccctactaagaagcccggaactcgccgccctcccttacccccccggcctacccacccccggcggaagcccctaccacccaacaatgtcaccggcaaaccgggaagcgctggaattatttcgtccgggccaatcactactccaccactaaggtcgacaccgagacccactggcacgccgctggaacgcatagaaactgacatcaagcagccaaccgtgccagcttctggggaggagcttgaaaacattaccgatttttccagctctccaacgcgcgagaccgacccgctggggaaacctcggttcaagggccctcacgtcagatacatccagaagcccgataacagcccctgtagcatcaccgacagtgtgaaacgtttcccgaaggaggaagctacagaaggaaacgccacatcacctccccagaatcctcctaccaatttgaccgtagtgacagtggagggatgtccctctttcgttatcttggattgggaaaaaccgcttaatgacactgtgacagaatacgaagtcatatcccgagaaaacggctcgtttagcggtaaaaataaatcaatccagatgacgaatcagacttttagcacggtggaaaacctgaaacctaacacgtcatatgagtttcaggttaagccaaaaaatcctctcggcgaaggaccggtgtctaatactgttgccttctcaactgagagtgccgatcctcgagtatcagaaccggtatcagcaggtcgtgacgctatatggaccgaaaggccctttaattctgactcctattcggagtgcaagggaaagcaatatgtaaagcgcacctggtacaagaagtttgtaggcgtacagctgtgtaacagcctgcgctacaaaatttatctgagtgactctctgaccggcaagttctacaatatcggcgaccagcgcgggcacggcgaagatcattgccaattcgtggattcgttcctcgacggccgcaccggccaacagctgacctccgaccagttgcctatcaaagaaggatactttcgcgctgtgaggcaggagccggtccagttcggcgaaatcgggggccacacccagatcaattatgtccagtggtacgagtgtggaaccactattcccggcaagtggtag

SEQ ID NO: 9295 - DNA, 2355 bp, Artificial Sequence
  Description of Artificial Sequence: Synthetic coding sequence
atgaccatcgtgcccaccaccgacatcgagcccgtgaccgtgcggacagaggccactgtgacgactttagcccctaagactagccagagaacccgcactcgtagacctcgcccaaagcataaaacaaccccccgacccgaaacccttcagactaaactggactttggcccgatcacgcctggaactagttctgcgccaacaactactactaaacggaccagacggccgcacccaaaaccaaagacaacaccccatcctgaggttccacaaaccaaattggcccccaaagtaccccaaaggactcacagaccacaccctaagcccaagactacactgtctcctgaggaactgcagacagagcttgtgcccgtgacagatctcgagccagtgacattccgcactgaaattcctgcgactacactggcgactaagacctcaaagcgcactagacctcccagaccccggcccaagaccactccctcccctcaggccccagaaaccaagcccgtacccgccacagtgttggagccagtcacattgcggcccgaagcaagcaccaccctggcctctaaaacaagtcagcgaacacggagaccgcggctccggaccaaaaccactcctcgccccgaagccccggagtcaaagccagctccaaaacagacaccacgcgccccgccgaaaccaaaaacttctccaagacctagaattcctcagacacagccagttcctaaggtacctcagagagttaccgccaagcccaaaacctcaccctcccccgaggtgtcctacacgactccggcccccaaggatgtgctcctgccgcacaaaccatatcccgaggtgtcccagtccgagcccgcgcccttagaaacccgaggcatcccattcatccccatgatatccccaagcccatcacaagaggaattacagacaaccttggaggagactgatcagtcgactcaagagccattcaccactaaaatcccacgtactacagaactcgctaagacaacgcaggcaccacatcggttctacaccaccgtgaggcccagaacttccgacaaaccccatatccgccctgtgttaaatcgcaccacgaccaggcctacgcgtcctaagccatcagggatgccctcaggaaacggggtcggcaccggcgtcaagcaggcccctcgtccatctggcgccgatagaaacgtgtccgtggacagcacacatccgaccaaaaagcccggtaccagaaggcccccgctccctcctcgaccaactcacccaagacgaaagcccttaccacctaacaacgtgaccggcaagccggggtccgccggaattataagcagcggccctattacaacaccgccgctgcggtccactccccggccaaccggtaccccactcgaaaggatcgaaactgatataaaacagcccaccgtgccagcctcaggagaggaacttgagaacatcactgatttttcttcatcacccactagagaaactgacccactcggaaagccaaggttcaaggggccccatgttcgatacatccagaagcccgacaacagtccatgtagcatcaccgatagcgttaaacggtttcccaaggaggaggcgaccgagggtaatgctacaagccctccgcagaatcccccaaccaatctgactgtggttacggtggaggggtgtccttcattcgtcatactcgactgggagaagccgctcaatgacactgtcacggagtatgaggtgatttctcgagagaacggcagtttcagcggcaaaaataaatcaatccagatgacaaaccagacattctccaccgtcgaaaatctgaaacccaacacttcctatgaattccaagttaagccaaaaaaccctctgggggaggggccagttagcaacaccgtggccttctccacagagtcggcagatcctcgggtatccgaacccgtatccgcaggcagagatgctatctggacagagaggccgttcaactccgactcatattctgagtgcaaaggaaaacaatacgttaaaagaacttggtacaaaaagtttgtgggcgttcaactttgcaactctttacggtacaagatttacctgagcgactctctgactggaaaattttacaatatcggcgatcaacgcggtcacggagaggaccactgccagtttgtggacagcttcctcgacggcagaactggccaacaactgacaagcgaccaattgcccattaaagagggctattttagagcagtgcgccaggagccagtacagttcggagaaattgggggtcacacccagatcaattacgtgcagtggtatgagtgcggaaccaccatccctggcaagtggtag

SEQ ID NO: 9296 - DNA, 1584 bp, Artificial Sequence
  Description of Artificial Sequence: Synthetic coding sequence
atgctgatgctgttcgtgttcggcgtgctgctgcacgaggtgagcttatctggacaaaacgaagccccccctaacacgcacagcattccaggtgagccgctgtacaactacgccagtatccggctcccagaggaacacatcccattctttttacacaataataggcacattgcaacagtgtgtagaaaggacagcctctgcccgtataaaaagcatcttgagaaattaaagtactgctgggggtacgagaagagttgtaaacctgaatttagattcgggtatcctgtctgtagttatgttgacatgggatggacagatacgctggaatccgccgaagacattttctggaagcaggccgatttcggttatgcacgagagagactagaagagatgcacgtgttatgtcagccaaaggagacgagcgacagttcattagtgtgctctagatacctccagtattgccgagcaaccaacctgtatctggatttgaggaacattaagcgaaatcatgatcgtttcaaagaagatttctttcagtcaggggagatcgggggtcattgcaaactggacataagaacactgacaagtgagggacaacgaaagagcccgctccagtcatggtttgcagaactgcagtcttacacccagcttaacttccggccaattgaggatgctaaatgcgatatcgtgatcgaaaaacccacgtattttatgaaactggatgccggcgtcaatatgtatcaccacttttgtgactttatcaacctgtacataacacagcacgttaacaatagctttagcacagatgtgtatatcgtcatgtgggacacctctagttatggttacggtgacctcttcagcgacacatggaatgcctttaccgactatgatgtgattcacctgaagacttatgatagcaagagggtgtgcttcaaagaagcagtgtttagcctcttaccccggatgcgctacgggctattttacaacactccattaatttcaggttgtcaaaacacgggtctctttagagccttcgcccagcatgtcctacacagactgaatatcactcaggagggtccaaaagacggcaagatccgggtaacaattctggccagatccactgaatacagaaaaatcctcaatcagaatgaactggtaaacgccctcaagaccgtgtctactttcgaagtccagattgtcgattacaagtacagagagttgggcttcctggaccagcttcgtatcactcacaatactgacatattcatcgggatgcacggagccgggctcacgcacctgctgttccttccagactgggccgcagtctttgagctgtataattgcgaggacgaacgctgttatctagacctggcccggttgcggggagtacactacataacctggcgacgccaaaataaagtgttcccacaggacaaaggacaccatcctactctgggcgagcatccaaagttcaccaattatagctttgatgttgaggagtttatgtacctagttctccaggcggccgaccatgttcttcagcaccccaagtggcccttcaaaaagaagcacgacgaactgtag

SEQ ID NO: 9297 - DNA, 2004 bp, Artificial Sequence
  Description of Artificial Sequence: Synthetic coding sequence
atgggcagcagccggctggccgccctgctgctgcccctgctgctgatcgtcattgatttatcagatagtgcgggcattggcttcagacacctcccacactggaatacaagatgtcctctggcctcccacacagatgactcctttacaggatccagcgcatacattccatgtaggacctggtgggcactgttttcgacaaaaccttggtgcgttcgtgtgtggcactgcagtagatgcttgtgccagcacctattatcagggggaagtggccttcaaagaggcctatttcacctactggttcagaagtctaagaagtctagcacttttaagttctataggaggcataagatgcccgcccctgctcagaggaagctgctccctcggcggcaccttagcgaaaaatctcatcatatctctatcccctcgccagacatatctcacaagggcctgcgttccaaaagaacccagcccagcgacccagagacctgggagtcactgccgagactagactctcagcggcacggcggacccgagtttagtttcgacctgctaccggaggctcgcgccataagggtgactatctcatccggaccggaagtgagtgtcagactgtgtcaccagtgggcattggaatgcgaggaactgagtagcccttatgatgtgcagaaaatcgtcagcggaggacatacagtggaactgccttatgaatttctgctaccttgcctgtgcattgaggctagttatctccaagaggatacagtgcggcggaaaaagtgtccctttcagtcatggcccgaggcatatggctctgacttttggaagtccgtccactttaccgattattcacagcatacgcagatggtcatggcacttacgctgcgctgtccccttaaactcgaggccgccctgtgccagcggcacgactggcacacactatgtaaagatctcccaaatgccacagctagagaatctgatggctggtatgtgctcgaaaaagtggatttacatccccagctttgcttcaaattctcgtttggtaacagctcccacgtagaatgtccacaccagacaggtagtctcacatcgtggaacgtttcgatggatacccaagctcagcaactgatcttgcatttttcatcacgtatgcacgctactttctctgccgcctggagtctacccggactgggccaagacactttggtacccccagtgtacaccgttagtcaggctcggggctcatccccggtcagccttgacctcattatcccttttttgcggcccggctgctgtgttctggtctggcgctctgatgtgcagttcgcatggaaacatctattgtgtcccgatgtttcataccgacatctgggcctgctcatcttagcactccttgctctattaaccctcttaggagtagtcttagctctgacttgcagacgaccccagagtggcccaggccctgccagacccgtactgctcctccacgcagcggactccgaagcccagcggagactggtgggagcattagcagaacttctgagggcggcgctggggggaggtagagacgtgattgtcgacctgtgggagggaaggcatgtcgcaagggtcggcccacttccgtggctgtgggccgcgcgtactcgcgtggccagagaacaagggaccgtgctgctgctgtggtcgggagccgatctgaggccagtttccgggcccgatccacgcgcagccccattgctggccttgctgcatgctgcccctcggcccctcttattgttggcctacttcagtcgtctgtgcgccaaaggagatattccgcctcccctaagggccttgccccgttaccgcttacttagggatcttcctaggctacttagggcacttgacgcaaggccgttcgccgaggcaaccagctggggtcgactaggtgccaggcaaagacggcagagtagattggaactttgtagtagactcgagagggaggctgcgcgactagccgatctcgggtag

SEQ ID NO: 9298 - DNA, 1101 bp, Artificial Sequence
  Description of Artificial Sequence: Synthetic coding sequence
atgcccatgatcagcgtgctgggcaagatgttcctgtggcagcgggagggtccaggaggacgttggacctgccaaactagtagaagagtttcaagcgacccagcctgggcagtggaatggattgaactcccacgaggcctctctctctccagtctggggtccgcccgaactctgcgtggatggagccggtcaagccgtccgtcgtctgtggattcacaggacctgcccgaagtcaacgtcggagatacagtggcaatgcttcccaaatccaggcgtgcgcttaccattcaggagattgccgccctcgcccgctcttccctgcatggaatctcccaagtggtgaaagaccacgtgactaagcccaccgcaatggcccagggtcgcgttgcgcacctgatcgagtggaagggctggtcaaaaccttccgacagtccagccgccttagagtcagcatttagtagctatagcgatctgtcagagggcgagcaggaggcccggttcgcagccggcgtcgccgagcagtttgcgattgcggaggcaaagctgcgcgcctggtcgagcgtcgatggggaggactcaactgacgatagttacgatgaagattttgccggcggaatggatacggatatggccggacagcttccactcggaccccacctccaggatttatttactggacaccgcttctccaggcccgtccggcaggggagtgtagaaccggagtctgactgcagccaaacggttagccccgacacactctgctcttctctctgtagtctggaggatgggttgctcggctctccagcgcgcctggccagtcagttgctgggcgacgaactgctgttggctaaactgcccccttctcgagaatccgcatttagaagcctgggccctttagaagcgcaggatagcctttataattccccactgaccgagagttgcctctccccagccgaggaggagcctgccccatgtaaagactgccagccgctctgtccccctctaacgggatcatgggagcggcagcggcaagcatcagacctggcgagctctggagtagtctcactggatgaggacgaggccgagcccgaggagcagtag

SEQ ID NO: 9299 - DNA, 5172 bp, Artificial Sequence
  Description of Artificial Sequence: Synthetic coding sequence
atgcagttccagctgaccctgttcctgcacctgggctggctgagctacagcaaggctcaggacgattgcaatcgcggagcatgccaccccaccacaggcgatctgctggtgggcagaaacactcagttgatggctagtagcacttgtgggctctcgagggctcagaaatactgcatcttgagctatctcgagggagagcagaagtgcttcatttgcgattcaagattcccgtatgacccctacgaccaaccgaactcccatacgatcgagaatgttatagtatcctttgaacccgatagggaaaagaaatggtggcagtccgagaacggactagatcatgtcagtatcagactggatcttgaagcattgttccgcttttcccacctgattcttacattcaagactttccgcccagcggcgatgcttgtggagagatcaacagactacggccataattggaaggtgtttaaatactttgccaaagattgtgctacttcattcccaaacataaccagcggacaagctcaaggcgtgggggatattgtgtgtgacagtaaatacagcgatatcgagccttccactggaggagaggtggtcttgaaagtgttagacccctcctttgagatcgagaatccatacagtccgtatatccaggatctggttactttgactaacctacgcataaacttcacaaaactacataccttaggggacgcacttctgggccggaggcagaatgactctctcgacaagtactattacgctctgtacgagatgatcgtacgtggtagctgcttttgtaacggtcacgcctcagagtgtagaccaatgcagaagatgagaggggacgtgttcagcccccccggaatggtgcatggccagtgtgtttgtcagcacaatactgacgggcccaattgtgagaggtgcaaggatttctttcaggacgccccatggaggccagctgcagacctgcaagataatgcatgccggtcatgctcctgtaacagtcactcctcgaggtgtcactttgacatgactacttacctggcatctggggggctctccggaggagtctgcgaggactgtcagcataacacagaagggcagcattgtgatcgctgcagaccattattctaccgcgaccctttgaagacgatcagcgacccgtacgcatgtatcccatgcgagtgtgacccggacggaaccataagtggcgggatttgcgtcagtcattcggaccctgcactcgggagcgttgctggccaatgcctgtgtaaagagaacgtagagggcgctaagtgtgaccagtgcaaacccaaccactatggcctgagtgccactgatccgctgggctgtcagccgtgtgattgtaatcctctgggttcactgcctttcctgacctgcgatgtggacacggggcagtgtctctgcctgagttatgttacaggtgctcattgtgaagagtgcacagtcggatactggggcctcggaaatcatctgcacggctgcagcccctgtgactgtgacatcggcggcgcttattctaacgtgtgttcccctaagaatgggcagtgtgaatgtcgcccacacgtaacaggacgctcatgtagcgaacctgcaccaggatacttctttgcccccctgaacttttacctatacgaagcagaggaagcgaccacgctgcaggggcttgcgcctttggggagtgaaactttcgggcagtcccccgccgtacatgtcgtacttggcgagccagtccccgggaatcccgttacatggacgggtcccggcttcgctcgggttttacccggagcaggcctgaggtttgccgttaataacatcccatttccggtggacttcacaattgcgatacattacgaaactcagtctgccgcagattggactgtgcagatcgtagttaacccgccagggggctcagaacactgtattccgaaaacactgcagtcaaaaccacaaagcttcgcactgccggcagcgactcggattatgctgcttccaacccccatctgtttagagcccgatgtgcagtactccatcgacgtttatttttctcagccgttacaaggagagtctcacgcacattcccacgttttggtcgattcactcggtctgatccctcagattaactccctcgagaacttctgttcaaagcaagacctggacgaataccagttgcataactgtgtggagattgccagcgcaatgggaccccaggtcctgccaggcgcctgcgagagactgatcatatctatgtccgccaagctgcacgatggcgccgtcgcatgtaaatgtcaccctcagggctcagttggttcttcatgttcgcggctgggcgggcagtgccaatgtaaacccctggtggtaggcaggtgttgtgacagatgctccactggttcctatgacctcggacaccacgggtgccacccatgccactgtcacccgcagggtagtaaggatacagtctgcgaccaggtcacggggcagtgtccttgtcatggcgaggtatcaggaagacgctgcgacagatgcctggcagggtactttggctttccctcttgccacccatgtccttgtaatcgctttgctgagctgtgcgaccctgagaccggatcttgttttaattgtggcgggttcaccactggtaggaattgtgaaagatgtatcgatggctactacggaaacccgagctccggacaaccatgtagaccatgtttgtgtccagacgaccccagttccaaccagtacttcgctcacagctgctatcagaatctctggtcaagcgacgtcatttgcaattgtctgcagggctacacggggacgcagtgcggcgaatgcagtaccggattctacggaaatcctcgcatctccggcgccccttgtcagccttgtgcctgcaataataatattgatgtcactgacccggagtcctgttccagagtgaccggagagtgcctccgttgcctgcataatacccagggagccaactgtcagctgtgcaaaccaggacactacggatctgccctgaaccagacctgcagaaggtgcagctgccatgccagtggtgtgtcccccatggagtgtccccctggaggaggagcctgcttgtgcgatccagtgactggcgcttgcccatgtttgcctaacgttacggggctcgcctgcgatagatgtgcggatggctattggaatctggtaccagggcggggatgccagtcctgtgattgcgatccccgaacatctcagtctagtcattgcgatcaactaaccggacagtgtccatgtaagctgggatacgggggaaaaagatgctctgagtgccaagaaaactattatggggaccctcctggaagatgcattccatgtgactgtaatcgggctggcactcaaaaaccaatctgcgatcccgataccggaatgtgtcgctgcagagagggggtgtccgggcagcggtgcgataggtgtgcaaggggacactcccaggagttcccgacatgtctgcagtgtcacctgtgcttcgaccagtgggatcatactatcagtagccttagtaaagccgtccagggactgatgaggctggccgctaatatggaggacaaaagagagaccttaccggtgtgtgaagcagacttcaaagatcttcgaggaaatgtgtccgagatagaacgtatcctcaagcacccagtttttccatccggcaaattcctgaaagttaaagattaccatgactccgtacgtcgccagatcatgcagttgaacgagcagctaaaggctgtctacgaattccaggacctcaaagatacaattgagagggcgaaaaatgaggcggatctcctcctggaggacctccaggaagaaattgacctccagagtagtgtcctgaatgcttctatcgcagacagtagcgaaaacattaaaaaatactaccacatctcgagttctgccgagaagaaaataaacgagacatcatctaccatcaatacttcggctaacactagaaatgacctgctgacaatcctcgacactttgacttctaaggggaacctgtccctggaaagactgaaacaaattaagattcctgatattcagattctcaatgaaaaggtgtgcggagatccaggtaacgttccgtgtgtgccgctgccctgcggaggggctctgtgcaccggtcgcaaagggcaccgtaaatgccgaggtcctgggtgtcatgggagcctgacactgtctaccaacgcgctgcagaaggctcaggaggccaaatccattattaggaatcttgacaaacaggtgagggggctgaagaaccagattgagtcgattagcgagcaggcagaagtgtccaagaacaacgctctgcagctcagggaaaagctgggaaacattagaaaccagtctgattccgaggaggaaaatattaacctgtttatcaagaaagtgaagaattttcttctggaagagaatgtgcctccggaggacatcgagaaagttgccaatggtgtattggatatacacctgcccattcccagtcagaacctgacagacgagttggtgaaaattcagaagcacatgcagctctgtgaagactaccggacagacgagaatagactcaatgaggaagcagatggagcccagaagctcctggtgaaagcaaaagccgctgaaaaagcagcaaacatactcctcaacctggacaaaactctgaaccaacttcagcaggctcagattacccaggggcgtgcaaacagtacaattacacaactaacggctaacatcacaaagatcaagaagaacgttcttcaggccgagaaccaaactcgagagatgaagtcagaactggagctggccaagcaacggagcggcctcgaggacgggctgtccctgctccagaccaaactgcagagacaccaagatcatgctgtgaacgctaaggtccaggccgaaagtgcccaacatcaggctggcagtctggaaaaagagtttgtggaattgaagaagcagtatgccatcctgcaaaggaagacatcaaccacaggtctgactaaggaaaccctgggcaaggttaagcaattaaaggatgccgcagaaaagttggccggcgacactgaagccaagatacggcgcataactggctgcttccaaaactctgccagatag

SEQ ID NO: 9300 - DNA, 5286 bp, Artificial Sequence
  Description of Artificial Sequence: Synthetic coding sequence
atgcagttccagctgaccctgttcctgcacctgggctggctgagctatagcaaagctcaagatgactgtaatcgtggtgcatgccacccaacaaccggggacctgcttgtgggaagaaatacacaactcatggcaagttcaacatgtggactaagccgcgcacaaaaatactgtatactatcatacttagaaggggagcagaaatgttttatctgtgatagccgattcccctacgacccatatgatcagccaaatagtcatacaatagagaacgtgatcgtgtcttttgagcccgacagggagaaaaagtggtggcagtcagaaaatggcctggaccatgtttccattcgtctagatttggaagcactgttccgattcagtcatcttatattgacattcaaaacctttagacctgctgccatgctcgtcgaacgcagtacagactacgggcacaattggaaggtttttaagtacttcgctaaggattgcgccactagtttcccaaatattacttccggccaggcgcagggcgtgggggatattgtgtgtgatagcaagtactccgacattgagccctctactggcggcgaagtagtgcttaaggtgctggacccctcattcgagatcgagaacccttactccccttatattcaagacttggttactctgaccaacctgcgaattaattttactaagcttcacactctcggagatgcactgctcggtagaaggcagaatgatagcctggacaagtactattatgcactgtacgagatgattgtgagaggatcatgcttctgcaatgggcacgcttctgagtgtcgaccaatgcagaaaatgagaggcgatgtgttctcacctcccggcatggtgcatgggcagtgtgtatgtcagcacaacacagacgggcctaactgcgagcgatgtaaggatttttttcaggatgccccatggagaccagcagccgacctccaagacaatgcatgtcgtagctgcagttgcaacagccactcctcccgctgccatttcgatatgactacttatctcgctagtggagggctttcagggggggtctgtgaggactgtcagcacaacactgaaggacagcattgcgatcggtgtaggcccctgttttacagggatcctcttaagacaatatccgacccctatgcttgcattccgtgtgaatgcgaccctgacggaaccatctctggaggtatttgtgtcagccactcagaccccgctcttggctcagtggccgggcaatgtttatgtaaggagaatgttgagggtgcaaagtgcgaccagtgcaagcccaatcactacggccttagtgctactgacccattgggatgtcagccctgtgactgtaatcccctggggagcctgccgtttctgacatgtgatgtcgacactggtcagtgtttgtgcttgtcttatgtgacaggtgctcattgcgaagagtgcaccgtgggctactggggcctgggcaatcatctgcacggatgtagcccatgtgactgtgacatcggtggcgcctactccaatgtgtgcagtcctaagaatggacaatgtgagtgtaggccccacgtcactggcagaagctgttccgagcccgccccaggatacttcttcgccccccttaacttctacttgtacgaggcagaggaggccactaccctccagggcctcgccccgttaggctccgagacctttggccagtcccccgccgtccatgtggtgctcggagaacccgtgccagggaatcctgttacatggactggtccgggcttcgcaagggtgctcccaggtgccggactgcgtttcgccgtgaacaacattccctttccagtcgatttcacaattgcaattcactacgaaacccagtctgccgccgactggacagttcagatcgtggtgaatccccctgggggctccgagcattgcatccccaaaaccctacagtcaaagccacaaagcttcgctctccccgccgccacgagaatcatgctcttgccaacccctatttgtcttgagcctgatgtgcagtatagcatcgacgtgtatttcagccaaccccttcaaggcgaaagccacgcacattcacacgtgctggtggatagcttgggactcatccctcagataaactcactcgaaaacttttgctcaaagcaggatttggatgagtaccagctgcacaactgtgtggagatcgccagcgctatgggacctcaagtgttgccgggcgcctgtgagaggctcattataagcatgagcgccaaactgcatgacggcgccgtcgcctgcaaatgccatccacagggaagcgtgggatcttcttgttctcgacttgggggccaatgtcaatgtaaacctctggtggtgggcaggtgttgtgatcgttgttctactggcagctacgatctcgggcaccacggatgccatccttgccactgccacccacagggatcaaaggacacagtctgcgatcaggtgacgggccaatgcccctgccatggagaggtgagtggtaggaggtgcgaccggtgcctggctggatacttcggctttccgtcctgccatccctgcccctgtaaccgtttcgccgagctgtgcgaccccgagactggctcttgcttcaattgtggcggattcactacagggcgaaattgtgagcggtgtatcgacggatactatggcaacccgagcagcggccagccttgccggccctgcctctgccctgacgacccgtcaagcaaccagtatttcgctcacagctgctaccagaatctctggtcaagtgacgtgatctgcaactgcctccagggctacaccggtacacagtgtggtgaatgttccactggattttacggcaaccccagaattagcggtgctccatgccagccctgtgcatgcaacaataatatcgatgtcaccgatcccgagagttgctcacgagtcactggcgagtgcctccgctgtctgcataatacacagggagctaactgccagctgtgtaaaccaggacattacggttctgctctcaatcagacttgtcggcggtgttcttgccacgcctctggggttagcccaatggagtgccccccaggaggaggtgcctgcctatgcgaccctgtaactggagcatgcccttgcctgcccaatgtgacaggtctggcatgtgaccggtgtgcggacggctattggaacctcgtcccaggcaggggatgtcagtcctgcgactgtgacccgcggacctcccagtcttcccattgcgaccaactcaccgggcagtgtccttgcaaactggggtatggcggaaagaggtgcagcgaatgtcaggaaaattactacggcgaccctccaggcagatgtatcccatgtgactgtaacagggcgggcactcagaaaccgatttgcgacccagataccggaatgtgcaggtgtcgcgagggtgtttctggacagcgttgcgatcggtgcgctcgaggacattcccaggaattcccgacttgcctgcaatgtcatttatgttttgatcagtgggaccacaccatcagctccctatccaaggcagtgcaaggcctgatgcggctcgccgccaatatggaagataaacgggagacacttccagtctgcgaggccgacttcaaggacctgaggggaaacgtatcagaaatcgagcgaatactcaaacacccagtgttcccctctggcaagtttctcaaggtcaaggattaccatgattctgtacggcgccagattatgcagctgaatgaacaacttaaagccgtttatgaattccaggatctcaaggatacgatcgagagggccaaaaatgaagctgatctgctgctcgaggacttacaagaagaaatcgatttgcagagctccgtgctcaacgccagcatcgccgactcatccgaaaacataaagaagtattatcacattagcagttctgcagaaaaaaaaatcaacgagacatcctctactattaacacctccgcgaatacacgtaatgacctgcttaccatactggatacgctcacttctaagggtaacttaagcttggagcgactcaagcaaatcaagatccccgacatacagatcttaaatgagaaggtgtgcggggaccctggcaatgtcccctgtgttccgctgccatgcggtggagccctatgcactggccgaaagggccaccgcaagtgcagggggccgggttgtcacggttccctgacgttgagcactaatgctttacagaaagcacaagaggcaaaatctatcattcgtaatctcgataagcaagtccgcggactgaagaaccagattgagagcatctctgaacaggccgaggtgagcaagaataacgctctccagttgagagagaagttggggaacatcagaaaccaatctgattccgaagaggagaatatcaatcttttcattaaaaaagtcaagaacttccttctggaggaaaacgttccacccgaggacattgagaaggtggccaatggcgtgcttgacatacatctgccaatcccgtcccagaacttgactgacgaattggtaaagatccagaagcatatgcagctatgtgaggactaccgtactgacgagaatcgccttaacgaagaggctgacggggcccagaagttgctcgtcaaggcaaaggcagccgaaaaggccgccaacatcctcctcaacctggataaaacacttaaccagttacaacaggcccagatcacacagggacgagccaattccacaatcacccagctcacagccaatattacaaagatcaagaagaacgtgcttcaagcagagaaccagacccgggaaatgaaatccgagctggaattggccaagcaaaggtccgggcttgaagacggcttatccctgctgcaaacaaagctgcagcgccaccaggatcatgccgtgaacgccaaggtgcaggccgaaagtgcacagcatcaggctggaagcctcgagaaggaattcgtggaattgaagaagcagtacgcaattcttcagcggaagacgtctacaacagggctgacgaaggaaactctcggcaaggttaaacagttgaaagacgccgccgagaagctggctggtgacaccgaagcgaagattaggaggatcaccgacctggaaaggaaaatacaggatctcaacttgtcccgccaagccaaggcagaccagctacgtattcttgaggatcaggtagttgcgatcaagaatgaaattgttgaacaggaaaagaagtatgctaggtgttactcgtag

SEQ ID NO: 9301 - DNA, 1455 bp, Artificial Sequence
  Description of Artificial Sequence: Synthetic coding sequence
atgggcgccgaggccctgcccggccccgacgaggccgccgccgccgctgctttcgccgaggtaactactgtgaccgttgcgaatgttggagctgcagcagataacgtgttcactacttcagtggccaacgcagcaagcatcagcgggcatgtgctaagtggcaggaccgcactacagataggcgattccctcaatacagagaaggctaccctgattgtagtccatacggacggatcgattgttgagaccaccgggctgaaaggccccgccgcacccttgaccccaggcccccaaagccccccgacacccctcgctcctggccaagagaaaggcggcacaaaatacaattgggacccttcagtgtatgactctgagttgcccgtgcgctgtcgcaacatttcaggcaccctgtacaagaaccggctcggctcggggggccgcggacgctgtataaaacagggagaaaactggtattcgcccacagagttcgaggctatggccgggcgcgcttcctctaaagattggaagcggagcatacgctacgccggcagaccgctacaatgccttattcaggacggcattctgaacccgcacgcggctagctgtacatgcgccgcatgttgtgacgacatgacactcagtggaccggttcgtcttttcgtgccctacaaacggcggaagaaagaaaacgagctaccaacgaccccagtcaagaaagacagccccaagaatattaccctgctgccggctacagccgccacaaccttcactgtgaccccgtctggtcagattacaacgagcggagccctaacctttgatcgagcatccaccgtcgaagccactgctgtcatttcagagtcacctgcccagggggatgtgtttgcaggggccactgtgcaggaagcctctgtgcagccaccttgccgggcctctcatcctgagccgcactaccccggataccaggattcatgccagatcgccccttttccagaggcggcccttccaacatcccatccaaagattgtcctcacgtcactgcccgcattagccgtgccgcctcctactcctacaaaagctgcccccccagcgctcgtgaacgggctggaactaagtgaacctcgcagttggctgtatttagaggagatggtgaattccttattaaacacagcgcagcagctcaagactctatttgagcaggctaagcatgcctcaacctatcgagaagcagctactaatcaagctaagatacacgctgacgctgaaagaaaggagcagagttgtgtgaactgcggcagggaagcaatgagcgaatgcactggctgccacaaagtgaactattgcagcactttttgtcagagaaaaaggtggtcattgaccatgctcacaagtctggtctccatttcttggcttcgagctatcttaccgtgtcaaccaccaaaggtgcttggcctctag

SEQ ID NO: 9302 - DNA, 1512 bp, Artificial Sequence
  Description of Artificial Sequence: Synthetic coding sequence
atgagcggcgccctgctgtggcccctgctgcccctgctgctgctgctcctgagcgcaagagacggcgtgagggcggcccagccccaagcgccagggtacctgattgccgccccaagcgtgttcagggcaggtgtcgaggaggtcatcagtgtgaccatctttaatagcccacgtgaagtgacggtgcaggctcaactggtagcccagggcgaaccagtcgtgcagtcccaaggtgcgatcctggacaagggaaccattaaattaaaagttccaacagggctgagggggcaagcactacttaaggtctggggccgcgggtggcaggccgaggagggtccattgttccacaatcagacctcagtgaccgtggatggcagaggagccagtgtttttattcagactgataagcccgtctatagaccacagcatcgggtactgatcagcattttcaccgtcagcccaaatctgcgtccagttaatgaaaagcttgaagcctacatactagacccaaggggatctcgtatgattgaatggcgacaccttaagccattttgttgcgggataaccaatatgtcgtttccgctgtctgatcagccggtcctgggagaatggtttatttttgtggagatgcaaggtcacgcttacaataagagttttgaggtgcaaaaatacgtattgcccaaatttgaactactcatagacccaccccgttacatccaggatctggatgcttgtgaaacaggtactgttcgggcccggtatacgtttggcaagccagtcgccggtgcgctgatgattaatatgactgttaatggagtgggctactattcacatgaggtgggcaggccagtcctgaggaccacgaaaatcctgggttctcgcgatttcgacatatgtgttagggatatgatacccgccgacgtgccagaacatttccgcggccgcgtatccatttgggcaatggtcacatctgttgacgggagccagcaggtggctttcgatgactctacccccgtgcaacgtcaactagtggatataaggtattcgaaggacaccagaaaacagtttaaaccaggtttggcttatgttggaaaggtggagttgtcctaccctgacggcagccctgccgagggcgttactgtgcagatcaaggctgaactcactcccaaagataacatctacactagcgaggtggtgtcccaaagaggacttgttggttttgagatccccagcattccaaccagtgcccagcacgtgtggctggaggtttttcaggaactggaggattacgatgtatcggacagcttcggggtgtcaagggaggatggtcctttttggtgggcaggcctgaccgctcagaggcgacggaggtcttctgtgttcccttggccgtggggaataactaaggatagcgggttcgcttttacagttaggcgagggaatggaactggcggcgatgaccggccttccgaacctgagcccccggcggggcggtggcctctgcaccgctag

SEQ ID NO: 9303 - DNA, 144 bp, Artificial Sequence
  Description of Artificial Sequence: Synthetic coding sequence
atgaagctgtgcgtgaccgtgctgagcctgctggtgctggtggccgcgttttgctccctggctctgtctgcccccaaagcttctaaatccgctctaactccagtgagccctggctcccgatccacttgcatgacatggaattag

SEQ ID NO: 9304 - DNA, 861 bp, Artificial Sequence
  Description of Artificial Sequence: Synthetic coding sequence
atggaggtgtacatccggcacctggagaaggtgctgcggcggtacgtccaacgactgcagtggctgctctccggaccagttctctgttccagaacttggtacaggcaatcgatggacagaggagtcatgatgacagccgcctcaggatcccggcggctcttcgggaccgttcttgagtctaaggtctgtatactccttgataccagcggaagcatgggcccttacttgcaacaggtgaagaccgaacttgtgctgctgatatgggagcagctgagaaaatgctgcgacagctttaatttgttgtcgtttgcagagagctttcagtcttggcaggatacactggtagaaacgaccgacgccgcctgccatgaggcaatgcaatgggtcactcatctgcaggcccagggctccacatctatcctgcaggctttacttaaagcattttcttttcacgaccttgaaggactatatctattaacggatggtaagcctgatacttcctgctctctcgtcttgaatgaagtacagaaattaagggaaaagcgggacgttaaggttcatactatttctctcaactgcagcgatcgagcggccgtagagtttctgaggaagttggccagctttaccggcggcagataccactgcccagttggtgaagatacgctgtcgaaaattcactcccttctgaccaagggatttatcaatgagaaagatcccacgctgccaccatttgagggggacgatctcagaatcctggctcaagaaattactaaagcgcgaagctttttgtggcaggcccagtcatttaggtctcagctgcagaaaaagaacgacgccgaaccgaaagtgaccctgagctag

SEQ ID NO: 9305 - DNA, 3555 bp, Artificial Sequence
  Description of Artificial Sequence: Synthetic coding sequence
atgaagaagtaccggaagatcagcatcggctgcttcgccatggccacacagacgagccatgtattccacggccaagagaatatgttccttgaaaaccactgtattcgccgtaacactggcagggactctaagaagccactgaaacagaagaatatgaatggcctcggccagaattcagataatggcttactggtgacccacgtgaaccagacccaggacctgctgcgattgcaagggtccgaaactcagagcagcgattgggaagattcagaggactggctctccgcacatagcctgaagtgccaaaagcttactctcgctgacctaatcagccagggtaccgaggtgctggaagagggaacaaatgtggtgcagaagatctgcttttcaacccagatcatccggcattttgagagcaaattatcagataccatcgaggtctatcaggagcggatacaatggctcaccgaaaatagcaaaaaagcctttggcctgatcaagggggcgcgggtgagtatcttaattgacgttagtgccattagctccggcccacagaaagaggaattccagaaggacttgatgtccctcatagacgagcagttgagtcacaaagagaagctatttgtcctaagtttcgggaccaatgcgggttcactttggcccgatccaatggaggtgtccgcctccaccctgcaggagctgaaactttgggtcaaaacattacagcctgatggcggcagcaacctgcttcaagcgcttaaaaagatattcactctgaagggactggattctttagttgccatcatgcgctcgtgtccagaccagccttcagagatcctcagtgactatatccaacagagcactatgggaagggaccttatcatccatttcattacctatcgatgcgacgatcagatgccgcctgctgtgctgaagaacctcgctgaggccgtaagaggatactaccattgctactctcctaaaatggagcattatacatccagagatatggacgagctgctggcagagattcagaaggcccaatcgctcttatcacacgtgcaggccctgcagcactcttcaccatgtgaagctctgacatgtaccatggaagagattagcacagagattactaacggacctttaatctcactgttgccaaagccacccaaacatgacgcgcctctgacgattgaattcccaaatctcgacaagaccagcgcggagtggctcaaagtaaacggtttgaaggccaaaaaactctctctgtatcaagtgctcgccccgaatgcattctctcccgtggaggagttcgtccccatcctccagaagacagtgtcttccaccattcacgagaaggccatgatccaatttgagtggcacgacggcaccgtcaagaatattcacgtggacccacctttcctgtataagtaccaacaacagctctctagagcgatgcgcatgtacgaacgacgaattgagtggctaagcctggctagtcgcagaatttggggcaccgtgtgcgagaagcgagttgtggtgctgctggacatctcagcaacaaacagtatgtacattattcatatccagcacagccttcgccttctcctggaagaacagctatcaaataaagactgctttaatctgattgccttcggctccacgatcgagagctggcgccccgaaatggtgcccgtgagccacaataacttgcaaagcgcctggcgctgggccttaaacttacggtgccgaggaagccggaacgttctcagcgcactccgcaaagctgtcgaagttgattttaaagataaagacaagcatcaatcccagggtatttaccttttcacggggggaatacctgaccaggacatgcccacactttcagcctatatggcagaagcttgtgggggttgtgatctacaactgaatgtgtgcctattttacgtcggcgaacccaaaatggatactactcctccagcccgatatgcctcacataccgataccgcagccgcttacaaggaagtgacccgggccgcgggcgggcgcttccactggttcggcgacaccgggatatatgaaagcgatgacattaacagtatcatgtctgagatggagaaagccctgaactactcccagaagtgtgcctttctcatggctagtctgaaaaaccatagtgggaaggttttaggtagctcagcattacctaaggagaaacctaaaacgctgcaacttaggagccaacccaaaaaactctgcccacctcggcctacagtgccactgggagctagaatgtccataaaggatgacccagaccgagaaaagtccccacctctgaagagcctgaaatggagacccttatcttcgcgcgtgggcatcagccccgctgcagcccagcctaccaaggaaggcatgatggagctgcgcaggaaaacaaaatctagggaggcggagacaagtctgctactcttttacacagagaaagggaatgatgtgggatccgtttacaaaaagtacccacaaggcaggggactccggagaacctcctcctccatcgacctgcccagaaaagataccgtatgctccagccaggagtgggtggcgaaatacgggcttaaaaagttgaaactggagatctcccgatgcatgggaccgaactgcactcaccaaaagtccggccaacggtctgcatctgcaaaacattgttcaatcttccccagcgtggagatacacggcgtcgtgagacacattcaatggacacccagagagatggaagtctacataagacatttagagaaagtcctacgacggtacgtgcagaggttgcagtggttactcagtggcagccgccgcctcttcgggacagtgttggagagtaaagtgtgtatcttactggacaccagtgggagtatggggccctacctacagcaggtgaagactgagttagtgctgctgatttgggagcagttgcggaagtgttgtgattcatttaaccttctgtcgtttgctgagtcttttcagagttggcaggatactcttgttgaaacgactgatgccgcctgccacgaggccatgcagtgggttacacatttacaggcccaggggagcacatcaattctccaggcactgcttaaggctttctcattccatgaccttgagggcctctacctgctcacagatggcaaaccagacacatcctgttcactggtgttaaatgaagttcagaagctgcgcgaaaagagagatgtgaaggttcacactataagcctcaattgctcagatagggccgctgtggagttcttaaggaaattagcctcttttactgggggaagataccattgccctgtcggtgaggatacactgagtaagattcactctctactgactaaaggattcatcaacgagaaagacccaactctaccccccttcgagggggacgatctgagaatcctcgctcaggaaatcacaaaggccagaagttttctgtggcaggctcaatcgttcaggtctcagctccagaaaaaaaatgacgcagaacccaaggtgacactttcttag

SEQ ID NO: 9306 - DNA, 906 bp, Artificial Sequence
  Description of Artificial Sequence: Synthetic coding sequence
atgctgcccctgaccatgaccgtgctgatcctgctgctgctgcccaccggccaggctgccccgaaagatggtgttaccagacccgacagcgaggtacagcaccagctactacccaacccgttccaacccggacaggagcaactcggactactccagtcatatctgaaggggctcggaaggaccgaggtgcagcttgagcacctgagccgtgagcaggttctgttgtacctcttcgcactccacgattatgaccagtctgggcagctggatgggcttgaactgttgtcgatgctgacagccgccctggcgccaggagccgccaactcaccgacaaccaatccagttattctgatagtggataaggtcctagaaacacaggacctgaatggcgacggcttgatgaccccagcggaactaatcaactttcccggagtggccctgcggcatgtggagcctggggaacccctggctccatcaccacaagaaccacaggctgttggacggcagagtctgctcgcgaagagccccctcaggcaggaaactcaggaagcaccaggtccccgggaggaagctaagggccaggtggaggctcgtagggagtcgcttgacccagtgcaggagcctggcggtcaagctgaagcagatggggacgtgccagggcctaggggagaggccgagggccaggccgaggccaagggagacgcgccggggccacgcggcgaggctggtgggcaagctgaggccgagggtgacgctcccggccctcgtggtgaagctgggggccaagctgaagcgcgagaaaacggggaagaggctaaggaactccctggcgagactctggagagcaagaacacccaaaacgactttgaagtgcatatcgtccaagtggagaacgatgagatctag

SEQ ID NO: 9307 - DNA, 4722 bp, Artificial Sequence
  Description of Artificial Sequence: Synthetic coding sequence
atgcgggtgctggcctgcctgctggccgccctggtgggcatccaggcggtcgaacgactgcgcctggccgatgggcctcacggctgcgcgggtagattggaagtttggcacggcgggcggtggggtaccgtatgtgacgacgggtgggacctcagagacgccgcagtggcctgcaggcaactgggctgcggcggtgcgctggccgccccaggcggagcattctttggcgaaggggccggcccggtttggctgtctgaactcgcctgtagggggaatgaaggccaattgggcttgtgtcaccatagagggtggaaggcccacatctgtagccacgaagaagacgctggtgtagtgtgtgcgggacagagggtagcaaattctcgggacgactctacatctcctctggacggagcaccctggcctggcctgctgctcgaactcagcccctccacggaggagccgctcgtcacgcatgcccctcgcccagccggtaacccccagaacgcaagcaggaaaaagtctccaagaccaaagcaggctaaatctacgcgagcccccctgttgaccactggagccccaagacaggaaagactaagactggtatcaggaccacacagatgcgctggccgtctggaagtctggcatggcggacgatggggaaccgtctgcgatgatggctgggacctgagggacgccgctgtcgcatgcagggagctcggttgcggtggagccctggcggccccggggggagcacggtttggccccggcgccggacccgtgtggatggacgatgtggggtgcggcggtggggaacaggcgctgagggattgtcccaggtctccatggggccgctccaattgcgaccattcagaagacgcaggcttggtgtgcacggggccagcacccaggcttcgcctagcagacgggccccatggctgtgccggaagactcgaagtatggcacggtggacgttggggcagtgtgtgtgatgacgcctgggatctccgggacgctgctgtggcctgtcgcgagctggggtgcggaggggctctggccgcgcccggaggcgcgttcttcggggaggggtctggacccattattctggacgatctccgctgtcgcggaaatgagaccgccctacgtttctgtccggctaggccgtggggacagcacgactgtcaccatagagaggatgctggtgccgtctgtgatgggatgcccttgggatacgtccctcccaccgctcctacggattctaataactccacccccagagaggccgcttcgaggcccccttccaccatgacatcacaggcccccgggactgctggagtgagccctccaccagcaagtcccacagtgctttgggagcccgggcccgaggcaggaagcccacagctgcgactggttgctggccccagcaaatgcagcggcagactcgaagtgtggcacgatcagagatggggaaccgtgtgcgacgactcgtgggacatgagggactcagctgtggtctgccgggagttggggtgtgggggcccacaacaacctgaccccgccgcgggacggttcggttggggcgcaggccccatctggctcgacgacgttggatgtgtgggaacagaagcttccctctccgactgtcctgcagcgccctggggtaaacataattgtgcccataatgaagacgtgggggtgacctgcactgggccccccggcttggattccatcagtgacccatttagctggtcctggatccctggactggggcgagatcgcgatgcgtggttgcctggtgagttggccaccaaacccagtgcatcagtgactgcttcggtcctggagaagaccacaaccaaggcacctggtaagatgcctaagagcacaaagaagtgggtgacgaaaaatgcaaagcgacccacaacccagccccctgtgatgcctacaacaaagcacagccgagcccagagcccccctgacctcacaagccagactactgccgctctgacaaccgaagcttcgaggcggccgactagtgagttcacaagaagacccaccacagaagcccctcagagatggacctcccacacaaccgccacactgactcctcaggctcctagggagcgcacaacaaagacaatggcaatgctcacaacccagggtccccaagagatgacttccgagtcaaccattaagtcaattccacaggctagtcttgagcccagcgctgagattcccgaaggtagccccgagtctcccaaggatcccgccccctcccccagcgtgtctaccaccggtgagtccggcttgtttagggtgcgactcgctgatggcccgaacaggtgtgctggccggttggaggtttggcacgcgggacgctggggaactgtttgcgatgacaattgggacctccgtgatgctacagtggcatgttgggaactgggatgtggaaaggtgcggccccgggtcggcaagacacactacggcccaggcaccggccccatctggcttgatgacatgggctgcaaaggctctgaagccagtctctcagattgcccaagtggggcgtggggaaagcacaactgcgatcatgaggaggacgtcggtctgacttgcaccggatataccgactacgacgactatcctccctggacctgggatcctacttctagggaagacctagcaaagggaaccacaacggccggggtacccgggcacacactgccttggagaactacacgccggccaggctcgtcatcaccagctattagacgcctgcctgatacggggagtaaagatggttataaacttccatggacgtgggatacgccttccgggcgggggctggcagagggaacacccaccgcagggaagctgggtcccactctgggggctggcaccaccagaagcccaggctcaccaccgacattgagagtgcacggcgatacaggtagtccccgcaaaccctggcccgaacgacgacccccgcgccccgcggctacccggactgctccccccacccccagcccagggccctctgccagcccgggaccgccagggcccgcactgacgtcagacagtagtcgcgagcttacaccacactctgccctgacgagtgaagcaacatccgatgctcccgacacctccccccccacaccagaccccgctagccgtacaaaccccgatctgatcctcactagtcccgacttcgcattgtccacgcccgactcttcagtcgtgccagccctgacacctgagccgtccccgactccattgccaaccctccccaaggaactaactagtgacccttctacccctagcgaagtaaccagtctcagcccgaccagcgaacaggtccctgagagcgatacaacgcccgacctggacactacaccctactcatctacagtgagcgagtacagtcggagtccagaccctagccctagtccacatcctaccacgactcctgatccgacgatggcccctgatccaattaccaccctgaaccccaccgtgacacctcattttcctaccactccccatccaacaacaaccccccatcctactactatcactcactccactatgattccggaccctaccaccaccccccagccctttactacaattacgcatagcaccatgatccccgaccctacgacaaccccacagccattcaccaccatgcaacccactacaaccccacacagcaccaccccccatcccacaacgaccccacacccaacaaccatcacccactcaaccatgatccccgatcccaccacaactccccagcccttcacaacaatgcagccaaccactatgcctcacccaaccactacaccgcaccccactacaaccccccatccaaccaccaccccccacccgaccaccaccccgcatcccacaatgacaccagatccgaccaccacaccctatcctacgacaactcccgaccctaccaccacgccccatccaaccaccccggaccctagttcgactcccgtaatcactactgtctcactcccaacgagccttggcacggaactttcatctcctacactcgccccaactgtaaagccatcactccatcctcagttaacgtttaccgccccagccccccacacgtctacatcacaaatcccaacccttgaaccaagccccgcccttgagtcatccccctccagaagttccacagcaaccagcatggatcccctcagcactgaggactttaaacctccacgctcccagagtcctaatctgactcctccccctacccataccccacacagcgcgtcagatctgaccgttagtcccgatccacttctgtctcccacagcccatcctctcgaccatccgcccctcgatcccctcaccctcggaccaacacctggacagagcccgggccctcatggtccatgcgtggcccctactcccccagttagagtgatggcctgcgagccaccagccttggtggagctcgtggctgcggtccgtgacgtcggaggccaactgcaaaggctaacacaggtggtagaacaggaacggcaagagcgacaggccctgctgctgggcctcactcaactagtggaggctgcaagaggattgggacagctgggcgaggcggttaaaaggttggccgaaatggcatggactactagcatgccggccccaactactaccacccctgaggaggaggaacggccactgagaggtgatgtgtag

SEQ ID NO: 9308 - DNA, 1911 bp, Artificial Sequence
  Description of Artificial Sequence: Synthetic coding sequence
atgaccacctggagcctgcggcggcggcccgcccggaccctgggcttgctcttactggtggtcctgggttttcttgtactgcggaggctggattggagtacgttggttccccttcgcttgcgacaccgccaactggggctgcaggccaaaggatggaattttatgcttgaggattcaacattttggatctttggcgggagcattcattactttagagttcctcgggagtactggagggatcgtctcttaaagatgaaggcttgcggccttaacactctgaccacctacgtgccctggaatcttcacgagccagagaggggaaaattcgacttctccggaaatctcgatcttgaagcgttcgtactgatggccgctgaaatcggactctgggtaattctcaggcccggcccctacatctgctcagaaatggatctcggcgggcttccctcatggctgcttcaagatcccggaatgaggctgaggacaacatataaagggttcacggaagctgttgatctctacttcgaccatctgatgtcacgcgtggtgcccttacagtataagcgagggggccctattatagctgttcaagtagagaatgagtatggctcttataacaaggaccccgcctatatgccgtacgttaagaaagcactcgaggatcgtgggatagtcgagctgttactcacttccgataataaggatgggcttagtaaagggatcgtgcagggcgtgctggccacgattaacttgcaatccacccacgagctccaactcctcaccactttcctgttcaatgtgcagggaactcagcctaagatggtcatggagtactggacaggctggttcgacagctggggtggacctcataatatcctggacagtagtgaggtcttgaaaacggttagtgccatcgtggatgcgggaagtagtatcaacctttacatgtttcatggaggaactaacttcgggttcatgaacggagcaatgcattttcacgattacaaatcggatgtcacatcatacgattatgacgctgttttaactgaggccggggattatactgctaaatacatgaagctgagggactttttcggatctatctccgggattcccttgccccctccccctgaccttctgcccaagatgccttatgagcctctgacacccgttctctatctcagtctctgggatgccttgaaatatctgggggaacccatcaaaagtgagaagcccattaacatggaaaatttgcctgtgaacggcggcaacggacagtcattcggttatattctgtacgaaacttccatcacatcttctgggatcctttcaggccacgtacacgaccggggccaggtgttcgtcaacaccgttagcattgggttcctcgattacaagaccactaagatagctgtgcctctaatccagggttacacagttctgcgcatcctggtggaaaatcgggggcgagtgaattacggcgaaaacattgatgatcagagaaagggcctgattggcaatctgtatctgaacgactctcccttaaaaaacttccggatatattcactagacatgaagaagagctttttccagagatttggactcgataagtggagtagccttcctgaaaccccaacactaccagcattttttctcggatctctgtctatatcttcaacaccatgtgacacttttcttaagctggaaggctgggaaaagggtgtggtgttcatcaatgggcagaacctggggaggtactggaacatcgggccacagaagactctgtatttgcccggtccgtggttatcgtcaggtattaaccaggtcattgtcttcgaggagaccatggctggccccgcccttcaatttactgaaactcctcatctgggcaggaatcaatatattaaatag

SEQ ID NO: 9309 - DNA, 2037 bp, Artificial Sequence
  Description of Artificial Sequence: Synthetic coding sequence
atgcggaccgtggtgctgaccatgaaggccagcgtgatcgagatgttcttggtgctgcttgtgacaggtgttcattctaacaaggagacggccaaaaaaatcaagagaccgaagtttaccgtgcctcagatcaactgcgatgtcaaagctggaaagatcattgatcctgaatttattgtgaaatgtccggcaggctgccaggaccccaaataccacgtgtatggtacagacgtgtacgcgtcttattcctctgtgtgcggagccgctgttcattctggcgtgctagacaactctggtgggaagattctggttcggaaggttgccggacagtccggatacaaagggagctattctaatggtgttcagtccttgtccctgccccgttggcgagagtctttcatcgtccttgaatcgaaaccaaaaaagggcgtcacctacccttctgcccttacctactctagcagtaagtctcccgccgcccaagctggagaaaccacaaaggcataccagcgccccccgattcccgggaccaccgcgcagcctgtcaccctcatgcagcttctcgcagtgaccgtggccgtggccacccccaccaccctgccacggccgtccccatctgccgcctccactacatccatcccgcgacctcaatcagtgggtcatcgatcacaggaaatggatctgtggtcaacagctacctacacctcatctcagaaccgccctagggcagatcctgggatccaaaggcaagacccttcaggcgccgcatttcagaaacccgtgggtgccgatgtgtcactggggctggtgcctaaagaggagctcagtacacagtccctggaacctgtcagcctcggcgatcccaattgtaagattgacctctcattcctgatcgatggcagcaccagcattgggaaaaggcgattccgcattcagaagcagctgctcgctgacgtggcacaggcgttggacataggccccgcagggccactgatgggggtggtgcagtacggagacaacccggcgactcactttaaccttaagacccacaccaactcccgggatttgaagacagctatcgagaagatcacccagagggggggactttctaatgtgggccgtgccatttcgtttgtcactaagaatttcttttccaaggctaatgggaataggagcggcgctcccaatgtcgtcgtagtgatggtggatggttggcctacagacaaagtagaagaagcatctcggctggcccgagagtctggaattaacatttttttcatcacaatcgagggtgcagctgaaaatgagaagcagtatgtcgtggagcccaatttcgctaataaagccgtgtgcagaacgaacggtttctactctctgcacgtgcagtcttggttcggactgcacaagacactgcagccactggtaaaaagggtatgtgataccgatcggctagcttgttcaaagacttgtctcaattccgccgacatcggtttcgtgatcgacggatcttcgtctgtgggaacaggcaactttagaacagtgctgcagttcgtgaccaacctgaccaaggagtttgagattagcgacacagacacacgaatcggagcggttcaatatacgtacgaacagcggttggagttcggtttcgacaagtactcaagcaagcccgatattctaaatgccattaaacgcgtgggatattggagcggcggcactagtaccggcgctgctataaatttcgccttggagcagctgttcaaaaagtctaagcctaataaacggaaactgatgatcttgatcactgatggcaggagctacgatgatgtgagaattccagccatggccgcacacctcaaaggggtcatcacgtatgctataggtgtggcctgggccgcacaagaggagctagaagtaatcgcaacccatcctgctcgagatcatagcttcttcgttgatgagtttgataatctgcaccagtacgtgcctcgcattatacagaacatctgcaccgagtttaattcacagcccaggaattag

SEQ ID NO: 9310 - DNA, 324 bp, Artificial Sequence
  Description of Artificial Sequence: Synthetic coding sequence
tgaaccgtggccgcccccagcgtgttcatcttcccccccagcgacgaacagctgaaaagtgggaccgcaagtgtggtgtgtttactcaacaatttttacccccgcgaagctaaggtccagtggaaggtagataacgcattgcaaagcggaaattcccaagaaagcgtgacagaacaggatagtaaagattctacctatagccttagtagcactctgacactttctaaggccgactatgaaaagcataaagtatatgcctgtgaggtaacacatcagggcctctcctctcctgtcaccaaatcatttaatcgcggagaatgctag

SEQ ID NO: 9311 - DNA, 366 bp, Artificial Sequence
  Description of Artificial Sequence: Synthetic coding sequence
atggtgctgcagacccaggtgttcatcagcctgctgctgtggatctctggagcttacggggatatcgttatgactcagagtccagattccttagccgtatcgctgggagaacgggcgactatcaattgcaaatcttcccagagtgttctgtattcctccaacaacaaaaattatttagcctggtaccagcaaaaacccggccagcccccaaaactgctgatatactgggccagcactagggaaagcggagtgcctgatcggtttagtggctcaggctcagggacagacttcacccttactatatcatctctacaggcagaagacgtcgctgtttactattgtcagcaatactactccactccctag

SEQ ID NO: 9312 - DNA, 984 bp, Artificial Sequence
  Description of Artificial Sequence: Synthetic coding sequence
gccagcaccaagggccccagcgtgttccccctggccccctgcagccgcagcacttccgaatctacagccgctttgggttgcttggtgaaggattattttccagaacccgttaccgtttcttggaactccggcgccctgacaagtggcgtgcacacatttcctgcagtgctccagtcatctgggctttatagcctgtcatccgtggtaaccgtgccctcttcaagcctgggaacgaagacttacacgtgtaacgtcgatcacaaaccatctaatacaaaggtggacaagagggtagagagcaagtatggccctccttgtcctagctgccccgctccggagttcttgggaggccccagtgtattcctgttccctccaaaacccaaggataccctgatgatttctcggaccccagaagtaacttgtgtcgtggtggacgtttcgcaggaggatccagaagtgcagtttaactggtacgtcgatggagtcgaggtccacaacgctaagacaaagcctagagaagaacagttcaacagtacatacagagttgtatccgtgctgacggtcctgcaccaagattggctcaacggaaaagaatataaatgtaaggtgagtaacaaagggctaccatcgtctatagaaaagaccatatctaaagctaagggacagccacgggaaccccaagtgtacactctcccgccctcccaggaggagatgaccaagaaccaggttagtctcacctgtctcgtgaaaggcttctatccgtccgacattgccgtagagtgggaaagcaatggacagcccgaaaataactacaagaccactccacctgtattggattcagacgggagtttcttcctgtacagccggctgaccgtggacaagtctcggtggcaggagggaaacgtcttctcttgctccgtgatgcacgaagccctgcataaccactatacacaaaaatccctgagtctttctctgggaaagtag

SEQ ID NO: 9313 - DNA, 981 bp, Artificial Sequence
  Description of Artificial Sequence: Synthetic coding sequence
gccagcaccaagggccccagcgtgttccccctggccccctgcagcagaagcacatcagaaagcaccgccgcattgggctgcctcgtgaaggactatttccctgagcctgttaccgtgtcctggaactctggcgcactcacatcaggagtgcacacttttcccgcagtgctgcaatcaagcgggttgtactccctgagtagtgtcgtcacagtgcccagcagtaattttggaacgcagacctacacgtgcaatgtcgaccacaagccatccaacaccaaagtcgacaaaaccgtggaacggaaatgttgcgtggagtgtccaccgtgtcctgctccgcccgttgcagggccatccgtctttctgttcccccctaagccaaaggataccctgatgattagtagaacccccgaggtcacctgtgtcgtagttgatgttagccacgaagacccagaagttcagttcaactggtacgtcgatggagttgaggtccataatgccaaaaccaagccgagggaggagcagtttaattctactttccgtgtcgtgagcgtcctcacggtggtccatcaagactggctgaacggcaaggagtataagtgcaaggtctcaaataagggcctgcccgcacccatcgaaaaaactatcagtaagaccaagggccagccccgagaaccccaggtctacactctacccccgtcccgggaggagatgactaaaaatcaggtaagtctcacctgtctcgttaagggattctacccctctgatatcagtgtcgagtgggaatctaacggccagccggagaacaactacaaaacaacaccacccatgctcgactctgacgggtcattttttctgtactcaaagctcacggttgataaatccaggtggcagcagggtaacgtcttctcctgctcagtcatgcatgaagccctacataatcactatacccagaaatccctgagcctgtctccaggaaaatag

SEQ ID NO: 9314 - DNA, 993 bp, Artificial Sequence
  Description of Artificial Sequence: Synthetic coding sequence
gccagcaccaagggccccagcgtgttccccctggcccccagcagcaagagcactagcggcggcaccgccgcgttggggtgcttggtcaaggactatttcccagaaccggttaccgtgagttggaacagcggagcacttacttctggggtccacaccttccctgccgtcctccagtcaagcgggctatattcactgagctccgtggtaacggtgccctctagctcattgggaacgcagacctatatctgcaatgtgaatcacaaaccttctaacaccaaagtcgacaaaaaggtggagccaaaaagctgcgacaagacacacacttgccctccctgccccgcgccagagctcctgggcgggccttcagtctttctattccctccgaaaccgaaagacaccctcatgatcagccgaaccccagaggtaacgtgcgtggtagtagacgtctctcatgaagatccagaggtcaaattcaactggtatgtcgacggggtggaagtgcataacgccaagacaaaaccacgagaggagcagtacaattccacctaccgagttgtgtcagtgctgacagtgctccatcaggactggctgaacggcaaggagtacaagtgtaaagtcagcaacaaagctctgcctgctccaatcgagaagaccatatctaaagccaagggccaaccgcgcgaaccccaggtgtacacactccccccatcccgggacgaactgactaagaatcaggtgagcctcacttgcctggttaaggggttctacccttccgacatagcggtcgagtgggaatccaatggtcaacctgagaacaattacaaaacgacccccccagtgcttgattcggacggctcattctttttgtacagcaaactaacggtggataagtccagatggcagcagggcaatgtgtttagctgcagtgtgatgcatgaagccttgcataaccactatacgcagaagtcattgtcactgtcaccagggaaatag

SEQ ID NO: 9315 - DNA, 651 bp, Artificial Sequence
  Description of Artificial Sequence: Synthetic coding sequence
atgggcgccgtgatgggcaccttcagcagcctgcagaccaagcagcggcgcccttccaaagacaaaatcgaggacgaacttgaaatgactatggtctgtcatagacctgagggactcgaacagttagaggcccagaccaacttcaccaagcgggagctgcaagtgctgtaccggggttttaaaaatgagtgtcccagcggcgtagtaaatgaggatacctttaagcagatttatgcccagttttttccacacggagacgcctccacctacgctcattatctttttaacgccttcgataccacacagaccgggtcggtcaagttcgaggattttgtgactgcattatctatactcttgcggggcactgttcacgagaagctccggtggacctttaatctgtacgacatcaacaaggacggctatattaacaaggaggaaatgatggatatcgtgaaggcaatatacgatatgatggggaaatacacttatcctgttctgaaagaagacacccccagacagcatgtggacgtttttttccagaagatggataagaataaggatggaattgtgacgctggatgagttcttggagtcttgtcaagaagacgataatatcatgcgtagtctgcagctgtttcaaaatgtcatgtag

SEQ ID NO: 9316 - DNA, 762 bp, Artificial Sequence
  Description of Artificial Sequence: Synthetic coding sequence
atggcccggagcctgctgctgcccctgcagatcctgctgctgagcttagccctggaaaccgcaggcgaggaggcacagggcgataaaatcatcgatggtgccccgtgcgcacgaggctctcacccttggcaggtggctctcttgagcggtaaccagctacactgtgggggagtgctggtgaacgaacggtgggtcttgaccgctgcccactgcaaaatgaacgagtacaccgttcaccttggctcggatacactcggtgatagacgggcccagagaatcaaagcgagcaaatccttcaggcacccaggctactcaacgcagactcatgtgaacgacctgatgctggttaaacttaactctcaggcccgcctcagcagtatggttaagaaggttagactaccctcacgatgtgagccaccagggaccacatgcaccgtgtccggctggggaacaactacatcccctgacgtgacctttccatccgacctcatgtgcgtggatgtgaaactcatatctcctcaggattgcaccaaagtgtacaaagatcttctagagaactcgatgctttgcgcgggaattcccgattccaagaagaacgcatgtaacggagattctggagggcccctggtctgtcgcggaacacttcagggtttggtgagttggggtacatttccttgcggacagcccaacgatccaggagtttatacccaggtatgcaagttcactaagtggatcaatgacacaatgaaaaagcatcgatag

SEQ ID NO: 9317 - DNA, 468 bp, Artificial Sequence
  Description of Artificial Sequence: Synthetic coding sequence
atgttccagcggctgctgctgctgctgctgctgagcatgggcggcacatgggcctctaaggagcccctgcgcccgcggtgtagaccgatcaatgctacgctcgcggttgaaaaagagggctgtccagtgtgcatcacagtcaataccactatctgtgccggctattgccccacaatgacccgggttctgcaaggggtactccctgccctcccccaggtcgtgtgtaattacagagacgtgcgctttgagagcattaggctgccagggtgtcctcgaggcgttaatcccgtcgtttcctacgccgttgcactatcctgtcagtgtgccctatgccgcaggtctactacggattgtggcggtcctaaggaccaccctctgacatgtgatgacccacgtttccaggactccagcagttccaaggctccacccccctctctgccctcacccagccgattgcccgggccatag

SEQ ID NO: 9318 - DNA, 1554 bp, Artificial Sequence
  Description of Artificial Sequence: Synthetic coding sequence
atggccgtgagccggaaggactggagcgccctgagcagcctggccaggcagaggactcttgaggacgaagaggagcaggaacgcgaaagaaggagaaggcacaggaacctatcctcaacgactgacgacgaagccccacggctcagccaaaacggagaccggcaggcaagcgcatccgagcgactgccaagtgtcgaagaagctgaggtcccaaaacccctacctcccgcttccaaggacgaagatgaggatatccaatccatccttcgaacacgacaggaacggaggcagaggaggcaggtggtggaagctgcacaggccccaatccaggagagactcgaggcagaggagggccgcaactcactctcacctgtccaggccacacagaagcccctggtatcaaagaaggagctggagataccgcctcgccgacgattgtcaagagaacagagagggccttgggccctggaagaagaaagcctggtcggtcgcgagcctgaggagaggaagaagggagtacccgagaagagtcctgtgctagagaagtcgtccatgcccaagaagacggccccagaaaaaagcctggtgagcgacaagacctccatcagcgagaaagtgctggccagtgagaaaacctctctgtctgaaaaaatcgctgtctctgagaagaggaattcaagtgagaagaaaagcgtgctcgagaaaacttcagtgtcagaaaagtccctagcacccgggatggcactcggatccggccgacggcttgtgtccgaaaaggcgtccatattcgagaaagccctggcctctgagaagtctcccacggccgacgcaaagcctgcgccgaaaagggccaccgccagtgagcagcctcttgcccaggaacccccagccagcggtgggtctcccgcgacaaccaaggagcagagagggcgcgccctgccaggaaagaacctaccttctctggcgaagcagggcgccagcgatcctcccaccgtggcatccagactgcctcccgtgacactgcaggtgaaaatccccagtaaggaagaggaggcggatatgtccagccctactcagcggacttatagtagcagcctgaaacgatcttcgccacggacaatctcctttcgtatgaagcccaaaaaagagaatagcgagactacactaacacgcagtgcaagcatgaagttgcccgacaacaccgtgaagctgggtgagaagctcgaacgctaccatactgctatacgccgcagtgagagcgtgaaatcgcgaggccttccttgcaccgaactgttcgttgcccctgttggagtggcttccaaaagacatctgttcgaaaaagagctggccggccagagtcgcgccgaaccagcctcttctcggaaagagaatctacgcttgtcaggggtggttacttcccggctgaacctgtggatatcacgaactcaggaaagcggagaccaggacccgcaggaggctcaaaaggcatcaagcgctaccgaacgtacacaatggggtcagaaaagtgattcatcgctcgatgcagaagtttag

SEQ ID NO: 9319 - DNA, 270 bp, Artificial Sequence
  Description of Artificial Sequence: Synthetic coding sequence
atgcaggcctgcatggtgcccggcctggccctgtgcctgctgctgggaccactcgcaggggcgaaacccgtgcaagaggaaggcgacccatatgcagagttgcccgccatgccatactggccattctcaacttctgacttctggaattatgtccagcatttccaggccctgggcgcctacccccagatcgaggacatggcccggacttttttcgcacactttccattggggagtaccctgggctttcatgtgccgtaccaggaagactag

SEQ ID NO: 9320 - DNA, 1302 bp, Artificial Sequence
  Description of Artificial Sequence: Synthetic coding sequence
atgggcaacgcctgctgggagctgtactgcctggagcacggcatccagcccgatggccagatgccatctgataagaccatcggaggcggcgacgattcatttaccactttcttctgtgaaactggcgctggcaagcacgtgccaagggcggtcttcgtcgatctggaaccaacagtcattgacgagattagaaatggcccataccgtcagttgttccatcctgagcagctcatcactggcaaggaagatgcggctaataactacgctaggggacactacacgattggaaaagaaatcattgatccggtacttgatcggattaggaagttgagcgatcagtgcaccggccttcaggggttcctcgtgttccactctttcgggggcggcactgggagtggatttacgtctctgttgatggagaggctctccgtagactacgggaaaaagagtaagctcgagttttctatttaccccgctcctcaagtatccactgcagtggtagagccctacaatagcattctaacaacacacaccacactggaacactcagattgtgcttttatggtcgacaatgaagccatctacgatatctgtcggcgcaatctggatatcgaacgccctacttataccaatttgaataggctgattagtcagatcgtttcttccataacagcctccctcagatttgacggcgcccttaatgtggacctaactgagttccagacgaatctagtcccttatccccgcattcactttcctctcgcgacttacgccccagtgatcagtgctgaaaaggcataccacgagcagctcagcgtggctgagatcacaaacgcatgcttcgaaccggctaaccaaatggttaagtgtgaccctcggcacgggaaatacatggcatgctgtttgctgtatagaggcgatgtggtgccaaaagatgtgaacgccgcaatagctgcgataaaaaccaagagatccatccagttcgtggactggtgccccaccgggttcaaggtaggcatcaactaccagccccccacagttgtccccggcggagaccttgcgaaggtgcagcgggctgtgtgtatgctgtccaacactaccgccatcgcagaggcctgggcacgcctggaccacaagttcgacttgatgtatgccaaaagggcttttgtgcactggtatgtgggcgaggggatggaagagggagagttctctgaagctcgggaagacatggccgcacttgaaaaagactatgaggaggtaggtattgacagttacgaagatgaggacgaaggggaagagtag

SEQ ID NO: 9321 - DNA, 1965 bp, Artificial Sequence
  Description of Artificial Sequence: Synthetic coding sequence
atggcccccaagaagctgagctgcctgcggagcctgctgctgcccttatccctaactctcttgctgccgcaggccgatacaaggtctttcgtcgtggaccgcggacacgaccgtttcctgttggacggggctccattccgatatgtgagtggttccctacactacttcagagtgccccgggtcctatgggccgacagactgctgaaaatgagatggtccggactcaacgcaatccagttttacgtgccctggaactatcacgaacctcagccaggggtttacaactttaatggtagcagggatctgattgctttcctgaacgaagcagctctcgccaacctgttggtgatactgcgtccagggccttacatttgcgccgagtgggaaatggggggcctcccttcttggctgctcaggaagccagagatccatttgcgcacgtccgatccagattttctcgccgcagtggattcctggttcaaagtgttacttcccaagatttatccatggctgtaccataatggcggaaacataatttctattcaggtcgagaacgaatatggctcctatcgtgcttgcgatttctcttatatgaggcatctcgctggcctgtttagggcattgctaggtgaaaagatactgttgtttactacagacggccctgagggcctcaaatgcggttcactgcgcgggctgtatacaaccgtggacttcggacctgccgacaatatgaccaaaatatttaccctcctccggaagtacgagcctcacggacccctggtgaacagcgaatactacactggttggctggactactggggacagaaccatagtacccgctcagtctccgctgtgaccaagggcctagaaaatatgctgaagctaggggcatcagtgaacatgtacatgtttcatggcgggaccaactttggctactggaacggagctgacaaaaagggcaggttcctgcccattactacatcatatgattatgacgcacctatctctgaagcgggcgaccctacacccaaattgtttgccctacgagatgtcatcagcaagttccaggaggttcccctcgggccacttccgcctccttctcccaagatgatgctcggaccggtcactctgcacctggtggggcacttgttggcattccttgaccttctttgtccgcgtggccccattcactccattctcccgatgacatttgaggctgtcaaacaggaccatggtttcatgctgtatagaacttacatgacccacactatctttgaaccaactcctttctgggtcccgaacaacggcgtgcacgacagggcttatgttatggtcgacggagtgttccagggggtggtagaaaggaacatgagagataagttattcctcaccggaaaattggggagcaagcttgacattttagtcgaaaatatggggcggctgtcctttggcagcaattctagtgactttaaaggcctgctgaagcctcctatccttggccagacgatcctgactcagtggatgatgttcccacttaagattgacaatctggtaaaatggtggttccctctacagttgcctaagtggccttatccacaagccccgagtggtcctaccttctacagcaaaaccttcccaatcctcggatccgttggcgatactttcctgtacttgccagggtggaccaagggacaggtgtggatcaacggatttaaccttggaagatattggacgaagcagggcccccagcaaacgctgtacgtgccacgttttctattattccctcggggagccctcaacaagatcacactgcttgaactggaagatgtgcccttacagccccaagtacagttcctcgataaaccaatcctaaattctacatcaacccttcataggacacacataaacagcctgtcagcggacacactatctgcctccgaacccatggagctatccggacactag

SEQ ID NO: 9322 - DNA, 1173 bp, Artificial Sequence
  Description of Artificial Sequence: Synthetic coding sequence
atgaagttccagggccccctggcctgcctgctgctggccctgtgcttaggatccggcgaggcaggaccactacaatccggtgaagagtctacaggaacaaatatcggggaggcgctcgggcatggtctgggcgacgctctctccgagggggtgggaaaagccatagggaaagaggccggcggtgcagcaggaagtaaagtgagcgaggccctggggcagggcacacgggaggctgtcggcaccggagtgagacaagtcccaggctttggcgtcgcggacgcgcttggcaatagggtgggagaagccgctcacgctctgggtaatactggtcacgaaatcggaaggcaggccgaagacgtcatacgacatggggctgacgccgtgcgcggtagctggcagggagtgcctggccacaacggtgcctgggagacatccggcggccacggaatctttggctcgcagggaggattgggaggccagggtcaggggaaccctggaggactagggaccccctgggtgcacgggtaccccgggaatagcgctggatcatttgggatgaaccctcagggcgctccctggggccaaggtggtaatggcggaccacccaattttggcaccaacacacagggcgccgtcgctcagccagggtacggcagcgtgcgggcaagcaatcagaacgagggctgcacgaatccaccaccctccggctctgggggtggaagcagcaacagcggcggtgggtctggatcacagtcgggctcgtccgggtctggtagtaatggcgataataacaatggatcctcaagcggtggcagtagtagcggatcatcaagcggcgggtctagcggaggatcgtcgggagggtcctcaggaaactcaggcggctcaaggggagactcgggcagcgagtcctcttgggggtcatcgaccgggtctagtagcggcaatcatggcggcagcgggggaggaaacggccacaagcccggttgcgagaaaccgggcaacgaagctcgcggatctggcgaaagtggaattcagggcttcagggggcagggagttagcagcaatatgcgcaacagcgaaactagcccgggcatgttcaatttcgacactttctggaaaaattttaaaagcaaactcgggtttatcaattgggatgcaatcaacaaatag

SEQ ID NO: 9323 - DNA, 846 bp, Artificial Sequence
  Description of Artificial Sequence: Synthetic coding sequence
atgggcagccggggccagggcctgctgctggcctactgcctgctgctcgcctttgcaagtggactcgtgctcagccgggtgcctcacgtgcagggtgagcagcaagaatgggaaggcactgaggagctgcccagtcctcctgatcatgccgaacgtgcagaggaacagcatgaaaagtaccgcccatcacaggatcaaggtttgcccgctagcagatgcctcaggtgttgcgatcctggtacaagtatgtacccggccactgccgtcccacagataaacataacaatactgaaaggtgagaagggggacaggggggaccgtgggctgcaggggaaatatggcaagactgggtccgctggtgctaggggacacaccggccccaaagggcagaaggggtcaatgggtgcccccggtgagcgttgcaagagtcattatgccgcgttctcggttgggcgtaaaaaacctatgcattctaatcattattaccagacagtcatcttcgatacagaatttgtgaacctctatgatcatttcaatatgttcaccggaaaattctactgctatgtccccggcttgtattttttcagtctgaatgtgcatacctggaatcagaaagaaacatacctccacatcatgaaaaacgaagaggaagtggtaattcttttcgcccaggtgggagatcgtagcatcatgcagagtcagtccctgatgctcgaacttagagagcaggatcaggtgtgggttcgtttatataagggagagcgagaaaacgcaatcttttcagaagaattggatacctacatcacattcagcgggtaccttgttaagcacgctactgagccctag

SEQ ID NO: 9324 - DNA, 876 bp, Artificial Sequence
  Description of Artificial Sequence: Synthetic coding sequence
gtgctgagcgccagcggccccggccggaagatgggcagccggggccaaggcctgctgctcgcctactgcctgcttcttgccttcgcatccggcctagtgctatctcgggtcccgcacgtgcagggggagcagcaggaatgggaaggaacagaggagctccctagccccccagaccatgccgaacgcgccgaagaacagcacgaaaagtataggcccagccaagatcaggggttgcccgcatcccggtgccttcgctgttgtgatcctgggacgagtatgtatcctgccaccgctgtcccccagataaacataaccatcttgaagggagagaagggcgataggggcgatagaggcctacaggggaaatacggaaaaactgggagcgctggcgctcggggacacactggcccaaaaggacaaaaagggagtatgggcgccccgggcgagcgttgtaaaagccactacgccgctttctctgtgggaagaaagaagcctatgcacagtaatcactattaccagacagtgatattcgatacagagttcgtaaacctctacgaccatttcaacatgttcacgggaaagttctattgttatgtgcccggcctctacttcttctcactgaacgtccacacatggaatcagaaggaaacttatctccacatcatgaagaacgaggaggaggtcgtcatcctgtttgctcaggttggcgatcgatcaatcatgcagagccagtctctcatgcttgagcttcgtgagcaggaccaggtctgggttcgactgtacaagggagaacgtgaaaacgcaatcttttcagaagaacttgatacctatatcacgttcagcggatatctagtgaaacacgctaccgagccctag

SEQ ID NO: 9325 - DNA, 1002 bp, Artificial Sequence
  Description of Artificial Sequence: Synthetic coding sequence
atggtgagcaagagccggtggaagctgctggccatgctggccctggtgctggtcgtaatggtttggtattctatcagtcgggaggacagatacatcgaactgttctacttccccatccccgaaaagaaagagccctgtctccagggggaagccgagagcaaagcatcaaagctcttcggcaattattctcgagaccaaccaatcttcctccgcctcgaggactacttctgggttaaaactccttctgcgtacgagcttccttacgggactaagggctcagaagatctgctgcttcgcgtgctggcaattacttcatcttctataccaaagaacatccagtctctgagatgcaggcggtgcgttgtcgtggggaacgggcacaggctccgcaattcctccttaggcgacgcgatcaacaagtacgacgtggtgattcgcctcaataacgccccagttgcaggctacgaaggagatgtgggatctaaaacaaccatgagactgttctacccagaatctgcccactttgatccaaaagtggagaataaccctgacaccttgttggtgctggtggcatttaaggcaatggacttccactggatagaaacaatcctctctgataagaaaagagtgcgaaagggcttttggaagcagccaccactcatctgggatgttaacccaaaacaaatccgcatcctgaatcctttcttcatggagattgcggcagataaactgttaagtcttccaatgcagcaacctagaaagatcaaacagaagcctaccacagggctgttggccatcacactggcgcttcatctgtgtgacctggtgcatattgccggtttcgggtacccagatgcctacaacaagaagcagactatccactactatgaacagatcaccctcaagtccatggcgggttcgggacacaacgttagccaagaggccctcgccattaagaggatgctggagatgggcgcgattaagaaccttacaagtttctag

SEQ ID NO: 9326 - DNA, 312 bp, Artificial Sequence
  Description of Artificial Sequence: Synthetic coding sequence
atgagcggccggggcaagggcggcaagggcctgggcaagggcggcgcaaaacgccaccgcaaggtcctcagggataacatccaggggattaccaagccagctatcaggcgcctggcacgcagaggaggtgtgaagaggatctccggactgatctacgaagagactcggggagtccttaaggttttcctggaaaacgtgatcagggacgcagtgacatataccgagcacgcgaaacgtaaaacagtgaccgcaatggatgtggtgtacgcgctgaaacggcaggggagaactttgtacggtttcggcggatag

SEQ ID NO: 9327 - DNA, 312 bp, Artificial Sequence
  Description of Artificial Sequence: Synthetic coding sequence
atgagcggccggggcaagggcggcaagggcctgggcaagggcggcgccaagcgtcacagaaaggtgctgcgggacaacatccagggcataacaaaaccagccatccgacgtctggcacggcgcggaggcgtcaagcggatcagcggcttaatttatgaggagaccaggggcgtgcttaaagtgtttctcgagaatgtgattagagacgcagttacctacacagagcacgccaagcgaaagaccgtcacagccatggatgtggtgtacgccttgaagagacagggtcgaactttatatggcttcgggggatag

SEQ ID NO: 9328 - DNA, 312 bp, Artificial Sequence
  Description of Artificial Sequence: Synthetic coding sequence
atgagcggccggggcaagggcggcaagggcctgggcaagggcggcgcaaagcgccatcgcaaggtgctacgcgataatatccaagggattactaagcccgccatcaggcgcctcgctcggcgagggggcgtgaaacgcatctcagggctcatatatgaagagacgcgcggggttctaaaagttttcttagaaaacgttattagagacgccgtgacatatacagagcatgcaaaaaggaagacagttacagccatggatgtcgtatacgctctaaaacggcaggggcgtacactgtatggttttggcggatag

SEQ ID NO: 9329 - DNA, 312 bp, Artificial Sequence
  Description of Artificial Sequence: Synthetic coding sequence
atgagcggccggggcaagggcggcaagggcctgggcaagggcggcgccaaacgccaccggaaggtgctaagagataacatccaggggattactaagcccgctatcagaaggctggccagacgaggcggggttaaacggatctctggcctgatctatgaagaaactcggggcgtgctgaaggtgtttctggaaaacgtcattcgcgacgcggttacttacacagagcatgccaagcgaaagacagtgacagccatggacgtggtttacgcattaaaacgtcaaggcagaacgttatatggttttgggggatag

SEQ ID NO: 9330 - DNA, 2268 bp, Artificial Sequence
  Description of Artificial Sequence: Synthetic coding sequence
atgccccccttcctgctgctggaggccgtgtgcgtgttcctgttctctagagtgccaccttcactgcccctccaggaagttcacgtgagtaaagagactattggcaagataagtgctgcctctaagatgatgtggtgcagcgccgctgtggacattatgttcctgcttgatggctcaaattccgtcggtaaaggttcatttgaaaggagcaaacactttgcaataacagtgtgtgacggactagacatctcgcccgaaagagttagggtcggggccttccagttttcctccactcctcacctggaatttcctctggacagcttcagcacacaacaggaggtcaaggcccgtattaagcggatggtgtttaagggcggacgaactgaaaccgagctcgccctgaagtacctgttacacaggggcctgcccggtggaaggaatgcttctgtgccccagattctgatcatcgtgaccgacggaaagtcccagggagacgtcgctttaccctccaagcagctgaaagaacgcggcgtcaccgtgttcgcagttggggtgcgctttcccaggtgggaggagctgcacgccttggcgagcgaaccccggggacagcacgttctgctggctgaacaggtggaggacgcaaccaacggccttttcagtaccctgagcagttccgccatatgctcctccgccacacctgactgcagagtagaggcacatccatgtgaacatcgcacccttgagatggtgcgcgagtttgccggaaatgccccgtgctggcgagggtcccgtaggaccctcgcagtcttagccgctcactgcccattttactcttggaagcgtgtgtttttgactcaccctgcaacatgttacagaaccacgtgcccaggcccttgtgatagccagccctgccagaacggaggcacctgtgtgccggagggcctggacggctaccaatgcttatgccccctggctttcggaggggaagcgaattgcgcccttaaactgtccctcgagtgcagagtggacctactcttcctcctagattcttcggccggcacaacattagatgggtttctgagagccaaagtatttgtgaaacggttcgtgcgcgctgtcctgtcagaagactccagagccagagtgggggtagccacgtatagccgcgaactcctggtggcagtgcccgtgggcgagtaccaggatgtgccagatcttgtgtggtctctggacggcatcccattccggggtgggccgactctgactggctccgcgttgcgccaggcagccgagaggggattcggctccgccactagaactgggcaagataggccccgcagggtagtcgttctgctaactgagagtcatagtgaggatgaagtggcagggccggcacgccatgccagggccagggagctcttgcttctgggtgtcgggtctgaggccgtgcgggccgaactcgaggagatcaccggttcgcctaagcatgtcatggtgtatagtgacccccaagacctttttaatcagatacccgagctgcaaggtaaactatgcagcagacagcgaccgggatgtagaacgcaggcccttgatctagtgttcatgctcgacacatctgcttccgtgggaccggagaacttcgcccagatgcagtcttttgttcgcagctgcgccctgcaattcgaagtcaaccctgacgtcacacaagtaggactagttgtctacggctcacaggttcagaccgcattcggcctcgatactaaaccaactcgggccgcgatgttgagggccatcagccaggcaccgtacctgggaggggtgggctccgcagggaccgccctgctacacatctacgacaaagtgatgaccgtacagcggggggctcgcccaggcgtgcctaaggccgtcgtcgtgctgacaggagggcgaggggccgaagacgcagcagtccccgcgcagaagctccggaataatggtatctcggtgctggttgtgggagtgggccctgtgctgtccgagggcttgagacgcttagcaggccctagggattccctgattcacgtggctgcgtatgccgatcttcgataccatcaggatgtactcatcgaatggctctgcggtgaggctaagcagccagttaatctttgtaagccctctccttgtatgaatgaagggagttgtgtattgcagaacggcagctaccgatgtaaatgccgtgacggctgggaaggcccccactgcgaaaatcgctttctccggcggccgtag

SEQ ID NO: 9331 - DNA, 816 bp, Artificial Sequence
  Description of Artificial Sequence: Synthetic coding sequence
atgatcaccggcgtgttcagcatgcggctgtggacccccgtgggcgtcctcacttccctggcatattgccttcaccagaggcgtgtagcccttgctgaactacaggaagccgacggccagtgccctgtcgatcgttcattgctgaaactgaaaatggtacaggtagtgtttcgtcacggagctagatctcccctcaagcctctacccttggaagaacaggtggaatggaaccctcagctgttggaagttccaccccagacccagtttgactatactgtaacgaacctggccgggggaccgaagccttactcaccctatgacagccaatatcacgagactaccctaaagggcggcatgtttgccggtcagctgaccaaagtcgggatgcagcagatgttcgcccttggtgaacgtctgaggaagaactatgtagaggatattcccttcttgagtccaactttcaacccccaggaagtttttattcgcagcaccaacattttcaggaacctcgaatccactagatgtctgctggctggtctgttccagtgtcagaaagaaggcccaatcataatccacacagacgaggcagacagcgaggtgttgtacccaaattaccagagctgttggtccctcaggcagcgaacacgggggagaagacaaacagcctccttacagcccgggatctccgaggatttaaagaaggttaaagacagaatgggcatcgactcctctgacaaggtagatttcttcattctgttggacaatgttgccgccgaacaagagaagatgggctcatgtaggttccacggttcatag

SEQ ID NO: 9332 - DNA, 1395 bp, Artificial Sequence
  Description of Artificial Sequence: Synthetic coding sequence
atggagcacagcgtgtgccccagcagcgccgtgcacctgatccccgtatctacccccaagaatggtatgtcctcaaaatcacggaaacggatcatgcctgatcctgtcaccgaacccccagtcactgaccccgtttatgaagccttgttatattgtaacatcccatccgtggccgaacgttccatggagggacatgcccctcatcatttcaagttggtctctgtgcacgtgttcattcgacacggcgaccgctatccactgtatgtcataccgaagactaaacgaccagaaattgattgcacactcgtagctaacagaaaaccataccaccctaaactcgaggcctttatttcacacatgtccaagggatccggcgcttccttcgagagtcccttaaatagcttgccgctgtacccaaatcaccctctctgcgagatgggggagctgacacagacaggcgtagttcagcacctgcaaaacgggcagctgctccgggatatctacttgaagaagcataaattactgccgaacgattggagtgcagatcagctgtatctcgagaccacagggaagtcacggacattacaatctgggttagctctactgtatgggttcctcccggattttgattggaaaaagatctactttcgccaccaaccgagcgcacttttctgttctggtagttgttactgccccgtgcggaaccagtatctcgagaaggaacaaaggcggcagtacctgctcagactgaagaatagtcagcttgaaaagacttacggagagatggccaagatcgtcgacgtccctacaaagcaactgagggccgcaaatccaatcgatagcatgctttgccacttctgccataacgtctcctttccatgcacgaggaacggctgcgtggacatggaacacttcaaggtgattaagactcatcagattgaggatgagagagagcgaagagaaaagaagttgtactttggttacagcctactgggggcccatccgatcctgaatcagactatagggcgcatgcaaagggctacagaggggcggaaggaggagctgttcgcactctactctgcgcatgacgtgactttgtcccctgtcctgtctgctctggggctgtccgaagcacggtttccacgctttgcagcccgtctgatttttgaactctggcaggacagggagaaaccatcagaacattcggttagaattctctataacggcgttgacgtgacttttcatacatcattctgccaggatcaccataagcgcagtcctaaaccgatgtgtcccttggagaatctggtgcgcttcgttaagcgcgatatgtttgtggccctgggcggcagcggtaccaattactatgacgcatgtcaccgggaaggcttctag

SEQ ID NO: 9333 - DNA, 1443 bp, Artificial Sequence
  Description of Artificial Sequence: Synthetic coding sequence
atgctgttccggaaccggttcctgctgctgctggccctggccgccctcctggcatttgtatccttatccctccaattttttcacctcattccggtgtcaacacccaagaatggcatgagtagcaagtctcgtaaaagaattatgcccgaccctgtgaccgaaccccctgtcacagaccctgtatacgaagccctgttgtactgtaacattcctagcgtggctgagagaagcatggagggccatgcgccccaccacttcaagctggtctccgtgcatgtcttcatcagacatggagacaggtatcctctgtatgttatccctaaaactaagagaccagagatcgactgcaccctggtggccaatagaaagccttatcaccccaagcttgaagcctttatttcccacatgtcaaagggctccggggcctcctttgaaagtcccctgaacagtttgcctctttaccctaaccaccccctttgtgaaatgggcgagctaacacagaccggggtggtacagcacctccagaatggccagctgctgagagacatctaccttaagaagcataagctgctgccaaatgattggtctgccgaccagttgtatttggagactacaggaaagtcccgcacacttcagagtgggcttgccctactgtacggattcttgcctgacttcgattggaagaaaatctactttaggcaccagccatccgccttgttttgttcaggcagttgctactgtccagttaggaatcaatacttagagaaggaacaacggcggcagtacctccttaggctaaagaattcgcaactggaaaaaacttacggggagatggcaaagattgtagatgtaccaactaagcagttgcgggccgcaaacccaatagattccatgctctgccacttctgtcacaacgtgtcctttccctgcactcggaatgggtgcgtggacatggagcacttcaaagtcattaagacccatcaaatcgaagacgagcgagaaagacgagagaagaaattgtattttggctactcccttttaggcgctcaccctatcctgaatcagacaattgggagaatgcagagagctacggagggcagaaaggaagagctgttcgcattgtactccgctcacgatgtcactttgtcacctgtactgtccgctttgggcctgagcgaggcccgattcccgcgtttcgccgcaaggctgattttcgaactatggcaggacagagagaagcccagtgaacattccgttcgcatattgtataatggcgtagatgttactttccatacgtcattctgccaggaccatcacaagaggagtccaaaacccatgtgccccctggaaaacctggtgaggttcgtgaaacgggacatgttcgtcgccctaggggggagcggtactaactactacgacgcttgccacagggagggcttttag

SEQ ID NO: 9334 - DNA, 1311 bp, Artificial Sequence
  Description of Artificial Sequence: Synthetic coding sequence
atgcagggcacccccggcggcggcacccggcccggccccagccccgtcgacagacgcactctcttggtgttctcattcatcttggccgccgcactgggccagatgaacttcacgggggaccaggttcttcgtgtgttggccaaggatgagaagcagctgtctctcctgggcgacttggagggactgaagccgcagaaggtagatttttggcgggggcccgctcgtcccagcctacccgtcgatatgagagtgcccttttccgagctgaaggacattaaagcgtacttggaaagccacggactggcgtattccattatgataaaggacatccaggtcctgctggatgaagagcgtcaggcgatggccaaaagccggcggctggaaaggtcaacaaacagtttctcttactcttcatatcatactctggaagaaatttattcatggatagataacttcgtaatggaacactccgacattgtcagcaaaattcaaatcgggaattctttcgagaatcaaagtatcctagtgctgaaattttctacggggggttctcgtcaccccgccatctggattgacacaggcatacacagtagggaatggataactcatgctaccggcatctggacagccaacaagatagttagtgattacggtaaggatagagtgttgacagacatcctgaacgctatggacatttttattgaattggtgactaatcctgatggatttgcatttacccactccatgaatcggctgtggcgaaagaataagagtattaggccggggatattttgtatcggtgtggatttaaacagaaactggaagtcgggattcggaggaaacggaagcaacagtaacccctgctctgagacatatcatggcccaagccctcagagtgagcctgaagtggccgccatcgtaaatttcattacagctcacgggaatttcaaggccctcattagcatacactcttatagccagatgctgatgtatccctatggtcggctcctagagccagtgtccaaccagagggaactgtacgatctggctaaagatgctgtggaagcactatacaaggttcatggaatcgagtatattttcggaagtatatctaccacactgtatgtcgcttcaggtattaccgtggactgggcttacgattctggtatcaagtacgccttttctttcgagctccgggacactgggcagtatggctttttgctgcctgccacccagattattcccaccgcccaggaaacctggatggcacttcggaccattatggagcacaccttaaatcatccatactag

SEQ ID NO: 9335 - DNA, 1161 bp, Artificial Sequence
  Description of Artificial Sequence: Synthetic coding sequence
atggcccagtggcactgcagccagcggacccaggccggcggccacggcgttggtgagcgtctcgcgcaatgtcaggaccagtcgtccagacacgcagcagaattgcgtgactttaaaaacaaaatgctgcctctgctggaggtggcagagaaagaaagagaggcactccggacggaggcagacaccattagtggacgggtggaccggttggagagagaagttgattacctggagacacagaacccggctctcccttgtgtggagttcgatgaaaaggttacgggtgggcccggaactaagggcaaggggcgcagaaacgaaaaatatgacatggtcaccgattgtggctacaccatttcacaggttcggagcatgaaaattctcaaacgctttggcgggccagcaggtttgtggactaaggaccctctgggtcagacagaaaagatctacgtgctggatggcactcagaatgacacagcctttgttttcccccggctgagagacttcacactggcaatggcagcccgcaaagctagcagggtacgggtaccattcccatgggttggaaccggacagctggtatatggagggttcctgtactttgcaaggaggccacccggcagacccggcggtggtggcgaaatggaaaacacacttcagctcataaaatttcacctggccaatcgaacggtcgtcgattctagtgtcttccctgctgagggactaatccctccctacggactgactgccgatacatacatcgatctggcggccgatgaagagggcctgtgggccgtgtatgccacccgcgaagacgacaggcacctgtgcttagctaaactagacccccagaccctggatactgagcagcagtgggacacaccttgcccccgggagaatgctgaagcagcattcgtaatttgtgggactctctacgtcgtgtacaatacccgcccagcatctagggcccggatccagtgctcctttgatgcctccggaactctcacaccagaacgggccgctcttccctattttcctaggaggtacggcgctcatgcaagcttacgctacaacccacgcgaacgccagctgtacgcctgggatgacggttaccaaattgtgtacaagctggagatgcgcaagaaggaggaggaggtgtag

SEQ ID NO: 9336 - DNA, 990 bp, Artificial Sequence
  Description of Artificial Sequence: Synthetic coding sequence
atgcggcccccccccgccctggccctggccggcctgtgcctgctggccctgccggctgcggcagcctcttattttggcctcacaggacgagaagtactgactccgttccccgggctaggtaccgctgctgcacctgctcagggcggggcacacctcaagcagtgcgaccttttaaagctttcacgtaggcagaagcagttgtgcagacgcgaacctggcctggcagagaccttgagagatgcagcgcacttagggttactggaatgtcaatttcagtttcgacatgagcgatggaactgctccctggaagggcgaatgggcctcctgaaaagagggttcaaagagaccgcatttctctacgccgtgagcagcgcagctctaactcacacactagctagggcatgttctgctggacgaatggaacggtgcacatgcgacgacagcccaggactcgaatcacgtcaggcctggcagtggggcgtgtgcggggacaacctcaagtactctacaaagttcctgagtaatttcttggggtctaagagaggtaacaaggacttaagggcacgtgcggacgctcataatacacacgtgggcattaaggccgtgaagtcaggactgagaacaacttgcaaatgtcacggcgtgagtggctcgtgcgctgtgcgaacatgctggaagcagctatcccccttccgagagacgggccaagtcctgaaactgaggtatgattcggcagtcaaggtgagcagtgcgactaatgaagcacttggtcggcttgaactctgggctcctgcccggcaggggagcctcacgaagggattagctcccagatcaggggacctcgtatatatggaggacagtccatcgttttgcagaccttcaaagtacagcccaggcaccgcaggctggagcgcagtcgcgaggtcacagctgatcaccacatctacctctagaattcaggcgatcctccctagccagctgcctgaatag

SEQ ID NO: 9337 - DNA, 579 bp, Artificial Sequence
  Description of Artificial Sequence: Synthetic coding sequence
atgcggctggccggccccgagagcagcgtgaccgccgccccccgggctaggaagtataagtgcggtttgccacagccatgtccagaagaacacctggcttttagagtcgtgagcggagctgcaaacgtgatcgggccgaaaatctgtctggaggataagatgctgatgtcctctgtaaaggataacgtgggaagggggctaaatattgctctcgtcaacggggtaagtggcgaactgatcgaggcccgagcgtttgatatgtgggctggggacgttaatgacctccttaagtttattcggcccctacacgaaggtacacttgtcttcgtggcttcatatgatgatccagccaccaagatgaatgaggaaacaaggaaactgttttctgaactcggaagccgtaacgcaaaggagttggcatttcgtgattcgtgggtgtttgttggggccaaaggagtgcagaataaatccccatttgagcagcatgtcaagaacagtaagcattctaataaatacgaaggatggcccgaggcactcgaaatggaaggatgtatcccccgacgttccactgcatcatag

SEQ ID NO: 9338 - DNA, 1053 bp, Artificial Sequence
  Description of Artificial Sequence: Synthetic coding sequence
atgaagtgcagcctgcgggtgtggttcctgagcgtggccttcctgctggttttcataatgtcgctgctttttacctattctcaccattccatggccaccttgccatatctggattcaggtgcactggacggtacacatcgggtcaaactggtccctgggtacgctggcctgcagcgcttatctaaggagcgccttagcggcaagtcctgcgcatgtagaagatgcatgggagacgcaggggcttctgattggtttgactcccactttgatggaaatatttcacctgtgtggactagggaaaacatggacctaccccccgatgtccaacgatggtggatgatgttgcagccacagttcaagtcacacaacacaaatgaggtcctcgagaaactcttccaaatagttcctggagaaaacccctacaggtttcgagatcctcaccagtgtaggcggtgcgccgtggtaggcaactccggaaacttgcggggatcaggatacggccaagacgttgatggacataacttcatcatgcgaatgaaccaggctcccaccgtcgggttcgaacaggacgtgggaagtcgaacaacgcaccatttcatgtatccagaatcggctaaaaacctgcccgccaacgtcagcttcgtgctggtgccctttaaggtcctagatctcttgtggatcgcttctgccctttccactggtcagatccgattcacttacgccccggttaagagctttttaagagttgacaaagaaaaagtccagatatataatcccgccttttttaaatacatccatgacaggtggaccgaacaccatggccgatacccaagtaccggtatgctggtactttttttcgccctgcacgtatgtgacgaagtgaacgtttacgggtttggtgcagactccaggggcaattggcatcattactgggaaaataaccggtatgctggtgagtttaggaaaaccggcgtgcacgatgccgatttcgaggcccacatcatagatatgctggcaaaagcgtcaaaaatagaagtgtacagaggtaactag

SEQ ID NO: 9339 - DNA, 189 bp, Artificial Sequence
  Description of Artificial Sequence: Synthetic coding sequence
atgaagatccagctgttcttcttcatcctgcacttctgggtgaccatcttacctgcccgaagtaatttcgagcctaagtaccgcttcgaaaggtgtgaaaaggttcgcggtatatgcaagactttttgcgatgacgttgaatatgattatggctactgtatcaagtggagaagtcaatgttgtgtatag

SEQ ID NO: 9340 - DNA, 738 bp, Artificial Sequence
  Description of Artificial Sequence: Synthetic coding sequence
atgaccctgttccccgtgctgctgttcctggtggccggcctgctgcctagcttccccgccaacgaagacaaggacccagctttcacagctctattgacgacacagacacaagtgcaacgtgaaatcgtcaataagcacaatgaactgcgcagagcagtctcgcccccagctagaaacatgctgaaaatggaatggaataaggaggccgctgccaatgctcagaaatgggctaatcagtgtaactatagacactctaaccctaaggacaggatgacctcgctgaagtgtggggaaaacctttacatgagcagtgcttcctcatcttggtcccaggccatccagtcctggttcgacgagtacaacgacttcgattttggcgttggcccaaaaacccctaacgccgtggtaggccactacactcaggtggtttggtattcatcatacctggtggggtgtggaaatgcctactgtcctaatcagaaagtattaaaatactactacgtctgccagtactgccctgcaggcaattgggctaaccggctgtacgtaccttacgagcaaggggccccttgcgcatcttgcccagataactgtgacgatggcctctgtaccaacggctgtaagtacgaggacctgtactccaactgtaaaagcctgaagctgacactgacatgcaagcatcagctcgtacgtgactcatgtaaggcatcgtgcaactgctctaattccatatattag

SEQ ID NO: 9341 - DNA, 1341 bp, Artificial Sequence
  Description of Artificial Sequence: Synthetic coding sequence
atgctgcaccccgagaccagccccggccggggccacctgctggccgtgctgctggcactcttgggcaccgcatgggccgaggtttggccacctcaactgcaggagcaagcccctatggccggagccctgaatagaaaggagtccttcctgctgttgagtcttcacaatagactcagatcctgggtgcagccacccgccgcagacatgcggcggcttgactggtctgactctctagcgcagttagctcaggcgagagcagctttgtgcggtacccccaccccatcactggcatccggactgtggaggaccttgcaggttggctggaatatgcagttactgcctgccggactcgtgtcattcgtagaggttgtgagtttgtggtttgctgaaggacagcggtacagccacgccgcaggagaatgcgctaggaatgccacttgcacacactatacccagctggtttgggccacctcttcccagctgggctgcgggagacacctgtgctcggcaggccaagcagcaattgaagcgtttgtgtgcgcgtacagtcctaggggtaactgggaagtgaatggaaaaactatcgtcccctataagaaaggtgcctggtgttccttgtgtaccgctagtgtgtctggctgtttcaaagcttgggatcatgcaggcggtctgtgcgaagtgcctagaaacccctgccgtatgtcatgccagaaccacggaagacttaatattagcacatgtcactgtcactgccctcccggttatacgggtcgatactgtcaggtaagatgttcattgcagtgcgtgcacgggcgttttagggaggaggagtgttcatgtgtgtgtgacatcggctacgggggcgctcagtgtgctactaaagtgcactttcccttccacacgtgtgatttacgtattgacggagattgcttcatggtgagtagcgaggccgacacatattaccgcgctaggatgaaatgccagagaaaaggtggcgttctggcccagatcaagagccaaaaggtacaggatattctggcgttttatctagggcggctggagacaactaacgaggtcatagactctgattttgaaacacgcaacttctggataggcctgacttacaagaccgccaaagactcttttcgctgggcaaccggcgaacaccaggcattcacgtccttcgcttttgggcagccggacaatcacgggtttggcaattgcgtggaacttcaggcctcagcagcctttaactggaacgatcagagatgcaagactaggaacaggtacatttgccaattcgctcaggaacatataagtcgatggggacctggctcttag

SEQ ID NO: 9342 - DNA, 585 bp, Artificial Sequence
  Description of Artificial Sequence: Synthetic coding sequence
atgaccatgcggcacaactggacccccgacctgagccccctgtgggtgctgctgctctgtgcccacgtggtgacattattggtgcgcgccaccccggtatctcagaccaccactgcggccaccgcgagcgtccggagcaccaaagatccatgcccctcacagcctcctgtgtttccagctgcaaagcagtgcccagccctcgaggtgacatggcccgaagttgaagtgcccctgaatgggacactatcacttagttgcgtcgcttgttctcggtttccaaatttctccatcctttattggcttgggaacggttccttcattgaacacttaccagggcggctctgggagggatctacgagtcgcgagcggggcagcactggaacccaactctgcaaggcactggtgcttgagcagcttactccagctctccatagcacaaacttttcttgtgtactggtggatccagaacaagtggttcagcggcacgtcgtgctggcacagctttgggccggactacgcgcaactctgccaccgactcaggaagctttaccatcgagccactcctctccccagcagcaaggttag

SEQ ID NO: 9343 - DNA, 585 bp, Artificial Sequence
  Description of Artificial Sequence: Synthetic coding sequence
atgaccatgcggcacaactggacccccgacctgagccccctgtgggtgctgctgctctgcgcacatgtggtgaccctgctagtgcgtgccacccccgtgtcacagaccactacagctgctactgccagcgtccgctcaaccaaagacccgtgcccttcacagccacccgtcttcccagctgccaagcaatgtcccgccctggaggtgacgtggcccgaggtggaggttccccttaatggtactctcagcttgagctgcgtcgcttgcagtcgtttcccaaatttcagtatcttgtactggttgggtaacggatcctttatcgagcacctgcctggacggctttgggagggatctacatcgcgagagagaggctcaaccggtactcagctgtgtaaggcgttagtgcttgaacagctgacaccagcacttcattcaacaaattttagttgtgtgctggtggacccggagcaagtggtgcagaggcacgtggtactcgcacagctgtgggccggcctgcgggctacgctgcccccaacccaggaggcacttcctagcagccactcttctccacaacaacaaggctag

SEQ ID NO: 9344 - DNA, 348 bp, Artificial Sequence
  Description of Artificial Sequence: Synthetic coding sequence
atgaccatgcggcacaactggacccccgacctgagccccctgtgggttctgctgctgtgtgcccacgtcgtgactctcttggtccgcgccactccagtgtcacagacaaccactgccgccactgccagtgtgcgtagtacgaaggacccatgcccgagccagcctccagtattccctgccgccaaacagtgtcctgctctggaagtgacatggccagaggtggaagtgccgctgtcttgggctgagggaaacttggcccctcatccaaggtctccagcattgcagcctcagcagagtacagccgcagggctgcgactgtccactggccctgcagcagctcagccttag

SEQ ID NO: 9345 - DNA, 528 bp, Artificial Sequence
  Description of Artificial Sequence: Synthetic coding sequence
atgctgccccccatggccctgcccagcgtgagctggatgctgctgagttgtctgatgctcctcagtcaggtgcaaggcgaagagccacagagggagttgccctccgccagaatccggtgtccaaaaggatctaaggcgtacggtagccactgttatgcactcttcctatcccctaaaagctggaccgacgctgacctggcttgtcagaaaagaccgagtgggaatcttgttagcgtgctgtctggggcggagggcagcttcgtctcttctctggtaaaatctattgggaactcttattcctatgtgtggatcggacttcatgaccccacccagggaaccgagcccaatggggagggctgggagtggagttccagtgatgtgatgaactatttcgcttgggaaagaaaccccagtacgatctcatcccccggccactgcgcaagtttaagtcggtcaacagcctttctgagatggaaggactacaattgtaacgttcggttgccttatgtctgtaagttcacagattag

SEQ ID NO: 9346 - DNA, 993 bp, Artificial Sequence
  Description of Artificial Sequence: Synthetic coding sequence
atgggcaagctgtgcctgggccccaccctgtgccccgccgccgccgctgaagagagcagggatgcagagcccagaagggaactcctctgtagtggtaggccctggacatggagggccgccgctcgagtcaccacaatgattccatgggtgctcctagcatgcgccttgccgtgcgccgcagacccgctgcttggcgcctttgctcggcgtgacttccggaagggctccccacaactggtgtgtagcttgccaggccctcaaggtccacccgggcccccaggagcccccggaccctccggcatgatggggaggatgggttttcctggtaaggatggccaggatgggcatgacggcgatagaggtgatagcggcgaggagggccctcctggccgcacaggcaatcgtggcaagccgggtcctaaaggaaaggccggagccatcggacgagctggcccacgggggccgaaaggggtcaatgggacccccggaaaacacgggactcctgggaagaagggcccaaaaggaaaaaaaggcgaacctggccttcccggaccttgcagttgtggaagtggacacaccaaatccgctttcagcgtggctgtgaccaagagctatcctcgagaacgtctacccatcaagttcgataagatcttaatgaacgaaggggggcactacaacgcttcctcgggcaagttcgtctgcggcgtgccagggatttactattttacgtacgatatcacactggccaacaaacacctcgccatcgggttagtccacaacggccagtatcgtattaggactttcgatgccaacactgggaatcatgacgtagcgagcggctctactatcttggcattgaaacagggcgacgaagtgtggctgcagattttctattccgaacagaacggattattttacgatccatactggacagactctctgtttactggatttctgatctatgcagatcaggatgaccctaatgaggtttag

SEQ ID NO: 9347 - DNA, 390 bp, Artificial Sequence
  Description of Artificial Sequence: Synthetic coding sequence
atgcggctgctgctgctggtgcccctgctgctggcccccgcccccggatcgtccgcgcctaaagtgaggaggcagtccgacacctggggcccgtggtcacaatggtctccgtgctcaaggacgtgtggcggaggggtctctttccgcgaacgcccttgctatagccagcgccgagacggcggcagctcatgcgtaggaccagctcgctctcatcggtcctgtagaaccgaatcctgcccagacggcgcaagagattttcgcgcagaacagtgcgccgaattcgacggggccgaattccagggtcgccggtacaggtggctcccctactactccgctccaaacaagtgtgagctcaattgtattcctaaaggcttgggtctacaaggatag

SEQ ID NO: 9348 - DNA, 1227 bp, Artificial Sequence
  Description of Artificial Sequence: Synthetic coding sequence
atgttcagcaacgccaacagccggagcaagatgtggctgctgctgacgatggcatctttgatctccgttctcggtacaacccatggcctttttggtaaattacatcctggctcaccagaagtgacaatgaatatctcacagatgataacatactgggggtatcccaatgaggagtacgaggtcgtgaccgaggacggctatattcttgaggtgaatcgaattccttatggcaagaagaacagtgggaatactggacagagacccgtggtctttttacaacacgggttactcgccagcgctacaaactggatctccaacctgcccaataattccctcgcctttattctcgccgacgcagggtatgatgtctggcttggcaactctaggggcaacacttgggctagacggaacttgtattacagccccgactctgtggaattttgggccttctcttttgatgaaatggcaaagtacgatttacccgccaccatcgatttcatcgtgaaaaagactggccagaagcagcttcactatgtggggcattcccaaggaaccactatcgggtttattgccttcagtacaaacccaagcttagccaaaagaatcaaaacgttctatgctctcgctcctgtggcaaccgtcaagtataccaaatccctcattaataagctgcgatttgttcctcaaagcttgtttaaattcatcttcggggacaagattttttacccacataacttcttcgatcagtttctcgccacagaagtatgtagtagggaaatgctcaatctgctctgttctaatgccctgttcatcatctgcggttttgattcaaagaacttcaatacaagccggctagacgtgtacttgtctcacaatccagccgggaccagcgtgcagaatatgttccactggactcaggctgttaagagcggcaagtttcaggcttacgactgggggtcccctgtacagaacagaatgcactacgatcagagtcagccgccatactacaacgtcaccgctatgaatgtccctatcgccgtctggaatggtggtaaagacctgcttgcggacccacaagacgtgggtcttcttctgcctaaattacctaatttaatctaccataaggaaattcctttctacaaccatctcgacttcatttgggccatggacgctccccaggaggtgtacaacgacattgtctctatgatctccgaggacaaaaagtag

SEQ ID NO: 9349 - DNA, 393 bp, Artificial Sequence
  Description of Artificial Sequence: Synthetic coding sequence
atggccagcgacctgatccggaccatcctggccgtggccctgatcagcaaactgggtactgccgtggatgcggagcttatgccatcaggtgccattctgcaaaacaaaagagagaatctccctcgggtttgtcacgcactcgcatttttagggatggcgcggtgccaagatctcttcctcgtgcggttgcaggggtggaagcttgggacaagatttcaagatggtccacgatcaaccccccaagaggagggaggttctccacagaggaaaagggggatgcccgtgcagattcatttcctgctgaaatcttttctgtctagcccgataacatttgcctttattagtcttgcccggaccgtgtctctggctactgccatctgcaagattgtttag

SEQ ID NO: 9350 - DNA, 393 bp, Artificial Sequence
  Description of Artificial Sequence: Synthetic coding sequence
atggccagcgacctgatccggaccatcctggccgtggccctgatctcaaagctagggactgctgtggatgccgaactgatgccaagtggagccattctgcaaaacaaacgggagaacctgcctcgcgtgtgccatgcacttgcattcttgggcatggcacgatgccaggacctgtttctggtgagactacaggggtggaagttagggacacgctttcaggatggtccgagatccacaccccaagaggagggaggctcccctcagcgtaagaggggaatgccagtccagattcacttccttcttaaatctttcctgtcttccccgatcacgttcgcattcattagtctggcacggaccgtctcactggccactgcaatttgcaaaatcgtttag

SEQ ID NO: 9351 - DNA, 1731 bp, Artificial Sequence
  Description of Artificial Sequence: Synthetic coding sequence
atgatcgtgttcggctgggccgtgttcctggccagccggagcctgggccaaggtctcttattgacccttgaggagcatatcgcccacttcctgggcaccgggggtgcagcaaccactatgggcaactcttgcatttgtcgggacgattccggtacagacgatagtgtagatacgcaacaacagcaggctgagaactccgccgtcccgacagcggacactcgcagtcagccccgggacccagtaaggccacctcggcgcgggcgcggcccccatgaaccacgaagaaagaagcagaacgttgatgggttggtcctggacactttagcagttattcggaccctagttgataacgaccaggaacctccatattctatgatcacccttcacgaaatggctgaaacagatgaggggtggctagacgttgtccaatcactgattagggtcatcccactcgaagatccacttggccctgccgtgattacattactgctggacgaatgcccactgccaaccaaggacgctctgcagaaactgacagagattttaaacctaaacggagaagtggcctgtcaggacagcagccaccccgccaagcacagaaatacatccgcggtgctggggtgtctcgctgagaagttagccggtccagccagtataggactgctctcacccggaatacttgagtacttactgcagtgcctaaagctgcagagccacccaacagtcatgctcttcgctctcatcgccttagagaagtttgcacaaacatctgagaacaaactgacaatatccgaaagtagcatctcagaccgtctcgtgacacttgagtcctgggcgaatgaccccgactacctaaaacgacaagtgggcttctgcgcccaatggtcgctggacaacctgttcttaaaggagggtaggcagttgacttatgaaaaagtgaatctttcaagtattcgcgctatgctgaatagcaatgacgtgagcgagtacctcaagattagcccccacggcttggaggcgcgctgtgacgcaagttccttcgaaagtgtaaggtgtacattctgtgttgatgccggagtctggtactacgaggtgactgtcgtcacgagtggcgtgatgcaaatcggatgggccacacgggacagtaaatttttgaaccacgaaggctatgggataggcgatgacgagtatagttgtgcatatgacggatgtagacagcttatctggtacaacgcacgctcaaagccgcacattcatccctgttggaaagaaggggatacagtcgggttccttctggacctgaatgaaaagcagatgatcttttttctgaacggaaaccagcttcccccggaaaagcaggtgttctctagtacagtgtcaggattctttgctgcggcatcatttatgtcgtaccagcagtgcgaattcaacttcggggctaaaccattcaagtatccaccatcaatgaagttcagcacttttaacgattatgctttcctgactgccgaggagaagatcatcttgcctcggcaccggagacttgccctgttaaaacaggtatctatcagagagaattgttgcagcctgtgttgtgatgaggtcgctgacacacagctaaagccatgtgggcatagtgatctctgtatggattgcgccctccagctggagacttgtcctctttgtcgcaaggagattgtgtcccgtattagacagatttcccacatttcttag

SEQ ID NO: 9352 - DNA, 360 bp, Artificial Sequence
  Description of Artificial Sequence: Synthetic coding sequence
atggcccggcccggcatggagcggtggcgggaccggctggccctggttactggtgctagcggaggaataggagccgccgtggctcgggccctcgttcagcagggtctgaaagtggtaggctgcgcccggacagtgggcaatatcgaggaactggcagcagagtgcaagtctgcaggctatcccggcactctgatcccatacagatgcgacctgtcaaatgaggaggatatccttagtatgttttcagcaatccggagtcagcactctggcgtggacatttgtattaataatgcaggcttagccaggccggacacgcttctttccggctctacaagcggatggaaagatatgttcaactag

SEQ ID NO: 9353 - DNA, 144 bp, Artificial Sequence
  Description of Artificial Sequence: Synthetic coding sequence
atgcaggtgagcaccgccgccctggccgtgctgctgtgcaccatggctctttgcaaccaggtgctgagtgcaccccaggccgggaggagtgtcctgacacccgtgagatccggcagtcgtaatacatcagttacctggagttag

SEQ ID NO: 9354 - DNA, 159 bp, Artificial Sequence
  Description of Artificial Sequence: Synthetic coding sequence
atgcaggtgagcaccgccgccctggccgtgctgctgtgcaccatggcgttgtgtaaccaagtcctgagcgctcccctttcacgcccccgcgaagccggccggagtgtgttgaccccagtccgaagcggtagtaggaacactagcgtgacttggagctag

SEQ ID NO: 9355 - DNA, 1272 bp, Artificial Sequence
  Description of Artificial Sequence: Synthetic coding sequence
atggagctggagctgatgcccttcaacgtgctgctgcggaccaccttagatcttctgcaggagaaggatcccgcccatatttttgcagaacccgtgaatttgagtgaagtgccagactacctggaattcatctctaagccaatggactttagtaccatgaggaggaaactagagtcacacctctacagaacacttgaggagttcgaagaggactttaatctgatcgtcacaaattgcatgaagtacaacgccaaagacactatatttcatagagccgccgtgagacttagggacctagggggagctatactgcggcacgccagacgacaggccgagaacataggctatgatccagaaagggggacacatcttccggagtctcctaaactggaagacttctataggtttagttgggaggatgtggacaatattctgatccccgagaaccgcgcacacctcagcccggaagtacagctcaaagaattgctagagaagctggacctggtgagtgccatgcggtcctcaggtgccaggactcgcagagtgagactactgaggcgggaaatcaatgccttgcgccagaaactagcacagcccccgccgccccagcccccaagcctgaacaagaccgtcagtaacggcgaactgcccgctgggcctcagggggacgcggctgtgctggaacaggctttacaggaagaacccgaagatgatggagacagagacgacagtaagctgcccccacctccgacattagaaccaacagggcccgcaccttctctctcggaacaagagagtccccctgaaccccctactctgaaacctatcaatgattccaagcccccatccagattcttaaagccacggaaagtcgaggaagatgaactcctcgaaaagtctcccctccagctggggaacgaacccctccagcggctgttgtcagacaacggtatcaataggctgtcactgatggcccctgacacccccgcaggcactcccctgtccggagttggacgccgaacgtctgttctgttcaaaaaggctaagaatggcgtgaagttacagcgcagccccgaccgtgttctggagaatggagaagaccatggcgttgctggcagccctgctagcccggcctccatcgaggaggagagacattcacggaagagacccaggagccgaagctgtagcgagtccgagggcgagcggtcaccacagcaggaagaagagacaggcatgacaaacggctttggaaagcatcgcaagagggtctag

SEQ ID NO: 9356 - DNA, 3030 bp, Artificial Sequence
  Description of Artificial Sequence: Synthetic coding sequence
atgggcagcggccgggtgcccggcctgtgcctgctggtgctgctggtgcatgcacgagcggcacagtactcaaaagctgcccaagacgtagacgaatgcgtggagggcactgataattgtcacatcgacgcgatatgccagaatacacctaggagctacaaatgcatttgtaagtcaggatatacgggtgatggcaaacactgtaaggacgtggatgaatgcgaacgggaagataacgccggttgcgtgcatgattgtgtgaacatacccgggaattacagatgcacctgctatgacggcttccacctagctcatgatggccataactgcctggacgtggatgaatgcgccgagggcaatggcgggtgtcaacaatcatgtgtgaacatgatgggaagctatgaatgccattgcagagaagggttttttctttccgacaaccaacacacttgcattcaaagacctgaagagggcatgaattgtatgaataagaaccatggatgcgctcatatctgcagagagacccctaaagggggcattgcttgcgaatgccggcctggcttcgagctgactaagaaccagcgagattgcaaattgacctgcaattacgggaacggcgggtgtcagcacacctgcgacgacactgagcagggaccgcggtgcggctgccatataaagttcgtgctgcacacagatggaaagacttgcatcggcgagcggcggctagagcagcacataccaacacaggccgtgtctaacgaaacttgtgccgtgaacaacggtggatgtgactccaagtgtcacgacgcagcgaccggcgttcattgtacttgccccgttggttttatgctccagccagacaggaagacatgtaaggacatcgatgagtgtcgattgaacaacggtggctgcgaccacatttgcaggaacacggtgggctcatttgagtgctcgtgcaagaaaggctataaactgctaattaacgaacgtaactgccaagatatcgatgaatgttctttcgaccggacctgcgatcatatttgcgtgaacacacctgggtcttttcagtgtctgtgccaccgaggatatctgctttacggaattacacactgtggcgacgtagacgaatgcagcatcaaccgggggggctgcagattcggctgcatcaatacaccaggaagttaccagtgcacctgcccagctggacagggcaggctgcactggaacggaaaggactgcacagagccactgaagtgccaaggctctcccggtgcctccaaagcaatgctctcgtgtaataggtcggggaaaaaggatacatgcgccctgacatgccccagtagagcccgatttctgcctgaatccgaaaacggctttacagtcagctgcggcaccccctcgcctagagctgctcctgcccgagcgggtcacaacggaaactctacaaatagtaatcactgccacgaggcagccgtattatctataaagcagagagctagcttcaaaatcaaggacgcaaagtgcagattgcatttgcgcaacaagggcaagactgaagaggccggccgcatcacaggaccaggaggcgctccttgctccgagtgccaggttacctttatacatctgaagtgtgactcgtcgcgcaaagggaaaggtcgccgcgcccggacaccgccgggcaaagaagtgacacgcttgacacttgagctggaagccgaagtgcgggccgaagagacaactgcatcatgtggcctcccttgcctgcgccagaggatggaaaggaggctgaaaggttccctgaaaatgctgagaaagagtataaatcaggaccgattcctcctgcggctggccggcctggactatgagctggcacacaagccaggattggtcgctggggaacgggccgagcccatggaatcctgcaggccgggccagcatcgtgctggtacaaagtgtgtaagctgtccccagggcacctattaccacggacagaccgagcagtgcgtgccctgtccggccgggacattccaagagcgagagggccagttgagctgcgacctatgtcctggtagcgatgctcacggccccctgggagccacaaatgtgactacctgtgctggacaatgtccccccggacagcacagtgttgatggatttaagccctgccagccatgcccgcggggaacttaccaacctgaggccggcagaactttatgctttccgtgtggaggcggcctgaccacaaagcacgaaggtgcgatttcttttcaggattgcgacaccaaagttcagtgctcgccaggccattactacaatacttctattcacaggtgcattcgctgcgccatggggtcgtatcagcccgattttcgccaaaatttttgtagccgatgtccagggaatacatccactgatttcgacggaagcacgagtgtggctcagtgcaagaaccgtcagtgtggaggtgaactcggtgagtttacaggatacattgaatcaccaaactaccctggaaattatccagcaggggtggaatgcatctggaatattaaccctccccccaagcggaaaatcctcattgtggtgccagaaatctttctcccgagcgaggatgagtgcggggacgtgctggtcatgaggaaaaactcttcaccatcaagcatcactacctacgaaacctgccagacttacgagcggccgatagctttcacagcgagatctcgaaagttgtggattaattttaaaactagtgaggcaaacagcgccaggggcttccagattccatacgtgacttacgacgaggattatgagcagctggttgaggatattgttcgggatggccgattgtacgcatcagagaatcatcaagagatactcaaagataagaagctcatcaaggctttttttgaggtattagcacacccccagaattattttaaatacaccgaaaaacacaaggaaatgctccccaagtctttcattaaattattgcggtctaaggtgagtagtttccttcgcccctacaagtag

SEQ ID NO: 9357 - DNA, 984 bp, Artificial Sequence
  Description of Artificial Sequence: Synthetic coding sequence
atgaccgccctggagctggcccggcggggcgcccgggtggtgctggcttgccggtctcaagagcggggggaagcggctgccttcgaccttcgacaggaatctggtaataatgaggtgatctttatggcgctggacttagcttccctggcctccgtgcgtgctttcgccactgctttcctgagttccgagcctagactcgacattctcatccataacgccggtatcagcagttgtggtcgcacaagggaagcattcaatctgctcctcagggtgaaccacatcggaccctttcttctaactcacctcttgctcccgtgtctaaaagcttgcgcgccaagtcgtgtcgtcgtagtggcttccgctgctcactgtcgcggcagactagactttaagcggttggatcgccccgttgtcgggtggagacaagaactgagagcgtatgccgacacaaagctggctaacgtgctctttgccagagagttggctaaccaattggaagcaaccggcgtcacctgttacgccgcccaccctgggcctgtaaattctgaactgtttctccgacatgtgccggggtggctcagaccattattacggcccctagcctggttggtacttcgagcaccgcgaggaggagcccaaactccactgtactgcgccctgcaggaaggaatcgagcctctgagtggaaggtactttgccaactgccacgttgaggaggtgcctcccgctgcacgcgacgaccgggcagcgcaccggctgtgggaagctagcaaaagactagccggtctgggaccaggagaggacgccgaaccagacgaggacccacagtccgaggactccgaggccccttcgtctctcagtacgccccatcccgaggagcccacggtatcccagccttacccgtcccctcagtcctcacctgatctttctaagatgacacacagaatacaggccaaagtggagcccgaaatccaattatcctag

SEQ ID NO: 9358 - DNA, 1320 bp, Artificial Sequence
  Description of Artificial Sequence: Synthetic coding sequence
atgcccgccatcgccgtgctggccgccgccgccgccgcctggtgctttttgcaggtggagtctcggcacctggacgccctggccggcggcgcaggcccaaatcatggcaatttcttggataacgaccagtggctgtccacagttagccagtatgaccgagacaaatattggaatcgtttccgggacgatgattatttccggaattggaatcctaacaagccctttgaccaggctttagacccctccaaagacccttgcttaaaagtgaaatgttccccacataaagtatgcgtcacccaggactatcagacagctctatgtgtttccaggaaacacctccttccaaggcagaagaaaggcaatgttgcccaaaagcattgggtgggcccctccaatcttgtaaaatgtaaaccgtgccccgtggcgcagagtgccatggtctgtgggtcagacggccacagttacactagtaaatgcaagctggaattccatgcgtgttcgaccggtaagtccctagccaccctgtgcgacggcccgtgtccatgtttgccagagcctgaacccccaaaacacaaagccgagcggagcgcgtgcacagacaaagagctgagaaacttggcaagtcggctcaaagactggttcggagctcttcacgaagacgcaaacagggtgatcaagccaactagttccaacacagcacagggtcgcttcgatacttctatcctgccaatctgcaaggatagcctggggtggatgtttaacaagctggatatgaactacgacttactgttggaccctagcgaaataaacgccatctaccttgacaagtatgaaccctgtattaagcctctctttaactcctgcgactcctttaaagatggaaaactgagcaacaacgagtggtgctattgttttcagaagccaggaggactgccctgccagaacgagatgaataggatccagaagcttagcaagggcaagtcgttactgggagcatttataccccgatgcaacgaagaaggctattacaaggcaacacagtgccatggttccaccggacagtgctggtgcgttgataagtatggtaacgaattggccgggtccagaaaacaaggagctgtctcgtgcgaagaggagcaagagacaagcggcgactttgggtcaggaggatctgtggtgctgctagacgatctcgaatacgaaagagagcttggtcccaaagataaagagggcaagctccgggtgcatacgcgcgccgttacagaggatgatgaagacgaagatgacgacaaggaggacgaagtgggctacatatggtag

SEQ ID NO: 9359 - DNA, 3687 bp, Artificial Sequence
  Description of Artificial Sequence: Synthetic coding sequence
atgaagggcgcccggctgttcgtgctgctgagcagcctgtggagcgggggcatcgggctgaacaattcaaagcattcgtggactatcccggaggatggtaattcccagaaaactatgccaagcgcatccgttccgccaaataaaattcagagtcttcaaattctgccgaccacaagggtgatgagtgctgagatcgccacaactccagaagcccgaacgtccgaagatagtctgttgaagtcaaccctccctcctagcgagaccagcgccccagctgagggggtgcgcaaccaaaccttaacttctacagagaaggcagaaggcgtggtgaagctgcagaacctgacgctacccaccaatgcctcaattaaattcaacccaggagcagaaagcgtggtcttaagcaattccactctcaagttcttacagagcttcgcaagaaaatccaatgagcaagcgacaagcttaaacacggttgggggaacaggaggaatagggggggtcggcggaaccgggggagtgggaaatcgagctcctagagagacctaccttagccgaggcgactcaagttcctcacagagaacggattaccagaagtctaatttcgaaaccacacggggaaagaattggtgcgcatacgtccataccagactgtcacctaccgtgatccttgataaccaggtcacatatgtgccaggcggaaagggtccttgtggatggaccggcgggtcctgtccccagcgctcccagaagatttcaaacccagtctatcggatgcaacacaaaattgttactagcctcgactggagatgctgcccaggctacagcgggcctaaatgccagctcagagctcaggaacagcagtccctgatccataccaaccaggccgagagccataccgccgtgggtaggggggtggctgagcagcagcagcaacagggatgcggagaccctgaagttatgcagaagatgactgatcaggtgaattaccaggcaatgaaattgaccttgcttcagaagaaaatcgataacatctccctgactgtcaatgatgtgcgaaatacttattccagtttggagggcaaagtgagcgaggataaaagccgcgagtttcaaagcctgttgaaaggccttaagagcaagagtattaacgttctcatccgggatatcgtgcgggagcaatttaagatcttccaaaacgacatgcaagagactgtcgctcaactgttcaaaaccgtatcttcactctcagaggacctggaatctacaaggcagattatccagaaggtcaacgagagcgtcgtgtccatcgccgctcaacaaaaatttgtcctggttcaggaaaatcggcccacgctgacagacattgttgaattgagaaaccacattgttaatgtgcggcaagagatgacattaacctgtgaaaaacccatcaaagagctggaagtgaagcagacccatctggaaggtgcactcgagcaggaacactccaggagcattctctattacgaatcactgaacaaaactctgtcaaagctcaaagaagtgcacgaacagttactgtccacagagcaggtttcagatcagaaaaatgccccagccgcagaaagtgtgtctaataatgtgaccgaatacatgtcaactttgcatgagaacattaaaaaacaatccctgatgatgctgcagatgttcgaagatttgcacatacaggaatctaaaataaataacctgacagtgagcctggaaatggagaaggaatcactccggggtgaatgtgaagatatgttatccaagtgtagaaatgactttaagttccagctgaaagataccgaggagaatcttcatgttctgaaccagactctcgccgaagtgctgttccctatggataacaaaatggacaaaatgtccgagcagttgaacgatctcacctacgacatggagatactacagcctctgcttgagcagggcgcatctcttcggcagaccatgacatacgaacagcctaaggaagccatcgtcatacggaagaagattgaaaatttgacctcagccgtgaattcactaaacttcattatcaaggaactaacaaaaaggcacaacctcttgcggaacgaggtgcagggcagggatgatgctctggaacgaaggattaacgagtacgcccttgaaatggaagatggactcaacaaaactatgactatcatcaataacgccatcgattttattcaggataattacgctttgaaggaaacgcttagtacaatcaaggataattctgaaatacaccataagtgcacatcggacatggagaccatcctgacctttatcccccaatttcacagacttaatgacagcatccaaaccctggtgaatgataatcagcgttataacttcgtgctgcaggttgccaagacattggccgggattccgcgagacgagaaactgaatcagtctaactttcagaaaatgtaccagatgttcaatgaaaccacgtcccaggtccgcaagtaccaacagaacatgtctcatttggaggagaagctgctgctgaccaccaagatttctaagaattttgaaaccagactgcaggacattgagtctaaggtgacacaaacactgatcccatattacatctctgtgaagaagggatccgtagtgacaaatgaacgtgaccaggcccttcagctccaggtgctgaattctaggtttaaagctctggaggccaaatccatccacttatccatcaattttttttcgctcaacaaaactctgcacgaggttctaacaatgtgccacaacgcgagcaccagcgttagcgagctaaacgccactataccaaagtggattaaacactccttgcccgacatccagttgctgcagaagggcctgactgagttcgtcgagccgattatccagattaagactcaagccgccctgtctaacctaacgtgctgcatcgaccgcagcctgcctgggtccctcgccaatgtggtcaaatcccagaaacaggtcaagtcgctgccaaagaaaatcaacgcactgaaaaagccgactgttaacttgactacagtgcttatagggcggactcagcgtaataccgataacattatttaccccgaggagtatagcagttgcagtaggcatccctgccaaaacggagggacttgcataaatggacgtacaagctttacttgcgcctgtcggcacccatttacgggtgataactgtactataaagttggtcgaggagaacgccctggcgcccgacttttcaaagggctcttatcgctacgcacctatggtggcattcttcgcttctcacacatacggcatgacgataccgggacccattctgttcaataacctggatgtcaattacggtgcgagttatacacctaggaccgggaaattcaggatcccttatctcggagtgtatgtgtttaaatatacaattgagtcattttccgcgcatatatctggattcttggtggttgatggcatcgacaagctcgcatttgaatcggagaacatcaactctgagattcattgcgatagagtgcttactggcgacgccctgcttgagttaaattatgggcaggaggtctggctgaggctggcaaaaggtaccatcccagctaaattcccccctgtcaccaccttttctggctatctgctttatagaacttag

SEQ ID NO: 9360 - DNA, 1596 bp, Artificial Sequence
  Description of Artificial Sequence: Synthetic coding sequence
atgaagggcgcccggctgttcgtgctgctgagcagcctgtggagcgggggtattggcctgaataactctaagcactcatggactatccctgaggatggtaacagtcagaaaacaatgccctctgcttccgtccctcccaataagattcagtctctgcagatactgcccaccacgagagtgatgagtgccgaaatagcaaccacacctgagaaggcagagggtgtcgtcaagctgcagaatttgactctgcctaccaatgctagcatcaaattcaatccaggcgcagagtccgttgtgctctctaactccaccctgaagttcttgcaatcgttcgccagaaaaagcaatgaacaggccacaagcctgaacacagtcgggggcactggtggtatcgggggggtaggcggcactggaggtgtgggcaaccgcgcccctagagagacctacctcagtcgaggagacagctctagcagtcagaggacagattaccagaagtctaattttgaaaccacacggggaaaaaactggtgtgcttatgtgcacaccagactgtcacccactgtgattctggataaccaggtgacttatgtaccaggaggcaaggggccgtgtgggtggaccggcggcagttgtcctcagaggagccagaaaatcagtaatcctgtataccgcatgcaacataagatagttacctctctggactggaggtgctgtccgggctacagtgggccaaagtgccagcttcgtgcacaggaacaacaaagcctaatccacaccaatcaggctgaatcccacacagcggtcggcaggggggtcgctgaacagcaacagcagcagggttgtggggatcccgaggtaatgcagaagatgaccgaccaagtaaattatcaagccatgaagttgactctgttacaaaagaagatagacaacatcagcttaaccgtaaacgacgtaaggaacacctacagttcgcttgaaggaaaagtttctgaggataagtctcgcgagtttcagtccctcctaaaggaggagtacagcagttgtagtagacatccttgtcagaacggcggcacatgcatcaacggcaggacctcttttacttgcgcatgcagacaccctttcaccggagacaactgcaccataaagctagtggaggagaatgcccttgctccagacttcagcaagggttcctaccgatacgctccgatggtggcattctttgcttctcacacatacgggatgaccatacctgggcctattctgtttaataatctcgacgtgaattatggtgctagctatacaccgcgtacagggaagttccgaatcccttatctgggtgtctacgtctttaaatatacaatagagagcttcagcgcccacatctcagggttcctcgtggtcgacggtatcgacaaactggcattcgaaagcgagaatataaactccgaaatccactgcgaccgcgtgttgaccggagacgccctcctggaactgaattacggtcaagaggtctggctcagactggctaagggaacaatcccagctaaatttccacccgtcactacattttccggatacttgctctaccggacgtag

SEQ ID NO: 9361 - DNA, 942 bp, Artificial Sequence
  Description of Artificial Sequence: Synthetic coding sequence
atgagcgacctgctgctgctgggcctgatcggcggcctgaccctgctgttgcttttgactcttctggcgtttgccggatactcagggctgttagcaggtgtggaggtctctgcaggctcacccccgatcaggaacgtaaccgtggcctacaaattccacatgggtctttacggcgagacgggaaggctattcaccgagagctgttcaatcagtccaaagctcagatccatagctgtgtattacgataacccccacatggtaccaccagataaatgtaggtgcgcggtcggatctatcctcagcgagggtgaggaaagtcccagccctgagctgatcgatttgtaccaaaaattcgggtttaaggtgttcagttttcctgcccctagccacgtcgttactgccacttttccctacaccacaattttatccatctggctcgcaacacgtcgagtacatccggcgcttgacacatacattaaggagaggaaactatgcgcctatccacgactggaaatttaccaggaggatcagattcattttatgtgtcccctcgctcgccagggcgacttttacgtcccggaaatgaaggagaccgagtggaaatggcgtgggcttgtggaagcaattgatactcaggtagatgggaccggcgccgacactatgtccgatacaagctcggtgagcctggaagtgtcacccggcagccgtgagacctccgccgccactttgagcccgggcgccagttctagaggctgggacgatggcgacaccaggtccgaacattcgtatagtgaaagcggagccagtggaagctccttcgaggaactggatttagagggcgagggccctctaggcgagtctaggctggacccaggcaccgagcccctgggtactaccaagtggctctgggagcccacggccccagagaaaggaaaagagtag

SEQ ID NO: 9362 - DNA, 834 bp, Artificial Sequence
  Description of Artificial Sequence: Synthetic coding sequence
atgtgcaccgtggtggacccccggatcgtgcggcggtacctgctgcgtcgacaactcggtcaaggggcctacggcatagtctggaaagccgtagaccgtcgtaccggcgaggtcgtcgcaattaaaaagatctttgatgcatttcgggacaaaaccgacgcccaaaggacctttagggagataactcttctgcaggaatttggagatcacccaaacatcattagcctgctcgatgtcattcgcgctgagaacgaccgcgatatttatctggttttcgaatttatgggctgcccaccctctccgcctccacctaccgcagtaagaactctttcagccgacacagatctgaatgccgtgataagaaagggaggcctgctgcaggatgtacatgtccgtagcatattctatcagttactgcgggccacgcggtttctgcacagcgggcatgttgtgcacagagaccagaagccatccaatgtgctgctggatgccaactgcacagttaaattgtgcgacttcggtctggcacggtcactgggagatctacccgaaggaccagaagatcaagcagtgaccgagtatgtggcaactaggtggtacagagctcctgaggtcctgcttagctctcacagatatactctgggcgttgacatgtggagcctcgggtgcattttgggggagatgctccggggaaggccactgttcccggggacttccactctgcaccagctcgagttgattttagaaacaattccacccccctcggaagaggaccttctggctcttggatcagggtgccgggccagcgtgctgcaccaattaggctcccggtag

SEQ ID NO: 9363 - DNA, 765 bp, Artificial Sequence
  Description of Artificial Sequence: Synthetic coding sequence
atgtgcaccgtggtggacccccggatcgtgcggcggtacctgctgaggcgccagttgggtcaaggcgcctatgggatagtgtggaaggcagttgaccgcaggaccggagaggtcgttgcaatcaagaagatcttcgatgctttccgggataaaaccgacgcgcaacgcacatttagggaaataacactgcttcaagagtttggggatcaccccaatatcatctccctgctcgatgtgatccgggccgaaaatgatcgcgatatctatctcgtgtttgagttcatggataccgatcttaatgctgtcatcagaaaaggaggcctgttacaggatgttcatgtgagatccattttttaccagctgctacgggcaacgcgctttctgcactcaggccacgtggtgcacagagatcaaaagccttctaatgtactgctggacgctaactgcaccgttaaactttgcgattttggcctcgccaggagcctgggagacctgccagagggacctgaagaccaggcagtgacagagtatgttgcaacgcgctggtacagagcccccgaggtacttcttagcagtcatcgctacactctgggtgtagacatgtggagccttggatgcattctcggggagatgctgagggggaggcccctctttcctggaacgtctactctgcaccagctggaattgattctggaaacgattccccctccttctgaggagggggcccagaccgcttgcaggtccggaacgggtgccagtacttag

SEQ ID NO: 9364 - DNA, 474 bp, Artificial Sequence
  Description of Artificial Sequence: Synthetic coding sequence
atggccctgctgctgtgcctggtgtgcctgaccgccgccctggcccacggctgtctgcattgccatagcaatttctctaagaagttctctttctaccggcaccacgtcaacttcaagtcttggtgggtgggggacattcccgtgtcaggagctctactgaccgactggtccgatgacacgatgaaagaattacaccttgcgatacctgccaaaattactcgcgaaaaactggatcaggttgccacagctgtttaccagatgatggatcagctctaccaagggaagatgtatttccctggatacttcccaaacgaacttaggaatattttcagggagcaagtgcatctcatacagaatgctatcatcgaacgacatctggcacctggaagctggggcggcggccagttaagccgagagggacccagcctggctcccgagggctcaatgccctctcctagaggcgatctcccatag

SEQ ID NO: 9365 - DNA, 699 bp, Artificial Sequence
  Description of Artificial Sequence: Synthetic coding sequence
atggccctgctgctgtgcctggtgtgcctgaccgccgccctggcccatgggtgcctgcactgccactccaactttagcaagaagtttagcttttataggcaccatgtcaacttcaagagttggtgggtgggcgacatcccggtttctggcgcgctgctgacagattggagcgacgatacaatgaaggagctgcacttagccattcctgcaaagatcacgcgggagaagctcgaccaggtcgcgactgccgtctatcagatgatggatcaactttaccaagggaagatgtacttcccagggtactttcctaacgagcttaggaatatttttcgcgaacaagtccacctcatccagaatgctatcattgagtcaaggattgactgccagcataggtgcgggattttccagtatgaaacaatcagttgcaataattgtaccgactcccatgtggcctgtttcggatataactgtgaatcctccgcccagtggaagtccgccgtccaaggcttgttgaattacataaataactggcacaagcaagacacttccatgcgcccgagatccagcgccttctcatggccaggtacccaccgggctacaccagcgtttctcgtcagtccagcactgagatgcctggaacctccccacttggccaatctaaccttggaggacgccgccgaatgtcttaagcagcactag

SEQ ID NO: 9366 - DNA, 396 bp, Artificial Sequence
  Description of Artificial Sequence: Synthetic coding sequence
atgggcggcgacggccggtacgtgctgaacggccactgggtggtgtccccccctggcacgtacgaggctgcaggcactcatgtggtatacacccgagatactggtcctcaagaaacactgcaggccgcgggacccaccagtcacgacctgctgttgcaggtcttgctgcaagagcctaacccaggcattgagtttgagttttggctgccacgcgaacggtactccccttttcaggcccgggttcaggctttaggctggcctctcaggcagcctcagcccagaggagtggaaccccaacctccagccgcacccgctgtgacccctgctcagacccccaccttggctcccgggcccagcgccggaccccccccacccggccccggcgatcccttgtag

SEQ ID NO: 9367 - DNA, 447 bp, Artificial Sequence
  Description of Artificial Sequence: Synthetic coding sequence
atggcccggatccccaccgccgccctgggctgcatcagcctgctgtgcttacagttacctggcagtcttagccgatcccttggaggggacccacgtcctgtgaagcctcgcgaaccccccgctcgcagtccttcctcatccctgcagccccgtcaccccgctcctcgcccagttgtgtggaaattacatcgagcactgcaggcccagcgcggagccggattagccccagtgatggggcagcctttaagagatgggggacggcagcactcagggcccagaagacactccgggcctaggcgtacccaggctcaattgttgcgggtgggatgcgttttgggaacgtgtcaggtacaaaacctgtcgcaccgtttgtggcagttgatgggccctgcgggaagacaagactcagcccctgtggatccatcctcgccgcacagttacggttag

SEQ ID NO: 9368 - DNA, 447 bp, Artificial Sequence
  Description of Artificial Sequence: Synthetic coding sequence
atggcccggatccccaccgccgccctgggctgcatcagcctgctgtgtctgcagctgcccgggtcactgtcgcgtagcctcgggggggacccccgaccagtgaagcctagggaaccgccagccagatctccttcaagttccctacagccaagacatcctgctcccagaccggtcgtgtggaagctgcatcgcgcccttcaggcccagagaggggcgggccttgctccggtaatgggacaacccctgcgcgacggaggacggcagcactccggccccaggagacacagcgggccccgccggacccaggctcagctgctaagggtgggctgtgtgctcggcacgtgccaggtccagaacctctcacatcggctgtggcaactaatgggtcccgcaggaaggcaagactcagcccctgtggacccaagctcaccccattcttatggatag

SEQ ID NO: 9369 - DNA, 537 bp, Artificial Sequence
  Description of Artificial Sequence: Synthetic coding sequence
atggaccgggccgcccggtgcagcggcgccagcagcctgcccctgctgttggccctagctctgggactggtgattctccactgtgtggtcgcagatggtaactccacccggtcaccggaaacgaacggacttctgtgtggagatccagaggaaaactgtgccgccactactactcaaagcaagagaaaaggacatttttctaggtgtccaaaacagtacaagcactattgtattaagggccgttgccgctttgtggtggcagaacagacccccagctgtgtatgcgacgaaggatatataggcgcaagatgtgagagggtagacctattttaccttcgtggcgatagaggccagattttagtgatctgtctgattgcagtcatggtggtttttatcatcctggtgatcggggtttgtacatgttgccatcctctgcgaaagcgtcgcaaacgaaagaaaaaagaggaggaaatggagacactcggaaaggacataacccccatcaacgaggacattgaagaaacaaacatcgcatag

SEQ ID NO: 9370 - DNA, 1251 bp, Artificial Sequence
  Description of Artificial Sequence: Synthetic coding sequence
atgagcatcagcctgagcagcctgatcctgctgcccatctggatcaatatggcgcagattcagcagggcggtcccgacgagaaggagaagaccacggcccttaaagatttgctttccagaatcgacctggacgagttaatgaaaaaggacgaacctcctctggacttcccagatacactagagggatttgagtacgcttttaacgagaagggccagctccgccatataaaaactggcgagcctttcgtgttcaactaccgcgaggatctgcaccggtggaatcagaaaaggtacgaggcactcggcgaaatcattactaaatacgtgtacgagctccttgaaaaagactgcaacctgaaaaaggtgtcaatccctgttgatgccactgaatctgagccgaagagctttattttcatgtctgaggatgcccttaccaacccccagaagctcatggtgctcattcacgggagcggggttgttcgcgctggccagtgggctcgcaggctcattattaacgaagacctcgatagcgggacccagatcccattcattaagcgggccgtcgcagaaggatatggtgtgattgtcctgaatcccaacgagaactatatcgaggtagaaaaacccaagatccacgtccagtcttctagcgattccagcgacgaaccagccgaaaaacgcgaacggaaagataaagtgtctaaggagactaaaaagagacgggatttctatgaaaaataccgcaacccccagcgggagaaggaaatgatgcaactttatatcagggaaaacggcagccctgaagagcacgccatctacgtttgggatcattttatcgcacaggcagccgccgaaaatgttttttttgttgcccatagctatggtgggcttgcttttgtcgaactcatgattcagagagaggcagacgtcaagaacaaggttaccgcagtagccctaactgactctgtgcacaatgtgtggcaccaggaagccgggaaaacaattagagagtggatgagagagaattgctgcaactgggtgagctcatcagagccccttgatacttcagttgaatcaatgctgcccgactgccctagggtgtccgccggtacagataggcacgagctcacatcatggaaatcctttcctagcatcttcaagttctttaccgaagcttccgaagcaaagacatccagcctgaaaccagctgtcacaagacgcagtcataggatcaagcacgaggaattatag

SEQ ID NO: 9371 - DNA, 840 bp, Artificial Sequence
  Description of Artificial Sequence: Synthetic coding sequence
atgaagatcatcatcctgctgggcttcctgggcgccaccctgagcgcaccgctgatccctcaacgcctgatgtccgccagcaattctaatgaactccttttgaacttaaacaacggccagctgttgcccctgcaattgcagggccctctgaacagctggatccccccattctccgggatcctgcagcagcaacaacaggcccagatacccggcctgtcccagttctccctcagtgccctcgatcagttcgccggcttactgcctaaccagatacccctgacgggcgaggctagcttcgcccaaggagcgcaagccgggcaagtagatcccttgcagctccagacacccccccagacacagccaggcccttctcatgtgatgccctacgtgtttagcttcaagatgccccaggaacagggccagatgtttcagtattaccctgtgtacatggtgctcccgtgggaacagccccagcagacagtgccaaggagcccccaacagacccggcagcaacagtacgaagagcagatcccattctacgcacagttcggatatatcccacagttagcagagccagccatctctggcggccagcagcagttggccttcgacccacagcttggcaccgcacccgaaatcgccgtgatgagtacaggtgaagaaatcccttatctacagaaagaagccatcaattttagacatgactccgctggcgtgtttatgccaagtacaagcccgaagccgtcaacgacaaacgtgtttacatcagcagtggaccagacaataactccagaactccccgaagagaaggataagaccgatagtcttcgcgagccatag

SEQ ID NO: 9372 - DNA, 444 bp, Artificial Sequence
  Description of Artificial Sequence: Synthetic coding sequence
atgggccccgaggccctgagcagcctgctgctgctgctgctggtggcctctggcgatgccgacatgaagggccacttcgaccccgccaaatgcaggtatgccctgggcatgcaggatagaacaatccctgactccgacatttccgcttcgtcatcctggagcgattctactgctgcgaggcatagccggctggagagctccgatggggatggcgcttggtgccccgccgggtctgtgtttccaaaagaggaagagtacctccaggtggatctgcaaagacttcaccttgttgcgcttgtaggaacgcaggggcgacatgcgggggggctagggaaggagttctctcgctcctaccgtctacggtatagtcgcgatggcagaaggtggatgggatggaaagataggtggggccaagaagtaatcagtggaaacgaggatccatag

SEQ ID NO: 9373 - DNA, 618 bp, Artificial Sequence
  Description of Artificial Sequence: Synthetic coding sequence
atgggcggccccgtgcgggagcccgccctgagcgtggccctgtggctgtcctggggtgcggcattaggtgcggtggcctgcgccatggctcttttgacacaacaaacagagttgcagtctttgaggagagaggtaagtcggttacagggcactggaggaccttcacagaacggggaaggatatccatggcagtcccttcctgaacagcactctgtgctgcacttggtccccattaacgcgacctccaaagatgactccgacgtgaccgaagtgatgtggcagccagctcttaggagggggagaggcctgcaggcccagggatacggtgtgcgtatacaagatgctggggtatatttgctctatagtcaggtcttgttccaggatgtgacatttactatggggcaggtggtgtccagggaagggcaggggcgccaggagacactctttcgatgcattagatcaatgccaagccatccagaccgagcatacaacagctgttactccgccggagtctttcacctgcaccagggggatatcctgagcgtgatcattccgcgggcacgtgccaaacttaatctctccccacatggcacattcctgggatttgtaaagttatag

SEQ ID NO: 9374 - DNA, 744 bp, Artificial Sequence
  Description of Artificial Sequence: Synthetic coding sequence
atgcccgccagcagccccttcctgctggcccccaagggcccccccggcaatatgggtggccctgtccgggaaccagctttgagtgtggccctctggctgtcttggggcgccgcccttggagcggttgcatgtgccatggctctgctgacgcagcagactgaactgcagtccctaagaagagaggtttcaaggttgcaaggcaccggtggccccagtcagaacggtgagggctatccatggcagtcgttaccagaacagtcgagtgatgcccttgaagcatgggagaacggggagcggagcagaaaacgccgagccgtcctgactcagaagcagaaaaaacagcacagtgtcctgcacctggtgcctatcaacgccacatcaaaggacgactctgatgttaccgaagtaatgtggcagcctgccttgagaagaggtcggggcctgcaggcacaaggctacggcgttagaatccaggatgccggtgtgtatctcctgtacagtcaggtcctttttcaggatgtcaccttcacgatgggccaagtcgtctcaagagaaggtcaggggaggcaggagactctgttccgctgcatccgaagcatgcctagccacccagatcgggcctacaattcgtgctacagcgccggcgttttccatctacaccagggcgacatcctatccgtgataatacccagggcaagagctaagctgaatctgtcccctcacggcacttttctcgggctgtag

SEQ ID NO: 9375 - DNA, 39 bp, Artificial Sequence
  Description of Artificial Sequence: Synthetic coding sequence
atgggcaagagcgagagcctgcagagcctgcagcggtag

SEQ ID NO: 9376 - DNA, 4266 bp, Artificial Sequence
  Description of Artificial Sequence: Synthetic coding sequence
atgatgctgccccagaacagctggcacatcgacttcggccggtgctgttgtcatcagaatttgttcagtgccgtggtcacttgtatattgctgcttaacagctgctttctcatctctagctttaatgggaccgacctcgagctgaggctggtgaatggcgacgggccttgttcagggacggtggaagtcaaatttcagggccagtggggaaccgtgtgcgacgacgggtggaacacaacagcttctactgtcgtctgcaagcaactgggatgtcccttcagcttcgctatgtttcgctttgggcaagccgtaacccgtcacgggaaaatctggctcgacgatgtgtcttgttacggaaatgaaagtgctttgtgggaatgtcagcacagggagtggggtagtcacaattgctatcatggtgaggacgtaggtgtgaactgctacggcgaggccaatctcggtctgcggcttgtggacggcaataattcgtgctccggccgagtggaagtgaaattccaggaacggtggggaactatctgcgacgacggctggaacctaaataccgccgccgtggtgtgtaggcagctgggctgtccctcgagctttatcagcagcggggttgtgaattcaccagccgtgctgaggcctatatggctcgacgacattctgtgccaaggcaatgagctggcactgtggaattgccgccatcgcgggtggggcaaccacgactgtagccacaacgaagatgtaactctgacttgctacgactcgagcgatttggagttgaggctggtggggggcaccaataggtgtatgggccgtgtggaactgaagatccagggtagatgggggaccgtctgtcaccacaaatggaacaatgcagctgccgacgtagtgtgtaagcagctgggatgtggaaccgcactgcacttcgcagggctgccgcacctgcagtctggttctgatgtggtttggctggacggagtgagctgcagcggcaatgaaagctttctgtgggattgcagacactcaggcactgtgaatttcgattgtctgcatcagaacgacgtgagcgtgatttgttcagacggggcggacctggagctaaggttggccgatggaagcaacaactgcagtgggcgtgtcgaggttcgtatccatgagcagtggtggactatttgtgaccagaactggaagaatgaacaggctctggtcgtgtgcaagcagctggggtgcccattttcagttttcgggtctcgccgcgctaagccaagtaacgaggccagagatatttggattaattcaatctcctgcacaggtaacgaatcagccctgtgggattgtacttacgatggcaaggcaaagagaacgtgttttcgacggtcagatgccggagtaatttgttcagacaaggccgacctagatttacggttggtcggagcccattcgccatgctacgggaggctggaggtgaagtaccagggtgagtggggaactgtctgtcacgatcgctggtccactagaaatgcggctgtggtgtgtaagcagcttggctgcggaaaacccctgcatgttttcggcatgacctacttcaaagaggcttctgggccaatatggctggacgacgtcagttgcatcgggaacgagagtaatatatgggattgtgagcacagcggatggggaaaacacaactgtgtgcaccgcgaagacgtaatcgttacctgcagcggagatgctacctggggtctgcggctggtgggggggagtaaccggtgtagtggtaggcttgaagtgtacttccaaggacgatggggtaccgtttgcgatgacggctggaacagtaaggccgctgcagtcgtctgtagtcagctcgattgcccgtccagtatcatcggaatggggctcgggaacgcaagtacagggtatggaaagatatggttagacgatgtctcttgtgacggcgacgagtccgatctgtggtcctgccgaaacagcggctggggcaataatgattgctcacactcagaagacgtgggcgtgatttgttcggacgcttccgatatggaacttcgcctggtgggtggctcttctaggtgcgcagggaaggtggaagtcaacgttcagggcgctgtggggattttgtgtgcaaacggatggggaatgaatattgccgaggtcgtatgtaggcagctggagtgtggttcggcaattcgcgtttctcgcgaaccccactttacagaaaggaccctccatatactaatgtccaacagcggctgcacggggggagaagccagtttgtgggattgtattcggtgggaatggaagcagacagcctgccatctcaacatggaggcatctttgatctgtagcgctcatagacagccccgactggtgggggccgatatgccgtgtagcgggagggtggaagtgaagcacgccgacacctggcgttcggtgtgtgatagcgacttttccttgcacgccgcaaatgtgttgtgccgggagcttaactgtggcgatgcaatttccctgagcgtgggtgaccacttcggaaaggggaacggactgacctgggcagagaagttccagtgcgaggggtctgagacacatctggccctctgtccaatcgtgcagcatcccgaagacacgtgtatccacagccgggaggtgggagttgtttgtagccggtacactgatgtccggctcgtaaatggaaaatctcagtgcgatggccaggtggagatcaacgttctcggccactgggggagcctgtgcgacacacactgggatccggaggacgcccgggtcctatgtagacaattatcttgtgggacagcgctgagtactacaggcggcaagtatataggagagagatccgttcgggtgtgggggcacaggttccattgtctcgggaacgagagcttgcttgacaattgtcagatgaccgtgctcggggcacctccctgcatccatggaaacactgtcagcgtgatatgtacaggttctctgacccagcccctgttcccatgcctggctaacgtgtctgacccgtacctttctgcagtgcccgaaggctcagccctcatatgcttggaagataaaaggctgagactggtcgacggagactcgcgatgtgccgggcgtgtggagatctaccacgatgggttctggggcaccatttgtgatgacggatgggatctgtccgatgcccacgtggtgtgtcaaaaattgggatgtggcgttgcgttcaatgccactgtgtccgctcattttggcgagggttctggcccaatatggctggacgacctgaactgtacgggtatggagagccacctgtggcagtgccccagccgaggttggggtcaacacgattgcaggcacaaagaggacgccggagttatctgttccgaatttacagccctgaggttatacagtgagactgagacagagagctgcgctgggcgcttagaggttttctataatgggacatggggctccgtgggaaggagaaatattaccactgccattgctgggatcgtgtgccggcagctggggtgtggcgagaacggtgtggtgtccctcgctcctctgtcaaaaaccggctcagggttcatgtgggtggacgatatacagtgccccaaaactcatattagtatctggcagtgcctgtccgccccgtgggagcggcgtatctcttccccggccgaggaaacttggatcacgtgtgaggatagaatcagggtccgcgggggagacacagaatgtagtgggagagttgaaatttggcatgctggatcatgggggactgtttgcgatgacagctgggacctcgctgaagcggaagtggtgtgccagcagctgggatgcgggagcgccctggccgccctgcgggatgcctccttcggacaaggaaccgggaccatttggttagacgatatgaggtgcaaagggaacgagagcttcctgtgggactgccatgcgaaaccttggggccaaagcgattgtggtcacaaggaggatgctggcgtacggtgttctggccagtcactgaaatccctgaacgcaagtagcggccaccttgccctgattctctcttcaatttttggcttactactgctggtgctcttcatactgttcctcacctggtgtcgggtgcagaagcagaagcacctgcccctgagggacgatacaccaaaccacggttgcgaggatgcaagcgatacgtccttgttgggcgtcctcccggctagcgaggctaccaaatag

SEQ ID NO: 9377 - DNA, 1410 bp, Artificial Sequence
  Description of Artificial Sequence: Synthetic coding sequence
atgatcaccgagggcgcccaggccccccggctgctgctgccccccctcctgttgctattaaccctgcccgccaccggctcagatcctgtgctttgtttcacacaatacgaagagtcctctggaaagtgtaagggactgctgggaggaggagtgagtgtggaagactgttgtctgaatacagcattcgcctaccagaagcggagtggaggattgtgtcagccatgccgttctccccggtggtccttgtggtctacctgggctccctgctcagttacgtgttccgagggcagccagcttagatatcgtcggtgcgtggggtggaatggtcaatgtagtggcaaggtggcgcccggaaccctcgagtggcaactgcaggcctgcgaagaccagcaatgttgtccagaaatgggaggttggagcggttggggtccttgggaaccctgttcggtgacctgctccaaaggcacacgcacacgccggagagcttgtaaccaccctgcccccaagtgcgggggacactgcccgggccaggcgcaggaatctgaggcctgtgacacccaacaggtctgccctacccacggtgcttgggccacatgggggccctggaccccatgttctgctagttgccacgggggcccacatgagccaaaggagacccgaagtcgaaaatgttccgcccctgaaccctctcagaaaccccctggaaagccatgtcccgggctcgcttatgagcagagaagatgtactggcctccctccatgtccggttgcaggaggctggggaccatggggaccagtcagtccctgtcccgtaacatgtggcttaggccaaactatggagcagaggacttgcaaccaccctgtacctcagcacgggggccccttctgcgccggcgatgccactcggacacatatttgtaatactgctgtcccgtgcccagtggacggggaatgggatagttggggggagtggagcccgtgcatacgacggaacatgaagagtatttcctgccaggaaattccaggccagcagtccaggggccggacatgcagaggacggaagttcgatggccatagatgtgcggggcaacaacaggacattaggcactgctattcgattcagcattgtccactgaagggcagctggagcgaatggagcacctggggactttgtatgccaccgtgcggtcccaatcctaccagggcaaggcagaggctgtgtactcctttgctgcccaaatatccgcccaccgtgagcatggtggagggacaaggagaaaagaatgtgacattctgggggagacctcttcctcggtgcgaggaactccagggccagaagttagttgtcgaggagaagcggccttgtctgcacgtgccggcctgcaaggatcccgaggaggaagagctatag

SEQ ID NO: 9378 - DNA, 837 bp, Artificial Sequence
  Description of Artificial Sequence: Synthetic coding sequence
atgcagtggctgcgggtgcgggagagccccggcgaggccaccggccaccgcgtaaccatgggaacagccgctctggggccggtgtgggcagccttgttgctcttcctgttaatgtgtgagatcccaatggtggagctgacattcgatcgtgcagtcgcctcgggttgtcaaaggtgttgcgactccgaagacccactagatccagcacacgtgagtagcgcaagctctagtgggagaccacatgccctccctgagattcgcccatacattaacattactatactgaaaggggacaagggtgacccaggtccaatggggcttccggggtacatgggcagagaggggccccaaggtgagcccggaccacaaggttccaaaggtgacaaaggagagatggggtcaccgggcgcaccctgccagaagcggttcttcgcattctctgtgggcaggaaaacagcgctccactctggcgaggacttccagacattgctatttgagcgagtgttcgtcaatctggatggatgttttgatatggcaactggccaattcgcagccccattgaggggcatatacttcttttccttgaatgttcactcctggaattataaagaaacatacgtgcacattatgcacaaccagaaggaagcagttattctgtacgcccagcccagcgaacgctctatcatgcagagccagtcagtgatgctagatctggcttacggggatcgggtgtgggtgcggctgtttaaacgacagcgcgaaaatgctatctattccaacgattttgatacctacatcacattcagcgggcacctcatcaaagccgaagatgattag

SEQ ID NO: 9379 - DNA, 1128 bp, Artificial Sequence
  Description of Artificial Sequence: Synthetic coding sequence
atggagttcgagatcaccttccggcccgacagcggcgacggcgtgctgctttatagctacgacaccggttctaaggacttcctcagcattaatctggcaggcgggcacgtggaatttaggtttgattgcggctcagggaccggagttctgcgatctgaggatcctttgacacttggcaattggcatgagctgagggtctcgcggacagccaaaaatgggattctacaggtggacaaacagaagattgtcgagggcatggcagaaggtggctttacccagatcaaatgtaataccgatatcttcattgggggcgtgcccaactacgatgacgtcaaaaagaactctggcgtgctgaagccattcagtggctccattcaaaaaattattttgaatgacagaactattcacgtgaagcacgattttacaagcggggtcaatgtggagaacgctgcccatccctgtgttagggccccttgcgcccacggcggctcctgtcggccgcggaaggaaggatacgattgtgactgtcctctggggtttgaaggattgcattgccagaaagccattatcgaggctatcgagattccacaatttattgggcgctcctatctgacttacgacaatcctgatattctgaagagggtctcaggatcgagatcaaatgtctttatgagatttaagaccactgccaaagatggcctcttactgtggcggggcgactcccctatgaggccaaattctgattttatcagcctgggcctgagggacggcgcactggtgttcagttacaatcttggcagcggcgtggctagtatcatggtgaatggctctttcaatgatggccgctggcatagggtcaaggcagtgagggacgggcagtcaggaaaaatcacagtggatgactacggggcccgtaccggaaagagtcccgggatgatgcgtcaactgaatatcaacggagccctctacgtaggtgggatgaaagaaatcgcactgcatacgaatcggcagtatatgaggggtctggtagggtgtatatctcattttacgttatccacagactaccacataagcctggtggaggatgccgtggacggcaaaaatattaacacatgcggcgccaaatag

SEQ ID NO: 9380 - DNA, 459 bp, Artificial Sequence
  Description of Artificial Sequence: Synthetic coding sequence
atgcggttcaagaccaccgccaaggacggcctgctgctgtggcggggtgactccccaatgcggccgaactccgattttatctccttgggcctcagggatggcgccctggtgttcagctacaacctgggtagtggagtggcatcaataatggtgaacggcagttttaacgacgggcggtggcaccgtgtaaaagctgtaagggacgggcagtcaggcaagatcacagtggacgattacggggctagaacgggcaaatcacccggaatgatgcgtcagcttaatataaacggcgccctgtacgtggggggcatgaaggagatagccctgcatactaaccggcaatatatgcgcggcctggtaggatgcataagtcatttcactctgtctaccgattaccatatttctctggtcgaggacgctgttgacggtaaaaatatcaatacatgcggagcgaagtag

SEQ ID NO: 9381 - DNA, 1050 bp, Artificial Sequence
  Description of Artificial Sequence: Synthetic coding sequence
atgaccgccctgcccggccccctgtggctgctgggcctggccctgtgtgcactgggggggggaggccctggcctgcggccaccccccggctgccctcaaaggcggctgggagctcgggaaaggcgcgacgtccagcgggaaattctggccgttctcggcttgccaggcagacctaggccacgggctcccccagcggcgtcccggttgcctgcgagtgcgccattgttcatgctagatctgtaccatgccatggcaggggacgacgatgaggacggcgcacccgctgagaggagactcggcagagcagatctcgtgatgtcattcgtgaacatggtagaaagggaccgggccttgggccatcaggaaccccactggaaagaatttaggttcgacctgacacagatacctgccggagaagccgtgacagccgccgagttcagaatatataaagtgccttcaatacacttactgaaccgcaccttacacgtcagtatgttccaggtggtccaggagcagagtaatcgcgagtcagacctgtttttccttgaccttcagacattgcgggccggcgatgaaggctggctggtcttagatgtgacagccgccagcgactgttggcttctgaagagacataaagatctggggctgcgtctctacgtagagaccgaggatggtgagacatggactggctggggttggacaaaggattcaagacttcagatgtggaaattaagactgtctcggaccccgtgggtgctctctctgcacgcccctgggccagcacaggcaccagctgagcgcccgcttctgtgcctcttgcagggacattgtccagccagcccatctcccatcaggaccccgcgtgctgtcaggcctctccggcgacgtcagccgaaaaaaagtaatgagctgccccaagccaatagactacccggaatcttcgatgacgtccatggtagtcatggacgccaggtgtgcaggaggcacgagctttacgttagcttccaagatctgggttggctggtcatcgctgacagcagttgcttctag

SEQ ID NO: 9382 - DNA, 1617 bp, Artificial Sequence
  Description of Artificial Sequence: Synthetic coding sequence
atgagcttcagcgccaccatcctgttcagcccccccagcggcagcgaggcgcgctgctgttgctgtgcttgcaaatcagagactaatggcggcaatacaggtagccaggggggcaatcccccaccatccacccccatcacggtaacaggccatggacttgcggtgcaatcatcagagcagctccttcacgtgatctaccagcgggtcgacaaggcggtcggcctggcagaggcagccctgggcctggctagggccaataatgagttactcaaacgccttcaggaggaagtcggagatctgcggcagggaaaagtttccattcctgacgaagacggggagagccgggctcattctagtccaccagaggagcccgggcccctgaaagaaagtccaggcgaggccttcaaggccctgagcgcagtggaagaggagtgcgactccgtggggagtggggtgcaggttgtgatcgaggaactgagacagctgggcgccgcctctgtcggccctggaccactcggtttccctgcaacgcagagggatatgcggctgcccggctgcacactcgcagctagtgaggccgctccactgctgaatccattggtggatgactatgtcgcctctgaaggagctgtgcagcgggttctggtgcccgcatatgctaaacagctttccccagccacacagctggccatccagcgagctaccccagagaccggtcctgaaaacgggaccaagctccccccccccaggcctgaagatatgctgaacgccgctgcggccttggatagcgccttagaggaatccgggcctggcagcaccggagaattgaggcattcactaggtctcaccgtgtccccttgtcggaccagaggatctggacaaaagaacagtcggaggaaaagagacctggtcctgagcaagctggtccacaatgtccataaccatatcaccaatgataagaggtttaacgggagcgaatcaattaagagttcttggaacatcagcgtggtcaagttcctactggaaaaactaaagcaggagcttgtgaccagccctcataattacactgataaagagttgaaaggagcatgtgttgcctacttcttaactaagagacgggagtatcgcaactccttgaaccctttcaaggggctgaaggagaaggaagagaaaaagctgagaagtcggcgctaccgactgttcgccaatagaagctctattatgaggcatttcggtcccgaggatcagcgcttatggaacgacgtaactgaggaactgatgtccgacgaagaggacagtctgaatgaacccggcgtgtgggtggcacgacccccacggttccgcgcacagagattaactgagctgtgctatcatcttgacgcgaactccaagcatggcacaaaggcaaacagagtgtatggaccgccctccgaccggctcccctccgccgaagctcaattactgccacctgaattgtacaaccctaactttcaggaagaggaggacgagggaggagacgagaacgcgcctggttcaccttcgtttgaccagccacataaaacttgttgccccgatctcaatagcttcatagaaatcaaagtcgaaaaggacgaatag

SEQ ID NO: 9383 - DNA, 630 bp, Artificial Sequence
  Description of Artificial Sequence: Synthetic coding sequence
atgagcttcagcgccaccatcctgttcagcccccccagcggcagcgaggccaggtgctgttgctgcgcatgcaaatctgagacgaacggtggaaacacgggctcccaaggtggcaatccgccaccaagcacccccatcacagtcaccggtcatggcctagcagtccagtccagcgagcagttattgcacgtgatttatcagagggtagacaaagcggtgggactcgccgaagctgcactgggactcgcacgcgccaacaatgaactcctcaagaggctccaggaggaggtcggggatctgaggcaaggtaaggtgtctatacccgacgaagacggggagtctagggcacactcctccccgcctgaggaaccaggcccattaaaggaatccccgggcgaggcattcaaggccctgagtgccgttgaagaggaatgcgactccgtgggatctggggttcaagtagttatagaggaactgcggcagctcggggcggcgtccgtgggacccggccccctgggattccccgctacacagcgggacatgcgactcccagggtgcaccctggcagcaagcgaggccgccccgctcctgaaccccctcgtggatgactatgttgcttccgaagggtag

SEQ ID NO: 9384 - DNA, 1617 bp, Artificial Sequence
  Description of Artificial Sequence: Synthetic coding sequence
atgagcttcagcgccaccatcctgttcagcccccccagcggcagcgaggctaggtgttgctgctgcgcgtgcaaatcggagacaaacggcggcaatactggcagccaggggggcaacccacctcccagcacgcccattacagttacaggacatggactggccgtacagagctcagaacagttgctgcatgtgatttaccaacgcgttgataaggccgttggcctcgctgaggcggccttgggcttagccagggctaataacgaactcctgaaacggctgcaggaggaagtaggagacctgcgacaggggaaggttagtattcctgatgaagatggtgagagtcgcgctcattcgtcacctccagaagaacctggacctctgaaagaatctcctggagaagcatttaaagccctctcggctgtcgaagaggagtgtgattcagtgggaagtggggttcaagtggtgattgaagagcttcgccagcttggcgccgcctctgttggccccggacccttaggttttcccgcaacccagcgggacatgcgcctacctggatgcactttggcagccagcgaggccgcgccccttctgaatcctctcgttgacgactacgtggcatctgaaggagctgtccagagagtgcttgtgcccgcatacgccaagcagctcagcccagcgacgcagctggccatccaaagagccacccccgagacaggcccagagaatggaacaaagctgcctccgccccgacccgaggatatgctgaatgctgccgctgccctggactctgccttggaagaaagcggcccgggcagcaccggcgagctgaggcattctctggggctgacagtgtccccatgccgcactaggggatccggccaaaagaattcccggcgcaagcgggatctcgttctatcaaagctcgtccacaacgtgcacaatcacataaccaacgacaaaaggtttaatggctccgagtctattaagagctcctggaatatcagcgtcgttaagttccttttagagaagctgaagcaggagcttgtaacgtcaccccacaattacaccgacaaggagttgaagggagcatgcgtggcgtacttcctgacaaagaggagggaataccggaactcactgaatccatttaaaggcctgaaggagaaggaagaaaagaagctgcgttccagacggtatcggctttttgccaataggagctccatcatgagacattttggaccggaggaccaacgcctgtggaatgatgtaactgaagaactcatgtccgacgaggaagatagccttaacgagccaggcgtatgggtggctcgcccacctcgcttcagggcccagagattaactgaattgtgctaccacctcgatgctaattctaaacatggcacaaaggccaacagggtgtatggtcccccaagtgaccgcctccccagcgccgaagcccagttacttccccctgagctttataacccaaattttcaggaggaagaggatgagggaggcgacgagaatgcccctggttcaccctcatttgatcagccacataagacatgttgtcctgatcttaacagtttcatcgaaattaaggtggagaaagatgagtag

SEQ ID NO: 9385 - DNA, 1524 bp, Artificial Sequence
  Description of Artificial Sequence: Synthetic coding sequence
atgtgcaccaagaccatccccgtgctgtggggctgcttcctgctgtggaacttatatgtctcttcttcacagacaatatatccaggcattaaggccagaattacacagcgagctctggattatggggtgcaagctggcatgaagatgatagaacaaatgctgaaggagaaaaagctgcccgacctgagtggatccgagagcctagagtttctcaaggtagattacgtgaactacaacttttctaatatcaaaatctctgcgttttcctttccaaacaccagtctcgctttcgtccccggagtaggaattaaggccctaaccaaccacggcacagcaaatatcagtacagattggggttttgaatcccctttgtttcaggacactggtggcgctgatctgttcctcagcggcgtttatttcaccggcatcatcatcttaacacgaaacgacttcggacatcctacactcaaactgcaggactgctacgctcaacttagtcacgctcacgtttccttttccggcgagctgagtgtgttatacaactcattcgccgagcccatggagaagcctatcctgaagaatctcaacgaaatgctttgtcccattatagcttcggaggtgaaggccttgaatgcaaacctgtccacattggaggtactgacgaaaatcgacaactatacactgctggactatagcctgatttccagccccgaaattacggagaactacctcgatctcaacctaaaaggcgtgttctacccactcgagaacctgacagaccccccctttagtccagtcccctttgtgctgcctgaacgatccaacagcatgctgtacataggcatagccgagtattttttcaaatctgcctcttttgcacacttcaccgccggagtgttcaatgtcacactttcaacagaggagattagtaaccacttcgtgcagaatagccaggggctgggaaatgtgctctcacggatcgccgagatctatattttgtctcagccatttatggtgaggatcatggccacagagccaccaatcattaacctccagccgggaaacttcactctggacatcccagctagtattatgatgttgacacagcctaagaactccacggtagaaaccatagttagcatggatttcgttgcaagcacttccgtgggcctggttattctgggacagcgactggtttgcagtctctctctgaatagatttcgcctggctttgcccgagtcaaatagatctaatattgaggtgctgagatttgagaatatcctgtccagtatcttacacttcggagtcctgccactagccaacgccaagctgcagcaggggtttcccttatctaaccctcataagtttctgttcgtgaactccgacatcgaggtgctggagggatttctgttaatctccaccgatctgaaatacgaaacaagtagcaaacagcaaccttccttccatgtctgggagggcttaaatctgatttctcgacagtggcgtggcaagagtgctccgtag

SEQ ID NO: 9386 - DNA, 753 bp, Artificial Sequence
  Description of Artificial Sequence: Synthetic coding sequence
atggccagcgagcggctgcccaaccggcccgcctgcctgctggtggctagtggggccgccgagggagtttctgcacagtccttcctgcactgttttacgatggctagcacagctttcaatctgcaggtagctacgccgggaggtaaggccatggaattcgttgacgtaactgagagcaatgcgagatgggtgcaggacttccgcctgaaggcctatgcctctccggcaaagctggaatcaattgacggcgcacgttatcatgcccttctcatccccagttgcccaggcgccctaaccgatctcgctagcagcggctccctggcccgcatactgcagcatttccattccgaatccaaacctatatgtgcagtcgggcacggtgttgccgccctgtgttgcgctactaatgaggaccgatcatgggtcttcgattcatattccctaacaggaccaagcgtgtgcgaattggtgcgtgcccctggattcgctaggctccctctcgtagtggaagacttcgtcaaggactcaggcgcgtgctttagcggggctgcggcatcatgcccaaaggccgaccggcactggcagcatttcccagtcgaggaaatttttctggcatgcgggtttaaagttgccgggttgggtgctgctcccgggtgggggagagggggcaaacaggaggaccgaccaccagaagaacagcgccgggctggagaggatttccctatctatcagtgcgtcttcatttatccctag

SEQ ID NO: 9387 - DNA, 1386 bp, Artificial Sequence
  Description of Artificial Sequence: Synthetic coding sequence
atgagcctggacatccagagcctggacatccagtgcgaggagctgagcgacgcccggtgggccgaacttttgcctttgcttcagcaatgccaggtagtcagactcgacgactgcggtttgacggaggcaagatgtaaggacatctcgtctgcattgagagtgaacccggcattggcagagttgaatcttagatcgaatgagttgggagatgttggcgtccactgcgtgctgcagggactacagactccatcctgtaagattcaaaaattatcattacaaaattgctgcctgaccggggccgggtgtggagtcctgtccagtaccctgcggacactgccaaccctccaggagcttcatctttctgataatcttttgggcgacgccggtctgcagctgctgtgcgaagggctcctcgacccacagtgccgcttggaaaagctccagctggaatactgttctttgtccgctgcaagttgtgagccactggcttctgttcttagagctaaaccagacttcaaggaactgactgtttctaataatgacattaacgaggccggagtccgcgtgctttgccagggcctgaaggatagtccttgccaattggaggcgctgaagctggagtcctgtggggtcaccagtgataactgcagggatctttgtggaatagtggcatcgaaggcttctctgcgggagcttgccctggggtcaaataagctcggtgatgtgggtatggcagaactttgccctggacttctgcacccatcttccagactgagaactctgtggatctgggaatgtggtattacggctaaaggttgtggcgacctttgccgcgtccttagggccaaagagtcgctgaaggagcttagtttggccggcaatgaactgggagatgaaggcgctagactgctttgcgaaacgctactggaacctggctgtcagctggagtcattgtgggtcaagtcatgttcctttacagccgcatgctgtagtcatttctcctcagtgttggcacagaatcgttttctgctggaactgcagatctccaacaaccggctcgaagacgcgggagtccgggagttgtgtcagggcctggggcagcccggcagtgttctgcgcgttttgtggctagctgactgtgacgtatcagatagctcatgctcctcactagccgcaacgcttctcgccaatcacagcctcagggaactggatctcagtaataactgtttgggggacgctggtattcttcagcttgtcgagagcgtaagacagccagggtgtctgttagaacaactcgtgttatatgatatctactggagtgaggagatggaggatcgactacaggccctggaaaaagacaaaccctccttgagagttatttcctag

SEQ ID NO: 9388 - DNA, 1386 bp, Artificial Sequence
  Description of Artificial Sequence: Synthetic coding sequence
atgagcctggacatccagagcctggacatccagtgcgaggagctgagcgacgccagatgggccgagctgttgcccttgctgcagcaatgccaggtcgtccgactggacgattgcggcttaaccgaagcacggtgtaaggatataagttccgccctacgggtgaaccccgccctcgctgagctgaatctgcgttctaacgagctcggggacgtgggagtgcattgcgttcttcagggccttcagacaccaagctgcaaaatccagaagctttccttacaaaactgctgcttaactggtgcaggctgtggagtgctgagtagtacattacgtactcttcccacactccaggaactgcacctgagcgataatttgctgggagacgccggcctgcagttgctgtgtgagggcctgctcgatccacagtgccgcttagagaagttgcagttagaatattgctctttgtctgctgcatcatgcgagcctctcgctagtgtcctgagggctaagccagacttcaaggaactgaccgttagcaataacgatatcaatgaggcaggagtgagggtcctttgtcagggacttaaggactctccttgccagctagaagcccttaagctggaatcatgcggcgtgacaagtgacaactgtcgcgatctatgcgggattgtggcctccaaagcctcactaagggagctggccctgggctctaataagttgggagacgttggcatggcggagctttgtcctgggctgctgcaccctagttcccggcttcgaacactctggatctgggaatgcggcattactgccaaaggatgcggagatttgtgtcgagttctgcgtgcaaaagagagcctgaaggagctgtcattagccgggaacgaactgggcgatgagggagcaagattgctctgtgagacccttctggaacccggttgccagttagaaagcctctgggttaaaagctgctcttttactgcagcatgctgctctcactttagcagtgtgctagcccagaaccgctttctcctggagctgcagatctcgaataacaggctcgaggacgccggcgtccgcgaattgtgtcaaggtcttggacagcctggctctgtgttgcgggtactgtggcttgctgactgcgatgtgtccgactcatcgtgttcctctctggccgccaccctcttggcgaaccactcactgagagaactcgatctgtctaacaattgtctgggtgatgcaggaattctgcagctggtcgaatctgtaagacagcccggctgtctcctggaacagctggtactgtacgatatctactggtctgaggaaatggaggaccgtctgcaggccttggaaaaggataaaccctccctgcgtgtgatctcgtag

SEQ ID NO: 9389 - DNA, 1386 bp, Artificial Sequence
  Description of Artificial Sequence: Synthetic coding sequence
atgagcctggacatccagagcctggacatccagtgcgaggagctgagcgatgctaggtgggcggagctgttgcccttactgcaacagtgccaggtggtgaggctggatgattgtggcttaacagaagcacggtgcaaggacatctcatcagcactacgagtcaatccagctttggcagaactcaatctgcggagcaatgagttgggggacgtgggggttcactgtgtgctgcaagggctccagacacctagttgtaagatccagaagctgagtctgcagaactgctgcctgaccggggccggttgcggcgtgctgagctccaccctgcggactctgcctactcttcaggagctccatctgagtgacaatctgctaggggatgctgggttgcaactgctgtgcgaaggccttctcgatcctcagtgccgcctggaaaagctacagctggagtactgtagcctgagtgctgcgtcttgcgagcctctggcctctgtgctccgcgccaaaccagactttaaggaactgacagtgtccaataatgacatcaacgaggccggagtaagagtgttgtgtcagggtcttaaggactctccatgccagttggaggcgttgaaactggagtcctgcggcgtcacgagcgataactgccgggacttgtgcggtatagtcgccagcaaggcgtccctgcgggagttggcattaggctcgaataaattgggtgatgttgggatggccgagctgtgtccaggtctgcttcacccctcatcaagattaaggaccctttggatttgggaatgtggcatcacggcgaaaggatgcggcgacctctgtagagtcctacgggcaaaggagagcctcaaggaattgtccctggctgggaacgagctgggggacgagggcgctaggctgctctgtgagactctcttggagccgggctgccagctggagagtttatgggtgaagagttgctcctttactgccgcctgctgtagccatttctcttctgttttagcccagaacaggtttctgttggaattacaaatttctaataatcgattggaggacgcaggagtccgagagttatgccaaggcctgggtcagcctgggtctgtgctcagggtattgtggttagcggattgtgacgtgtcggattcatcttgttcctctctggcagccaccctgctcgctaaccactcactgagagagttagacttaagtaacaactgcttgggtgatgccggcatcctgcagctcgttgaaagcgtgaggcaaccggggtgcctcctggagcagctggtcctatatgatatctactggtccgaagaaatggaagacagactacaggcacttgaaaaggataagccgtcactgagggtgatttcatag

SEQ ID NO: 9390 - DNA, 1452 bp, Artificial Sequence
  Description of Artificial Sequence: Synthetic coding sequence
atgatcaccgcccactgcagcctggacctgctgggcagcgtggccgttctatgcgtgtgcgatcttagccctgcgcagtgcgacataaactgctgctgcgatccggattgctcaagcgtggactttagtgtattctctgcgtgttctgtgccagttgtgaccggcgattcccagttctgttctcaaaaggcagtgatctactcacttaattttaccgccaacccaccgcagcgagtgttcgagttagtggatcagattaatccatctatattctgcatccatattacaaactacaaacccgcgttgtccttcatcaatccagaagttcccgacgagaacaatttcgatacccttatgaaaacttctgatggctttaccctgaatgctgagagctatgtctccttcactacgaagcttgatattcctactgctgccaagtatgagtacggcgtgccgcttcaaacgtctgattctttccttagattcccctcttctctgacctcctccttgtgtaccgacaataaccctgctgcattcttagtgaatcaggcagtgaagtgcacgcgtaagatcaatctcgaacagtgtgaagaaatagaagcattatcaatggctttttactcgagtcctgaaattctacgggtccccgattccaggaaaaaagttcccataactgtccagagcattgtaattcagagcctgaataaaaccctgacccgccgcgaggatactgatgtcttacagcctacactcgttaatgctggacacttcagtttgtgtgttaatgtggtgctggaagtgaagtactccctgacatacacggacgcaggagaagtcaccaaggcggacctcagtttcgtcctgggtactgtctctagtgtggtcgttcccctgcaacaaaagtttgaaatacacttcctccaagagaacacccagcccgtgccactgtctggaaaccctggctacgttgtcggattgcctcttgctgcaggcttccagccgcacaaaactggtgccttaccttgccagcttgtggctcagaaggtcaagtcgctcctctggggccagggttttccggactacgtggcacctttcggaaactcccaggcgcaagacatgctggattgggtgccaattcactttattacacagagcttcaaccgcaaacattttgtgctacaggactcgtgccaactccccggggcactggtcattgaagttaaatggacaaagtacggtagcctgcttaacccccaggcgaagattgttaacgtcacagcaaaccttatctcctcctcctttcccgaggcaaatagcggcaacgagcggaccattttaatatctactgctgttacattcgtggacgtgagtgcacctgctgaagctggcttcagagcccctccggcaatcaacgcacgacttccattcaatttcttcttccctttcgtgtag

SEQ ID NO: 9391 - DNA, 1596 bp, Artificial Sequence
  Description of Artificial Sequence: Synthetic coding sequence
atgtgccagctgctggagagcaccgtgatccagccccagggcgactcccccgtagcagttctgtgcgtgtgcgacctatctccggcccagtgtgatatcaattgttgctgcgaccctgactgttcttctgtggatttcagcgtgttctctgcatgttcggtacccgtggtcaccggagattcccagttttgtagccagaaagccgtaatatatagcctcaattttacagccaatcccccacagcgagtgttcgaacttgtagatcaaatcaatccttcaatcttctgtattcacattacgaactacaagcccgcacttagcttcataaatcccgaagttcccgacgagaacaatttcgatactctgatgaaaacctcagatgggttcactctgaatgccgagtcttatgtttcttttactacaaagctcgatattccgacagcagctaaatatgaatacggggtgcccctccagactagcgattcgtttctgcggtttcctagcagcctgacaagctcgctctgtacggacaacaacccagccgcgtttctggtgaaccaggccgttaaatgtacacgcaagattaatctagagcagtgcgaagagattgaggctttgtctatggcattttatagctcccctgagatccttcgggtgcccgacagccgtaagaaagtccctataactgttcagtccatagtgatccaatcgttgaacaagacactgacaagacgcgaggacaccgacgtcctccaacccaccttggtgaacgctggccatttctctctctgcgtgaatgtggtgctggaggtgaaatactccttgacttacacagatgcgggcgaggtgacaaaagcagatctttcttttgtgctggggactgtgagttcagttgtcgtcccactgcagcagaagtttgaaatccatttcctgcaggagaatactcagcctgtcccactgagtggtaacccaggatacgtcgtgggactgcccctggctgccggatttcagcctcacaaaatgagtgggattatccagacaactaatcgctatggtcagcttacaattctgcattctacaactgaacaagattgcctcgctttagagggtgtgcgtacccctgtgctgtttggctacacgatgcagtctggctgcaaattaagactaactggggctctgccctgccaacttgtggcgcagaaagtgaagtctcttctatggggccaaggcttccccgattatgtggctccatttggcaacagtcaggcacaagatatgcttgattgggtgccgattcattttattacccagagctttaatagaaaggactcctgtcagctcccaggcgccctagtgatcgaagtgaagtggaccaagtatggatccctcctgaatccccaagcgaagatcgtgaatgtgaccgccaatctgatctcttcatccttcccggaagcgaactcaggaaacgaaagaactatcctcatctctaccgctgtaactttcgtcgatgtgtcagcccctgcggaggcgggtttccgtgcaccccctgccatcaacgcaagactgccgttcaactttttttttccattcgtgtag

SEQ ID NO: 9392 - DNA, 1722 bp, Artificial Sequence
  Description of Artificial Sequence: Synthetic coding sequence
atgcggccccggggcctgccccccctgctggtggtgctgctgggctgttgggcttccgtgagcgctcaaacagacgccaccccggctgtgaccactgagggccttaatagtaccgaagccgcactagccaccttcggaacattcccatctacaaggcctccaggaactccgagggcccctggaccttcttctggcccaagacctacaccggtcacagatgtcgccgtgctgtgtgtgtgcgaccttagcccagcccaatgcgacataaattgttgctgtgaccctgactgcagttccgttgatttttccgttttttccgcctgtagtgtaccagtggtgaccggtgattcacagttttgctcccagaaggctgttatatattctctcaacttcaccgccaaccctcctcagcgggtgttcgaactcgtcgaccagataaatccatcaatcttttgcattcacatcaccaactacaagcccgcactgtccttcattaatccagaggtccccgacgagaacaattttgacacattgatgaaaacgtccgacggattcaccctgaatgcggagagctacgtgtcctttacaaccaagctcgacattcccaccgccgcaaagtacgagtatggcgtgcccctccagacttccgacagcttccttcgtttcccatcctctttaaccagctctctttgtaccgacaataatccagcgggccaggcctactggttcacgccggtgatcccagctctatgggaggcagaagcgcgtggctctctggaggtccccgattcccgtaagaaggtgccaataactgtacagtccattgtcatccagagtttgaacaagaccctgacccgcagagaagacacagacgttttgcaacccactctggtgaatgcgggccacttctcactgtgtgtgaacgttgtgctagaggtaaaatattccctgacctacaccgacgccggggaagtcactaaagctgacctctcattcgtcttagggacagtgagcagcgtcgtggtgcccctccagcagaagttcgagatccacttcttgcaggagaatacccagcctgtgcccttatccgggaatcctgggtatgtggtgggcctgcccctggcggcaggattccagccccacaagggatccggtattattcagaccacaaatagatacggccaattgactatcctccactcaaccacggaacaagattgtctggccttagaaggagtcagaactccagtccttttcggatacacgatgcagagcggctgcaaactgaggctcaccggagccctgccttgtcagctcgtggcgcagaaggtcaagtcacttttgtggggacaaggtttccctgactacgtggctcctttcggtaactcgcaggcccaggatatgctggattgggttccgatacatttcatcacacagtctttcaaccgaaaggactcctgccaattgcccggtgctttggtcattgaggtgaaatggaccaagtacggatcactgctgaacccgcaggctaagatcgtgaatgtaacggctaacttaatttcctcctctttccctgaagcgaattcaggcaacgagagaacgatccttatctccaccgctgtcacttttgtcgatgtgtcagccccagccgaggctgggttcagagccccaccggctattaatgcaagactgccatttaatttttttttccccttcgtgtag

SEQ ID NO: 9393 - DNA, 1230 bp, Artificial Sequence
  Description of Artificial Sequence: Synthetic coding sequence
atgaagaccagcgacggcttcaccctgaacgccgagagctacgtgtccttcaccactaagttggacatccctacagccgcgaagtatgagtacggggtgcccctgcagacctccgattcattcttgagattcccgtcctctctgaccagttctctgtgcacggataacaacccggcggctttcctcgtgaaccaggctgtaaagtgcacacgcaagatcaaccttgagcagtgtgaggagatcgaagccctctccatggcgttttatagtagtcctgaaatactcagagttcccgattcaagaaaaaaggtccccattacggtgcagagcatcgtgattcaaagtctgaacaagacccttaccaggcgcgaagacactgacgttttgcagcccacgcttgttaacgccggccactttagtctgtgcgttaatgttgtccttgaggttaaatacagtctgacttataccgacgctggcgaggtgaccaaggccgatctctcgttcgtactgggtacagtgagctcagtggtcgtgcctctgcaacagaaatttgagatacactttcttcaagagaacactcaacccgttcctctctctggaaatccggggtacgtggtgggcctgcccttagccgccgggttccagcctcataaaggatctgggatcatccagactactaacagatacggccagctgaccatcctccactctacaactgaacaggattgtctggcccttgagggtgtacggacacccgttctcttcggttataccatgcagtctggctgtaagttgcggttgaccggagctcttccctgtcagctggttgctcagaaagtgaaatccttgctctggggtcagggatttcctgactatgtcgcacccttcggcaacagccaagcccaggatatgctggattgggtgcctatccatttcataacacagtcctttaatcggaaagactcttgccaactccctggagccctcgtgattgaggtcaagtggaccaagtatggctctcttctcaatccacaggctaagatcgttaacgtgacagccaatctgataagcagctcgtttcccgaggccaacagcggcaatgagagaactatactgatcagtaccgcagtcacatttgtcgacgtgtccgcccccgccgaggctggtttcagggcaccccctgcgattaacgcaagactgccctttaatttttttttcccctttgtatag

SEQ ID NO: 9394 - DNA, 1779 bp, Artificial Sequence
  Description of Artificial Sequence: Synthetic coding sequence
atgcggccccggggcctgccccccctgctggtggtgctgctgggctgctgggcgtctgtgagtgctcagacagatgccactcccgccgtcacgactgaaggcctgaatagcacggaggcggcacttgccacattcggaacttttccctcgacccggccccccggaacccccagagctcctggcccctcatcgggcccacggcccacccctgtgacagatgtggccgtgctgtgcgtgtgcgacctgtctcccgcccagtgcgacattaattgctgctgcgatccagactgcagcagtgtcgacttctcagtgttctccgcttgctccgtcccagtggtcaccggagattcacagttttgcagccagaaagcagtgatatattctcttaatttcaccgcaaacccaccccaacgagtgttcgaattggttgaccagatcaatccatccatcttctgcatccacatcactaactataagccagcactctcgtttatcaatcccgaagtccccgatgaaaataacttcgatacattaatgaaaacatcagacgggttcaccttaaatgcagagtcctatgtgtcctttaccactaaacttgacatcccgacagcagccaagtatgagtacggcgtgcccctccagacctcagacagtttcctgcgctttccctcctctctgacaagttctctgtgtacagataataaccccgccgctttccttgtaaatcaggccgtgaagtgcacccgaaaaattaacctggagcaatgtgaggaaatcgaagccttgagtatggctttctactcttcacctgaaatcctcagagtgcctgacagcagaaaaaaggtccccataaccgttcagtctattgtgattcagtctctcaacaagacactaaccagaagagaggatacagacgtcttgcagccaacccttgtgaacgctggccatttcagcttgtgcgtcaatgtggtgctggaggtgaagtattctttgacctacaccgatgctggagaggtgacgaaagccgacttgagtttcgtactcgggactgtgtctagtgtggtggtgccattacagcagaaatttgaaatccatttcctgcaggaaaatacccagcctgtcccactctctggaaatcccggttacgtggtaggtctgcccctggctgctggcttccagcctcacaagggatctggaattatccaaaccacgaatagatacggtcagctgactatattgcatagcaccactgaacaggactgcctggccctcgaaggcgtgaggactcccgtactgtttggctataccatgcaatctggttgtaagcttaggctgaccggggccctcccctgccaactggtggcccagaaagtgaaaagcctcctgtggggtcagggatttccagactacgtggcccccttcggaaatagccaggcccaagacatgctagattgggtccctatacacttcatcacccagagttttaatcgcaaacactttgtgctgcaggattcctgtcagctaccaggtgcacttgttattgaggtgaagtggacgaagtacggcagtctgctgaatcctcaggccaagatagtgaacgttactgccaatctgattagtagctcttttcccgaggctaactccggtaacgaaaggaccatcctgatctccacagcggtgacgtttgtggacgtctctgcgccagccgaagcaggattccgcgctccgcctgccataaacgcccgcctcccatttaacttcttttttcccttcgtgtag

SEQ ID NO: 9395 - DNA, 552 bp, Artificial Sequence
  Description of Artificial Sequence: Synthetic coding sequence
atgatcttcctgctgctgatgctgagcctggagctgcagctgcaccagattgctgccttgtttaccgttacagttcccaaggagttatacatcatcgagcatggaagcaatgttaccttagaatgcaattttgacaccggctcccatgtgaatctgggggccatcaccgcatcactgcagaaggtggaaaatgacacctccccccaccgtgaacgggccacactgttagaggagcagctgcccttaggaaaagcctcatttcacattccgcaggtgcaagttcgcgacgaaggccagtaccaatgcatcatcatttacggagtggcttgggactataaatatttgacactgaaggtgaaaggtcaaatggagccccgcacccatcctacatggctcttgcatattttcatccccttctgtatcatagcctttattttcatcgcaacagtcatcgcccttcgcaaacaattatgccagaaactgtattctagtaaagacacaacaaagaggcccgtcacgacgaccaagcgagaggtgaattccgcaatatag

SEQ ID NO: 9396 - DNA, 822 bp, Artificial Sequence
  Description of Artificial Sequence: Synthetic coding sequence
atgatcttcctgctgctgatgctgagcctggagctgcagctgcaccagattgctgcattgttcaccgtaaccgtcccgaaagagttgtacatcatagagcacggttcaaatgtgacgctcgagtgcaatttcgataccggttctcatgtgaatctgggggccatcactgccagtcttcagaaggtcgaaaacgacacgagccctcatagagaacgggcaacactgcttgaagaacagttgccactgggaaaggcaagcttccacattccccaggtacaggttcgtgatgaggggcaataccagtgcatcataatatacggggtcgcttgggactataagtatctgacccttaaggttaaagcctcttaccgtaaaatcaacacacacatcttaaaagtgcctgagacagacgaagtagaactcacttgtcaggccacaggataccctctggctgaggtgagctggccaaatgtgtcagtcccagccaacacatctcattcacggactccagagggactgtatcaggtcacttccgtacttcgcctaaaacctccccccggccgaaacttcagctgtgtcttttggaatactcacgttagagagttgaccctcgcttctatagacctgcagagccagatggagccaaggactcaccctacctggctgctgcacatttttatacctttctgtatcatcgctttcatttttatagcaacagtgattgcactaagaaaacagttatgccagaaactctacagttctaaagatacaaccaaacgaccagtgactaccacaaaaagagaggtgaatagcgccatctag

SEQ ID NO: 9397 - DNA, 372 bp, Artificial Sequence
  Description of Artificial Sequence: Synthetic coding sequence
ctgggcgaccggcggggccggagcagcggcgcccgggccgccgccgtgggctcaacaggagagagattggaaatggaagaagatattttgcagctccaggccgaagccaccgccgaggtgttgggggaagtggcccaggcacaaaaggtgctgcgggacagtgtgcagcggcttgaggtgcagctcagaagtgcttggctgggacctgcctatagggaatttgaggttcttaaggcccatgctgataagcagtcccacatcctctgggccctgacaggacacgtgcagagacaaaggcgcgagatggtagctcagcaacataggctgcgacagatccaagagagactccatactgcagctctgccagcttag

SEQ ID NO: 9398 - DNA, 345 bp, Artificial Sequence
  Description of Artificial Sequence: Synthetic coding sequence
atggccagcttcaagctggccgacagcgtgtgggaggacagcctgtcaaagaggcagcgcaatcagggaagaatgaagaccctccctgtcctggtcctctcactgactctgctgaccgtgttctcggagaccagccctattctcactgagaagcaggctaaacaactgcttcgttcccgccgtcaggacaggccgagcaagcctggcttccccgacgagccaatgcgggaatacatgcaccacctgttggccctcgagcatagggctgaggaacagttcttggagcattggctgaacccacactgcaagccgcactgcgatcggaaccgaatccacccggtttag

SEQ ID NO: 9399 - DNA, 345 bp, Artificial Sequence
  Description of Artificial Sequence: Synthetic coding sequence
atggccagcttcaagctggccgacagcgtgtgggaggacagcctgagcaagcgccagagaaatcagggcaggatgaaaactttacccgtcttagtgttgtccctcacactcctcacagtattttcagagacctctcccatcttgaccgagaagcaggcaaagcagctcctccgttcaagaagacaggatcgtccttccaagcctgggtttcctgacgaacctatgcgtgaatacatgcatcatctcctcgcacttgaacatcgtgccgaagaacagtttctggaacattggctcaacccccactgcaaaccacactgcgatcggaatcgcattcaccccgtttag

SEQ ID NO: 9400 - DNA, 444 bp, Artificial Sequence
  Description of Artificial Sequence: Synthetic coding sequence
atggccctgcagcggacccacagcctgctgctgctgctgctgctgacactgcttggtctggggctggttcagccttcttacgggcaagacggcatgtaccaaaggtttttaaggcagcacgtgcatccggaagaaaccggaggttctgacagatactgtaatctaatgatgcagcggcggaaaatgaccctgtatcattgcaaacgttttaacacattcatccatgaggacatctggaatattcgatctatctgcagcaccacaaatattcaatgtaagaatggtaaaatgaattgccatgagggcgtggtgaaggtgactgactgcagagacaccggctcctctagggctcccaactgtcggtatagagcgatcgctagtactagacgagtggtcattgcctgcgaaggtaatcctcaagtgccagtccactttgatggttag

SEQ ID NO: 9401 - DNA, 1302 bp, Artificial Sequence
  Description of Artificial Sequence: Synthetic coding sequence
atggagccccagctgggccccgaggccgccgccctgcggcccggctggctagccctgcttctttgggttagcgcattaagctgcagcttctccttacctgcctcctcgttgagtagtttggttccacaggtacggaccagctacaattttggccggactttcctgggactggacaagtgtaacgcctgtatcggaacttccatatgtaaaaagttctttaaagaggaaatcagatccgataactggctagcctcgcatctgggtctgccacctgacagtctgttgagctatcccgctaattactctgacgattccaaaatctggcgccccgtcgagatattcaggctggtgtccaagtaccaaaacgaaatttcggaccgacggatctgtgctagcgctagcgctcccaaaacttgttccattgagcgcgtgttgagaaaaacagaaaggttccagaaatggctccaggccaaacgtctaactccggatttggtgcagggccttgcgtcgcccctgctgaggtgcccttcccagagattactggatagggttgtcaggcgatacgccgaagtcgccgatgctgggtctattttcatggatcactttacagaccgggataaacttcggctactgtataccctggcagtgaactcccatccgatcctgctgcagatcttccctggcgcagaaggatggcctctgccaaagtacctgggctcctgcgggaggttccttgtctccacaagcacgcgacctttacaggaattctatgatgcacctcccgaccaagcggccgacttggcatatcagctgctaggcgtgctggagtccttaagatccaacgatctgaactatttcttttacttcacccatattgacgctggcatgttcggcgttttcaataacggacacctgtttatcagggatgcttccgcggtgggagttatcgataagcaagagggttcgcaagaggctaacagagccggcgagaacaaggacattttttcctgcctcgtaagcggctgccaggcccagctgccgtcctgcgagtccatctccgaaaagcagtccttggtacttgtatgtcagaaactgctgccaaggctcctacagggccggttccctagccctgtccaggacgacatcgattccatccttgtccagtgcggagacagtattcgtccggaccctgaggtactgggtgctgcctcacagctgaaagacattctccggccccttagaacttgcgacagcagatttgcgtacaggtatccagattgtaaatataacgataaattctag

SEQ ID NO: 9402 - DNA, 600 bp, Artificial Sequence
  Description of Artificial Sequence: Synthetic coding sequence
atggagaccttccccctgctgctgctgagcctgggcctggtgctggcagaggcttcggaatcaactatgaaaatcattaaagaagagttcaccgatgaggagatgcagtatgacatggctaagtcaggccaggaaaaacagaccattgagatactcatgaacccaatcttgctggtaaagaatacgtcactctctatgagtaaggacgatatgagttctaccctgctgacctttaggagtctccattacaacgaccctaagggtaatagcagcggaaatgataaggaatgttgcaatgacatgacagtttggagaaaggtgagcgaagccaatggtagttgcaagtggtccaacaatttcattcggagctcaaccgaggttatgaggcgagtccatcgcgcacccagttgcaagtttgtacagaaccccggcatatcctgttgtgaaagcctagagctggaaaacactgtatgtcagttcaccacagggaagcagtttcctaggtgtcagtatcattccgtgacctccctcgagaagatattaactgtactgaccggccacagtttgatgagctggctcgtgtgcgggtcgaagctgtag

SEQ ID NO: 9403 - DNA, 600 bp, Artificial Sequence
  Description of Artificial Sequence: Synthetic coding sequence
atggagaccttccccctgctgctgctgagcctgggcctggtgctggcggaggcgtcagagagtaccatgaagattattaaggaggaatttaccgatgaggagatgcaatatgacatggcgaaatccggacaggagaaacagacaatcgagatcctgatgaacccgatcttgctggtgaaaaatacatctctgagtatgtccaaggacgacatgagttctaccctgctgactttccgttcactccattataatgatccaaagggtaacagcagcggaaatgacaaagaatgttgtaatgatatgaccgtatggagaaaagtaagtgaggctaatggaagctgtaagtggtctaataattttatacgaagttccactgaggtgatgcgccgggttcacagagccccctcctgtaagttcgtgcagaaccctggtatctcttgctgcgaatcactggagctcgaaaacacagtatgccagttcacaactggaaaacaatttccaaggtgtcagtaccatagcgtcaccagtctggagaaaatcctgaccgtgctgaccgggcattccttgatgtcctggctggtttgcggtagtaagctttag

SEQ ID NO: 9404 - DNA, 291 bp, Artificial Sequence
  Description of Artificial Sequence: Synthetic coding sequence
atgctgccctgcctggccctgctgctgctgatggagctgagcgtgtgtacagtggccggagatggcggggaagaacagacactgtccaccgaggccgaaacctgggagggggcaggtccttcaatccagctgcagctccaagaggttaaaactggtaaagcgtcccagttctttggactgatgggcaaacgcgtcggcgcctatcagctggagcatacatttcagggcctgctgggtaagcgaagtttgtttaccgaggggcgtgaggacgaggctcagggtagcgagtag

SEQ ID NO: 9405 - DNA, 981 bp, Artificial Sequence
  Description of Artificial Sequence: Synthetic coding sequence
atgaccggcctgtgcggctacagcgcccccgacatgcggggcctgagattgattatgattcccgtagaactgttgttatgttacttgctcctgcacccggtcgacgccacctcatacggaaagcagacaaacgtgttgatgcactttcccctctcactggagagccaaactccttctagtgacccactctcatgtcagtttctgcatcctaagtcactgcctggcttctctcacatggctcccctgcccaaattcctggttagtctcgcgctgcgaaatgcactggaagaagcggggtgccaagccgacgtttgggctctgcagctgcaattatatcgccaaggtggggttaacgctactcaggtcctcatccagcatttgcggggacttcagaagggtcgcagcactgaaagaaatgtctccgtcgaggcgttggcctccgccctccagttgctggccagggagcagcagtccaccggacgcgtgggcagaagtttgccaactgaagattgcgaaaatgaaaaggagcaggctgtccataacgtagtgcagctgcttcctggtgtggggaccttttataacctcggcacggcgctgtattacgctacccagaattgtttgggaaaggcccgcgaaagggggcgggacggagccatagacctaggatatgacttgcttatgacaatggcaggtatgtcaggggggcccatgggcctggcaatatccgccgccctgaagccagcactgaggagcggcgtgcaacagcttattcagtactatcaggatcagaaggacgccaacattagtcagcccgaaaccaccaaggagggactacgggccatttccgacgtgtccgatcttgaagaaactaccactctggcctccttcatcagtgaagttgtctctagtgccccctattggggctgggctattattaaaagctacgacctggaccccggcgccgggagcttggagatatag

SEQ ID NO: 9406 - DNA, 1476 bp, Artificial Sequence
  Description of Artificial Sequence: Synthetic coding sequence
atgcggtggatcctgtgctggagcctgaccctgtgcctgatggcccagacagccttgggggccctgcataccaagagaccacaggtcgtgacaaaatatggaactcttcaaggaaagcaaatgcatgtggggaagacacctatccaggtgtttctgggcgtcccattctctcggccccctctgggaatcctccgatttgcgccgcctgagcccccggagccctggaagggaatcagggacgccactacatatccgcctggttgcctgcaggaatcttggggacaactggccagcatgtacgtgtctacaagggagcgatacaagtggctgcggtttagcgaagactgcctgtatctcaacgtctatgcccccgcacgagctcccggcgacccccaactgccagtcatggtgtggttccccggaggagcctttatcgtgggagctgcatcctcttacgagggttccgatctggcagcaagagaaaaagtggtactcgtctttttgcagcaccggttaggcatattcgggttcctgtcaaccgacgactcccacgctagagggaactggggactgttagaccagatggctgcactgaggtgggtccaggaaaatattgctgcgttcggcggagatcccggcaacgtaaccctgttcgggcaaagcgccggcgccatgtcgattagtggattgatgatgtctcctctggccagtggactgttccaccgcgccatatctcaaagcggtacagcgctcttccggctgtttattacctccaatcctctgaaggtcgcaaagaaagtagcccacttagctggatgtaatcacaactccacccagatcctagttaactgtctgcgcgccctttcagggactaaggtgatgagggtgtctaacaaaatgagattcttacaattgaactttcaacgcgatccagaggagataatctggtccatgtcacccgtcgtggacggtgtggtgattccagacgatcccctggtcctgcttacgcaaggcaaggtgagcagtgttccttatctgctgggagtcaacaacctggagttcaactggctgcttccttataacataaccaaagaacaagtccccctggtggtggaagagtacttggacaatgttaatgagcatgattggaaaatgctccggaacaggatgatggatattgtgcaggacgcaacctttgtttacgccacgctacagacagcgcattaccacagagggctgtctatgggcaaggagaaggcactgtctctgcagatgatgaaatactgggctaattttgccagaacaggtaatcccaatgatggtaatctaccatgctggcctaggtacaataaggacgagaaatatctccagctcgatttcactacacgcgtgggcatgaagttgaaggagaaaaagatggctttctggatgagtttataccagtcacagcgccctgagaagcaaaggcagttttag

SEQ ID NO: 9407 - DNA, 285 bp, Artificial Sequence
  Description of Artificial Sequence: Synthetic coding sequence
atggccgccttcccccacaagatcatcttcttcctggtgtgcagcacgctaacacacgtcgcattctcaggaatctttaataagagagatttcacccggtggccgaagcctcgctgcaagatgtacatcccactggaccccgactataacgcagactgccctaacgtaacggcgcccgtatgcgcttccaatggtcataccttccaaaacgaatgttttttctgtgtggagcagcgggagttccattacagaattaagtttgaaaagtatgggaaatgtgattag

SEQ ID NO: 9408 - DNA, 402 bp, Artificial Sequence
  Description of Artificial Sequence: Synthetic coding sequence
atgcggcagcggctgctgcccagcgtgaccagcctgctgctggtggcgctgctgttccccggcagctctcaggcaaggcacgtgaatcacagtgcaactgaagccctaggcgaactgcgagagcgcgcgccaggacaaggaacaaacggctttcagctgctaagacatgctgttaaaagagacctgttgcctcctcggacaccgccctatcagggtgatgtgccccctgggatccgtaataccatttgtcatatgcagcaaggaatttgccgattattcttttgtcactctggagaaaaaaagagagatatatgctcggatccgtggaatagatgttgtgtcagtaataccgacgaagaagggaaggagaagcccgagatggacgggaggtcagggatctag

SEQ ID NO: 9409 - DNA, 564 bp, Artificial Sequence
  Description of Artificial Sequence: Synthetic coding sequence
atgggctgctgcggctgcagcggcggctgcggcagcggctgcggcgggtgcgggtcaggatgtggtgggtgcgggagcagctgttgcgttcctatttgctgttgtaaacctgtgtgttgctgcgtgcctgcatgctcttgtagctcatgcggatcttgcggtggatcaaaaggagggagagggagctgcggcggttctaagggcgactgcggcagctgcggcgggtctaagggaggatgcggatcctgtggttgcagccaatgctcctgttataaaccatgctgctgtagtagcggctgcggaagtagctgctgccaatcgagctgttgcaaaccttgttgtagccagagcagctgctgtaagccatgctcttgctcctccgggtgcggcagctcttgctgccagtcctcatgctgcaaaccctgttgtagtcagtcatcatgctgcaaaccgtgctgctgctcctccggctgcgggtcaagttgttgtcaatccagctgctgtaaaccgtgctgctcccagtcaagttgttgcgtgccaatttgttgccagtgcaagatctag

SEQ ID NO: 9410 - DNA, 564 bp, Artificial Sequence
  Description of Artificial Sequence: Synthetic coding sequence
atgcggcccctggccggcgcccccgtgcccaagcggcagaagtgcgatcactggactccatgcccttctgatacatatgcctataggctgctgagcggggggggcaggtcgaaatacgctaaaatctgctttgaagacaatctcctcatgggggagcagctggggaacgtggctcgcggcatcaatattgcaattgtaaattacgtcaccggcaacgtaaccgcaactcggtgttttgacatgtatgaaggggataactctggccccatgactaaatttatccagagcgctgcccccaagagcctcctctttatggttacctacgatgatggcagtactcgccttaacaacgacgccaaaaatgctatagaagcgttgggtagtaaggaaatccgcaatatgaagtttaggtcaagctgggtgttcattgccgccaagggcctcgagctgccgtctgaaatccaaagggagaagatcaaccatagcgatgcaaaaaacaacaggtattccgggtggccagcagaaatacagatcgagggctgcattccaaaggaacgctcctag

SEQ ID NO: 9411 - DNA, 249 bp, Artificial Sequence
  Description of Artificial Sequence: Synthetic coding sequence
atgaagatcctgtgcatcttcctgaccttcgtgttcaccgtgagctgtggcccgtccgtcccccaaaagaaaacccgtgaggtagctgagcgaaagcgagagtgtcaactggttaggggcgcttgtaaacctgagtgcaattcctgggagtacgtgtactactattgcaacgtcaatccatgttgcgccgtctgggaatatcagaaacccatcatcaataaaattacctccaaactgcaccaaaaatag

SEQ ID NO: 9412 - DNA, 186 bp, Artificial Sequence
  Description of Artificial Sequence: Synthetic coding sequence
atgaagatccacgtgttcctgttcgtgctgttcttcttcctggtgccgatcgccactagggtgaagtgtgctgttaaggacacatattcttgttttataatgagggggaagtgccgacatgagtgccacgatttcgagaaacctatcggattctgcactaaactcaatgccaattgttacatgtag

SEQ ID NO: 9413 - DNA, 1056 bp, Artificial Sequence
  Description of Artificial Sequence: Synthetic coding sequence
atgggcaacctgttcatgctgtgggccgccctgggcatctgctgcgccgccttctccgccagtgcatggagcgttaacaactttctaatcacaggaccaaaagcatacctgacttatacaactagcgtcgcgttaggcgctcagtctggaatcgaggagtgcaaattccagttcgcgtgggagcgttggaactgccccgaaaacgccctgcagctgtctacacataacagactgcgctcagccacccgtgagacctcatttatacacgccattagttccgcaggcgtcatgtatataattactaagaactgttcaatgggggattttgagaattgtgggtgtgatggaagcaacaacggaaaaactgggggtcacggatggatctggggtggatgttctgacaacgttgaattcggcgaaaggatctctaagctgttcgttgacagtttggaaaaaggaaaagacgccagagctctaatgaacttgcataataacagagccggtcgcctcgccgtgcgagccacgatgaagcgaacctgcaagtgtcatggtatctccgggagctgcagcattcaaacttgttggctccagctcgccgaattccgggagatgggtgactacctgaaagctaaatatgaccaggcgctcaagatcgaaatggacaaacgtcagctgagagctggaaactctgctgaaggacattgggtgcccgctgaagctttcctgccttctgccgaggccgagctgatctttctggaggagtcccccgactattgtacatgcaattcgtctctggggatttacggaaccgaaggacgcgagtgcctccagaactcccacaacacaagtaggtgggaacgccggagctgcggacggttgtgtacggaatgtggcctacaggtcgaggagcgtaagaccgaggttatcagcagttgcaactgcaaattccagtggtgctgtacggttaagtgcgaccagtgtagacacgttgtgtccaaatactattgtgcccgcagtcctggcagcgcccagtccttagggaaaggatccgcttag

SEQ ID NO: 9414 - DNA, 1446 bp, Artificial Sequence
  Description of Artificial Sequence: Synthetic coding sequence
atgcagagccggctgctgctgctgggcgcccccggcggccacggcggccctgcaagccgcagaatgcggctcttactgagacaggtcgttcagaggcgacccggaggcgacagacagaggccagaggtacgcctgctccacgccggatcaggggctgatactggcgacaccgtgaacatcggtgatgtgagctacaaacttaagatcccaaaaaacccagagctggtgccgcagaattatatttccgacagcctggcacaatccgtggtgcagcacctccgctggatcatgcagaaagacctgctcggacaggatgtctttctcattggaccccccggtcctctccgacgcagcatcgctatgcaatacctagagctcactaagcgggaagttgaatatattgctctttcccgtgacaccacggagaccgatctgaaacagcggagagaaatccgggcaggcactgcattctatatcgaccagtgtgccgtgcgggcagctacagaaggacgcactttgatactggagggactggaaaaagctgaaaggaatgtgcttcccgtattgaataatctgctcgaaaacagggagatgcagcttgaagacggtcggttccttatgtcagctgagcgctacgataaactgctgcgggaccataccaagaaggagctcgactcctggaagatcgtgcgtgtctcagagaactttcgtgtcatagcactaggccttcccgtgccccggtatagcggtaatcccctggacccaccattgaggtcccggtttcaggctcgggatatttattacctgcctttcaaagaccagctgaagttactgtactctataggcgctaacgtcagtgcagagaaagtctcacagcttctttccttcgcgaccaccctttgctctcaggagtcttctaccctgggactgcccgacttccctctcgattcgttagcggcagccgtgcaaatcctggacagctttccgatgatgcccatcaaacatgctattcagtggttgtatccatactcaatcctgcttggccatgaggggaagatggcagtggaaggcgtgctcaaacggttcgagttgcaggattccggaagttcacttttgcccaaagagattgtgaaggtggagaaaatgatggagaaccatgtttctcaagcgtccgttactatccgtattgccgacaaagaggtcacaatcaaggtgcccgccggcaccaggctattgtcccagccttgcgcgtcggaccggtttatccagaccttatcccataaacagctgcaggccgagatgatgcagtctcacatggttaaggacatttgtttgatcgggggaaagggctgtggaaagactgtgattgcaaagaatttcgcagataccctcggctacaatattgaacccattatgctgtatcagcacaaggtgccacatatctag

SEQ ID NO: 9415 - DNA, 786 bp, Artificial Sequence
  Description of Artificial Sequence: Synthetic coding sequence
atggccagcctggccgtgagcaactggcccaagcccatgcccctgatcccatgtctctcttggtctactgcgtccggcgttttcaccacaggcgtgctgagtaagtccataaactggagggaactggaaaaacaatattatacacaaactgtatacgaggaggagattatacatatgctggagtattgcggtacggactcttttaagatggggcaggaatttgtgaagcactttacatcatctgcagataagttgacaaaccttaacctggtcagcagaacactgaaccttgatatttccaaccaggttgtttctcagaaaccagctgattgccacaactctagcaagactagcgtgtctgccacttcagaagggttattgctccaggatactagcaagatgaagaggttcaaccagaccctttctacaaacaaatcaggctacacctcaaggaaccctcagtcctaccacttgctgtcaaaggagcagtcccggaatagcctgagaaaggagagcttaatcttcatgaagggagtgatggacgaatgcacccacgtggcaaatttttcagtgccggtggacccctcactgatcatcgtggttcaagccaaggaagatgcttatataccacggacaggcgtcaggagtctccaggaaatctggcctggctgcgagataaggtacctggagggggggcatattagcgcttacttattcaagcaaggactctttcggcaggcgatttatgacgcattcgacaggttcctgcataagtacgccaactag

SEQ ID NO: 9416 - DNA, 1245 bp, Artificial Sequence
  Description of Artificial Sequence: Synthetic coding sequence
atgggcgtgagcaagctggacatcctgtaccggcggctgctgctgacaaagctcttcatcaggggctgggggcgacctgaggatctcaagaggctattcgagttcagaaagatgataggcaatcgagagagatgtcaaaatttggtgtctagcgactatccggtccatattgacaaaattgaggagcaatcggactgcaaaattctggacggccacttcgtatcgccgatggctcattacgtacctgatatcatgcctattgagagtgtgattgctcgcttccagttcatagttcccaaggaatggaacagcaaatatagaccggtgtgtatccatcttgcaggcacaggggatcaccattactggcgtcggagaacactgatggctaggcccatgatcaaagaagcgcggatggctagtctactattagaaaatccctattacggctgtcgtaaaccaaaggaccaggtgaggtccagtttgaagaacgttagcgacttatttgttatgggaggggccctcgtgctggagtcagccgcactactccactggttggagagagaagggtatgggcccctgggcatgacgggcatctcaatgggcggacacatggcgtcacttgcagtttctaactggccaaaacctatgcccttgatcccttgcctaagttggtcaaccgcctcaggcgtgttcactaccaccgactccttcaagatgggtcaagagttcgtgaagcattttacttctagtgccgataaacttacaaaccttaatctagttagtcgtaccctcaatcttgacatatctaatcaagtcgtgagtcagaagcccgccgactgccacaactcaagcaagacatcagtcagcgccacatccgaggggctgctcctgcaggacacgagcaaaatgaaaaggttcaatcaaactctgtccacaaacaagtctgggtatacctctaggaacccccaatcctaccatcttctttccaaggaacagagcagaaattccctccgtaaagagtctttaatctttatgaagggcgttatggacgagtgtacacacgtggccaatttttcagtccctgtagatccttcgcttatcatcgttgtccaggcaaaggaggatgcgtacatacctaggacgggcgtcagatctttacaggagatctggccgggctgtgagattcgataccttgagggggggcacatcagtgcctatttgttcaagcaggggttgtttcggtag

SEQ ID NO: 9417 - DNA, 747 bp, Artificial Sequence
  Description of Artificial Sequence: Synthetic coding sequence
atgaagctgaccttcttcctgggcctgctggccctgatcagctgctttacgccctccgaatcccagagattctccaggcgtccttacctccccggtcagctcccaccaccccccctgtacaggccgcgctgggtgcctccttccccccctcccccttatgacagcaggctgaactctcccctgtccctgccattcgtaccaggaagggtgcctcctagtagcttctcccgattcagccaagccgtcattctctcccagctatttcctttagaatccatcaggcagcctcgcctttttccagggtaccccaacttacattttcccctcagaccgtattatgttgggccaatcagaattctgaagccaccgttcccccctattccatttttcttggctatatacctgcccatctcaaacccggagcctcagattaacattaccacggccgatacgacgatcacaaccaatcctcccacaacggccacagccactacctcgactagcaccaagcctacaatgactatctcctcctcaactgtgcccatctcctcaacacccgaacctgccacgagcatttcggcggctactcccgccgccagcaccgaaaacactacccagattctggctaataggccccataccgtgctcttgaacgctacagttcaggtcaccacttcaaatcagactattctgtcctcccctgcatttaaaagtttctggcaaaaactgtttgcaatctttggttag

SEQ ID NO: 9418 - DNA, 231 bp, Artificial Sequence
  Description of Artificial Sequence: Synthetic coding sequence
atgggcgccgccatcagccagggcgccctgatcgccatcgtgtgcaacggtctcgtggggttcctgctgctgctcctctgggtaatcctttgttgggcatgccactccagaagcgccgatgtggattccctgtccgagagctcaccaaactcctcgccggggccctgcccggaaaaggccccaccccctcagaaaccttcacacgaagggtcttacctcctccagccgtag

SEQ ID NO: 9419 - DNA, 1536 bp, Artificial Sequence
  Description of Artificial Sequence: Synthetic coding sequence
atgctggtggacggccccagcgagcggcccgccctgtgcttcctgctactggcagtggctatgtcctttttcggcagtgccttgtctatcgatgaaaccagagcccacctgctcttgaaggagaaaatgatgagactcggcggacggctcgtgctcaacactaaagaggagctggctaacgagcggttaatgacactcaaaattgctgagatgaaagaggccatgcggaccttaattttccctccatctatgcattttttccaggcgaaacatctgatagagagatcccaggtgtttaacatccttcggatgatgccaaaaggggcggcactacaccttcacgacattggcattgttacaatggactggcttgtccgaaatgtaacatatagacctcactgccatatatgctttactcctagaggaattatgcagttcaggtttgctcaccctactcccaggcccagcgagaagtgtagcaaatggatcctgctggaagattatcgaaagagagtacagaacgtgactgagtttgatgactccctgctgaggaattttacactggtgacgcagcacccggaagtgatctacacaaaccaaaatgtcgtgtggagcaagttcgagactatattttttacaatatccggcctaattcactacgcgcccgtttttagggattatgtcttcagatccatgcaggagttttacgaggataatgttctgtatatggagattagggctaggctgttgcctgtctatgaactcagcggcgagcaccatgacgaggaatggtccgtcaaaacctaccaggaagtcgcccagaaattcgtggagacccatcctgagttcatcgggatcaagataatatacagcgatcatagaagcaaggatgttgccgtcatcgcggagtccattagaatggcaatgggtctgaggattaagtttcctacagttgtagcaggctttgatctcgtcggacacgaggatacaggtcacagcctccacgattataaggaggctctgatgatccccgcgaaagacggcgttaagctaccctatttttttcatgccggtgaaactgactggcagggaacctcgattgatcggaacatcctcgacgctctcatgctgaacacaactaggatcggtcacggcttcgccctgtcaaagcatccggcagtgcggacgtattcgtggaagaaggacatcccaatcgaggtttgcccgattagcaaccaggtcctgaaactggtatcagacctgcgtaaccatcctgttgccacactgatggctactggacacccgatggttatttccagcgacgatcccgctatgtttggggcaaaaggccttagttacgatttctatgaggtgttcatgggaattggggggatgaaagccgacctccgaacccttaagcaactcgccatgaactcaattaagtatagcactctgctcgagagcgaaaaaaatacatttatggagatctggaaaaagcggtgggataagttcattgccgacgtcgccactaaatag

SEQ ID NO: 9420 - DNA, 1536 bp, Artificial Sequence
  Description of Artificial Sequence: Synthetic coding sequence
atgctggtggacggccccagcgagcggcccgccctgtgcttcctgctgttggctgtggcaatgtcatttttcggttctgcactcagtatcgacgaaacacgggcccatttgttgctcaaagaaaagatgatgaggcttggcggtcgccttgtacttaacactaaggaggaactggcaaacgagagactgatgaccctgaaaatcgccgagatgaaggaggctatgcggactcttattttccctccatcgatgcattttttccaagccaagcacctgattgagcgctcgcaggtgttcaacattttacgcatgatgcccaagggcgctgctctacaccttcatgatatcggcattgtgacaatggactggctggtcaggaatgtgacctatcggccacattgtcacatatgtttcaccccaagggggatcatgcagtttcggtttgctcaccccacgcccagaccatcagagaagtgctcaaaatggatccttttagaagactacaggaaacgagtgcagaatgtgaccgaattcgacgactcactgctgcgcaactttaccttagtcacacagcaccccgaagtcatctacacaaaccagaatgttgtctggtccaaatttgaaaccatatttttcaccatcagcggcctaatccactacgctccagtctttagggattatgtgttccgctcaatgcaggagttttacgaggataacgtactgtatatggaaatccgggctagacttctgcctgtgtacgagcttagtggcgagcatcatgacgaagaatggtccgtaaaaacctaccaggaggtcgctcagaaattcgtagagactcaccctgagttcatcggtattaaaatcatttatagtgatcaccggagtaaagatgtcgcagtgattgccgagagcatccggatggctatggggctccgcatcaagttcccaaccgtcgtggctgggtttgacctggtggggcacgaagacaccggacattccttacacgactataaagaggccctgatgattccggccaaagacggggttaagctaccctacttctttcacgcaggcgaaaccgactggcaaggaacgtctatcgaccggaatattctggatgcattaatgctgaatactaccaggatcggtcatggtttcgcactttcgaaacaccccgccgtccggacctattcttggaagaaagacattcccatcgaggtctgtcccatctcaaaccaggtgttaaaactggtttcagatcttagaaaccaccccgtcgctaccctcatggctactgggcaccccatggtcatctcctcagacgatccagcaatgtttggggcaaaaggccttagttatgatttctacgaagttttcatgggcatcgggggtatgaaggccgatctgagaacgctgaaacagcttgctatgaattctattaaatattcaactctgcttgagagcgaaaaaaacacattcatggagatctggaaaaagaggtgggacaagttcatcgcagacgtggcgaccaagtag

SEQ ID NO: 9421 - DNA, 240 bp, Artificial Sequence
  Description of Artificial Sequence: Synthetic coding sequence
atgaagctgcacagcctgatcagcgtgctgctgctgttcgtgaccctgattccaaaggggaaaaccggcgttattcccggtcaaaagcagtgtatcgccctaaagggagtgtgtcgcgacaagctctgttctactctggacgacacgattggaatatgtaatgagggcaagaagtgctgcagaaggtggtggatacttgaaccatacccaactccagtgccgaagggtaagtctccatag

SEQ ID NO: 9422 - DNA, 351 bp, Artificial Sequence
  Description of Artificial Sequence: Synthetic coding sequence
atggccgccggcagcgcccccatgcagctgcacctgcgggccaccattcgcatgaaggacggtctgtgtgtccccagaaagtggatataccaccttacagaaggctccaccgatcttaggaccgagggcagacctgacatgaagactgagctgtttagttcctcctgccccgggggtatcatgcttaatgagacgggacagggctaccaacgctttttactctataatagatccccacatccaccggaaaaatgtgttgaggagtttaaatctctgacctcttgcctagattctaaagcatttctcttgacaccccggaatcaggaagcttgtgaactttccaataactag

SEQ ID NO: 9423 - DNA, 543 bp, Artificial Sequence
  Description of Artificial Sequence: Synthetic coding sequence
caggtgatccccatcaacagcggcgacctgttcgtgcaccccctgtggaaccgatcctgcgtggcctgcggtaatgacatcgcattgattaagctatctagatctgcacagctgggagatgctgtgcaactggcctctcttcccccagccggagacatattgcccaatgaaaccccatgttacatcactggttggggccggctttacactaacggcccactcccagataagctccaggaggcactcctccctgtggtggactacgagcattgtagtcgttggaattggtggggcagttccgtcaagaagaccatggtgtgcgccggtggggatatccggtcaggatgtaatggggactcgggcggcccgttgaattgtccaaccgaggacggggggtggcaggtgcatggggttacctctttcgtgagcgctttcgggtgcaatacgcgtaggaagcccacagtctttactcgggtgtctgctttcatcgactggattgaggagaagctccagggtaacaaagctcctgaatctaggacgtag

SEQ ID NO: 9424 - DNA, 1215 bp, Artificial Sequence
  Description of Artificial Sequence: Synthetic coding sequence
atgccccccttcctgatcaccctgttcctgttccacagctgctgcctccgggcaaacggccatcttagggaagggatgaccctattaaagacagaattcgcccttcatttgtatcagagcgtggccgcctgtcggaacgagaccaactttgtgatttctccagcaggcgtctctttaccgctcgaaatcctgcagttcggcgctgagggatctacaggacagcagctcgcagacgcattgggttacacggtgcatgataagcgcgtgaaagatttcctccatgctgtatacgccaccctgcctacatcctcacagggaactgagatggaactcgcttgtagcttgttcgtccaggtggggacacctctgtcgccttgttttgtggaacacgtcagttggtgggctaattcatcgttagagccagccgatctctctgagccgaattcaaccgccattcagaccagtgaaggggccagccgagagacagccggcggcggaccgtcagaaggacctggcgggtggccctgggaacaggtgtcagccgccttcgcacagctcgtgctcgtgtcgacaatgagctttcagggcacatggcgcaagagattctcaagcaccgacacacaaattctccccttcacttgcgcttatgggcttgttctgcaggtgccaatgatgcatcagacgacagaggttaactacggtcagtttcaagatacggctggacatcaggtcggagtccttgagctgccctacttgggatccgccgtgagcctgtttctcgtgttaccaagagataaagacaccccactttcacatatcgaacctcatctgacagctagcaccattcacctgtggactacgagcctgaggcgggcacgcatggacgtcttcctccctagatttaggatccagaatcagttcaatctgaagtccattctgaattcttggggagttaccgatttgtttgaccccctgaaggcgaatctgaagggcatcagcggacaggatggcttctacgttagcgaggccatccataaggcaaaaattgaggttttggaagaaggaaccaaagccagcggcgcaacggccctactcctgctcaagagaagccgcatccctatttttaaggcggacagaccgttcatctactttttacgggaacccaatacagggtttgtcttctcaatcggccgagtatcaaacccacttgactag

SEQ ID NO: 9425 - DNA, 444 bp, Artificial Sequence
  Description of Artificial Sequence: Synthetic coding sequence
atgggccccgaggccctgagcagcctgctgctgctgctgctggtggctagcggcgatgcggacatgaaagggcactttgaccccgccaaatgtaggtatgccctgggaatgcaggaccgtaccattccagattctgacatcagcgccagctcatcctggtccgattcaactgccgctcggcacagtcggctggagagttcggatggcgatggcgcctggtgtcctgcgggttcagtgtttcctaaggaggaggaatacttgcaggtcgacctacagcggctgcaccttgttgccctcgtcggaacccagggcagacacgctgggggcctaggtaaagaattttcccggagctatagactgaggtatagcagagacggacgccgctggatgggatggaaggatagatgggggcaggaggttatcagcggaaacgaggatccctag

SEQ ID NO: 9426 - DNA, 2631 bp, Artificial Sequence
  Description of Artificial Sequence: Synthetic coding sequence
atgggccccgaggccctgagcagcctgctgctgctgctgctggtggcttccggcgatgccgacatgaaaggacatttcgacccagctaaatgtcgatatgctctgggcatgcaggatagaacaattccggactcagacatcagcgcaagctctagctggtccgactcaaccgccgcacgccactcacgcctggagagctctgacggtgacggtgcctggtgcccggcagggtccgttttccccaaagaagaggagtatttacaggttgatctacaaaggctacatctagtcgctctggttggtacacagggccgacatgcgggcggtctggggaaggagttctcaaggtcatacaggttgcggtattcccgcgatggccgtaggtggatggggtggaaggaccggtgggggcaggaagtgatctccggaaatgaggatccggaaggcgtggtgctgaaagacctgggcccgcccatggttgcaagacttgttcggttctatcctcgcgctgacagggttatgagcgtgtgcctgagggtggaattatatggctgtttatggagagacgggctactgagctatacagctccagtaggtcagacaatgtacttgtcggaggccgtgtatctgaatgattcaacatacgatgggcataccgtcggcgggttacaatatggtggcctgggtcagttggccgacggcgttgtgggcctggacgatttccggaagtcccaggagcttcgcgtttggccgggctacgattatgtcgggtggtccaaccactctttcagcagcggctacgtggagatggagtttgaattcgatcgcctgagggcctttcaggcaatgcaggtacattgtaacaacatgcatactctgggtgcccgtcttccaggcggagttgaatgtcgctttcggagagggcccgcaatggcgtgggaaggggaacctatgcggcacaatctgggcggaaacctcggcgacccacgggcaagagccgtgtcagtgccactgggggggcgcgtcgcgcgcttcctccagtgcaggttcctttttgcaggcccttggctgttgttcagtgagatttcttttatatctgacgtggtgaataatagctcaccggccttgggcgggacatttccgcccgcaccgtggtggccacccggccctccacctaccaatttttctagcctggagttagagccgcggggtcaacagccagtggctaaggccgagggttcgcctacggccatactgatcgggtgcctggtggctatcattctgctgcttttattgatcattgcacttatgctgtggagattgcactggaggaggctgttatcgaaagcagagagacgggtgctcgaagaggaattgaccgttcacctcagcgtgccgggagacacaatcttgatcaataacagacctggccctcgggaaccacctccctaccaggagccacgcccaaggggaaatcctcctcattcggccccctgtgtccctaatggcagcgcatactctggagactacatggagcccgagaagcctggggcccctttgctaccccctcctcctcagaacagcgtgccccattacgcggaagccgacattgtcacgttgcagggagtcaccggaggcaacacatatgcggtgcctgccctgcctcccggtgcagtaggggacggcccacctcgagtcgacttccccagatctcgcctgcgcttcaaggaaaaactgggggaggggcagtttggtgaggttcacctgtgcgaggtggattcacctcaggacctggtttccctggatttccctctgaatgtgcgcaaagggcatcctttgcttgttgccgtaaaaatactgaggcctgacgctacgaaaaatgcccggaacgactttctgaaggaagtgaagatcatgtcccggctaaaggatcccaacatcatcaggcttctcggcgtatgtgtgcaggacgatcccttatgcatgattacagactatatggagaatggcgatcttaaccagttcctgtcagcccatcagctcgaggataaggccgctgaaggcgcccccggcgatgggcaggccgcccagggaccaactatctcctacccaatgctgctccacgtggccgcacagatcgcgagcggaatgaggtaccttgctaccctgaatttcgtgcacagggacttggccacaaggaactgccttgttggtgagaacttcaccataaagattgccgattttgggatgtctcgcaacctgtacgcaggtgattattaccgagtacagggcagggccgtcctgccaattcgatggatggcatgggagtgcatactaatggggaagttcactacggcctcagacgtctgggccttcggggtgactttgtgggaagtcttaatgctgtgtcgggcccagccgtttggacagctgaccgacgagcaggtgatagagaatgcaggagaatttttcagggatcaggggcgccaagtgtatttaagcaggccccccgcttgtccccagggtctctacgagctgatgctgcgctgctggtcgcgggagtccgagcaacggcctccattcagtcagttacacagattccttgcggaagatgctcttaacaccgtgtag

SEQ ID NO: 9427 - DNA, 2631 bp, Artificial Sequence
  Description of Artificial Sequence: Synthetic coding sequence
atgggccccgaggccctgagcagcctgctgctgctgctgctggtggcttcaggggacgccgatatgaagggacactttgatcctgctaagtgccggtatgccctggggatgcaggacagaacaattcccgactccgacatctccgcttcctctagttggtctgactccaccgccgctagacatagccggctcgaaagctctgatggtgatggggcttggtgtccagccgggagtgtctttcctaaggaagaggagtacctgcaggtggatttgcagcggctgcatcttgtggccctagtggggacacaggggcgccacgcaggcggacttggtaaggagttcagtcgtagctaccggttgagatactccagagatggtcgccgctggatgggatggaaggacaggtggggacaggaggtgattagcgggaacgaagatccagagggggtggtactgaaggacttgggaccccctatggttgcaagactcgtgagattctacccccgggcggaccgggtcatgagtgtatgccttcgggtagagctgtatgggtgcctgtggcgggacggcctactaagctacactgcacccgtgggacagacaatgtatctatccgaggccgtatatctcaatgacagcacgtacgatggacacaccgtgggcggccttcagtatggcgggctggggcagctggcagatggagtcgtggggctggatgacttccggaagtcccaggagcttagagtttggcccgggtatgattatgtcggttggtctaaccactcctttagctctggatacgttgagatggaattcgagtttgatagattgcgggccttccaggcaatgcaggtccactgtaacaatatgcacactttgggcgctcggctgcctggtggcgtggagtgtcggttcagacgagggcccgccatggcgtgggagggcgaaccaatgagacataatttgggtgggaaccttggtgatcctagagctcgggccgtttctgtgcccctcggggggcgagtcgctagattcttgcagtgtcgttttctctttgcagggccatggttgttgttctccgagatctcattcatcagtgatgtagtgaacaacagttcaccagccctgggtggcacttttcccccagccccctggtggcctccgggccccccccccaccaatttttcatctttggagctcgaacctcggggccagcagccagttgccaaggccgaaggcagtccaacagcaattttaatcgggtgtctggttgcaataatattactgctcttgttaataatcgcactgatgttatggaggctgcattggcggcgtctgcttagcaaggccgagagacgagtgctggaagaagagctgacggtacatctgtcagtccccggcgacactatactaatcaacaataggcctggaccacgggagccccccccctaccaggagccccgtccacgcggaaatccaccccactccgccccatgcgtccccaatggatcggcgtactccggagattatatggaacccgagaaacccggggcgccattactgcccccaccaccccagaatagtgttccacactacgccgaggctgatatagttacattgcagggtgtcacaggaggcaacacttacgctgtgccagccctgccccccggagcagttggcgacggccccccccgtgtcgactttccacgcagcagactccgatttaaggaaaagctcggcgagggacagttcggcgaggtgcatctgtgtgaggtcgactcccctcaggacctcgtgtcactggatttccctcttaatgtaagaaaagggcaccccctgctcgtggcagtgaaaatcttgcgccctgacgccactaaaaacgctagaaacgacttcctcaaggaggtgaagatcatgagtcgtctgaaagatccaaatattattcgcctgctaggggtatgcgtgcaagacgacccgctctgtatgatcaccgactacatggagaacggggacctcaaccagtttctctctgcccaccagttggaggacaaggcagccgagggggctccgggagacgggcaggctgctcaaggcccaacgatttcctatccaatgctcctacacgtggccgcccagattgcttcgggaatgcgctacctggctaccctcaattttgttcaccgtgacctggcaacccgcaactgtttggttggggagaacttcaccatcaagatcgccgatttcggaatgtctaggaacctatatgccggggactattacagagtccaggggagagcggtgctccccattaggtggatggcgtgggaatgcatactgatggggaagtttacaacagcaagcgacgtgtgggctttcggcgtgaccttgtgggaggtgctgatgctctgtagagcccagcccttcggccaactcactgacgagcaggtcatcgagaacgccggtgagttttttcgtgatcagggcagacaggtgtatctttcacgaccacctgcctgtcctcagggtctctacgagctgatgctgcgatgctggagtagggaatcagagcagagacctccgttctctcaactgcataggtttctcgcggaagacgccctcaacaccgtctag

SEQ ID NO: 9428 - DNA, 2742 bp, Artificial Sequence
  Description of Artificial Sequence: Synthetic coding sequence
atgggccccgaggccctgagcagcctgctgctgctgctgctggtggcctcaggggacgccgatatgaaaggccacttcgacccagctaaatgccgatatgccctgggcatgcaagacagaactatccctgactctgacatttcagcgtcaagctcttggtcagactctaccgccgccaggcatagtcgcctggagagcagtgacggagacggcgcctggtgtcccgctggcagtgtatttccaaaagaagaagaatatctgcaggtggacttacaacgcctgcatcttgtcgccctggtggggacccagggcagacatgctggcggattagggaaagaatttagtaggtcttaccgactgcgctacagtcgggatggtagacgttggatgggttggaaagatcggtgggggcaagaggtgataagcggaaatgaggacccggagggagtggtcttaaaggacctcgggccacccatggtggccagactcgtaagattctacccgcgagctgaccgcgtgatgagcgtgtgtttgagagttgagttgtacggttgcctgtggagggacgggctgctgagctacaccgcccctgtggggcagaccatgtatctcagtgaggccgtgtatctaaatgactccacctacgacggccacactgtgggaggactccagtacggaggactgggccagttggctgatggcgtggtgggtctcgacgactttaggaagtctcaagagctccgggtctggccagggtatgactatgtcggctggtcgaaccattcctttagctctggctacgtcgaaatggaatttgagtttgatagactgcgggcctttcaagctatgcaggtccactgtaacaacatgcacaccctaggagcgagactgcctgggggggtcgagtgtcgtttccggcgcggtcccgcaatggcttgggagggcgaaccaatgcgccataatttgggaggaaaccttggtgatcctagagctcgggctgtatcagtccccctcgggggcagggtcgcaaggtttttgcagtgccggtttcttttcgccggaccatggctgctcttctcggaaatctcctttatcagcgacgttgtaaacaactcctcccctgcactgggaggaaccttcccacccgcaccctggtggccacctggacccccaccaacaaattttagctctttggagctggagcccagaggccagcagcctgtggcaaaagccgaaggctccccaacggcaattttaattggttgcctcgtggccatcatactgctcttgctgcttatcatcgctttgatgctgtggcgccttcactggcggcgactcctcagcaaagctgagcgacgcgtcttggaagaggaactcacggtgcacctgagcgtgcccggcgacaccattctgattaacaaccggccgggtccccgcgagcccccaccgtaccaagaaccgcggcctcggggcaatccaccacattcagccccttgtgtacctaacggtagcgctctgcttctgtccaaccccgcatatagactgcttctagctacctacgctcgcccccctcgcggtcccggtccacccactccggcttgggcaaaaccgactaatacccaggcatactcaggcgactacatggaacccgaaaagccaggagccccgctactacccccccctccccagaattctgtcccgcactatgctgaagccgatatcgtgaccttgcagggcgtgacgggcggtaatacttacgccgtacctgcactccctccaggggctgtgggtgatggcccaccgcgggtggatttccccaggagcagactgaggtttaaggagaagttgggcgaaggacagtttggagaggtgcacctctgcgaagtggactccccacaggatttggtgtcattggatttcccacttaatgtccgcaaaggacacccgcttctggttgccgtgaagattcttcggcccgatgcaaccaaaaacgcacgaaatgatttcctcaaagaagtgaagattatgtcaagactcaaagatccaaacattatccggctcctaggggtgtgtgtgcaggacgatcctctgtgcatgatcaccgactacatggagaatggggacctgaaccagtttctaagtgcacatcaactcgaagataaagccgccgagggcgcccccggggacggtcaggcagcacaagggccaacaattagctaccctatgctgctgcatgtggcagcccaaatcgcaagcggcatgcgatacctggcaactctgaacttcgttcaccgagacctggctacaaggaattgtctcgtgggggagaactttacaatcaaaatagcagactttggaatgtcccgtaatctttacgcgggcgactactaccgcgtgcaggggagggctgtccttcccattcgctggatggcatgggaatgtatcctgatggggaaattcaccacggctagtgacgtgtgggcctttggggtgaccctttgggaggtgttaatgctgtgtagggcacagccctttgggcagctcaccgacgagcaagtcattgaaaacgctggggaattctttcgcgaccaggggcgacaagtgtatctgtcgaggcctccggcctgtccacagggcctgtatgagctaatgctcaggtgttggagccgagagtcagaacagcgaccgcccttcagccaactgcatagattcctggccgaagatgccctgaatacagtgtag

SEQ ID NO: 9429 - DNA, 444 bp, Artificial Sequence
  Description of Artificial Sequence: Synthetic coding sequence
atgggccccgaggccctgagcagcctgctgctgctgctgctggtggcaagcggagacgccgatatgaaaggtcattttgatcccgcgaagtgccggtatgccttgggtatgcaggatcgcacgataccagactcagacatttcagcttcttcttcctggtccgattccacagccgcacgacatagccgactggaatctagcgacggggacggggcctggtgtccggcaggaagcgtctttcccaaggaggaagagtacttgcaggtagacctgcagcgcttacacctcgtagctctggtggggactcaaggcaggcacgctggtggcctgggaaaagaattctcgcggtcatataggcttagatacagtagagacgggcgccgctggatgggttggaaggaccgatggggtcaggaggtgattagtggtaatgaggatccatag

SEQ ID NO: 9430 - DNA, 2631 bp, Artificial Sequence
  Description of Artificial Sequence: Synthetic coding sequence
atgggccccgaggccctgagcagcctgctgctgctgctgctggtggcatcaggagatgcagacatgaaggggcatttcgatccagccaaatgtagatatgcactggggatgcaggacagaacgatacctgactccgacatatctgcctcatcgagttggtctgactcaactgccgctaggcactcacgcctggaatcatccgatggcgacggtgcttggtgtccagctgggtctgtatttcctaaggaagaggagtacctgcaggtcgatttgcagcggctccatctcgtcgctcttgtgggaacccagggccgtcatgcagggggcctgggtaaggagttctctcgctcctacaggttgaggtactccagggatgggaggagatggatgggctggaaagacagatggggccaggaggtgatcagcggtaacgaagaccccgagggtgtggtcctcaaagatctcggaccaccgatggtcgctaggctggtgcggttttaccccagagcagatcgtgtgatgtcagtctgcttacgagtggagctctacggctgtttgtggagggacggtcttctcagctatacagctcccgtcggccagaccatgtatttgtcagaagcagtctacctgaatgacagcacatacgatggacacactgtcggaggcctgcaatacggtgggctgggccagcttgcagacggggtggtgggtctggacgatttccggaagagccaggagctgcgggtgtggcccggctacgattatgtcggctggagcaaccactccttttcctccggctatgtggaaatggaattcgagtttgatagactgagagcattccaggcaatgcaggtgcattgtaataatatgcacactctcggggctcggttaccagggggagtcgaatgtcggtttcgtcgaggccctgctatggcctgggaaggcgaaccaatgcggcataacctgggcggaaacctaggggacccaagggccagagccgtaagcgtaccgcttggcgggcgagtcgcccggttcctacagtgccggttcttgtttgccgggccctggctgcttttttccgagatttcttttatctccgatgtcgtgaacaattccagccctgccctagggggtacttttcctcccgcgccatggtggccgcccgggccccctcctacaaacttttcatctctggagttggagcctcgaggtcaacagccggttgccaaagcggagggatctccgaccgcaatcttaatcgggtgcctggtcgctataatactgctacttttgctgatcattgccctcatgctgtggcgtctgcactggcgccggttgctgtccaaagctgagcgaagagtcctcgaagaagagctgactgtgcacctgtctgtgccgggcgacacgatactaatcaacaacaggccaggcccacgtgagccacccccatatcaggaacccagaccaagaggaaacccaccccactctgccccatgtgtacccaacgggagcgcgtatagtggtgattacatggaacctgaaaaacctggcgcgccactgttgcctccacctcctcagaacagcgttccgcactatgccgaagccgacattgtgaccctgcaaggagttacaggagggaacacatatgcagtgcccgcacttccaccaggcgcagtgggcgatggacccccgcgtgtggattttccgagaagcagactcaggtttaaggagaagctaggagaaggtcagtttggagaagtccacctgtgcgaagttgatagtccccaagatctggtgagcttggactttcccttgaatgtgaggaaagggcatcctctgttggtggcagtcaagattttacggcccgatgccaccaagaacgcgcgcaacgacttcctgaaggaagttaagataatgagtcgccttaaagatccaaacattatcaggctgctcggcgtgtgtgttcaagacgacccactctgcatgattacagactatatggagaacggtgacctcaatcagttcctgtctgcacaccagttagaggataaggcagccgaaggggcacctggtgatggccaggccgctcagggtcccacaatcagctaccctatgctgttgcacgttgcagcacagattgcttcaggtatgcgataccttgcgactttgaacttcgttcatcgcgatcttgcaacaaggaactgtctagtgggagagaactttacaatcaaaatcgctgattttggaatgtccaggaacctctacgccggtgactattacagggtgcagggccgggcagtcttgccaatccgttggatggcttgggaatgtatattaatgggcaagtttacaactgcttctgacgtgtgggcgttcggggtaactctgtgggaggtcttgatgctgtgtcgtgcacagccctttggtcagctgactgatgagcaagtaatagaaaacgcgggcgagttctttagagaccaggggcgacaagtctacctatctcgcccacccgcatgtcctcagggtctgtacgagctgatgctgcgctgctggtcaagagagtctgagcagaggccacccttttcccagctgcataggtttctggcagaagatgccttaaacaccgtatag

SEQ ID NO: 9431 - DNA, 2631 bp, Artificial Sequence
  Description of Artificial Sequence: Synthetic coding sequence
atgggccccgaggccctgagcagcctgctgctgctgctgctggtggcttccggggatgcggacatgaagggacatttcgatcctgctaaatgcaggtacgctctcggcatgcaagacaggactattccagattcggatataagcgccagttcctcatggagcgattctacagccgcacgccattctcgcctggagtcgagtgacggagacggggcctggtgccccgcgggaagcgtgttccccaaggaggaagagtatctgcaggtcgacttgcaacggctgcatctggttgccttagtggggacacagggtaggcacgcaggcggcctgggaaaggaattctccaggtcgtacagattgaggtactcaagggatggccgcagatggatgggttggaaggacaggtggggccaagaggtaatctccggtaacgaagatccagagggtgtggtgctgaaagacctgggccctcccatggtcgcgcggctcgtgcggttctaccccagagcggacagggtgatgtctgtgtgcctgcgggtggaactgtacgggtgcctgtggcgcgatggcctgctctcttacacagcaccggtcgggcagacaatgtatttgtccgaagcagtctaccttaacgacagcacttacgacggacacaccgtggggggtctgcagtatggagggctcgggcagctagcagacggcgtggtcggcttagacgactttcgcaagagtcaggagctgagagtttggcccggctacgactacgtgggctggagcaaccacagttttagctcgggctacgtggagatggaattcgaattcgatagattgcgggcctttcaagctatgcaagtccattgcaataacatgcatactcttggggcccgtttgccagggggagtggaatgccggttcaggcgaggccccgccatggcatgggaaggagagccaatgagacataacttgggcggaaacctgggcgatccgcgcgcccgtgctgtctcagtgcctctagggggaagagtagcacggttcctgcaatgcagattcctcttcgccggtccctggttgctgttcagcgagatttcattcattagtgacgtggtcaataactcgagtcctgctctgggcggcacattccccccggctccctggtggccgccaggcccgccgcctacgaatttcagcagtctggaactggaaccgcgaggccagcagcctgtcgccaaggccgaaggttcaccaacggccatactaattggctgcttagtagcaatcatactattgcttctattaattattgcgctcatgctctggcgtctccattggcggaggctcttgtctaaagccgagagaagagttctcgaagaagaacttacagtgcacctgagtgttcccggggataccattctgatcaataatcggcctgggccgcgagagcccccaccgtatcaggaaccccggcctcgcggaaaccctccccattccgccccatgcgtcccaaacgggagcgcttacagcggagactacatggaaccagaaaaaccaggagctcctctccttccgccgccaccccaaaattccgtaccgcattatgccgaggccgacattgttaccctccagggcgtcactggaggaaatacttatgccgtgcccgccctgccccccggagccgtaggggatggcccaccaagggttgactttccaaggtccaggctgcgttttaaggaaaaactaggcgagggccagttcggagaagtccatctgtgcgaggtggatagcccgcaggatctggtctcactggactttcctttgaatgttcgcaaaggccatcctctcctggtcgctgttaaaatattgaggcccgacgctactaaaaatgccagaaacgacttcctgaaggaggttaagatcatgtccagacttaaagacccaaacatcattcgcctcctaggggtgtgcgttcaagacgatccattgtgcatgattaccgactacatggaaaatggcgatttgaatcagttcctctccgcacaccaactagaggacaaggctgccgaaggggcgcctggagatggccaggcagcccagggaccaacaattagttatccaatgcttttacatgtagcggcccagattgcctctggaatgcgctatctcgccaccttgaatttcgtgcacagggatctggcgacccggaactgtcttgtgggggaaaacttcacaatcaagatcgccgacttcgggatgtcgcgaaatctgtacgctggcgattactatcgcgtgcagggccgggccgtgctgccaatccgatggatggcctgggaatgcattttgatggggaaattcaccacggccagtgatgtatgggcattcggcgtcactctatgggaggttctaatgctgtgcagggcgcagccttttggccagctcacagacgagcaggtgatagagaatgctggcgaattctttcgggaccaggggcggcaagtgtatctcagccggccacccgcatgcccacagggcctgtatgagttgatgctgcggtgttggtcaagagagtcggagcagaggccaccattctcacagctgcatcgcttcctggcggaagatgccctcaataccgtttag

SEQ ID NO: 9432 - DNA, 2631 bp, Artificial Sequence
  Description of Artificial Sequence: Synthetic coding sequence
atgggccccgaggccctgagcagcctgctgctgctgctgctggtggcttcaggagatgcggatatgaaggggcactttgaccccgcaaaatgccgctacgcattgggtatgcaggatcgaactattcctgatagtgacatcagtgcctcgtcaagttggagcgactccaccgccgcaagacactcccgcctggagagctccgacggcgacggggcctggtgcccagcgggatccgtgttccctaaagaggaagaatatctgcaggtagacctacagcgactgcatctggtggcacttgtggggacgcagggaaggcacgcagggggcctcggcaaggagtttagtcggagttacagactgcggtattcgcgagacggcaggcggtggatggggtggaaggacagatggggacaggaagtcatctcgggcaacgaagatccggaaggggttgtgctgaaagatctgggaccacccatggtcgcaaggcttgtccggttttaccctcgagctgacagagttatgtccgtgtgcctgcgagtcgaactgtatggctgcctgtggcgggatggcctattatcttatacagctcccgtggggcagaccatgtatttaagtgaagctgtgtaccttaatgactcaacgtatgacggacacacggtcgggggactacaatacggcggactgggacagctcgctgacggggttgtgggccttgatgattttagaaagagccaggagttacgtgtgtggccaggatacgattatgtgggatggtccaaccatagcttctctagtggttatgtagaaatggaattcgagttcgaccggctcagagcattccaggcgatgcaggtccactgtaataacatgcacacattgggcgcccggctacctggcggtgtggagtgcaggttcaggagagggccagcaatggcttgggaaggcgagcccatgaggcacaacctgggcgggaacctgggtgaccccagagccagggcagtaagcgtaccacttgggggcagagtcgcacggttcctgcagtgtcgctttttgttcgcaggaccttggctgttgttctccgaaatatcatttattagtgatgtggtgaataatagctcccccgcactgggcggaaccttccctcctgccccatggtggcctccagggccccccccaacaaatttttcttcattagagttggagccacgggggcagcaacccgtggcaaaagccgagggcagtcctactgcaatcctcatcgggtgtttggtggcaatcatcttgctgttgttgcttattatcgccctgatgctttggagactgcattggcgacgtcttctgagcaaagctgagcgacgtgtgctcgaggaagagctgacagtgcatctctccgtcccaggagacaccattctcattaacaaccgccccgggccacgggaacctccgccctaccaggagcccagaccaaggggcaatccacctcactccgctccctgcgtacccaacggctccgcctacagtggggattacatggagccagagaagcccggagccccactcctacccccccccccgcagaatagcgtgcctcactatgccgaagccgatatcgtcaccctgcagggcgtgaccggaggcaacacctatgccgtaccagctttacccccgggtgccgtgggagacgggcctccaagggtggactttccccgatcccgactgcgattcaaagagaaattgggcgagggccaattcggggaggttcacctgtgtgaagtggactcaccccaggacctcgttagtctggatttccctctaaacgtccgcaaagggcatccgctgctggtcgcagtcaaaattctgcgtcctgatgccactaaaaatgctaggaatgacttccttaaggaggtgaagatcatgagccgactgaaagatcccaatattattcggctactgggggtctgtgtgcaggatgatccactctgcatgatcaccgactacatggagaatggtgatttgaatcagttcctctcggcccaccagctcgaagataaggctgcagagggggctccaggtgacggtcaagcagcacaaggtcctaccatcagctacccaatgctgctacacgtggccgcacagatcgcgtcaggcatgcgctatttggccacactcaatttcgtgcatagagatctggccaccagaaattgtctagtaggtgaaaacttcaccattaagattgcggatttcggaatgtccaggaacctatatgccggcgattattaccgagtgcagggtcgcgccgttctgcccattaggtggatggcttgggaatgtatccttatgggaaaatttaccacagcctctgacgtgtgggccttcggagtcacgttgtgggaagtgctgatgttgtgtagagctcagccgttcggccagctgaccgacgagcaggtgattgagaacgcaggtgagttcttccgcgaccagggccgtcaagtttatttgagcagacctccggcgtgcccccaaggtctgtatgaactgatgctgcggtgctggtcccgagagagcgagcagcgcccacctttctctcagctccatagattcttggcagaagacgctttgaatacagtttag

SEQ ID NO: 9433 - DNA, 2742 bp, Artificial Sequence
  Description of Artificial Sequence: Synthetic coding sequence
atgggccccgaggccctgagcagcctgctgctgctgctgctggtggcctccggcgatgccgacatgaagggtcattttgatcctgccaaatgtcgctacgccctaggcatgcaggaccggaccatcccggactccgatatctcagctagctcttcctggagtgacagtaccgcggccaggcacagtcggttggaatcatccgacggcgatggcgcttggtgtcctgctggcagtgtgttccccaaagaggaggagtacctgcaggttgacttacaacgcctgcacctggtggccttggtcgggacccagggccgtcatgcggggggtctgggaaaggaatttagcagatcataccgccttcgctatagtcgagacgggcggcggtggatgggctggaaagaccgctgggggcaggaagtcatcagcggcaacgaggaccccgagggagtagtgctgaaggatctcggcccaccgatggttgcccgcttggtgcggttctatcctagagccgaccgagttatgagtgtctgcctcagggtagaactgtatggctgcctttggagagatggactgctgtcttacacagctccagtcgggcagacaatgtatttgagcgaagccgtgtacttaaatgactctacttatgacgggcacacagtcggtggtctgcaatatggcggcctggggcagctcgccgatggagtggtgggactcgatgatttccggaagtcacaggaattgcgggtttggccaggctacgattacgtgggatggtctaatcacagcttttccagcggctacgtcgagatggagttcgagtttgacaggctgcgcgcctttcaggcaatgcaagttcactgcaacaatatgcacaccctgggtgctaggctgccaggaggggtcgagtgtcggttccgaagagggccagccatggcctgggagggcgagcctatgcgccacaatctgggcggtaacctgggagatccgagggcgagagccgtctctgtcccgctcggaggtcgagtggctagatttctgcagtgccgcttcttgttcgcggggccatggctgctgttcagcgaaatctcattcatttcagatgtggtgaataactcctcccccgccctcggcggtactttccctccagctccttggtggccccctggcccccctccgacaaacttcagctcactggaattagagccacggggacagcagccggtcgccaaggctgaaggctctccaactgcaatccttatcggttgtttagtcgccatcatactgctgttgttattaatcatcgccctcatgctctggagactccactggcgaagactgttgagtaaagccgaaaggcgggtgctggaggaagaattaaccgttcatctgtctgtgccaggggacacaatactgattaataacaggcccgggcccagggagccacccccgtatcaggaacccagaccccggggtaatccgccccactcagcgccatgtgtacccaatggaagcgccctactgctttcaaacccagcctatcgtctccttctcgctacctatgctagaccacctcggggccccggacccccaacccccgcatgggcgaaacccactaatacgcaagcctatagcggggattatatggaacccgaaaagcctggagccccactgttgcctcctcctcctcagaactccgtgccccattatgctgaggccgatatcgtgacgcttcagggcgtaacagggggtaatacctatgccgtgcccgcactcccccccggagcagtaggagatggacccccccgggtcgacttccctaggtctagattgaggttcaaggaaaagctgggagagggtcagttcggagaagttcacctttgtgaggtagacagtccacaggacctggtgtcgttggactttcccttaaatgtgaggaaaggacacccgctgctcgtggccgtcaagattttgcggcccgatgcaaccaaaaacgcccgcaacgacttcctgaaagaggtgaagataatgtcacgcttgaaggaccctaatattatcagacttctcggagtgtgcgtgcaagatgatcctctgtgcatgatcacagattatatggagaatggcgacctgaatcagtttctttccgcacatcagctcgaggacaaagccgccgagggtgcacccggcgatggccaggctgcgcaggggcccacaatcagctatccaatgctgctgcacgtggccgcacagatcgccagcggtatgcggtacttggccactctcaattttgtacaccgagacctagctacaaggaattgtttggttggggagaatttcacaatcaaaatcgcagactttggcatgagccggaacctgtacgccggcgattactatcgggttcaaggaagagcagtgcttcctatacggtggatggcctgggagtgtatcctgatgggaaagtttaccaccgcttcggacgtgtgggcgtttggcgtcacgctctgggaggtcctcatgctctgccgcgcgcagcctttcggacagctaactgacgagcaggtgatcgagaatgcaggggaattctttcgcgatcaggggagacaggtgtacctgagccggccacccgcctgtccacagggtttgtacgagttgatgctgcgctgctggagccgagagtcggagcagaggcctccgttttctcagttacatcgattccttgcagaagacgcgttgaatacggtgtag

SEQ ID NO: 9434 - DNA, 2742 bp, Artificial Sequence
  Description of Artificial Sequence: Synthetic coding sequence
atgggccccgaggccctgagcagcctgctgctgctgctgctggtggcttctggcgatgcggacatgaaaggtcatttcgaccctgcaaagtgcaggtatgcccttggcatgcaggacaggactatccctgactcagacatcagcgccagctcgagttggtccgacagtacagcagcccgacacagccgactggagagctcggatggcgatggagcatggtgcccggcaggaagtgtgtttcccaaagaggaagagtacttacaggtcgacttgcagcggttgcacctagtagcattagttgggacacagggccgccacgccggcgggcttggaaaggagttctcaaggagctatcgacttaggtacagccgagacggcagacgctggatgggatggaaagatagatggggtcaagaagtgatctccgggaacgaggatcccgaaggcgttgtcctgaaagatttaggacctcctatggtcgcgaggttggtgcgtttctacccacgggccgatcgggtaatgagtgtatgtctcagagtcgagctgtacggttgcttatggagggacgggctcctttcttatacggcacccgttggccagacgatgtatctgtcagaggctgtgtatcttaacgattctacctatgacggacacaccgtcggaggactgcagtacggtggcttaggccagttggcagatggcgtggtaggactggatgactttcgaaagagccaggaattgcgcgtatggccaggatatgattatgttggatggagcaatcacagcttcagcagcggttatgtcgaaatggagttcgagttcgacaggctaagagcgttccaagcaatgcaggtacactgtaataatatgcacacactgggggcacggctgcccggaggtgtcgagtgtcgtttccgtcggggtccggccatggcttgggagggcgaacccatgcgacataacctcgggggtaacctcggggacccgcgagccagggctgtctccgtgcctttgggcgggagagttgctcggttcctgcaatgtcggttcctctttgcaggcccctggttactgttttccgagattagcttcatctctgatgtggtgaataattcaagcccagctcttgggggcacattcccgcccgccccatggtggccccctggcccaccgccgacgaattttagctcgctggagcttgagcctaggggtcagcagccagttgctaaagcagaagggagcccaacagctattcttattggttgcctggtggctataatcttgctcctgctgctgatcattgccttaatgctgtggagactgcattggagacgcctccttagtaaggccgagcgacgcgttctggaggaagagctgactgtgcatctttccgtcccaggggacaccatcctaattaataacaggcccgggccccgagaacccccaccttaccaagagccacggccccgcggcaatccacctcattctgcaccctgtgtgccgaacgggagcgctctcttgctcagcaatcccgcgtataggttattgttggccacctacgcccgtcccccgaggggacccggaccaccaacacctgcctgggcaaagccaacgaacacccaggcctacagcggagattatatggaaccggaaaagccaggagcccctctcttgcctccaccccctcaaaacagcgttccacattatgcagaggccgatatcgtcactcttcagggcgtcaccgggggcaacacttatgccgtgcctgcactgcctcccggtgcagtaggggacggacccccacgcgtggacttccccaggtcgcggctgagatttaaggagaagttaggagaggggcaattcggcgaagttcatttgtgcgaagtggactccccccaagacctagtgtcgcttgactttccgctcaatgtacggaagggccacccactgctggttgccgtaaagatccttagacccgatgcaacaaaaaacgcccggaatgacttcctcaaagaggtgaagatcatgtcaaggttgaaggaccccaatattattcgcctacttggtgtctgcgttcaggatgacccactctgtatgattaccgattatatggagaacggagacctgaaccagttcctcagtgctcaccagctggaggataaggccgcagaaggcgctcctggagatggacaagcagcccagggccccacgatttcgtaccccatgctgctgcacgtggcagcccaaatagctagcggcatgcgctacctggccaccctcaatttcgtccacagagatttagccacccggaactgtctcgtgggcgaaaattttacaatcaagatcgccgacttcggaatgtccaggaacctgtatgcgggggattattaccgtgtccaggggcgcgcagtcctaccaataaggtggatggcgtgggaatgcatcttgatgggcaagttcacaactgcaagtgatgtgtgggccttcggcgttactttatgggaggtgctgatgctgtgccgcgctcaaccttttggccagctaaccgacgaacaggtcattgagaacgctggtgagttctttcgagatcagggaagacaggtctatcttagccgtccacccgcttgtcctcagggtttatacgagcttatgctgaggtgctggagccgggagtccgaacaacgacctccctttagccagctgcacaggtttctcgctgaggacgccctcaatacggtgtag

SEQ ID NO: 9435 - DNA, 309 bp, Artificial Sequence
  Description of Artificial Sequence: Synthetic coding sequence
atgagcgtgatgaagccctgcctgatgaccatcgccatcctgatgattctggcccagaagacaccaggaggtctatttcgcagccacaacggcaagtccagggagccctggaatccgtgtgagctgtatcaaggcatgtgtcggaatgcatgcagggaatatgagatccagtatctgacatgccccaatgaccagaagtgctgtctgaaactcagcgtgaaaatcacttcgtctaagaacgtcaaggaagactacgactctaatagcaatctgtcggtgacgaacagctccagctactctcatatctag

SEQ ID NO: 9436 - DNA, 267 bp, Artificial Sequence
  Description of Artificial Sequence: Synthetic coding sequence
atgctgcccgaccacttcagccccctgagcggcgacatcaagctgagtgtactagcgctggtggttttagtggtcctcgctcagacagccccagacggatggatacgacgctgctactatgggacaggacggtgcagaaagagctgcaaagaaatcgaaaggaagaaggagaaatgcggagagaagcatatttgctgcgttcctaaggaaaaggacaagctcagccacatacatgatcaaaaggagactagcgagctgtatatttag

SEQ ID NO: 9437 - DNA, 1401 bp, Artificial Sequence
  Description of Artificial Sequence: Synthetic coding sequence
atgaagccccccctgctggtgttcatcgtgtgcctgctgtggctgaaagatagccactgtgctcctacttggaaggacaagactgctatctccgagaacctaaagtccttcagcgaagtgggagaaatcgacgcagacgaggaagttaaaaaggcactgacaggcattaaacaaatgaagatcatgatggaaagaaaggagaaagagcatactaaccttatgtccacattaaagaaatgccgtgaagaaaagcaggaggccctcaaactgttaaacgaagtgcaggaacatctggaggaagaagagaggctgtgtcgcgagtccctagctgattcttggggcgagtgccgatcatgcctagagaacaattgcatgcgcatctatactacttgtcagccgagttggtcctccgttaagaacaaaattgaaaggttctttcggaagatctatcagtttctgttcccattccatgaggataatgagaaagacctgcctatctccgaaaaacttatcgaggaagacgctcaactgacccagatggaggacgtctttagtcagctcactgtggacgtgaatagcttgtttaataggagcttcaatgtgttccggcagatgcagcaggagttcgaccagactttccaaagtcactttatcagtgatacagacttaaccgagccttactttttccctgcctttagtaaggagccaatgaccaaagcggatcttgagcagtgctgggatattcctaatttcttccagcttttctgcaactttagtgtcagcatctacgaatctgtcagtgaaaccataacaaaaatgctcaaggcaattgaggacctgcccaagcaggataaggctccagaccacggtggactgatctccaagatgttgccaggtcaggatcgggggctgtgtggagaattggatcaaaatctctctcggtgctttaagtttcatgaaaagtgccagaaatgccaagctcacctcagtgaggattgccctgacgtaccagccctgcacaccgagttggacgaggccattcgactagtgaacgtgagtaatcagcagtacggacaaatactccagatgacaagaaaacacctcgaagacacagcatatctcgtggaaaaaatgcgtggccagttcggatgggtgtccgagctggctaatcaagcaccagaaaccgagatcatcttcaactctattcaggtggtcccccggatccatgagggaaatatttcaaagcaggacgagacaatgatgaccgatctaagcattcttcctagcagcaactttactctgaagattcctctggaggaaagcgccgagagcagtaatttcatcggatatgtcgtcgctaaggctttacagcattttaaagagcacttcaaaacatggtag

SEQ ID NO: 9438 - DNA, 207 bp, Artificial Sequence
  Description of Artificial Sequence: Synthetic coding sequence
atgaagctgtgcgtgaccgtgctgagcctgctggtgctggtggccgcattttgctcacttgcactaagtgcacctacaaagtcgagcgaatggaagctccagggcgtctgtttccagtgctgcagtggaaaagaccccatacatcagtcttgtcccacgtggacgatggtgcgccaaagaaaaatgcctactacaggcaagggctag

SEQ ID NO: 9439 - DNA, 420 bp, Artificial Sequence
  Description of Artificial Sequence: Synthetic coding sequence
atgtacaagctggccagctgctgcctgctgttcatcggcttcctgaaccccctgctgagcctcccgctgttagacagccgggaaatttctttccagttatccgcaccacatgaggacgcacgcttgactccagaggagctagagagagctagtctgctgcagatcctgcccgaaatgttgggtgccgagcggggcgatatattaagaaaggccgatagcagcaccaatatctttaacccgcgggggaatttgagaaagtttcaggacttctctggccaggaccctaacatactactgtcacacctgctcgcaaggatatggaagccatacaaaaagcaacgccggaaactgaggcaggatcttcgcctttggaagaaggagcctggcctcagaattttcaaaaattacgtctatatctag

SEQ ID NO: 9440 - DNA, 1974 bp, Artificial Sequence
  Description of Artificial Sequence: Synthetic coding sequence
atgcggaccgtggtgctgaccatgaaggccagcgtgatcgagatgttcctcgtcttgctggttacaggcgtgcactcaaacaaagaaactgctaagaagatcaagaggcccaagtttactgtcccgcagatcaattgtgatgttaaagccggaaaaatcatcgatccagaatttatcgttaagtgtccagcagggtgccaggaccccaagtatcatgtctacggcaccgatgtgtacgctagttattcgtctgtgtgcggggccgcagtccacagtggggttctggacaatagcggcggcaaaatcctggtgagaaaggtcgcggggcaatctgggtataagggctcttacagtaatggggtgcagtctctctcgctgccccgctggcgagagtcctttattgtcctggaatcaaagccaaagaagggagttacctatcctagcgcgctgacctattccagtagtaagagtcccgctgctcaggctggagaaaccactaaagcttatcagcgaccgccaatcccaggaacaaccgcccagcccgtgaccctcatgcagctcttggccgtcaccgtagccgtggctacacctaccactctcccacgcccttccccatcagcagcatcgactaccagtatcccccggccccagtcagtgggacacagaagccaagagatggatctgtggtctacagcgacatacacatccagccaaaaccggccccgggccgaccctggcatccaaagacaggacccgtcaggggccgcatttcagaagcccgtaggggccgacgtgtctctggattgcaaaatagacctctccttcctcatcgacgggagcacttctattggcaaaaggcgcttccggattcaaaaacaactgctggcagatgtggcccaggccctagatattggtcctgctgggcctctgatgggcgtggttcagtatggcgataatccagccacccactttaatctgaaaacccacacaaattctcgggatttgaaaacagccattgagaagattacgcagagaggggggcttagcaacgtcggccgcgccattagcttcgtcacgaagaatttcttcagtaaggctaatggtaaccgcagcggagctccgaatgtcgtggtagtgatggtggatggttggcccacagacaaggtagaggaggcaagcaggctggcacgcgagagcggcatcaacatattctttataaccattgagggcgctgcggaaaatgaaaaacagtatgtggtcgagcctaacttcgcgaataaagcggtctgcagaactaatgggttctattctctgcacgtgcagtcttggttcgggcttcataagaccttgcagcccctggtgaaacgtgtttgcgataccgaccgcctagcctgttcaaagacctgtctaaactcagccgacatcggcttcgttatcgatggctcaagtagtgtgggaactgggaatttccgcactgtcctccagttcgtcaccaacctgactaaggagttcgaaatttctgatacagacacccggattggcgccgtgcagtacacctatgagcagcggctggagttcgggttcgataaatacagctctaaaccagacatcctgaatgcaatcaagcgtgtgggatactggagtggaggaacatccactggggcagcgattaatttcgcactggaacagctgtttaagaagtctaaacctaataaacggaagctgatgattttaattacggatggccggtcctatgatgatgttagaatacccgcaatggcagctcatctgaagggcgtgatcacctacgcgataggagtcgcctgggcggcacaggaggagctagaggtgatagccactcaccccgccagagaccacagtttctttgtggatgagttcgacaacctacatcagtatgtccctcggatcatccagaatatctgcactgagtttaattcgcagcctagaaactag

SEQ ID NO: 9441 - DNA, 3975 bp, Artificial Sequence
  Description of Artificial Sequence: Synthetic coding sequence
atgcggcacggcgtggcctgggccctgctggtggccgccgccctgggactcggagcaagaggggtgcggggagcagttgccctggcagacttttaccctttcggagcggagaggggagacgcagttacccctaagcaagacgacggtggctcaggcctgagaccactgagcgtgccgtttcccttctttggagctgagcactccgggctctatgtgaacaacaacggcatcatttcttttcttaaggaagtcagtcaatttacgccggttgcgttccccatcgccaaggatagatgtgtcgtcgctgcgttttgggccgatgtggataaccgaagggccggggacgtgtactatcgcgaagcaacagaccccgccatgctgagacgcgccacagaggacgttaggcattacttccccgaactgctggacttcaatgcaacttgggtgtttgtagcaacttggtaccgggtgacttttttcggagggtcaagctcctcgcccgtgaatactttccagactgtactcatcaccgatggtaagctgtcattcacaattttcaactatgaatccatcgtctggactaccgggacacatgcctcttccggcggtaatgcgactgggctagggggtattgccgcccaggctggctttaatgctggtgacgggcagcgctattttagcattccaggtagtcgcacagctgacatggcagaagtcgagaccacaaccaatgtgggagtgccagggaggtgggcttttaggatcgacgatgctcaggtgagagtaggcggttgtggacacactaccagcgtgtgtctagcccttcgtccttgcctcaacggcggcaagtgcattgacgattgtgttactggtaaccctagctacacctgctcatgcctatccggttttactgggaggcgatgtcatctcgatgtcaacgagtgcgcctcccagccctgtcaaaatggtggcacatgtactcacggcataaactcattcagatgccaatgtcctgccggcttcggcgggcccacttgcgagactgcccagagcccctgtgacacgaaggagtgccagcacggtggccagtgccaggttgagaacggaagcgcagtttgcgtgtgtcaggctggctacaccggagccgcttgcgagatggatgtcgatgactgctcacctgatccatgtttgaacggcggatcctgtgtggacttggtgggaaattatacttgtctgtgcgctgagccctttaaaggactgaggtgtgaaacaggcgaccacccagtacccgacgcctgcctgagcgcaccgtgtcacaacgggggaacatgcgtggatgccgaccaaggatatgtctgtgaatgtcccgaagggttcatgggtcttgattgcagggagagagtacctgacgattgtgaatgtcggaacggtggaagatgtctgggagccaatacgacgttgtgccagtgtcccctcggtttcttcggattgctgtgcgagtttgaaattacggctatgccctgcaacatgaatacccagtgcccagacggtggttattgtatggaacatggtggctcctacctgtgtgtgtgtcataccgaccacaacgcatcgcacagtctgcccagcccatgcgacagtgacccctgctttaatggaggtagctgtgacgcccacgatgatagctacacctgtgaatgccctcggggcttccacggcaaacactgtgagaaagcccgcccacatctctgttcctcagggccgtgtagaaatggggggacgtgcaaagaggctggaggcgagtaccactgttcctgtccatacagattcacaggacggcactgtgaaatcggaaagccagattcttgtgcatccgggccttgtcacaacggcggtacatgtttccactacatcggaaaatacaagtgtgactgccctccaggctttagcggtcgccactgcgagattgctccaagcccttgttttagaagcccctgcgttaacggaggaacctgcgaggatcgagataccgattttttctgccattgccaggcagggtacatggggcgccgttgtcaggccgaggtcgattgcggcccaccagaagaggtgaagcatgccaccctgagatttaacggcacccggttgggagccgtcgcactctacgcttgcgatcgaggatactctctgtccgccccatcgcgaattcgagtgtgtcagccccatggcgtctggtcagaaccaccccagtgcctggagattgatgagtgtcgctcccagccctgtctgcacggcgggtcctgtcaggaccgcgtcgctggctatctctgtctgtgcagtacgggctacgagggggcccattgtgaattggagcgcgacgaatgccgggcccatccgtgccgaaacggtgggtcatgtcgtaatctccctggcgcgtacgtctgtcgttgcccggccggcttcgtgggagtgcattgcgaaacagaagtggatgcctgtgactcttccccttgccaacatggaggccgctgcgagagcggcggtggagcttatttgtgcgtctgccccgaatcctttttcggctaccattgtgagacagtttccgatccctgttttagttccccatgcggcggcaggggttactgcctcgcatctaacggctcccacagttgcacctgcaaggtaggctacactggggaagactgcgctaaggagttgtttccacccacggctttaaaaatggaaagagtggaggaaagcggggtatctatatcttggaatccacccaacgggcccgcagctaggcaaatgcttgacggttatgctgtgacttacgtatcctcagacggatcatataggagaactgattttgtggaccgcacacgctcaagccaccagcttcaggcccttgcagccggtagagcatacaatatatctgtattttcagttaaacggaactctaataacaaaaatgatatcagcaggcccgctgtgttgcttgcaaggacacgcccccgtccggttgaggggtttgaggtgacgaacgtgactgctagtactatttctgtacagtgggccctgcatcgaatcaggcacgccactgtaagtggcgtgagagtcagcatccggcaccctgaagcccttcgtgaccaggccacagatgtggacagatccgtggacagattcaccttccgtgccctgctgcctggaaagagatatacaatccaactgacaaccctgtccgggttgcgcggagaggaacatcccacagaatcacttgccaccgcccccacacatgtttggacaaggcctttgcctcctgccaatctgaccgcggcaagggtgaccgccacaagcgcccatgtggtctgggatgcccccacgcctggctccctgttggaagcttacgtgatcaacgttacgacgtcacagtcgacaaaatctcgctacgtgcctaacggcaagctggcctcatatactgtgcgagatcttctgcccggtcggcggtaccagctgagtgtaatcgctgtgcagagcactgaactggggccgcagcattccgaacctgcccatctctatatcataactagccctcgggacggtgccgacaggagatggcatcagggaggccatcacccccgggtgcttaaaaacaggccgccgccagctaggctgcctgaactgcggttgttgaacgatcactccgcccctgaaacacccacacagccccccaggttcagcgaattagtcgacggacgagggcgcgtctcagccaggttcggcgggagtccttctaaagctgccacagtaaggtcccagccaaccgcaagcgcgcaactcgaaaacatggaagaagcgcccaagcgggttagtctggctctccagctcccggagcacggatccaaagatatcggaagcgagagtgctgcactcgtgggaacgctaggtctgaccgattgttcacaaggaccatag

SEQ ID NO: 9442 - DNA, 732 bp, Artificial Sequence
  Description of Artificial Sequence: Synthetic coding sequence
atgggcatcttcctggtgtacgtgggcttcgtgttcttcagcgtgttgtatgtccagcaggggctgtcgagtcaggcaaagtttacagaattcccaagaaatgtgacagctactgagggccagaatgtcgaaatgagctgcgccttccagagtggctctgcttctgtgtaccttgagatccagtggtggttcctgcgaggaccggaggatctggaccccggcgctgagggagccggcgcacaagtggagctgttgcccgaccgtgaccctgattccgacggcacaaaaatcagtaccgtgaaggtgcaaggcaatgatatcagccataagcttcagatcagcaaggtgcgaaagaaggacgagggactgtacgagtgtagagttactgatgccaattatggcgagcttcaggagcacaaggcacaagcctacctcaaagtcaacgctaacagtcacgcacgccgaatgcaagcctttgaggcttctccaatgtggctgcaggacatgaagcctaggaaaaatgttagtgcagccattccctctagcattcatggatcggctaatcagaggacgcacagtacctccagcccccaggtcgtggccaagattcccaaacagtcacctcagtcggggatggaaacccactttgaaccgtttatcctccctttaactaacgccccacagaaggggcagagttaccgcgttgacaggtttatgaacggcgacttctag

SEQ ID NO: 9443 - DNA, 1218 bp, Artificial Sequence
  Description of Artificial Sequence: Synthetic coding sequence
atgtggtacgtgagcacccggggcgtggccccccgggtgaacttcgagggggccctttttagcggctatgcaccggatggcggcctgtttatgcccgaggaactgcctcagcttgaccgcggcaccctttgccagtggtcaaccctgtcctatcccggcctagtcaaagagctgtgcgcccttttcattgggagcgaacttcttcccaaggatgaactgaatgacttaattgatagagcgttcagtcggttcaggcacagggaggttgtgcatttgagccgcctgcgcaacgggttgaatgtgctggaattatggcatggagtgacatacgccttcaaagatctctcactaagctgcactactcagtttttgcaatatttcctggagaaaagggaaaaacatgtgacagtggtagtcggtaccagtggtgataccggttcagcggccattgagagtgtgcagggtgcaaagaacatggacattattgtactgctgcccaaagggcattgcaccaagatccaggagctgcagatgactaccgtgcttaaacagaatgttcatgtgtttggggtggaaggcaactctgatgagttggatgagccaataaaaaccgtgtttgctgacgtggcctttgttaaaaagcacaatctaatgtcattgaattctattaattggtctcgcgtcctggtacagatggctcatcatttcttcgcctactttcagtgtaccccgagccttgacacacacccccttccactggtcgaagtggttgtaccaaccggagcagctggcaacctggctgccgggtacatcgctcaaaagattggtctccccatacgccttgttgtagctgtaaacagaaacgacattatccaccgaaccgtacagcagggcgattttagcctaagcgaagctgtgaagagcacccttgcgtccgccatggatatccaggttccttacaatatggagagagtcttctggcttctgtccgggtccgattctcaggtgactcgcgctctgatggagcagttcgagaggacccagtccgttaacctgccaaaagagcttcacagtaaatgggagcgtcaggactatgagaagatggcagtcatggaatgcgacggatgctgtgtcgagctgtgcctggggaactgcgggcctcgtcgcggctctgtgaccgatatccctggtaccgctatggtcagagggggaggatag

SEQ ID NO: 9444 - DNA, 573 bp, Artificial Sequence
  Description of Artificial Sequence: Synthetic coding sequence
atgcggaccgtggtgctgaccatgaaggccagcgtgatcgagatgttcctggtgctcctggtcacgggagtccatagtaacaaggagaccgcaaagaaaattaaacgccctaagtttactgtgccacagattaactgcgacgttaaggcgggaaaaatcatcgacccagagttcattgtgaaatgcccggcaggatgtcaggatcctaagtaccacgtgtacggcaccgacgtgtatgccagctacagctctgtgtgtggcgccgccgtacacagtggagttctggacaattcaggcggtaagatattagtacggaaggtggccgggcagtctggctataagggctcttacagcaacggtgtgcagagtctctccctcccgcgttggagagaatccttcattgtgctcgaatctaagcccaagaagggcgtgacgtaccctagtgctctgacatacagttctagtaagtctccagcggctcaggcagacctgtggagcacggctacttacacatctagtcagaatcggcctcgggctgatcctgttcagcgccaaccttgttacagtttgtag

SEQ ID NO: 9445 - DNA, 399 bp, Artificial Sequence
  Description of Artificial Sequence: Synthetic coding sequence
atggcccccagcccccggaccggcagccggcaggacgccaccgccttgcctagcatgtctagtaccttctgggcctttatgatccttgcctcactgctgatcgcctactgcagtcagctggcggctggcacgtgcgaaatcgtcacgcttgaccgcgactcttcccaaccccggaggactattgcgcgccagacagcccgctgcgcatgcagaaagggacagattgcaggtaccactcgtgcaagacccgcttgcgtggatgcaaggatcatcaaaacgaagcagtggtgtgatatgctaccgtgcctggaaggagaggggtgtgatttactaattaatcggtctggatggacctgcacacagccgggcggaagaattaaaactacgacagtgtcttag

SEQ ID NO: 9446 - DNA, 957 bp, Artificial Sequence
  Description of Artificial Sequence: Synthetic coding sequence
atgctgcccctgaccatgaccgtgctgatcctgctgctgctgcccacaggacaggccgctccaaaagacggcgtgaccaggccagattccgaggtccagcatcagcttcttcctaatccttttcagcccggacaggaacaactgggcttgcttcaatcctacctgaaaggccttggaaggaccgaggttcaactggagcatctgtcgcgagaacaagtccttttgtatctgtttgctctgcacgactatgaccaatccggacagctggatggtttagaattgctgtcgatgcttacagccgcgctcgctccaggtgctgcaaactcccccaccaccaaccctgtgatcctgattgtggataaggtgctcgagacccaggacctgaatggggatggcctaatgacaccagcagagctaataaacttccctggtgttgcgcttaggcatgtggagccaggagagcccctcgccccatcgccacaggagccccaggctgtcggtcgtcagtctctactggcaaaatcacctctgcggcaggaaacccaggaggcaccaggccctcgggaggaagctaaaggccaggtcgaggcacggagagaatcactggaccccgtgcaggagcccggcggccaggctgaggccgacggagatgtgccaggacccaggggagaggctgaggggcaggctgaggcaaaaggagacgcacccgggcctcgtggagaggcaggcggccaagcagaggccgagggagacgcccccgggccccggggggaagcggggggccaggctgaagcggaaggagatgctccggggccacggggggaggccgggggccaggcggaagccagggagaatggggaagaagcgaaggaactgcctggagagaccctggaatcaaagaatacccagaacgacttcgaggttcacattgtacaggtggagaacgacgaaatctag

SEQ ID NO: 9447 - DNA, 399 bp, Artificial Sequence
  Description of Artificial Sequence: Synthetic coding sequence
atgctgcccctgaccatgaccgtgctgatcctgctgctgctgcccacaggccaggcggcaccgaaggacggagtcaccagacctgattcagaggtgcagcaccaactcctgcccaatcctttccagcccggacaagagcaactcgggctgctgcagagttatttaaaagggttgggccgaacagaagttcagctcgaacatctctcgagggaacaggtgctcctctatctgtttgcattacacgattacgatcagtccgggcaattggatgggctggaacttctttctatgctcacggcagcccttgcacccggagccgccaattcccctacaaccaatccaggcaatttagacgctcgacttgacggcggcgagaaagcgatgcagccacaatggtag

SEQ ID NO: 9448 - DNA, 732 bp, Artificial Sequence
  Description of Artificial Sequence: Synthetic coding sequence
atgctgctgagcctgctgggcgcctgcgccgtggtgggccccttccacggtccagaatgggagccagtgcaaggcctcctgagccagaaccacagctgtagagacccccagtgttgtggcaacctcctcgttctgtgcctgttcctcgtctggcaagtgaggcactgctggcaccaagtaacacgcacacggttttctacgagaaacgtcattaaggtccctctgcagaagcgggccgtgccctctatgcgatgcgagaccgtgttcaaactgacacccgagtttttttcgccaggcaaatctcgcggcctggacagccagcagtgtgcacaacgacagaggtggggatatagacgttcactccaggagtcctgggcccagaacctgctgagcccccaacatccttgtccaggacccccctcaggggtgcacacgcatagcgagcctatcttctgtaccacatctatcagcaatacatgtctgctgcctcagaatagcagctggaaagcttggcaagtgccctggtgcctgcatgacggccaaacccgcccagcactggatatgtgccaggagatggaacagctgttacttcactcccaagaaagattggtgtccctcgagccggtcatctccgtaaggagccgtccaacaagtatgaccctcactacctccctaccgaatctcctatcagcggagaggcttcagttctgtccgcagcgcgcaccagcttag

SEQ ID NO: 9449 - DNA, 2505 bp, Artificial Sequence
  Description of Artificial Sequence: Synthetic coding sequence
atgaagcacaccctggccctgctggcccccctgctgggcctgggccttggcctagccctgtctcagctagccgcgggcgccacagactgtaaatttctcggacctgcagagcacttaactttcaccccagcggcacgtgcgagatggctggcccctcgggtcagggcacctggcctgctcgattctctttatggtactgtcaggcgtttcttaagtgttgtgcagctcaacccctttcctagtgagttagtgaaagccctgcttaacgagctggcgtccgtaaaggtgaacgaggttgtgcgttatgaagccggctacgtggtgtgtgctgtaatcgccggactttatctccttctggtccccaccgccggcctgtgcttctgctgctgccggtgccaccggagatgtggcggacgggttaagaccgagcacaaagctcttgcttgcgagcgggctgccctcatggtttttcttttgctgacaaccctactgctgttaatcggtgtggtgtgtgctttcgtgacaaaccagaggactcacgagcagatgggcccaagcattgaggccatgcccgaaactctactctcgctgtgggggttggtgagtgacgtcccacaggaactgcaggccgtggcccagcaatttagtctaccacaggagcaggtgtccgaagagctcgatggggttggcgtgtctatcggctcagccatacatacgcagttgaggagctcagtttacccactgctggccgctgtcggctcccttggacaggtgcttcaagtcagcgtgcaccacctccagacactgaatgccaccgtggtggagctgcaagcaggccaacaggacctcgagcccgctatccgtgaacatcgggaccgccttctggaactgctgcaggaggcaagatgccagggagactgcgcgggagccctgagctgggccagaactctcgagctgggcgccgacttctcccaggtcccatcggtcgaccatgttctccaccagctcaagggggtccctgaagcaaatttcagctccatggtccaggaggaaaacagtacattcaatgcactgccggccctggcagcaatgcagacatcaagtgtggtccaggagttgaagaaggctgtcgcacaacagccagagggcgtgcggaccttggcagaagggttccccggtctagaagcagctagccggtgggctcaggccctccaagaggtggaggagagttcacgcccttatctccaggaagtgcagcgctatgaaacttatcgatggatcgtaggatgcgtcctttgttccgtggtcttgtttgtcgtgctgtgtaacttgctcggactgaatctggggatttgggggttgtctgcgcgagatgatccttctcatcctgaggcaaagggagaggccggagctaggtttcttatggccggggtaggtttgtcgtttctgttcgccgcacccctgattctccttgtttttgccacctttttggtgggtgggaatgtgcagacccttgtgtgccagagctgggagaacggggagctctttgaatttgccgacacaccggggaacctgccacccagcatgaacttaagtcagcttctggggcttcgtaaaaacatcagcatccaccaagcataccagcagtgcaaggagggtgcagccctttggactgtcctgcagttgaatgacagttacgaccttgaagaacacctggacatcaatcagtatactaacaagttacggcaagaactccaaagcttaaaagtcgatacccagagccttgatcttttgagctcagcggcgagaagggaccttgaggccctccagagctcaggcctgcaacggatccattatcccgatttcctcgtgcagatacagcggccggtcgtcaagacctccatggagcagctggcccaggagctgcaaggccttgctcaagcacaggataattctgtcctagggcaaagattgcaggaggaggctcaaggacttcggaatttacatcaggagaaggtcgtgcctcaacaaagtctggtcgctaaactgaatttatctgtacgtgccctggaaagttctgcgcctaacctacaacttgaaacttccgacgtcctggctaatgtgacatacctgaagggggagctaccggcatgggccgcccgaatcttgcggaacgtgtccgagtgttttctggctagggagatgggttatttctcccagtatgtggcttgggttcgggaggaggtaacccaaagaatcgcaacatgccagccccttagcggagcactggataattcccgtgtcatcctgtgtgatatgatggccgacccatggaatgcgttttggttttgtttagcctggtgcacgttcttcttgataccaagtatcatctttgccgtcaaaacatccaagtatttcaggcctattcggaagagactgtcttccacttcctcagaggaaacccagctgttccatatccccagagtaacctccctgaagctctag

SEQ ID NO: 9450 - DNA, 1185 bp, Artificial Sequence
  Description of Artificial Sequence: Synthetic coding sequence
atgtggcggtgccccctgggcctgctgctgctgctgcccctggccggtcatctggctctgggggcacagcaggggagagggaggcgcgagctcgcccccgggctccatctgcgcgggattcgcgatgcgggagggaggtattgtcaggaacaggacctttgttgcaggggaagggcggatgattgcgcactgccttatctgggggcaatctgttattgcgatctgttctgtaaccgcactgttagcgactgctgtccttttccccccatccaggggtgtatgcatggtggccggatctaccccgtactgggtacctactgggataattgcaatcgctgtacgtgccaggaaaaccgccagtggcagtgtgaccaggagccatgtctggttgaccccgacatgattaaggctattaaccaggggaactatggatggcaagccgggaaccactctgctttttgggggatgaccctggatgagggtattaggtatcgcctggggactatccgcccgtcaagctcagtgatgaacatgcacgaaatttatacagtgcttaaccctggcgaagtcttacctaccgcttttgaagcgagcgaaaagtggccaaacttgattcacgaaccacttgaccagggcaactgtgccggaagctgggccttcagcaccgccgcagtggcctctgacagggtttcgattcatagcctaggtcacatgacaccagtactgtcaccccaaaacctgctatcctgtgacacacatcagcaacagggctgtaggggggggcgtttagacggcgcatggtggttccttagaagacgcggagtagtaagtgaccactgctatcccttttctgggcgagagagggacgaagcaggaccggcaccaccctgtatgatgcactcccgcgccatggggcgcggcaaacgccaagccactgctcattgtccaaattcctatgtcaataacaacgatatctatcaggtcacaccagtatatagactgggatcaaatgacaaagaaattatgaaggaactcatggaaaacgggcccgtgcaggccctgatggaggtccatgaggattttttcctctataaaggtggtatctactcacacacgccggtatcgctagggcggccagaacgttaccgtcggcatgggacacattcagtgaaaatcacgggatag

SEQ ID NO: 9451 - DNA, 303 bp, Artificial Sequence
  Description of Artificial Sequence: Synthetic coding sequence
atggccgccgccctggccctggtggccggcgtgctgagcggcgccgttctgccactgtggtctgcattaccccagtacaagaaaaaaatcacggaccggtgctttcaccattccgagtgctatagcggatgctgcctaatggacctcgactccggaggggctttctgcgcaccccgagctcggatcacaatgatatgtctgcctcaaacaaagggcgccacaaatatcatatgcccttgtagaatgggtctgacatgcatttccaaggacctcatgtgctctcgccgatgtcatatgatatag

SEQ ID NO: 9452 - DNA, 978 bp, Artificial Sequence
  Description of Artificial Sequence: Synthetic coding sequence
atgcggctgccccggcgggccgccctgggcctgctgcccctgctgctgctcctgcctcccgcacccgaagcagcaaaaaagcctactccatgccatagatgccggggattagttgacaaatttaaccaaggcatggttgacacagcaaaaaaaaattttgggggtggcaatactgcctgggaggaaaagaccctgtccaaatacgaatcgagcgagattcggctactcgagattctggagggattgtgcgaatcatcagatttcgaatgcaatcagatgctagaagcacaggaggagcacttggaagcatggtggctgcagttaaagagcgagtatccggatctcttcgaatggttctgcgtgaagactttgaaggtttgttgctcacccgggacatacggaccagattgtttagcctgccaaggaggatctcaacgcccctgcagcggcaatgggcactgctccggagacggctctaggcaaggcgatggctcctgccggtgccacatgggttatcaaggacccctgtgtacagattgtatggacggctatttctccagtctcaggaatgagacacatagcatttgtacagcatgtgatgaatcgtgtaaaacatgttccgggctcaccaaccgggactgtggtgaatgtgaagtgggttgggtgcttgacgaaggcgcttgtgttgagtgcgattctagttgtgtgggatgtaccggagagggccctggtaactgcaaagagtgcatttctggatatgcaagggaacacgggcagtgcgccgacgtcgacgagtgtagcttagccgagaaaacgtgtgtgcggaaaaacgagaactgctacaacacccctgggtcctatgtgtgtgtgtgcccagacggctttgaggaaactgaggacgcgtgcgttccccctgccgaggctgaagcgacagagggcgaatctcccacccagcttccaagcagagaggacctatag

SEQ ID NO: 9453 - DNA, 459 bp, Artificial Sequence
  Description of Artificial Sequence: Synthetic coding sequence
atgcggggccccggccaccccctgctgctgggcctgctgctggtgcttggggcagcaggtagaggaagaggaggtgccgagccaagagaacctgccgacggccaggcactgctgcgcctggtcgtcgagcttgtgcaggagctgcgcaaacaccattccgcagaacacaagggtctacaactactcgggcgagactgcgccttaggacgcgcagaagcagcaggattgggaccgagcccagagcagagggttgaaatagtcccacgggatcttcgcatgaaagataagttcctgaagcacctcacgggcccattgtatttcagtcccaagtgctctaagcactttcaccgactctaccacaacactagggattgtacaatacctgcctattataagcgttgcgctcgtctcctgacccggcttgccgttagcccagtgtgcatggaagataaacaatag

SEQ ID NO: 9454 - DNA, 411 bp, Artificial Sequence
  Description of Artificial Sequence: Synthetic coding sequence
atggcccggaccaagcagaccgcccggaagagcaccggcggcaaggcccccaggaagcagctagccacaaaagccgctcgtaaaagtgccccagccactggtggtgttaagaaaccacatagatatcgcccagggaccgttgccctgcgcgagataaggcgatatcagaagtccactgagttgcttatccgaaagctgccttttcaacggctggtcagagagatagcccaggatttcaaaaccgatctgcgcttccagtcctccgctgttatggccttgcaagaagcatccgaggcctaccttgtgggactgttcgaggatactaatctctgtgcaattcatgccaaacgagttactattatgccaaaggacattcagctcgcacgccgaatcaggggagaaagggcctag

SEQ ID NO: 9455 - DNA, 1209 bp, Artificial Sequence
  Description of Artificial Sequence: Synthetic coding sequence
atgcggctgccccggcgggccgccctgggcctgctgcccctgctgctattactgccaccagctcccgaggcggccaagaagcccacaccttgccatcgctgccgcgggctagtggacaagttcaatcaaggtatggtggacacagccaaaaaaaatttcggaggtggaaacacagcctgggaagagaaaactctctctaaatacgaaagctccgaaattcgcttgttagagattctggagggtttatgcgagtccagtgattttgagtgcaaccaaatgctagaggcccaagaagaacatctcgaggcttggtggcttcaacttaaaagtgagtatcccgacctcttcgagtggttctgcgtcaaaacactcaaggtgtgttgtagtccagggacctatggccctgactgcctcgcatgccaagggggatcccaaaggccctgctctggaaacggacactgtagcggtgatggaagcaggcaaggagacggctcatgccgatgtcatatgggataccaaggcccactctgtacagactgtatggacggatacttcagttccctgcgcaacgagacacattcaatatgtactgtcaggacagggttgtcagacagctatcctccgtgctgcctgtcgctcggatgctggaggggagtaggacacgcatggatccgaggaagaaatactcatacacaacctggttatagctctcgggtgtggattgccgcttttagccctgcgtgtgatgagagctgcaagacttgctctggactcacaaatcgagactgtggcgagtgtgaagtaggttgggtgcttgacgagggtgcttgcgtcgatgttgacgagtgcgctgccgagcctccaccttgttctgctgctcagttctgtaaaaatgccaatggaagttatacatgcgaagaatgtgatagctcatgcgtaggatgtactggagaagggcctgggaactgcaaagaatgcatctccggatacgcaagagagcatgggcagtgtgcagacgtggacgagtgcagccttgctgagaagacatgcgttcgcaagaacgagaactgttacaatacgcccggaagctatgtgtgcgtttgcccagatggcttcgaagaaaccgaagatgcctgtgtgccaccagccgaggcagaggccaccgagggagagagcccaactcaactccctagccgggaagacctgtag

SEQ ID NO: 9456 - DNA, 633 bp, Artificial Sequence
  Description of Artificial Sequence: Synthetic coding sequence
atgagcgccggcaagatgatgcggaccctgatcaccacccaccccctacccctgctgctactcccccagcagctcctccagctggtccagtttcaagaggtggacaccgattttgacttcccagaggaggacaagaaagaagaattcgaagagtgcttggagaagtttttctcaacggggcccgctcggccacctaccaaagaaaaagtgaaaagaagagttttgatcgagccgggcatgcccctgaatcatatagaatactgtaatcacgagattatggggaaaaacgtctattacaaacacagatgggttgccgagcactattttctccttatgcagtacgatgaactccaaaagatttgctataaccgctttgtgccctgcaaaaatggaatccgaaagtgtaacagaagcaaggggctggttgagggcgtttattgtaatctgaccgaagcttttgagattcctgcctgtaagtacgaatctctttaccgtaaaggatatgtgctcattacttgcagttggcagaacgagatgcagaaaaggatcccccacactatcaatgacttggtagaacccccagagcaccgttcctttctctctgaagatggcgtcttcgttatctcaccatag

SEQ ID NO: 9457 - DNA, 585 bp, Artificial Sequence
  Description of Artificial Sequence: Synthetic coding sequence
atgaccatgcggcacaactggacccccgacctgagccccctgtgggtacttttgctctgtgcacatgtggtgacactgcttgtacgggccactcctgtctcgcaaaccacgactgcagcgactgcctctgtgcggtctacgaaagacccttgtccgtcccaaccgccggtgttccctgccgccaagcaatgcccggccctggaagttacatggccagaggtggaggtgccactgaatggcactttgtccctgtcttgtgtggcatgtagtagattccccaactttagcattttatattggttaggaaatgggtctttcatcgagcacctccctggaagattgtgggagggctctacaagccgagaacgggggtcaacagggactcagctgtgtaaagcgctggtgctggaacagcttacaccagcactgcacagtactaatttctcatgtgtactggtagacccggaacaggtcgtgcagcgacacgtggtgttagctcaactgtgggcggggctgcgagccactttacccccaactcaggaggccctgcccagttcccattcctctccccagcagcagggttag

SEQ ID NO: 9458 - DNA, 4059 bp, Artificial Sequence
  Description of Artificial Sequence: Synthetic coding sequence
atgcggcacggcgtggcctgggccctgctggtggccgccgccctgggcctgggtgcccgaggagttaggggagctgtagccctggcagacttctatccttttggcgctgagaggggtgacgcagtgacaccaaagcaggacgacgggggctctggcctgcgacccttgagtgttccattccccttcttcggtgctgagcattctgggctttatgttaataacaacggaataatcagctttctgaaagaagtttctcagttcacaccagtggcattcccaatcgcgaaagatcggtgcgtcgtggccgcattttgggccgatgtggacaacagaagagctggcgacgtgtactacagggaagcaactgaccccgcaatgctcagacgcgccactgaagatgtgcggcactacttcccagagctcttggactttaatgctacctgggtattcgtggccacatggtacagagtcacgttttttggaggctcttccagctctcccgtgaacacattccagactgtcctgatcaccgacggaaaactgagctttactattttcaactacgaaagcatcgtctggactacggggacccacgcctcgtctggaggaaatgccaccggactgggaggaattgccgcccaggctgggttcaatgctggtgacgggcagcggtacttttccattccggggagcaggaccgctgatatggcggaggtggaaactacaactaacgtgggggtgccggggaggtgggcctttagaatcgatgacgcccaggtgagggtaggcggatgcggccataccacttccgtttgcctggccctgcgcccttgcctaaatggtgggaagtgcattgatgattgtgtaacaggaaatcctagctatacttgcagttgcctcagcggattcactggccgcaggtgccacctagacgttaatgaatgcgccagtcaaccgtgtcagaacggaggaacctgcacccacggaatcaactcatttcgctgccagtgcccagccggtttcgggggccccacatgcgagacagcgcagtcaccatgcgacacgaaagagtgccagcacggaggccagtgtcaggtcgagaatggctccgcagtctgcgtgtgccaagctggctataccggtgcagcctgcgagatggacgtggacgactgttctcctgatccatgtctcaacggaggttcatgcgtagacctcgtgggcaattatacatgcctatgtgccgaaccttttaaaggcttgaggtgcgaaacgggggaccatcccgtgccagatgcttgcctctccgcaccgtgccataatggcgggacctgcgttgacgctgatcagggctatgtgtgtgagtgtccagaaggctttatgggactggattgtcgcgaacgagtccctgacgattgtgagtgtcggaacggcggtcgctgcctgggagccaacactactctgtgtcagtgcccactggggttttttgggttactatgtgagttcgaaatcacagctatgccttgcaatatgaacacccaatgtcccgatggcgggtactgtatggagcatggcggcagctatctgtgcgtatgtcatactgatcacaacgcatcccacagcctgccatctccctgcgacagcgacccctgcttcaacggaggaagttgtgacgctcacgacgacagctatacatgcgagtgcccgaggggctttcacggcaaacattgcgagaaagctaggccccacctttgtagtagcggtccttgccgcaatggtggaacctgcaaagaggccggtggtgagtaccattgctcatgcccctaccggttcaccggacgccactgcgaaattgggaagcccgattcgtgcgcctcgggaccctgccacaacggagggacctgttttcattacataggcaagtacaaatgcgattgcccccccggattctctggtagacactgcgagattgcacctagtccgtgtttccggagtccgtgtgttaacggcggcacatgtgaggaccgtgatacagattttttttgccattgtcaggctgggtacatgggaagacgctgtcaagcagaagtcgactgcggaccgcccgaggaggtgaaacatgccactctccgatttaatgggactagactcggtgccgtggcactgtacgcctgcgataggggatattctctgtccgctcctagccgcattagggtctgccagccccacggtgtgtggagtgaaccaccccagtgcctcgaaatcgacgagtgccggagccagccatgtctgcacggtggttcctgtcaggatagggtcgccggctacttatgcctgtgttccaccggatatgagggagcccactgcgagttggagcgagatgaatgccgggctcacccttgcagaaacgggggtagctgtcgaaacttgccaggcgcttatgtgtgtagatgccccgctgggttcgtgggggtgcactgcgagacagaggtagacgcctgcgattcgtcaccctgtcagcatggaggacggtgtgaatctggtggcggggcatacttgtgtgtgtgccctgaatcctttttcgggtatcactgcgagacagtttcggatccctgctttagctccccttgtggtggtcgaggatactgcctcgcctcaaacggctctcactcatgcacatgcaaagtgggctacaccggagaggattgcgccaaggaactctttccacccaccgcccttaagatggagagagtcgaagagtccggagttagcatctcatggaatccacctaatgggcctgctgcccggcagatgctcgatgggtatgctgtgacgtacgtgtcatcagacggaagctaccgtagaacggatttcgtcgatcggacgcggagcagtcatcagctgcaggctcttgccgctggcagggcctacaacatcagtgtgttttctgtgaaacgtaactccaataataagaacgacatctcaagacccgctgtactattggccagaacccgccctcgacctgtcgaagggtttgaagtgaccaacgtgaccgccagcacgatttccgtacaatgggccttacatagaatccggcatgctacagtttctggcgtgcgggtgtcaattcgacatcccgaggcgctccgtgaccaggctaccgacgtcgatcgctcagttgatcgctttactttccgggccctgctgcctggaaagagatacacaattcagctgaccaccctgtccgggcttcgaggagaggagcatcccaccgaatccctggccaccgctcctacgcatgtttggacacggcctctgcccccagcaaatctgaccgccgcaagagtgacagctacaagcgcgcacgtcgtgtgggacgccccgacacctgggagcctgcttgaagcttacgttattaacgttaccacatcccaaagtaccaagtcgcgctacgtcccaaatggcaaattggcctcttatactgtcagggatttactccccggccggcgatatcagctgtcagttatcgccgtgcagtcaaccgaactggggcctcaacactcggaacctgcccatctgtacattattacaagcccgcgggatggtgctgataggaggtggcatcagggtgggcaccaccctcgggtgcttaagaaccgtcccccgcctgccaggttgcccgagctgcgactgctgaacgatcatagcgcccccgagacaccaactcagccacctagattttcagaactggttgatgggcggggaagagtgtccgcgcgcttcggaggaagcccctccaaagccgcaacggtaaggagccatgtccccgggaattgctctgagaatccttgtcagaacggaggtacttgcgtgccgggggcggatgcccactcttgcgattgtgggcccgggttcaaaggcaggcgatgtgaactggcgtgcataaaggtttcgagaccatgcactcggctgttctccgagaccaaggcattccccgtctgggaggggggagtttgccaccacgtgaaacaatcaaaaagccagacgttagagaagtcttag

SEQ ID NO: 9459 - DNA, 957 bp, Artificial Sequence
  Description of Artificial Sequence: Synthetic coding sequence
atgctgcccctgaccatgaccgtgctgatcctgctgctgctgcccacgggccaagcagcacctaaggatggcgttactcggccagacagtgaggtgcagcaccagctgctgcccaaccctttccagccaggccaggaacagcttggattactgcagagctaccttaagggactgggaagaaccgaggttcagcttgagcacctgtcccgagagcaggtcctgctgtacctcttcgctctgcacgattacgaccaaagtggtcagctggatgggttagaactcctttctatgttgacagccgctctcgctcccggcgcagccaatagcccgaccacaaaccctgttatcctgattgtcgacaaggtgctggagacacaggacttgaacggcgatgggcttatgactccggccgaattaatcaacttcccaggtgttgcattacggcatgttgagcctggggagcctttagccccctctcctcaggaaccccaggccgtgggccgccagtctctcttggccaagtcacctctgagacaggagacgcaggaagcgcccggtccccgtgaagaagctaaaggacaggtggaggcaagacgtgaatcccttgaccccgtgcaggagccaggcggacaggcagaggctgatggcgacgtccccggcccacgaggcgaggccgagggtcaagctgaggctaaaggagatgcaccaggtccacggggggaagcaggcggtcaagccgaagccgagggagatgccccgggacccaggggcgaggccggtggccaggccgaagctgaaggcgatgccccgggacctagaggtgaagctggaggccaggctgaggcaagggagaacggcgaagaggctaaagagctccctggcgaaaccctggaatccaaaaacacccagaatgactttgaggtgcacatcgtgcaggtggagaacgacgaaatctag

SEQ ID NO: 9460 - DNA, 816 bp, Artificial Sequence
  Description of Artificial Sequence: Synthetic coding sequence
atgcaggccgcctgctggtacgtgctgttcctgctgcagcccaccgtgtacctggtaacatgcgcaaatttaactaatggcggaaagtcggagctccttaagtccggctcctctaagtcaacgctgaagcacatttggacagagagcagcaaagacttgagtatctcacgtcttctcagccagactttccggggtaaggagaatgatacagacctcgatctcaggtacgatacccccgaaccctatagcgagcaagacctgtgggattggctcagaaattcgaccgacttgcaggagcccagaccacgggccaaacggagacctattgtcaaaactgggaaatttaaaaaaatgttcggatggggcgatttccactctaacatcaagaccgttaagctcaatctgctgataacgggcaaaatagtggatcacggcaatggcacattttccgtgtactttcgccacaactctacaggtcagggcaacgtaagcgtttcactcgtcccccctacgaagatcgtggagtttgacctcgcccaacaaaccgtcatcgacgcaaaggatagtaaatccttcaactgtcgcatcgagtatgagaaggttgacaaggctacgaagaacacactgtgcaactacgatccatccaagacctgctaccaggagcaaacccagtcacacgtcagctggctctgcagcaaaccctttaaagtgatttgcatctacatctctttctacagtaccgattacaagctcgtgcagaaggtatgcccagactacaactatcattctgacaccccatactttccctctgggtag

SEQ ID NO: 9461 - DNA, 999 bp, Artificial Sequence
  Description of Artificial Sequence: Synthetic coding sequence
atgctgctgctggccgccgccttcctggtggccttcgtgctgctgttatatatggtctcccccctgatatcacctaaaccgctagccctgccaggagctcacgtggttgtgacaggagggtccagcggtataggtaagtgtattgcaatcgagtgctataaacagggagccttcatcactctcgtagccaggaacgaggataaactgctccaggctaagaaggagatcgagatgcacagcatcaacgacaagcaggtcgtcttgtgtatttctgtagatgtcagtcaagactacaaccaagtggagaacgtcattaagcaggcccaggagaagcttggccccgtggacatgttggttaactgtgctggcatggccgtaagtggcaagttcgaagatcttgaggtcagcacttttgaacgactgatgagtataaactacctgggatcagtgtaccccagcagagccgtcataaccactatgaaagagaggcgcgtagggagaattgtcttcgtcagttcccaggctggccagctcggactattcggctttaccgcctattccgccagtaaattcgccatacggggtctcgccgaagccctgcagatggaggtgaagccatataacgtgtatattacagtggcctatcccccggatacagacacgcctgggttcgcagaggagaacagaacaaagcccttggagactagattaatctctgagaccacttcggtttgcaagccagaacaggtagcgaagcagatcgttaaggacgccatacagggaaattttaacagctcacttggcagcgatggatatatgctttcagccctcacgtgcggtatggccccagttacttccatcaccgaaggacttcagcaggtcgtgacaatgggcctgtttcgtaccattgcgctattctatctgggctctttcgatagtattgtccggcgatgcatgatgcagcgagagaagagtgaaaacgccgataaaacggcatag

SEQ ID NO: 9462 - DNA, 1497 bp, Artificial Sequence
  Description of Artificial Sequence: Synthetic coding sequence
atgagcttcagcgccaccatcctgttcagcccccccagcggcagcgaagcaagatgttgctgctgtgcctgcaagtctgaaacaaacggaggtaataccggtagccagggaggaaatccaccacccagcaccccgattacagtcaccggacacggcctcgccgttcagtcctccgagcagcttctgcacgtgatataccagcgagtggataaggccgtgggtcttgctgaggccgctctcggcctagctcgtgctaacaatgaactgcttaaacgtctccaagaggaagtgggcgacctgaggcaggggaaggtgagcattccggatgaggacggggagtcccgggcccattcaagtcccccagaagaaccaggacccctgaaggaatctccgggagaagctttcaaggcattgtcggccgtggaggaagagtgcgactcagtaggctccggtgtgcaggtagttatcgaggagctgagacagctcggagctgcctccgtgggtcccggtcctctgggcttcccggccacccagagggacatgagacttccggggtgcactctggctgccagtgaggctgccccactgttgaatccgctggtcgatgattacgtggcatccgagggcgcggtgcagagagtgctggtcccggcctacgcaaagcaactctctcctgctacccaactggccatccagcgggccacacccgaaacaggtcctgagaacggtacgaaactcccgcccccacggcccgaggacatgctcaacgcagctgctgctctcgacagcgccttggaggagtccggacccgggagtaccggcgagttgaggcattcgttggggttgaccgtttccccttgtcgaacaagaggttcaggccagaagaacagtcgacggaaaagagacctagttctgagtaaactcgtgcacaacgtgcataatcatatcacaaatgacaagaggtttaacgggagtgaatcaataaagagcagctggaacatatcagtcgtaaagttccttttagaaaaattgaaacaggaactggtcacttcccctcacaattacaccgataaggagctgaaaggagcctgcgttgcgtattttctcaccaagaggcgggagtaccgcaatagcttgaacccattcaaaggcctgaaggagaaggaggaaaagaagcttaggtcacgcagatatcgcctgttcgccaaccggtcaagcattatgaggcactttggcccggaggatcagcgcctgtggaacgacgtgacagaggaactgatgagtgatgaggaggactccctgaacgaacccgatcgcctgccgtcagcagaagctcagctgctgcctccggagttgtacaatcctaattttcaggaggaggaggatgaggggggcgatgaaaatgcccctggctctccatcctttgatcagcctcataaaacatgctgtccagacctgaacagcttcattgaaatcaaggtcgaaaaggatgagtag

SEQ ID NO: 9463 - DNA, 966 bp, Artificial Sequence
  Description of Artificial Sequence: Synthetic coding sequence
atgcggctgccccggcgggccgccctgggcctgctgcccctgctgctccttttaccacctgccccagaggctgccaagaaaccaacaccttgccaccgatgcaggggcctcgtggacaaatttaaccagggaatggtagacacggcaaaaaagaattttggggggggaaacacagcgtgggaggagaagaccctgagcaagtatgaatctagcgagatccgtttgctggaaatactggaaggcctgtgcgagtcctctgacttcgagtgtaaccaaatgctggaggcccaggaggagcatctagaagcgtggtggttgcagctcaagtcagaatatcccgacttgtttgagtggttttgtgttaaaacacttaaggtgtgttgcagccccggtacctatggccctgattgtttagcctgccaagggggatcccagagaccctgtagcggcaatgggcattgctccggcgatggaagcagacagggcgatggctcttgtcgatgtcatatgggataccaaggcccattatgtacggattgtatggacgggtacttttcctcgctccgaaacgagacacactccatatgtactgcttgcgatgagagctgtaagacatgctctggattgacaaacagggactgcggagaatgtgaagtgggttgggttctcgacgagggcgcttgcgtggacgtggacgagtgtgctgctgagccccccccctgctcggctgcgcagttctgcaagaacgcaaacggtagctatacgtgtgaggatgtagatgaatgctctctagctgagaagacttgtgtaaggaagaacgagaattgctacaatactcctggctcttacgtttgcgtttgtcctgacgggttcgaagagaccgaggatgcctgcgtccccccagccgaggctgaggcaaccgaaggcgagagtcctacccaactgccctcaagagaggacttgtag

SEQ ID NO: 9464 - DNA, 711 bp, Artificial Sequence
  Description of Artificial Sequence: Synthetic coding sequence
atgatgggcatcttcctggtgtacgtgggcttcgtgttcttcagcgtgttgtacgtccagcagggcctgtcaagccaggctaaattcaccgagtttcctcggaacgtgaccgctactgaggggcagaatgtagaaatgagctgtgcttttcagtccggaagcgcctccgtgtatctagaaattcagtggtggttcttacgaggtccggaggacctggatccgggagctgagggtgctggagctcaggtggaactgctgcccgatagagaccccgacagcgacggcaccaaaatctccaccgttaaagtgcaggggaatgatatctcccataagttgcagatctcaaaggtgcggaagaaagacgagggcctgtacgagtgccgcgtaactgacgccaattatggagagttgcaagagcacaaggcccaggcctacctgaaagtgaatgccaatagtcatgcacggcggatgcaagccttcgaagccagtccaatgtggctccaggacatgaaaccccgtaagaacgtgtccgcagctatcccaagtagcatccacggatcagccaaccaaaggacccactctaccagctctccacaggtggtggcaaagatacctaagcagtctccccaaagtggtgccaggatcgctacctctcacggtttgtcagtgctgttactggtctgcggctttgtgaaaggggcattgttatag

SEQ ID NO: 9465 - DNA, 273 bp, Artificial Sequence
  Description of Artificial Sequence: Synthetic coding sequence
atgaacatgaagcccgccaccgccagcgccctgctgctgctgctgttaggccttgcatggacccaagggagtcatggttggggcgctgatgccagtagcctgcagaaacgtgcgggccgggacgaccagaattacaattataatcagcacgcctaccctacagcttatggaggtaagtacagtgtgaaaacacctgccaagggcggtgttagcccctctagctctgcatctcgagttcaaccaggccttttacaatgggtgaagttctggtag

SEQ ID NO: 9466 - DNA, 360 bp, Artificial Sequence
  Description of Artificial Sequence: Synthetic coding sequence
atgcccgccgtgttcatgctggccagcagcagcgccctgcagtgcgggcgcggggtgccccggtttcccagaactgaagtgggagctggtcattcagtcaacgaagagaccaaggctgaaaaggtggggaaccagacttctgtgatccctgccacatcccggcaggctgccctcggcacatcatggacccagcgccgcacccagccgctacaggagcgcagtcactggcatccccgcggcaataacgcctcaggtatggggggtcatagaatgtttcctggcccattgaggggcccagccgcgcaggtgctggagaacgagtgcggcagtctaggacgggctgctgaggggaggtcatag

SEQ ID NO: 9467 - DNA, 639 bp, Artificial Sequence
  Description of Artificial Sequence: Synthetic coding sequence
atgctgagcagcgtggtgttctggggcctgatcgccctgatcggcacctcaaggggtagttacccttttagtcactccatgaaaccacacttgcatccgcgcctctatcatggctgctacggtgatataatgactatgaagaccagcggcgcgacctgcgatgccaactccgtgatgaactgtggaattcggggctccgaaatgtttgccgaaatggatcttagagccataaagccttatcagaccctgatcaaagaggtcggacaaaggcattgcgtggatcccgccgtaatcgcagccattatttcacgcgagagccacggaggctccgttctgcaggacgggtgggaccaccgtggattaaagtttggtctaatgcagctcgataagcagacttaccaccctgtgggagcatgggactcaaaggagcatcttagccaggcaacaggtatacttacggagcgcatcaaggccatccagaagaaatttccaacatggtctgttgcccagcacttgaaaggaggactatctgcatttaagagcggaatcgaggccatcgccacaccgagcgatattgacaacgacttcgtgaacgatattattgcacgagccaaattttacaagcgacagagtttctag

SEQ ID NO: 9468 - DNA, 387 bp, Artificial Sequence
  Description of Artificial Sequence: Synthetic coding sequence
atgcgggtggcccggcggacccggaacgtgtgccggtgcccccgggctgctggccccggagtcccagagcccagggccgccccactgccactgctcgccatggcccccccccctgcatgcagatcccctatgagtcccccgcccccacccttgcttttgcttctgctcagtctcgcgctcctgggagcacgagctagagcagaaccagcaggatctgctgtgcctgcgcaatcacgtccttgcgtggattgtcacgccttcgagttcatgcagagagctcttcaggatctcaggaagacagcatgttccttagatgccaggaccgaaaccctcctgctgcaggccgagcggagagcactatgcgcctgctggccagcaggacactag

SEQ ID NO: 9469 - DNA, 399 bp, Artificial Sequence
  Description of Artificial Sequence: Synthetic coding sequence
atgggcccccgggtgctgcagccccccctgctgctgctgctgctggccctgctcctggccgcactgccctgcggggcagaagaggcttctccgctgagacccgcccaggtgacactgtccccccctcccgcggtcacaaacggttcccagccgggtgctcctcataatagcacccatacacggccgcctggagcttctggcagcgctttgaccaggtccttttacgtgattctgggattttgcgggctgacagcgctttattttctgattcgagcctttagacttaagaagccacagaggagaagatacgggctgctcgccaatacagaagatcctacagagatggcaagcctcgatagcgacgaggagacggtattcgaaagtagaaatctgcggtag

SEQ ID NO: 9470 - DNA, 585 bp, Artificial Sequence
  Description of Artificial Sequence: Synthetic coding sequence
atgagcgccctgtggctgctgctgggcctgctggccctgatggacctatcggaatcctcgaattgggggtgttatggaaatatacagagcctggatactccaggggcaagctgcggaatcggacgtaggcatggtctgaactactgcggagtgcgtgcatctgaaagactggccgaaatcgacatgccatatctcctcaagtatcaacctatgatgcaaaccattggccagaaatattgcatggaccccgcagtcatagctggtgtcttgagcagaaagtcacccggagacaagattttagtgaacatgggtgaccggacgagcatggttcaggatcccggttcacaggcgccaacttcctggatatctgaaagccaggtcagtcaaacaaccgaagtgctgactacgagaataaaagagattcagaggagattccccacctggacgccggaccagtacttgaggggtgggttatgtgcctattccgggggggctggatatgtgcggtcttcccaggatttatcttgtgatttctgcaatgatgtactggcaagagccaagtatctgaaaaggcatggtttttag

SEQ ID NO: 9471 - DNA, 441 bp, Artificial Sequence
  Description of Artificial Sequence: Synthetic coding sequence
atggtgatcaccatctactacgacgtgaaggtgcggttcatcgtgcgtggctgcggccagtacatctcgtacagatgtcaggagaaaagaaatacatactttgcagaatattggtaccaggcacagtgctgccagtatgactactgcaactcctggtcaagcccccagctccagagctcattacctgagccacacgaccgccccctggccttgcccctgtcagactcccagattcagtggttctatcaagctctgaacttaagcttgcccctgcccaatttccacgccggtactgaaccggatgggctagatccaatggtgaccttatctctcaatctgggccttagttttgccgagctgcggaggatgtatttgttccttaactccagcggtttattggtgctgccccaggccgggctgctgactcctcacccatcgtag

SEQ ID NO: 9472 - DNA, 234 bp, Artificial Sequence
  Description of Artificial Sequence: Synthetic coding sequence
atgggcagcagcggcctgctgagcctgctggtgctgttcgtgctgctcgccaacgttcaggggccggggctcaccgattggctttttcctcggcgatgcccaaaaattcgagaagagtgcgagtttcaggaaagggacgtatgcaccaaagatcgccagtgtcaggacaataaaaaatgttgtgtgttctcatgtggcaagaagtgcctggatctcaagcaagggaaacagtag

SEQ ID NO: 9473 - DNA, 444 bp, Artificial Sequence
  Description of Artificial Sequence: Synthetic coding sequence
atgggccaggaggtgcacggcagctgctgggccctgggcgccggcggagggcagcgacaatgggtgggaagaagcatgcccccactcgccccccagttgtgtagagctgttttcctggtgccgatcctgctcctgctgcaagtgaagcccctgaatggatccccggggcctaaggatggttcccagaccgaaaagactccctccgcagatcagaaccaggagcaatttgaagagcattttgtggcttcctccgtgggcgagatgtggcaagtggtggacatggcacagcaggaggaagaccaatcaagtaaaaccgctgctgtgcataagcacagctttcacctgtcgttttgctttagtctggcgtctgtcatggttttttccgggggcccactacgtagaacattcccaaacatccaactctgcttcatgctcactcattag

SEQ ID NO: 9474 - DNA, 1695 bp, Artificial Sequence
  Description of Artificial Sequence: Synthetic coding sequence
atggcccccaagaagctgagctgcctgcggagcctgctgctgcccttgagcctgactttgctcctgcctcaggcagataccaggtcctttgtcgtggatcggggacacgaccgcttccttctggatggggcacctttcagatatgtgagcggcagcctgcattacttcagagtgccacgcgtgctgtgggccgacaggttgctgaaaatgcggtggagcgggttgaacgccatccagttctatgttccctggaattaccatgaaccacagccgggggtgtataatttcaatggaagccgggatcttatcgcgttcttaaacgaggccgctctggccaacctgctggtcatcttgagaccaggaccctatatctgcgccgagtgggagatgggagggttgccatcttggcttctgcggaagcccgaaatccacttgagaacatcagaccccgctgacaacatgactaaaatctttacactacttcgaaagtacgaaccccatggccccctggtgaactccgaatattacacaggttggttggactactggggccagaaccatagcacacgctccgtgtctgcagtgactaaggggctcgaaaatatgcttaagctcggtgctagcgttaacatgtacatgttccacgggggtaccaactttggctattggaatggcgctgataagaagggacgctttctccccatcactacctcatacgactatgatgccccaatttctgaggctggagacccaacgccaaagctattcgctctgagggacgtgatcagcaagttccaggaggtgccactggggcctctccccccacctagccccaaaatgatgctggggcctgtgactcttcatctggtgggacatctgctggcctttctggacctgttatgcccacgaggaccaattcatagcattcttccgatgacttttgaggccgttaagcaagatcacggctttatgctgtaccgtacttacatgactcacacgatattcgaacccacccctttctgggtacccaacaacggcgtgcatgatagggcttatgtcatggtcgatggggtcttccaaggcgtggtagagcggaatatgagggataagttatttctgaccggcaagctcggctccaaactggacatactcgtcgagaatatgggacgcctgtcattcggttccaactcctcagattttaaaggactcctcaaaccacccatcttgggccaaacaattctgacgcagtggatgatgttccctctcaagatcgataacctggttaagtggtggtttcctttgcagctgccaaagtggccctacccccaggcccctagcggccccactttctactccaagacatttccgatcctcggcagtgtgggcgatacctttctgtacctgccaggttggacgaaaggccaggtatggattaacgggttcaatcttggaaggtactggacgaagcagggtccacagcaaaccctttatgtcccacgatttctgttgtttccaagaggcgccctgaataaaatcacccttcttgagttagaggacgtacccctacagccccaggtgcaatttctggacaagccaatcctcaattccacttctaccctccataggacgcatattaactcactttctgccgatacccttagcgcctctgagccgatggagctcagtggacattag

SEQ ID NO: 9475 - DNA, 423 bp, Artificial Sequence
  Description of Artificial Sequence: Synthetic coding sequence
atgttcttcaccatcagccggaagaacatgagccagaagctgagcctgctactgttagtgtttggcctaatctgggggctgatgttgttgcactacacctttcaacagccacgccatcagtcttcggtgaaactccgcgagcagatcctggatctttccaagcgctacgtcaaggctctggctgaagagaacaagaatacagttgacgtggaaaatggcgcctctatggctgggtacgctgacttgaagaggacaatcgctgtgctgctggacgacatcttgcagcggctcgtcaagttagagaataaagtagattatatcgtagttaatggcagcgctgcaaacaccactaatggaacctccggtaatctggtgcctgtcactactaataaaaggacaaacgtctctgggtctattcgctag

SEQ ID NO: 9476 - DNA, 528 bp, Artificial Sequence
  Description of Artificial Sequence: Synthetic coding sequence
atgctgccccccatggccctgcccagcgtgagctggatgctgctgtcatgtttaatgttgttatctcaagtgcagggggaagagccgcagagggagctcccatccgcccgcatcagatgtcccaagggctccaaggcctatggcagtcactgttatgctctgttcctttcaccaaaatcctggactgatgctgatctcgcatgtcagaagcggccctctgggaacctggtctccgttctgtcaggcgcagagggctcttttgtgagcagcctggtgaaatcaatcggtaactcatacagctacgtttggatcggacttcacgatcctactcagggcactgaacccaacggggaggggtgggaatggtcctctagtgatgtgatgaattacttcgcttgggaaaggaatccatcaacaatcagcagtccaggacactgcgccagtctttcccggtctactgcttttcttcggtggaaggactataattgcaacgtccgactcccgtatgtctgtaaattcaccgattag

SEQ ID NO: 9477 - DNA, 381 bp, Artificial Sequence
  Description of Artificial Sequence: Synthetic coding sequence
atgcacctgagccagctgctggcctgcgccctgctgctgaccctgttaagcttgcgcccctccgaagcgaagccaggagcccctcccaaagttcctaggacccctcccgcagaggagttggccgagccacaggcagccggcggggggcagaaaaaaggagacaaggcccctggagggggcggcgcaaaccttaagggtgaccgtagtcggttgctcagggatcttcgcgtcgataccaagagccgggcagcatgggcaagactactgcaggagcaccctaatgccaggaagtataaaggcgccaacaaaaaagggctgagtaaaggctgcttcggactcaagttggataggataggttctatgtctgggttgggctgctag

SEQ ID NO: 9478 - DNA, 288 bp, Artificial Sequence
  Description of Artificial Sequence: Synthetic coding sequence
atggcccccccccccgcctgccggagccccatgagccccccccccccaccacttctactcctcctccttagtttagccctgctgggcgccagagcccgtgctgaacccgcgggaagcgccgtgccagcccagtcacgcccttgtgtggattgccatgcttttgagttcatgcagagggctctccaggatctgcggaaaacagcatgcagccttgacgcacgcactgagactctcctattgcaggcagaaagacgggccctctgtgcctgctggcctgctggtcactag

SEQ ID NO: 9479 - DNA, 423 bp, Artificial Sequence
  Description of Artificial Sequence: Synthetic coding sequence
atgttcttcaccatcagccggaagaacatgagccagaagctgagcctgctgctgctggtgttcggactaatctgggggttgatgctgctgcattacacatttcagcagcctcggcaccagtctagcgtgaaactgagagaacagattctggacctaagtaaaagatatgtgaaagctttagctgaggagaacaaaaacaccgtcgatgtggagaacggggcgtctatggcaggctatgcagatctgaaaaggacgatcgccgtccttctagacgacatcctacagaggcttgttaagttagagaacaaagtggattatattgtcgtgaatggctccgcagctaatacaacaaacggaacttccggaaacctggtaccagtaacaaccaataagagaactaacgtctcaggcagcattagatag

SEQ ID NO: 9480 - DNA, 291 bp, Artificial Sequence
  Description of Artificial Sequence: Synthetic coding sequence
atggagcacaaggaggtggtgctgctgctgctgctgttcctgaagtcgggccagggagaacccctcgacgattatgttaatacccagggccctagcctcttctctgtcactaaaaagcagctcggggccgggagcagagaggaatgcgcggcaaagtgcgaagaagacaaggagtttacgtgcagggcatttcagtatcacagcaaagaacagcagtgtgtcattatggccgaaaaccgtaagtccagcatcatcatccgtatgcgggacgctgtactgttcgagaagtag

SEQ ID NO: 9481 - DNA, 678 bp, Artificial Sequence
  Description of Artificial Sequence: Synthetic coding sequence
tgagccgacctgcccagctgctggggcgccggcccctgctacaccggccacaaagtcggcgctcttcgccgcgatacagtgatttgctgttgccgtcacggtgactatagcaccccctgcctgtttactcctgggaagccatctcgcaatcctagcccgtggaagagaaccctgtggactctgtcagctccttgggccggccccgctggatggactggggaggaacagaacgcaactaagacaggcttgattacaagaagaccacgccctttacgcagaagaccccacccagctccggcttcaccacttccggagattattaggggcaacatcccacggatgcttggaaaatttgtccctgtcaactgggaacctccacaacccctgccattccctaaatacttgcgatgctatcgatgcttattggaaaccaaagagttagggtgtctactgggttcagatatttgcctgactccagcgggatcaagttgcatcaccctgcataagaagaattcttctggcagtgacgttatggtcagcgattgcaggagtaaagagcagatgtctgattgcagtaatactcggacaagtcctgtgtctgggttctggatcttcagtcagtactgtttcctcgacttttgcaatgatccccagaatcgcggattgtacacaccctag

SEQ ID NO: 9482 - DNA, 684 bp, Artificial Sequence
  Description of Artificial Sequence: Synthetic coding sequence
atgggcgccgtgatgggcaccttcagcagcctgcagaccaagcagaggaggccatctaaggacatcgcctggtggtactaccagtaccagcgtgacaaaatcgaagacgaactggagatgaccatggtgtgccatcgtcctgaaggtctcgagcagctcgaagctcagacaaatttcactaaacgggagttgcaggtgttgtaccgcgggttcaaaaacgaatgcccatccggagtagtgaacgaagacacatttaagcaaatttatgcacagttcttcccacatggcgatgcctctacctacgcccactacctgttcaatgccttcgacaccactcagaccggatctgtgaaattcgaagattttgtcacggctttgtctattctgctgcggggaactgttcacgaaaagcttaggtggactttcaatttgtacgatatcaacaaggacggctatatcaataaagaagaaatgatggatatcgtcaaggctatctacgatatgatggggaagtatacttacccggtcctgaaggaagacacaccacgccaacatgttgatgtgttctttcagaaaatggataagaacaaagatggcatagtgacgcttgatgagtttctcgaaagttgccaggaggatgataacattatgcgctcattacagctgttccagaatgtaatgtag

SEQ ID NO: 9483 - DNA, 546 bp, Artificial Sequence
  Description of Artificial Sequence: Synthetic coding sequence
atgcaggtgaacttcgtgagctacgtgcagctgaccagccgggccctccccagccttaccgactcaaaggggagtctggttgtggtgtcatcccttctgggcagagttcctacaagcttctcgactccctattccgctgcgaagttcgcacttgacggattctttgggagtctccgtcgggagttagacgtccaggatgttaatgtcgcgatcactatgtgtgtgctgggcctcagagaccgggccagtgccgcggaggccgtgcgatcaagtacttccagaccacggcaaccagagcacagaggggtgccccttcaatcccagacagccatgtttcttcctccaaccgtgccgggtgcccggacattgaccgagacacctctgagaggatggcctcagccaaagatgaaatcttccagacagaagtctaagacagagaagaatgacggccatttggaacccgtgacagcttgggaggtgcaagtccctagagtaaggagactgtgcaggggtctcgctcgtccacacttgttcggccacgactag

SEQ ID NO: 9484 - DNA, 423 bp, Artificial Sequence
  Description of Artificial Sequence: Synthetic coding sequence
atgagcgacctgctgctgctgggcctgatcggcggcctgaccctgctgttgctccttaccctgctggcttttgcaggctattctgggctgctggccggggtggaagtgtccgctggctccccacctattcgcaatgtgactgtcgcatataaattccatatgggtttgtacggagaaaccggccgcctctttactgagtcctgctccataagtcccaaactgaggtcaatagcggtctattatgataatccacatatggtgccacccgataaatgccgttgcgctgtgggaagtatcttgtcagaaggagaggaaagtccatcccccgaattgatagatctctatcagaaatttggctttaaggtgttctccttcccggccccttcccatgtcgtgacagccacctttccctacaccacctag

SEQ ID NO: 9485 - DNA, 177 bp, Artificial Sequence
  Description of Artificial Sequence: Synthetic coding sequence
atgggccccgaggccctgagcagcctgctgctgctgctgctggtggcctctggagacgccgacatgaaaggtcatttcgaccctgccaaatgtagatacgccttagggatgcaggataggaccattccagactcagacatctctgccagcagctcctggtctgatagtaccgcctag

SEQ ID NO: 9486 - DNA, 2742 bp, Artificial Sequence
  Description of Artificial Sequence: Synthetic coding sequence
atgggccccgaggccctgagcagcctgctgctgctgctgctggtggcatctggcgacgctgatatgaagggtcattttgatccagccaaatgtcgttacgcattggggatgcaggacaggacaattccagacagcgatatctctgcatcctcttcttggagtgatagtaccgccgccaggcattcaagactggaaagttccgacggggatggggcttggtgtcccgcgggttccgtattcccaaaagaggaagaatacctgcaggtggacctgcagaggctgcacttagtcgccctcgttgggacacaaggacgtcacgcagggggactgggtaaagaattttccagaagctataggcttcggtacagccgcgacgggagacgctggatgggctggaaagatcgatggggtcaagaggtgattagcgggaacgaggatccagagggcgtagtgctgaaggacctcggccctccaatggtagcaaggctcgtgcgcttctatcctagagcagacagagtgatgagcgtatgtttaagggtcgaactgtacgggtgcctgtggcgcgatgggctgttgtcttataccgccccggtgggtcagacaatgtacctgtcagaggctgtttaccttaacgactcaacttacgacggacatacagtcggaggcttgcaatatggggggctgggtcagctggccgatggtgttgttggcttggatgatttccggaagtctcaggaactgcgggtttggcccgggtacgattacgtcggatggtccaatcattccttttccagcggctacgtggagatggagttcgagttcgatcgcttaagggcattccaggccatgcaggtgcactgcaataatatgcatacacttggggcacgcctcccggggggcgtggagtgtcgtttccgaagggggcccgcaatggcttgggaaggagagccaatgcgccacaacctcggtggaaatctcggagatccacgcgctagggcagttagcgtgcctcttggaggtcgcgtcgcaagattcctgcaatgcagatttctttttgcgggaccatggttactgtttagcgagatcagcttcataagcgatgttgtcaataactcaagccctgcccttggagggacatttcccccagccccttggtggcctcccggaccacccccaacgaattttagttcacttgaacttgagcctaggggccagcagcctgtcgcaaaagcagaaggcagtcccacagccattctaattggctgcctcgtggcgattatcctactgctcctgctgattatcgccctgatgctgtggcgcttacactggagacggctcctgtctaaagccgaacgcagggtcttagaggaggagcttaccgtacatctatccgtgcctggggataccattctgatcaataacagacccggtcccagagaacctcctccttaccaggagccacgcccaaggggtaatcctccacactctgcgccctgcgtccccaatggcagcgccctcctcctatcgaatcctgcctataggctattattagctacatacgctcgcccccccaggggtcccgggcctccaactcctgcttgggctaagccgacgaatacccaggcttattctggcgactacatggagccagaaaagcccggtgccccactcctgcctcccccaccacagaatagcgtcccacattatgccgaggcggatatcgtaacccttcagggtgtcaccggaggtaacacttatgcagtgcccgccctgccacccggcgctgtgggcgacggaccaccccgcgtagactttccacggtcccgactacgtttcaaggagaagcttggagaagggcagttcggcgaggtccacctgtgcgaggtggacagtccccaggacctggtaagcctcgatttcccgcttaacgtgagaaaggggcaccccctactcgtggcagtcaaaatattgcggcccgatgctactaagaatgcgaggaacgatttcctcaaagaggtcaaaataatgtctcgattgaaagatcctaacattatcaggttgctaggcgtctgtgttcaggatgatccgctgtgcatgattaccgactatatggagaacggcgacctgaatcagtttttgagcgcccaccagctggaggataaagccgctgagggggcccctggggacgggcaggccgctcagggtcccacaatcagctatccaatgctgctgcatgtggcagcacagatcgctagcggtatgaggtatctggccactctgaattttgttcacagagatcttgccaccaggaactgtcttgtgggcgagaattttacaattaagattgccgacttcggcatgtccagaaacttatacgctggcgactattaccgagtccagggacgagccgtgctcccaatcagatggatggcctgggagtgtattttaatgggtaagtttactaccgcaagcgatgtgtgggcttttggcgttactctttgggaagtcttaatgctttgtcgcgcacaaccctttggtcaactcaccgacgagcaggtgatcgagaatgccggggagttcttcagagaccagggcagacaggtgtacctctctcggccccccgcctgcccccaggggttgtacgaattaatgctcaggtgttggtccagggagtccgaacagaggccccctttctcacagctccatcggttcctggccgaggatgctttaaatacagtgtag

SEQ ID NO: 9487 - DNA, 1146 bp, Artificial Sequence
  Description of Artificial Sequence: Synthetic coding sequence
atgcggctgctggcctggctgatcttcctggccaactggggcggcgcaagagcggagcctggtaaattttggcacatcgcagatctgcatttggatcctgattataaggtgagtaaggaccctttccaggtctgtccaagcgctggctcacagcccgtgccagacgccggaccttggggtgactacctctgtgatagcccttgggctctcattaactcatctatttatgccatgaaagagatagagccggagcctgacttcatcttgtggaccggtgacgacacacctcacgtccctgatgagaaactcggagaggcagccgtgcttgaaattgtagagaggctgacaaagctaattcgtgaggtcttcccaggagctttttactgcgagaagcttcccggtccttccggagccggacgaatagtggtgttgaataccaacttatattacacgagtaatgcgctgactgcagacatggcggatcccggtcagcagttccagtggctagaggacgtcctcaccgacgcctcgaaggccggagacatggtgtacatcgtgggccacgtgccgcccgggtttttcgagaagactcagaataaggcgtggtttagggaaggttttaacgaaaaatatctaaaagtggtgcgcaagcatcaccgtgtaattgcggggcagttctttggccaccatcacactgattctttccgaatgttatacgatgatgctggcgtgcccatatcagcgatgtttatcacgcccggcgtgactccctggaagaccactctccctggcgttgtcaatggcgcaaacaatcccgccattcgggtttttgagtacgatcgcgccacactgtcactcaaagacatggtcacatattttatgaacctgagccaggccaatgctcaaggtacaccacgatgggaattagagtaccagtccacactgcagcgctattacgtttacaacagcgtgagctatagtgctggggtttgtgacgaggcatgttctatgcaacacgtatgtgcaatgagacaagtggacattgatgcctatacaacatgcctctatgcctctgggaccaccccagttccccagctcccattgctcctcatggccctactgggcctgtgcaccctggttctgtag

SEQ ID NO: 9488 - DNA, 456 bp, Artificial Sequence
  Description of Artificial Sequence: Synthetic coding sequence
atgcgggtggccggcgccgccaagctggtggtggccgtggccgtgttccttttgactttttacgtgatcagccaagtatttgaaatcaaaatggacgcatccctcggtaacctgttcgcccggtcagcccttgatacggcagcaaggtctactaagccccctcgatataagtgcggcatcagcaaagcttgcccagagaaacacttcgccttcaaaatggcctcaggcgccgcaaatgttgtcggccccaagatttgcctcgaggacaatgtgttaatgtctggagtgaaaaataatgtcgggcgcggaattaatgtcgcgctcgccaacgggaaaactggggaggtcctagataccaaatattttgatatgtgggggggggacgtggccccctttatcgaatttctgaaggccatccaggatgggaccatcgttctcatgggtacctacgattag

SEQ ID NO: 9489 - DNA, 936 bp, Artificial Sequence
  Description of Artificial Sequence: Synthetic coding sequence
tgagcccccagcccctgcagccacttcaactgcggcagccaggtgacggacggcggcactatcaaacagaaaatttttacattcgacgctatgtttagcaccaactacagtcacatggagaattaccggaaaagagaggacctggtgtaccagagtactgtgcgtctcccagaggtcaggatctcagataacggcccctacgaatgccacgtgggcatttatgaccgcgctaccagggagaaggttgtcttagcgtccggaaacattttcctcaatgtaatggcgccacctacctccatcgaagttgtggcagccgatactccagcaccgtttagccggtaccaggctcaaaactttacattggtttgtatagtctctggagggaagcctgctccaatggtgtatttcaaacgagatggcgagcccatcgatgccgtacccctgagtgaaccccccgcggcgtcgagtggcccgctgcaagattcacgaccctttcgtagtttactacacagagacctcgatgataccaaaatgcagaaatctctctcattgctggacgctgaaaatcgggggggtagaccatacaccgaaaggcccagtagaggccttacccctgatccgaatattcttttgcagcctaccactgaaaatatacctgaaaccgtggtatcccgcgaatttccccgctgggttcattctgccgagccaacctactttcttcggcacagtcgtactccctcctccgacggcacagtggaggttagagccctgttaacttggacactcaatccccaaattgataatgaggcgctgtttagttgcgaggttaagcatccagccctcagcatgcccatgcaggcagaagtcaccctggtcgctcccaaaggacctaaaattgttatgacgccgtcgcgtgctcgggtcggggatacttag

SEQ ID NO: 9490 - DNA, 978 bp, Artificial Sequence
  Description of Artificial Sequence: Synthetic coding sequence
atgcagggccgggtggccggcagctgcgcccccctgggcctgctgctcgtgtgcctgcacctgccaggcttgttcgcaaggtcaattggggtggtggaggagaaggtgtctcagaatcttggtactaatttgcctcagctggggcagccttcctcaacgggaccatccaattccgagcatccccagccagccctagaccccaggtctaatgatctggcgagggtgccactcaagcttagcgtgccagctagtgatgggtttcctcctgcgggcggatctgcagtgcagaggtggccaccctcctggggactgcctgccatggacagttggcctcctgaagatccctggcaaatgatggctgccgcagctgaagatcgcctaggcgaggcattgccagaagagctgagttacctctccagcgcggcggccttggctcctggcagtggaccactgccaggggagtcttctcccgatgcgacaggcctcagtcccaaggcctcattactgcatcaagactcagagtcccggagactgccacgtagtaattccctgggcgccggagggaagatcttgagccagagacccccttggagcctgatacacagggtccttccagatcatccatggggaactctaaacccgtctgtttcttggggaggagggggacctgggacgggctggggcacacggcccatgcctcaccctgaggggatctgggggataaataaccagccaccaggtacttcctggggaaacattaaccggtatcccggtggctcatggggaaacatcaataggtatcctgggggttcctggggcaacattaataggtaccccgggggttcttggggtaacattcatctctacccagggataaacaatcccttccccccaggagtgctacggccacccggcagtagctggaatattccggccgggttccccaatcctccttctccaagactacaatggggttag

SEQ ID NO: 9491 - DNA, 957 bp, Artificial Sequence
  Description of Artificial Sequence: Synthetic coding sequence
atgggcctgcacctgcggccctaccgggtgggcctgctgcccgacggcctcctctttctgttgctcctcttgatgctactcgcagaccccgccctgcctgcaggccgtcaccctcccgtggtactgggctggtttaccacaaaacaccccggacccccaagcttcctcatggtgtggatgtacgtcagcctcgcccttggacgaccttcccactggtcatcgtggaccccagccaaagcagcctgggtgccaatcagtaccccctggtggcgggcattatgggccggggccactcatggtgttcgaatgtcagaggggcttcccatgactggcgcagaaccccagcggcagcctcaggcatggaaagataaatatatcagagcatttgtttctctgggagcgccctggggtggagttgccaagactctccgagtgttagccagcggggacaacaatagaatccccgtcatcggccccttaaagattcgagaacagcagcggagcgccgtgtctacaagttggctacttccctacaactacacctggtctccagaaaaggtgttcgttcagacacccacaatcaattacactctgcgtgattataggaagtttttccaggatataggtttcgaggatggctggctcatgagacaggatactgaggggctggtggaagctaccatgccccctggggtccagctgcactgcctgtatggaacaggtgtaccaacgccagactctttttattatgagtcttttccagatagggaccccaagatatgtttcggggacggcgacggcacagtgaacctgaagtccgctctgcaatgccaagcttggcagtcccgccaagagcatcaggtgcttttgcaggaacttccgggctctgagcacattgaaatgctggccaacgctacaactcttgcctacttgaaacgcgtgctgctgggaccctag

SEQ ID NO: 9492 - DNA, 1575 bp, Artificial Sequence
  Description of Artificial Sequence: Synthetic coding sequence
tacgccctgcgggaccggcagggcaacgccatcggcgtgaccgcctgcgatatcgatggagatgggcgcgaagagatttactttctgaatacaaacaacgcattttcaggggtggcgacctatacagacaaactattcaagttccgcaacaaccggtgggaggatattctgtccgatgaggtgaatgtggcgcggggagtggccagcttgtttgccggccggagcgttgcctgtgtggaccggaaaggtagcggtcgctacagcatttatatagccaactacgcgtacggtaatgttgggcccgatgccttgatcgaaatggacccagaagcgagcgaccttagccgtggcatcctagccctacgcgatgttgctgcagaagctggggtatctaaatacacagggggcaggggagttagcgtcggacccattctgtccagttccgcaagcgacatcttctgcgacaatgagaacggccccaacttccttttccataaccgcggcgacgggacattcgtcgatgccgccgcgagtgccggcgtggacgatccacaccagcacggacggggggttgcgctagcagacttcaatagggatggcaaagttgacatcgtctatggcaactggaacgggccacacaggctgtacctgcagatgtcaacacacgggaaggtgcgattccgagatattgcctcccctaaattctctatgccatctcctgtcagaacagtgatcacagctgacttcgataacgatcaagagctggaaattttttttaataacatcgcatatcgcagctcatctgcaaataggttgtttcgtgtgatcaggagggagcatggcgaccccttaatagaggaacttaaccccggggatgcccttgagccagaggggagggggacaggtggcgtggtcaccgactttgacggagatggtatgcttgatctcattctgtcgcacggagagagcatggctcagcctctcagtgtttttagaggcaatcagggattcaacaataactggctccgagtcgtacctcggaccagattcggggcattcgctagaggggctaaggtcgtactctataccaaaaaaagtggggctcatttaaggatcatcgatgggggttcgggatacttgtgcgagatggaacccgtggctcacttcggcctgggcaaggatgaggcaagctcagtcgaagtgacttggcccgacgggaaaatggtcagccgcaacgtggcttctggggagatgaattccgtcctcgagatcctttatcctagggacgaggacaccctccaagacccagcacccttagaaacgcctatgaatgcttctagcagtcactcctgtgcactggagacttctccctatgtttccaccccaatggaggcgaccggggctgggccaactcgctccgcagtgggcgctactagccctacccgcatggcccagcccgcttggggtttgtctgcctcacacagagctcccgcccccccgcctcctccactactcctgccactgccactcttgctgcctctcctggaacttccccttttgcaccgctccagctag

SEQ ID NO: 9493 - DNA, 636 bp, Artificial Sequence
  Description of Artificial Sequence: Synthetic coding sequence
atggtgagccggatggtgagcaccatgctgagcggcctgctgttctggctggcttctggatggacaccagctttcgcctactctccccgtacacctgaccgtgttagcgaagcggacatacagcggctgctccatggcgtgatggaacagttaggtatcgcaaggccacgagtggaatatccagcgcaccaggccatgaacttggtgggccctcagtccatcgaagggggggcccatgagggcctgcaacatctcggaccttttggcaatatccctaatatcgtagcagaattgacaggggataacattcccaaggatttctccgaggaccaaggttacccagatcctccaaacccctgtcctgtcggaaaaaccgacgacgggtgcttggagaatacgccagataccgccgagttctcccgggagttccaactccatcagcacctgttcgacccagagcacgattaccccggattgggcaaatggaacaaaaaactgctctacgagaagatgaagggcggggagcggcggaaacggcggtctgttaatccctaccttcagggccagcggctggataacgtggtggccaagaagtcagtaccacatttttctgatgaagacaaagatccagagtag

SEQ ID NO: 9494 - DNA, 465 bp, Artificial Sequence
  Description of Artificial Sequence: Synthetic coding sequence
atggccctgggcgtgcccatcagcgtgtacctgctgttcaacgccatgaccgccctgacagaagaggccgctgtaacagtcactcctcccataactgctcaacagggcaactggacagtaaataaaaccgaagccgacaacatcgagggtcctatcgctcttaagttttcacacttatgcctggaagaccataactcttactgcattaacggggcttgcgcctttcaccatgagcttgaaaaggcaatttgcagatgcttcactggatacactggagaaagatgtgagcacctgacccttacttcctacgctgtggacagctacgagaagtatatcgctatcggcattggcgttggactgctgctgagcggatttctggtcattttttactgttatattagaaagaggtgtctgaagttgaagagtccctacaatgtgtgtagcggagaacgccggccgctgtag

SEQ ID NO: 9495 - DNA, 1446 bp, Artificial Sequence
  Description of Artificial Sequence: Synthetic coding sequence
atgggcaagctgcggcccggccgggtggagtggctggccagcggccatactgagaggccacacctgtttcagaatttgctgctgtttctgtgggccctgctcaattgtggtttgggagtgtccgcacaaggtccaggagagtggacaccatgggtttcgtggacccggtgttcatcatcttgcggccggggcgtgtcagtaagaagccgccgctgtctaagactgcctggcgaagagccatgctggggggacagtcacgagtatagactttgtcaacttccggactgcccgccgggggctgttccctttcgtgacctacagtgtgctctgtacaacggaaggcctgtactagggacacagaagacgtaccagtgggtgcccttccacggagcccccaaccagtgtgatctcaattgtctggctgagggccatgcattttaccattctttcgggcgcgttctggatggcactgcttgcagccccggggcccaaggcgtgtgcgtcgcaggtaggtgcctgagcgccggatgtgacggactgcttggttccggggccctggaggataggtgcggtagatgtggcggagctaacgattcctgtctattcgtccagcgcgttttccgggatgccggtgcattcgcaggctattggaacgtcacacttattcccgagggcgcgagacatatacgcgtcgagcacagaagcagaaaccatttagccttgatgggcggagatggccgctacgtgttaaatggtcactgggtcgtgtctccacctggcacttacgaggcggcagggactcatgtcgtgtatacaagggataccggaccacaggagacacttcaggcagccggacccacttctcacgatctgttactgcaggttctcctccaggaaccgaaccccggcatcgaattcgaattctggcttcctcgggaacgctactcaccatttcaggctcgggtgcaagctctcggctggccattacgccagccccagccccgaggcgtcgaaccccagccaccagctgctccagctgtcacccccgcgcagactcccacacttgcaccggacccctgcccaccgtgccccgacactcggggaagggctcatcggctcttgcattattgtggctctgacttcgtgttccaggccagagtcctgggccaccaccaccaggctcaggaaacccgctatgaagtgaggatccagcttgtgtataagaaccggtcgcccctcagagctcgcgagtacgtctgggcccccgggcattgcccctgcccgatgctggccccccaccgcgattacttgatggctgtgcaacggctggtgagtccggacggcacgcaagatcagctgctgctgccgcacgcaggctatgcaagaccttggtccccagcggaggacagccggatccggttaactgcccgccgctgcccgggatag

SEQ ID NO: 9496 - DNA, 627 bp, Artificial Sequence
  Description of Artificial Sequence: Synthetic coding sequence
atggccgacatgcagaacctggtggagcggctggagcgggccgtgggacgtctggaggctgtgtctcacacatccgacatgcaccgcggttacgcagactcgccctcaaaggcgggcgctgccccttacgtgcaggctttcgacagcctgctggcgggtccggttgcagaatacttgaagattagcaaggagataggtggggatgtccagaaacatgctgaaatggtgcacaccgggttgaaacttgagagagccctgctggttacagcttcacagtgtcagcagcctgcagagaataagctgtctgacttattagctcctattagtgagcagattaaggaggtcatcacattcagagagaagaaccgcgggtcaaagcttttcaaccatctgtccgccgtctctgagtctatccaagccctgggctgggtggccatggctccaaaaccaggcccttacgtcaaagagatgaatgacgctgcaatgttttacacgaacagagtgctgaaggagtacaaggacgtggacaagaagcacgtagattgggtgaaagcatatttgagcatttggactgaattgcaggcctacatcaaggagttccacacaaccggtctggcatggagctag

SEQ ID NO: 9497 - DNA, 1482 bp, Artificial Sequence
  Description of Artificial Sequence: Synthetic coding sequence
agcgaggccgtgtacctgaacgacagcacctacgacggccacaccgtaggcggcctgcagtacgggggcctgggtcagctcgcggatggggtcgtagggctggacgatttccgcaaaagccaagagctgcgagtttggcccggctacgactatgtggggtggtccaatcattccttttcaagcggttatgtcgaaatggaatttgaatttgaccgactacgagcgtttcaagctatgcaggtgcattgcaacaacatgcacacccttggggctcgccttcctgggggcgtagaatgtcgatttaggaggggccctgcaatggcctgggaaggcgagcctatgaggcacaatttaggaggcaacttgggggatccacgggctagggcagtgtccgtgcccctcgggggccgcgtcgcccgatttctgcaatgtcgttttctttttgcaggaccgtggttattgttcagcgaaatatctttcatcagcgatgtggtgaataatagtagccctgccttgggggggacattccctcccgctccctggtggccgcccggccctcccccaacaaatttctctagcttagaactcgagccaagaggccagcagccagtcgcaaaagcggagggatcccctaccgccatcctcatcgggtgcctcgtggcaataattctcttgttactcctgatcatcgcactcatgctgtggcgactgcattggcgtcggctcctcagcaaggtgctagaaagccatccacgcactcgaagtccgggcctggtcggcattcggccaactcccctgccagttagtcctatggctctccgctgctgttcacccatccaacccactgcttctttctggccattaactccggtaccactggaagcccgggcccccccacacccccctggcccaaaccccccaacacctcgtggcgtaacaggggggaatacttatgctgtgccagcgttgcccccgggggctgttggcgacgggccgccccgcgtcgacttcccgagatcgcgtcttagatttaaggagaaacttggcgaaggtcaattcggggaggtccatctgtgcgaggtggactccccccaggacctggtgtctctggacttccccctcaacgtacggaaaggtcaccccctgctcgtggcagtcaaaattctgaggccagatgccactaagaacgctcgtaacgacttcctgaaggaggttaagataatgtcccgccttaaagaccctaatattatcagattgcttggagtgtgcgtccaggacgacccactttgtatgatcaccgattatatggaaaacggcgatctgaaccagttcttgtccgcccaccagctagaggataaggccgctgaaggcgcgcccggagatggccaggcagcccaaggaccgaccatatcttacccaatgctcctgcatgtagccgcccagattgcctccggcatgcggtacctggccacactgaactag

SEQ ID NO: 9498 - DNA, 2319 bp, Artificial Sequence
  Description of Artificial Sequence: Synthetic coding sequence
atgcagttccagctgaccctgttcctgcacctgggctggctgagctacagcaaagcccaagatgattgcaatcgcggcgcctgtcatccaactaccggcgaccttctggtgggaaggaatactcagctaatggctagtagtacgtgcggactgtctagagcccagaagtattgcatcctgagttacttggaaggagaacaaaagtgttttatttgcgacagcagatttccctacgatccctatgatcaacctaacagtcatactatcgagaatgtgattgttagcttcgaaccggaccgcgagaaaaagtggtggcaatccgagaatggcttggaccacgtcagcatccgcctggatctggaagcccttttccggtttagccacctgattctgacattcaagacatttcgacccgccgctatgctggtggagcgctcaactgactacggtcataattggaaagtgttcaaatatttcgccaaggactgcgccactagtttccctaatatcacaagtggacaggctcagggagtgggagacatcgtctgcgattcaaaatactccgacatagagccgtctactggcggagaagtcgttctcaaagtgctggacccctcatttgagatcgagaacccatattccccctatattcaggatctagtgacactgacaaatctgcgtattaactttaccaagctgcacacactaggggacgcccttctcggcagaaggcagaatgactcactagacaagtattattatgcgctgtacgagatgatcgtacgcggaagctgcttttgcaatggtcatgcttctgagtgcaggccgatgcagaagatgcgtggcgacgtgttctcaccacctggcatggtgcacgggcagtgtgtatgccagcacaatactgatggacccaattgcgaaaggtgcaaggacttcttccaggacgctccttggaggcctgccgccgacctgcaggataacgcatgtcggtcttgctcctgcaattcacacagcagtaggtgtcatttcgatatgacaacctatctagcctctggggggttgagtgggggggtttgtgaagactgtcagcacaacaccgaaggacaacattgcgatcgttgccggcccctgttctaccgcgaccctctcaagacaatatctgatccctatgcttgtattccttgtgaatgtgatcctgacgggactattagtggcggtatctgcgtgtcccacagcgatcctgccctgggttcggtggccgggcaatgcctgtgtaaagagaatgttgagggagccaagtgcgaccagtgcaagcctaaccactatggcctgtctgctacggaccctctgggatgtcagccatgtgactgcaatccactggggtccctgcccttcctgacgtgcgatgtggatacaggacagtgcctgtgcctcagctatgtaactggcgcacactgcgaggagtgtactgtgggctattggggtctgggaaatcatttacacggatgcagtccgtgtgactgcgacatcggcggcgcttactccaacgtgtgcagtcctaaaaacggccagtgtgagtgcaggccccacgtcactggtagatcttgtagcgaacccgcccctggttacttctttgcccccttaaatttttacttatatgaggccgaggaggctacgacacttcagggtctggcgcctctggggtctgagacattcggtcagtcgccagcggtgcatgtagtgctcggggagccagtgccggggaatcccgtgacttggaccgggcctggatttgccagagtgctgcccggagccggcctccgatttgctgtgaataatattcctttcccagtggatttcacaatcgctattcattacgagactcagtctgctgcggattggacagtgcagattgttgtaaaccctcctggaggttccgaacactgtataccgaagacgttgcagagcaagccacagtctttcgccctccctgccgcgacgaggatcatgttgttgccaactcctatctgcctggaacccgatgtacagtactctattgatgtgtacttctcccagccactccaaggggagtctcatgcccacagtcacgttctcgtggacagcgccgctgtccaatggcacaacctaggttccctccagcccccccctccggaatgcaagcagttctcctgcttttcatttccatcatcatgggactaccgtcacccaccccctcatctcgccaatttctgcatcttctcaagggacggagttagccctcactggcctgggtggtcccagacgcctgacctgaggtag

SEQ ID NO: 9499 - DNA, 1371 bp, Artificial Sequence
  Description of Artificial Sequence: Synthetic coding sequence
atgggccgggccggcgccgccgccgtgatccccggcctggccctgctgtgggcggtgggcctgggatctgccgcacccagccctcatctcagactgagttttcaggagttgcaggcttggcacggcctgcagacattcagtctcgaacggacgtgttgttaccaggcgttattggtggacgaagagagaggtaggctgttcgtcggagcggagaaccatgtagcgagtctcaacctagataacatctccaagcgagctaagaaactggcctggccagcacctgttgagtggcgtgaggaatgtaattgggctgggaaagatatcggaaccgagtgcatgaacttcgttaagcttttgcatgcttacaatcgcacgcatctgctggcatgtggaacaggcgcgtttcaccccacctgtgccttcgtagaggtagggcatagagcagaagagcctgtgttaagactggacccaggtaggatcgaggatggtaagggcaagagtccctatgatcctagacaccgcgccgcttccgtcctggtgggggaagaactgtatagcggtgtagccgcagatcttatgggccgcgacttcacaatattcaggtctctagggcaacgcccatctctgagaaccgagcctcatgactcaagatggctgaatgaacctaaattcgtcaaagtgttctggatccccgagtccgaaaatcctgatgacgataagatctactttttctttagggagactgctgtggaggcagctcccgcattggggagattatccgtatctagagtagggcagatatgtaggaacgatgttggtgggcagcgatccctggtgaacaaatggactaccttcctgaaggccagactggtctgttccgttcctggcgtagagggtgatacccatttcgatcaacttcaggatgttttcttactctcatcccgcgatcaccgtactccattgctgtatgccgtattcagtacgagcagctcgatctttcaaggctctgcagtgtgcgtatactctatgaatgacgtccgccgggcatttttgggccctttcgcgcacaaggaaggacccatgcatcagtgggtgtcctaccaggggcgggtgccctacccacgtcaggcttgcgctccagctcggccgctggccccctccgtacctccacgtactagccagactatgtcgtctagccttagggggacaacaccttcttgcaccaccctgagctgtccattgggaggtgcactattctcctacaagcttgagccaattacaccgtccctgaaactgccgcggacgggactacagcccctgacagataccatgacaagctcgagcctggcccagaccttagcaaggtgctag

SEQ ID NO: 9500 - DNA, 333 bp, Artificial Sequence
  Description of Artificial Sequence: Synthetic coding sequence
ctgttcatgctgcacaagatcgtgcaggtgtacaacagcgacgtgatcgataagcaatcggccagtatgacgagtgataacgctgatgacaaggcggtcataatcctggtgcctgtacggctgggaggcgaacgcaccaatacagactatctggagttcgtgaaaggcattctgtcattagagtattgtgtgggaattatcggaggaaagcctaagcagagttattattttgcaggtttccaggatgacagccttatatatatggatccccattactgtcagtcttttgtggacgtgagcatcaaggacttccctctggaggtcattctgtag

SEQ ID NO: 9501 - DNA, 420 bp, Artificial Sequence
  Description of Artificial Sequence: Synthetic coding sequence
atgggccccgaggccctgagcagcctgctgctgctgctgctggtggctagtggggatgccgatatgaagggccacttcgacccagcaaagtgcaggtacgccctgggtatgcaagatagaaccatccccgattcagacatctcagcttcatcgtcctggtcagacagtactgctgctcgccattcacgcttggagtcttcggatggggacggggcatggtgccccgccggttctgtgtttcccaaggaggaagaatatctgcaggtggatttgcagagactgcatctggtagccttggtcggaacacagggtagacatgccggtggcctcgggaaggagttctcacgatcatatcgcctgagatattctcgggacgggcgaaggtggatggggtggaaggaccggtggggccaagaatag

SEQ ID NO: 9502 - DNA, 570 bp, Artificial Sequence
  Description of Artificial Sequence: Synthetic coding sequence
atgctgggcatcaccagctgcagcgaccagcaggccaaggagggcgaaggcctggaaggaagtagtaccggctctagcagcggtaatcatggcgggagcggaggcggcaacggacacaagcctgggtgtgaaaaacctggcaatgaggcgcgcgggtcaggcgaatccggcatccaaaattcggaaacttccccaggcatgtttaactttgataccttttggaaaaactttaagagcaagctgggcttcatcaactgggacgccataaataagaatcaagtgccgccaccatccacccgggccctactctattttagcagactgtgggaggactttaagcaaaacacccccttccttaactggaaagctattattgagggcgccgatgcaagcagcctgcagaagagagccggtcgtgatgaccaaaactataattacaaccagcatgcttaccccactgcttatggaggaaagtactctgtgaaaacccctgcaaaaggaggagtaagtcccagcagctctgcgtccagggtacaacccgggctgttgcagtgggtgaagttttggtag

SEQ ID NO: 9503 - DNA, 438 bp, Artificial Sequence
  Description of Artificial Sequence: Synthetic coding sequence
atggccgacatgcagaacctggtggagcggctggagcgggccgtggggagactggaagccgtctcacataccagtgatatgcaccgaggctacgcggacagcccaagcaaagccggcgcagcaccttacgtgcaagcttacattaaggagttccacacaaccggcctcgcttggtccaaaaccggacctgtagcaaaagagcttagcggtctgccatcaggtccaagcgccggaagttgccctccccctccgccaccatgcccacctccccctcccgtgtctactatctcttgttcttatgaatctgcttcccgcagcagcttattcgcgcagattaatcagggagagagtataacacatgctttaaagcatgtcagcgatgatatgaagacccacaagaacccagcactcaaagcgcagtccggccccgttagatag

SEQ ID NO: 9504 - DNA, 264 bp, Artificial Sequence
  Description of Artificial Sequence: Synthetic coding sequence
tgcaagcggaagccctacctgctgcccagcatccgggagggcgccaggctgggtatccaggagtgcggaagccagttccgccatgagcggtggaattgcatgataaccgctgcagccacgaccgccccgatgggtgcctcacctctttttggctatgaactgagctcaggatgtaggcaggtcgatgtgtctcgcttgccactgccgcggagttttcgattactatgctgcgagaacatgctcgagaatcatgtgtttttctag

SEQ ID NO: 9505 - DNA, 2535 bp, Artificial Sequence
  Description of Artificial Sequence: Synthetic coding sequence
atgggccccggcgcccccttcgcccgggtgggctggcccctgcccctcttggtagtcatggcggctggggtggctcccgtgtgggcctcccattccccccacctgccgcggccccactcccgggtgcctccacatccctccagcgagcggcgtgccgtctacataggcgcgttgtttccgatgagcggcggctggcccggaggtcaggcatgccagcccgcggtggagatggccctggaggacgtgaatagtcgacgtgacatcctgcctgattatgagctcaagctgattcatcatgatagcaaatgtgacccaggtcaagccaccaaatacctgtatgaacttctatacaatgaccccataaagattatcctcatgcctggatgttcctcggtgtctaccctcgtcgcggaggctgccaggatgtggaatctgatcgtgctctcatatggttcatctagtccagccttgtccaacagacagagatttcccaccttcttccgcactcacccttcagccacgctccataacccaaccagggtgaaattgtttgagaaatgggggtggaagaagattgcaacaatccagcagaccaccgaagtgttcacttccactttggatgatctcgaggagagggtgaaggaagccggtattgaaataacttttcggcagagcttcttcagtgatcctgctgtaccagtgaagaacctaaagaggcaggatgccagaatcatcgtgggactgttttacgaaactgaagctcgcaaggtattctgcgaggtgtacaaggaaaggctatttggaaagaaatacgtgtggtttttgatcggctggtacgcagataattggttcaaaatctatgacccttcaattaactgtaccgtggatgaaatgactgaggctgtggagggccacattacaacagaaatagtgatgcttaatcccgcaaacactcgcagtattagcaacatgactagccaggaattcgtggaaaaactgacaaagagactcaaaaggcatcccgaggagaccggaggcttccaggaggccccattggcatatgacgccatctgggccctcgcattagctctgaacaagacctccgggggcggcggaaggtcgggtgttcgtctcgaggactttaattataataatcaaacaattacggatcaaatatacagggccatgaattcctcatcatttgagggggtgagtgggcatgtcgtgttcgacgcatcgggctcccgtatggcatggacgcttatagaacagttgcagggtggttcttacaagaagattggctattacgacagtaccaaggatgatctgtcttggtcaaagactgataagtggatcggggggtctccccccgctgaccagaccctagtgattaagacatttagatttctcagccaaaagctgttcatctcagtgtcggtgctttcttcactgggaattgtcctcgccgtggtctgtctgagctttaacatctacaattctcacgtccgatacatccagaactcccagcccaatcttaataacctgacagccgtcggatgttccctcgctctggcagcagtgtttcctttaggcctcgacggctatcatatcggacgcaatcaatttccttttgtgtgccaagcgcgtctctggctactgggtctggggttttctctcgggtacggcagcatgttcaccaagatttggtgggtgcacacggtctttacaaagaaggaggaaaagaaggagtggaggaaaacattggagccatggaaactgtacgctaccgtgggcctgctggtcggcatggatgttctgaccctggccatttggcagattgttgatcccctgcaccgcaccatcgagaccttcgctaaagaagagcccaaagaggacatagacgtgagtatccttccgcagctcgaacactgcagttcccggaaaatgaacacgtggctaggaattttctacggttacaagggcctgctgctgctactgggtattttcctggcatacgaaaccaagtctgtctcaactgagaagataaacgaccatagggccgtcggcatggcgatttataatgtggctgttctgtgtctcattacggcacctgttaccatgatcctctcttcccaacaggatgccgctttcgcctttgcctccctggccattgtgttctcctcttatattaccctggtggtactgtttgtacccaagatgcgccggctgataacaaggggggagtggcagagtgaggcccaagatactatgaagaccggctcttcgaccaacaataacgaagaggagaagtctcgactcctggaaaaagaaaatagagagctggaaaagattatagccgagaaggaggaacgggtctcagagcttagacaccaacttcaatctaggcaacagttgaggtctcggagacatccacccactccaccagagccgtctggaggcctgcccagaggacccccagaaccccccgacagactcagctgtgatggatcacgggtacatttactgtacaaatag

SEQ ID NO: 9506 - DNA, 2631 bp, Artificial Sequence
  Description of Artificial Sequence: Synthetic coding sequence
atgggccccgaggccctgagcagcctgctgctgctgctgctggtggccagtggtgatgctgatatgaaggggcacttcgatccagccaaatgcagatatgcgttgggtatgcaggaccgaactattcctgacagcgacatttctgctagctcgtcatggtcagactcaaccgcagcacggcactccaggctggagagctctgatggagatggcgcctggtgtcctgctggaagcgtttttcctaaggaagaggagtatctgcaggtggatctacagagactccacctcgtggcactggttggaacccaaggcaggcacgcaggtggcctcgggaaggaattcagtcgaagctaccgcctcaggtattcgagagatgggcgcagatggatgggttggaaagacagatggggacaggaagtcatctcaggcaatgaagaccctgagggcgtcgttctaaaagatctgggacctccaatggttgctagactggtgcgcttctaccctagggctgatcgcgtcatgagcgtttgcttgagagttgaactgtacgggtgcctttggcgcgacggactgctcagttatacagcaccggtgggacagactatgtacctatccgaagccgtgtatctcaacgacagtacctacgacggccacacagtcggggggctgcagtatgggggactcggacagcttgctgatggggttgtgggcctggatgattttcgcaaatcccaggagctacgcgtgtggccaggatatgactacgtgggttggtccaatcacagttttagcagtggttacgtggaaatggaattcgaattcgacaggttacgggccttccaagctatgcaggttcattgtaataacatgcataccctgggagcgaggctgccaggcggagtggaatgccgctttcgacgcggccccgccatggcctgggaaggtgagcctatgcggcataatttgggtgggaacctgggtgatcctagagcccgcgcagtatcagttccacttggggggagagtggcgcgcttcctgcagtgtcgctttttgttcgcaggtccctggctgctcttcagcgagatcagcttcatttccgacgtggtcaataattcttcacctgcccttggtggtacgtttccaccggcgccctggtggcccccaggtccgccgcctactaacttttcttctctggagcttgagccaagaggtcaacagcccgtggctaaagccgaaggatccccgactgcaattctcatcggctgcctggtggctattatcctccttttgttattgatcatcgcacttatgttgtggcggctgcattggcgacgacttctatctaaggctgaaagaagggtcctcgaggaggaactgaccgtgcatctctccgtacccggcgatacaatcctcatcaacaaccgtcccggcccccgagagccccctccataccaggaacctcgtccgaggggcaaccctccacactcagctccatgtgtacccaacggtagtgcatactctggtgactacatggagccagagaagcccggcgcacccttgcttccacccccccctcaaaattcagtcccgcactatgcggaggcagatattgttacgttgcagggcgtcaccggaggcaacacctatgcagtgcctgcgttacctcccggcgccgtgggcgacgggcctccccgggtggatttcccacggtctcgcctccggttcaaggagaagctcggcgagggacagtttggagaagtgcacctttgcgaagttgattcgccacaggatctcgttagtctcgatttccctctaaatgttcgaaaagggcatccactcctcgtggcggtgaaaattttgcgaccagatgctacaaaaaacgcacggaacgactttctgaaggaagtgaaaatcatgtctcggttaaaggatccaaacattatccgtctgctcggggtttgcgtccaagacgaccccctctgcatgattaccgactatatggagaatggcgatctaaaccagttcctcagtgcacatcagctggaggataaggccgcagaaggagccccgggcgatggtcaagccgctcagggaccaacgatcagttatccaatgctgttgcacgtcgctgcacaaatcgcgagcggaatgcggtacctagccactttgaacttcgtccacagggacctggcaacgaggaactgcctggtgggcgaaaatttcacaatcaagattgcagactttgggatgtctagaaatctctatgcaggggattactacagagtacagggcagggccgtgctgccgattcgctggatggcgtgggagtgcatcctgatgggtaagttcacaactgcaagtgacgtttgggccttcggcgtcactctgtgggaggttctgatgttgtgtcgcgctcagccatttgggcagctgacggacgagcaggtgattgaaaacgctggagaattcttcagggatcagggccgccaggtttatctgtctcgcccaccggcctgtccacagggcttgtacgaacttatgctgagatgctggtctcgcgaaagcgaacagagacccccattttcccagcttcaccgattcctcgccgaagatgcacttaacaccgtatag

SEQ ID NO: 9507 - DNA, 942 bp, Artificial Sequence
  Description of Artificial Sequence: Synthetic coding sequence
atgagcgacctgctgctgctgggcctgatcggcggcctgaccctgttactgctgttgacactcttagccttcgccggatattctgggttgctagcaggagtggaggtgtccgcaggcagcccgcctattaggaatgtgacagtggcttataaatttcacatgggactttacggagagacaggccggctgttcactgagtcgtgtagtatcagccccaaactgcgatcaatcgccgtctactacgacaacccgcacatggtccccccggacaagtgccggtgcgctgtgggtagcatcctgtctgaaggcgaggagtcgccttcccctgagttaattgacctgtaccaaaagttcggctttaaggtattttccttcccggcaccctctcatgtggttactgccacattcccgtataccaccatactttccatctggctcgcaacccgaagggtccacccggccctcgatacgtacattaaggaacggaaactctgtgcttatccccggctggaaatctatcaggaggaccagatccacttcatgtgtcccctggctaggcagggggacttctacgttccagagatgaaggaaactgaatggaagtggcgagggttggtggaggcgatagatacccaagtggatggcaccggggccgatacaatgtccgacacctcctctgtgtcattggaagtgtcgccaggatcccgcgaaacgtccgctgccactctctcgcctggagcaagttcaaggggatgggacgacggggacacccggtctgagcactcctactccgagtcaggggccagtggcagctctttcgaggagctcgatctggagggggagggccctctgggcgaatcaaggctcgaccctggtacagagccccttgggaccaccaagtggctgtgggagcccactgctccagagaagggaaaagagtag

SEQ ID NO: 9508 - DNA, 843 bp, Artificial Sequence
  Description of Artificial Sequence: Synthetic coding sequence
atgaagaccttcacctggaccctgggcgtgctgttcttcctgctggtggatactggccattgtaggggtgggcaatttaagatcaagaaaattaaccagcgccgctatcctagaactattaaggatatgattactcgtatggatttggagaacttgaaggacgtgttgtctagacagaagagggaaattgacgttttgcagttagtggtagacgtggatggcaacatcgtgaatgaagtgaaactcctccgtaaagagagtcggaatatgaatagccgcgtgacgcagctctatatgcagctactgcacgaaatcatacgcaagagagataactctctggagttgagtcaactggagaacaagattctcaacgtgacgacagagatgctaaagatggctactagataccgggagctggaggtcaaatacgccagtctcactgatttggtgaataatcagagcgttatgattacacttctggaggagcaatgcctccggattttcagccggcaggacacccacgtgtcaccaccacttgtgcaggttgtcccccagcacattcccaacagtcagcaatatactcctggtctgttgggggggaatgagatccaaagggatccaggctaccctcgggatctgatgccgcctcctgatttggccacttcccccaccaagagcccgttcaagataccaccagtcacttttataaatgaaggacccttcaaggattgccagcaagccaaagaggccgggcacagcgtgaacggcattttttgggcagagtataggggtggtagttactcacttcgcgccgtgcagatgatgataaagcctatcgattag

SEQ ID NO: 9509 - DNA, 522 bp, Artificial Sequence
  Description of Artificial Sequence: Synthetic coding sequence
atgcactggaagatgctgctgctgctgctgctgtactacaacgccgaggctagcatgtgtcaccgctggagcagggcagtgttgtttccggccgctcaccgacccaagagaagctcttctctgccactcaaccctgtgctacagacctccttggaagaggtcgaattgttgtatgaatttttgctagcagagctggagatttccccggatctccagatctcaatcaaagacgaagaactcgccagtctgcgtaaggcctctgatttcagaactgtctgcaacaacgtgattcctaagtcaatccctgacatccgtcggctgagcgccagcctgtcctcacatcccggtatactcaaaaaggaggacttcgagcgtaccgttctgacgctggcctataccgcgtaccgtaccgccctgagccacggccatcagaaggatatatgggcccagtcactggtcagcctgtttcaggccctccggcacgacctcatgcggagttctcagcccggagtgccaccgtag

SEQ ID NO: 9510 - DNA, 309 bp, Artificial Sequence
  Description of Artificial Sequence: Synthetic coding sequence
atggagcggggcgccggcgccaagctgctgcccctgctgctgctgctccgcgccacagggtttacttgcgcgcagacggatggccggaatggctataccgcagtcatcgaggtgacaagcgggggcccctggggagattgggcctggcctgaaatgtgcccggacggcttcttcgcctccggcttcagcttgaaggttgagcctccgcagggtatccccggcgatgacaccgcgctgaatggcattaggctgcattgtgcccggggtaatgtcctaggcaatacccatgttctaggccgcatggagtag

SEQ ID NO: 9511 - DNA, 351 bp, Artificial Sequence
  Description of Artificial Sequence: Synthetic coding sequence
atggccgccggcagcgcccccatgcagctgcacctgcgggccaccatccgcatgaaggatgggctgtgtgtgcctcgcaaatggatctatcacctgaccgagggctctactgatctgcgaacggaaggtcggccagacatgaagactgagctgttttcatcctcgtgccctggtggaatcatgctgaacgaaaccggccaagggtaccagcgcttcctcctatacaatcgctcaccacacccccccgagaaatgtgtggaagagtttaaatccctgaccagttgtttagactccaaagccttcttgcttacgccccgcaaccaggaggcctgtgagttgtcaaataattag

SEQ ID NO: 9512 - DNA, 1137 bp, Artificial Sequence
  Description of Artificial Sequence: Synthetic coding sequence
tgatacagcggcgactacatggagcccgagaagcccggcgcccccctactgcccccccccccccagaacagcgtgcctcactatgcagaggctgacattgtgacgcttcaaggggtgacaggcggcaatacgtacgccgtaccagccctgcccccaggcgcagtgggggacgggcctcctagagttgactttccacgatctaggctgaggttcaaagagaaattgggagaggggcaattcggggaggtgcacctgtgtgaggtggattcacctcaggacttagtgtcacttgactttcctctgaacgtacgcaaaggacatcccttactcgtcgcggttaaaattctccgcccagacgccacgaagaatgcgtcattctccttattctctcggaatgacttcctcaaggaggtgaaaatcatgtctcgactgaaggaccccaacatcataaggttacttggcgtctgcgtgcaggatgaccctctgtgtatgatcacagattatatggaaaacggagacctgaaccagtttctctcggcacaccaactcgaggataaagctgcagagggtgctccgggggacggccaggccgctcaagggcctacaattagttacccaatgctgctgcacgtggccgctcagattgcatctgggatgcggtacctggctacgctcaattttgtccaccgcgaccttgcaacccgaaattgcctggtcggcgagaatttcacgattaagattgccgacttcggcatgagccggaatctgtacgctggagactactaccgggttcaggggcgtgcagtgctgcccatacgatggatggcgtgggagtgtattctgatgggaaagttcacgacagcaagcgacgtatgggcattcggtgtgaccttgtgggaagtgcttatgttgtgtagagcacaacccttcggccagttaactgacgagcaggttatagaaaacgctggcgagttcttccgggatcaggggaggcaggtgtacctgtctcgacctcccgcctgtccacaaggtctctacgaactgatgttgcgctgttggtctcgtgaaagcgagcagagaccaccatttagccaacttcatcggtttctcgctgaggacgctcttaatacggtgtag

SEQ ID NO: 9513 - DNA, 942 bp, Artificial Sequence
  Description of Artificial Sequence: Synthetic coding sequence
atgagcgacctgctgctgctgggcctgatcggcggcctgaccctgctgctcttactgactcttcttgcctttgccggttactcaggcctcttggctggagtggaagtgagcgccggaagtcctcctattcgcaacgtgacagtggcatataaattccatatgggcctgtatggagaaacaggaagactttttacggagtcttgtagcataagtccaaagctgcgtagcattgcggtctactatgataacccccacatggtgccccctgataagtgcaggtgcgccgtgggcagtatcctgagtgaaggagaagagtcaccctctccggagctcattgatctttatcagaaattcggttttaaggtgttttccttcccagcacctagccatgttgtgactgcgacctttccttacaccacaattctgtcaatctggctggcgaccagacgcgtacatcccgctctcgacacttacattaaagagaggaaactgtgtgcataccctcggctcgaaatataccaggaagatcagatccactttatgtgtcctctcgcacgccaaggcgacttttacgtgccagaaatgaaggagacggaatggaagtggagaggcctggtggaggccatcgacactcaggtcgatggcacaggcgctgacaccatgtctgatacttcctctgtgtcactggaagtcagcccgggatcacgagagacatcagcagctacactctctccaggagcctctagcaggggctgggacgacggggacacaaggtctgaacactcttattctgaaagcggcgctagcggctcttcctttgaagaactagatctggaaggagagggccctctgggagagtccagactagacccgggcaccgaaccgcttggcactaccaagtggctgtgggagcctaccgcacctgaaaagggaaaggaatag

SEQ ID NO: 9514 - DNA, 420 bp, Artificial Sequence
  Description of Artificial Sequence: Synthetic coding sequence
atgggccccgaggccctgagcagcctgctgctgctgctgctggtggcatctggagacgcagacatgaagggacattttgaccctgcgaagtgtcggtacgcactgggaatgcaagatagaactatcccggactccgacatttccgcatctagttcatggtccgattcaacagctgccagacactctcggctcgagagcagtgatggcgatggggcatggtgtcccgcaggcagtgtttttccaaaggaggaggagtacttacaggtggatttacagaggctacacttagtcgccttggtgggaacacagggaagacatgcaggcggtttgggaaaagaatttagccggtcttatcgattgcgatacagtcgcgatggacgtcgctggatgggctggaaagatagatgggggcaggaatag

SEQ ID NO: 9515 - DNA, 342 bp, Artificial Sequence
  Description of Artificial Sequence: Synthetic coding sequence
atggacaacgtgcagcccaagatcaagcaccggcccttctgcttcagcgtcaaggggcacgtgaagatgctcagactggccctgaccgtaacgagtatgactttcttcatcatagcccaggcccctgaaccttacattgtcattaccggctttgaggtaactgtgattctgtttttcattctattgtacgtcttaaggctggaccgccttatgaagtggctattctggcctctcctggatattataaatagtctggttactacagtctttatgctcattgtgtctgtactggcactgattcccgagaccactacactaacggttggtggtggcctattttag

SEQ ID NO: 9516 - DNA, 465 bp, Artificial Sequence
  Description of Artificial Sequence: Synthetic coding sequence
atgttcggctggggcgacttccacagcaacatcaagaccgtgaagcttaatctcttaatcacaggcaagattgttgatcacggaaatggaacattttctgtctattttcggcacaatagtacggggcaggggaacgtcagtgtgtccctggtcccccctacaaagattgtcgaattcgatttggcccagcaaaccgtgattgacgcgaaggatagtaaatcctttaattgcagaatcgagtacgaaaaggtggacaaggctactaagaacacactgtgtaactacgatccgtccaagacctgctaccaggagcaaacccaatctcatgtttcctggttatgtagtaagccttttaaggtgatatgcatctatatttctttctacagcactgactacaagctggtgcaaaaggtctgccccgactacaattaccatagcgacacaccatacttcccatcaggatag

SEQ ID NO: 9517 - DNA, 531 bp, Artificial Sequence
  Description of Artificial Sequence: Synthetic coding sequence
atggccgacatgcagaacctggtggagcggctggagcgggccgtgggccgcctggaggctgtatctcacacctcagatatgcaccgcggttacgctgactcacctagcaaagcgggggccgctccctacgtgcaggcattcgattcactacttgctggtcctgtcgctgaatacctgaagatcagtaaggagattggcggcgatgtccagaaacatgcagagatggtgcacactggtcttaagctggagcgggcattgctcgtcacagcgagccaatgccaacagcccgccgagaataaactgagtgaccttctggcccctattagtgagcaaattaaggaagtgattacatttcgtgagaaaaaccgcggaagcaagctgttcaatcacctcagcgctgtgtctgagtctattcaggcactgggttgggtggctatggctccaaagcctgggccatacgtcaaagaaatgaatgacgctgccatgttttacacaaatagagtgctgaaggaatataaggacgtagactag

SEQ ID NO: 9518 - DNA, 2535 bp, Artificial Sequence
  Description of Artificial Sequence: Synthetic coding sequence
atgggccccggcgcccccttcgcccgggtgggctggcccctgcccctgctcgtcgtgatggcggccggcgtggcaccggtgtgggcctctcacagtcctcatctcccacgaccccattcccgggtgccaccacacccttcatctgagaggcgagcagtttacatcggggccctcttccccatgtcaggtggttggcctggcggtcaagcctgtcaacccgccgtcgagatggcattggaggatgtgaacagccggcgcgacatcctgccggactatgagttgaagttgatacaccacgatagtaagtgcgaccctggtcaagccacaaaatatctgtatgagctgctgtacaacgatcctatcaaaattattttgatgcccggttgcagctccgtatcgactctggtggccgaggcagctaggatgtggaacctgattgtactgtcctatgggtcgtcatcccctgccctctcaaataggcagaggtttcccactttttttagaacgcacccgtcggcaaccctgcacaaccctacacgggtgaagctgtttgaaaagtggggatggaagaaaatcgcgactattcagcaaacaacagaagtctttacatccacactcgatgacttagaggaacgtgtgaaggaggccggtatcgaaattacgtttagacaatccttcttttctgatcctgctgttccagtgaagaatctcaagcgtcaggacgcccgcattatcgtaggacttttctacgagaccgaggcaagaaaagtcttttgcgaagtttacaaggagagactgttcgggaagaaatatgtttggttcctgatcggctggtatgccgataattggttcaaaatatacgatccaagtataaattgtactgttgatgagatgactgaggctgtagaggggcatatcaccacggagattgtgatgctgaatccggccaatactaggtccataagcaacatgaccagtcaggagttcgtggagaagctgacgaagaggctgaagcgtcaccccgaagaaaccggtggttttcaggaggctccattggcttatgacgcaatctgggcgctggcgcttgccctaaataagaccagtggaggcggcggccggagcggagtccgattagaggacttcaactacaataatcagaccattacggatcagatctaccgggctatgaactccagctcttttgagggcgtgagtggacacgttgtcttcgatgcatcggggagtcgcatggcgtggacgctcattgaacagctccagggcggttcctataaaaaaattgggtactacgactccacaaaagatgacctctcatggagcaagaccgataaatggattggcggctccccccccgccgatcaaacgttggttatcaagacttttcgcttcctctcgcagaagctctttatctcagtctctgttctatcttccctgggcatcgtactggcagtggtgtgcttaagcttcaacatttataattcgcatgtgaggtacatccagaattcacagccgaatctgaataacctcaccgccgttggctgttcattagccttggccgctgtgtttccgctagggttagacggctaccacatcgggcgcaaccagtttccattcgtgtgccaggctcgcctgtggctgctgggtctgggattctctttggggtacggcagcatgttcaccaaaatctggtgggtgcatacagtcttcacaaaaaaagaagagaaaaaggagtggcggaaaactttggaaccgtggaaactttacgccacagtgggcctcctggtggggatggatgtcctcaccttggctatctggcagatagtggacccactgcaccgaacgatagaaacatttgcaaaggaggagcctaaagaggatattgacgtatctattctgccacagctggagcactgtagctcacgaaagatgaacacttggttaggcatcttctacggatacaaaggactacttctgttacttgggatttttctagcatacgagactaagagcgtgtccactgagaaaatcaatgaccaccgagccgttggcatggccatatataatgtggctgtcctgtgcctgattacagcacccgtgacgatgattctctctagtcagcaagacgctgcgttcgctttcgcatccctggcgatagtgttcagctcatacataactctggtggtgctgttcgtcccgaagatgcgtaggctgatcacccgcggggaatggcagagtgaggctcaggatacaatgaagacaggctcttctaccaataacaatgaggaagagaagtctcgcctgctcgagaaggagaatcgggagcttgagaagatcattgctgaaaaagaggagagggtgtccgagctgcgacaccaactgcagtccaggcagcagctgaggtcaaggagacatccacccacacctccagagcccagtggcggattgccaagaggccctcccgagccacccgaccgcctgtcctgtgacgggtcaagggttcatctgttgtataaatag

SEQ ID NO: 9519 - DNA, 2055 bp, Artificial Sequence
  Description of Artificial Sequence: Synthetic coding sequence
tgaccccggagcagcacccacgtgcccctggtgctgcccctgctggtgcttctgcttctcgcaccggcccgccaggcagctgctcagcggtgtcctcaggcttgcatctgtgataacagtcggagacatgttgcctgcaggtaccagaacctgacggaggtgccagatgctatccccgaacttacacagaggctcgatctccagggtaacttgctgaaagtgatacccgcagccgcattccaaggtgtccctcacctgactcaccttgacttgaggcattgtgaagttgaattggtcgcggagggcgccttcagggggttgggccgcctcctgctactgaatctggcttccaaccacctcagagaactgcctcaggaggcactggacggcctaggaagcctgcggagactagagcttgagggaaatgccctggaagaactgcgacccggtactttcggtgcactgggagcactggccaccttgaatctagctcacaacgctctcgtgtaccttccagccatggccttccagggactattgcgtgtgaggtggctgcgtctgagtcataacgcactgtccgtgctggctccggaggcacttgccggattgccagcactcaggcggttgagcctgcatcataatgagctccaggcactccctggacctgtactgtctcaggccagggggctggctcgcttggaattaggccataatccattaacctatgccggggaagaagatggcctggcgctccccggacttcgggagcttcttctggacggaggcgccctccaggccctgggtcccagggcctttgcccactgtcctcggctgcacacgctggatctgcgcggcaatcagcttgatactctgccccctctgcagggacccggacaactcagaaggctgagactgcagggaaaccctctctggtgtgggtgtcaggcacgacccctcctcgaatggctggcaagggcccgggttcggagcgacggcgcatgtcagggcccccggagactgcgcggggaagctctggatgccctccgtccctgggatttaagatgtcccggtgatgccgcgcaggaggaggaggaattggaggaacgcgctgttgctgggcccagggctccaccccgagggccacctcggggtcctggggaggaaagagcagtggccccttgcccccgggcgtgcgtgtgtgtgccagaaagccggcactccagctgcgaagggtgtggcctgcaagccgtgccccggggattcccctctgacacgcaattgctggaccttcgacgaaatcactttccgtcagttccacgtgcggccttccctggcttgggccatctggttagcctgcacctccaacattgtggaatcgcggagttggaagctggcgctctggccggtctgggccggctcatttatctgtatttatccgacaatcaactggccggactgagtgccgccgcccttgagggagcccccaggctgggttatctttatttggaacgcaatagattcctccaggtaccgggggctgctctgagggccctcccaagcctgttctccctccacctgcaagacaacgctgttgataggttggccccaggtgatctgggccgaacacgcgcgctgcggtgggtgtacctgagtggaaacagaattaccgaagtcagtttgggcgcacttggcccagcgcgagagttagagaaactgcaccttgatcgcaatcaactccgcgaggtgcccactggtgcactggaggggctgccagccctgctggagttacagctgtcgggaaaccccttacgtgcccttcgcgacggagcttttcaaccagttggacggtccctgcagcatctatttctgaacagcagtggactggagcagatttgtcctggagccttcagcggcttgggacccgggctccagagcttacacctccagaagaatcaactgcgtgctctgccggccctgccatctgcacgaagaacaccaattaaaggccgacaatgcggcgccgataaagttggcaaggagaaagggaggctctag

SEQ ID NO: 9520 - DNA, 2259 bp, Artificial Sequence
  Description of Artificial Sequence: Synthetic coding sequence
atggcccggcacctgctgctgcccctggtgatgctggtgatcagcccaatcccgggcgccttccaagactccgccctgtcccccacccaggaagaaccggaggacttggattgcggcagaccagaacccagcgctcgaatagtcggcgggtcaaacgcgcagcccggaacttggccatggcaggtgagcctccatcacggcgggggtcacatatgcggtggttcactgattgctccctcgtgggttctgtctgccgcccattgtttcatgactaatgggacccttgaacctgcggctgaatggtctgtcctgctgggagtgcacagtcaggatggccctttggacggggctcacactagggccgtagccgctatcgttgtacctgccaattattcccaggttgagttgggcgccgatctggcattactgcgcctagcttcgccagctagcttaggacccgctgtctggcccgtgtgcctcccccgcgcttctcaccgcttcgttcacggcacagcatgttgggctacaggctggggcgatgttcaagaagcagacccgctgcctctgccctgggttctccaagaggtggagctgcgcctgctcggcgaagcaacctgccagtgcctctacagccaacctggtcccttcaatctgaccctgcaaattctgcccggcatgctgtgtgccggttatccagaagggcggagggacacctgccaaggggatagtggggggcccctggtatgcgaagagggagggcgctggttccaagcaggcatcacatccttcggatttggatgcgggcgcagaaatcgaccaggggtcttcactgccgtggctacttacgaagcatggatacgagagcaagtgatgggatccgaaccgggcccggcctttccaacccaaccccagaagactcagagcgatcctcaagaacctagggaggaaaactgcacaatcgctttgcctgagtgtggcaaagcccctcggcccggcgcctggccctgggaggctcaggtaatggtgcctggcagcagaccctgccacggcgcactggtcagcgagtcatgggttctggctcctgcatcttgctttctggatcctaattcctcagactctccacctcgtgatttggatgcctggagagtgctgttgcctagcagacccagggctgagcgagtcgcgagacttgtacagcatgagaacgcctcttgggacaatgcaagcgacttggctctgctgcagctgagaactcccgtgaacttgtccgccgcgagcaggccagtgtgcttgcctcatccggagcactactttctgcccggcagtcggtgccgactggcacgctggggcagaggcgagccagccttgggtcctggggccttgctagaggcagaactcttgggcggttggtggtgtcattgcctctatggccgccagggcgcagcggtcccattgcctggggatccaccccacgcactgtgtccggcataccaggaaaaagaagaggtcggcagctgctggaacgatagcaggtggagtctactttgtcaggaagagggaacttggttcctcgcgggaatcagagacttcccctcggggtgcctcaggccacgcgcattctttcccctgcaaacgcatggcccttggatttctcacgtgacaagaggcgcttatcttgaggatcagctggcttgggattggggaccagatggcgaagagactgaaactcagacttgcccaccacacaccgaacacggcgcctgtgggctgcgcctggaagcagctcccgtgggcgtgctttggccctggctcgctgaggtgcatgttgccggcgatcgggtttgtaccgggatcttactggctccaggatgggtgctggcagccacccactgcgtcctcagaccgggctccactactgtgccctatatcgaagtgtacctgggtcgggccggcgcttccagtttaccacagggtcaccaaatgacatctgcccctcccctgctctgccagatgactgaaggcagctggattctagtgggcatggcagtccagggctctagagaactgttcgcagcaatcggtcccgaggaggcttggatttcccaaaccgtgggggaagccaactttctacctccgagcggatcgccccattggcctactggcggcagtaacctctgcccccccgagctggccaaagctagcggctcccctcatgcagtctacttcctcctccttctgacattattgattcagtcatag

SEQ ID NO: 9521 - DNA, 453 bp, Artificial Sequence
  Description of Artificial Sequence: Synthetic coding sequence
atgcggttcatggccggccccgccggcagccagagcctgggccccctctgtttccacagtagcccccaggcactgtatacagtcctgctaatcgttttagtaatgatgtctctggtctttggaaagttcgtgccagtgaactgggagccacctcagccactaccttttcctaagtatctccgatgctatcgctgcctgctggagactaaggagctcggctgtcttttgggcagtgacatctgcttaaccccagccggatcttcttgtatcacacttcacaagaaaaattcttccggaagcgacgtgatggtgtctgactgtcgctccaaagagcaaatgtctgactgttctaatacccggacttcgccagtctccgggttttggatcttctctcagtactgctttctggacttctgtaatgacccccagaacagggggctctacactccctag

SEQ ID NO: 9522 - DNA, 1161 bp, Artificial Sequence
  Description of Artificial Sequence: Synthetic coding sequence
atgaagttccagggccccctggcctgcctgctgctggccctgtgcctcggaagtggagaagcaggaccgctgcagagtggcgaagagagcaccgggacaaatattggcgaggcattaggacatggactcggagatgctttgagtgaaggtgttgggaaggccatcggcaaagaggccggcggcgccgctggcagcaaagtctctgaggcactgggccagggtacccgcgaggcagtcgggacaggagtgagacaggtacctgggtttggcgtggctgacgccttgggcaatagagtaggcgaggccgcccatgccttaggcaatactggccatgagataggcaggcaggctgaggacgtcatacgtcacggtgccgacgctgttagaggatcttggcagggggtccccggccataatggggcatgggaaacttcagggggtcacggtatttttgggagtcaggggggcctaggcggccaggggcagggcaacccaggggggttaggcacaccatgggtgcacggatatcccggcaatagcgccggtagttttggaatgaaccctcagggtgcgccttggggtcagggcggcaacggcggacctccaaactttggtacgaatacgcagggtgccgtggctcagcccgggtatggaagcgtgcgagctagcaatcaaaacgaaggctgcactaacccacctccttcagggtctggcgggggctccagcaactcaggtggaggcagcgggtctcagagcggcagcagcggtagtggcagcaacggagataacaataatggcagttcatcagggggtagttcctctggctcgtcatcgggcggttcatccggcggaagctctggaggctcatccggtaattccggcggctcacggggcgacagcggatccgaatctagctggggctcctccactggttcgagctctggtaaccatggggggagtggaggaggcaacgggcacaaacccggctgtgaaaagccaggaaacgaggcccggggctcaggagagtcaggcatacagaacagtgagaccagtcccggaatgttcaattttgataccttttggaagaattttaagagtaaactgggcttcataaactgggatgcgataaataaggaccaacgctcctccaggattccttag

SEQ ID NO: 9523 - DNA, 1995 bp, Artificial Sequence
  Description of Artificial Sequence: Synthetic coding sequence
atgaagaccggcctgttcttcctgtgcctgctgggcaccgccgccgccatccccaccaatgcacgattgcttagcgaccattcaaaacctacagcagaaaccgtggccccagacaataccgctatccctagccttcgcgctgaagccgaggaaaacgaaaaggaaactgcagtgtctaccgaagacgactcccatcacaaggctgaaaaatcctccgtgctgaagtccaaggaggagtcccacgagcagtctgccgagcaggggaaatcctccagccaagaactgggcctcaaggaccaggaggacagcgatggccatctgagtgtgaaccttgaatacgccccaacggagggcactctggatatcaaggaggacatgtctgaaccacaggagaagaagctaagcgaaaacacagactttctagctcctggagtctctagtttcactgattccaatcaacaggagtccattactaagcgcgaggaaaatcaggaacagccccgaaattattctcaccatcaactgaatagatcatctaagcacagccaaggccttcgcgaccagggtaaccaggagcaagacccaaatatctctaatggagaggaggaggaggagaaggaacccggagaggtcggtacccataacgacaatcaggaaaggaaaacggagctgccccgagaacacgccaactccaaacaagaagaggacaatacccagtctgacgacattttagaggaatccgatcaaccgacgcaggtttccaagatgcaggaagatgaattcgaccaggggaatcaggaacaggaggataattcaaacgctgagatggaggaggaaaatgccagtaatgtgaacaagcacatccaggaaaccgagtggcagagtcaggaaggtaagacaggcttggaggcaattagtaatcataaagagacagaagaaaagactgtgagcgaggccctccttatggaacctacggacgatgggaacactacccctagaaatcatggagtggatgatgatggggacgatgacggggacgacggcggtacagacggacctcgacactccgcctcagatgactactttattccctcgcaagcttttctggaggccgaaagagcacagagcatagcctatcatctcaaaatagaagaacagagggagaaggtgcatgagaatgagaatatcggaaccaccgagccaggagagcatcaggaggctaagaaagctgaaaactctagtaatgaagaagaaacatctagcgagggcaacatgcgcgtccatgccgtagactcttgcatgagctttcagtgtaagcgcggtcacatctgtaaagctgaccagcagggaaagcctcattgcgtgtgtcaggaccccgtgacatgcccgccaactaagcctcttgatcaagtctgtggtacagataaccagacgtatgccagtagctgccatctgttcgccactaagtgccgcctggaggggaccaagaaagggcaccagttgcaattggactatttcggcgcttgcaaatcgatccccacctgtactgattttgaagtcattcagtttccgttgaggatgcgagactggctgaagaacatcctcatgcaactctatgaagccaacagcgaacacgctggatacctgaatgagaagcagcgtaacaaggtgaaaaaaatttatctggacgaaaagcgccttctggcaggggaccaccccattgaccttctcctgagggactttaaaaaaaattaccatatgtatgtgtatcctgtgcactggcaattcagcgagctagatcaacatccaatggaccgtgtcctgacacacagcgagctggccccgctcagggctagcctcgtcccaatggagcattgcatcactcgatttttcgaagagtgtgacccaaacaaagataagcacattactctgaaggaatggggtcactgtttcggtataaaggaggaggacattgacgaaaacttattgttctag

SEQ ID NO: 9524 - DNA, 420 bp, Artificial Sequence
  Description of Artificial Sequence: Synthetic coding sequence
atgggccccgaggccctgagcagcctgctgctgctgctgctggtggcgagtggcgatgcagacatgaagggccactttgaccctgcgaaatgcaggtatgcgttaggcatgcaagaccgcaccatccccgactctgacatctctgcttcctcaagctggtccgacagcactgccgctcgtcattcccgtttggagagtagcgatggggacggcgcgtggtgccccgctggaagcgtgtttcctaaggaggaagaatacctccaggtggacctacagcgcttacacctggtagcactggtggggacacaggggcgccacgccgggggccttgggaaggagttctcccggtcttacaggctgcgctactcccgggacgggaggcggtggatggggtggaaggacagatgggggcaggagtag

SEQ ID NO: 9525 - DNA, 285 bp, Artificial Sequence
  Description of Artificial Sequence: Synthetic coding sequence
atgcagcacagcctggtgttcttcttcgccgtgatcctgcacctgagccacctgctgcacctcgatgcgtctattcacccttttcgacttcctttctcatcaaagccgtttctgttgatacccatgagtaatactaccctgcctcacaccgcctggccactcagctttctgcaccagaccgtcagcacactcaaggcggtcgccgtgacacattccctgtggcatctgcagatcccggtcgattgccaagcttgtaatagaaagagtaagaagatttattgctag

SEQ ID NO: 9526 - DNA, 699 bp, Artificial Sequence
  Description of Artificial Sequence: Synthetic coding sequence
atgctgcccaagagccggcgggccctgaccatccaggagatcgccgccctggcccggtcttccctgcatggcatatcgcaagtagtgaaggaccatgtaactaaaccaactgctatggcccagggccgggtggcacacctaattgaatggaaaggttggtccaagccttccgattcccctgcagccctcgagagtgcattcagcagctatagtgatctatcagaaggggaacaggaagcgcggtttgccgccggcgtggccgagcaatttgcaatcgcagaagccaaactgcgggcctggtcttcggtggatggtgaagacagtacagacgattcctatgatgaagatttcgctggtggtatggatacggatatggccgggcaactgcccttggggccccatctgcaggaccttttcacagggcacagattttcacggccagtacggcaagggtctgtggaacccgaatctgattgttcccagacagtgtccccagatacattgtgctcctccctctgtagcctcgaggacggactgctgggcagtccagccagacttgcctctcaacttttgggcgatgagctacttctggccaaactcccaccaagccgagagagcgccttccgcagcctcgggccactcgaagcccaggactcactgtataactcaccccttactgaatcttgtctctccccctag

SEQ ID NO: 9527 - DNA, 2631 bp, Artificial Sequence
  Description of Artificial Sequence: Synthetic coding sequence
atgggccccgaggccctgagcagcctgctgctgctgctgctggtggccagtggggatgctgatatgaagggacacttcgatccagccaagtgccgctatgctctagggatgcaggataggaccattccagactcagacatttccgcgtcttcctcttggtctgactcaaccgccgcccgacactctcgactggaatcctcggatggcgatggtgcatggtgtcctgcaggcagcgtcttccctaaggaggaagagtatctgcaggtcgatcttcaaagactgcacttggttgcgctggtcggaacacagggcaggcacgctggcgggctggggaaagaattttctaggagttatagactgcggtacagtagagacggccgccgctggatgggttggaaagacagatggggccaggaggtaatctccgggaacgaagatcccgagggggtggttctgaaggacttgggcccccccatggtagccagattggtccgcttttacccccgcgcggacagggtgatgtctgtttgcctgagagtcgagttgtacggatgtctttggagggatgggcttctgagctacactgccccagtaggacagacgatgtatctgagcgaagcggtgtatttgaacgactccacctacgatggtcacactgtagggggcttgcagtacggtggcctcgggcaactggccgatggagttgtcggcctggacgacttccgtaaaagtcaggaactgcgcgtgtggcctggatacgattacgtcggatggtccaaccatagcttctcatcagggtatgtggagatggaattcgaattcgatcggttaagggcattccaggctatgcaggttcactgtaacaacatgcatacactaggcgccaggttacccggcggtgtggagtgtagattccgacggggtccagctatggcctgggaaggagaacctatgcggcacaatctgggcggaaatctcggggacccacgagcccgggctgtgagcgtgccgctgggcggacgtgtggcccgttttctccagtgtcggtttcttttcgccggcccgtggctcctgttctcagaaatttcgtttatatcagatgtcgtgaataacagctctcccgccctgggcggaactttcccacctgcaccttggtggccaccgggccccccgccgactaacttttcctccctggagctggagcctcgtggacagcaacctgtcgcaaaagccgaggggtccccaactgccattctgatcgggtgcctggtcgctatcattctgttgttgcttcttattattgcactgatgttgtggaggctgcactggcgtagacttttgtccaaggcggagcgccgcgtcctcgaggaggaactgacagtgcatctttccgttcccggggacactatacttatcaacaatcggccagggcctcgcgagcccccaccctaccaagaaccaagaccaagaggtaaccccccccactcggcgccatgcgtgcctaacggatcagcctacagcggtgattacatggaacccgagaagcccggtgccccactgctgccacctcccccacagaactccgtgcctcattacgcagaagcagacatagtcacactccagggggtgacaggaggcaacacttatgccgtgccagctctccctccaggagccgtgggagacggcccccctcgggtggatttcccccgttctaggctgaggttcaaagaaaagctgggcgagggacagtttggggaagtgcacctgtgtgaagtcgactcacctcaggatctggtttctcttgactttccacttaacgtaaggaaaggccaccccctgcttgtggcagttaaaatcctgcgtcctgacgctacgaagaatgctcgcaatgacttcttgaaggaggtgaagatcatgagtcgcctgaaggatcctaacattattagactcttgggggtctgtgtacaggatgaccctctgtgcatgattaccgactacatggaaaatggggatctgaatcagtttctttctgcccaccagctcgaagacaaggccgccgaaggcgcgcctggggacggccaggccgcccaaggaccaactataagctatcccatgctgctgcacgtggccgcccagatcgcaagtggaatgagatacttggctacactgaattttgtgcaccgtgatcttgctacgagaaattgcctggtaggcgaaaacttcaccatcaagattgctgacttcggcatgtcacggaatctttacgcgggagattattacagagtacaggggcgggctgtgttgcctattcggtggatggcttgggagtgcatcctgatggggaagttcacgaccgcttctgacgtctgggccttcggtgtcaccctttgggaagtcctcatgctgtgcagagcccaaccctttggtcaactcactgatgagcaggtgattgaaaacgcgggggagttttttagagatcaggggcgtcaggtctacctcagccggccacctgcctgcccgcagggtctctacgagttgatgctgcgatgttggtccagggagtcagagcagcgaccccccttttcacagttgcatcgattcctggcagaggatgccctcaatactgtgtag

SEQ ID NO: 9528 - DNA, 165 bp, Artificial Sequence
  Description of Artificial Sequence: Synthetic coding sequence
atgtgccgggagaccgccggctacggctggctgctggccagcaccgagttgctaagcctgctcgagccattgagccctcagctgctaaaggagcacatctcctgtacgtctcaagtggctgccggtgccaaggtgactcccgactccgccgtctgggccccgtag

SEQ ID NO: 9529 - DNA, 2256 bp, Artificial Sequence
  Description of Artificial Sequence: Synthetic coding sequence
atggccttccggaccatctgcgtgctggtgggcgtgttcatctgctccatttgcgtgaaaggctccagccaaccacaggcaagagtctacctgactttcgatgagctccgggagactaagacttccgagtattttagcttaagccaccacccgctggactacagaattctactgatggatgaggatcaagacagaatctacgtgggcagcaaagaccatattctgagcctgaatattaataacatctctcaagaggcattgtccgtgttttggcctgcatccaccataaaggtagaggagtgtaaaatggccggcaaggacccaactcacggctgcggcaacttcgtgcgtgttatccagacatttaacagaactcacttatatgtctgcggatccggggcattctcgcccgtgtgcacttacttgaaccgtggccgaaggagcgaggatcaagtgtttatgatcgacagcaagtgcgagtccggcaagggccggtgtagctttaatcccaatgttaataccgtttctgtgatgatcaacgaggaactgttttccggaatgtacattgattttatgggaacggatgccgcgatttttcgttctctgaccaagcgcaatgcggtccggacagatcagcacaattcaaagtggttgtcagaaccgatgtttgtcgacgctcacgtgattcctgacggcaccgatcctaatgatgccaaggtatacttttttttcaaggaaaaactgacggataataatcggtccacaaagcaaatccattcgatgatcgcacgaatttgccccaacgacaccggtggtcttaggtccctcgtgaacaagtggactacgtttctgaaggcccggcttgtgtgtagtgtgaccgatgaggatggaccggagacccatttcgacgagcttgaggacgtattcctgcttgagaccgacaacccaagaactaccctcgtctacggtatcttcaccacatccagttctgttttcaagggatctgccgtgtgcgtgtaccatctgtctgatattcaaaccgtgtttaacggtccgttcgcccacaaggaaggccccaaccaccagctgattagttaccagggacgaattccgtatccccggcccggcacatgcccaggaggcgcctttactcctaatatgaggaccaccaaagagtttccagacgacgtagtgacattcatccgaaaccacccccttatgtacaactcaatctacccaatccacaaacgcccccttatcgttaggatcggcactgattacaagtataccaaaattgccgtcgaccgtgtgaacgccgctgacggccgctaccacgtgctctttctgggtactgataggggaaccgtgcagaaggtggtagtactccctacaaataacagtgtttccggggaactgatactggaggagctggaagtcttcaaaaaccatgcaccgatcacaacaatgaaaatcagctcaaaaaagcagcagctgtatgttagctccaacgaaggggtgtcacaggtgtccctccatcgctgccacatttacggcaccgcctgcgcggactgttgtctggcccgagacccttattgtgcctgggacggacatagttgttctagattctaccccactggcaaacgaaggtcgcggagacaggacgttcggcacgggaatcccctaactcagtgcaggggcttcaatttgaaggcttataggaatgccgcggagatcgttcagtacggcgtcaagaataacactacttttcttgagtgtgcacccaagagtcctcaggcatctatcaaatggttgcttcagaaagacaaagaccgaaggaaagaagttaagctgaacgagagaatcattgcaacgtctcaagggcttctgattcggagtgtgcagggatcggaccagggtctctatcactgcatcgccacagaaaatagctttaaacagaccattgctaagatcaattttaaagtgctggacagcgagatggtggctgtagtcacagacaagtggtctccgtggacgtgggcatccagtgtcagggctctgcctttccacccaaaggacatcatgggagcctttagccactcagagatgcaaatgattaaccaatactgcaaagacactagacagcagcaccaacagggcgatgagagccagaaaatgcgcggggattatggaaaactcaaggcgctcattaacagtcgcaaaagtcgaaatcgccgtaatcagttgcctgaatcttag

SEQ ID NO: 9530 - DNA, 630 bp, Artificial Sequence
  Description of Artificial Sequence: Synthetic coding sequence
atgggccccgaggccctgagcagcctgctgctgctgctgctggtggccagtggcgacgctgatatgaaaggccacttcgatccggcaaagtgcagatatgctctgggtatgcaggacaggaccatcccagattctgatatctcggcctcatcatcctggagcgacagcacggccgcccgtcactcacgcctggaatcatctgatggggatggagcctggtgtccagccggaagcgtattccccaaagaggaggagtacttacaggtggatctgcaacgccttcatctcgtcgccctcgtcggcacgcagggtcgtcatgcaggagggctgggaaaagagttttctcggtcgtacaggctgagatattcccgagatggaaggaggtggatgggctggaaggaccgatggggccaggaggtcattagtggtaatgaagaccctgagggggtcgtgctgaaagacctgggtccacctatggtagcgaggttagtgagattctatcctagggcagaccgagtaatgtcagtttgtttacgagtggaactctatggctgtctgtggcgagacggactattaagctacaccgccccagtgggtcaaacaatgtacctgagcgaagcagtgtattag

SEQ ID NO: 9531 - DNA, 315 bp, Artificial Sequence
  Description of Artificial Sequence: Synthetic coding sequence
atgagcgacctgctgctgctgggcctgatcggcggcctgaccctgctgctgctgctgacacttctggccttcgctggatactccggactgctggctggggttgaagtcagtgcagggtctccccccatcagaaatgtgaccgtcgcttataagtttcacatgggtctgtatggcgagaccgggcgacttttcactgaatcatgcagcatcagccccaaattgcgctctatcgccgtatattatgataacccccacatggtgcctcccgacaagtgtcggtgcgctgtgggctcaatcttgtcggagggcgaatag

SEQ ID NO: 9532 - DNA, 2631 bp, Artificial Sequence
  Description of Artificial Sequence: Synthetic coding sequence
atgggccccgaggccctgagcagcctgctgctgctgctgctggtggcctcgggcgacgctgacatgaaagggcacttcgacccggcaaagtgtcgatacgcacttggcatgcaggaccggaccatccctgattcagatattagtgctagttcttcatggtccgattcaactgccgctcgtcacagcagacttgaatcttcggacggcgacggggcctggtgtcccgctggatccgtgttcccaaaggaggaagagtatctgcaggtcgacctgcaacgtttacacttggtggctctggtggggactcagggaaggcacgctggtgggctcggtaaagagttcagccggagctatcggctgcgatactctcgggatggcagaaggtggatgggttggaaggatcgatgggggcaggaggtgatttccggcaacgaagatcccgaaggagtggtattgaaagacctaggacccccaatggttgcacgtcttgttcggttttacccccgggctgatcgcgtgatgtccgtttgcttgcgagtggagttgtatggttgtctttggcgtgacggattgttgtcctataccgccccggtgggacaaacaatgtatctgtcggaggcagtgtacctcaacgactcgacgtacgacggccataccgtgggaggccttcagtacggcgggctgggacagcttgccgacggggtggtgggtctcgatgacttcaggaagtcccaggagttgagagtgtggccaggatatgactacgtggggtggagcaaccactcctttagtagcggatacgtggagatggagttcgagtttgacaggctgagggcctttcaggccatgcaggtgcactgcaacaatatgcatactttgggggctagattaccaggaggagtcgaatgtcggttcaggcgcgggccagcaatggcttgggagggggagcccatgcggcacaatctgggcgggaatttgggcgacccacgcgctcgtgcggtgagtgtgcctttagggggccgcgttgctagatttttacaatgtagatttctctttgctgggccctggcttctatttagcgagatatccttcataagcgatgtggtgaataattcctccccggcgctgggcggcactttcccgccggcgccctggtggccccctgggcctcctcctactaacttctcatcactggaacttgagcctcggggacagcaacctgttgctaaggcggagggaagccctactgccattctaattggctgtcttgtggcgatcatccttctcttactactgataatagccctgatgctatggcgcttgcattggcgccgattacttagcaaagccgagcgtcgtgtgctggaggaagagttgactgtgcatctatccgtacctggtgatacaatcttgattaacaataggcccggaccacgggagcccccgccttatcaggaacctaggcctcggggaaatcccccccatagcgctccctgcgtcccaaatggcagcgcatactctggtgactatatggaacccgaaaaaccaggggcaccactgctgccaccccctccccagaattcggtgcctcactatgcagaggcagatatcgttaccctgcaaggggtaaccggggggaacacatatgccgtgcccgccctcccaccgggcgcagtgggcgacgggcctcctcgtgttgactttccacgatcgcgattgaggtttaaggaaaaactaggggagggtcagttcggcgaggtccatctctgcgaggtcgattctccccaagacttggtttctttggattttcctttgaatgtcagaaaaggccatccacttcttgtcgcagttaagatcttgcgacccgatgctacgaagaatgctcgtaacgactttttgaaggaagtcaaaatcatgtcgcgactcaaagaccctaatatcattcgactgctgggcgtctgtgttcaggacgatcctctctgcatgattacggattacatggagaacggcgacctgaaccagttcttgtctgcgcaccagttagaggacaaggctgcagagggcgcaccaggtgacggccaggccgcacaaggccccaccattagttatcccatgctactgcacgtcgcagcccagatcgcctcaggcatgagatatttggccacactgaactttgtgcatcgtgatctcgctactagaaactgtctggtgggcgagaactttacaattaagatagcagacttcggcatgtcgcgaaacctttatgctggtgattactacagggtgcagggccgcgctgtactgccgattcggtggatggcttgggaatgtattctaatgggcaagtttacgacagcatccgatgtgtgggcattcggcgtcacgttgtgggaagtcctgatgctatgcagagcacagccgtttggccaactcacggatgagcaggtgatagaaaacgctggtgaattttttcgtgaccagggaaggcaggtttacctaagccgcccccctgcttgcccccagggcctgtatgagctgatgctgcgctgctggtctcgggagagtgaacaaaggcctccgtttagccaactccatcgctttctggctgaagacgctctgaacactgtctag

SEQ ID NO: 9533 - DNA, 1053 bp, Artificial Sequence
  Description of Artificial Sequence: Synthetic coding sequence
atggaggccttcgccctgggccccgcccggcggggccggcggcggacaagggctgcggggtctctactttcgagggccgccatcctgctgtttatcagtgccttcctagtgcgagttccaagcagtgtggggcatcttgttcggctaccacgcgcattccgcctaacaaaggattcggtcaagattgtcggttccaccagtttcccggtgaaagcgtatgtgatgttgcaccagaaatctccacacgtgttgtgtgttacacagcagctgcggaatgccgagctgatagacccatcattccagtggtacgggcctaaaggaaaagtcgtctccgaaaaccgcaccgctcagatcacctctaccggctctttggtcttccagaattttgaagaaagtatgagcggtatttacacctgcttcctggagtacaaaccaacggtggaagagatcgtcaaacgcctgcagttaaaatacgctatctatgcctatcgggagccgcactattactatcagtttacagctcgttatcacgcggccccttgcaactcaatctataatatctcctttgaaaagaaattgttgcagatcctatcaaaattactcctggacctgtcttgtgagatttcactgttgaagtcagaatgtcatcgagtgaaaatgcagagagctggtttacagaatgaactgttcttcgcattctcagtaagctctttggacaccgagaagggccccaagcgctgtacagatcacaattgtgagccgtataagaggctctttaaggccaaaaacctgattgagcgcttcttcaatcagcaggttgaaattttagggaggagggccgagcagctgcctcagatctactacattgagggaacactacagatggtttggattaaccggtgctttcccggatatggcatgaatgtccagcaacacccaaaatgccctgagtgctgcgtcatatgctcccctggaagctataatcctcgggatggcattcattgtctgcagtgcaattcctccttggtgtacggtgctaaaacgtgcctgtag

SEQ ID NO: 9534 - DNA, 1392 bp, Artificial Sequence
  Description of Artificial Sequence: Synthetic coding sequence
tgactggccctggtgctgtgcaccgtggacagccggccccccgcccagctggctctttcacacgccggcagactgttggcctcttccacggctgccagcgtgccaaacacacttcgtcttgagttgaggggccctcaaccacgggacgaagggttctactcctgctcagctcggtccccgcttggccaggccaatacttctctggagttgcgcttggagggggtcagagtaattcttgcacctgaggcggctgtgcccgagggcgctccaatcaccgtgacctgcgctgatccagctgcccacgccccgaccctctacacgtggtaccacaatgggcgttggttgcaggagggtcctgccgcgagcctctcttttctggtcgctacgagggcccatgctggcgcttactcctgtcaagcccaggacgcccagggcaccaggtcctcaagacccgctgcccttcaagtgctatatgccccccaagacgcagttttgtcgagttttcgagactcacgcgctcggagcatggccgtgatacagtgtactgtggactctgagccgcccgctgagttggccttgtcccatgacggcaaggttctggcaacctcgtcaggcgtgcacagcctggcaagcggaaccggccatgtgcaggtcgcccggaatgctctgcgcttacaggtacaggacgtgccagcaggtgacgatacctacgtgtgtaccgcccagaatcttctgggaagtataagcactatcggacgtctgcaagtggagggagctagggtggtagctgagcccggcctcgatgttcccgagggagcggctctcaacttatcttgcagattgttgggtggcccaggtcccgtggggaacagcacgttcgcttggttctggaacgataggcgacttcacgccgagccagtgccaacccttgcctttactcacgtcgcacgcgcacaggcaggcatgtatcattgtctcgctgagctgccgacaggagcggcagccagtgctccggtgatgttaagagttctctacccacccaaaacacccacgatgatggtgtttgtggagccagagggggggctacgaggaatcctcgactgtcgggtcgacagcgagcctctggcgtccttgacactccatctcggatctcgtctcgtcgcctcctctcagccacaaggcgcccccgccgagccccacattcacgtcttagcttcacctaacgctctccgtgtggacatcgaggccctaagaccctcagatcaaggcgaatacatatgttccgcaagtaacgttctggggtcagcctccactagcacctatttcggggtgcggggagaagggcgcggcttacacctcccaggacactcagcacagaagccgtcatcgtag

SEQ ID NO: 9535 - DNA, 1398 bp, Artificial Sequence
  Description of Artificial Sequence: Synthetic coding sequence
atgaagttccagggccccctggcctgcctgctgctggccctgtgcctcggatccggagaggcaggaccactgcagtctggtgaagagtctacagggacaaatatcggggaagccctgggtcatggattgggcgatgcattgtccgaaggggtagggaaggcaattggcaaagaagctggcggtgcggcaggctctaaagtgagcgaggcactggggcaaggcaccagggaagccgtggggacgggcgtgcggcaggtcccaggattcggcgtggccgacgccttgggcaacagggtaggagaggccgcccatgccctcggcaacacgggtcacgagatcggaagacaggctgaggatgtgattagacatggggcggatgctgtccgaggaagctggcagggcgtgccggggcacaatggggcatgggagacatcgggaggacatggcatttttggcagccaaggcggcctgggtggacagggtcagggaaacccaggaggactaggtaccccgtgggtgcacggttacccgggcaacagcgcaggtagcttcggaatgaaccctcagggagccccatggggccagggtgggaacggtggacctccaaactttggtaccaacactcaaggtgcggtggcccaacccggctacgggagtgtccgagcctccaatcagaacgaaggctgcacaaatcccccaccctccggttctgggggcgggtcttctaattccggcgggagcagcacagggagcagctctgggaaccatggggggagtggaggtggcaacggccacaagcctggctgcgagaaaccaggcaacgaggctcggggtagtggagagagtgggattcaggggttccgcggacagggggtgtcatcaaatatgcgagagatttccaaagagggcaacagattgctgggcggatcaggagataactatagaggccagggaagttcttggggctccggcggcggcgacgctgtgggcggggtgaacacggtgaactcagaaacctcccccgggatgtttaattttgacactttttggaagaattttaaaagtaagctaggttttataaactgggacgcaattaataaaaaccaggtgcctccgcctagcacacgcgctctgctgtatttcagccggctgtgggaggatttcaagcagaacacaccctttctgaattggaaagccatcattgaaggcgctgatgccagttccctgcaaaagagagccgggcgcgacgaccagaactacaattataatcagcatgcgtaccccactgcctatggaggcaaatattctgtcaaaaccccggcaaagggcggtgtgagcccatcttccagcgccagccgagtacagcccggacttttacaatgggttaaattttggtag

SEQ ID NO: 9536 - DNA, 2700 bp, Artificial Sequence
  Description of Artificial Sequence: Synthetic coding sequence
atgctgctgctgctgctgctggcccccctgttcctgcggccccccggagcgggtggagcccagactcccaatgctacgtcagagggctgccagataattcacccaccctgggagggaggcataagataccggggcctgacacgggatcaggtgaaagcaatcaacttcctgccagtggactacgaaatcgaatacgtttgcagaggagaaagagaagttgtcggcccaaaggtccggaagtgtttggccaatggcagctggacagatatggacactcctagtcgctgtgtgaatcgtacccctcacagtgagcgacgtgctgtctacattggagccctgttccctatgtccggaggctggccggggggtcaggcctgccaaccagccgttgaaatggccctcgaggatgtaaactcccgtagagatatcctcccggactatgaactgaaattaatccaccatgactcaaagtgcgatccgggacaggctaccaaatacctctatgaacttctgtataacgatcccataaagataatcctcatgcctgggtgttcctctgtaagtacactcgttgcagaagcagctagaatgtggaatctcatcgttctgagctatgggtcatcctccccagccctgtcgaaccgtcagagattccccaccttctttaggactcacccctctgctacgctgcacaaccctactagggtgaaactctttgaaaagtgggggtggaagaagatcgcaacaattcaacagaccaccgaagtgtttacttcgaccctcgatgatttggaagaaagggtgaaggaggcaggaatcgagatcacttttcgtcaatctttcttctctgaccccgccgtccccgtgaagaatctgaagaggcaggacgccagaattattgttggcctattctatgaaacagaagctaggaaggtgttttgtgaggtttacaaggagcgtttgtttggcaaaaagtatgtctggtttctgatcggctggtacgcggacaactggttcaaaatctacgacccgagcatcaattgtacagtagacgaaatgaccgaggccgtggaaggacacatcaccaccgagatagtaatgctgaatcccgctaatacccgctcaatcagtaatatgacatctcaggaatttgtcgagaaactgacaaagcggctcaaacggcatccagaggagacaggggggtttcaggaggctccgctggcttatgatgcaatttgggctctcgccttggcacttaacaaaacatccggagggggcggtcgtagcggcgttagattagaggatttcaattataataatcaaacgatcactgaccagatctatagggctatgaactcttcctcattcgaaggggtaagcggacatgtagtttttgacgcctccggaagccgaatggcctggaccctcattgagcagctgcaggggggctcttacaaaaaaatcggctactatgattcaacaaaagatgacttgagctggtctaagaccgataaatggattggtggtagccctcctgccgaccaaaccttggtgataaaaacctttaggtttctcagccagaagctgttcatctccgtgtctgtactgtcaagtcttggcatagtgttggcagttgtgtgtctatcatttaatatttacaatagccatgtcagatacatccagaacagtcagccgaaccttaataatctcacagcggtgggatgttctctggccctcgcagcggtcttccctctgggtctcgacggttatcacattgggaggaatcagttcccattcgtgtgtcaggcccggctgtggctactaggactaggattttcacttggctatgggtcgatgtttacaaaaatttggtgggtccacaccgttttcactaagaaggaagaaaaaaaggagtggcggaaaaccctggagccctggaaactatatgccaccgtaggcctactggtgggaatggacgtgttaaccctggcaatatggcaaatcgtggacccactgcatagaaccattgaaacatttgccaaagaagagcctaaggaagatatcgacgtgtccatacttccacagcttgagcactgctcttcacggaaaatgaacacctggctcggtatcttttacggctataaaggtctgctgttgctcttggggatttttcttgcctatgaaaccaagtcagtcagcacagaaaaaattaacgatcacagggctgtgggcatggccatctacaatgtggctgtcctgtgtttgatcaccgcccctgtcactatgattctgtcaagccagcaggacgccgccttcgctttcgcctctttagccatcgtctttagttcctacattacactcgttgtcctgttcgtacccaagatgcgccgtctcattaccaggggcgaatggcagtccgaagcccaagacacaatgaaaacgggctcaagtaccaataacaacgaggaagagaagtctaggctcctcgagaaagagaaccgcgagttagaaaagatcatcgccgagaaggaagaacgcgtcagcgagcttagacatcagctccagagtcgccaacagttaagaagcagaaggcacccccctacaccccccgagccaagtggcggcctaccaaggggaccacctgaaccaccagaccggctgtcttgcgacggtagcagagtgcacttactatacaagtag

SEQ ID NO: 9537 - DNA, 381 bp, Artificial Sequence
  Description of Artificial Sequence: Synthetic coding sequence
atgtggtacgtgagcacccggggcgtggccccccgggtgaacttcgaaggagccttgttttccggctacgcacccgacggcgggctttttatgcctgaagaactgcctcagctggatcgcggcactctgtgtcagtggtccaccctgtcctacccagggctggttaaggaactctgtgctctgttcatagggtctgaacttctgcccaaggacgagctaaacgacttaatcgaccgagccttcagcaggtttcgccacagggaggtggttcacctgtcccgactccggaatgggctgaacgtgttggagctgtggcacggcgtcacatacgccttcaaagacttgagcttgtcttgtactacccagttcctccaatattag

SEQ ID NO: 9538 - DNA, 147 bp, Artificial Sequence
  Description of Artificial Sequence: Synthetic coding sequence
atgccccccttcctgatcaccctgttcctgttccacagctgctgcctccgcgccaacggacatctgcgggaaggaatgactttgctgaaaacagaattcgctctccacctttaccagagcgtggccgcttgtagaaacgagacctag

SEQ ID NO: 9539 - DNA, 390 bp, Artificial Sequence
  Description of Artificial Sequence: Synthetic coding sequence
atggccgccggcagcgcccccatgcagctgcacctgcgggccaccatccgcatgaaggatggactgtgcgttccaaggaagtggatttatcacttaacagaggggtccacagatttacgtactgaagggaggcccgatatgaagactgaattattttcttctagttgtcctggagggataatgttgaacgagaccggccagggttaccagcgattcctgctgtacaatcggtctccccacccaccggaaaaatgcgtggaggaattcaagtcattgacatcttgtctcgattcgaaagcttttttgctgacaccgcggaaccagggaaaaggactcaagtcccacaagacaggccttgggctcacaaaaagctcgggagtgacagggtag

SEQ ID NO: 9540 - DNA, 462 bp, Artificial Sequence
  Description of Artificial Sequence: Synthetic coding sequence
atgaccatccacatcctgatcctgctgctgctgctggccttcagcgcccagggcgacttggatacggccgcccgacgggggcagcaccaggttccccagcacagaggccatgtgtgctatctgggggtttgtagaacgcaccggttggccgaaatcatttactggatcaggtgtctgcatcagggggctctcggggagggccagcctcgggcacctgggccgctacagttgtgggctccacctgtggccagggggggatcgcctgctcggttccctgggttccggcccgccgcccggggactggcccagtgccctgctaggtgggtgactagcggaacagcaaggccattactcggcttttcacttcccatatgtatgctagagctgctgttgcacatcagcagtcccctgacacctgctccagaaaccgtgtttccaagtcccagtcccgggtgcgactag

SEQ ID NO: 9541 - DNA, 450 bp, Artificial Sequence
  Description of Artificial Sequence: Synthetic coding sequence
atgggctggctgacccggatcgtgtgcctgttctggggcgtgctgctgactgcccgagccaactatcagaacggcaagaacaacgtgccccgcctcaaactgagttacaaagaaatgctggaaagcaacaatgtgattactttcaacggcctcgctaattctagctcatatcatacttttctgctcgatgaggagcgatcccgcctctacgtgggcgcaaaggaccacatattcagcttcgaccttgtgaatatcaaagatttccagaagatcgtgtggccggtttcatatactaggcgggatgaatgtaagtgggccggaaaagacattctgaaagagtgcgctaactttatcaaggttcttaaagcttacaaccagactcacttatacgcctgcgggacaggggcgttccaccctatctgcacctacattgagatagggcaccactag

SEQ ID NO: 9542 - DNA, 543 bp, Artificial Sequence
  Description of Artificial Sequence: Synthetic coding sequence
atggccgacatgcagaacctggtggagcggctggagcgggccgtggggcggcttgaagctgtatcacacacgagcgatatgcatcgaggttacgccgacagcccttcaaaagccggcgcggccccatacgtgcaggcctttgattcacttttggctggacctgtggctgaatatttgaagattagcaaggagatcgggggggacgtacaaaaacacgctgagatggttcacaccggcttgaaactcgaaagagccctcttagtgaccgcttcacagtgtcagcaacccgcggaaaacaaactatcagatttgctggcacctatctcagaacaaatcaaagaggtgattacctttagggagaagaaccgaggcagtaagctcttcaatcatctctctgccgtgagcgagagtatacaggctcttggctgggtggccatggcgcccaagcctggcccttatgttaaggaaatgaatgacgccgctatgttttacaccaatagagtgctcaaagaatacaaggacgtggacaaaaagcatgtgtag

SEQ ID NO: 9543 - DNA, 630 bp, Artificial Sequence
  Description of Artificial Sequence: Synthetic coding sequence
atgggccccgaggccctgagcagcctgctgctgctgctgctggtggcctcaggtgatgcagacatgaagggtcattttgatcctgctaagtgtagatatgccctgggtatgcaggatagaacaataccagattctgacatttctgctagctcttcttggtctgattctaccgccgcaagacacagcagattggagtcctcagacggcgacggagcgtggtgccccgcaggttcggtcttccctaaggaggaggagtatctgcaagtcgacttgcagaggcttcacctggtcgcactcgtcgggacccagggacggcacgccgggggattagggaaggagttcagccggtcatatcgcctccgctactctagggatggaaggcggtggatgggctggaaagaccggtggggccaggaagtgatttcgggcaatgaagaccctgaaggggtcgtcttaaaggacttggggccccccatggtcgctcgactggttcgattttatccccgagcggaccgggttatgagtgtgtgccttcgtgtcgagttatacggatgtctgtggagggacggtctgctgagctacaccgccccagttgggcagaccatgtatctttctgaggcggtgtattag

SEQ ID NO: 9544 - DNA, 630 bp, Artificial Sequence
  Description of Artificial Sequence: Synthetic coding sequence
atgggccccgaggccctgagcagcctgctgctgctgctgctggtggccagcggagacgcagacatgaaaggacatttcgaccctgctaagtgccgatatgccctggggatgcaggacaggaccattcctgactcagacatcagcgcatcctcaagttggtcggacagtaccgcagctcgtcactcaaggcttgagtctagtgatggagatggggcatggtgcccggcagggtccgtgtttcccaaggaggaggagtacctgcaggtcgatcttcagaggctgcacctggttgctctggtcgggactcagggcaggcacgccggcggcctcgggaaagaatttagcagatcttaccgactgaggtattctagggatggccgacgctggatggggtggaaggatcggtggggacaggaggtcattagtggcaacgaagatccagaaggggtcgttctgaaagatttaggaccgcccatggttgctagactagtgcgcttctacccgcgggctgaccgtgtgatgtctgtttgcctgcgtgttgaactctacggctgtttatggagggacggtctgctttcttacacggctccggtcggccaaacaatgtatctttcggaagccgtgtactag

SEQ ID NO: 9545 - DNA, 2631 bp, Artificial Sequence
  Description of Artificial Sequence: Synthetic coding sequence
atgggccccgaggccctgagcagcctgctgctgctgctgctggtggccagcggcgacgccgatatgaaaggccacttcgatcccgctaaatgtaggtatgcactaggtatgcaagaccgcactattcccgacagtgacatctccgcctcttcctcatggtcagatagcaccgctgcaaggcactcccgcttggagtcatctgatggagatggagcctggtgccctgccggaagtgtgttcccaaaagaagaggagtacctgcaggttgacctgcagcgtctgcatcttgtggcactggttggtacacaagggaggcacgctgggggcctcggcaaggagttcagtaggagctaccgcctgcggtattcccgcgatggtagaagatggatgggatggaaagataggtggggtcaggaagtcatctccggaaatgaggacccagaaggagtggtgctcaaggatctgggtcctcccatggtcgcccgcctggtccgattctaccctcgagcagacagggtaatgtctgtgtgtctgcgggtggagctgtacggttgcttgtggagggatggactgttgtcctacactgccccagttggacaaacaatgtatcttagtgaggccgtctatctgaatgactctacatatgatggccacaccgtggggggtttgcagtacgggggcctggggcaactcgccgatggtgtcgtggggctggatgacttcagaaagagtcaagagctccgggtgtggccagggtatgattacgtcggatggtccaaccacagcttttctagtggctatgtagagatggaatttgagttcgatcgcctgagagccttccaagctatgcaggtgcattgcaacaacatgcacaccctcggagccagactacctggaggggtcgagtgcagattccggcgaggccccgcaatggcctgggaaggggagcccatgaggcataaccttgggggcaatctgggtgacccccgtgcacgtgcagtttcagtaccactgggtgggagggtggcaaggtttctgcagtgtaggtttctctttgctggtccctggttattgtttagcgaaatctcgtttatcagtgacgttgtgaataacagctctcctgcgttgggcggcactttccccccagctccatggtggccaccgggcccgccaccaacaaactttagtagtctcgagcttgagcccagagggcagcagcctgtcgccaaggccgagggcagccctactgccatcctgattggctgtttagtggcaatcatcctcctgctgctactgattattgcactcatgctgtggagactgcactggcgcagattgctaagtaaggctgaacggcgcgtcttggaggaagagcttaccgtgcacctaagtgtccccggcgatacaatcttgataaataatcgacctggcccccgtgaaccaccaccatatcaggaacccagaccccggggtaaccccccgcactctgccccttgtgtaccaaacggctcagcctattccggcgattacatggaacccgaaaagcctggggctcccctactgcctccaccaccacagaacagtgtccctcactacgcagaagccgacattgtgacactccagggagtgacagggggaaacacatatgccgttcccgcgctccctcctggggcggtgggggacggcccccctcgggtagattttcccaggtcccggctgcgctttaaagaaaagctgggcgagggccagtttggcgaagtccacctgtgcgaagtcgatagcccccaggacctggtttcactcgatttccctctgaacgtgaggaaggggcatccgctactcgtagctgtgaagatcctgcgcccagacgcgacaaaaaacgctcgcaacgatttcctgaaagaagtcaaaattatgagtcgtctcaaggatcctaatattatacggttgcttggggtttgtgtacaagacgatcctctttgcatgattactgactacatggagaacggcgacctcaatcagttcttgtcggcacatcagctggaggacaaagctgccgagggagcaccaggtgatgggcaggccgcacagggccccaccatctcttaccccatgctgctccacgtcgccgcacagatcgccagtggaatgcggtacctcgctaccttaaatttcgtccaccgggatcttgcaacgaggaactgtctggtgggcgaaaactttaccataaaaatagccgatttcggtatgtcccgcaacctttacgccggagattactatagggtacagggacgcgccgttctccccatcagatggatggcttgggagtgcatcttgatgggtaaatttactaccgcaagtgacgtctgggccttcggagtgactctatgggaggtcttaatgttatgccgcgcacaaccctttggccagctgacagacgaacaggtgatcgagaacgcaggcgagttctttcgggatcaaggccggcaagtgtatcttagccggcccccagcatgccctcaggggctgtatgaattgatgcttaggtgctggagccgagaaagcgagcagaggccccccttcagccagctccatcgctttcttgccgaagacgctttaaataccgtctag

SEQ ID NO: 9546 - DNA, 2103 bp, Artificial Sequence
  Description of Artificial Sequence: Synthetic coding sequence
atgctggcccccttcctgctgctgctgacccacagccggagccccctgtcgtttcgaccttgttcccatgtacccggagctctgattgcccagaaaccaatggggtcctctcgtctggctgccctgcttcttcccttgctgctcatagtcatcgatctatcggactcagccgggattggctttcgccacttgccccactggaacaccagatgtcctttagcaagtcacactgacgacagtttcactggcagttcagcttacatcccttgtagaacctggtgggccttgttcagcactaaaccctggtgcgttcgcgtgtggcactgctcgcggtgtttgtgccagcatctactctccggtggttccggcctgcagcgcggattatttcacctgcttgtgcagaaatctaaaaaaagctccactttcaagttttacagacggcacaagatgccggccccagcgcaaagaaaacttctgccaaggcggcatctcagcgagaagagtcaccacatctccatcccaagtcccgatatctcacataaggggctgcgatcaaaacggactcagccttctgatcccgaaacatgggagtcgcttcctcgactggacagccagcggcatggcggtcccgagttctcctttgacctactgccagaggctcgggctatcagagttacgatctcctcggggccggaagtgtcagttcgactgtgtcaccagtgggctctggagtgcgaggagctgtccagcccctacgacgtccagaaaattgtgtccggaggccatactgttgaacttccatacgaatttttactgccctgcctctgtattgaagccagctatcttcaagaggacaccgtgagaaggaaaaagtgccctttccagtcctggccagaggcctatgggtctgacttctggaagagcgtgcatttcactgattactcacagcacacacagatggtgatggcgctgaccctgaggtgccctctaaaactcgaagctgcactctgccagcgccacgattggcacacgctgtgcaaggatctaccaaatgccacagctcgggaaagcgatggatggtatgttctggagaaagtcgacctgcacccacagctgtgtttcaaattctcattcggcaatagttctcacgtggagtgtccacaccagaccggtagcctgacttcatggaatgtttctatggatactcaggcgcagcagctcattcttcattttagtagcagaatgcacgccacattctctgcagcctggtcactccccggtttgggccaggatacacttgtgccccccgtctacactgtctcccaggctcgggggagctctcccgtgagcctcgatctcataatcccatttctgcgccctggttgttgtgttctagtgtggcgctcggatgtgcagtttgcctggaaacatctgttgtgccccgacgttagttatagacacctgggattactcattctggccttacttgctctgcttaccctgctgggtgtggtgttagcactcacatgtcgtagacctcagagtgggcccgggcccgcccgccctgtgctcttacttcatgcagctgactcagaggcccaacggaggcttgttggagcccttgctgagcttctcagagcggctctgggcggggggcgcgatgtaatcgttgacctctgggagggtcgccacgtagccagggtgggacctctgccttggctgtgggctgcacgtactcgggtggctagggagcaagggacagtgttgctgctctggtccggcgcggatctgcggcctgttagtggcccggatccccgcgcggctccactgctcgccctgctacacgcagctccacggcccctgcttctcctggcttacttttcgagattgtgtgccaaaggggatatccccccacctctccgcgctctccctaggtatcgtctattgcgcgacctgccacgactcctacgcgcgcttgacgctcgtccgtttgcagaggctactagctggggacgattgggggccagacagcggcgtcaatcaaggctcgagttgtgctcgcggcttgagcgagaggcagccaggcttgctgatctgggatag

SEQ ID NO: 9547 - DNA, 1194 bp, Artificial Sequence
  Description of Artificial Sequence: Synthetic coding sequence
atgcggagcctgctgctgctgagcgccttctgcctgctggaggccgccctggctgccgaggtcaagaagccagcagccgccgcagcccctgggacagcggagaagctgtctcctaaagccgcgaccctagccgagcggtctgccgggttggcttttagtttatatcaggcaatggcaaaagatcaggccgtcgagaacatcctggtatctcccgtggttgtagcgtcgtcactggggctcgtgagcctgggaggaaaggccactacagcctcacaggctaaggcggtcctatctgccgagcagctccgcaacgtgacatggaagcttggcagccgtctgtacggtccctcctcagtttcttttgccgatgacttcgtccgcagctcaaaacagcattacaactgcgaacactccaagataaattttcgagacaagaggtctgccttgcaaagtataaacgaatgggcggcccagactacagatgggaaactgcccgaagtcaccaaggatgtggaaaggacagacggggctctgttagtaaacgctatgttcttcaaacctcactgggatgaaaagttccaccataaaatggtagacaatcgaggtttcatggtcactcgcagttacactgttggcgttatgatgatgcacagaaccggcctgtacaactattatgacgacgaaaaggagaaactacagatcgttgagatgcccctggctcataaactctcctctcttatcattctgatgcctcatcatgtggaaccgctggagcggctagagaagttgcttacaaaggagcaactaaaaatctggatgggcaaaatgcaaaagaaggctgtagccatcagtctgccaaaaggcgtggtcgaggtaacccatgacttacagaaacaccttgccggactagggctgacagaggctatcgataagaacaaggctgacctatccagaatgtcagggaaaaaggacttgtatctagcgagtgtattccatgctactgccttcgagctggataccgacggaaacccgttcgaccaggacatctatggccgtgaagaactccggagtcctaaactcttttatgcggatcacccattcatttttctggtgcgcgatacacagagcggctccctgctgtttatcggcaggctcgtgcggccaaagggcgacaaaatgcgcgacgagctctag

SEQ ID NO: 9548 - DNA, 612 bp, Artificial Sequence
  Description of Artificial Sequence: Synthetic coding sequence
atggccgacatgcagaacctggtggagcggctggagcgggccgtgggacggctggaagccgtgtctcacacctcagacatgcatcggggttatgctgactcccccagtaaggcaggtgctgccccgtacgtccaggcttttgattccctgttagcgggccccgtggccgagtatctcaaaatctccaaggagatcggaggggatgtacaaaagcacgccgagatggttcatacaggtctgaaactggagagggctttgttggtcactgcttcacagtgtcagcagcctgccgaaaacaaactatctgacttattggcccccattagtgagcagatcaaagaagtaattacattcagggagaagaaccggggtagcaagcttttcaatcatctcagcgcggtgtcggagtcaatccaggccctggggtgggttgctatggctccgaagccggggccctatgttaaagagatgaatgatgccgccatgttctacaccaatcgagttttaaaggaatacaaggacgtggacaagaagcacgtggactgggttaaggcatacctaagcatctggacagagctccaggcatatattaaagaattccatactacctag

SEQ ID NO: 9549 - DNA, 1293 bp, Artificial Sequence
  Description of Artificial Sequence: Synthetic coding sequence
atgcggaagctgatgaagcaggtgcaggagcagtgccccaacatcactagaatttatagtattggcaaatcatatcaaggactgaagctttacgtgatggagatgtccgacaaacccggcgaacacgagctgggggagcccgaggttaggtacgtggcgggtatgcacggtaatgaagcgctaggcagagagctgctactcctactgatgcagtttctgtgccacgagttcctgcgaggtaatcctagagtgacgaggctgctgagtgagatgcgcatccacctcctccccagcatgaatccagacggctacgagattgcttatcaccgtggtagtgagctggtgggctgggccgaaggtaggtggaataaccagagcattgacctcaatcataacttcgctgatttaaatactcctctgtgggaggcacaagacgatgggaaggtgccccatatcgtccccaaccatcacttacccctgcccacctactataccctgccaaatgcaacagtggctccagagactcgcgcagtcattaaatggatgaagcgaattccttttgtcctatcagcaaatttacacggaggcgagttggtggtttcctatcccttcgacatgacacgaaccccgtgggccgcaagagaactaacccctacacccgacgatgctgtcttcaggtggctgtcgactgtctacgcaggatccaacctcgccatgcaagacacctcaaggcgcccctgtcattcccaggatttttctgtgcatggaaacatcattaacggcgctgactggcatactgtaccaggcagtatgaacgacttctcatatctgcacacaaattgcttcgaggttaccgtcgagctcagctgtgataagttcccgcacgaaaacgaattgccccaggaatgggaaaacaataaagacgccctgctgacgtacctagagcaagtcagaatgggcatcgcgggcgttgttagagataaagacaccgagctggggattgcagatgccgtgattgcggtggacggaatcaaccacgacgtcactactgcctgggggggtgactattggcgactgctaactccgggcgactacatggtgacagcttctgcggagggctaccactcggtgacgcgcaattgcagagtgaccttcgaggagggcccatttccttgcaacttcgttctgacaaagactccgaagcagagattacgtgagcttctggccgccggagccaaagtgccacccgacctgagacgtcggctggaacggctgagaggtcagaaggactag

SEQ ID NO: 9550 - DNA, 1680 bp, Artificial Sequence
  Description of Artificial Sequence: Synthetic coding sequence
atgtggaccaacttcttcaagctgcggctgttctgctgcctgctggcagttttaatggtcgttgtccttgtcatcaatgtgacccaggtggaatatctcgatcatgagaccgtttctgcaacatttatcgactcatctggacagtttgtgagttcccaggtcaccggaattagtaggaacccgtactgcggatatgatcagcaaactctctcctcacaggaaaggatggaggaggatagtttacttgccgccctccacaggcaggtacctgatgtgggaccagtgccctttgttaaatctaccgatccatcatcctcctacttcgtgatcctcaattccgcggcatttttcaaagtgggtagccagttggaggtgctcgtccacgtgcaggattttcagagaaagcccaagaagtatgggggggactatctccaggctcggatccatagcctgaaattgcaagctggcgccgttggccgggttgtcgactatcagaatggcttttataaggtgtttttcacactcctatggcctggaaaagttaaagttagtgtgtctctggtccacccatccgaaggtatccgtgtgctgcaacggctccaggaggacaaaccagaccgtgtctattttaaatccctgttcaggagcggtaggatttccgaaaccacagagtgcaatgtgtgtctaccaggtaacctgcccctctgcaatttcaccgacttatacacaggagagccctggttttgttttaagcctaaaaagcttccctgctcatctcgcatcacccatttcaaaggaggttatttgaaaggcctcttgacggccgcggagagtgcattcttccagagtggggtcaacattaagatgcccgtcaattcttcaggcccagattgggtgacagtgattcccagaagaataaaggaaaccaatagcctagagctgagtcagggctccggaacgtttccttcaggatactattacaaggaccagtggcgccccaggaaattcaagatgcgacagttcaacgacccagataacataactgagtgcctacagcggaaggtcgtgcacctatttggcgattcgactatccgacagtggttcgaatatctgacgacatttgtacccgatctggtagaattcaaccttggttcccccaaaaatgtaggaccttttttggctgtggatcagaagcataatattctgctaaagtatagatgccatgggccaccaattagatttacaaccgtgttttccaatgaattacattacgtggccaacgagctcaacggtattgttggcggaaagaataccgtggttgccatcgcagtgtggagccacttctctactttccctttagaggtttacatccggcgtctcagaaatatcagacgagcagtggttcgcctgctagacaggagcccaaagacagtggtggtcatcagaaccgcgaacgctcaggagcttggtcctgaggtgagtctgttcaacagcgattggtacaatttccagctggacaccatcctacggcgcatgttctctggagtgggtgtgtatctggtggacgcatgggagatgaccctggcccattatctgccccataagttacacccggatgaagtcatcgtcaagaatcagctggacatgtttttatcatttgtttgccccctggagacgtag

SEQ ID NO: 9551 - DNA, 8199 bp, Artificial Sequence
  Description of Artificial Sequence: Synthetic coding sequence
atggagcagaccgactgcaagccctaccagcccctgcccaaggtgaagcacgagatggatctagcctatacctctagttcagatgaatccgaagacggcaggaagccacgacagagctataactcccgggagactcttcacgaatataatcaggagctgcggatgaactacaactcccagtctaggaagagaaaggaggtagaaaagagcacgcaagagatggagttctgcgagacgtctcatacgctgtgttccggctatcagaccgatatgcatagcgtcagtcggcacgggtatcaacttgaaatgggaagcgacgtggacacagagacggagggtgccgcatcccccgatcacgctctgagaatgtggataagggggatgaaatcagaacatagtagctgcctgagttctcgtgccaactcggcactctccctgactgataccgaccatgagcgcaagagcgatggagagaacggttttaaattctctcctgtttgttgcgatatggaggcacaggccgggtccacccaggacgtgcaaagttcaccccacaaccagtttacattcagacctttaccaccgccccctccacctccccatgcttgtacctgtgcaagaaaaccccctccggctgcggattccctgcagcgtaggagcatgactacccgctcgcagccgtctcctgccgcccccgcacccccaacgtctacccaggacagtgttcatctgcacaacagctgggtcctgaattctaacatcccactggagacgaggcatttcctgttcaaacatggctctggctccagcgctatcttttctgcagcaagccaaaactaccctttgacgagcaacactgtgtattctcctccacccagacctctcccaaggagtacatttagtagacctgcctttacgtttaataagccatatagatgctgcaattggaaatgtaccgcactgtccgcaaccgctatcacagttacccttgccctgctgctagcgtacgtgattgccgtgcacctgtttggactgacctggcagctacagcctgtagaaggtgaactgtacgccaatggcgtgagtaagggaaacaggggaaccgagtctatggacaccacatattctcccattggtgggaaggtgtcagacaagagcgagaaaaaggtctttcagaagggccgtgctatcgatacaggcgaggtagatattggagcccaggtgatgcagacaattcctccagggctgttttggcgttttcaaattactattcaccaccctatctacttaaaatttaatatctcactcgccaaggatagcctgctggggatctatgggaggcgtaacatccctccaactcacacacaattcgacttcgtcaaacttatggatggcaagcagctggttaagcaggatagtaagggatctgatgacacacagcacagcccacgaaatctcattcttactagcttgcaagagaccggctttattgagtatatggatcaagggccatggtatttggcattttataatgatgggaagaaaatggagcaagtgttcgtactgactacagctatcgagattatggatgactgctccactaattgtaatggaaatggggaatgcatttcagggcactgtcactgcttccccggcttcctgggtcctgactgtgctcgagattcttgcccagtgctctgtggaggaaacggcgaatatgaaaaaggacactgtgtctgtaggcacgggtggaagggtcccgagtgtgacgtgccagaagagcaatgcatcgaccctacctgcttcgggcacggcacttgcattatgggggtttgtatctgtgttccaggatataaaggcgagatttgtgaagaggaagattgccttgatcccatgtgcagtaaccatggtatttgcgtcaagggagagtgtcactgttccaccggatggggaggtgtcaactgcgaaaccccattgccagtctgccaggaacagtgctctggtcacggtacttttcttctcgacgctggcgtgtgctcctgtgatcccaagtggactggatccgactgttctacagaactgtgtactatggaatgtgggtcccacggagtctgcagtagagggatttgccagtgcgaggaagggtgggtggggcctacctgcgaggagcggagttgtcactctcattgcactgaacacgggcagtgtaaagacgggaaatgcgaatgcagtccaggatgggagggcgaccactgtacgatcgcccactacctagatgctgtgcgtgatgggtgtcccgggctgtgcttcggaaacgggagatgtactctagatcagaatggatggcactgcgtctgccaggtgggatggtctggaaccggctgtaatgtcgtcatggaaatgctgtgtggcgataacctcgataatgacggggacgggctgacagattgtgtggatccagattgctgtcaacaatcaaattgctacatctcccctctgtgccagggttctcccgatccactggacttaatccaacaaagccagacccttttttcccagcatacctccaggctgttctacgaccgaattaaattcttaataggcaaggactctacacatgtcatacctcccgaggtgtcctttgactccaggagggcgtgtgttattagaggccaggtggtcgcaatcgatggtactcctttggtgggtgtgaacgtgtcattcctccaccatagcgattatggatttacgatatcccgacaggacggctccttcgatctggtggccatcggcggcatctctgtcattctgattttcgaccggtccccattcctcccggaaaagcgtacattgtggctgccatggaaccagtttatcgtggtggagaaagtcaccatgcaaagagtcgtaagcgacccgccaagttgtgatatttctaactttatttccccgaatccgattgtgttgccatcccctctcactagctttggaggctcttgcccggagaggggcacaattgtgcccgagcttcaggttgtgcaggaggagattccaatccccagcagcttcgttcgcttgagctacctgagttccaggactcccggttacaagacactactacgcatcctcctgactcattccaccatccccgtgggaatgattaaggtgcatctaacagtggccgtagaagggaggttgacccagaaatggttccccgccgctatcaacttggtctacactttcgcctggaacaagaccgacatatatggccagaaggtttggggattggcggaagccctggtctccgtcggttacgagtacgaaacctgtcctgactttattctgtgggaacagcgaaccgtggtattacaaggttttgagatggacgcctctaacctcggaggatggtctctgaataaacaccatatattgaacccacaatcagggatcatccacaaaggcaacggcgagaacatgttcatttcccaacagcctcctgtcatctccactatcatgggtaacgggcatcagcgtagcgttgcatgcactaattgtaatggccccgcacataataacaaactgtttgccccagtcgccttggctagtggcccggacgggagcgtgtacgttggcgatttcaactttgtgagacggattttcccctccgggaacagcgtgtctatactggagttgcggaatcgagatacccggcactcaacctctcctgcccacaaatattaccttgccatggaccctgtctctgaaagcctatatctgagtgacaccaatacacgtaaggtctacaagctgaagagcctggtggagaccaaagatctgtccaaaaatttcgaggtggtcgccggaactggcgatcaatgtttgccctttgatcagtcccactgtggcgatggtggtagggcaagtgaagcctcgttgaactcacctagaggaatcaccgtcgatcgccatggatttatttattttgtcgatggaaccatgatcagaaagatcgacgaaaacgctgtaattacaacagtgatcggctcaaacgggctgacctccacccagcccctttcttgtgatagtggtatggatatcacgcaggtaaggctggagtggccaacggatctcgccgttaacccaatggacaactctttatacgtgctggataacaatattgtgctccagatttctgaaaataggagggttcgcataatcgcaggacgacctattcactgccaggttccggggatagatcatttcctggtctctaaggtcgccatccacagcactctcgagtcagctagggcaatctccgtctctcattcaggtttactcttcattgccgaaacggatgagaggaaagttaataggatccagcaagtgaccacgaacggagaaatctatataattgcgggcgcccctacagattgtgattgcaagatagaccctaattgcgactgcttctccggcgatggaggctacgcaaaggatgcaaagatgaaggcgcccagtagtttggccgtatcacccgacggaaccctgtacgtggccgatcttggtaacgtgagaatacgcaccattagcagaaaccaggctcacctgaacgatatgaacatctacgagatcgcctcccctgcagaccaggagttatatcagtttactgtgaacggaactcacctgcatactcttaacctgattactcgcgattacgtgtacaactttacctataactcagagggggaccttggcgcaattacatcgagtaacggcaattctgtgcacatcagaagagatgccggcggaatgcccctatggctcgttgtgcctggggggcaggtctactggctcacaatcagcagcaacggcgtactgaaacgagtttctgcacagggctacaatcttgccttgatgacatatccaggcaacactggattgctggctacaaagagtaatgaaaacggatggactacagtgtatgaatatgatcccgagggccatctcacaaacgccactttccccacaggcgaggtgtctagcttccacagcgacctcgagaagctaaccaaagtagaactggatactagtaaccgagagaatgtgctaatgtccaccaacttaacggctactagcacgatttacattctcaaacaagaaaacacccaaagtacgtaccgagtgaaccccgacggaagccttcgggttaccttcgcttccgggatggagatcgggctgtcttcagaaccgcacatcctggcaggtgccgtgaaccctacacttggcaagtgtaacatttctcttcccggagagcacaatgctaatctgatcgagtggagacaacgcaaggagcaaaataaggggaacgtgagcgcgtttgagaggcgattaagagcgcataaccggaatctgttgtcgatcgactttgatcatatcacccgaactggaaagatatatgacgaccatcgcaaatttactcttcgcatcctctatgaccagacgggcaggcccattctgtggagtccggtgtcccgctataacgaggttaatatcacctactctccctctgggctagttacttttattcagcgcgggacttggaacgaaaagatggagtatgatcagagtggtaagatcatcagccgaacttgggctgacgggaagatctggagttatacctacctggagaagagtgtgatgctcctgctgcacagccagcgaaggtacatctttgaatacgaccaacccgattgcctcctctctgttacgatgccgtctatggtacggcactccctgcagacgatgctgtctgtcggatattaccggaacatatatactcctcccgacagcagtacctccttcattcaggactacagccgcgacggccgactgttgcaaaccttgcatctcggcaccggacggagggtgctttacaagtacactaaacaggctaggctctcagaggtgctgtatgatacaacccaggtgacattaacttatgaagaaagctccggtgttattaagactatccacctaatgcatgacggatttatctgtaccataagatataggcagaccgggcccctgattggcaggcagatcttccgatttagcgaagagggcctcgtaaatgcccgattcgactattcctacaataacttccgagtgacgagcatgcaggctgtgattaacgagactcctttgccaattgatctataccgatatgtcgacgtctccggaaggaccgaacagttcggcaagtttagtgtgatcaactatgacctcaaccaagtgataactactactgttatgaaacacacgaagattttttcggctaatggtcaggttatcgaagtgcagtatgaaatattgaaagccattgcttattggatgacaatccagtacgacaatgtgggacggatggttatttgtgatatccgtgtgggtgttgatgccaatattactcgatacttttacgagtatgacgccgatggtcagctgcaaacagtttctgttaacgacaagacccagtggcggtactcttacgacctcaatgggaatatcaatctgcttagccacggtaaatcagcacgactcacgcccctgcgatatgacttaagagatagaatcactagactgggggaaattcaatataagatggacgaagatggctttcttcgccaacgggggaatgacatattcgaatataattcaaacggactgttgcagaaggcatataataaagcgagtgggtggactgtgcagtattattatgatggcctcgggaggcgcgtggctagtaagagcagtttaggccagcacctgcagtttttctacgctgatttgaccaaccccatcagggtgacacacctctacaatcacactagcagcgagatcacttcattatattacgacttacaagggcacctcattgccatggaactgagttcaggagaagaatattacgtggcctgcgataatacaggcacacctttggcggtattttcgagcagaggacaagtgatcaaagaaatcttgtacactccctatggagacatataccacgacacttatccggatttccaagttattatcggatttcatggggggctgtacgacttcctgactaaactggttcaccttggacagagggattacgacgttgttgctggtaggtggacaacacccaaccatcacatctggaagcagctcaatcttttgccaaagccttttaatctttactctttcgagaacaattatccggttggtaagatacaagacgtggcaaagtacacaacagatattcgaagttggttagagctcttcggtttccagctgcacaatgtgctgcctggcttccctaaacctgaactggagaatctggagctgacttacgagctactgagattgcaaaccaaaactcaggagtgggacccgggcaagacaattctaggcatccagtgtgaactccagaaacagctgcgaaattttatcagcctcgaccagttgcctatgacacctcgttacaacgatggaaggtgcttggagggcggcaaacagccacgatttgcggccgtgccaagcgtgttcgggaaaggcattaagtttgcaattaaagatggaatcgtgactgccgacatcattggcgtggcaaatgaggattcccggcggcttgccgcgatcctaaacaacgcccactaccttgagaacctgcacttcaccattgagggtagggatacacactatttcatcaagttggggtcgctggaggaagacctggtccttatcgggaataccggaggccgtagaatcctggagaatggagtcaacgtgactgtatcacagatgacatcggtacttaatggtcgaacaagacgctttgctgacattcaactgcagcacggggcgctgtgctttaacatcaggtacggaaccacagtggaagaagagaagaaccacgttttggagattgctcgccagcgagctgtcgcacaggcctggacaaaagaacagagacgcctccaggaaggcgaggaagggatccgcgcctggacagaaggtgaaaagcagcagttacttagtacaggcagagtgcaaggctacgacggctatttcgtgctgtccgtggaacagtatctggagctctctgattctgctaataatatccacttcatgcggcagagcgagattgggcgccgctag

SEQ ID NO: 9552 - DNA, 264 bp, Artificial Sequence
  Description of Artificial Sequence: Synthetic coding sequence
atgaaggtgctgctgctgaccggcctgggcgccctgttcttcgcctattattgggacgataattttgatccagctagcctccagggggcccgcgttctcctgaccggcgcaaacgcaggggtgggggaggagcttgcgtaccattatgcacggctgggctcacatctggtgctgacggcccataccgaggcgctgttacagaaggcacggtggttgaccctggttgtaagcaccctcggaggccgtggcaagtggataacctag

SEQ ID NO: 9553 - DNA, 1233 bp, Artificial Sequence
  Description of Artificial Sequence: Synthetic coding sequence
atgcgggcctgcatcagcctggtgctggccgtgctgtgcggcctggcttgggcaggcaaaatcgaatcatgcgcatctaggtgtaacgagaagttcaaccgggacgccgcatgccagtgcgatcgccgctgcctatggcatggcaattgttgtgaggactatgagcacctttgtaccgaggaccacaaagaaagtgaacctctgccccaactggaagaggagacggaagaagccttagcaagcaacctgtacagcgcacctacttcatgccaggggagatgttatgaagccttcgataagcaccatcaatgccattgcaacgccagatgccaagagttcggcaattgctgtaaggatttcgagagcctgtgctcagaccacgaagtctctcactcatcagacgccatcaccaaagaagagattcagagcatctctgaaaagatttatcgagctgacaccaacaaagcccagaaagaggacatcgttctgaatagccagaattgtatcagccccagcgagactcgtaatcaagtcgaccgctgtcccaagcccttgtttacttatgttaacgagaagctgttctccaagcccacatatgccgccttcatcaatctcctgaacaactaccagcgtgcaactggccatggggagcacttcagcgctcaggagctcgcagagcaggacgcttttttacgggagattatgaaaacagctgtgatgaaagagctgtatagctttttgcatcaccagaatagatatggaagcgagcaggaatttgtggatgatctgaagaacatgtggttcggattgtattctaggggaaacgaagagggggatagcagtgggttcgagcacgtcttttctggcgaagtaaaaaagggtaaggttacaggcttccataattggatcaggttctacctcgaagaaaaggagggcctcgtggattactattcccatatttacgatggcccctgggatagctatcccgatgttctcgctatgcagtttaattgggacggttattataaagaagtaggcagtgcatttattggctctagtccggagtttgagttcgccttgtatagcctgtgtttcattgctagacccggaaaagtgtgtcagctctcccttggaggctaccccctcgccgtgaggacgtacacttgggataagtcgacctatggcaacgggaaaaagtacatcgcgaccgcatacatcgtgtcaagcacctag

SEQ ID NO: 9554 - DNA, 351 bp, Artificial Sequence
  Description of Artificial Sequence: Synthetic coding sequence
atggccgccggcagcgcccccatgcagctgcacctgcgggccaccatcagaatgaaagacggactgtgcgtgcctcgcaagtggatttaccacctcactgagggctcaacagatctgcgcacagaaggtcgtcccgatatgaagactgaactcttctcatcctcttgccctgggggtataatgctgaacgaaacaggtcagggttaccagcgatttctgctctacaacagatcacctcacccacccgagaagtgcgtggaggagttcaaaagtctgacttcatgtctagactcgaaggccttcctccttaccccaagaaaccaggaggcgtgtgagctgtcaaacaattag

SEQ ID NO: 9555 - DNA, 1200 bp, Artificial Sequence
  Description of Artificial Sequence: Synthetic coding sequence
atgagcgcccggggccggtgggagggcggcggccggcgggcctgccggggatccctgggactggctagagcgcagggtgctgaaagggttaccagtagcgagcagcgtccagccatggcatctctgggcctcctccttctgctcttactgactgccctgcccccgctctggtccagtagcctgcctggactagacactgccgaaagcaaggctaccattgcggacctgatcctatcagccctcgagcgcgccactgtgttcctagaacagagactgcctgagattaatctggacggcatggtcggtgtccgagtactggaggaacagctcaagtccgtaagggagaagtgggcccaggagcccctcttgcagccactaagtctcagggtcggcatgctgggagaaaagcttgaggcagccatccagcggtccctgcactaccttaagttgagcgatcccaaatacctccgggaattccagctgaccctccagcccggtttctggaagctgccccatgcctggatacacacagatgccagccttgtgtacccaaccttcggaccacaggattctttcagtgaagagagatcagacgtgtgtcttgtgcagctgctggggacaggtacagattcaagtgagccatgcggtctctcagacttgtgtcgcagcctcatgaccaagccaggctgcagcggctactgcctcagccatcaactactctttttcctctgggctcgcatgcgaggttgtacccaaggccccttgcagcagagccaggattatatcaacctcttctgcgctaacatgatggatctgaaccgtagggctgaagccataggatatgcataccctacgagagatatcttcatggaaaatataatgttttgtggaatgggcggcttctcagacttctacaaactgaggtggttggaagccatcctctcttggcagaagcagcaggaaggttgtttcggggaacctgacgcggaggatgaggaactgagcaaggctatccagtaccaacagcacttctcccgtcgggtgaagcggcgtgaaaaacagtttcctgatggatgcagttcgcacaacacggcaaccgccgtggctgcccttgggggctttctgtatatcctggcagagtacccgcctgctaacagagagccgcatccaagcactcctcctccacccagtagtaggtag

SEQ ID NO: 9556 - DNA, 510 bp, Artificial Sequence
  Description of Artificial Sequence: Synthetic coding sequence
atgctgagcagcgtggtgttctggggcctgatcgccctgatcggcacttctcgaggttcctacccattttctcattcaatgaaacctcacctgcatccgaggctgtatcacggctgttatggagatatcatgaccatgaaaacatctggcgccacttgcgatgccaacagtgtgatgaattgcggaatccgaggatctgagatgttcgctgaaatggatctgcgggcgatcaaaccttatcagacactgatcaaggaggtggggcagcgccattgcgttgatcctgccgtgattgccgccattatctcccgggaatctcatggtggtagtgtgctgcaggacggctgggaccaccgggggttgaagtttggtcttatgcaactggacaaacagacttaccacccagtcggcgcgtgggactctaaagagcatctgtcccaggctaccgggattctaactgaacggatcaaggctattcagaaaaagttcccgacctggagtgtcgcctag

SEQ ID NO: 9557 - DNA, 300 bp, Artificial Sequence
  Description of Artificial Sequence: Synthetic coding sequence
atggagcggatcagcgccttcttcagcagcatctgggacaccatccttaccaaacatcaggaaggcatctataatacgatttgcctgggagtcctcctggggcttcccttgttagtgataattacccttctgtttatctgttgtcattgctgctggtcccccccaggcaagcgagggcagcagcccgaaaagaacaagaagaagaaaaaaaagaagaagaaaaaagatgaggaggacctgtggatctctgcccagcccaagttgttgcagatggagaaaaggccctctctgccggtgtag

SEQ ID NO: 9558 - DNA, 468 bp, Artificial Sequence
  Description of Artificial Sequence: Synthetic coding sequence
atgaccagcctgaagtgcggcgagaacctgtacatgagcagcgcctccagcagctggtcgcaggctatacagtcttggtttgatgagtacaacgacttcgacttcggcgtgggcccaaaaacacccaatgctgtcgttgggcattacacacaggtcgtttggtactcctcctatctggtgggttgcgggaacgcctactgccccaaccagaaagtgcttaaatattactacgtgtgccagtactgcccggctgggaattgggccaatcggctgtatgtgccctacgagcagggagcaccttgcgctagttgcccagacaactgtgatgacggtctgtgtacgaacggttgcaaatatgaagatttgtattccaattgcaagtccctgaaactgactctgacttgcaaacaccaattagtgcgggactcttgcaaggctagctgtaactgttctaactcaatatattag

SEQ ID NO: 9559 - DNA, 2886 bp, Artificial Sequence
  Description of Artificial Sequence: Synthetic coding sequence
atgctgctgctgctgctgctggcccccctgttcctgcggccccccggcgccggcggggcacaaaccccaaacgccaccagtgagggctgccaaattatccatcccccctgggagggcggtattagataccgcggtctaacaagagatcaggtgaaagcaataaattttttgcctgtggactacgaaattgagtatgtgtgtagaggggagcgtgaggtggtgggacccaaggtgcggaagtgtctggcaaacggttcctggacagacatggatactcccagccgttgcgtccggatatgtagtaaatcatacttaacactcgaaaacgggaaagtgtttctcactgggggggaccttccagcactcgacggcgctcgcgtcgacttccgctgtgatccggacttccatctggtaggatcatcacgctccatttgttcacagggccagtggagcactccaaaacctcactgccaggtgaaccggacgccccactcagagcgtagagccgtttacatcggagcgctattccctatgtccggcggatggcccggcggtcaggcctgtcagccagctgtagagatggcattggaagatgtgaactcgcggcgagacatcttgccggattatgagctgaagcttattcatcacgactcaaaatgcgatcccgggcaggcgaccaaatatctctatgagctcctctataacgacccaattaagatcattcttatgccaggatgttcctctgtgtctaccttggtggccgaagcggcccggatgtggaacctgatcgtgctgtcttatggctccagtagccctgccctgagcaaccgacaacgattccccacatttttccgaacacaccccagcgcaacccttcacaacccaacccgagttaagctctttgaaaagtggggatggaagaagatcgccaccatccagcagaccaccgaggtattcacctccacgcttgacgacctggaagagcgggtaaaggaagccgggatcgagattaccttccgtcagagcttcttctcagacccggccgttccagtgaagaatctgaaaaggcaagacgctaggatcatcgtgggcctgttttatgaaactgaagcaagaaaagtgttctgtgaggtctataaagaacgtctgttcggcaagaagtatgtttggtttttaatcggttggtacgctgataactggttcaagatctatgatccatccatcaactgtaccgtcgatgaaatgaccgaagctgtcgagggccacatcacaaccgagattgtgatgctaaacccagctaatacaagaagcattagtaatatgacctctcaagaattcgtcgaaaaactcacaaaaagactgaaaagacatccggaggagacggggggatttcaggaggcacccctggcgtatgatgccatctgggccttagccttagctctgaataagacgagcgggggaggcggacggagtggggtgagactggaggattttaactacaacaatcaaactattacagaccagatataccgggccatgaactcgtccagttttgaaggtgtcagcggacatgttgtttttgacgcctctggctcaagaatggcctggactctaatagagcagttgcagggagggtcttataagaagatcgggtattatgattcgaccaaggacgacttgagctggagcaaaactgataagtggattggaggaagcccccctgcagaccaaacactggttatcaagacctttaggttcctcagtcagaaactgttcatatctgtcagtgtgttaagctccttgggaatagtgctggcagttgtctgcttatccttcaatatttacaattcccatgtgagatatatccagaacagccaacctaatctcaataacctaaccgctgtcgggtgttcccttgccttggctgcggtattccctctgggcttggatgggtatcatatcggtcggaaccaattccctttcgtttgtcaggccaggctctggttacttggtctgggcttttccctgggctatgggagcatgtttacaaaaatttggtgggtacacactgtgttcaccaagaaggaggaaaagaaggagtggcggaaaacattagaaccttggaagctgtatgctacagttggacttctagtcgggatggatgtgctgaccctggccatctggcagatcgtcgatcccctccacagaaccatcgagacctttgccaaggaggagcccaaagaggacatagatgtgagcattctccctcagctcgaacactgctcaagtcggaaaatgaatacatggttaggaatattttatgggtataaaggactgttgctcttgcttggcatttttttagcttatgagactaaaagtgtgagcacagagaagatcaacgatcatcgggctgtcggcatggccatatacaatgtcgcggtactctgtctcatcaccgcccctgtaaccatgatcctttcgagccagcaggatgcggcattcgcatttgccagcttggctatcgtgttttcttcctatataaccctggtcgtgctgttcgtgcctaagatgcgcaggctcataacaagaggagaatggcagtccgaagctcaagatacgatgaagactggctcatcaaccaacaacaatgaggaggagaagtctcggttactggagaaagaaaatagggaactggaaaagatcatcgctgagaaagaggagcgagtatctgagctgcggcatcaactacagagcagacagcagttaagaagcagacggcatccccctacgccccctgaaccttccggtgggctgccccgcgggccgcccgagccacccgataggcttagctgtgatgggtctcgtgtgcacttgctttacaagtag

SEQ ID NO: 9560 - DNA, 444 bp, Artificial Sequence
  Description of Artificial Sequence: Synthetic coding sequence
atggccggcccctggaccttcaccctgctgtgcggcctgctggccgccacattaatccaggcaactttatcccctacggctgtgctgatcctggggcctaaggtcataaaggagaagttgacccaggagcttaaagaccacaatgcaacaagcatcctgcaacagcttcctctgctgagcgcaatgagggagaagcccgcaggcgggatccccgtcctgggcagtctagtgaacaccgtactgaaacacataatttggctaaaagtgattacggctaacatcctgcaattgcaggtaaaaccaagcgctaacgaccaggagcttttggttaagatccctctggacatggtcgctggattcaatacccccctcgtgaagaccatagtggagttccatatgaccactgaggcccaggcgaccattagaatggacacgagtgcatag

SEQ ID NO: 9561 - DNA, 948 bp, Artificial Sequence
  Description of Artificial Sequence: Synthetic coding sequence
atgaaggtgctgctgctgaccggcctgggcgccctgttcttcgcctactattgggacgataacttcgatcccgcttcattgcaaggagcccgcgtgctgctgacaggcgctaacgccggcgtgggagaggagctcgcttaccactatgcccggttggggtctcacctggtgttgactgcccacacggaagcccttctgcaaaaggtggtggggaattgtcgtaagcttggagctcctaaggtcttttacatagcggcagatatggccagtcccgaggcccccgaaagcgttgtgcagtttgccttagacaagctcggaggcctggactatctcgtccttaaccacatcggaggagcccctgcagggacaagggctaggagtccacaggccaccagatggctcatgcaagtgaattttgtgtcatacgtccagttgacgagtagagctctacccagtctcacggattcgaaagggtccctagtcgtggttagcagtttgctgggacgagttccaactagtttctccactccttatagtgcagcgaagtttgcactcgacgggtttttcgggagcctgaggcgcgaactggatgtccaggatgtcaacgttgctatcactatgtgcgtgcttggattgagggaccgcgctagcgctgcagaggcagtgcgtagctctactagccgcccaaggcaacccgaacatcgaggcgtgccactgcaaagtcagacggccatgttcctgcctcctaccgtgcccggagctcggacactgacagaaacacctctccgggggtggcctcagccaaagatgaagagctctaggcagaaaagcaagacagagaagaacgatggacacctggaacccgtcacggcatgggaagtgcaggtgcctagggtgagacgtctttgccgcggtttggcccgaccgcatctctttggccatgactag

SEQ ID NO: 9562 - DNA, 285 bp, Artificial Sequence
  Description of Artificial Sequence: Synthetic coding sequence
atgcagcacagcctggtgttcttcttcgccgtgatcctgcacctgtcccacttgctgcacttggacgcctcaatccatcccttccgacttcccttcagcagcaaaccgtttctgcttattccaatgtcaaacaccactttgccgcacaccgcatggccattgagcttcctgcatcaaacggtgtctacactgaaggccgtggccgtgacccactctttgtggcacctccaaataccagtagattgccaggcgtgcaatagaaagtctaaaaaaatctactgttag

SEQ ID NO: 9563 - DNA, 783 bp, Artificial Sequence
  Description of Artificial Sequence: Synthetic coding sequence
atggagaagttcaacaccatcagcgtgagcaagtgcaacaaggagactgtcgccatgaaagagaagtgtaagttcggcatgacctccactattccaagcggccatgtgtggcgcaacacatggaacccagtgtcttgcagcctggcaacagtgaagatgaaggagtgtctgcgcgggaaactgatttacttgatgggggactccactatccgtcaatggatggaatactttaaggcttccatcaacactctaaaaagtgtagatctgcacgagtccggaaaattacagcaccaactggcggtcgatctggatcggaatatcaacattcagtggcagaaatattgctacccattgattggctctatgacctatagtgtgaaagagatggagtacctgacacgggctatagacaggacgggcggagaaaagaacaccgtaatcgtgatctccctcgggcagcattttagaccctttccaatcgatgtctttattcgtcgtgctctgaacgtgcataaggcgattcagcacttactgctccgctcccctgataccatggtgatcatcaagaccgaaaacattagggaaatgtacaacgacgctgagagattttctgactttcatggctatattcagtacctgataattaaggatatcttccaagatctatctgttagcatcattgacgcatgggatatcacaattgcctacggaacgaacaatgtgcatccgccacagcatgtggtaggcaaccagattaacatcttgcttaattacatctgctag

SEQ ID NO: 9564 - DNA, 1644 bp, Artificial Sequence
  Description of Artificial Sequence: Synthetic coding sequence
atgagcagcaacaccatgctgcagaagaccctgctgatcctgatctcttttagcgttgtgacatggatgatttttatcatcagtcagaactttaccaagttgtggagtgctctaaacctgagcatttcagtccattattggaataattctgctaaatctctctttcccaagacctccttaatccccctgaagccactgaccgagacagaactgaggattaaagagatcatcgaaaaacttgatcagcagatccccccaagaccatttactcacgtgaacacgacgacatcagccactcactctacagccactatcctcaacccgcgcgacacttactgcagaggcgaccagctggatatactgctggaggttcgagatcatttgggacaaaggaagcagtacggcggtgatttcctacgggcccgaatgtcctccccagcactcaccgctggcgcctccgggaaagtcatggattttaataacggaacttacctggtgtcattcacactcttctgggaaggacaagtaagcctgagcctgctcttgatacacccaagtgagggagcatctgccctttggcgtgcccgcaatcagggctacgataagatcattttcaaagggaagtttgtgaatgggacctctcatgtatttacggagtgtggcctgaccctcaacagcaatgctgaactttgcgagtatctcgacgatagagatcaggaggccttctactgcatgaaaccacagcacatgccctgcgaagcactgacgtacatgaccacacgaaatcgagaggttagttacctgacagataaagagaactcgctgtttcacaggagcaaggtgggtgtggaaatgatgaaagaccgaaagcacatcgacgtgaccaattgtaacaaacgcgaaaagattgaagaaacatgtcaggtgggtatgaagccacccgttccgggcgggtacaccctccagggaaaatggatcacaaccttctgcaatcaagtgcaattggataccataaaaattaatggctgcctgaaggggaagctcatctaccttctcggtgatagtacacttcggcagtggatttattatttccccaaggtggtcaaaacattgaagttctttgacctgcacgagaccggcatctttaagaaacacctgctcctagacgctgagcgacatactcagatccagtggaaaaaacattcataccctttcgtaaccttccagctgtactctctgattgatcacgactatattccgagagagatagatcgtctgtcgggagacaaaaacactgccatagttatcacttttggccagcactttaggccatttcctatcgatatattcattcggcgcgccataggtgttcagaaagctatcgaacggctatttctgagaagtcctgccacaaaggttattataaagaccgagaatattcgggaaatgcacattgagacggagcgatttggcgattttcatggatacatccattacctgatcatgaaggacatctttaaagacctaaatgtcggtatcatcgacgcatgggacatgaccatcgcatacgggaccgacacgatccatccgccagaccatgtgatcggcaaccagattaatatgtttctcaattacatctgctag

SEQ ID NO: 9565 - DNA, 399 bp, Artificial Sequence
  Description of Artificial Sequence: Synthetic coding sequence
atgctgatgctgttcgtgttcggcgtgctgctgcacgaggtgagcctgagcgggcagaacgaggccccacccaacactcattctatccctggagaacctctttacaattacgcatccattcgactacctgaggagcacatcccattctttttacacaataatcggcacattgccacagtttgtcgcaaggacagcctttgtccttacaaaaaacatttggagaagctgaagtactgctggggttacgaaaagagctgtaaaccggagtttcggtttggatacccggtttgtagttacgtcgacatgggctggactgacactctggaaagcgctgaagacattttttggaagcaggcggattttgggtacgcgcgcgagcgacttgaggagatgcactag

SEQ ID NO: 9566 - DNA, 861 bp, Artificial Sequence
  Description of Artificial Sequence: Synthetic coding sequence
atgggcagcgccctgttcgtgaagaaggagctgcagctgcaggccaatttcctcggaaacgttaaaagactgtacgaagccgaggtattttcaactgattttagtaatccttccatagcccaggctcggatcaatagccatgtaaagaagaagacacagggcaaagtcgttgatattattcagggcctggacctgcttactgctatggtgctggttaaccatatcttttttaaagctaaatgggagaagccattccaccctgagtacaccagaaagaatttccctttcctggttggtgagcaggttacagtccacgtgcccatgatgcatcaaaaagagcagttcgccttcggagttgacaccgaactgaactgcttcgtcctgcagatggattataaaggcgacgctgttgcgttttttgtgctcccgagtaaaggcaagatgaggcaactggagcaggccctctcggccaggaccttgcgcaagtggtcccacagtctgcagaaacgatggatcgaggtcttcatcccccggttctcgatttccgcatcttacaatctagagacgatccttcctaaaatgggcatccagaacgtgttcgataagaacgctgacttctctgggattgcgaaaagagattctctccaggtgtccaaagccacccacaaggctgtcttagacgtgagcgaggaagggaccgaggctacagcagcaactactactaagtttatagtccgcagtaaggacggtcctagttatttcacagtcagcttcaaccggacatttctgatgatgatcaccaacaaagcaacagacgggattctctttctggggaaggtcgagaaccccactaaatcatag

SEQ ID NO: 9567 - DNA, 60 bp, Artificial Sequence
  Description of Artificial Sequence: Synthetic coding sequence
atgggctggctgacccggatcgtgtgcctgttctggggcgtgctgctgaccgccaggtag

SEQ ID NO: 9568 - DNA, 1197 bp, Artificial Sequence
  Description of Artificial Sequence: Synthetic coding sequence
atgaagttccagggccccctggcctgcctgctgctggccctgtgcctgggctccggcgaggccgggccactacagtctggcgaagaatccaccgggaccaacatcggtgaggcactagggcacggtctgggggacgccctctctgagggtgtcggcaaagcaattgggaaagaggcgggaggagctgctggtagtaaagtgtccgaggcgcttggtcaggggactagagaggcagtgggaacaggcgttcgccaggttcctgggttcggggtcgcagatgcactggggaatcgtgtcggcgaagccgcccacgcattaggaaacacaggccatgaaatcgggaggcaagctgaagatgtgatccgccacggcgccgacgccgtgcgcggttcctggcagggagttccgggccacaacggcgcatgggagaccagcggcggccatggtatctttgggtcccagggcggactgggtggacagggtcagggcaaccccggcggcctggggaccccttgggtgcatgggtaccctggtaacagcgcgggtagctttggcatgaatcctcaaggcgcaccatggggccaggggggtaatgggggcccaccaaacttcggtactaatacccagggtgcagtggcacaacccggttatggctctgtgcgggctagcaaccagaacgaaggatgtaccaatcccccccctagcgggagcggcgggggttcaagtaactctggcggggggagcggcagccagagcgggagtagcggctcaggatcaaatggcgataacaacaacggatcatcaagtggcgggagtagttccggctcaagctcaggtgggtcttcaggaggcagtagtgggggaagctctggcaacagcggcggcagtcgaggcgattccgggtccgagagctcgtggggaagcagcacaggttcatcatctgggaatcacggcggtagcggcggtggtaacggacacaagcccgggtgtgagaagccaggcaatgaagcacgcgggtcaggggagtctggcatccaagggttccgaggccaaggcgtttcctctaacatgcgtaactccgagacttcccccgggatgttcaattttgatacattctggaaaaacttcaagtctaagctgggcttcatcaactgggacgcaatcaacaaggaccagaggagctctcgaataccctag

SEQ ID NO: 9569 - DNA, 81 bp, Artificial Sequence
  Description of Artificial Sequence: Synthetic coding sequence
atggcccccaagaagctgagctgcctgcggagcctgctgctgcccctctccttgaccctgttgctcccccaggccgattag

SEQ ID NO: 9570 - DNA, 696 bp, Artificial Sequence
  Description of Artificial Sequence: Synthetic coding sequence
atggcccagctgttcctgcccctgctggccgccctggtgctggcccaggcgccagccgccctggccgatgtcttagagggggattccagtggcatctataggtgcgaagtgcaacacggcatcgacgatagctccgacgccgtggaggtcaaggttaaaggggtcgtcttcctgtatagagagggaagcgctcggtatgcattttctttctccggcgcccaagaggcatgcgcccggataggggcacatattgcaacccccgagcaactgtacgccgcgtacttgggcggttacgagcagtgcgacgcaggctggctgagcgaccagacggtgaggtatcctatccagacacctagggaggcttgttacggagatatggatgggttcccaggggtgagaaactacggggtggtcgatcccgacgacctgtatgatgtatactgctatgccgaggacctgaatggcgaactgttcctcggtgatcctccagagaagctgaccctcgaagaggctcgggcatattgccaggagcggggagctgagatcgctacaacaggacaactgtatgcagcctgggacggtggccttgaccattgcagtcctggctggctggctgacgggagcgtacggtatccaatcgtcactcccagccagagatgcggcggaggattaccaggcgtgaaaactctgttttag

SEQ ID NO: 9571 - DNA, 600 bp, Artificial Sequence
  Description of Artificial Sequence: Synthetic coding sequence
atggacgagctgctgcccctgatccccgtgctggagcagtacaagacagatgctaagcttatcacccagtttaaggaagaaattcggaacttatccgcggtgctgaccggaattcaggaggaaattggtgcttacgattatgaggagctgcaccagcgagtactgtccctcgaaactcgccttagggattgtatgaagaagctgacttgtggaaagttaatgaagattacaggccccgtgaccgtcaagactagcgggacaaggttcggcgcctggatgacagatcccctggcttcagagaagaataacagagtttggtatatggacagttacaccaacaacaaaattgttcgggaatacaaaagcatagcagactttgtttcaggcgcggagtccagaacctacaacctgccatttaaatgggccggaaccaatcatgtggtctacaacggctccctctatttcaataaataccagtcaaatatcattatcaaatactctttcgatatgggtagggtgttggcccagcggtcattggaatacgcagggtttcataatgtcaccccaacccacggagtggacagcttaacaagtacatag

SEQ ID NO: 9572 - DNA, 609 bp, Artificial Sequence
  Description of Artificial Sequence: Synthetic coding sequence
atggccgacatgcagaacctggtggagcggctggagcgggccgtggggcggctagaagccgtgtctcacacctcggatatgcacagaggttatgccgactctcccagtaaggcaggagcggccccctatgtccaggccttcgactccctattggctggacccgtcgccgagtatctgaagatatccaaggaaattggtggcgacgtgcagaagcacgctgagatggtccatacgggactgaagctcgagcgggcgctcctggtgactgcttcacagtgccagcagcctgcggagaataagctgtccgatctgctcgcgcccatatcagaacagatcaaggaagtaatcacctttagagagaagaaccgcggctctaaactgtttaatcacctctctgctgtaagtgaaagtattcaggccctgggctgggtggccatggccccaaagccgggtccgtatgttaaagagatgaatgacgccgccatgttctacaccaatagagttctcaaggaatataaggatgtggacaaaaaacacgtcgattgggtgaaggcatacttaagtatttggacagagcttcaggcatacattaaagaattccatacatag

SEQ ID NO: 9573 - DNA, 2886 bp, Artificial Sequence
  Description of Artificial Sequence: Synthetic coding sequence
atgctgctgctgctgctgctggcccccctgttcctgcggccccccggcgccgggggggcccagactcctaatgctaccagcgagggatgccagatcattcatccgccttgggaagggggcattcgatatcgaggtctgacaagagaccaggtaaaagctattaacttcctccctgtggactatgaaatcgagtacgtttgtaggggtgagcgcgaggtggtgggaccgaaagtccggaaatgcctcgccaacggctcctggactgatatggataccccctccagatgtgtccggatttgttccaagtcttacctcacactggagaatggcaaagtcttcttgacaggaggcgacctgcctgccctggacggagcccgagtggacttccgatgtgatccagactttcatctggtaggcagtagccgttccatttgttcccaggggcagtggagcacgcctaagccacactgccaggtcaatcggaccccacattctgagcgaagggccgtctacataggtgccttattcccgatgagtggtggctggcctggcggacaggcgtgccagcccgctgtggaaatggctcttgaggacgtgaattcccggcgcgatattttacctgactatgagcttaaattaatacaccacgatagcaaatgcgatcccgggcaggccactaaatacctttacgaactactgtataatgatcccatcaagattatccttatgcctgggtgtagctctgtttctacccttgtggcagaagccgctagaatgtggaacctgatcgtgctgagctatggcagctctagccctgcgctatctaatcgacagcgtttccccactttttttagaactcatccctcagccacactgcacaaccctacacgcgtgaaattattcgagaagtggggatggaaaaaaattgcaaccatccagcaaactacagaagtgttcacatctactttggatgacttggaggaaagggtgaaagaagccggaattgagattacctttcggcaatcttttttttccgacccggcggtgccggtcaaaaaccttaaacggcaagatgccagaattattgtgggcctcttttacgagactgaggcccgaaaagtattctgcgaggtttataaggaacgactgttcggcaagaagtacgtgtggttcttgattgggtggtatgctgacaactggtttaaaatctatgatccatctattaattgcaccgttgatgaaatgacggaagctgtggagggccatatcactacagagattgtgatgctgaatcccgctaatacacggtcaattagtaatatgacatctcaggaattcgtcgaaaagctgacaaaaagattgaaaagacacccagaggagacaggcggcttccaggaggccccacttgcttacgatgccatttgggctctggccttggcactgaataagaccagtggtggaggcggccgaagcggcgtgcggctggaagacttcaactataataaccaaacaattactgaccagatttacagggcgatgaatagttcctccttcgagggagtgtccggacatgtggttttcgacgcgagcggttctcggatggcatggactttgatcgagcagctgcaaggaggcagctacaaaaaaattggatactatgatagtaccaaggacgacctctcctggtcaaaaaccgataagtggatcggaggatcgccccctgccgatcagaccctggtgatcaagaccttcagattcctcagtcaaaagctgtttatctccgttagtgtgctgagtagcctgggcatagtactcgccgtggtgtgtctgagtttcaacatctacaattctcacgtgcggtatattcagaactcacagccaaacctaaataacctgactgctgtaggctgttccctcgcgctggccgcggtgtttccactcggcctagacggataccacatcggcagaaatcaatttccgttcgtctgccaagcccggttatggctacttgggctgggattctccttaggatacggctccatgttcaccaagatttggtgggttcacaccgtattcaccaaaaaagaggagaagaaggaatggaggaagaccctggagccgtggaagttgtacgccacagtgggactgctggtaggaatggacgtgctgactctggcaatatggcagattgtcgatccccttcacagaacaatcgagacctttgccaaagaggagccaaaagaggatatcgacgtgagtatcctcccccagctggaacactgttccagccggaaaatgaatacgtggctcggtattttctatggatacaagggcttacttctcctgctgggcatatttttggcgtacgaaactaagtctgtgtcgaccgaaaagattaatgatcacagggccgtgggaatggccatatacaatgtggccgtgctatgcctgatcactgccccggtcactatgatcctgtctagccagcaggatgcggcatttgccttcgcatccttagctatcgtgtttagctcttatataacactggtagtcctcttcgtgcccaaaatgaggagactcataactagaggcgaatggcagtctgaggcccaggacactatgaaaacaggttccagtaccaacaacaacgaggaggaaaagtcccggctgctggagaaggaaaatagagaactggagaagatcatagctgaaaaggaggaacgcgtttctgagctccgccaccagctgcaatcccggcagcagttgcgctctcggcgtcacccaccgaccccacccgagccctcaggcggcctcccaaggggcccaccagagcctccggatcgtctctcttgtgatggcagtagagtgcacttgttgtacaaatag

SEQ ID NO: 9574 - DNA, 351 bp, Artificial Sequence
  Description of Artificial Sequence: Synthetic coding sequence
atggccgccggcagcgcccccatgcagctgcacctgcgggccaccatccgcatgaaagacggtttatgcgtccctcgcaagtggatctatcatctcacagaaggatctacagatttgcgcaccgaagggaggcccgacatgaagaccgaactgtttagctcttcttgtcctggagggattatgctgaatgagacagggcaggggtaccaacgctttctgctatataaccggtctccccacccgcctgaaaagtgtgtcgaggaatttaagagcttgacatcttgcctggacagcaaggccttcttattgactcctagaaaccaagaagcatgtgaactgtcaaataactag

SEQ ID NO: 9575 - DNA, 2334 bp, Artificial Sequence
  Description of Artificial Sequence: Synthetic coding sequence
atggccgccgccggcctggtggccgtggccgccgccgccgagtactcgggcaccgtggcctctggaggcaatctgcccggtgtgcattgtggtccatcctccggggccggccctggcttcggaccgggcagctggtccaggagtctggaccgggcccttgaggaggcagccgtaacaggggttctgtccctcagcgggcgaaagctgcgcgagttcccgcggggagctgcgaatcatgacctgaccgataccactcgcgctgatctgtcccggaataggctgagtgaaattcctatcgaggcctgccactttgtgtctcttgagaaccttaatctttaccagaattgtatccggtatattcccgaggccatcctgaatctacaggctctgacattcctgaatataagccggaatcagctgagcacattaccagtgcacctgtgtaaccttcccttgaaggtgctcattgccagtaacaataagctggtatctctgccagaagagattggacacctgcgccacctgatggagctggatgtttcttgcaacgagatccagaccatcccgagccagatcgggaacttagaggccctgcgtgatctcaacgtgcgaaggaatcacctggttcacttacctgaagagctcgccgagttgcccctaatcagactcgatttttcttgcaacaagatcactaccatcccggtttgctacaggaacttgcgccaccttcagaccatcaccctcgacaacaatccccttcagtccccaccggcccaaatctgtattaagggaaaggttcatattttcaaatacttgaacatccaggcttgcaaaatcgcccctgatctaccagattatgaccggagaccgctggggttcggatcatgccatgaagaattgtactcatctcgaccttatggagccctggacagtgggtttaactctgttgattccggggataaacgctggtctggcaacgagcccacagatgaattttccgatttgccactcagggtcgccgagatcaccaaggagcagagactccgccgggaatcacagtaccaggaaaaccggggttccttggtcgttacgaatgggggcgtggaacatgacctggaccaaatcgactatatcgattcatgtaccgcagaagaagaggaagctgaggtaaggcagccaaaaggccccgaccctgactcactgtcctcgcaattcatggcttacatcgaacagaggagaatcagtcatgagggatccccagttaaaccagtggccatcagggaatttcagaaaacggaggatatgcggcggtatctccatcagaatcgcgttccagcagaacccagtagcctcctgtctctttctgctagtcacaaccagctgtctcataccgatctggagctgcatcagcgacgagagcagctcgtcgaacgcacacgcagggaagcacagttggctgccttgcagtacgaggaagagaagattcgcacaaagcagatccaacgggacgccgtgctcgacttcgtgaagcagaaagccagccagagcccccagaaacagcacccattgcttgacggtgtagacggtgaatgtccattcccctccagacggtcccagcacactgacgactcagccttgtgcatgagcctatccggcttaaatcaagttggctgcgctgctactcttcctcacagttctgccttcacaccactgaaaagcgacgacagaccaaatgccttactctcctcacccgccactgagactgtgcaccactctccggcttactctttccctgccgctatccagcgcaatcagcctcagagaccagaaagcttcctgttcagagctggggtgcgggccgaaacaaacaaggggcatgcctctccactacctccgagtgccgctcccaccacagactccactgatagcattactggtcagaacagtcggcagcgggaggaggagttggaacttatcgaccagctacgtaagcatattgagtatcggctgaaagtttctctgccttgcgaccttggagccgccctcactgatggcgtggtgttgtgccacctggccaaccatgtacggccccggtcagtgccttcaatccatgtgccttcccccgcggtgccaaaactgactatggccaaatgcagaagaaacgtggaaaactttttagaggcctgtaggaaaataggagtgcctcaggagcagttatgcttacctttacacatcttagaggagaaagggctatctcaggtagccgtgaccgtgcaggctctcttagagctcgcccctcccaagcagcaacagcaccagttgtcagctgtttag

SEQ ID NO: 9576 - DNA, 834 bp, Artificial Sequence
  Description of Artificial Sequence: Synthetic coding sequence
atgctgcaccccgagaccagccccggccggggccacctgctggccgttctgctggcgctgctgggcaccacttgggctgaagtgtggcctccccaactccaggagcaagctccaatggctggcgcgttgaatcgcaaagaaagcttcctgcttctaagcttacataatcgtttacgatcatgggtgcaaccgcctgcagccgacatgcggcgtttattggtatgggccacttcctctcagctgggctgtggacgccatctttgctcagccggccagactgcgattgaagccttcgtgtgcgcttattctccggggggcaactgggaagtcaatggcaagaccatcatcccttataaaaaaggggcctggtgctccctttgcacggcatccgtttccggatgctttaaagcctgggaccatgcaggcgggctctgtgaagttcccagaaacccatgcagaatgtcctgccagaatcacggcagattaaatataagcacatgccactgtcattgtccccccgggtacaccggtaggtactgccaaggccacctgcccaatagtaacatgccccattccgccatgggaaccaagcctaagacgccaggcgtgcccgcgataggctccctcgtgcgctgctcactccaatgcgtccacggcagattccgggaagaagaatgctcctgtgtctgcgacatcggctatggcggagctcagtgcgcgagtgaatcttgccccagagccccgaaagaaccagctcccctcaaaacccccttgcagtggggaatatctagtcaagagcccgctgtctgtctctccttccagctaattcagtag

SEQ ID NO: 9577 - DNA, 456 bp, Artificial Sequence
  Description of Artificial Sequence: Synthetic coding sequence
atgagcgacctgctgctgctgggcctgatcggcggcctgaccctgctgctgcttctcacgctcctcgcattcgccgggtattccgggctcctcgccggcgtcgaagtgtctgctggtagcccacctatccgcaatgttacagtcgcatacaaattccatatgggtctctatggagagaccggcagattattcacggaatcatgctccatttcacctaagctccggtctatcgctgtgtactatgataacccgcatatggtgccccccgacaaatgccgctgtgccgttggcagtattctgagtgaaggcgaagagtcgccgtcccctgagctgatcgacctgtaccagaagtttggtttcaaggtattttcgtttcctgccccatctcatgttgtgacagccaccttcccctacactaccattctcagcatttggttggccactagacgtgtgtag

SEQ ID NO: 9578 - DNA, 390 bp, Artificial Sequence
  Description of Artificial Sequence: Synthetic coding sequence
atggccgccggcagcgcccccatgcagctgcacctgcgggccaccattagaatgaaggacggtctgtgcgtgccccgtaaatggatataccacttgacggagggctccacagatctgcggacggagggacggcccgacatgaagacagagttgttcagcagcagctgtcctggcgggattatgctgaatgaaaccggtcaaggatatcagcgattcttactgtacaatcggtctccacacccacctgagaaatgtgtggaggaattcaaaagcctaaccagttgcttggattcgaaggccttcctgctgacccctcggaatcagggaaagggcttaaagagccataagacagggctcggcctgacgaaatcttccggcgtgactggttag

SEQ ID NO: 9579 - DNA, 390 bp, Artificial Sequence
  Description of Artificial Sequence: Synthetic coding sequence
atggccgccggcagcgcccccatgcagctgcacctgcgggccaccattaggatgaaggatggcctatgtgtcccacgcaagtggatctatcacttgaccgaaggatcaacggacctcagaaccgaaggtagacccgacatgaagaccgaattgttcagcagttcttgccccggaggcatcatgctaaatgagacaggacaggggtatcagcgcttcctgctctataacaggtctccacatcctcctgaaaaatgcgtcgaggagttcaaatctctgacgtcatgcctcgactccaaagctttcctcctgactcccaggaatcaggggaagggacttaagtcacacaagacaggcctggggctcacaaagtctagtggagtaacaggttag

SEQ ID NO: 9580 - DNA, 891 bp, Artificial Sequence
  Description of Artificial Sequence: Synthetic coding sequence
atggaggccctgctgctgggcgccggcctgctgctgggcgcctacgtgttagtttactacaatctcgtgaaggcacctccgtgcggaggcatggggaacctgagggggagaacagccgtcgtcaccggtatttccagctgtggcaggacaagagaagcgttcaatctgctgctgcgagtcaaccacattggaccttttttactaactcatttactgctgccgtgtcttaaagcctgcgccccctcacgcgtggtggtcgtggctagcgctgctcattgtagggggagactggactttaaaagattagaccggcctgtcgtgggctggcgccaggagctgcgcgcgtacgcagacactaagctggccaacgtattgtttgcacgcgaattggccaaccagctggaagctaccggagtaacttgttacgctgcgcaccctggcccggtgaactcagagctgttcctacggcacgtgcctggatggcttaggcccctcctgcgacctctggcatggcttgtgctgcgagccccccgcggcggagcccaaacgcctctctactgcgcattgcaagaaggcatcgaacccttatcaggcagatacttcgccaattgccacgtggaagaagtgccccctgcggccagggacgatcgggccgcacatcggctgtgggaggcttccaagcggttggccggcctcggcccaggagaggatgccgagcctgacgaagacccccagagtgaagacagcgaagctcccagctctctgagtacccctcaccctgaggaaccgacggtttctcagccttacccatcaccgcagtcaagtcctgatctgtcgaagatgacacatcggatccaggcaaaggtcgagcccgaaattcagttgagctag

SEQ ID NO: 9581 - DNA, 567 bp, Artificial Sequence
  Description of Artificial Sequence: Synthetic coding sequence
atgttccaccagatctgggccgccctgctgtacttctacggcatcattctgaattcaatctatcagtgccctgagcactctcaactcacaacgcttggcgttgatggcaaagagtttcctgaggtccatctcggacagtggtacttcattgctggggccgctcccactaaggaggaattggcaacattcgatccagtcgacaacatcgttttcaacatggcagcagggagcgcaccaatgcaattgcacctgagagccactatccgcatgaaggatggtctctgcgttccaaggaagtggatctatcatttgacagaaggttccaccgatttgcggacggagggcagaccagatatgaagacagagctgtttagctcgtcatgccccggcggcatcatgttgaatgagacaggccaggggtaccagaggtttctcctgtacaacaggagccctcacccacctgagaaatgtgtggaggagtttaagtctcttacatcgtgtcttgatagcaaagctttcttacttaccccaagaaaccaggaggcctgcgagctgagcaacaactag

SEQ ID NO: 9582 - DNA, 978 bp, Artificial Sequence
  Description of Artificial Sequence: Synthetic coding sequence
atgcagggccgggtggccggcagctgcgcccccctgggcctgctgctcgtctgcctacatttgcctggactatttgcgagatccataggggtcgtggaagagaaagtgagccagaacctcgggacaaacctcccccaactggggcagccgagtagtactggaccatccaacagtgagcatcctcagccagccctggatccacgttcgaatgatctggcaagagtgccgctgaagttaagtgtccctgccagtgatgggtttcctcccgccgggggtagtgcagtgcaacggtggcctccatcttggggcctacctgccatggactcatggcctccagaggacccctggcagatgatggccgctgcagcagaggacaggctgggagaggcgctgcctgaagaactgagctatctcagttcggcagccgctcttgccccagggtctggtccactgcctggcgagagctcaccggacgcaacaggcctgtcccccaaggcgtcgcttctccaccaggattcagaatctcgtcgcctccccagaagcaattctctgggcgcggggggcaagatactgagccagcggcccccctggagtcttatacatcgggtcctgcctgaccacccctggggaaccctaaacccttcggtgtcatggggaggtgggggcccaggcacgggttggggaaccaggcctatgcctcatccagagggcatttggggcatcaataatcagcccccgggcacaagctgggggaacattaacagataccccggaggaagttggggaaacattaatcgatacccgggaggttcctggggaaatataaatcggtatccaggtgggtcatggggaaacatccatttataccccggcattaacaatcccttccctcccggcgttctgcggcctccagggtcctcatggaatatccccgccgggttcccgaatcccccttcaccgagactgcagtgggggtag

SEQ ID NO: 9583 - DNA, 2631 bp, Artificial Sequence
  Description of Artificial Sequence: Synthetic coding sequence
atgggccccgaggccctgagcagcctgctgctgctgctgctggtggccagcggagatgctgacatgaagggtcacttcgacccggccaagtgtagatacgctctcggtatgcaagaccgaactatcccagactctgacatctcagcttcaagctcctggtcagacagtacagccgcccggcactccaggttggagagttcggacggcgacggcgcctggtgcccagccggtagtgttttcccgaaagaggaagagtatctgcaagtcgatctccagagactgcatctagtcgctctggtgggcacccagggacggcatgccggaggactgggcaaagagttcagccggagttatcggctgcgctacagccgggatgggagacgatggatgggatggaaagaccggtgggggcaagaagtgatcagcggtaatgaggatccagaaggggtggtcttaaaagacctgggacccccgatggttgcacgcctggtgcgcttttatcccagggccgaccgggtgatgtctgtttgcttgagggttgagctctatggatgtttgtggagggacggattgctatcctacacggcccccgtagggcagactatgtatctctctgaggcagtctacttaaatgattccacttatgacggacacactgtgggtggccttcagtatggagggctggggcagctcgccgatggcgtcgtggggcttgatgacttccggaaaagccaggagttaagagtgtggcccggctacgactacgttggctggagcaatcacagcttctccagcgggtatgtcgaaatggagtttgaattcgaccggttacgagccttccaagcaatgcaggttcactgcaacaacatgcacacgctgggcgctcgccttcccgggggcgtggagtgcagattcaggcgcggcccggctatggcctgggagggcgagccaatgcggcacaatcttggcggcaaccttggagaccccagggctagagccgtaagcgtcccattgggcggccgggtagctaggtttctacagtgccggtttttattcgctgggccatggctactctttagcgaaatttcctttatctcagatgtggtgaacaacagttcccccgccctgggtggaactttcccgcctgctccttggtggccaccggggccaccgcctacaaacttcagcagtctggagcttgagccccgaggccagcagccagttgctaaagcagaggggtctcccactgcgatcctgattgggtgtctcgtggccataattcttctgcttcttttaattatcgctttaatgctgtggcggctgcactggaggcggctcctgagtaaagcagagagacgagtgctggaggaggagttaacagtgcatctgagtgtaccaggcgacaccattttgattaacaaccggcccggaccacgtgagcccccaccctaccaggaaccaaggccgaggggaaatccccctcacagtgccccatgcgtccccaacggtagtgcctatagtggcgattatatggagcctgagaagcctggagcgcctctgcttcctccgcctcctcagaactccgttccccactatgctgaggccgatatcgtcactctccaaggtgtgaccggcggcaacacatacgcagttcccgctttaccgccgggagccgtgggggatggcccgccacgggtggacttcccaagaagcagactgcgatttaaggaaaagttaggcgaggggcaatttggcgaggtgcatctgtgcgaggtggattcaccacaggatctcgtcagtctggactttcctctcaacgtgcgcaaggggcaccccctgttggtggccgtcaaaattcttcgcccagacgctacgaagaatgccagaaatgactttctgaaggaggtcaagatcatgagccgtctcaaggaccccaacattattcggctgctcggcgtgtgcgtccaagacgaccccctctgtatgatcacagactacatggaaaacggtgatctaaatcagtttttatcagcccaccaactggaggacaaagctgcggagggagcgccaggagacggacaggccgctcagggacccaccatatcttaccctatgctcttacacgttgctgcccaaatcgcctcggggatgcgatacctggctactttaaactttgtacacagggatctggccacacgtaactgcctcgtgggcgaaaacttcacgataaagatagctgatttcggcatgtcgcgtaacttgtacgctggagactactaccgcgttcagggaagggccgtactgcccattcggtggatggcatgggagtgtatccttatgggaaaattcaccaccgccagtgatgtgtgggctttcggagttacactgtgggaggtcttgatgctgtgccgggcacaaccctttgggcaactcactgatgagcaggtgatcgagaatgccggcgagttcttcagggatcagggacgacaggtttatctcagccgcccacccgcctgtccccagggcttgtatgaactcatgctgcgatgctggtctcgggagagcgaacagcgaccccccttttctcaattacacaggttcttggccgaagacgccttaaacactgtgtag

SEQ ID NO: 9584 - DNA, 1482 bp, Artificial Sequence
  Description of Artificial Sequence: Synthetic coding sequence
atggccctgctggccggcggcctgagccggggcctgggcagccaccctgcggccgctggccgagatgccgtcgttttcgtatggttactgttgagtacttggtgcactgcccccgctcgggctatccaggtcactgtgagcaacccctaccacgtggtgatactttttcagcccgtgactcttccttgcacatatcaaatgacctctacccccacacagcctatcgtgatttggaagtacaagagcttctgtcgcgaccgaattgccgatgcattttcccctgcatcagtggacaatcagttaaatgcccaactggcggccgggaatcctggctacaacccctatgtcgagtgccaagattccgtaaggacagtaagggtggtggccaccaagcaagggaatgccgtgacactgggtgactattaccagggcagaaggatcaccatcactgggatgtacgcagctggaaaggcagcaacatccggagtgccttctatttacgccccttccacatacgcccatctttctccagctaaaacacctccccctcccgcaatgatccccatgggccctgcctacaatggttaccctgggggctatcctggcgacgtggatcgaagctctagcgctggggggcaagggtcatacgtccccttactgagggacacggattctagcgtggcatcagaggtgagaagcggctatcggatccaggcctcccagcaggacgattccatgcgggttctctattacatggaaaaggagttggccaattttgaccccagccgtccgggccccccttctgggcgggtcgaacgggccatgtcagaagtgacttccctccacgaagatgactggagatccagaccttccagagggccggctctgacacctatccgggatgaagagtggggtgggcactctccccgatctcctagggggtgggaccaggagccggcacgtgagcaagcagggggcgggtggcgagctcgccgcccaagggccaggagcgtggacgctctggacgatctgactccaccatccacagctgagtccggaagtagaagcccgaccagcaacggcggcagatcacgtgcctacatgcccccacgcagccgctctcgagacgatctgtatgaccaggatgacagtagggactttccaagaagtcgcgaccctcactatgacgacttccgctccagagagagaccccctgcggaccccagatcccatcaccatagaacccgagacccacgcgataatggatcccgcagcggagacttgccgtatgatggccgcctcctcgaggaggccgtgagaaaaaagggctcagaggagaggcggcggccccataaggaggaagaggaagaggcgtactacccacccgcaccccctccctacagtgagaccgactctcaagcctcccgcgaacggcgcctgaaaaaaaatttggcacttagtagggagagtctggtggtctag

SEQ ID NO: 9585 - DNA, 1788 bp, Artificial Sequence
  Description of Artificial Sequence: Synthetic coding sequence
atggacttcctgctggccctggtgctggtgagcagcctgtacctgcaggctgccgcagagtttgacggcagatggccaagacagatcgtttcttccattggcctgtgccggtatgggggaagaatcgattgttgttgggggtgggcacgacagtcttggggacagtgccagcctgtctgccagccccgttgtaagcatggggagtgcatcgggccaaacaaatgtaaatgccatccaggctatgccggtaaaacctgcaatcaggacgaacacattcctgcacccctcgaccagggctcagagcagccactttttcagcctctggatcaccaggcaacatctctgccgtctagggacctgaatgagtgtggtctcaagccgcgaccctgcaaacatcgttgtatgaatacctacggatcatacaaatgttattgtttgaatggctatatgctcatgccagacgggtcctgctcatccgcccttacgtgcagcatggcaaactgccagtacggttgcgatgttgtgaagggccagatacggtgtcagtgtcctagtcccggccttcagctagccccagatggaagaacttgcgtagacgttgatgagtgcgcaaccggacgggctagctgtcctcgcttccggcaatgcgtgaatacgttcggttcttatatttgtaagtgtcacaagggctttgacctgatgtacatcggcggcaagtaccagtgccatgacatagatgaatgctctctgggacagtatcagtgcagcagtttcgcgcggtgctacaatatacgcgggagttataagtgcaagtgtaaggaggggtaccaaggggacggcctgacatgcgtgtatattcccaaggttatgatagaaccatctgggcccattcatgttcccaagggcaacgggacaattctgaagggtgatactggaaacaacaattggatcccagacgtgggcagcacatggtggccccccaaaacaccttacatacctccaatcatcaccaaccgccctaccagcaaaccaaccacccggccgacccccaagcccactccaataccaactcccccacccccccccccgcttccaacggaacttcgaacacctctgccccctacaactcctgaacgtcccacaacaggactgacaaccatcgcccctgcagcgagcacgcctcctggcgggatcaccgtcgacaacagggtgcagactgatccccagaagcccaggggagatgttttcattccacggcaaccgtcaaacgatctgttcgagatctttgagatcgagcggggagtgagcgctgatgacgaggccaaggacgacccgggggtgcttgttcactcttgtaacttcgaccacggactgtgcgggtggatcagagagaaagataacgacctgcactgggagccgattcgagatcctgcgggcgggcagtacctcaccgtgtctgctgccaaggctccaggtggcaaggctgccaggctggtcctccccctcggccgactgatgcactcaggcgatttatgcttatctttcaggcacaaggttacaggcttacactcagggaccctccaggttttcgtgcggaagcacggcgcacacggcgcggccctttgggggcgcaatggagggcatggctggcgacagactcaaattacattgcgtggggccgatatcaagagtgtggttttcaaaggcgagaaaagacgcggacatactggcgaaatagggctcgatgacgtctccctcaaaaaaggtcattgtagcgaagagcgatag

SEQ ID NO: 9586 - DNA, 210 bp, Artificial Sequence
  Description of Artificial Sequence: Synthetic coding sequence
atgaagaaccaggacaagaagaacggcgccgccaagcagagcaaccccaagtcctcccccggccaaccagaagctggatcattcgattcactggacctggagaaagtgtccctggggagagcactggcaggtaggtctgagctcgggatcagctgcctggaacaaggcacgtggcgcatgttcctgaggggtatgatgtgctggtcctag

SEQ ID NO: 9587 - DNA, 483 bp, Artificial Sequence
  Description of Artificial Sequence: Synthetic coding sequence
atggcccgggactacgaccacctgttcaagctgctgatcatcggcgactcaggagtcggcaagtctagtctgcttctccgattcgctgacaacacctttagcggctcttacatcacaacaataggagttgatttcaagatccggactgtagagatcaacggagagaaagtgaaactgcagatctgggacaccgccggccaagagcgatttagaaccattacctctacagccgagaccgccctgcgatccctgccccagcccgaagcgcacggaggaagctccggagactcattgtcatttgtccccctctttaaggagtttagcccgtgtttctgtatcggtcgatgccacaggcacttcctgcctcgtccacctcgcgtcccacgacggtgttggactagccctccatttccgactggcgcccctagctcgcccgccaaggcgcccggtcctggggaggacgccgccagacgcgcagattag

SEQ ID NO: 9588 - DNA, 360 bp, Artificial Sequence
  Description of Artificial Sequence: Synthetic coding sequence
atgaacaagatcctgagcagcaccgtgtgcttcggcctgctgaccctgctatccgtgctgtcttttttacagtccgtgcatgggcgcccatatctaacacaggggaatgagatcttcccggacaagaaatatacaaatcgtgaggaactgctcctagctctgctgaacaaaaatttcgacttccagcggccattcaacaccgatctcgccctgcccaacaaactggaggaactgaaccagctggaaaagctgaaggaacagctggtcgaagagaaggacagtgagactagttatgccgtggacggtttgttcagctctcatccctccaaacgggcttgcttttggaagtactgtgtatag

SEQ ID NO: 9589 - DNA, 2514 bp, Artificial Sequence
  Description of Artificial Sequence: Synthetic coding sequence
atgttcaagtgctggagcgtggtgctggtgctgggcttcatcttcctggaaagcgagggaagacccacaaaggagggcggatatgggcttaaaagttatcagcctctcatgcgactgcggcataaagagaaaaaccaggagagctcacgcgtaaagggttttatgatccaagacggaccatttggtagctgcgaaaataagtattgtgggctgggccggcattgcgtgacctctcgcgagactggccaagccgaatgtgcctgtatggatctatgtaagaggcactataagccagtgtgtgggtcggatggcgagttctacgaaaaccactgcgaggtccaccgggccgcctgtctgaagaagcagaagatcactatcgttcataacgaggactgtttcttcaaaggggataagtgcaagactacagaatattcaaagatgaaaaatatgcttctggacctacagaaccaaaagtatatcatgcaggagaatgaaaatccgaacggagacgacattagcaggaaaaagctcttagtagatcagatgttcaaatatttcgatgccgacagcaatggcctggtagatatcaatgaattgacgcaggttatcaaacaggaagagctgggaaaggacctttttgactgcaccctatatgttttactcaaatacgacgacttcaatgccgacaaacatctggcgctggaggagttttaccgcgctttccaggtcatccaactgtccctcccagaagaccagaagttatctattactgctgccacagtaggacaatctgccgtgctcagttgtgcgatccaggggactctcaggccacccattatatggaagagaaacaatattattctcaacaatctggatttggaagacattaacgactttggggacgatggctctctgtacattactaaggtcaccaccacccacgtaggcaactatacctgctatgccgacggatacgaacaagtctaccagactcatatatttcaagtcaatgtgcctccggtaatacgcgtctacccagaaagccaggcacgcgaacccggtgtcactgcctcactccggtgtcatgcagaaggtataccaaaaccgcagcttggatggttaaagaatggaattgacatcaccccgaaactgtcgaagcagctaacactacaggcaaatggtagcgaggttcacatttcaaacgtcagatatgaagacacaggggcgtatacatgtatcgccaagaatgaggccggcgtggatgaggatatctcctcactctttgttgaagatagcgcgcgaaagacaagactgggaatcggcaatatgttttatgtattttatgaagatggaattaaagtaatccagccgattgagtgcgagtttcagagacacatcaagccctcagaaaaattactcgggtttcaagatgaggtgtgcccaaaggccgaaggagacgaggtgcaacggtgcgtctgggcctctgctgtgaacgttaaggacaaatttatttacgtggctcagcccaccctcgatcgcgtgctgatcgttgacgttcaatctcagaaggtggtgcaagccgtaagcaccgatccagtgccagttaagttgcattatgataaatctcatgatcaggtttgggtgttgtcttggggaactctcgagaagacttcccctacactgcaagttattacccttgccagcgggaatgtgcctcaccacacaattcatacgcagccggtgggcaaacagttcgaccgcgttgacgactttttcattcccacgacgacattaatcatcactcatatgcggttcggctttattttacacaaagacgaagccgccctccaaaagatagatctcgaaaccatgagctacatcaaaactatcaaccttaaagactataagtgtgtaccccagagccttgcatacacccatctcgggggatattattttataggatgcaagccggacagcaccggagccgtgagtccgcaggtcatggttgatggggtcacagattctgtcatcgggttcaattcagacgtgaccgggaccccctatgtgtcccccgacggacactacctggtttccataaacgatgtgaagggccttgtccgcgtgcagtacattaccatccggggcgagattcaggaggcctttgatatctacacaaatcttcacatctcagatcttgcctttcagcctagcttcactgaggcccaccagtacaatatctacggctctagcagtacccagacagacgtcttgtttgtggaactctcaagcggtaaagttaagatgattaaaagcctgaaagaacctttgaaggccgaagagtggccatggaatcggaaaaaccggcagatccaggattcaggactattcggtcagtatctcatgacgccatccaaggactcactttttattctggatggacgtctgaataaactgaattgcgaaatcacggaagtcgaaaaaggaaatacagtcatttgggtgggggacgcgtag

SEQ ID NO: 9590 - DNA, 648 bp, Artificial Sequence
  Description of Artificial Sequence: Synthetic coding sequence
atggccgacatgcagaacctggtggagcggctggagcgggccgtgggtcggctggaggcagtttctcacacctccgacatgcatagaggttacgccgattcgccctcaaaagctggtgccgcgccctacgtgcaagcttttgatagtttattggctgggcctgtggcagagtatctgaaaatcagcaaggagattggtggcgacgttcaaaaacatgcggagatggtgcacaccggactgaaactggagcgggcactcctagttactgccagccaatgtcagcagcctgccgagaacaaactgagtgacttgctcgctcccatcagcgaacagatcaaggaagtgataacgttcagggagaagaatcgtggctccaaattattcaaccatttgtctgcagtcagtgaatccatccaagccctggggtgggttgctatggctcctaaacctggaccatacgtgaaggagatgaatgacgctgccatgttctatacaaacagagtgttgaaggaatacaaagatgttgacaaaaagcacgttgactgggttaaggcctatctctctatttggaccgaactccaggcatacatcaaggagttccacacaaccggactcgcatggtcaaagacaggccctgtggccaagtag

SEQ ID NO: 9591 - DNA, 3837 bp, Artificial Sequence
  Description of Artificial Sequence: Synthetic coding sequence
atgcggctgctgctgctggtgcccctgctgctggcccccgcccccggaagtagcgcccctaaagtgcgccggcagagcgacacatggggaccgtggagtcagtggtctccatgttctcgaacttgcggaggaggtgttagtttcagagaacgaccttgctacagccaaaggagagatggggggtcatcttgcgttggcccggctcgtagccataggagctgcaggaccgagtcttgtcccgacggggccagggactttagagcggaacagtgtgccgagttcgatggcgccgaatttcagggccggcgttaccgttggctgccctattacagtgcaccaaacaaatgtgaattgaattgtatcccaaaaggggaaaatttttattataaacaccgagaagccgtcgtggacggaactccatgtgagccaggcaaacgcgacgtctgcgtggacggtagttgcagagtagtcggctgcgaccatgagcttgatagctcaaagcaggaggacaaatgcctgcgctgtggcggggatggaacaacatgttacccagtggcagggacctttgatgccaatgatctctcacggggctacaaccaaattttgatcgtgccaatgggcgccacctccatccttattgatgaggccgccgctagtagaaacttccttgcagtgaaaaatgtgagaggagagtactatctcaacgggcattggacaattgaagctgccagagccctgccagcggcatccactatcctccattatgaacggggagcagagggggacctggcccccgagaggctacacgcaagagggcccacctctgaacccttagtaattgaactgatatcacaagagcccaaccccggcgtgcattatgagtatcacctgcccctgcgacgcccatcacccggtttttcttggtcccacgggagttggtctgactgctccgctgagtgcgggggaggtcaccaatctcgcttagtcttctgcaccattgaccatgaagcctacccagatcacatgtgccagcggcaacctcgacccgctgaccgccgctcctgtaacctgcacccttgtcccgaaacaaaaaggtggaaagccggcccctgggctccctgtagcgcttcctgcggtggaggatctcagtcccggagcgtctactgcatcagcagcgacggtgctggaatccaggaggctgtggaagaagccgaatgtgccgggctgcccggcaaaccacctgccatccaggcctgtaatcttcagcgatgcgcagcttggtcccccgagccatggggggagtgctccgtgtcttgcggtgtgggggtgcgtaaaagatccgtgacctgcagaggtgaaagggggagcctcctgcataccgctgcctgctctttggaggaccggcccccgcttacagagccctgtgtccatgaagattgtccactcctttccgaccaggcttggcatgtcggaacgtgggggctgtgctccaaatcctgcagcagtgggacccgtcggcggcaggtgatctgtgcgatcggacctcctagtcactgcgggagtctgcagcacagcaaacctgttgatgtcgagccctgtaatacacagccctgccacctgccacaggaggttccctccatgcaggatgtgcacacacctgcatccaatccctggatgccactgggacctcaggagtcccccgcctcagacagcagaggtcagtggtgggccgcgcaggaacacccttctgctaggggcgatcacaggggcgaacgtggcgacccccggggggatcaaggcacccatttgagcgcccttggcccagcaccatcattgcaacagcctccataccaacaacccctccgttctggttctggcccccatgattgtcggcactctccacacgggtgctgccccgatggccacacagcgtcgctgggcccacaatggcagggatgcccaggtgccccctgtcagcagtcccggtacggatgttgtcccgaccgggtttctgtggcagaaggcccacaccacgctggctgcaccaagagttatggtggagacagtactggaggtatgccacgcagcagagctgtcgcttccactgtgcacaacacccaccagccccaggcccagcaaaacgaacctagcgagtgtaggggatcccagttcgggtgttgttacgacaatgtagcaaccgccgccggccctcttggggaagggtgcgtgggacaaccctcacacgcataccctgtccgatgcctgctgccaagcgctcacggttcatgcgccgattgggccgctcgctggtactttgttgcttcagtgggccagtgcaatagattttggtacggtggctgtcatggcaatgcgaataatttcgcctctgagcaagaatgtatgtctagctgtcagggcagcttgcacggacctaggaggccacagcccggggcaagtggaaggtcaactcacacagatggagggggatcctccccggctggcgaacaggagcctagccagcacagaaccggggccgccgtacagaggaaaccctggccttctggggggctttggagacaggaccagcaaccaggcccaggggaagcaccccacacccaagccttcggcgagtggccgtggggacaggagcttggctcgagagcgcctggtctcgggggggatgctggaagtccagcacccccattccattcgagctcctataggatatcgctggcaggggtcgaacccagcctcgtgcaagcggcactaggccaactggtgcggttgtcttgcagcgatgatacagcgcccgagagtcaggcagcgtggcagaaagatgggcagccaatttcatccgatcgtcataggttgcagttcgacggatctcttatcatccacccccttcaggcggaggacgccggaacctacagctgcggatcaaccaggcccggccgtgatagccaaaaaatacagcttaggatcattggtggggacatggccgtgttgagtgaggctgaactcagccggttcccacaaccccgggaccccgcccaggactttgggcaggctggagctgctggaccactgggagctattccgagttctcatccccagcctgcgaaccggttacgtctcgatcagaatcagccgagagtggtggatgcttcccctggtcaacgaatcagaatgacgtgccgggcagaaggctttcctcctcccgctatcgagtggcaacgcgacggccagccagttagctctccgagacatcagttgcagccagacggaagcctcgtgatatctcgcgtggctgtcgaggatggaggcttttatacctgtgtggcattcaacggacaggatcgcgaccagcgttgggtccagctgagagtgttgggcgaattgactataagcgggctcccgccaacagtgactgtgccggagggagataccgccaggctgttatgcgtagtggctggagaaagcgttaatattaggtggtcgaggaacggcttgccagttcaagccgacggccaccgggtccaccagtctcccgatggaacactcctcatctataacctacgtgccagagacgaaggctcatatacatgtagtgcataccagggaagtcaggctgtttcgagatccactgaggtaaaagtggtgtcacccgcccccacagcacaaccaagagatcctggaagagattgtgttgaccagcccgagctggcgaactgcgaccttatcctgcaagctcaactctgcggaaacgagtactattcctctttttgctgtgcatcctgctctcgctttcagcctcatgcacagccaatatggcaatag

SEQ ID NO: 9592 - DNA, 546 bp, Artificial Sequence
  Description of Artificial Sequence: Synthetic coding sequence
tgaaagggccacgccagccccctgccccccagcgccgcccccaccactgactctacagacagcataactggacagaactcacgccagcgagaggaggaactggaactcattgaccaattgcgtaagcatatagagtacagactgaaagtgagtctcccatgcgatctaggcgccgcactgaccgacggggtcgtcctttgccatctggccaatcacgttcgcccccggtccgttccgtctattcacgtgccatcacctgccgtacctaagctcaccatggccaaatgtcggcgcaatgtggaaaatttcctcgaagcctgccgtaaaatcggggtgccccaggataatctgtgtagtccctcggatatcttgcagctaaatcttagcgtcaagcgcaccgtggaaacgctgctgtctttgggggcacatagcgaggagagttcgtttgtgtgcctgtcattacagctgctcgggttcgtggccttttattgtaccgtaatgctgacgctatgcgtgctatattattggttgtttccagctcgatag

SEQ ID NO: 9593 - DNA, 804 bp, Artificial Sequence
  Description of Artificial Sequence: Synthetic coding sequence
atgggccccgaggccctgagcagcctgctgctgctgctgctggtggcctcaggcgatgctgatatgaagggccactttgaccccgccaaatgtaggtacgctttggggatgcaggataggaccattccagactcagacatctcagcatcatcctcatggagcgactccaccgccgcaagacattctcggctcgaaagtagcgatggcgacggcgcctggtgtcctgctgggtcagtgtttccaaaggaggaagagtatctgcaggttgacttgcagagactgcatctggttgctctggtgggaactcagggacgccacgcaggggggctgggcaaagaattttcaagatcttaccgactgaggtactctcgtgatgggcgaagatggatgggatggaaggacaggtgggggcaagaagtaatctcaggcaatgaagaccccgagggagtggtgctgaaggacctggggcctcctatggttgcccgacttgtgagattttatccgcgggccgaccgagttatgtctgtgtgcctgcgcgtcgagctgtacgggtgcctttggcgggacggccttcttagctacacagccccagtggggcagaccatgtacctgagcgaagctgtgtacttaaatgacagcacttacgatggtcacactgttggcggcctgcaatatggagggctagggcaactggccgatggcgttgtggggctcgacgatttccgaaagtctcaggagttgcgggtttggcccggttatgactatgtcgggtggtccaatcactccttttcatctgggtattag

SEQ ID NO: 9594 - DNA, 345 bp, Artificial Sequence
  Description of Artificial Sequence: Synthetic coding sequence
atggcccccaagaagctgagctgcctgcggagcctgctgctgccccttagccttaccctgctgttacctcaggccgatacccggtctttcgtggtcgatcggggacacgaccggtttttgctggacggggcacccttccggtacgtttctggttctctgcattattttagagtgcctcgggtgctgtgggcagaccggctcttgaaaatgcgctggagtggactgaatgccattcagttctacgttccgtggaattaccatgaaccacaaccaggcgtttacaattttaatggtagtcgcgacttaattgcgttcctgaatgaagcagctttggcaaacctgtag

SEQ ID NO: 9595 - DNA, 507 bp, Artificial Sequence
  Description of Artificial Sequence: Synthetic coding sequence
gccccccggatggagatgttccagggcctgctgctgctgctgctgctctctatggggggcacttgggcaagcaaggagccactccggccgagatgtaggcccatcaacgccactctggctgtggagaaggaagggtgcccagtgtgcatcactgttaatactactatctgtgcgggctactgccccacgatgactcgcgtgttacagggagtactgcctgcactgccccaggttgtctgcaattatcgagatgtccgcttcgagagcattaggctgccaggctgcccgagaggtgttaacccggtcgtatcctacgcagtggccttaagctgtcagtgcgcgctctgccggcggagcacaaccgattgtgggggcccaaaggaccaccctctgacatgcgacgacccaagatttcaggacagttcgtcatcaaaagcgcctccaccgtccttgccgtccccttccagacttccagggccctctgatactcctatactgcctcagtag

SEQ ID NO: 9596 - DNA, 1203 bp, Artificial Sequence
  Description of Artificial Sequence: Synthetic coding sequence
atggagacccaggagctgcggggcgccctggccctgctgctgctgtgcttcttcacctccgcgagccaagacttgcaggtgatcgaccttctgaccgtcggcgagagccgccagatggttgctgtcgcagagaaaatccggaccgctctgttaacagctggagacatctaccttttgagcacctttcgtctgccacctaaacagggcggagtactgttcgggctttactctaggcaggacaacacccgctggctggaggcttcggtggtgggcaaaattaataaagtgaccaacgccctccattctattctcggcgaggggaacgtgcccgatccaaagcaccactacggcgtgagtggttttcacgagcagcgaagccactgcagcccaaatccatgctttcggggggttgactgcatggaagtctacgagtacccaggatataggtgtgggccttgcccccccggtctgcagggaaacggaacacactgctccgatatcaatgagtgcgctcacgcggatccatgtttccctggctcatcctgtataaacacgatgccaggattccattgtgaggcctgcccccggggatacaaggggacccaagtatccggagtgggcattgactatgcgcgggcctccaaacaggtgtgcaacgacatagacgagtgcaacgatgggaataatggaggctgcgatccgaactcaatctgtacgaataccgtcggatctttcaagtgtgggccgtgccgcctcgggtttcttggaaatcagtcacagggatgcttacccgctcgaacctgccacagccctgcccacagcccatgtcatatccacgcacactgccttttcgaaaggaacggtgcggtgtcttgtcagtgtaacgtggggtgggccggtaatggcaacgtgtgcggaacagacacagatattgacgggtatcccgaccaagccctcccttgcatggacaataacaagcactgcaagcaagacaactgtttgctaaccccaaacagcgggcaagaggatgcagacaacgatggagtgggggatcagtgtgatgacgacgctgatggagatggaatcaaaaacgtggaagcctcaccaatggactggactatcgctctcaaaagtccaacccattaccggcaaacaggcatgcgcaccggatgggagatgctggcaactgccgcgttaaagtag

SEQ ID NO: 9597 - DNA, 618 bp, Artificial Sequence
  Description of Artificial Sequence: Synthetic coding sequence
atgatgcggaccctgatcaccacccaccccctgcccctgctgctgttgccacagcagctgctgcagctggttcaatttcaggaagttgatactgacttcgactttccagaagaagataaaaaggaagagtttgaagagtgcctagagaagtttttcagcaccggcccggcccggccccccaccaaggagaaggtgaaaagaagagtgcttatcgagcccggcatgcccttgaaccatattgaatactgcaaccacgaaataatgggcaagaatgtgtactacaaacatcgctgggtggcggaacattatttcttgttaatgcagtacgacgagctgcaaaagatctgctataaccggttcgtcccttgcaagaacgggattcggaaatgcaatcgcagtaagggactggtggagggtgtgtattgtaatttaacagaggcatttgaaataccggcatgcaaatatgagagcctttataggaagggttacgtactcatcacatgttcctggcagaacgagatgcagaaacggattccccacacaataaatgacctggtggaaccgcccgaacatcgcagcttcctgtcagaggacggagtcttcgtaatctctccctag

SEQ ID NO: 9598 - DNA, 177 bp, Artificial Sequence
  Description of Artificial Sequence: Synthetic coding sequence
atggacctgctgcagttcctggccttcctgttcgtgctgctgctgtctggcatgggcgccacaggcacactccgtacaagtctggaccccagtcttgagatttataagaaaatgttcgaggtgaagcgccgcgaacaacttcttgccctaaagaacctggcgcagctgaacgactag

SEQ ID NO: 9599 - DNA, 450 bp, Artificial Sequence
  Description of Artificial Sequence: Synthetic coding sequence
atgaaggtgatcgccatcctgaccctgctgctgttctgcagccccacacatagcagcttctggcagtttcagcgcagggtcaagcacattaccggaagaagcgcgttcttttcttattatggttacggttgttattgcggcctgggagacaagggtatacccgtcgatgatactgaccgccatagcccatccagcccgagcccatacgagaagttgaaggagtttagctgtcaacctgtgcttaattcttaccagtttcacattgtgaatggggctgtcgtttgtgggtgcactctgggaccaggtgcaagttgccactgccggctgaaagcatgtgagtgcgacaaacaaagcgtccactgcttcaaggagagtctccctacatacgaaaagaatttcaagcagttctcgtcccagccgagatgtgggcgtcataaaccctggtgctag

SEQ ID NO: 9600 - DNA, 237 bp, Artificial Sequence
  Description of Artificial Sequence: Synthetic coding sequence
atgggcagcggcctgcccctggtgctgctgctgaccctgctgggcagttcacatggtactggacccggtatgactctacaacttaaactgaaagagagcttcctgaccaacagttcatatgaatctagctttctggagctgctggaaaaactttgtctgctcctgcatctaccctccggtacaagtgtgaccctgcatcatgcccgctctcagcaccatgttgtgtgtaacacatag

SEQ ID NO: 9601 - DNA, 1461 bp, Artificial Sequence
  Description of Artificial Sequence: Synthetic coding sequence
atgatcagccccagccccagccaggaggagctgcagaccaccctggaggaaactgatcaaagcacccaggaaccttttacgaccaagatccctcgcacaaccgagctggctaaaactacacaggccccacatcgcttctacaccaccgtacggcccagaaccagcgataaaccgcatattcgacctgttctcaatagaacaaccacccgtcccacgcgcccaaagccttctggtatgcccagcgggaacggcgtaggaacaggtgtcaagcaggcccctcgcccttcaggtgcggaccgcaacgtatccgtggattccacacaccctactaagaagcccggcactcggcggccccctctgcccccacgtcccacgcatcctcggcgcaaacccctccctccgaacaacgtcacaggcaagccaggatcggccgggatcatctcgagcggaccgatcaccacaccaccattgagaagcacacctagacccactgggacgcctctagaaagaatcgagaccgatattaagcaaccaaccgtaccggcgagtggcgaggaattggaaaatatcacagacttctctagctccccaacacgggagaccgacccacttggcaaaccaaggtttaagggccctcacgtgcgatatatccagaagccggacaactcaccctgctcaattaccgattcagtgaaaaggttcccgaaagaagaggccaccgaaggaaatgctacgagcccccctcagaatccccccacaaatttgaccgtagtgaccgtagagggctgcccgagtttcgtcattctcgattgggagaaaccactcaatgacaccgtcacagagtacgaggtgatcagccgggagaacggatccttcagtggcaagaataagagtattcaaatgacaaaccagacatttagtactgttgaaaatcttaagcctaacacctcatatgaattccaggttaaacccaaaaacccgctcggtgaaggtcccgtgtcgaataccgtggcattcagcaccgagagtgccgacccccgcgtgtccgagcctgtgagcgcaggacgggatgccatctggacagagcgcccctttaatagcgactcttatagtgaatgcaagggtaagcagtacgtcaaacgaacatggtacaagaaatttgtaggagtgcagctgtgtaactccctgcgctacaagatctatttgagcgattcgctgaccgggaaattttacaacataggggaccagcggggccacggcgaggaccactgtcaattcgtcgactcgtttttggatggtaggaccgggcagcaactgacgagtgaccagctccccattaaggaaggatattttagagcagttcgacaagaaccggtgcagtttggcgagattggagggcatactcagatcaactacgtccagtggtatgaatgcggaaccaccatccccggtaagtggtag

SEQ ID NO: 9602 - DNA, 243 bp, Artificial Sequence
  Description of Artificial Sequence: Synthetic coding sequence
tgaaacggccccgtgctgtggttcaagggcaccggccccaaccggaagttgatttataactttaaacaggagcagaatccgcggccacccaagaaccgcccagccgggcgcgccggctcccgggcccatcacgatgcacacacctgccttagcgcattaccagaacggaacagtaccaattacttcgtgcagccctgctgctgcttaaggctgctgggtctgactggattactgtctaaatag

SEQ ID NO: 9603 - DNA, 1341 bp, Artificial Sequence
  Description of Artificial Sequence: Synthetic coding sequence
atgctgcaccccgagaccagccccggccggggccacctgctggccgtcctgctcgccctgctgggcactacttgggccgaagtctggcccccccagcttcaggaacaggcccccatggcaggcgccctcaataggaaggagtctttcctgttgttgtctctgcataaccggcttcgcagttgggtgcaacctcccgccgccgatatgagacggctagactggtctgacagtctcgcccagctggcgcaagctagggctgctttatgcggaatcccgacaccctcactggcgtccggcttgtggcgtaccctccaggtaggatggaacatgcagctcctgccagcaggtcttgcgtctttcgttgaagtggtgtccttatggttcgctgaaggtcagcgatacagccacgccgcaggcgagtgtgctcgtaatgccacctgtacccattacacccagctcgtctgggctacttccagtcaactcgggtgcggccgtcacctgtgctcggcaggccagaccgcgatcgaagcatttgtctgtgcatacagcccccgaggcaactgggaagtgaacggaaaaaccattattccctataaaaagggggcctggtgtagtctctgcaccgcgagcgtgagtggatgttttaaggcctgggatcacgcaggaggcttgtgcgaggtgcctaggaacccgtgtaggatgtcctgccaaaaccacggtaggctaaacatatccacctgccactgccactgtcccccaggctacaccggccgctattgtcaggtaagatgctctctgcagtgcgtgcacggccgatttagagaggaggagtgttcctgtgtttgtgatatcggctatggcggagcccaatgcgccactaaggtgcattttccttttcatacatgtgatctgcggatagacggtgattgctttatggtgagctcagaagccgatacatattacagagccaggatgaaatgccagcgcaagggtggagttctagcccagattaaatcacagaaggtccaggacattctcgccttctatcttggtcgactagagacaactaacgaggttattgattccgatttcgaaacaaggaacttctggattggcctcacctataagaccgctaaggacagcttccgatgggcaacaggcgaacatcaggctttcacctccttcgcgttcgggcagcccgacaaccatggatttggtaattgcgtggaattgcaggcttcagctgctttcaactggaacgaccaaaggtgtaagaccagaaaccgctacatatgccagttcgctcaagagcacattagcaggtggggccccgggtcgtag

SEQ ID NO: 9604 - DNA, 432 bp, Artificial Sequence
  Description of Artificial Sequence: Synthetic coding sequence
atgcaggccgcctgctggtacgtgctgttcctgctgcagcccaccgtttacctggtgacgtgtgccaatctcacgaatgggggtaagagtgagctcttgaaaagcgggagcagtaagtctactctcaaacacatatggactgagagctccaaggacctgtcgatctccaggttgttaagccagacatttcgaggaaaagaaaacgacacggatttagacttgagatatgacactcctgaaccttacagcgagcaggatttgtgggattggctcagaaactcaactgacttgcaggaaccacgtccccgggcaaaacgtagacctatcgtaaagactggaaagtttaagaagatgtttgggtggggagattttcattcaaacattaagactgtgaagctgaacctgctgatcactggcaagatcgtcgattag

SEQ ID NO: 9605 - DNA, 783 bp, Artificial Sequence
  Description of Artificial Sequence: Synthetic coding sequence
atgcagggcgagcccttcgcctgcctgacccaccaggagcccctgccaaaaatgtttaaactgctgtctcgggcctacgcagacgtgcacccaatgatgatggacaggtccgagaatcgctgtggcgggaacttcctgaaacggggatctataatcaacggagcagattggtacagttttacgggaggcatgtccgattttaattatttacatacaaattgtttcgaaataactgtggagctgggctgcgtgaagtttccaccagaggaggctctgtacattctgtggcagcacaataaggagagcctgcttaattttgtggaaacggtgcacagaggcatcaagggggtggtgaccgacaagttcggaaagccggtgaaaaacgcgcgcattagtgtcaagggaatacgccacgacataactaccgccccagatggcgattattggagacttctgccacctggcatccacatcgtaatcgctcaggcccctgggtacgcaaaggtcatcaaaaaagttatcatcccagccagaatgaaacgagccggaagagtggacttcattctgcagccactagggatgggccctaaaaactttatccacggactgcgacggacaggacctcacgatccactgggaggtgccagttccttgggtgaagccacagaacccgatcccctccgtgctcgccgacagccatcagccgacgggtcaaaaccatggtggtggtcgtactttacgagcttgtcaactcatcgtcctcgatggctgcttaagtattag

SEQ ID NO: 9606 - DNA, 882 bp, Artificial Sequence
  Description of Artificial Sequence: Synthetic coding sequence
atgagcagcggcggcggcagccggggcctgctggcctggctgctgctcctgcagccgtggcctggtcaaaactgggcaggcatggctgcccctcgcctgccatctcccttattgagtgaggagggaggagaaaaccctgaggccagcccagccccggggcctgaggcaggaccgccactcaacctcttcacatcctttccaggcgactccttactgtgcggcaggactccccttcgcattgtggggggcgtagacgccgaagagggaagatggccctggcaagtgtctgtcaggaccaagggacgacatatatgtggggggacactcgtgacagctacgtgggtgttaacggcggggcactgcattagctcacggttccactattcagttaagatgggtgataggagcgtgtacaacgagaatacctctgtggtggtttccgttcagagggcctttgtccatcctaaattctcaaccgttaccacgatcagaaacgatctggcccttctacagctgcagcatccagtgaattttacttcgaacatacagcccatttgcatcccccaagagaattttcaggtggaaggccgtacacgatgctgggtcacggggtggggtaagacacccgaacgcgagaagctggctagtgagatcttgcaggatgtggatcaatatataatgtgttatgaagagtgtaacaaaatcattcagaaagcccttagttcaacaaaggatgtgatcatcaaagggatggtctgtggatataaggaacagggcaaagactcatgtcagggggattccggagggaggctggcatgtgagtataatgatacatgggtccaggtcgggatcgtgagctggggaatagggtgtgggcggtag

SEQ ID NO: 9607 - DNA, 870 bp, Artificial Sequence
  Description of Artificial Sequence: Synthetic coding sequence
atgttcgtgctgctgtacgtgaccagcttcgccatctgcgccagcgggcaacctcgagggaaccagctcaagggagagaattacagcccccggtatatatgcagcatacccggactgcctgggccacccggaccgccaggagctaacggtagtccaggtccgcatggccgaattgggttacctggccgagacggtcgggatgggaggaagggtgagaagggtgagaaaggcacagccgggttaaggggcaagactgggccactcggcctggccggggagaagggagaccagggtgaaacggggaaaaagggtccaattggtccagaaggagagaaaggagaggtcggcccaataggtcctccaggccctaagggtgataggggggaacagggagaccctggattaccgggtgtgtgtcggtgcggatcgatcgtactcaagtctgcattctcagtaggtatcaccacgtcttaccccgaggaacggctacctataatctttaataaagtcctttttaatgagggagagcattacaaccctgcgacaggtaaatttatttgtgcttttcctggcatctactacttcagctatgacattaccctggcaaataagcatcttgccattgggctggtccataatggacagtatagaataaaaactttcgatgcgaacactggcaaccacgatgtcgcctcagggagcactgtcatttatcttcaaccggaagacgaagtgtggctggagattttcttcactgatcagaacgggttattctctgatccagggtgggctgacagcctgttcagtggcttccttctgtacgttgatacagattatctggatagcatctctgaggatgacgagttgtag

SEQ ID NO: 9608 - DNA, 2742 bp, Artificial Sequence
  Description of Artificial Sequence: Synthetic coding sequence
atgggccccgaggccctgagcagcctgctgctgctgctgctggtggcctctggggatgccgacatgaagggacactttgacccagctaagtgccggtacgctcttggtatgcaggatcgtactattcctgactcagacatcagcgcttcctcctcgtggtctgattcaactgctgcccggcactccagactggagagctctgatggagacggtgcatggtgtcctgctggctcagtgttcccaaaggaggaggaatatctgcaggtggatctccaaagacttcatctggtggcactggtgggtactcagggacggcatgccgggggcctgggcaaagaattctctaggagctatcgacttagatacagtagggacggtcgccggtggatggggtggaaggaccgatggggacaggaagtaatctctggaaatgaagaccctgaaggcgtggttcttaaggatctgggcccccccatggtcgctcgcctggtaagattctatccaagggctgatcgggtgatgagcgtgtgcctccgggtggaactctacggttgtctgtggagggatggtttgttaagctatacggccccagtcggacagacgatgtacctgtccgaggctgtgtatcttaatgattcgacatatgacggtcacaccgtgggcgggctccagtacggtgggctcggacagctcgcggatggggttgttgggcttgacgattttcgtaagtcacaggagttgagagtgtggcccggctatgactacgtggggtggagtaaccatagctttagctcagggtacgtagagatggagttcgaattcgataggctgcgggcctttcaggcaatgcaagttcattgcaataatatgcacaccctgggcgccagattacccggtggcgtggagtgccgttttagacggggcccagcgatggcttgggagggggagcctatgagacacaacctgggtggcaatctgggcgatcctagggcgcgcgcagtgagcgtgcccctgggtggacgggttgcgcgcttcctgcagtgtcgattcctctttgcggggccatggctcctttttagcgaaatcagttttatctctgatgtggtgaacaactctagccctgcccttggaggtacttttccccccgcaccctggtggccccccgggcccccacccacaaacttttcctcactggagctggagccgcgtggccagcaacccgttgccaaagccgagggtagccccacggcaatactgattggatgcctggtggccataattttgctcctcctcctgattatcgcacttatgttgtggcggctccactggaggagattgctgtctaaggccgagcgaagggtcctggaagaggagctaacggtgcacctatcagtcccgggagacactattctcataaacaatcggcctgggccccgtgagcctccaccttaccaggaacctaggcctcgaggcaacccacctcattcagcaccatgcgtgcctaatggttcggccttgctgctgagtaacccagcctaccgcttactccttgcgacttacgcccgtccaccacgtggcccaggtccaccaactcccgcatgggctaagcccacgaatacccaggcgtatagtggcgactatatggaacccgagaagcccggcgctcccctcctgccccctcccccccagaactcagtcccgcactatgcagaagctgacatcgtaactcttcagggagtcaccggaggaaatacttatgctgtcccagcacttccaccaggcgctgttggggacgggcccccacgggttgacttcccacggtcaaggctaagattcaaagagaaactgggggaagggcagttcggagaggtccacctttgcgaggtcgactccccacaggacttagtcagcctagacttccccctcaatgtgcgcaaaggacatccgctgctggtcgcagtaaagatcctgagacccgacgcaaccaaaaacgcgcggaacgactttctgaaagaggttaagattatgagcagactgaaggacccaaacatcatccgcctcctgggagtatgtgtacaggatgacccactctgtatgatcactgactatatggagaacggtgatctgaaccagttcttgagcgctcaccagctcgaagacaaagctgccgagggggcccctggggacggtcaggcggcacaagggccgacaattagttaccccatgcttctgcatgttgcagcgcagatcgcgtccggaatgagatatctggcgacgcttaacttcgttcacagggatctcgctactcggaactgtctggtgggagaaaacttcaccatcaagatcgctgactttggaatgtcgcgtaacttgtatgccggggactactaccgcgtgcagggccgggctgttcttcccattagatggatggcatgggaatgcatcctcatgggcaagttcaccacagccagcgacgtgtgggcgttcggagtcaccttgtgggaagttctgatgctgtgccgcgctcaaccattcggccaacttaccgacgaacaggtgattgaaaatgcgggagaattctttcgtgaccagggcaggcaggtgtatctctcaaggccccccgcgtgcccccagggcctatacgagctgatgctgcgatgttggagcagagagtctgagcagcgccctccttttagccaattgcacagatttctggccgaagacgccctcaacaccgtgtag

SEQ ID NO: 9609 - DNA, 1089 bp, Artificial Sequence
  Description of Artificial Sequence: Synthetic coding sequence
atgcggaccctgttcaacctgctgtggctggccctggcctgcagcccagtacacacgacactgtccaagtccgatgccaaaaaggccgcaagtaagactctgttggaaaaatcccagttctctgataagcctgtgcaagacagaggactcgttgtaactgatttgaaggccgagtcagtggtgctggagcatcggagctattgtagcgctaaggcccgcgaccgtcacttcgctggggatgtgctaggttatgtgaccccctggaattcacatggctatgacgtgacaaaggtgtttgggtctaagtttacgcagatcagtcctgtctggttacagttgaagagacggggacgggaaatgtttgaggtaactggtctccatgatgtggaccagggctggatgcgggccgtgaggaaacacgccaaaggtctgcatatcgtacccagactattatttgaagattggacttacgatgactttcggaatgtgctcgactctgaagacgaaattgaggagctgtcaaagacagtggtccaggtcgctaagaaccagcactttgacggctttgtagtggaagtgtggaatcagctcttatctcagaaacgtgttaccgatcaattgggaatgttcactcataaggaatttgagcagttggcgccagtcctagacgggtttagtctgatgacttatgattacagcactgcacatcagcctggtcctaatgcaccattaagctgggtaagggcgtgtgtacaagttctggaccctaaatctaagtggcggtcgaagatcctcctaggcttgaacttctacggcatggactacgcgacctctaaggatgctcgcgagcccgtggttggagcccgctacatacagaccctgaaagaccacagaccacgaatggtgtgggatagccaggcgagtgagcatttttttgagtacaagaagtctcgaagcggccgacatgtggtgttttaccccacactgaagagtttacaagtgcggctagagcttgccagagagctcggagtgggtgtgtccatttgggaactggggcaaggcctcgactacttttatgatctgctctag

SEQ ID NO: 9610 - DNA, 1350 bp, Artificial Sequence
  Description of Artificial Sequence: Synthetic coding sequence
atgaagttccagggccccctggcctgcctgctgctggccctgtgcttaggttccggcgaagctggtcctctgcagtctggggaagagtcaaccggaacgaacatcggcgaagcattaggccacgggctgggggatgccttatcagagggagtgggaaaggctatcggcaaggaagcaggcggagcggccggttccaaggtgtccgaggcactgggccagggcaccagggaggcggtgggaaccggcgtaaggcaagtgcctgggttcggcgtggccgatgccctgggaaacagggtgggtgaggccgcacacgcccttggcaacactggacatgagataggcaggcaggccgaggatgtgattcgccacggcgctgacgccgtcaggggaagttggcagggagtcccaggccacaatggcgcctgggaaacgagcggcggccacggcatcttcgggagccagggaggacttggaggccaaggacagggcaatccaggtggcttaggaactccctgggtgcatgggtatcccggcaactccgctgggagtttcggcatgaatcctcaaggcgcgccttggggacagggggggaatggaggacctccaaatttcggaacaaatacacaaggtgcggtggcacagcccggatacggcagcgtgcgcgcgagtaaccagaatgaaggctgcaccaaccccccaccatccggaagcggcggcggaagcagcaactccgggggatcatccacgggatccagttctggcaaccacggcggctccggcgggggaaatggacacaaacctggatgtgaaaaacccgggaacgaagcaaggggatccggtgagagtggcatccaggggcagggatcttcttggggttccggcgggggggatgcggtgggcggagtgaataccgtcaactctgaaacaagccccgggatgtttaattttgacaccttttggaagaactttaaatcaaaactggggttcattaattgggatgcaatcaacaaaaaccaggttccccctccaagtacaagagccctgttgtatttcagccggctatgggaagatttcaaacagaacaccccatttctgaactggaaggccatcatagaaggcgccgacgcctcctctctgcagaagcgcgccggcagggatgaccagccaggcgctgggtggcaagaagtcgctgccgtgacatccaagaactacaactataatcagcacgcttacccgaccgcttacggagggaagtacagcgtgaaaacccccgcaaaagggggggtgagtcccagctccagcgcttcgcgcgtgcagcctggactgctgcaatgggttaaattctggtag

SEQ ID NO: 9611 - DNA, 735 bp, Artificial Sequence
  Description of Artificial Sequence: Synthetic coding sequence
atgtggggcgcccccctgccccggcggcccgtgtgggacgtgcggtccgcttccgcagggccacagccatgtttgggtggcaagatgaaactgaatcttgtccagatatttttcatgctcctgatgttgctcttagggctcgggatgggtctggggctcgggctgcacatggcaacagctgtactggaggaaagcgatcaacctcttaacgagttctggagcagcgactctcaggacaaggccgaagctaccgaggaaggcgacggaactcagactaccgaaacactggtgcttagcaataaggaagtggtgcagcctggctggcccgaagatccgatccttggtgaagacgaagtgggagggaacaagatgttacgggcatcagcgctgttccagtccaataaggattacttgcgcctcgatcagactgacagagaatgcaacgatatgatggcgcacaaaatgaaagaacccagccaaagttgcattgcgcagtacgcctttatacacgaggatctgaacactgtcaaggctgtctgtaactcgcccgtaatagcttgtgagctgaaggggggcaagtgtcacaaaagctccagaccattcgatctgacactgtgtgagttgtcccagcccgatcaggtgaccccaaattgtaactacctgacatctgtaatcaagaaacacattatcataacgtgtaatgatatgaagcgccaattgcccaccgggcagtag

SEQ ID NO: 9612 - DNA, 1728 bp, Artificial Sequence
  Description of Artificial Sequence: Synthetic coding sequence
atggccagctggctgcggcggaagctgcggggcaagcggcggcccgtaattgccttctgcctgctgatgattctgagtgctatggccgtgacccggttcccccctcagaggcccagcgcaggcccagaccccggaccgatggaaccacagggagtaactggtgctccagccactcacattagacaggcattaagctctagcaggaggcaaagagccaggaatatgggtttctggcgaagtagagcactcccaagaaatagtatactggtctgcgccgaggaacagggccacagagcccgtgtggatcggagtagagagtctcctggcggggatctgagacacccagggagagtcaggcgggatatcaccttgagcggacatccacggttgtctacacagcatgtcgtcctgctgcgcgaagatgaagtgggggatccaggcaccaaggatttaggccacccacagcacggaagcccaattcaggaaactcagagtgaggtcgtaacccttgtttcacccctgcctggaagcgatatggcggcgctgccggcttggcgcgcaacttcagggttgacactgtggccccataccgcggagggcagagatctgctaggcgccgagaatagggctctgacaggaggtcagcaggctgaggacccaactctagcatcgggagctcaccagtggcctggatccgttgaaaagcttcaaggttcagtgtggtgcgacgcggaaacactactatcatctagccggaccgggggtcaggccccaccatggctaactgaccatgatgtgcagatgctaagactgttggctcagggtgaggtcgtggacaaggccagggtacctgctcatggccaggtgctgcaggtagggttcagcacagaggccgctctgcaggacctgagcagcccaaggctgagtcagctgtgttctcagggtttgtgcggcttaattaaacggcccggggatctccccgaagtgctgagcttccacgtcgaccgggttttgggactgcgccggtctttgccagctgttgctaggagattccattcacccctgcttccttatcggtacaccgatggcggggccagacctgttatatggtgggcccccgacgtgcagcacctttccgaccccgatgaggaccaaaattccctggcgctgggatggcttcaatatcaggcactcctggcgcatagctgcaattggccagggcaggccccttgccccggcattcaccacaccgagtgggcacgcttggctcttttcgattttctgttgcaggtccacgaccgactggacagatactgctgtggttttgagcccgagccctccgacccttgcgtcgaagaacgccttagagagaaatgccaaaatcccgccgagctcaggctggtccacatcctagttcgtagctccgatccatcacacctggtgtacatcgataatgcaggcaatctccagcaccctgaagacaaactcaattttagactattggagggaattgacggttttcccgagtcagccgtcaaagtgttagcatcaggttgtctgcagaacatgctgctcaagtcactgcagatggatccagtattctgggaatctcaggggggagcacaggggttaaagcaggtgttgcagacattggaacagagaggtcaagtgctgttgggacacatccagaagcataatcttacactgtttagggacgaggatccatag

SEQ ID NO: 9613 - DNA, 390 bp, Artificial Sequence
  Description of Artificial Sequence: Synthetic coding sequence
atggccgccggcagcgcccccatgcagctgcacctgcgggccaccattagaatgaaagacggcctctgcgtgccacgcaaatggatttatcacctgaccgagggatcaaccgacctgcgaacagagggaagacctgatatgaagaccgagttattctcatcttcctgtccaggcggaataatgctgaatgaaactgggcaaggctaccaaagatttctgctatataataggtcaccacatccaccagagaagtgcgttgaggaatttaagtcgctgacaagctgcttggacagtaaggccttcctgctcacccctagaaaccagggaaagggtctcaaaagccacaagaccggcctaggccttaccaaaagcagtggtgttacgggatag

SEQ ID NO: 9614 - DNA, 567 bp, Artificial Sequence
  Description of Artificial Sequence: Synthetic coding sequence
atgttccaccagatctgggccgccctgctgtacttctacggcatcattttgaactccatttaccagtgtccagagcacagccagctaacaaccctgggcgtagatgggaaggagtttcccgaggtccacttgggccagtggtattttattgctggggccgcgccaaccaaggaggagctcgccacctttgatcctgtggacaacatcgtgtttaacatggcagcaggctccgcccccatgcagctccatttacgggccaccattaggatgaaagacggcctgtgtgtgccccggaaatggatctatcacttaaccgaagggtcaaccgatctacggacggagggccgcccggatatgaagaccgaactgttctcatcctcctgtcccggcggcataatgttgaacgaaacagggcaaggatatcagcgatttctgttgtacaaccgttctccacacccacctgaaaaatgtgtggaggaatttaagagcctgacctcatgcttagactctaaagcgttcctgctgacccctagaaaccaggaggcttgcgagctgagtaacaattag

SEQ ID NO: 9615 - DNA, 2676 bp, Artificial Sequence
  Description of Artificial Sequence: Synthetic coding sequence
atgctgcccaccgaggtgccccagagccaccccggccccagcgcccttctgcttctgcagttgctccttcccccaacttcagctttcttcccaaatatatggtcgctactggcagcccccggatcaatcacacaccaggacctaaccgaagaggcagctttgaacgtgacactccaactgttcctcgaacagcctcctccagggcgaccgccgcttaggctggaggacttcctggggaggacattactggccgatgatttgttcgcagcatatttcggccctggttctagtcgcaggttccgcgccgccttgggggaggtgtctagggctaacgcggcgcaggactttctgcccacctctcgtaacgatccagatttgcacttcgatgccgaaagattaggccagggacgcgccaggttggtcggtgcattaagagaaaccgtcgtcgccgcccgggcacttgaccatacactggcccggcagagacttggcgcggcactgcacgctctgcaggatttctacagccactcaaattgggtcgaacttggcgagcagcaaccccaccctcatctcctctggccgcggcaggagctccagaatcttgcccaggtggccgatcctacatgctccgactgcgaggaattatcctgcccgcgtaattggctaggctttaccctgcttacctccggatacttcgggacgcatcccccaaagcctcccggaaagtgcagccacgggggacactttgatcgctcgagctcccagccccccagggggggcatcaacaaagacagtacctccccagggttctcaccacatcacatgctgcacctccaggccgccaagctggccctgctggcatccatacaggctttcagtctgctgagatcccgactcggcgatcgggattttagtaggttgctggacattacgcccgcgtcatccctgagcttcgttctggacacgacaggcagtatgggagaggagatcaatgcagccaaaatacaagccaggcatctggtggaacagaggcggggatcgcccatggagcctgtacactatgtgttggtgcccttccacgatcctggatttggaccagtctttacgacatccgatccggacagcttttggcagcaattgaatgaaatccatgctctcggcggtggcgatgaacccgaaatgtgcctgtctgcactgcagcttgccttgctgcacactcctcctctatctgacatcttcgtttttacggatgcaagccccaaagatgcgtttttaactaatcaagtggagagcctcactcaagagcggaggtgtagagtgaccttcctggtgacagaggatacttcacgcgtccagggtagagcacgccgagagatactcagcccactgagattcgaaccttataaagcagttgctctggcaagcggtggtgaagtcatcttcacgaaggatcagcatatcagggatgttgccgcgatcgtgggagaatccatggccgctctggtaaccctccccctggatccccctgtggtagtacccggccagccactggtgttcagcgttgacgggctgctgcagaagattaccgtgagaatccatggagacatatcgtcattttggatcaagaatcctgcgggagtttcgcagggccaggaggagggcggtggcccattaggtcacactcggaggttcggtcagttctggatggtaacgatggacgaccccccccaaacggggacatgggagattcaggtgaccgccgaggatacccctggcgtgcgggtccaggctcaaacatctctcgatttcctgttccatttcggcattcccatggaggatggaccccaccctggcctgtacccattgacccagcctgtggccggactccagacccagctgctcgttgaagtgacaggattagggtcacgggccaaccccggcgatccccagccacacttttcgcacgtgattctgagaggcgtgcccgaaggggctgaattgggacaggtcccgttggagcctgttgggccaccagagcgtggcttgctggccgccagcctgagtcccacactcctgagtactccgcgccccttttctctggaactgattggacaggatgcggcagggaggagactacatagggccgctccacagccctcaaccgtggtccctgtgcttctggaactgagtgggccttctggtttccttgcaccgggctcaaaggtacctctgagcctaagaattgcttcctttagtgggccccaggatctggatctgcgaactttcgtcaatccatccttttcactaacctcgaatctgtcacgcgctcacttagagctgaacgagagcgcctggggaagactatggttagaagtgcctgattccgccgcacctgacagcgtcgtgatggtaactgttactgcagggggtcgggaggctaacccggtacctcccacccatgccttcttgcggctcctcgtcagtgcccccgcccctcaggaccggcacacaacccccacagggtcttccgacccgatcttgacaacagccactcccgcttttagtccattcactttggtcacccagggccgggcaggggccggactggcggctggttcaccctggtgggggacagttggaggtgtgctgctgctgctcggtctggcctcttggtag

SEQ ID NO: 9616 - DNA, 2742 bp, Artificial Sequence
  Description of Artificial Sequence: Synthetic coding sequence
atgggccccgaggccctgagcagcctgctgctgctgctgctggtggcttccggggacgccgatatgaaaggccacttcgacccggctaagtgccgctatgctttaggtatgcaggacagaaccattcctgatagtgacattagcgctagctccagctggagtgattcaactgccgccaggcattcacgtctggaatcatctgatggagacggcgcctggtgccccgcaggctccgtgttccccaaagaagaggagtatctgcaggtggatcttcagaggcttcacctggtagctctggtcggcacccaagggcggcacgcaggagggctgggcaaggagttctcgagaagttaccggctcaggtatagccgagacggaagacgctggatgggctggaaggatcgatggggccaggaagtgatctccggcaacgaggatccagagggcgtagtcctgaaggacttggggccacctatggtggcacggttagtaagattctatcctcgggcggatagggtaatgtcagtctgcttaagggtggagttgtacggctgtctgtggcgggatggtctgctttcctacacagctccagttggtcagacaatgtatctcagtgaggccgtgtaccttaatgacagcacctatgatggacatacggttggaggtctgcaatatggcggtctggggcagctcgcagatggcgttgtgggccttgatgacttcaggaagtcacaggagctgcgggtgtggcccggttatgactacgtgggctggagcaaccatagtttctctagcggatacgtggaaatggagtttgaatttgatcgcctgagagcatttcaggccatgcaagtgcattgtaacaatatgcatacactgggagccaggctgccaggtggagtggaatgccgctttaggcggggaccagccatggcctgggaaggtgagcctatgaggcacaatctggggggaaacctgggtgaccccagagcgcgggccgtctccgtgcccctaggaggcagagtcgcccgatttctccaatgccgctttttgtttgctgggccttggctcctgttttcagagatttccttcatcagcgatgtggtgaataacagtagtcctgcgttgggggggacatttccccctgccccttggtggcctcccgggccacccccgacaaatttctcatcattggagttagaaccacggggccagcaaccagtggccaaagcggaaggctctccgacggcaatcctcatagggtgtcttgttgccatcattctgctgctgctgctgatcatcgccttgatgctctggagattacactggcgcaggctgctttccaaagctgaacggagagtgctggaggaggagctgacagtgcacttaagcgttcccggcgacacaattctcattaacaatcgtcctggcccccgcgaacctccaccataccaggagcctagaccacggggaaacccccctcattccgcgccttgcgtgcccaacggaagcgccctcctgctcagcaaccctgcctaccgcctgttacttgcaacttacgcgagaccacccaggggaccagggccaccgactccagcttgggctaaacccacaaacactcaggcttatagcggcgactacatggaacccgagaaaccaggagcacctctcctccctcctcctccgcagaactccgtgccccattacgcagaggccgacatagttaccctgcaaggagtgacaggcgggaatacttacgctgtgcctgctctgccaccgggtgctgtgggtgacggacccccacgggtggacttccctcgcagccggctcaggtttaaggaaaagctgggggagggacagttcggcgaagtccacttgtgcgaggtggactccccacaggatctcgtctccctcgactttccactgaacgtgagaaagggccaccccctactggtcgctgttaagattctgagacccgacgccactaaaaacgccaggaatgactttcttaaagaggtaaaaataatgagccgtctcaaagaccctaatatcattcgcctgttgggcgtatgcgtgcaagacgatcctctttgcatgattaccgactatatggaaaatggagacctgaaccagtttcttagcgcccatcagttggaagataaagccgccgaaggcgcgcccggagatggtcaggcggcacaagggccgaccatcagttatccgatgctcctgcacgtggcagctcaaatagcttccggcatgagatacttagcgacgctcaattttgtccacagggatttggcgaccaggaactgtttggttggagaaaatttcactattaaaatcgcagatttcgggatgtctcgtaacctgtacgcaggtgattattaccgtgtgcagggacgcgcagtgctcccaatcaggtggatggcttgggaatgtatcttaatgggcaagttcactaccgcatctgatgtttgggccttcggagtgacattgtgggaagtgctgatgctgtgccgggcgcagccctttggacaattgaccgatgagcaagtgattgagaatgccggcgaatttttccgcgatcaaggccgtcaggtgtatttatccaggccaccggcctgtccccaaggcttatatgagctcatgcttcgctgctggtcacgggagtccgagcagcgcccacctttcagccagttacaccgctttctcgccgaagacgcccttaacaccgtctag

SEQ ID NO: 9617 - DNA, 453 bp, Artificial Sequence
  Description of Artificial Sequence: Synthetic coding sequence
atgcggttcatggccggccccgccggcagccagagcctgggccccctgtgcttccactcatcaccccaggcactgtacaccgttctcctgattgtgctggttatgatgtctctggtctttgggaagttcgtgcctgttaattgggaaccaccccagcccctcccgtttcctaagtacctgaggtgctaccgctgcctcctggagactaaggagctggggtgtctgctcggcagtgacatttgccttactcccgctggctcatcttgcatcacgctgcacaaaaaaaactctagcggctcagacgtcatggtgtcagactgcagatccaaagaacagatgagtgactgttcaaacaccaggacaagtcctgtgagcggcttctggatcttcagccagtactgctttctggacttttgcaacgatccccagaatcggggactctacactccatag

SEQ ID NO: 9618 - DNA, 192 bp, Artificial Sequence
  Description of Artificial Sequence: Synthetic coding sequence
atgggccccgaggccctgagcagcctgctgctgctgctgctggtggcttctggagacgctgatatgaagggccattttgatccagctaagtgtcggtatgccctggggatgcaggatcgcactatacctgacagtgacatctccgcctcttcctcgtggtcggattctacagccgccagacattcacggtag

SEQ ID NO: 9619 - DNA, 1212 bp, Artificial Sequence
  Description of Artificial Sequence: Synthetic coding sequence
atgcagggcacccccggcggcggcacccggcccggccccagccccgtggacagaagaacccttctggtatttagttttattctggcagccgccctaggtcagatgaatttcaccggcgaccaggttttacgggtccttgccaaggacgagaaacagctgtctctgctcggagatctcgagggtctgaaaccccagaaagtagatttttggagggggcctgcccgtccctcactgcctgtggatatgagagttcccttcagcgaactaaaagatataaaggcctacctcgaatcccatggtttggcttactcgattatgataaaggacattcaggtgctgctggatgaggagaggcaagctatggccaaaagtagacgcctggaacgttccaccaactcattctcttattccagttatcataccttggaggagatttattcctggatcgacaatttcgtgatggaacacagcgacattgtgtctaagatccagattggtaactcgttcgaaaatcagtccatcctggtccttaaattctcaacaggtggtagtcggcatcctgcgatatggatagacaccggcattcattcccgcgagtggatcacccacgccacagggatttggaccgcgaataaaattgttagtgactatggcaaagatagggtgcttactgacatacttaacgcgatggacatttttatcgagctggtaactaatcccgacggctttgccttcactcattctatgaacagactctggcggaagaataagtccatcagaccaggaatcttttgcataggcgtggatctgaacaggaactggaaatcagggtttggcggtaacggtagcaattctaacccttgttctgaaacttaccacggaccttctccacagtccgaacccgaggtagctgccattgtcaacttcattaccgcccatggcaactttaaggctttaatatccatccattcctactctcaaatgctcatgtatccgtacggacggctgttggaaccagtcagcaatcaaagggaactcatgtggcccgtcgggagtccgtccaccggaccaatgaccgtggccagttctacccccagtgctctttcatccggcactctggggagtatggccagttgctgcagaccacatagatcaagcccccgcccccggagacgaggctggcggttcggaccttcctggtccacaccatag

SEQ ID NO: 9620 - DNA, 1542 bp, Artificial Sequence
  Description of Artificial Sequence: Synthetic coding sequence
atggcccccgcccggaccatggcccgggcccggctggcccccgccggcatacctgcggtggctctgtggctgttgtgtacgctgggtctccagggaacacaagctggcccaccacccgcccccccgggacttccagctggggcagattgtttgaacagcttcacagctggggtccccggttttgtgttggatactaacgccagtgttagcaacggcgctacatttttagaaagcccgaccgtacggagaggatgggactgcgtacgcgcttgctgcacaacacaaaattgcaatttagccctcgtcgagctgcagcccgacaggggggaggacgccattgcggcatgcttcctaataaactgtctctatgagcaaaatttcgtatgtaagtttgcccccagagaaggatttatcaattatctaacacgagaggtctatcgctcctatcgccaactccggacacagggattcggcggatccgggattccaaaagcctgggctggcatagaccttaaggtgcaaccacaggaacccttggtgttaaaagacgtggaaaatacagactggaggctgctccgcggggacacggatgtgagggtggaacgtaaagatcccaatcaggtggagctttggggtctcaaggaaggcacctacctattccagctcaccgttactagttcagaccaccctgaggatacagccaacgtcacagtgaccgttttatcaaccaaacagaccgaagactactgccttgcctccaataaggtcggaaggtgtcgtggtagcttcccgcgatggtattacgatcccactgagcagatttgcaaaagtttcgtctatggcgggtgcctgggcaacaagaacaactacttgcgcgaggaagagtgtattctggcttgcagaggcgtgcagggaccttccatggagcgacgccaccctgtttgctccggcacctgccagccaactcagttcagatgctcgaatggctgttgcatcgattctttcctggaatgtgatgacactcctaactgtcccgacgcgagcgacgaggcagcctgcgagaagtacacatctggattcgatgagctccagcgcattcactttccctccgacaaaggtcattgtgtcgatttacctgataccgggctttgtaaggagagcataccccggtggtactataacccatttagtgaacactgtgctcgctttacatacggcggatgttatggcaacaaaaataattttgaagaggaacagcaatgcctggagtcatgtcgtgggattagtaaaaaggacgtgttcggcctgaggagagaaatccccatcccatctactggcagcgtggagatggccgtcgctgttttcctggtgatctgtattgtggttgtggtagctatactgggctactgtttcttcaagaatcaacgcaaggactttcacgggcatcaccatcaccctccaccgacacccgcctcgagtacggttagcaccaccgaggacactgaacacctcgtgtacaaccatacgacgagaccattatag

SEQ ID NO: 9621 - DNA, 798 bp, Artificial Sequence
  Description of Artificial Sequence: Synthetic coding sequence
atggccccctggagccaccccagcgcccagctgcagcccgtgggcggcgacgcggtctccccagcactgatggttctgctgtgcctggggttaagtctgggtccaaggacgcatgttcaagccggaaacctcagcaaagctacgctgtgggcggaacctggttctgttatttctcggggaaacagcgtgacgatacggtgccagggaacactggaggcgcaagaatatcgcttggtcaaagagggctccccagagccatgggatactcagaatccacttgaaccaaagaataaggcaaggttctctattccatccatgactgaacatcatgcagggcgctacagatgttactactactcccctgctggctggtctgagcctagcgaccccctcgaacttgtcgtgaccggattctacaataagcctacattaagtgctctgccctcccccgtggtaacgtccggggaaaatgtgaccctgcagtgcgggtccagacttcgattcgaccggtttatcctaacagaagaaggcgaccacaagctgtcctggacactggattcccagcttacccctagcggccagttccaggcattgttcccagtgggaccagtcaccccaagccatcgttggatgcttagatgttacggctctcgcaggcacattttacaagtgtggagcgagcccagtgacttacttgaaattcctgtatcgggggaagaggcaaccgtgttcagttctaccatccagggcagtcaaaccggctgcggggagttgtaccgtcaggggtctccatgttag

SEQ ID NO: 9622 - DNA, 795 bp, Artificial Sequence
  Description of Artificial Sequence: Synthetic coding sequence
atggagaagcccatcctgaagaacctgaacgagatgctgtgccccataattgcgtccgaggtcaaagctctgaacgcaaacttatctaccctcgaagtcctgactaagatcgataactacaccttgctggactattcgctgatatcttcccctgagattacagagaactacctcgatttgaaccttaagggagtcttctatcccttagagaatcttacggaccctccattctcacctgtgcccttcgtgttgcctgagcggtccaattccatgctctacattggaatcgctgaatattttttcaaaagtgctagttttgctcactttaccgcaggtgtctttaatgtcaccctgtccaccgaagaaattagcaatcattttgtccagaatagccaaggcctaggtaacgtcctgtcccgcgtggcctctacctccgtgggcctggtgatcctgggtcaacggcttgtttgtagcctgtcactcaaccgctttcgcctggctctgcccgagtcgaaccggtctaacatcgaagtcttgcggttcgagaacattttaagctcaattctgcattttggcgtccttcctttggctaacgcgaaactacagcaggggtttcctctgtctaacccacacaaatttctctttgtgaactccgacattgaggtcctagaaggctttttgcttatcagcaccgatttgaaatatgagactagcagcaagcagcaaccatcttttcacgtttgggagggtcttaacttgataagcagacagtggcgcggtaaatctgccccttag

SEQ ID NO: 9623 - DNA, 117 bp, Artificial Sequence
  Description of Artificial Sequence: Synthetic coding sequence
atgaacaagatcctgagcagcaccgtgtgcttcggcctgctgaccctcctgtctgtcttatcctttttacaaagcgtgcacgggagaccttacttgactcaggggaacgagatttag

SEQ ID NO: 9624 - DNA, 567 bp, Artificial Sequence
  Description of Artificial Sequence: Synthetic coding sequence
atgttccaccagatctgggccgccctgctgtacttctacggcatcatcctcaattcaatataccagtgtcccgagcactctcagcttacgactctcggcgtggatggcaaggagttccctgaggtacacctgggccagtggtatttcatcgctggcgccgcccccacaaaggaggagcttgcgacctttgatccagtcgataatattgttttcaatatggccgcagggtcagccccaatgcagctccacctgagagccaccatccgtatgaaggatgggctttgtgtcccgcgcaaatggatttaccatctcacggaaggttctaccgatttacgtaccgagggcagacctgatatgaagacagagctgtttagctccagttgcccgggcgggattatgctcaacgagaccggacagggctaccaacgctttctgctctataataggagcccccatccccctgagaaatgtgtcgaagagttcaagtcacttacttcttgtctggacagcaaggcatttctactaactccacgtaaccaggaagcctgtgagctctctaacaattag

SEQ ID NO: 9625 - DNA, 600 bp, Artificial Sequence
  Description of Artificial Sequence: Synthetic coding sequence
atggagaccttccccctgctgctgctgagcctgggcctggtgctggccgaggcatccgagagtaccatgaagattatcaaagaagagtttaccgacgaggaaatgcaatacgatatggcaaagagtggacaagagaaacaaaccatcgagattctgatgaaccctatactgctggtcaagaacacatccttatctatgagcaaggatgacatgagctccacactgctgacgtttcggtcattacactacaacgaccccaagggaaattcgagtggtaatgataaggaatgctgtaacgatatgacggtgtggagaaaggtatctgaagccaatggctcctgtaagtggtcaaacaattttattaggagttcaacagaagtcatgcgcagggtgcaccgcgcaccaagttgcaagttcgtccaaaatcccggtataagctgttgcgagtccttggaactcgaaaacaccgtgtgtcagtttacaaccggcaagcagttccctcggtgccaatatcactccgtgacatccctggaaaagatccttacggtgctgacaggccatagcctcatgtcatggctggtgtgcggatctaagttgtag

SEQ ID NO: 9626 - DNA, 30 bp, Artificial Sequence; identical to SEQ ID NO: 4613
  Description of Artificial Sequence: Synthetic coding sequence

SEQ ID NO: 9627 - DNA, 831 bp, Artificial Sequence
  Description of Artificial Sequence: Synthetic coding sequence
atggcccccagccccctgcagcggctgcactgcggccccagcccctccccgcgacctacggaggtgcctagaggcaccgtttcagttagctgtcgctacctgaaaaacagtctccacgtatttgtgagtggtggagccattgggacaagtagtcctgcgcttctggaatgccaggagggcgtaggcccagctcgcccgtctcttctggtaccaccccccccaaggccccgccggctcgatctcgctcgcacattgccggccgagcggaccgacagtcagagtctatacatagtgtatattgcgctgcctggccggacaccacgtcccgcactggcctttgccttcctgatgcccgcttgttgcaacaggcccagtccacgacctagccccgcacacctaacagcctcgtctgtcctccgcagacagaggcacgtccttgccgcctccgcagccagcccttgtcagtggtcagggctgcgagtagcccattctctgagacaggtagtgtctttgtgcccccggtgtaccggcagttgcccatttagcggggcctgcgcttctagtctgccctctcctttaagctgccctcattctcatagcggctcctggggaacatggtcacagggcaggccctgctctagcactgaggttgctggactcgctctgtggcccaccgacttcctgagctgcctcctggacgcctcagagctgcagactcaagggagtcacggattctcattcactcctacgggattttcctccaaccggaaagtgggcgttggttcttgccgggacggcgccggccggggagccatggggggccttttctag

SEQ ID NO: 9628 - DNA, 678 bp, Artificial Sequence
  Description of Artificial Sequence: Synthetic coding sequence
tgagccgacctgcccagctgctggggcgccggcccctgctacaccggccacaaggtgggggcactgcgaagggacaccgtcatctgctgctgtcgacacggtgactacagcaccccgtgcctgttcacccccggaaaacctagtagaaaccccagcccctggaagaggaccctgtggacattgagcgctccatgggcaggccctgccggatggaccggggaggaacagaacgctaccaaaaccgggctcatcacacgccggccccgtcccctcaggcgacgcccacatcccgcacctgcgagtcccctcccggagataattaggggcaacataccccgaatgctcggcaaatttgttcccgtgaattgggaaccgccacaaccgctcccctttccaaagtacctgcgttgctatcggtgcttgctggaaactaaggagctagggtgcctgctcggctccgatatctgccttacgcccgctggttcctcatgtattacacttcacaaaaaaaactcttctggctcagatgtgatggtttctgactgtagaagtaaagagcagatgtcagactgctcaaacacgagaactagtccagtctctggcttctggatcttttcccagtactgcttcttggatttttgtaatgatccacaaaaccgcggcctgtataccccatag

SEQ ID NO: 9629 - DNA, 534 bp, Artificial Sequence
  Description of Artificial Sequence: Synthetic coding sequence
atggtgcccgccgccggcgccctgctgtgggtgctgctgctgaacttaggcccaagggcagccggcgcacaaggtcttacccagacacccactgaaatgcagagggtgtcactgcggttcgggggacctatgactcgcagttaccggagtactgcccgtacaggactcccaagaaaaactcgaattatactggaggatgagaatgacgcaatggcagacgccgaccgattggccggccctgccgccgccgaactcttggccgcaactgtctcgactggattttccagatccagcgctattaatgaagaggacggcagctcagaagagggtgtagtgataaacgcaggaaaggattccacctcccgggagttaccgtcagctaccccaaatactgcagggtccagctcaacacgcttcatcgctaattctcaggagcctgagattaggctcaccagctctctacctagaagtcccggtcggagtactgaggatttgcccccctgccacctcctcagaatctgtgggtggtgctag

SEQ ID NO: 9630 - DNA, 912 bp, Artificial Sequence
  Description of Artificial Sequence: Synthetic coding sequence
atgctgcaccccgagaccagccccggccggggccacctgctggccgtgctccttgctctactcggaaccgcttgggctgaggtgtggcctcctcagcttcaggaacaggctccaatggctggggccctcaaccggaaagagtcatttctattgctgtcgcttcataataggttgcgatcctgggtgcagcctcccgcagcagacatgcgtcgcctagactggtcggatagtcttgcccagttggcgcaggccagggcggccctgtgtggaatacctacacctagcttggcttctgggctgtggagaaccctacaggtggggtggaacatgcaactgcttcccgccgggttagccagtttcgtagaggtggtgagcttgtggtttgccgagggtcaacgatatagtcatgcagccggtgagtgcgcaaggaatgctacatgtacccactatacacagttagtgtgggcaactagcagccagttgggctgtggcagacacctctgctctgccgggcaagctgctatcgaagcgtttgtgtgtgcttatagcccacgtggcaattgggaagtgaatggaaaaaccatcgtgccatataagaagggtgcctggtgctctttgtgcacagcgagcgtatctggttgcttcaaggcctgggaccacgcggggggactgtgtgaggtcccaagaaatccttgccggatgagttgtcagaatcacggccgcttgaacattagtacatgtcactgtcactgcccaccgggatatacaggacgctactgtcaggtgcgatgttcactccaatgcgtgcacggccgctttcgagaggaggaatgtagctgcgtgtgcgacatcggatacggcgaaccatcagtcccaccccggtgcatatttccttccactcccgtgacttag

SEQ ID NO: 9631 - DNA, 1482 bp, Artificial Sequence
  Description of Artificial Sequence: Synthetic coding sequence
agcgaggccgtgtacctgaacgacagcacctacgacggccacaccgtcggtggcctccaatacggaggactcgggcaactggccgatggagttgtcggcctggatgattttagaaagtctcaggagctccgcgtctggcccggctacgactatgtcgggtggtccaaccactcattctccagcggttatgtggaaatggaatttgagttcgacaggcttcgtgcatttcaggccatgcaggtgcattgcaacaacatgcacaccctgggcgctagactcccagggggcgtggagtgcaggtttagaaggggacccgccatggcttgggaaggggaacctatgaggcacaatctggggggcaatctcggagatcccagggcaagagccgtgagcgtgccacttggcggaagggtggcacggtttctccagtgtcgcttcctgttcgctggaccctggctgctcttttctgagatcagctttatcagtgacgtggtgaataactcctcaccggccttgggcggtaccttccctcctgcaccctggtggccgcccggaccgcccccaacaaacttctcctctttagagctggagcccagaggtcagcaacccgttgcgaaggctgaaggaagcccaactgcaatcttgattggctgtctggtggccataattctgttattactgctgattattgccctgatgctctggagattgcattggaggcggctactaagtaaggtcctggaaagccacccgcggacgaggtcccccggtctcgtcggaatccggccaactccactgcccgtgtccccgatggctctgcggtgttgctccccaattcagccaacagcttccttctggcccctgacccctgtgcctctggaagcaagagcacctccacatccccccggacctaaccctccaactccacgtggcgtgactggcggcaatacttacgcagtgcccgccctcccccctggcgccgtgggagacggcccccccagagtggacttccctcgctctaggctacggttcaaggagaagcttggcgagggtcagtttggtgaggtccatctctgcgaggtcgactctccacaagacctagtgagtctggattttcccttaaacgtgaggaaaggtcacccattactggttgctgtgaagatcctgcggcccgacgccacaaaaaatgctagaaacgattttctgaaggaggtgaagatcatgtccaggctcaaggacccgaatatcatacgcctgctgggcgtctgtgtccaggacgacccattatgtatgatcacggactatatggaaaatggcgacttgaaccagttcctctcggctcaccaattggaggacaaggcagccgagggcgcccctggtgatggacaggctgctcaaggacctaccatcagctacccaatgttgctccatgtggccgctcagatcgcttccgggatgaggtacctggctaccctgaattag

SEQ ID NO: 9632 - DNA, 807 bp, Artificial Sequence
  Description of Artificial Sequence: Synthetic coding sequence
atgaagcagatcctgcaccccgccctggagaccaccgacccctgcagtactggcttcgtattcccagccatgactctcttcccagtccttctctttttggtcgccgggctacttccaagtttcccagccaacgaggataaagatcctgcattcactgccttgctaaccacccagacgcaggtgcagcgggaaattgtgaataaacacaatgaattacgtagagccgtttcaccccctgcccggaacatgctgaaaatggagtggaataaagaggctgccgccaacgcacagaagtgggcaaatcagtgtaattaccgccactccaatcccaaggaccgtatgacttcattgaaatgcggcgaaaatttatacatgtcctccgctagcagctcctggtctcaagcaattcaatcatggttcgacgagtataatgattttgatttcggagtgggaccgaagacgcccaatgcagtcgtaggacactatacacaagtggtttggtattccagttatctggtcggctgcggaaatgcttactgcccaaatcagaaagtgcttaagtattactatgtatgccaatattgccctgccggtaactgggctaataggctctacgttccttatgagcagggagcaccctgcgcctcttgccccgacaactgcgacgatggcctgtgcacaaacggctgcaagtatgaggatctatatagcaattgtaagagtctcaaactcacactgacttgtaagcatcaattggtgcgagacagctgtaaagcctcctgcaactgcagtaattctatttactag

SEQ ID NO: 9633 - DNA, 372 bp, Artificial Sequence
  Description of Artificial Sequence: Synthetic coding sequence
atgctgcccaagagccggcgggccctgaccatccaggagatcgccgccttggcaaggagttctcttcacggcatctctcaggtggtgaaggatcacgtgacaaagcctacagccatggcgcagggccgcgtcgctcacctgatcgagtggaaaggctggtccaagccaagtgatagtccggctgcactggaaagcgcgtttagcagctattctgatctaagtgagggcgagcaagaggctcgtttcgcagctggagtcgccgaacagttcgccattgccgaagccaagctcagggcctggagctctgtagacggagaagactctaccgacgactcatacgatgaggatttcgcgggcggcatggacacatag

SEQ ID NO: 9634 - DNA, 726 bp, Artificial Sequence
  Description of Artificial Sequence: Synthetic coding sequence
atgggcgccgtgatgggcaccttcagcagcctgcagaccaagcagcggcgcccctccaaggacaagattgaggatgaattggagatgactatggtttgccacaggcccgagggtctagagcaactggaggcgcagacgaactttaccaaaagagagttgcaagtcctatacagaggatttaaaaatgagtgtcctagcggtgtggtgaacgaagatacttttaagcagatctacgctcagttctttccacacggtgcgcttccctgcctggagggcagtccatgcgtcgaatttctgccacccagccctgccctcctattctgcttggttgacgcttccacttacgctcactacctgtttaatgcattcgatactacacagaccggaagcgttaagtttgaagatttcgtgaccgccttgtccatccttcttagaggcactgtacatgaaaagctgcgctggacctttaacctgtacgacattaacaaagatggatacatcaacaaagaggagatgatggatatagtcaaggcgatttacgacatgatgggtaagtatacataccccgtactgaaggaagacacccccagacaacatgtcgatgtctttttccagaagatggacaagaacaaagatggaattgtgacactcgacgagtttctggaatcatgtcaggaagatgataatattatgaggagcctacagctcttccagaatgttatgtag

SEQ ID NO: 9635 - DNA, 630 bp, Artificial Sequence
  Description of Artificial Sequence: Synthetic coding sequence
atgggccccgaggccctgagcagcctgctgctgctgctgctggtggcttccggggacgcggacatgaaagggcactttgatcctgctaagtgtaggtatgcgctgggcatgcaagaccgaacgatacctgattctgatatctccgcctcatcttcatggtccgattccacagcagcacgccacagcaggctggaatctagcgacggtgacggcgcctggtgtcccgccgggagcgtctttcctaaggaagaggagtatctgcaagtagacctccagaggctgcatcttgtggccctcgtgggaacgcaaggcagacatgcgggcgggctgggcaaggagttttcgcgctcttaccgccttagatattcccgagatggtaggcgatggatgggctggaaagataggtgggggcaggaagttattagcggtaatgaggatcctgaaggtgtagtgctgaaagacctgggtccaccaatggtggcaaggctggtgcgattttaccctagagccgaccgcgtgatgtccgtctgtcttcgcgtagaattgtacggttgcctatggcgcgacggcctgctgagttacaccgcacccgtgggccagactatgtacctatccgaggccgtgtactag

SEQ ID NO: 9636 - DNA, 312 bp, Artificial Sequence
  Description of Artificial Sequence: Synthetic coding sequence
atgcggcagcggctgctgcccagcgtgaccagcctgctgctggtggcactgctgttcccaggcagcagccaagccagacatgtcaaccacagcgccacagaggccttgggcgaattgcgcgagagagcccccggacagggtactaatggattccagctgctgaggcacgctgtgaaaagagacctgctgcccccaagaacgcctccttatcaggtccacatctcacatcaggaagcccgagggccctcttttaaaatctgtgttggtttcctgggcccccggtgggccagagggtgttctacaggcaactag

SEQ ID NO: 9637 - DNA, 426 bp, Artificial Sequence
  Description of Artificial Sequence: Synthetic coding sequence
atgaagaccggcctgttcttcctgtgcctgctgggcaccgccgccgcaatccccaccaacgcccgcctgctgtccgatcattccaaacccacagctgagacagtggctcccgacaacactgccattccctccctgcgcgctgaagctgaagaaaacgagaaggaaacagcagtaagcacggaggacgacagccaccacaaggcagaaaaaagctccgtgctcaaaagcaaggaagaatcccacgagcagtctgctgagcagggtaaaagttcctcccaggaactgggcctgaaggatcaggaggacagtgacggacatttgtctgtgaacctggaatatgcacccactgaaggcacattggacatcaaggaagacatgtcagaaccccaggagaaaaaactcagtgaaaacaccgacttcttatag

SEQ ID NO: 9638 - DNA, 642 bp, Artificial Sequence
  Description of Artificial Sequence: Synthetic coding sequence
atgcggctggccggccccctgcggatcgtggtgctggtggtgagcgtgggggttacatggatagtagtgtcgatcttgcttggaggcccaggcagcggatttccacgcatccaacagttattcacatctcccgagagttcagtgaccgctgcccctagagcacggaaatataagtgcgggctgcctcaaccctgcccggaagagcatcttgcctttcgggtcgtcagtggagctgctaacgttataggacctaaaatatgccttgaggacaaaatgctcatgtcatcagtgaaggacaacgtggggcgcggcctgaatatagctctcgtgaacgatgttaatgacctgctcaaattcattcgtccgctccacgagggaactttagtttttgttgcttcttatgatgatccagccaccaagatgaatgaggaaaccagaaagctctttagtgagctgggctccaggaatgcgaaggaactcgcctttagagactcctgggtgtttgtcggagctaagggtgtacagaataagtctccttttgaacagcacgtgaagaactctaaacatagcaacaaatacgaggggtggcctgaggccctcgagatggagggctgtatcccccgtcgatctaccgcatcttag

SEQ ID NO: 9639 - DNA, 2700 bp, Artificial Sequence
  Description of Artificial Sequence: Synthetic coding sequence
atgctgctgctgctgctgctggcccccctgttcctgcggccccccggggccggcggcgctcagacgccaaatgcaacatccgaggggtgccaaataatccatcccccatgggagggtggaattagatataggggcttgacccgtgatcaggtcaaggctatcaattttcttccggtggactatgagatagaatatgtgtgccggggggaacgcgaagtagtgggtccaaaggtgagaaagtgtttggccaacggaagctggactgacatggatacaccctctaggtgtgttaatcggactccccacagtgagaggagagccgtgtacatcggggctctgttccccatgtccgggggatggcctgggggccaggcgtgccagccagccgtagagatggctctagaggacgtcaatagccggcgagacatcctaccggattacgagctgaagctgatccatcacgatagtaaatgcgaccccggccaggccaccaagtacctgtacgagcttctatacaacgaccccattaagattattctcatgcccggttgtagctctgtcagcaccttggtcgcagaagcagcacggatgtggaacctaatcgtacttagctatggatctagttcaccagcattgtctaaccgccagcgctttcctacttttttccgcacacacccgtccgccacattacacaacccaaccagagtgaagctgtttgagaaatggggatggaagaaaatcgctactattcagcagaccaccgaggtctttacctccaccctcgacgacttggaagagagggtgaaagaggcgggaatagaaattacgttcagacagtcattcttctccgaccctgccgttccggtaaagaacctcaagcgccaggatgctagaattatcgtggggctgttttatgaaaccgaagcaaggaaagtgttttgcgaagtctacaaggagagactgtttggcaaaaagtacgtttggtttcttatcgggtggtacgcagacaactggttcaagatttatgatccatcaatcaactgcacagtggacgagatgaccgaagctgtggaggggcatattacaactgagattgttatgctcaaccccgccaatacacgaagtatttccaatatgacctcccaggaatttgttgaaaagctgaccaaaaggctcaaacggcaccccgaggaaacgggcgggttccaggaggctccactagcctacgacgccatatgggcgctggccctggccctgaacaaaaccagcggcggcggtgggcgctctggagtgcgcttggaggactttaattacaacaatcagacaattaccgatcagatctaccgagcaatgaactcctccagcttcgagggggtttccggccatgtcgtatttgatgcttctggctcgagaatggcctggacactcattgagcaactgcaaggcggcagctacaagaagatcggatattatgactcaactaaagacgatctgtcatggtcaaagaccgacaagtggatcggcggtagcccgcctgctgatcagacgctcgtcatcaagaccttcagatttttgtcccaaaaactgttcatttcagtgagtgtgctgtcgtcactcgggatcgtgttggccgtggtgtgtttgtctttcaatatttataattctcacgtgagatacatccagaatagccagcctaacctaaacaatctgaccgccgttgggtgctctctggcattggcagcagtctttcccctgggcctcgacggctaccacattgggcggaaccaatttccgttcgtatgtcaggctcgtctatggctgctggggctgggcttttcattaggatacgggagcatgttcacaaagatctggtgggtacacactgtgtttactaagaaagaggagaagaaagagtggcgtaagacgctcgaaccctggaaactgtacgcgacagtcggcttgctggtcgggatggatgtgttgactttggctatctggcagatagtggatcctctacacagaacaatcgaaactttcgctaaagaggagcccaaggaagacatcgatgtgtcaattctccctcagctcgaacattgcagcagcaggaaaatgaacacttggctgggaatattctatggttacaaagggttgctgctgctactaggaatattcttggcttatgagactaagagtgtaagcacagaaaagataaatgaccatagggccgtaggcatggccatatacaatgtggctgtgttatgcttgatcaccgcccccgtgaccatgattctgtcttcccagcaggacgccgcgtttgcttttgcctccctagccatcgtgtttagtagctatattaccctggtggtacttttcgtccctaaaatgcgccgcctaattacacggggagaatggcagagtgaggcacaggatacgatgaaaacaggctcaagcacgaataacaacgaggaagagaagtcccgcctcctggagaaggaaaacagagagctggaaaagattatagccgagaaggaagaaagagtgtctgagctgcggcaccagctgcagtcccggcaacagctgcggtcccggagacatcctcccaccccacctgaacctagcgggggcctcccaagagggccccctgagccacccgaccgactttcctgtgacgggagccgggtgcatctgctttataagtag

SEQ ID NO: 9640 - DNA, 192 bp, Artificial Sequence
  Description of Artificial Sequence: Synthetic coding sequence
atgggccccgaggccctgagcagcctgctgctgctgctgctggtggcatccggcgatgccgacatgaaaggccatttcgaccccgctaaatgtcgatatgcgctggggatgcaagatcggacgattcctgattcggacatcagcgcctcatcttcatggtctgactcaacagccgctcggcatagcaggtag

SEQ ID NO: 9641 - DNA, 489 bp, Artificial Sequence
  Description of Artificial Sequence: Synthetic coding sequence
gacgaggaccggtacaccacctgctggcccaagacctggctggccaaggattgtcctgccttaagaatcatctccgtagaatatgacacctcgctgtcagactggcgcgctagatgcccaatggaaagaaaatcaatagcattcagaagcaatgagctgctgagaaagctgagggcagccggtgtgggagacaggcccgtcgtgtggatttcgcacagcatggggggattgctggtcaagaagatgctcctggaagcctcaacaaaacccgaaatgtccaccgtaattaataatacacgcggaatcatattctactctgttcctcatcacggctctcgactggctgaatacagtgtcaatattagatatctgttgtttccgtccctggaagtgaaggaactgtctaaagggaataccttttgtcataagggaaattggggatacatcaacatttcctataccgagaagaagaagaagttcctgccctag

SEQ ID NO: 9642 - DNA, 1083 bp, Artificial Sequence
  Description of Artificial Sequence: Synthetic coding sequence
atgcccgagctggtggtgaccgccctgctggcccccagccggctgagtctgaagctattacgggcctttatgtggagtctagtattcagcgtagccctcgtggcagccgcagtttatgggtgtatagccctcacacatgtgctgtgcagaccccgtaggggatgttgcggccggaggcggtctgcatctccagcctgtctgtctgacccctcccttggtgagcatggattcctcaatttgaaatccagcggactgcgcctgcattacgtgtccgctgggaggggcaatggtccgctgatgctgttcctgcatggatttcccgagaattggttttcctggagataccagctgcgagagttccagtcaaggtttcatgtggtggctgtagatctgagagggtacgggccctctgatgctccacgagatgtggactgctatactatcgacctgctcctcgtcgacatcaaagacgtgatcttaggcctgggatacagtaaatgtattttggtggcccatgattggggcgccttgctggcttggcacttcagcatctattacccctctctcgtggaaaggatggtcgtcgtgagtggtgctccgatgagcgtgtaccaggactatagtctacaccatatatctcaattctttcggtcacactatatgtttctatttcagctgccgtggcttccggaaaagttattgtccatgagtgattttcagatattgaaaaccacactcacacatcgcaaaacagggataccctgcctgactccttcagagctggaggctttcttgtataacttcagtcagcccggcggtctcactggtcccttgaattactacagaaacctgtttcggaactttccccttgagcctcaggagcttaccacaccaacactcctgttgtggggggaaaaggacacctatctggaactaggcctggtggaagccatcgggagtaggttcgtgcctgggcgccttgaagcccatatactgcctggaatcggacattggatcccccagagtaaccctcaggaaatgcaccagtatatgtgggccttccttcaggacctgcttgactag

SEQ ID NO: 9643 - DNA, 678 bp, Artificial Sequence
  Description of Artificial Sequence: Synthetic coding sequence
tgagccgacctgcccagctgctggggcgccggcccctgctacaccggtcacaaagtcggcgccctccgaagagataccgtgatatgctgctgtcgacacggagattatagcaccccctgcctttttaccccggggaagccaagcaggaacccatctccctggaagcgcactctctggaccttatcagcaccctgggcgggtcccgcaggttggacaggcgaagagcagaacgcgactaagaccggcctcatcacacggcgcccgcggcccctcaggcgtcgcccccatcctgcacctgcttctccgctgccggaaataatcagaggtaatattcctagaatgctcggtaagttcgtgccagttaactgggagcctccccagcccttgcccttccccaaatacctgcggtgttataggtgtcttctcgagactaaggaactgggctgcctgcttggtagcgacatatgcctgacacctgccggaagtagttgcatcacgcttcataagaagaactcatccggttccgacgtgatggttagtgattgccgctcaaaggaacagatgtcagactgttccaatacacggacttctcccgtttcaggcttctggatcttctctcagtattgttttcttgatttttgcaacgaccctcagaacagaggcctctatacaccgtag

SEQ ID NO: 9644 - DNA, 192 bp, Artificial Sequence
  Description of Artificial Sequence: Synthetic coding sequence
atgaagcacgtgctgaacctgtacctgctgggcgtggtgctgaccttgctgtcgatttttgtgcgagtgatggagtccctcgaaggcctgcttgagtcgccctcgcccggcactagctggacaacacgctctcaactagcgaataccgagccaacgaaagggcttccggatcatcccagccggtcaatgtag

SEQ ID NO: 9645 - DNA, 5235 bp, Artificial Sequence
  Description of Artificial Sequence: Synthetic coding sequence
atgcggctgctgtggggcctgatctgggccagcagcttcttcaccctcagtctgcagaaacctaggcttctgctctttagtcccagcgtcgtacacctcggtgttccactgagcgtcggcgtacagttgcaggacgtaccaaggggtcaagtggtcaaagggtcagtttttctgcggaatccctccagaaacaatgtcccctgcagtcccaaggtcgatttcacactcagttctgaacgcgatttcgccctcttgagcttgcaggtgccactgaaggatgccaaaagctgcggactgcaccagcttcttcgaggccccgaagtgcaattggtggcacactccccttggctcaaagacagtttatcacggacaaccaacatccaaggaatcaatcttcttttctcatcccgtcgaggacacttatttctgcagacagatcagcctatctataatccagggcaacgggtcaggtacagagtcttcgcacttgaccagaagatgaggccctccaccgacaccattactgtaatggttgagaattctcacggacttcgcgtgagaaagaaagaggtctatatgcccagttctatcttccaggacgacttcgtgatccccgacataagcgagccaggaacctggaagatctccgccagatttagtgacggcctagaaagtaattcctccacccaatttgaggtgaagaaatacgtcctacccaacttcgaagtaaagatcacgcccggcaaaccatacattttaaccgtgcctgggcacctcgatgaaatgcaactggacattcaggcccgctatatttacggtaagccagttcaaggggtggcctacgtgaggtttgggttactggacgaagatgggaagaaaactttcttccggggtctcgaatcccagacgaagctggtgaacggtcagtcacacatctccctctccaaagctgagtttcaagacgccctagagaaactcaacatgggaataactgatctccagggactgagactgtacgttgcagcggcgataatagagtacccagggggcgagatggaggaagcggagctgacatcatggtacttcgtgtccagcccattcagtctggatctctcaaagactaagcggcacctcgtaccaggggcccctttcttactacaagcactcgtaagagaaatgagcgggtcccccgcttcaggcatacccgttaaggtgtccgcaaccgtctcatcccctgggagcgtgccggaagtgcaggacatccagcagaatactgacggcagcgggcaggttagtatccccatcataattccacagactattagcgagctccagctttccgtcagcgcggggagcccacatcctgccattgcccgtctgactgtggcagcccccccaagtggggggccagggttcctgagtatcgaacgacccgactcaaggcctccccgggtgggcgatacactcaacctgaacctcagggccgtgggctctggagcaaccttttctcattactactacatgatcttaagccgggggcagattgtgttcatgaaccgcgaacctaaacgaacactgaccagtgtgagcgtctttgtggatcatcatcttgccccctcattttacttcgtcgccttctattatcacggtgaccacccagtagcgaactctcttcgtgtcgacgttcaggcgggagcctgcgagggcaaacttgagttatcggtcgatggggcaaaacaataccgcaacggcgagtctgtgaagctgcacctggagactgacagtctggccttggttgcgctgggggctctggacacagccctttatgctgcgggttcaaaatcacataagcccctcaatatggggaaggtattcgaggcaatgaatagttatgacctcggttgcgggccgggggggggggattcagctctccaagtcttccaggcagcaggcctggctttctctgacggcgaccagtggaccctcagtagaaagcggctgtcatgtcccaaagagaagactacaaggaaaaagcgtaacgtgaactttcagaaggcaatcaacgagaaattagggcagtatgcttcgccaaccgcaaaaaggtgctgccaggacggggtaacaagactccctatgatgcggtcttgtgaacagcgagcagctcgcgtccagcaacctgattgccgcgagcctttccttagctgttgtcaattcgcggaatctttgcgaaaaaagtcccgcgataaaggccaggcaggcctccagcgggcacttgagatcctgcaggaggaggatcttatagacgaggacgacattcccgtgcggagcttctttcctgaaaactggctgtggcgggtcgagacggtcgataggtttcagattctgacactgtggctgccggactcattgacaacatgggaaattcacggattgtctctttcaaaaaccaaggggctgtgtgtggccacacctgtacagctcagggtattccgcgaattccatctccacttgagactgccgatgtccgtgaggcgtttcgaacagctggagttacggcctgtactgtacaattacctggacaaaaatttaaccgtttcagtgcatgtttcccccgtggagggcctgtgtctggctgggggtggaggactcgctcaacaggtgttggttccagccgggagcgcgcgacccgttgccttctcagtcgtccccacagccgcagctgctgtttcactgaaggtggttgctcgcggtagttttgagtttcccgtgggggatgcagtcagcaaggtcctgcagattgagaaggagggcgccatccatcgcgaggagctggtgtatgaactaaaccctctggatcatagaggccgaaccttagaaattcctgggaactctgatcctaatatgattcctgacggagattttaattcgtatgtcagggtgactgcctccgatcctttggatactcttggaagcgagggcgcattgtccccaggaggggtcgccagcttacttcggctgccacgggggtgcggggagcagacgatgatctatttggcccccactctcgcggcctcgcgttatcttgacaagacggagcagtggtctactctaccgccagagacgaaagatcacgccgttgatttaatacaaaaggggtacatgcgcatccagcagtttcggaaggctgatggatcctatgccgcctggttgtcaagggggtcctccacgtggcttactgcgttcgtgctgaaagttttgtccctggcacaggagcaggttggcggtagtccagagaaactgcaagagacgagtaattggctcctatcccagcagcaggccgatggcagttttcaggacctgtccccagttatacaccgaagcatgcaagggggactcgtgggtaacgacgagaccgtcgctcttactgcctttgtgacaatagccctacatcacgggctggcggtcttccaagatgaaggcgcggaaccccttaaacaacgggtggaggcttctatcagtaaggccagctcttttctcggagaaaaggcttccgcagggcttttaggggctcatgccgctgccattaccgcatacgctctgacactaaccaaagcccctgcggatctgaggggggtagcccataacaatctcatggctatggcacaggagacaggtgacaacctctactggggcagcgtcactggctctcaatcaaacgctgttagccctacgcctgcacctcgcaacccctccgatcccatgcctcaagcccctgctctgtggatcgagacaaccgcctacgcactccttcacctcctattgcacgagggcaaggctgaaatggctgatcaagctgcagcatggttgacacggcagggtagcttccaggggggattcaggagcacacaagataccgtgatcgccctggacgctttgtccgcttattggatcgcttcccatacaactgaggagcgggggctcaacgttacgcttagctccacaggccgtaatgggtttaaatcacatgcattgcagctcaataatagacagatccggggactagaggaggagctgcagttttctctaggttcgaagatcaatgtgaaagtaggtggcaatagcaagggcacgctgaaagttctgcgcacttacaatgtgctagatatgaagaatacgacttgccaagatctgcaaatagaagttacagtgaagggccatgttgagtacacgatggaggccaacgaagactacgaggactatgagtatgacgagctcccagctaaagacgaccccgatgctccactgcagcctgtgacaccactccagctattcgaaggcagaagaaatcgccgacgtagggaggcacctaaggtcgtcgaggagcaggagagccgcgtccattacacagtgtgtatctggcgaaacggaaaggtcggccttagcggcatggcaatcgcagatgtaaccctactaagtgggttccacgccctccgggcagatctcgagaaactgacatctttgtccgatcggtatgtgtcacatttcgaaacggagggtccgcacgtgctgttatactttgacagcgtgccgactagtagagagtgtgtgggctttgaagccgtgcaagaggtacccgtgggactcgttcaaccagccagcgctacgctctacgactactataaccccgagcggaggtgtagtgtgttctacggtgccccctcaaagagtcgtttgctggccactctgtgctcggctgaagtctgtcagtgtgctgaaggcaagtgtccccgccagcggagggccctggagagaggacttcaggatgaggatgggtacagaatgaaatttgcttgttactatccccgggtagagtacggtttccaggttaaggtgctccgagaagatagtagagcggcctttaggcttttcgaaacaaaaatcactcaagtgctgcattttactaaggacgtgaaggccgccgcgaatcaaatgcgaaatttcttagttagggctagctgcaggctacgtctggagcctggaaaggagtatctcattatgggactcgacggagccacttatgacttagaggggcatcctcagtacctgctggattctaacagctggatagaggagatgccaagcgagcgactgtgtcgatcaactaggcagagagcagcatgtgcccagctgaacgactttctgcaagaatatgggacgcaggggtgccaggtgtag

SEQ ID NO: 9646 - DNA, 792 bp, Artificial Sequence
  Description of Artificial Sequence: Synthetic coding sequence
atggccgacatgcagaacctggtggagcggctggagcgggccgtggggcgcctagaggcggtgtctcatacaagcgacatgcaccggggctacgcagatagtcccagtaaaggtgctgctccctatgttcaagcatttgacagcctgctcgccggccccgtggccgagtatctgaagattagcaaagagattggtggcgatgtccagaagcacgcagagatggtgcatacagggctaaaactcgagagggcgttgctcgttacagcaagtcagtgtcaacagcctgctgaaaacaaactttctgacttactggcccccataagtgagcagataaaggaagtgatcacgttcagggagaaaaaccgcggtagcaagctgttcaaccacctcagtgccgtgtccgaatcaattcaggccctcgggtgggtggccatggcaccaaaaccaggaccatatgtgaaggagatgaacgacgctgccatgttttatactaacagggtgctcaaagagtacaaagacgtggacaagaaacatgttgattgggtgaaggcatatttgtcaatttggacagaactccaggcctacatcaaagagttccatacaactggcctcgcatggagcaagactggtccagtagctaaggagctgtcaggactgccctcaggacccagcgccggctcttgtccgcccccacctcccccctgccccccccccccgccagtgagtactatcagctgctcatatgagtcagcttcacgtagtagcctcttcgcccagattaatcagggatag

SEQ ID NO: 9647 - DNA, 501 bp, Artificial Sequence
  Description of Artificial Sequence: Synthetic coding sequence
atgggccccgaggccctgagcagcctgctgctgctgctgctggtggctagtggcgacgccgatatgaaaggccacttcgacccggccaaatgtcggtatgccttgggtatgcaagatcggaccattcccgacagcgacatcagcgcttcaagtagctggtccgactctaccgctgctcgacactctcgcctggagtcttctgacggagacggtgcctggtgccctgcaggatccgtctttccaaaagaggaagagtacctccaagtggacctgcagcgcttgcacctcgttgccctggtagggacacaagggcggcatgctggggggctaggcaaagagttttcgaggtcatataggctccgctactcacgggacggccggcgctggatggggtggaaggatagatggggacaggaagtgatttcaggcaatgaagacccagagggtgtggtccttaaggatctaggcccaccaatggtcgcacgtcttgttcggttctag

SEQ ID NO: 9648 - DNA, 2349 bp, Artificial Sequence
  Description of Artificial Sequence: Synthetic coding sequence
agcatcctgcgggtggaggccgtggacgccgactgcagcccccagtttagccagatctgttcttacgagataatcacgcctgacgtccccttcaccgtggataaggatggatacatcaaaaataccgaaaagttaaattatgggaaggaacatcagtacaagcttactgtgacagcatatgactgtggaaaaaagagggcgacagaagatgtactggtcaaaatcagcattaaacccacatgtacacctggatggcagggatggaataatcgcattgagtacgagcccgggaccggtgctttggctgtcttcccaaatatccatctggagacgtgtgatgaacccgtcgcatccgtgcaagccactgtagagctagagacctcgcacatcgggaaaggatgtgaccgcgacacttacagcgagaaatcactacatcgactgtgcggcgctgctgccggcacagccgaactcctcccctcaccatccgggtcactgaattggacaatggggctgcccacagataacggacatgactcagaccaagtgtttgaattcaacgggacacaggctgtgcggatacctgatggcgttgtgagtgtgtcaccaaaagaaccatttactatctcagtatggatgcggcacggccccttcggacggaaaaaggaaactatcctctgctcttccgacaaaacggacatgaataggcaccactacagtctgtacgtgcatggatgcaggttgatcttcttattccgccaagaccccagtgaagagaagaagtatagaccggctgaatttcattggaaactaaaccaggtgtgtgacgaggaatggcaccattatgtgctgaacgtagaatttccttctgtcacgctttatgttgacggaacctcccacgagccgttcagtgtgactgaagactaccccctgcatccatctaagattgagacccagctggtggtgggtgcctgctggcagggcggggacctgcacatgactcagttttttcggggcaatctggccggacttacattgcggtcgggaaagctggcagacaagaaagtgattgattgtttatacacctgcaaggaggggctggatctgcaggtgctcgaggatagcggcaggggcgtgcagattcaagcacacccttcacagctggtcctgacactcgagggggaggatttaggagaattggacaaagcaatgcaacacatttcttacctgaactccagacagttccccactcccgggatccggcggctcaagatcacttcgacaatcaaatgcttcaacgaagctacatgtatctccgtgcctcctgtagacggttacgtgatggtgcttcagcccgaagagccaaaaattagccttagcggcgtgcaccactttgctcgcgctgcttcagaatttgaatcttccgaaggagtgttcctgttcccagagctgcgcattatttctaccattacccgagaggtggaacccgaaggggacggggccgaggaccctaccgtgcaagaatctctcgtctccgaagaaatcgtacacgatctggacacctgcgaggtgacagtagagggcgaagagctgaaccacgagcaggaatctttagaggtagatatggcccggctccaacagaaagggatcgaggtgagcagttctgaactcggcatgacattcaccggtgtcgacaccatggcctcttacgaagaggtgctccatcttctgagatacagaaactggcatgccaggtctttactcgatagaaaatttaagctaatctgctctgagttgaacgggcgatacatctcaaatgagtttaaggtcgaggttaacgtgatccatactgccaaccccatggagcacgctaatcacatggcagcccagccccaatttgtgcatccggaacaccgctcctttgtcgacttatctggtcataatttagcaaatccccaccccttcgccgtggtgccctcgaccgcaacagtggtgatcgtcgtgtgcgttagctttctggtgtttatgatcattctgggcgtcttccgcatcagggcggctcataggagaacaatgagggatcaggacacaggcaaggagaatgagatggattgggatgattcagctctgacaattaccgtgaacccgatggaaacctatgaagatcagcatagctcagaagaggaagaagaagaggaggaagaggaagaatcagaagacggagaagaggaggacgatatcacatccgccgaatcagagagcagcgaggaggaggagggagagcaaggcgacccccaaaatgccacgaggcaacagcagctggaatgggacgactctaccctgtcatactag

SEQ ID NO: 9649 - DNA, 531 bp, Artificial Sequence
  Description of Artificial Sequence: Synthetic coding sequence
atggcccggcggcactgcttcagctactggctgctggtgtgctggttggtcgtgacagtcgcagaggccctatcaactttttacctacaacagcacattaatttgcatatggacaagaaacgctacctccgactgctggagatacacaaaataatgagaaccttgccaaccgctcgatccctgcacagccccctccacctcccccgtggcgtgagatcacagggtccttcccccagtcaacggcatcccggcgttccgtctatatttttccatgagggacctgaaagcattttggggtttcagactgacttgtcatcactccagggggtcactacagtgtttcacagctctcactttattggccataccgttacattactgattggtattagccccgaggaggatagccgagaggaggcacacctacgcaaagccgaacgagaggagaagccaaaacatacagaggccaaaaaatctttgtcctttcggaagaaacagcaaaaagacttttgctttatctttcggaattag

SEQ ID NO: 9650 - DNA, 1182 bp, Artificial Sequence
  Description of Artificial Sequence: Synthetic coding sequence
atgcggaccctgttcaacctgctgtggctggccctggcctgcagccccgtccatactactttgtctaagtccgatgcgaagaaggccgccagcaagaccctgttggaaaagtcacaattctctgataaacccgtgcaggataggggactcgtggtgacagatctgaaggccgagagtgtcgtgttagagcaccgcagctattgtagcgccaaagctagagacagacacttcgccggggacgtgttgggatatgtgactccctggaatagccacgggtatgatgttactaaggtttttggcagcaaattcactcaaataagccctgtttggctccagctgaagcgtagagggagagaaatgttcgaagttacaggattacacgacgtggatcagggctggatgagggctgtccggaaacacgctaagggcctacacatagtaccacgcctcctgttcgaggactggacctatgatgatttccggaacgtgttggattctgaagacgaaattgaggaattgtcaaagacagtcgtgcaggtggctaagaaccagcacttcgatggattcgtggtcgaggtctggaatcagttacttagccagaaacgagtgggattgatacatatgcttacacacctcgcggaggcccttcaccaggctaggttgttggctcttctggtcataccacctgccattactcccgggactgaccagctgggtatgttcacccacaaagaattcgagcaacttgcccctgtgcttgatggcttttccttgatgacatatgactatagcactgctcatcagccaggcccaaacgcacctctgtcctgggtcagggcttgtgtccaggtgctggatccgaaatcaaagtggcgcagcaaaattcttctggggctgaatttttacggcatggactatgccacctctaaagatgccagggaacctgtagtcggggcaaggtacattcaaactcttaaggaccaccgacctcggatggtgtgggactcccaggcgagcgaacacttttttgagtataagaaatcccgctccgggagacacgtggtgttttacccaaccctgaagtccctgcaagtcagactcgaactggcccgcgaattgggggttggagttagtatctgggagttaggccaagggttggactacttctacgacctcttgtag

SEQ ID NO: 9651 - DNA, 324 bp, Artificial Sequence
  Description of Artificial Sequence: Synthetic coding sequence
atgctgccctgcctggccctgctgctgctgatggagctgagcgtgtgtactgtggctggcgacggcggcgaggaacagacactttccactgaagcagagacatgggaaggtgcggggccttcaattcagctccaactgcaggaggtgaagactggcaaagccagccaattttttggacttatgggaaagcgagtcggaggacgccccctaatccaacctaggcgcaaaaaggcttaccagcttgagcatacctttcaagggctgttaggtaagaggtctctcttcactgaaggaagggaagacgaggcccagggaagcgagtag

SEQ ID NO: 9652 - DNA, 1086 bp, Artificial Sequence
  Description of Artificial Sequence: Synthetic coding sequence
atgggcatcatccagagcatcctggccaccagccgggactgctactccttcaagaagaaacccattcccaagaagcctaccatgttagccctagccaaaattctactgatctccacccttttctatagcctgctgagcggatcacacggcaaggagaatcaggatatcaatacaactcagaatatagcagaggtcttcaagactatggagaacaagcctatttccttggagagcgaagcgaatctcaatagcgataaagagaacattaccacatccaacttgaaagccagtcattccccccccctgaacctgcccaacaattctcatggaattacagattttagctccaatagcagcgctgaacattcactaggctcgcttaaacccacctccacaataagtacgagccctccgctgatccattcatttgtgagcaaagtgccgtggaatgccccaatcgctgacgaggacctcctgccaatctctgcacatccaaacgccacacctgccctcagttctgagaactttacatggtctctggtgaatgacaccgtgaagacaccagacaacagcagcatcacggtgtctattctgtcctcggaaccgacctctcccagcgtgactcctctcattgtggagccttcaggatggctcacgactaatagcgatagttttacaggattcaccccataccaagagaagaccactcttcaaccaactctaaagttcactaacaatagcaagctctttcccaatacctccgaccctcaaaaggagaacaggaacacagggatcgtgttcggggcaatactgggcgccatactgggtgttagcttattaactttagtgggatatcttctgtgtggcaaaaggaagactgactccttcagccaccggcgtctttacgatgacaggaacgaacctgttctgagactggataatgctcccgaaccttacgatgtgtcattcggaaacagttcatattacaaccccactttgaacgacagcgctatgccagaaagcgaggagaacgctagagatggaattcccatggacgatattcctcccttgagaacctcggtatag

SEQ ID NO: 9653 - DNA, 279 bp, Artificial Sequence
  Description of Artificial Sequence: Synthetic coding sequence
atgcggggccccggccaccccctgctgctgggcctgctgctggtgttgggcccttcccctgagcagagggtcgaaatcgtgccacgcgaccttcggatgaaagataagttccttaagcatcttaccggcccactgtatttctctcctaaatgctccaaacacttccaccgcttatatcacaatacacgagattgtaccatcccagcttattataaaaggtgtgctcgactcctgacacgcctggcagttagccccgtttgcatggaggacaagcagtag

SEQ ID NO: 9654 - DNA, 1125 bp, Artificial Sequence
  Description of Artificial Sequence: Synthetic coding sequence
tgacgggtgcggcggggccccctgcccgccgaccggccccgggccttgggcccagccagacgctgttcccggcacccacacccagcaccctttagagtttgtagcgaaggagctgcccataggctgcggcggccggaaagattaccactgccaagccgtgccctccgtccacggcccgcccatacacctatcttaggcccggcgcctcgggcgtgccccggtgctccacgagcttccgattcaccgacttgtgctgcagcagcggccactgcttggccgaggactcgggcagtggagcggaagggatgccaagtcgcagcagccgctggcgtgagaggcacgggctgcccctctagggcggaccttgaaaaggatagctggaatgatactaaggaagacgtgtttgtgcaccagacagctatcaaaaaaaacaatccccgcaaatacctcaggtcagtgggcgatggcgagaccgtagaattcgacgtagtagagggtgagaagggtgccgaagcagccaatgtcactggcccaggaggagtgccggttcaggggtctaagtatgccgcagaccgtaatcattatcgtcgctacccacgacggcgtggcccgcctcggaattaccagcagaactatcagaacagcgagagcggggagaagaacgaaggttctgagagcgccccggaaggccaggcccagcaaaggcgaccgtatcgccggagaaggttccccccctattacatgaggcggccgtatggacgccgaccgcagtattccaatcctcccgtgcagggcgaggtgatggagggcgccgataatcagggcgcaggtgaacagggccgccctgtgcgccagaatatgtatagagggtaccggcccaggttccgccggggcccccctagacagcggcaacccagagaggatggcaacgaggaggataaagagaatcagggagatgagactcagggacagcaaccacctcagcgaagataccggagaaatttcaactacagacggaggaggcccgaaaaccctaaaccccaagatgggaaagagacaaaggccgctgatccacccgctgaaaactcatctgcccctgaagctgagcagggcggagccgagtag

SEQ ID NO: 9655 - DNA, 420 bp, Artificial Sequence
  Description of Artificial Sequence: Synthetic coding sequence
atggccctgcggatgctgtgggccggccaggccaagggcatcctggggggctggggcatcatctgtctggtgatgtctttactgctgcagcaccctggagtgtactccaagtgctattttcaggctcaggccccttgtcattacgagggtaagtatttcacactcggtgagtcctggctcagaaaggattgctttcattgtacctgtctgcatcctgtgggagtgggttgctgcgatacatctcaacacccaatagactttcccgcaggctgcgaagtacgccaggaagctggtacctgtcaattttctctggtgcagaaatccgatccccggctaccttgcaagggcggaggcccagacccagagtggggctcagccaacacaccagtccccggcgcccctgcacctcattcctcttag

SEQ ID NO: 9656 - DNA, 462 bp, Artificial Sequence
  Description of Artificial Sequence: Synthetic coding sequence
cactactgcaaggagggctactaccgggacatgggcaagcccatcacgcaccggaaagcttgtaaagcctgcgattgccaccctgtaggcgcagcaggtaaaacgtgtaatcagacaaccggccagtgtccatgtaaggatggcgtgacaggaatcacttgcaatcgatgcgcgaaaggttaccagcaatctaggagccctattgctccctgcatcaaaatccccgtggctcctcccactacagcagcctcttctgtggaggaacccgaagctgcacgccaaccaaacacttttcaggcagaggggttgtctctgttgcctggggctgcggagaaagaaggggccaggtgttggggctatcggcgccggttgggacatagggtggcacaggccgagtgtagagggcctcggtcatgggcttgggggcgaatcacttcctccttctcatttgcatccaactag

SEQ ID NO: 9657 - DNA, 213 bp, Artificial Sequence
  Description of Artificial Sequence: Synthetic coding sequence
atgctggtgctgttcctgctgggcaccgtgttcctgctgtgcccctactggggtgaactgcatgaccccatcaaaggacagtcgatgtaccactattccaagttatcatgcatgacatcttgcgaggatatcaattttcttggatttactaaaagggtggagttgatatgttgcgaccactccaattattgcaatctgcccgaaggtgtgtag

SEQ ID NO: 9658 - DNA, 567 bp, Artificial Sequence
  Description of Artificial Sequence: Synthetic coding sequence
atgttccaccagatctgggccgccctgctgtacttctacggcatcatcctaaactcgatctatcagtgtccagagcattctcagctgacaactttgggagtggacggaaaggagtttccggaagtccatctgggacagtggtatttcatcgctggtgccgctcccactaaagaggagcttgccactttcgaccctgtcgacaacattgtgtttaacatggctgctgggtctgcacctatgcagcttcatctcagagctactatcaggatgaaagatgggctgtgcgtcccacggaaatggatttaccacctaacagagggatctaccgacctgcggaccgagggacgaccggacatgaagacagaactcttctcctcgtcatgtccaggtgggattatgcttaatgaaacaggccagggttaccaacgcttcctactgtacaatagatctcctcacccccccgagaaatgtgttgaagagtttaagtcactcacttcctgcttggattccaaagccttcctcctgactccccggaatcaggaagcctgcgagctaagcaacaactag

SEQ ID NO: 9659 - DNA, 2316 bp, Artificial Sequence
  Description of Artificial Sequence: Synthetic coding sequence
atgggctggctgacccggatcgtgtgcctgttctggggcgtgctgctcaccgcacgggcgaactatcagaatgggaaaaacaacgtcccacggctgaagctgtcttacaaagagatgttggaatccaacaacgtgattacctttaacggtctggctaattccagcagctatcacacctttctgctcgacgaggagcgcagcagattatatgtcggcgctaaagaccatatcttttctttcgatctcgtgaatataaaagactttcagaaaattgtgtggcctgtgtcttacactcgacgggatgagtgtaaatgggccggtaaagacattctcaaggagtgcgctaactttattaaggtgcttaaagcctacaatcagacccacctgtatgcttgtggcactggtgctttccatcctatctgcacctatattgaaataggacaccaccctgaagacaatattttcaaactggaaaacagccatttcgaaaacggaaggggaaagtcaccgtatgatcctaagctgctgacagccagcttactgattgatggcgaactctattccggcacggcagctgactttatgggtcgggactttgcgattttcagaactttaggccatcatcacccaatccgcaccgagcagcacgacagtcgatggctcaacgatcccaaattcattagcgcccacttgattagcgagtccgataatcctgaggatgacaaggtgtatttcttctttcgggaaaacgccatcgacggagagcatagcggaaaggctacgcatgcccgcattggacaaatttgtaaaaacgatttcggcggtcacagaagcctggttaataagtggacaaccttcttgaaggcccgactgatttgttccgtgcccggccctaacggtatcgacactcattttgatgagctgcaggacgtgttcctcatgaacttcaaggatccaaagaaccccgtagtatacggagtttttaccacatcaagtaacatctttaaggggagtgcagtctgtatgtattctatgagtgatgtgaggagagtctttctcgggccatatgcacaccgcgacgggccaaactatcagtgggtgccttaccagggcagggtgccataccctcgacccggcacttgtccaagcaagacctttggtggattcgattctaccaaggacctgcccgacgacgtcatcacttttgcaagatctcaccccgccatgtacaatccagtttttcctatgaataatcggccaattgtgatcaagactgatgttaactatcagttcacacagatcgtcgtcgatagggtggacgctgaggacggccagtatgatgtgatgttcattggcactgacgtagggactgtgttaaaagtagtctccattcctaaggaaacatggtacgatctcgaagaagtgctgctggaagagatgaccgtgtttagagagcccaccgcaatctctgctatggaattgtcaaccaagcagcagcagctttatattggcagtactgctggtgtggcccaacttccactgcaccgttgcgacatatatggcaaagcatgtgcagagtgctgtcttgcacgtgatccttactgtgcctgggacggttcagcatgctccaggtactttccaaccgctaagaggagaactcggcggcaagacatccgcaatggcgatcctcttacacattgcagcgacctgcaccatgataaccaccacggacactcccccgaggagagaatcatctacggtgtggaaaacagtagcactttcttagaatgtagtcccaagtcccagcgagccctggtgtactggcagttccaaagaagaaatgaagaaaggaaggaggaaataagagttgacgaccatatcatcaggacggaccagggactgcttctgaggagcttacagcaaaaagattctgggaactacctttgccacgccgtggagcatgggttcatacaaaccctgcttaaggttactctcgaagttatcgatacggagcacttggaagaactgctgcacaaggacgatgacggggatggttcaaaaacaaaggagatgtctaattctatgaccccatcacagaaagtgtggtatagagatttcatgcagctgattaaccatcctaatctgaatactatggatgagttctgcgagcaggtgtggaaaagggataggaagcagcggaggcaacgaccaggccatactcctggaaatagtaacaagtggaagcatctgcaggaaaataagaaaggaagaaatcgtcgaacgcatgagttcgagagggcaccacgttccgtgtag

SEQ ID NO: 9660 - DNA, 1014 bp, Artificial Sequence
  Description of Artificial Sequence: Synthetic coding sequence
atggcccggcccatgatcaaggaggcccggatggccagcctgctgctagaaaacccgtattacgggtgcagaaaacccaaagaccaggtgcgctcctcacttaagaacgtcagtgatctgttcgtgatgggtggagcactcgtgctggagtcagccgcgttacttcactggctcgaaagggagggctatggcccactggggatgactggcatttcgatgggcgggcatatggcatctctcgctgtcagtaactggcccaagccaatgcccttgatcccatgccttagctggagtactgcctctggagtgtttaccaccggggtgctttcaaagagtatcaactggcgtgaattggagaagcaatattatactcaaacagtgtatgaggaggaaatcatccatatgcttgagtactgcggtacagattctttcaagatgggtcaggaatttgttaagcatttcacctcctccgccgacaagctaaccaatctgaatcttgtctcacgaactcttaacctcgatatttcaaaccaggtggtctcacagaagccagcagattgtcataattcatctaaaacgagtgtttccgcgactagtgagggcctgctcctccaggacacttctaagatgaagcgcttcaatcagaccctgtccacaaacaagtccgggtatacttcacggaacccccagagctaccacttgctgagcaaggaacagagcaggaattctctgcgaaaggaaagtctcatctttatgaagggggttatggatgagtgtacacatgtggcaaactttagcgtgcccgtcgatccgagtctcattatcgtggtccaagccaaagaggacgcttacatacctcgaaccggtgtaaggagcctccaagaaatttggcctggatgcgagattaggtacttggaagggggacatattagcgcttatctgtttaagcaaggcctattccgccaggcaatctacgacgcctttgacagattcctgcacaaatatgccaattag

SEQ ID NO: 9661 - DNA, 462 bp, Artificial Sequence
  Description of Artificial Sequence: Synthetic coding sequence
atgggccccgaggccctgagcagcctgctgctgctgctgctggtggccagtggcgacgctgatatgaaaggacattttgacccagccaagtgtagatacgctctgggcatgcaggaccgcactattcctgatagcgatatttccgccagttcctcatggagcgacagcacagccgcccgacatagccggctcgaaagcagcgacggggacggcgcgtggtgccctgcgggctctgtgttccccaaggaagaggaatacctgcaagtggacctgcagcgactccaccttgttgctttggtagggacacaaggccggcacgccggtggcttggggaaggagttttctcgatcctatcggctgcgatatagccgtgacggccggcggtggatgggatggaaagacaggtgggggcaggaagtaatctctgggaatgaggatccagaaggcgtggttcttaagtag

SEQ ID NO: 9662 - DNA, 345 bp, Artificial Sequence
  Description of Artificial Sequence: Synthetic coding sequence
atggacaagagcctgctgctggagctgcccatcctgctgtgctgctttcgcgccctgagcggcagcctgagtatgcgtaacgacgctgtgatcgaaatcgtgcagtgccgaatgtgccatctgcagttccctggcgaaaaatgttctcgcggtcggggcatatgcaccgccaccacagaggaggcctgtatggtgggcagaatgtttaaacgcgacgggaatccatggctgaccttcatgggctgtctcaagaattgtgccgatgtcaaggggatccgctggtctgtctacttagtgaatttccgctgttgtcgttcacacgatctgtgcaacgaagacctatag

SEQ ID NO: 9663 - DNA, 630 bp, Artificial Sequence
  Description of Artificial Sequence: Synthetic coding sequence
atgggccccgaggccctgagcagcctgctgctgctgctgctggtggcctctggtgatgcagatatgaaggggcactttgatccggctaagtgccggtatgcactcggcatgcaggatcggacaatacccgactctgacatctcagcatcttcaagttggtctgattctaccgccgcaaggcacagcaggctggagtccagcgacggagacggcgcctggtgtcctgctggatccgtgttccccaaagaagaggaatatctccaggtggatctccagagactccacttggtggccctggtcgggacacagggacggcacgctggaggactgggaaaggagttcagccgaagctatcgacttagatactctagggacggcaggcggtggatgggctggaaggacaggtggggccaggaagtgatctctggcaatgaggaccccgaaggagtggtcttgaaagaccttggacccccaatggtagcccgactcgtacgcttttatccacgggcagatagagtcatgtctgtatgcctgagggttgaattatatggttgcctgtggcgggatggattgctgtcatatactgcccctgtggggcaaacaatgtatctgtctgaggctgtatactag

SEQ ID NO: 9664 - DNA, 639 bp, Artificial Sequence
  Description of Artificial Sequence: Synthetic coding sequence
gacttcggctactgcccccgggtgtactgcgagaaccagcccatgctgccaataggggtcttagtaatggtgggatttaccgtgggaaaggtgcctgtgccagatatcaggacgtgtcatttctgtctcgtggaagacccttctgttggctgtattagcggtagtgagaagtgcaccattagctctagctcactgtgcatggttatcacaatctactatgacgtgaaagtgagattcattgtacgcggatgcggccagtacatttcctatcgctgtcaggagaagcggaacacgtatttcgctgagtactggtatcaagcccagtgctgccaatacgactattgcaactcatggtccagccctcagctgcagagcagcctgcccgaacctcacgacagacccttggcattaccactctcagacagccagatacagtggttttaccaggcactgaatctgagcctaccactgcccaacttccatgcaggcactgagcccgatggcctggatcctatggtgactctgtcgctgaatctgggcctgtcgttcgcagaactccgtcgaatgtacctgttcctgaatagcagcggcctgcttgtgctgccccaggccggtctgctcaccccacatccctcttag

SEQ ID NO: 9665 - DNA, 240 bp, Artificial Sequence
  Description of Artificial Sequence: Synthetic coding sequence
atgaagctgcacagcctgatcagcgtgctgctgctgttcgtgacccttattccaaagggaaaaacaggcgttatccctgggcaaaaacagtgcattgcactgaaaggggtatgtagggataagctttgttctacgctcgatgatacaatcggcatatgtaacgaagggaaaaagtgctgccgccggtggtggattctggagccctaccctacccctgtgccaaagggaaagtccccctag

SEQ ID NO: 9666 - DNA, 1620 bp, Artificial Sequence
  Description of Artificial Sequence: Synthetic coding sequence
atgagcgagccccaggagaagaagctgagcgagaacaccgacttcctagcccccggtgttagctcttttacagacagcaaccaacaggagtccattaccaaaagagaggaaaatcaggaacagcccaggaattattctcatcatcagctgaatcggtcaagcaaacattcacagggcctacgagaccagggtaaccaggagcaggaccctaatatctccaacggtgaggaggaagaagagaaagagccaggcgaggtcggtactcacaatgataaccaggagcgtaagacggaactgccccgcgagcatgcaaactcgaagcaagaggaggataacacacagtctgatgacatcctggaggaatcagatcagcccacccaggtaagcaagatgcaggaagatgaattcgatcagggcaaccaggagcaggaggacaacagcaacgccgaaatggaggaggaaaacgcaagtaacgttaataaacatattcaggagaccgaatggcagtctcaggagggaaaaactgggttggaggctatctcgaatcacaaagaaactgaagagaaaaccgtctccgaagccttgttgatggaacccactgacgatggcaacactacacctcgaaatcacggggtggacgatgacggtgatgatgacggcgacgacggcgggacggacggcccccgacattccgccagcgatgactacttcatcccatcacaggcatttctggaagctgagcgggcccagagtatcgcctaccatctgaagattgaagagcagagagaaaaagtgcacgagaacgagaacattggcaccacggaacccggcgagcatcaggaagcgaagaaggctgagaattcttcgaacgaagaagagacttcctctgaagggaacatgcgtgtgcatgcagtcgattcctgcatgagtttccagtgcaagcggggccacatttgtaaggctgaccaacagggcaaaccccattgtgtttgccaagatcccgtaacttgccccccaaccaagccactcgatcaggtgtgcggtacggacaaccagacatatgccagtagctgccacctgtttgccacgaagtgtagactagaaggaaccaaaaaaggccatcagctgcagctggactacttcggggcttgtaaatctataccgacctgcactgactttgaggttatccagtttcctctacgcatgcgagattggctcaaaaatatcctgatgcagttgtacgaagctaatagtgaacatgcaggttacctgaacgagaaacagaggaacaaggttaagaagatctatctggatgaaaaacgcctgctggccggagaccatcctatagacctcctgttgcgtgatttcaagaaaaactaccacatgtacgtataccctgtccactggcagtttagcgaactggatcagcatcccatggatcgagttctgacccactcagagttggctccactgcgcgcctcattggttcccatggagcattgcatcactcgtttcttcgaggaatgtgatccgaacaaagacaaacatatcactttgaaggagtgggggcactgtttcggaataaaggaggaggacatagatgaaaatctgctcttctag

SEQ ID NO: 9667 - DNA, 2535 bp, Artificial Sequence
  Description of Artificial Sequence: Synthetic coding sequence
atgggccccggcgcccccttcgcccgggtgggctggcccctgcccctcttggtggtaatggcggcgggcgtagctccagtgtgggcctctcactctccccacttgccccgcccgcattcacgcgtcccgccacatcctagttcagaaaggcgggctgtgtacatcggagccctatttcctatgtcaggaggttggccagggggccaggcatgtcaacctgccgtagaaatggcccttgaagatgtgaacagtagacgcgacatcctgcctgattacgagctgaaactgatccaccacgacagtaaatgcgaccccgggcaggcgactaagtacctgtacgagctcctgtacaatgacccaattaagattatcctcatgcccggctgttcttcagtgagcaccctggttgccgaggcagcaagaatgtggaatctgatcgtgctgtcctacggcagttcctcccctgcacttagcaacaggcagaggttcccaacattttttcgaactcatccctccgccaccctgcacaatcctacccgcgtgaagttgttcgaaaagtgggggtggaaaaagatagccaccatccagcaaactaccgaggtcttcacttcgacactggacgacttagaggagcgtgttaaagaagccgggattgagataactttccgccagtcctttttctctgacccagcagttccagtgaagaacctcaaaaggcaagatgctcggattattgtcggcctcttctacgaaaccgaggcccgcaaggtgttttgtgaggtgtataaggaaagactgttcggtaagaagtatgtctggtttttgatcgggtggtatgcagataattggttcaagatatatgatccaagtataaactgtaccgtggacgagatgactgaagccgtagagggccacattacgaccgagattgtcatgctcaaccctgccaacacaaggtcaattagtaatatgacatcccaggagttcgtcgagaagctcactaagaggctgaagaggcaccctgaagagaccggagggtttcaggaagcccccctcgcctatgacgctatctgggctcttgccttagccttaaacaagactagtgggggcggcggacgtagtggggttcgcctggaagattttaattacaataatcagactatcacggatcagatttacagggccatgaattcaagctcctttgaaggtgttagcggccacgttgtcttcgatgccagcggttccaggatggcttggaccctgatcgaacagctccagggcggaagctacaagaagataggatattacgactcaaccaaagacgatctgagctggagcaaaaccgacaagtggatcggcggcagtccacctgcagaccagaccctggtgatcaagactttcagatttctctctcagaagttgttcatctctgtgagtgtactcagctcccttggcatagtgctggctgttgtttgcctgtccttcaatatctacaattcgcacgtccggtacatccaaaattcccagcccaacttgaacaacctgactgcggtgggctgttcactggcacttgctgctgtgttcccgctcgggctcgacggctatcatattggtcggaaccagtttcccttcgtttgccaggcgcggctgtggctccttggcttaggattctccctgggctacggcagcatgttcaccaaaatttggtgggtgcatactgtgttcaccaagaaggaagaaaaaaaagaatggagaaaaacactggaaccctggaagctctacgctacagtggggctgttagtgggcatggacgtcctgacgctcgccatatggcagatcgttgatccattgcataggactattgaaacatttgctaaagaggagccgaaggaggatattgatgtgtcgatcctcccacagctggaacattgctcctccaggaaaatgaacacatggctgggaatcttctatgggtacaagggtttgttgctgctgctcggaatcttcctagcctatgagactaagagtgtctccaccgagaaaatcaatgatcaccgagcagtgggcatggcaatttacaacgtagctgtgctatgtttgatcacagcgcccgtgaccatgattttaagtagccaacaggatgccgcctttgctttcgccagtttggctatcgtgttctcatcttacatcacgctggttgtcctgtttgtgccgaaaatgcgaaggttgatcacaaggggagagtggcaaagcgaagctcaagacaccatgaagacaggttcaagcactaataataacgaggaggagaagagccggttgctggagaaggagaatagggaactagagaagattattgcggagaaagaggaacgcgtgtccgagcttcggcatcagctgcagtctagacagcaacttaggtctagaaggcaccctcctacacctcccgagccaagtgggggattgccacgggggcccccagagcccccggatcgactgtcatgcgacggctctcgcgttcacctcctgtataagtag

SEQ ID NO: 9668 - DNA, 993 bp, Artificial Sequence
  Description of Artificial Sequence: Synthetic coding sequence
atgcagctgttcctgctgctgtgcctggtgctgctgagcccccagggggcttctctgcatagacaccacccccgcgagatgaagaaaagagtggaagacctacacgtcggcgcgactgttgctccctcaagccggcgcgattttaccttcgatctgctgggaaacgcactgtttactgatcttgttgtggatttacaggacacttttgtgtccgctatgaaaacactgtatctggccgacacattccctactaattttcgagattccgcaggagctatgaaacaaatcaatgactacgtggctaaacagacaaaagggaagattgtggacctcctcaagaatctcgatagcaacgccgttgtcatcatggttaattacattttttttaaagcaaaatgggaaaccagctttaaccacaaagggacccaggagcaggatttttatgtcacgagcgagacagtcgtcagagtgcccatgatgtccagagaggatcagtatcattatctgctagacagaaacctcagctgtcgcgtcgtgggcgtgccctaccagggcaatgcaaccgccctcttcatcctgccaagcgaaggaaagatgcaacaagtcgagaatggtctgagcgaaaagacactccggaagtggcttaaaatgtttaaaaagcggcagctagagctataccttccaaaattcagcatagagggaagctaccagcttgagaaagtactcccgtctctggggatcagcaacgtgttcaccagccatgccgacctatcaggtatctccaaccactctaacatccaggtcagcgagatggttcacaaggccgtggtggaggttgatgagtccggcacccgcgcggccgccgctactggcaccatctttaccttcagatccgctcggctcaacagccagagactggtcttcaacagaccattcttgatgttcattgttgataataatattctctttctggggaaagttaatcggccatag

SEQ ID NO: 9669 - DNA, 2676 bp, Artificial Sequence
  Description of Artificial Sequence: Synthetic coding sequence
atgctgcccaccgaggtgccccagagccaccccggccccagcgccctcctgcttcttcagcttctgctacctccaacaagcgccttttttccaaatatctggtccctgctcgcagcccctgggagcataactcatcaagacctgacagaagaagctgcgctgaatgtgaccctgcaactgttcctcgagcaaccaccccccggcaggccgccgctacgtctggaggacttcctcggcagaaccctgctcgctgacgaccttttcgccgcctactttggacctggttcgtcaaggcgtttcagagcagctctaggagaggttagccgggcgaacgctgcgcaggattttctccccacgagccgcaatgacccggacctccatttcgacgcagagcggctggggcaggggcgggcccgactggtgggagccctccgggaaactgtggtggctgcacgcgctctggaccatacactcgctcggcagcggcttggagcagccctgcatgccctgcaggatttttacagtcatagcaattgggtggaactcggtgaacaacagccgcacccacatctcctctggccacggcaggagcttcagaacctggctcaggtggccgatccgacatgctccgactgtgaggagctgtcttgtccacggaactggttagggtttaccctgctgacttccggctattttggtactcatcccccaaaacctcctggcaaatgtagccatggcgggcatttcgaccgttcttcttcccagcccccacggggtgggattaataaagatagcacgagtcccggattcagtccccatcatatgcttcacttgcaggccgctaaactggccctgctcgccagtattcaggccttttcccttcttcgttctcgccttggcgacagagacttttcccggctgctggacataacgcctgcctcgtctctgtcctttgtactggacactacggggtctatgggtgaggagattaatgcagccaaaatccaggcccgccatttggtggagcaaaggcggggctccccaatggagccagtgcactatgtgctcgtgccgtttcacgatccagggtttggacctgtctttactacctcagatcccgattctttttggcagcagttgaacgaaatacatgcattaggcggtggggatgaacccgaaatgtgcctgtccgccttacagctggccctactacatacacctcccctctctgacattttcgtgtttaccgacgcaagtccaaaggacgccttcctgacgaatcaggtcgagtccctcacccaggaaaggagatgtagagtgacctttttagtgactgaagacacttcccgcgttcaggggcgtgctagacgcgaaattctctcaccactgcggtttgaaccatataaagctgtggctctcgcaagcgggggtgaagttatttttacgaaagatcaacatatcagagatgtggccgcaatagtcggcgagtccatggccgctttggtcactctgcccctagatcctccggtggtcgtgcctggacagccactggtgttttctgtggacggactgcttcagaagatcaccgtccgtattcacggggatattagctctttctggataaagaaccccgcgggcgtgtctcagggccaagaggaaggcggagggcctttagggcatacccgcaggtttggtcagttctggatggtcacgatggacgacccccctcagacaggaacctgggagatccaggttacagcggaggatacccctggcgtgcgagtacaagcacagaccagtttagacttcctgttccattttggaatacccatggaggacggaccacatccgggactatatcccttgacacagcctgttgccggtcttcagactcagctgctcgttgaagtgaccgggctcggctccagggcaaaccctggggatccccagccacatttttcccatgtgatcctgaggggggtcccagagggtgctgagctgggtcaggtgccgctcgagccagtgggacctcccgaaaggggtctccttgccgctagtttgtcaccgactcttctcagcacccctaggcccttttctctggagctgattggccaggacgccgccggccggcggcttcatagggcagccccgcagccatcgactgtagtcccagtgctgctggagctgagcggaccaagcgggtttttagcacccggatctaaagtccccttgagtcttcgtatcgcctctttctccggcccccaggatctggacctgcgaacgttcgtgaacccttccttttccctcacaagcaacctgtcccgtgcccatcttgaactaaacgagtccgcatggggaaggctgtggctggaagtgccagactcagctgctcccgactctgtggtaatggtgactgttacagccggcgggcgtgaggccaatcccgtgccccccacccacgctttcctgcggctcctcgtctctgcccctgctccccaggacaggcatacaactcctaccggttcttccgatcctatcctgaccactgctactccagcttttagcccctttacgctcgtgacccaaggcagggcgggcgccggcctggccgctggtagcccttggtgggggacagtgggaggagtgctcctgctgctgggcttggcaagctggtag

SEQ ID NO: 9670 - DNA, 708 bp, Artificial Sequence
  Description of Artificial Sequence: Synthetic coding sequence
atgaagtacgtgttctacctgggcgtgctggccggcaccttcttctttgccgactcctctgtgcagaaagaggaccccgccccttatctggtgtatctcaagagccattttaatccatgcgtcggtgtcctcatcaagcccagttgggtgctggccccggcccactgttatctccctaatctcaaagtgatgctgggaaactttaaatcacgcgtccgcgatggcaccgagcaaaccatcaatcctattcagatcgtgagatactggaactactctcacagcgccccccaggacgatttgatgctgatcaaactcgctaaacccgcgatgctgaatcctaaggtgcaacctttgacgttggccaccacaaatgtgaggcctggcactgtgtgcctgctgtcagggctggactggagccaagagaacagcggacgacatcccgaccttcgccagaacctggaggctccggttatgtctgaccgcgaatgccagaagactgaacagggtaaaagtcacaggaacagcctctgcgtcaagttcgtaaaagttttttctaggattttcggcgaggtagctgtggctacagtaatatgcaaggataagctccagggaattgaagttggccacttcatgggaggggacgtgggcatttatacaaacgtgtataaatacgtgagctggatcgaaaacacagccaaggataagtag

SEQ ID NO: 9671 - DNA, 1386 bp, Artificial Sequence
  Description of Artificial Sequence: Synthetic coding sequence
atgagcctggacatccagagcctggacatccagtgcgaggagctgagtgacgcgagatgggccgagctgctgcccctgctgcagcaatgccaggtcgtacgtctcgatgactgtggcctgactgaagctcggtgtaaggatatatcatccgcccttcgggtgaacccagctcttgccgagcttaacctgaggagcaatgagttgggcgacgtgggggtccactgcgtcttgcaggggctgcaaactccctcctgcaaaattcagaaactgagcctgcagaattgctgtctaacaggtgcgggctgtggggtgttatcctctactctgcgtacattacccaccctacaagagctgcacttatcagacaacctattgggtgacgctgggcttcagctgctatgtgaaggcctgctggacccccaatgtcggctcgaaaagttgcagctggagtactgcagcctgagcgcagccagctgcgaaccccttgcctctgtgctgagggcaaagccggattttaaggagctgacggtgagcaacaacgacatcaatgaagccggcgtaagagtgctgtgccaagggctcaaagattcaccatgccagctcgaagctctgaagctggaaagctgcggcgtgaccagtgataattgccgggacctgtgcggaattgttgctagcaaggcctctttacgagagctggcccttggatctaacaaactcggcgatgtgggtatggcggagctatgcccgggtctgttacacccctcttcaaggctgcgtaccctgtggatctgggaatgtggcatcactgctaagggctgtggcgacctgtgtagagtgctgcgagctaaggagtccctaaaggagctctctcttgctggcaacgaacttggggacgagggggctcgattgctctgcgagacactgctagaacccggttgtcagctcgagtcactttgggtgaagtcttgttccttcacagctgcatgttgttcacatttcagctccgtcctcgcccagaaccgcttcctgctggagctgcagattagcaataaccgccttgaagacgccggagtccgagaactatgccagggccttggacagccaggctcagtgctgcgagtgctatggctggctgactgcgacgtaagcgactcatcctgctcaagtctcgcagcgacgctgttggctaaccacagcttgcgcgaactcgatctatcaaataattgcctcggggacgccggcattttgcagctcgttgaaagtgtgagacagcctggatgtttgctggaacagctggtgctgtatgacatatactggagcgaagaaatggaagacagattgcaggcactggagaaagacaagccctctcttagagttatttcctag

SEQ ID NO: 9672 - DNA, 2676 bp, Artificial Sequence
  Description of Artificial Sequence: Synthetic coding sequence
atgctgcccaccgaggtgccccagagccaccccggccccagcgccctgctgctcttacagctcctgcttccccctaccagcgccttctttcctaatatctggagcctcctggccgccccgggctccatcacgcaccaagatttgaccgaggaggccgctttaaacgtgactctgcaactatttctggagcaaccaccacccggcaggccacctctgagacttgaggattttttggggaggacgcttttagccgatgacctgtttgccgcttatttcggacccggttcatccagacggtttcgagccgcgctcggagaagtatcacgcgccaatgctgctcaagactttctgccaacaagcagaaatgaccctgatctgcattttgatgccgagcgtctcggccagggacgcgctcgcctggtcggagctctgcgtgaaactgttgtcgccgcgagagctctggaccatactcttgcgcggcagagacttggcgccgcgttacatgcactgcaggacttttactcccactccaattgggtcgagctcggggaacagcagccacacccccacttattgtggcctcgccaggaactgcaaaatctcgcgcaggtcgctgaccccacttgttctgattgtgaggagctctcgtgtcctcgcaattggctgggcttcactttgctgacttcaggctatttcggaacccaccccccaaagccaccagggaagtgcagtcatggcggacacttcgaccggagttcctcccagccccctcgaggtggtatcaataaggattcaacaagtccgggtttttcaccccatcatatgcttcacctccaggcagccaaacttgcattgctggcatccatccaggcattctccctcctcagatccagattaggcgacagagatttctcccgccttctcgatatcactcctgcctcctccctgtcattcgtcttggatacaacgggctccatgggagaggagatcaacgcggcaaagattcaagccaggcaccttgtggaacagcggagaggctcccctatggaaccagtgcactacgtgctggtccccttccacgacccgggtttcgggcccgtgttcactacgagcgacccagacagcttttggcaacagctgaatgaaatccacgctctgggcggcggggatgaaccagaaatgtgcctgtccgctcttcaattggccttgttacacacccctcccctcagcgacattttcgtcttcaccgacgcttcccctaaagatgcctttctgacaaatcaagtggagtccctgacccaagagcgacggtgccgtgttactttcctagtcacggaggacacatcccgagtccaaggacgcgcaaggagagagattctcagccctctccgctttgagccttataaggcagtggccctggcctccgggggggaagttatcttcacaaaggatcagcatatccgagacgtggccgcaatcgtgggggaaagtatggcagcactggtcactctgcccctggatccacccgttgtggtaccagggcaacctttggtcttttccgtggatggcctcttgcagaagatcacggtcagaattcacggcgacattagctcattctggatcaaaaatccagccggagttagccaaggacaggaggagggaggaggccccttggggcataccaggcgcttcggacagttctggatggtaacgatggatgaccctccccagacaggtacttgggagatacaggtgacagctgaggatactcctggcgttagggtgcaggcacagacaagtctggattttctttttcactttgggatccctatggaggacggcccacaccccggtctctatccactgacccagcccgtggctggtctccagacgcagctgttagttgaagtgactggattgggctccagggccaaccccggcgatcctcagccacatttctcgcatgtgatactccgtggagtgcccgaaggggcagagctgggccaggtgcctctcgagccagtcggacccccagaacgaggtctgcttgcagcctcactgtccccgacccttctgtccacaccaagaccctttagtctggagctcattgggcaggacgcagcaggaagaagactccatcgtgccgcccctcagcctagcacagtcgtgcctgttcttttggagctcagtggcccctccgggtttctcgcacctggttctaaagtccctttgtctctgagaattgcttccttttccggacctcaggatctggatcttaggacctttgtgaatcctagtttctcgctgacgtcgaatctgtctcgggctcacttagagctcaatgagagtgcttggggcagattgtggcttgaggttcccgactccgcagctcccgactctgtggtcatggtcacagtgaccgcggggggcagggaggccaatccagtccccccaacccacgcctttctgcggctcctcgtcagcgcccctgctccccaggaccggcatacaacacccacaggctcctctgatccaatccttaccaccgcaacccctgcgttcagccccttcaccctggtcactcagggccgcgccggagcaggcttagcagccggctccccttggtggggcaccgttggaggagtgttgctcttgctgggcttggcaagttggtag

SEQ ID NO: 9673 - DNA, 501 bp, Artificial Sequence
  Description of Artificial Sequence: Synthetic coding sequence
atgggccccgaggccctgagcagcctgctgctgctgctgctggtggcatcaggagacgccgacatgaagggacactttgatccagctaagtgtcgttacgcgctgggcatgcaggacaggaccatcccggattccgacataagtgcttcctcctcttggagtgattcgacagctgccaggcactcaagacttgagagcagcgacggggacggcgcatggtgccccgcgggatctgtatttcccaaggaggaggagtatctccaggtggatctgcagcggctgcatctcgtggcactggtgggcactcaaggacgccatgccggtggactgggcaaggagttttcgcggagttaccgactgcggtactctagggatggccgccgctggatggggtggaaagatcggtgggggcaggaggtaatcagcggtaacgaggatccagaaggcgtcgtgcttaaggacctgggccccccaatggttgccagactggtccgcttttag

SEQ ID NO: 9674 - DNA, 420 bp, Artificial Sequence
  Description of Artificial Sequence: Synthetic coding sequence
atgcaggccgcctgctggtacgtgctgttcctgctgcagcccaccgtataccttgtgacttgcgctaacttaacaaacggaggcaaatctgagctgctgaagagcggctcctcgaagagtaccctcaaacacatatggacagaaagttccaaggatctctctatctcccggctgctgtcccagaccttcagggggaaggagaacgacactgacctggatcttaggtacgatacccctgagccctactccgagcaagatctttgggattggctgaggaacagtaccgatctgcaggagccccggcctcgcgcaaaacggcgacccatcgttaaaaccggaaaattcaagaagatgttcggatggggagactttcacagcaatatcaagactgtcaaactcaaccttctgattactgggtag

SEQ ID NO: 9675 - DNA, 2412 bp, Artificial Sequence
  Description of Artificial Sequence: Synthetic coding sequence
atggccgccgccggcctggtggccgtggccgccgccgccgagtactcaggcaccgtcgcgagcggagggaacctcccaggggtccattgtggccccagctctggtgccggtcccggcttcggccccggaagctggtctcgctcccttgaccgtgccctggaggaggctgccgtgactggagtgctgagcttgtcaggtcgtaaactccgggagtttcccaggggggctgcaaaccatgatttgaccgacactaccagggctgatttatcaagaaataggctctcagagatccccattgaggcttgccactttgtgagcttggaaaatctcaatctgtatcagaattgcatacgctatatcccagaagccattttgaacctccaggcacttaccttccttaacattagccgcaaccagctgtcaacactgccagtgcacctgtgtaaccttcctctgaaggtgcttattgcttcaaacaacaagctcgtgtcactgcctgaggagatcgggcaccttcgccacctcatggaactggatgtgagttgcaatgagattcagaccattccttcccaaattggcaatctggaagcgctacgtgatctcaatgtccggagaaaccacctcgttcaccttccagaagaacttgcagagcttcctctaatccgccttgacttttcatgtaacaagattacgacaatccccgtgtgttataggaacctaaggcatctgcagactatcaccctggacaacaaccccctgcaatctcctcctgcgcagatctgcataaaaggtaaggtgcacatcttcaaatacctgaacatacaagcctgtaaaatcgcaccagacttgcctgactacgaccgcagacccctgggcttcggatcctgtcatgaagaactgtattctagcagaccctacggggccctggactcaggatttaattcggtggactccggagacaagcgctggtctggaaatgagccaactgacgaatttagcgatttgcctttgcgggtcgctgaaataactaaggagcagcggcttcggagagaatcccagtaccaggaaaataggggaagcctagtcgtaactaacggcggggttgagcacgatctggaccagatagactatatcgacagctgcaccgcggaagaggaagaggctgaagtgcgccagcccaaagggcccgatcctgactctctctcctcccagtttatggcctacatcgagcagaggcgcatttcccatgagggaagccctgtgaagcctgtggccatcagagagttccagaagactgaggacatgcgcagatacctgcaccagaatagggtgcccgcggagccctcatccctgctgtctctctccgcaagccataaccagctatcccacaccgatctggagctgcatcaacggagggagcagcttgtagaacggacgaggcgcgaagcccagttggcagctttgcagtacgaggaggagaaaataaggacaaagcaaatacagagagatgctgtgctggatttcgtgaaacagaaagcctcacagtcacctcagaaacagcaccccctgttagatggagtggacggtgaatgcccattccctagcaggcggtcgcaacataccgacgactccgctctgtgtatgtctctgtccggccttaaccaggttgggtgcgcggcaacactacctcattctagtgcatttacccctctgaagtccgatgacagacccaatgctctcctctcttccccagccaccgagactgttcaccactcgcctgcgtactcctttcctgccgctatccagcgcaaccagccccagcggccagagtcgttcctatttagagccggagtccgggctgagacgaataagggccatgcatcaccactgccaccttccgcagcacccacgaccgattcgacagattcaatcaccgggcagaattccaggcagcgggaggaggagcttgagcttatcgaccagcttcggaaacacatagaatatcgattgaaggtaagcctgccctgcgatttaggcgcagctttaacagatggagtagtgttgtgccatctagccaatcatgtccgacctaggagcgtgccaagcattcatgtgccaagccccgcagttcctaagctgactatggccaaatgcagaaggaatgtggaaaatttcctggaagcctgtcggaaaattggcgtgccccaggacaacttgtgcagtcctagcgatatactccaactaaacctgtcagtgaaacgaaccgtagagacgctcctatctctgggcgcacactctgaggagtcaagctttgtgtgtttgagtctacagttactgggattcgttgcattttattgcactgtgatgttgaccctgtgcgtgctttactactggctgtttcctgcacgctag

SEQ ID NO: 9676 - DNA, 633 bp, Artificial Sequence
  Description of Artificial Sequence: Synthetic coding sequence
atgtacaaggcccggccccccgccggcagcggcggccccggcgccgagccaccagcaatggccgcaccccgagggcgggctgcgccatggacaaccgctctcctgctgcttctggccagccaggttctctcccctggatcttgcgcggacgaggaggaagtacctgaagaatgggtcctacttcacgtggtccaaggtcagatcggcgccgggaattacagctatttaagacttaaccacgagggcaagatcgtcctgagaatgagaagcctcaagggcgacgcagacctctatgtgtccgctagcagcctgcatcccagcttcgatgactatgaactccagtctgcaacatgcggccccgatgcagtctcaataccagcgcacttccgccgccccgtgggtatcggagtgtacggacacccaagccacctagaaagcgaattcgagatgaaagtgtattacgatgggaccgtcgaacagcatccttttggcgaggcggcctaccccgctgacggtgctgatgctggccaaaagcatgctggggccccagaggacgcctctcaggaagaggagagcgtgttatggaccatcctcatcagtatcttaaagctcgttctggaaatcttgttctag

SEQ ID NO: 9677 - DNA, 486 bp, Artificial Sequence
  Description of Artificial Sequence: Synthetic coding sequence
tgatgccccaccgagatcatcgccttcggcgaccggctggaggagttccgttccatcaatacagaggtcgtggcttgcagtgtggactcccaatttacacacctggcatggattaatacgccacggcgccagggcggcctcggtcccatccgaatccctcttctgtccgatctgacccaccagatatccaaagactacggggtgtacctggaagactcgggccacaccctacgcggtctgtttatcatcgacgacaaggggattttgcgccagattactctgaatgatcttcctgtgggtagatccgttgacgaaacgctgaggctagtccaggcttttcagtataccgacaaacacggcgaggtgtgtcccgctggctggaaaccgggttcagagacaatcaaaccagaagataccatgaaggcttggtggccacgagagagctacaatcctcggtcttcctggaaggcagaggtgtttcgatag

SEQ ID NO: 9678 - DNA, 2886 bp, Artificial Sequence
  Description of Artificial Sequence: Synthetic coding sequence
atgctgctgctgctgctgctggcccccctgttcctgcggccccccggtgcagggggagcgcagactccgaacgcaaccagtgaaggatgtcagatcatccatccaccttgggaaggcggcatacggtatcgcggtctgactcgcgaccaggtcaaggccataaatttccttcctgtggattatgaaattgaatacgtgtgccgcggggagcgggaagtcgtggggcccaaagtccggaaatgtctcgccaatggcagctggaccgatatggatactccttcacggtgtgtgaggatttgctccaaatcgtacttgaccctggaaaacgggaaagtttttctcaccggcggcgacctacccgccctggacggggcccgcgttgattttaggtgcgatccggacttccatctggttggtagcagtcgaagtatctgtagccagggccagtggagcacgcctaaaccccactgccaggtgaacagaactccgcactctgagcggagggcagtttatattggcgccctgttccccatgtcgggtggctggcctgggggtcaagcctgtcaaccagccgtggagatggccttggaagacgtcaactcccgcagggacatcctgcctgactatgaactgaaactgatccatcatgacagtaagtgtgaccctggacaggcgacgaagtatctttacgagttactatacaatgatccaatcaagatcatattgatgcccggatgttcttcagtttcaactcttgtcgctgaagctgctcggatgtggaacctgatagtgcttagctatggctcctcgagccccgctctctctaacagacagaggtttcctaccttttttcggacccacccaagcgcaactctgcataatccgactcgggtgaagctctttgagaagtggggctggaagaaaattgctactatacaacaaacaactgaagtctttacatctaccctggatgatttggaggaacgtgtgaaggaagccggaatcgagatcacctttagacagagcttctttagcgatccggctgtgcctgtgaagaacctgaaaagacaagacgctcgcatcattgtggggctgttctatgagaccgaagccagaaaggtcttttgtgaagtttacaaggagagactgtttggtaagaagtatgtatggtttctcatcgggtggtatgctgacaactggttcaagatatatgaccccagtatcaactgcactgtcgacgagatgactgaggccgtggagggccacattaccaccgagattgtgatgctgaatcccgctaatacccgaagcatctctaatatgactagccaggagtttgtggagaagctgaccaagcggttgaagcggcatcccgaagaaaccggaggtttccaggaggcgccccttgcctatgacgcaatctgggctctggctctggctctcaataagaccagtggcggcgggggccgctccggtgtccgcctagaagactttaattacaacaaccagacaattaccgatcagatttacagagcaatgaatagctcaagttttgagggtgtttcagggcacgtggtattcgatgcctcgggaagcagaatggcctggacattaatcgagcagctgcaaggcggaagttacaaaaagatcggatattacgacagcaccaaagatgatctcagctggagtaaaaccgataaatggatcggtggatccccaccggcagaccagacgctggtcattaaaacatttcgttttcttagccaaaaactgttcatctcagtgagcgtgcttagcagtctcggtattgtgctcgccgtggtttgtctcagcttcaacatttataacagtcacgtgaggtacatccagaattctcagccgaacctcaataatctgacggcggtgggctgcagtctcgccttggccgctgtgtttcccctgggcttggatggctatcatattggaaggaaccaattcccattcgtttgtcaagcccgcctttggctgctaggccttgggttctcattgggctacgggtctatgttcacaaaaatatggtgggttcacaccgttttcacaaagaaggaagagaaaaaggagtggcggaagactctggaaccttggaagctgtacgccacagttggcttgctcgtcggtatggatgttctgactctggctatttggcagatcgtggatccactgcatagaacaatcgagacatttgcaaaagaagagccaaaagaggatattgatgtgtccatactcccccagctggaacattgtagttcccggaaaatgaacacctggctgggaattttttacggctacaaaggtttgcttctcctattgggtatctttctcgcgtacgagacgaaaagtgtttcaacagagaagataaacgatcaccgcgctgtcgggatggcaatttacaatgtggcagtgctttgcttgattaccgcccccgttacaatgatcctctctagtcagcaggatgcggcgtttgcgtttgcctcgttggcaatagtgttctccagctacattacattggtggtgttattcgttccgaaaatgagacggttaattacccgcggcgaatggcagagcgaagcccaggacaccatgaagacaggtagtagtaccaataacaatgaggaagagaaaagtagattgttagaaaaagagaatcgggagctggaaaagatcatcgctgaaaaggaggagcgagtgagcgaacttagacaccaacttcaaagcagacagcagcttagatcccgaaggcacccacctactccacctgagccgagtggtggcctacccagaggtcctccagagcctccggaccgtctgtcctgtgacggcagccgcgtccacttgctttataagtag

SEQ ID NO: 9679 - DNA, 2853 bp, Artificial Sequence
  Description of Artificial Sequence: Synthetic coding sequence
atgacctggcggatgggcccccggttcaccatgctgctggccatgtggctggtatgtgggtctgagccccatccacacgcaactatcaggggcagtcatggaggccgcaaggtgccattggtctcccctgacagttctagacccgcgaggtttttacgacacaccggacgctcccggggtatcgagcgctccacactggaggagcctaatctgcagcccctgcaaaggcgacgtagtgtgccagtgctacgactcgcccggccaaccgagccacctgcccgcagtgacataaatggtgccgccgttaggccggagcagcggcccgccgcccgcgggtcgccacgggagatgattagggatgaggggagcagcgccagatctcggatgttgaggttcccctccggctcctcctccccaaacattctggcctcattcgctggcaagaacagggtctgggtgatttccgcacctcacgcgagcgagggatattaccggctaatgatgtccctccttaaagacgacgtgtactgtgaattagcagagcgtcacatccagcagatcgtattgtttcaccaagccggggaggagggggggaaagtgaggcggatcacgtcagaaggacagatcctcgaacagccactggacccctctttgatacccaagctgatgtcttttctgaagctggagaaaggcaagttcggaatggtcctgctcaagaagacacttcaggtcgaagaacggtatccatatcccgtcagacttgaagccatgtatgaagtcattgatcaaggaccaataagaaggatcgagaaaataagacaaaagggattcgttcagaagtgtaaggcctccggagtggagggccaggtggtcgctgagggtaacgacggcggaggaggggctggccgtcccagcctcggctctgagaaaaaaaaagaagatccccggagggcacaggtaccccccactagagagagccgagttaaagtgctgcgtaagctagcggccaccgcccccgctttaccacaacctccaagtacacccagggctacaacactccccccagctcccgcgactaccgttactcgatccacctcgagggccgtcacagtggcggccagacccatgacgaccacggctttcccgactacgcagcgtccttggacgccgtccccctcccacaggcccccgaccaccactgaggtcattaccgcacgccggccttctgtttctgaaaacttatatcctcctagcagaaaagatcagcaccgggagagaccccagaccacccggcgcccatctaaggccaccagcctagaatcctttactaacgctccccctacaacgatctcggaaccttcaaccagagcagctgggccaggtcgcttccgcgacaacaggatggatcggcgcgaacacggacacagagatcccaatgtggttcccggtccacccaagcccgctaaagagaaacctcccaaaaaaaaagcccaagataaaatcctgtctaatgagtatgaagagaagtacgacttgagccgccccaccgcatcacagctggaggacgagctgcaggtcggcaatgtgccgctgaaaaaggcaaaggagtccaaaaagcacgaaaagcttgaaaagccggagaaggaaaaaaagaaaaagatgaagaacgaaaatgcagacaagctgctgaaatcagaaaaacagatgaagaaatctgagaagaagagcaaacaggaaaaagagaaaagtaagaagaaaaagggaggcaagaccgagcaggacggatatcagaagcccaccaacaaacactttacccaatcccccaagaagtctgttgccgacctactgggttcgtttgaggggaaaaggcgtctcctgctgatcacagctccaaaagccgaaaataatatgtacgtgcaacagcgcgatgagtacctggaatcgttctgcaagatggctaccaggaaaatcagcgttattaccatctttggacccgtgaataattccacgatgaagattgaccactttcagctggacaacgagaagcccatgcgggttgttgacgatgaggacttggttgatcagagattaatttccgagttgaggaaggaatacggtatgacgtataatgacttttttatggtactcacagacgtggacctgcgggtaaaacagtactacgaggttcccatcactatgaagagtgtattcgatctgatagatacatttcagagcagaataaaagatatggaaaaacagaagaaagagggaattgtctgtaaagaagataagaagcagtccctcgaaaatttcctgagtaggttccggtggaggcgacgactgctagtcatttcggccccgaatgacgaagactgggcctatagtcagcaactgagtgctctcagtggccaggcttgcaatttcggcctacggcacatcacaatcctgaaacttttgggagtgggggaggaagtcggtggagtgctggaactcttccccatcaatggaagctccgtggtggagcgggaagatgtgcccgctcatttggtcaaggatatccgcaattatttccaggtctccccagagtacttttcgatgctgttggttggcaaggacggcaatgttaagtcgtggtatccctcccccatgtggtctatggtgatcgtctacgatctgatcgactctatgcagctcagacggcaggaaatggctattcagcagtccctgggaatgcggtgccccgaggatgagtatgccggatatgggtaccattcatatcatcaaggttaccaagatggttatcaggacgattacagacaccacgagagctaccatcacggttacccctactag

SEQ ID NO: 9680 - DNA, 351 bp, Artificial Sequence
  Description of Artificial Sequence: Synthetic coding sequence
atggccgccggcagcgcccccatgcagctgcacctgcgggccaccatccggatgaaagatggcctctgcgtcccaagaaaatggatttatcatctgaccgaaggctctaccgacttgcgcacagaaggcaggcccgatatgaagacagaactattctcgagctcatgtcccggcgggattatgttgaacgaaaccggacagggataccagcggttcctactgtataatagaagccctcaccctcccgagaagtgcgttgaagagtttaagtctctgacgtcctgtctcgatagcaaagccttcctacttactccccggaatcaggaagcatgcgagctgagcaacaactag

SEQ ID NO: 9681 - DNA, 1251 bp, Artificial Sequence
  Description of Artificial Sequence: Synthetic coding sequence
atgaagttccagggccccctggcctgcctgctgctggccctgtgcctgggcagcggggaggcaggacccttgcagagtggagaggagtctaccggtaccaacatcggagaggcattaggccacgggctaggcgacgctctctctgagggcgtcgggaaagcaattggaaaggaagcaggcggagcggcagggtccaaggtgagtgaagcgctcggtcagggcacacgggaggccgtgggtacaggagtacgccaggtccctggcttcggggtggccgacgccctcggcaatcgggtcggcgaggcagcccacgccctgggaaataccggccatgagatcggaagacaggccgaagatgtcattaggcacggcgccgatgccgtgcggggatcatggcagggcgtgcctggacacaatggagcatgggagacgtccggtggacatggaatatttggatctcaggggggactcggaggccaaggccaggggaatcctggcggtctgggtactccatgggtgcacggttaccccggcaacagcgcaggatccttcggcatgaatccacaaggcgccccctggggccagggcgggaatggaggccccccgaactttggtacaaacacacagggcgctgtggcccagcctggatatggaagcgtgagagcttctaaccagaacgaaggctgcactaacccacccccatccgggtccggtggcggatctagcaattctggcgggggctccgggtctcagtccggctcatccggaagtggttccaacggcgacaataacaacggtagctcctctggtggatcgtccagcggctccagcagtggcggctcctcaggtggctcatctggaggctcatccggcaacagcggaggaagtagaggtgattcaggtagtgaatcctcctggggctcttcaacgggatcgagcagcggcaatcacggggggagcggcgggggcaatgggcataagcctggctgtgaaaagccagggaatgaagctcgtgggtctggagaatcgggaattcagggtttcagaggacagggcgtgtccagtaatatgagggaaatctccaaggagggtaatcgcctgctcgggggaagcggtgataattacagaaattctgagacttctcctggaatgtttaacttcgataccttctggaagaacttcaaatcaaagctgggttttatcaattgggacgctatcaataaggaccagcggagcagccgcattccctag

SEQ ID NO: 9682 - DNA, 933 bp, Artificial Sequence
  Description of Artificial Sequence: Synthetic coding sequence
atggtggacaaggacaccgagcgggacatcgagatgaagcggcagctgagacggctacgtgagttacatctatattccacctggaagaaatatcaagaggccatgaagacatcactgggagtaccgcagtgcgaaagagacgaagggtccctggggaagcctctatgtccccccgagattctcagcgagactctgcccggatctgtgaaaaagagagtttgcttcccgagtgaagaccacttagaggagttcattgctgagcacctgccggaagcctccaatcagtctcttttgacagtggcccacgccgatgccgggactcagacaaacggcgatcttgaagatctcgaagagcacggaccaggacagaccgttagcgaagaggcaaccgaggtgcataccatggagggggatccagacaccctggctgaattcttgatcagagacgtgttacaggaattatctagctacaacggcgaggaagaagatcccgaagaggtgaagacatctctcggcgtaccgcagagaggagacttagaagacctcgaggagcatgtcccgggtcaaactgtctccgaggaagctactggcgtacacatgatgcaggtggaccctgctacactggctaagagtgatctggaagacttggaagagcacgtccctgagcagaccgtttccgaagaagcaaccggagtgcacatgatgcaggttgaccccgctaccctggcaaagcagttggaggacagtactattacgggctcacaccaacaaatgagcgcgtcaccctcctctgcccctgcggaggaagccactgagaagacaaaggtagaggaagaagtcaaaacacggaaacctaaaaaaaaaaccaggaagcctagcaagaagtccagatggaatgtgctgaagtgctgggacatattcaatatattctag

SEQ ID NO: 9683 - DNA, 150 bp, Artificial Sequence
  Description of Artificial Sequence: Synthetic coding sequence
atggccccccccagcgtgcccctggtgctgctgctggtgctgctgttgtcactggccgagaccccagcctccgcccccgcacacagatcatcgacctttccaaagtgggttaccaagacagaacgaggacgccaacctttgaggtcttag

SEQ ID NO: 9684 - DNA, 978 bp, Artificial Sequence
  Description of Artificial Sequence: Synthetic coding sequence
atgcagggccgggtggccggcagctgcgcccccctgggcctgctgttagtctgtctgcatctccccggcctgttcgctcgctccattggggtcgtggaagagaaggtatcacagaacctgggcaccaacctcccacagctggggcagcccagttctacaggtccctctaactccgagcaccctcagccagccctagaccctcgctccaacgatttagcgcgagttccactgaagctttcagtgccggcctcagacggctttccgcccgctggaggaagcgccgttcagcggtggccaccttcctggggcctcccggccatggatagctggcctccagaagacccgtggcagatgatggctgcggccgcagaagatcggctaggagaagctctacctgaggagttatcttatctgtcttccgctgcagccctggctccaggttcaggccccctcccgggcgagtcttcgcccgatgctacaggcctgtctcccaaggcctccctgctgcatcaagattccgagtcaagacggttacctcgatccaatagtctgggagccgggggaaaaatcctgagtcagcgccccccttggtccctgatccatcgcgtcctcccggaccatccctggggtacactcaatccgtcagtgtcctggggagggggagggcccggaaccggatggggcaccagacccatgccacaccccgaagggatatgggggataaacaaccagcctcctggaacatcctggggaaacatcaatcggtaccccggtggaagctggggcaatattaacagataccccggcggcagctggggcaacatcaataggtatccaggcgggtcatggggtaacatccacttgtatccaggtataaacaatccatttccgcctggggtattgcgccctccagggtcgagctggaacattcctgctgggtttccaaaccccccatcgccaaggctgcagtggggctag

SEQ ID NO: 9685 - DNA, 390 bp, Artificial Sequence
  Description of Artificial Sequence: Synthetic coding sequence
atggccgccggcagcgcccccatgcagctgcacctgcgggccaccattcggatgaaggacggactgtgcgtcccacgaaagtggatttatcatttgactgagggctctacagatctgcgtacagagggacgtccagacatgaagaccgagcttttctcatcttcctgccctgggggcattatgcttaacgagacgggacagggttaccagcgctttctcctgtacaaccggagcccacaccccccggaaaaatgtgtggaggaattcaaatctcttacgtcctgcctggatagcaaggccttccttctaactcctcggaatcagggaaagggattaaagagtcacaagactggcttgggcctcacaaagagctcaggggtgaccggttag

SEQ ID NO: 9686 - DNA, 1056 bp, Artificial Sequence
  Description of Artificial Sequence: Synthetic coding sequence
atggccggcatccccggcctgctgttcctgctgttcttcctgctgtgcgccgtgggccaggtgtcaccatattctgccccctggaagccgacctggccggcctacagactcccagtggtgctgccccagtctacgctcaatctggcaaagcagtacctctcctatgagacgctgtacgccaatggcagcaggaccgagactcaagtcggaatttatatcctttcatccagcggtgatggggctcagcacagggattctggcagcagcggcaagagccgccgaaagcgccagatctacggctacgactcgcgcttcagcatctttggaaaagattttctgctcaattatcccttcagtacaagtgtcaaactctcaacaggctgcacagggacactggttgcggagaagcacgtgctgactgcagcccactgtattcacgatggtaagacttatgtcaaggggacacagaaactgagggtgggcttcctcaaacctaaatttaaagatggaggccgaggcgcaaacgattcaacatccgccatgcctgagcagatgaagttccagtggattagagttaaacgtactcacgtcccaaaagggtggatcaagggaaacgccaatgatatcggtatggattatgactacgcattactagaactgaaaaagccacacaaaagaaaatttatgaagattggagtttccccacctgctaagcagttacctggagggcggatccacttcagcgggtacgataacgacagaccaggaaatctggtgtaccgtttttgtgatgtcaaagacgagacctacgatctcctgtaccagcagtgcgacgcacaacccggggcctcaggaagcggagtctatgtgaggatgtggaaacgccaacagcaaaagtgggagcgcaagatcatcgggatcttctcagggcatcagtgggttgatatgaacggaagccctcaagactttaatgtcgccgtcaggattacccctttgaagtacgcgcagatttgttactggatcaagggcaactatctggactgccgagagggatag

SEQ ID NO: 9687 - DNA, 345 bp, Artificial Sequence
  Description of Artificial Sequence: Synthetic coding sequence
atggagcggggcgccggcgccaagctgctgcccctgctgctgctgttgagagctacaggatttacctgcgcccaaacagacggccggaatggatatactgctgtaattgaggtgacatctggggggccctggggggactgggcgtggcctgagatgtgtcccgatggattttttgccagcggcttctcactgaaggtggagccaccccagggcatcccaggggacgatacggccctgaatggcattaggttgcattgcgcccgcggcaacgtgcttggcaacacgcatgttgtggagagccagtccggacgatggggagcgggagtggaagaccctttaggatag

SEQ ID NO: 9688 - DNA, 825 bp, Artificial Sequence
  Description of Artificial Sequence: Synthetic coding sequence
atgtggcggtgccccctgggcctgctgctgctgctgcccctggccggtcacctagctctcggtgctcagcaggggagggggcggcgagaactggctcccggactgcacctgcggggtatccgcgatgctggggggagatactgccaagaacaggatctttgttgccgcgggagggctgacgactgcgccctcccttatctgggggcaatttgttattgcgaccttttctgcaaccgaaccgtctccgactgctgccccgacttttgggatttctgtctgggcgtcccacccccttttccaccaatccagggctgcatgcacggcggtcggatctatcccgtgctcggtacttattgggataattgtaatagatggccaccgctcgagtgttgggacttattgcctccagcgttacctggtcctgtctgggccgctctcggagccaaggaagagatggccggcaaggaccgaaccgtgtactgccctctcctaatgaaagccctcggtgcccgggttggcgaatgtcccgggtgtcagtcacctcagaggatgctacccgaaagctctagagtcctactgccccgctgtgccgagggcgagcaaccaggcgtgcagcgggggaaaggtcggatgcgcaaggcttttccagccttacagacaccacttgccctgccttcttctgcaccagcttcaccaggtgccgggaagccatcacatacgggttcttggctacccctgcgtctcttgaagcgtcagcactggcgatgggagccttggacggcctgtaaggaagctgtccagcacttagtgataactgagctgtag

SEQ ID NO: 9689 - DNA, 438 bp, Artificial Sequence
  Description of Artificial Sequence: Synthetic coding sequence
atggcccagctgttcctgcccctgctggccgccctggtgctggcccaagctcctgctgccctggccgacgtgctggagggtgatagttctgaagatcgcgcctttagggtccgcattgccggggatgcacccctgcagggagtcctgggcggagccctgacgatcccatgccacgtgcattatctgcggccgcctccatctcgaagggcagtacttggcagccctagagttaagtggacttttctgtcccgcgggcgcgaggccgaagtgctcgtcgctcgtggggtgcgtgttaaggttaacgaggcttataggttccgagttgccctgccggcatatccagcctctctgacagatgtcagcttggcgctgtctgaactgcggcccaatgattccgggatatatcgctgtgaagtgcaacacggcatcgacgactag

SEQ ID NO: 9690 - DNA, 567 bp, Artificial Sequence
  Description of Artificial Sequence: Synthetic coding sequence
atgttccaccagatctgggccgccctgctgtacttctacggcatcatcctaaattctatttaccagtgtcccgagcattcccagctgactaccttgggggttgacggcaaggagttccctgaagtccacctgggacaatggtacttcatcgctggagccgctcctactaaggaggaactagctacctttgatcctgtggataatattgttttcaatatggctgccggctctgcacctatgcaactccacctcagagctacgatcaggatgaaggatggcctctgtgtgccaaggaaatggatctaccacctgacagagggctccaccgacttgcggactgagggtaggcctgacatgaaaaccgagctgttttcatcttcttgtcccggaggcataatgttgaacgaaaccgggcagggctatcaacgatttctgctttacaacagatcaccccacccaccggagaaatgtgttgaagaatttaagtcgttgacttcctgcctggactccaaggcatttctcctcactccaaggaaccaggaggcatgcgagctcagcaataactag

SEQ ID NO: 9691 - DNA, 558 bp, Artificial Sequence
  Description of Artificial Sequence: Synthetic coding sequence
atgggccccgccggctgcgccttcaccctgctgctgctgctgggcattagcgaccgcgattaccattctgctttgcaggaagccgaagtccccatcattgatcgtcaagcctgcgaacaattgtacaatcctatcggcattttcctgccagcactagaacccgtgatcaaagaagataagatctgcgccggcgatacccagaatatgaaagacagttgtaaaggggactccggtggccccttgagttgccatattgatggagtatggatccagaccggagttgtctcctgggggttggagtgtggaaaaagtttacccggcgtttacacaaatgtgatttattaccagaagtggattaacgcgactatttcgcgagcgaataatttggactttagcgattttctctttccgatagtacttctctccctcgcactcctccgcccctcttgcgccttcggtcctaatactatccatcgcgtgggcacggtggctgaagctgtagcctgtattcaaggctgggaggagaacgcctggagattttcacctaggggtagatag

SEQ ID NO: 9692 - DNA, 1653 bp, Artificial Sequence
  Description of Artificial Sequence: Synthetic coding sequence
cccgcccccgccagccggaagctgctgccccggcggcacctgagcgagaagagccatcacatcagcattccatcgccagacattagtcacaaggggctgcgcagtaagaggacccagccctccgatcctgagacttgggagtcactgcctaggctggacagtcagcgccacggcggtcccgagttcagcttcgatctgttgccagaagccagggcaatccgtgttaccatctcttccgggcccgaggtgtcggtgcggctctgtcatcagtgggcgctggagtgtgaggaattgagcagtccttacgacgttcaaaagatcgtcagtggcggacacactgtggagctgccttacgagtttctgcttccttgtctgtgtattgaggcctcctacctgcaggaagatacggtgcgtaggaaaaaatgcccattccagagttggccggaggcatatggctcagatttctggaaaagtgtgcattttactgattacagtcagcatacccagatggtgatggccctcactctccggtgcccgcttaagttggaagcggctctgtgccagagacacgactggcataccttgtgcaaagatctacctaatgctaccgctcgggagagcgacggctggtatgtcctggagaaggtggacttgcatccacagttgtgtttcaaattctcctttggcaattcgtctcacgttgagtgccctcatcagactgggtccttgacttcctggaacgtgtctatggatactcaagcccagcagctcattttgcacttttcatcccgaatgcacgctacttttagtgctgcctggagccttcccggcttagggcaagacactcttgtgcctcctgtttatacggtgtcacaggcccggggtagttcaccagtgagcctggatctgattatccctttcctacgccccggctgctgcgtgctcgtgtggcggtctgatgtgcagtttgcctggaaacatttgttatgccccgatgtcagctatagacacttgggcttactgattctcgccctgctagccctcctaaccttactgggggtcgttctggcactcacgtgcaggcgaccacaatcagggcccggccccgcgagacccgttctcctgttgcatgcagctgattctgaagctcagagaaggcttgtgggagcactcgccgagttactgcgcgccgccttaggtggaggcagagacgtcatcgtcgacctgtgggaaggccggcacgtagcgcgagtgggtccactgccctggctctgggctgcacgaacccgtgttgcaagagagcaagggacagtgctgctactttggtcaggggccgatctgaggccagtgagcggccctgacccacgggcagccccattgcttgccctcctgcacgcggctccaaggccgctcctgctgctcgcctatttcagtcgcttgtgtgccaaaggagatattcctcctccccttagagccttgccccgttatcgcctcctcagagatttgcctagattgctcagagctttggacgcaaggcccttcgccgaggctacttcctggggccgcttgggcgcacggcagcggagacagtcaaggctggagttatgcagccggctggaacgcgaggcagctcgactagctgacttaggctag

SEQ ID NO: 9693 - DNA, 816 bp, Artificial Sequence
  Description of Artificial Sequence: Synthetic coding sequence
atgggcatcgtgtgcgcccagtgcagcttcatcctgctgctgagcattataagggccaggccccctcccttcctcttctgtcccctgtcctcacagcggacagaatcaccttataagcctgtgcacctgggtttgggccccaccgacaaggtggctgcaatcgccatggcccggatcatcgacttggtcccgtgggacgatggctctactcacgtttacgcatctccggccatacttctgcctatggagaggcagaggaaccagcttgctggagtaaagcagcaactatatcaccccgctctgcccacactgcgccatatggaccgagacacagtcaaagcctgtctccctgatgaacattgccagagcaccacctattgtaggaaagacgagttcgacaacgcacatttcaccctgcttggtgtgcccaacaagccactgcagtgcctcgacattactgccacaggacaaaaactgcggaatagatatcacgaggggaaacttgcacccattgctccggggatcaatagggtagattggccatgctttactcgggctattgaggactggtcccattttgtgtcaagtgcaggggagttcaagttaccgtgccttagaaagcgggccgaaggactgtcgggatacgccgtcaggtatctgaagccggacgtgacccagacgtggcggtattgtctgtcccagaatccatcactggatcgctacggtcagaagccactgcctttcgactcgttgaacacgttccggtcgtttggaagttcctatagtagagtcaactatctgactccttggcactag

SEQ ID NO: 9694 - DNA, 1743 bp, Artificial Sequence
  Description of Artificial Sequence: Synthetic coding sequence
atgcacctgagcgccgtgttcaacgccctgctggtgagcgtgctggccgcggtgctgtggaagcacgtcagactccgcgagcacgccgcaacactggaggaggaactcgcgctgtctagacaagcgacagagcccgctcctgcactcagaattgattaccctaaggcactccaaattttgatggaaggtgggacacatatggtgtgcacaggtaggactcataccgaccgcatatgccgattcaagtggctttgctattccaatgaagcagaggagtttatcttcttccacggcaacacctcagttatgcttccaaacctggggtctcgcaggttccagcccgccctgctcgatctgagcaccgtggaagatcataatacgcagtattttaattttgtggaactgcctgcagctgctctgcggttcatgccaaaacccgtattcgtcccggatgtcgcactgatcgctaacagatttaatcccgacaatctgatgcatgtctttcacgatgatcttctgccattattttacactttaaggcagtttccagggctcgcccatgaagccaggttattcttcatggaaggatggggggagggggctcatttcgatctgtataaactgcttagtccaaaacagccactactgcgggctcaactgaaaactttgggaaggctcttgtgcttctcacatgctttcgttggcctctctaagatcacaacctggtatcaatatggattcgttcagcctcagggcccaaaggccaacattctagtgagcgggaatgagatacgacagttcgctaggtttatgacagagaagttgaacgtttcgcatacaggcgtaccactgggggaggagtatatcttggtgttttcacggacgcagaatcggttgattctgaacgaagccgaactgctgctagcgttggcccaggaattccagatgaagaccgtgactgtatcgttagaagatcatacgtttgcagacgtcgtgaggctcgtgtctaatgccagcatgctcgtgagtatgcatggtgcgcagttagtgacaaccctcttcttgccaagaggtgcaacggtggttgaacttttcccatacgccgtcaatccagaccactatacaccctacaagaccttggcaatgctgcccggcatggacctccagtatgtcgcctggcgaaatatgatgccagaaaacaccgtaacccacccggaacggccctgggatcaagggggaatcacccatctggacagggcagaacaagcccggatcctgcaatcaagggaagtccctcggcacctatgttgccgaaatcccgaatggctgtttagaatctatcaagatactaaggtagacatcccgtccctgatccagaccataagaagggtcgttaaaggacgcccaggacccagaaaacaaaagtggacagttggcctgtatcctgggaaggtgagagaagcacggtgccaggcctccgtacacggcgctagcgaggcccggcttacagtctcatggcagattccctggaatctcaagtacctgaaagtacgtgaggtgaaatatgaggtttggctgcaagaacagggggagaacacatacgttccctacattttggcgctccagaaccacacctttaccgaaaacattaaaccatttaccacctacctggtgtgggttcgatgtatcttcaataagattctgctgggtccgtttgctgacgtcctggtgtgtaacacctag

SEQ ID NO: 9695 - DNA, 513 bp, Artificial Sequence
  Description of Artificial Sequence: Synthetic coding sequence
atggagttcgtggacgtgaccgagagcaacgcccggtgggtgcaggattttcgcttgaaagcatatgctagccccgcaaagttggagagcatcgacggggcccgctaccacgccctcctaatcccttcctgtcccggagcccttaccgacctcgctagtagtggaagccttgcgcggattctccagcacttccattccgagagcaaacctatatgcgcagtcgggcacggagtcgccgccctgtgctgtgccactaacgaggatagatcgtgggtgtttgatagctactctctcacaggacccagtgtctgcgaactggtccgggccccggggtttgccagattgcccctggttgtagaggacttcgtgaaagattcgggagcatgtttctcagcctctgagcctgacgcggtacacgtggttttggaccggcatctcgtcacgggccaaaacgcaagctctacagtgccggctgtccaaaatctgctgttcttatgtggcagccgcaaatag

SEQ ID NO: 9696 - DNA, 1041 bp, Artificial Sequence
  Description of Artificial Sequence: Synthetic coding sequence
atgcggctgctgttcctggccgtgctgcggccccacaccggcaacgcggtcaccgcccagcgcgttcgagctcatcttgaggcagcagggcacgtgtgcgttttaaaagatgcattcgacttcgagtctcgttccgagattgctaatcttatcctggctgagaactgtgaagcagccctggccttacacttatacagaggcggtagattgctgcaaggacacagaatccccttcggcgtaatcttcggaggcacagatgtcaatgaagacgccaaccaggcagagaagaacacggtgatgggacgcgtgctggaggaggccaggtttgccgtagcttttactgagtcaatgaaagagatggctcaggcacaatggccccatgcaaaggggaaggtgtacgtgcaaagccagggaatagctacgacgccaaacgccgctttcaactggaatacgtttctgcagagatccgagatcaatcaaagcgcagataatctccatatcttcctacttatctgtggcctgaggcaagtgaaagacccactgtacctcgtagatgccttttcagcttggcaccaggaggagcctaacgtccacctcgttatagtaggaccagaagtggaccctgtgtttaccagagaggtcaaggcaaaagtgaagcgggccgctggcgtcaggctcatcggagagatgccacaggaggatcttcacgccgtggtgaagaactgcttcgcagtggtgaatagttcagtcagtgagggcatgtctgctgctattctggaagctatggacctggaagtacccgtcttggctaggaatataccgggcaacgcagccgtggtgaaacacgaagtgacaggtctgcttttttccaatccgcaagaatttgtccatctcgccaagcggctggtgagtgaccctgcactggaaaaggagatcgtcgtcaacggccgtgagtacgtcaggatgtaccattcttggcaggtggagcgtgacacataccagcagctcattagaaaactggaggggtcgacagaggactag

SEQ ID NO: 9697 - DNA, 1482 bp, Artificial Sequence
  Description of Artificial Sequence: Synthetic coding sequence
agcgaggccgtgtacctgaacgacagcacctacgacggccacaccgtggggggacttcagtatggaggcttaggacagctggccgacggcgtggttggtctggatgattttagaaagagccaggagctccgggtttggccaggatacgattatgtggggtggtcaaaccacagcttctccagtggctacgttgagatggaatttgaattcgatcggctgcgagcgtttcaggccatgcaggtgcattgcaataacatgcacacattgggtgctaggttacccgggggtgtggagtgccgattcaggcggggccccgccatggcatgggagggcgaacccatgcgccataacctcggcggaaacttaggcgatccacgagccagagcagtatcggtccctctgggtggtcgcgtcgcccgattcttacagtgccggtttcttttcgctggaccatggctgctgttttcagaaatcagctttattagcgatgtcgtgaataactcctcccctgctctgggaggtacgtttccccccgctccttggtggcctcctggccctcctccgacgaacttttcctcccttgaattagaacccagagggcaacagccagtggcaaaagctgaaggctcaccaaccgcaatccttataggttgcttagtcgccatcattctacttttattactgattattgctttgatgttatggcggctgcactggaggaggctgctctcaaaggtcttagaaagtcatcccagaacgcgctcaccaggactggtcggaatccgacctacccccctcccagtctcacccatggcgctgagatgctgttctccaatccagccaaccgctagtttttggccgctcacacctgtgccccttgaggccagagcccctcctcacccgccgggaccaaatcctcctaccccgaggggggtgacaggcggcaatacttatgctgtgcccgccctcccccctggcgctgttggcgacggacccccaagggtcgactttccccgcagtaggcttagattcaaagaaaagcttggagaaggtcagtttggagaagtccatttatgcgaggtggattctccccaggatctggtgtcccttgactttccgctcaacgtacgcaaaggccacccactgcttgtggctgtcaaaattcttcgccccgatgcaactaaaaatgcccggaatgatttcttgaaggaggttaaaattatgtcccgactgaaggacccaaatatcatcaggctcctgggcgtgtgcgtccaagacgaccctttgtgcatgattaccgactacatggaaaacggcgatcttaaccagtttttatcagcccaccagctggaagacaaagccgccgaaggggccccaggggatggccaggccgcccagggccctaccatcagctatccgatgctgctccacgtcgccgcgcagattgccagcggcatgagatacctggcaaccctgaattag

SEQ ID NO: 9698 - DNA, 354 bp, Artificial Sequence
  Description of Artificial Sequence: Synthetic coding sequence
atgctgatcttctggaccatcaccctgttcctgctgggcgccgccaagggaaaggaggtgtgctatgaggacctgggctgctttagcgatacagaaccttggggagggaccgcaatcaggcctctgaagatcctgccttggagcccggaaaaaattgggacgaggttcctgttgtacacgaacgaaaaccccaacaacttccagattctcctgttatctgatccatccacaattgaagccagcaatttccagatggaccggaaaacccggtttataattcacggatttatcgacaagggcgacgagtcatgggtgaccgacatgtgcaaaccaggtgcctctccacgcgcctag

SEQ ID NO: 9699 - DNA, 1581 bp, Artificial Sequence
  Description of Artificial Sequence: Synthetic coding sequence
atgcagggccccctgctgctgcccggcctgtgcttcctgctgagccttttcggcgcagtgacccaaaagacaaagaccagctgcgcaaagtgccccccaaacgcgtcatgcgtcaataatacacattgtacctgcaatcacggatatacctccggcagcgggcagaagctgttcactttcccattggaaacgtgcaacgctattgaaacccaggccatcaccgataattgttccgaggaaaggaagacttttaatttaaacgttcagatgaacagcatggacatcagatgctccgatataatacaaggagatacacaggggccgtctgcaattgccttcattagttactcaagcctcggcaacataattaacgcaacttttttcgaggaaatggacaagaaagatcaggtatacctgaacagtcaagtcgttagcgcagcaattggccctaagcgaaatgtgagcctctctaagagtgtcactttaacgttccagcatgtcaagatgaccccgtctacgaagaaagtgttttgtgtctattggaagagtacaggacaaggctctcagtggtcccgggatggatgtttcttgatccacgttaacaagtctcatacaatgtgcaactgctctcatctaagcagcttcgctgtactcatggccctgacgtctcaggaggaagaccctgtgttgactgtcatcacatacgtgggtttgtctgtttcgctcctctgcttgttgctggcggctttaaccttcctgttgtgcaaagccattagaaacacctctacctctctgcatctgcagcttagcctgtgtctgtttctcgcccacctgctcttcctggtcggcatcgatagaactgagcctaaggtgctgtgttcaatcatcgccggtgcactgcattacctatacctcgctgcctttacctggatgcttctcgaaggggtgcacctgttccttacagcccgtaatctgacggtcgtgaactatagttctataaatcgcctgatgaagtggattatgtttccagtgggctatggcgtgcccgctgtgactgtggcaatatcagctgcttcttggccacacctttatggtacagctgacagatgctggcttcacttggatcagggtttcatgtggtcctttctcgggcccgtgtgtgcaatattcagtgctaatctagttctgttcattcttgtgttctggattctaaagcgcaagttgtccagtcttaactctgaggtgagtaccatccagaatacaaggatgctcgccttcaaggccacagcacagctgtttatactgggttgcacatggtgtctgggattgctacaggtcggccccgcagcccaggtgatggcctatctttttaccatcataaattcgctccaggggttctttatcttcctcgtatactgtctgctgagtcaacaagtgcagaagcagtaccagaaatggtttagagagatagtgaagtcgaagtccgaatcagaaacatatacactttcatctaaaatgggaccagacagcaaaccctctgagggcgatgtattccccggccaggtgaagcgcaaatactag

SEQ ID NO: 9700 - DNA, 5832 bp, Artificial Sequence
  Description of Artificial Sequence: Synthetic coding sequence
tgacccagcctggccggccggggcgccggccggatggcccccggcgccctccgaggtggctgcgagcagcgcgctcccggggggggggcaaggaccgctgcccttggcccatggccatggccctcccccggcccagcaccgtcccctggggcggccccaccccggagccgtaaaatgtcaggagcactcttatggcccctgctccctctgctgctactgttactgtccgctagggacggagtgcgcgctgctcagccccaggccccgggttatctgattgccgcgccatcagtattcagggcaggtgttgaggaagtgatctccgtcactatttttaattccccaagggaagtgacagttcaagcgcaactggtagcccagggggaacctgttgtacagagccaaggcgctatcctggacaagggaactatcaagctgaaagtaccgaccggcttacgagggcaggcactcttaaaggtatggggtcgcggatggcaggctgaggagggtcccctttttcacaaccagacatccgttacggtcgacgggcgcggtgcaagtgtttttatccaaaccgacaagcctgtgtaccgcccccagcatcgagtactgatttctatcttcacggtgagcccgaatctcaggcctgtgaacgagaagttggaagcctacatcctggaccctagggggagtcgaatgatagagtggaggcatttgaagcccttctgctgcggtattacaaatatgtctttccctctctcggaccaaccggttctcggggaatggttcattttcgtggagatgcagggtcacgcatataataagtcctttgaagtgcagaagtacgtgctgccaaagtttgaactgctcatcgacccaccgcgatacatccaggatctagacgcatgcgagactggcaccgtccgcgcacggtacaccttcggcaaacccgtggccggagccttaatgatcaatatgactgtaaacggagtgggctattatagccacgaggtggggagacctgtgctgagaaccaccaagattctgggatccagggatttcgatatctgtgtcagggacatgatccccgctgacgtgcctgagcattttagggggagggttagcatctgggcgatggtaacgagcgttgatggatcccagcaagtagccttcgacgactcgaccccagttcagcgccaactcgtggatatcagatacagcaaggataccagaaaacagtttaaaccgggactcgcctatgttggtaaagtagagctaagctacccagacgggtccccagccgagggtgtaaccgtgcaaataaaggcggagttgacacctaaggacaatatctatacatcagaagtggtgtcacaaaggggcctggtgggttttgaaatcccatcgatcccaacgagcgctcagcatgtatggctggaaacaaaagttatggcgctcaacggaaaacctgtgggagcccagtatctgcccagctacctcagtttaggttcctggtattctccttcccaatgctacctgcagctccagccaccctcccatcctctccaggtgggagaagaggcttacttttccgttaagtccacgtgcccctgcaactttacactatactacgaagtggctgctcggggaaatattgttttaagtggacagcagcccgcacacacgacgcaacaacgcagtaaacgggctgctccagcactggaaaagcctatccgcttgacccatttgtcagaaaccgagcccccgcccgcccctgaagccgaagtggacgtctgtgtgacttctcttcatctggctgttactccaagtatggtgcctctgggccggttgctggtgttttatgtaagagagaatggtgagggggtcgcagattctctgcagtttgcagttgagacatttttcgagaatcaggtcagtgtgacttactcagcgaatgagactcagcccggtgaggtagttgatctgcgcatacgggctgccaggggctcctgtgtctgcgtggctgctgtagacaaatctgtgtacttgcttcgcagcgggttccggttaacccccgcccaggtgtttcaggaactggaggactacgatgtatcggactcatttggcgtgagccgggaggatggtcctttctggtgggcaggtctcactgcccagaggaggaggagaagtagtgtgtttccgtggccctgggggatcacaaaggattcaggttttgctttcacggagactgggctcgtggtaatgaccgacagggtctcactgaaccatcgacaagacggagggctttacacagacgaggctgtgccagcctttcagccccatacaggctccctagtggcagtagctccttcccggcaccctccacggacagagaagcggaagcgtaccttctttcctgagacttggatttggcactgcctcaatatcagtgacccctcgggtgagggaaccctttcagtcaaagttcctgattccattacctcatgggtgggtgaagccgtggccctaagcacctcacaaggcttgggcattgcagagcccagcctcttaaagacatttaagccattttttgtagactttatgctgccagccttaattatacgtggcgaacaggtcaagattccactgtccgtttataattatatgggaacatgtgcggaagtgtatatgaagctttccgtgcctaagggtatacagttcgtcggacatccagggaagaggcacgtcactaagaagatgtgtgtagctccgggggaagcggaacccatttgggtcgttctgagtttcagcgacttgggcctgaataacatcaccgccaaagccctcgcctacggtgatacaaactgctgtcgagacggtaggtcttctaagcaccccgaggagaatcacgccgacagaagggtccctattggcgtcgatcatgtgaggagatctgtcatggtagaggccgaaggggtgccccgcgcatatacatatagcgcctttttctgcccatcggagcgcgtgcatatttctactccaaataaatacgagttccagtacgtccagagaccactccgactgactcgatttgacgtggctgtaagagcacataatgacgcccgcgtggcactgagtagcgggccacaagacaccgctgggatgattgagattgttctcgggggccatcagaacacccggtcttggatctctacttccaagatgggcgaacccgtcgcatctgctcataccgctaagatcctgtcgtgggacgagttcagaactttctggatcagttggcgtggcggactgatacaggtaggacatgggcccgaaccgtcaaacgaatcggttatcgttgcatggaccctgcctaggccccccgaggtgcagtttatcggcttttcaaccgggtgggggtctatgggggaatttagaatttggcgaaaaatggaggttgacgaaagttactcggaagctttcaccctcggggtgccccacggggctatcccaggttctgaacgggcaacagcttctataatcggagacgtgatgggtccaacactgaatcaccttaataaccttctgagactgcctttcggttgtggggagcagaacatgatccacttcgcacccaatgtgttcgtacttaagtatctacagaaaacccaacagctctctccagaagtggagagggagactacagactatctggtgcaaggatatcagcgccagctcacatacaagaggcaagacggctcttacagcgccttcggcgagcgggacgcctcgggttccatgtggctgacagcctttgtactgaaatccttcgcacaggctagaagctttatcttcgtggatccccgcgagctcgctgctgccaagagctggattatccagcagcaacaggccgatgggtcattcttagccgtgggtcgggtcctgaacaaggacatccagggaggtatccacgggactgtgcctctaaccgcttatgttgtggtagctttgctggaaactggcacagccagtgaggaagagcgtgggagcaccgacaaggctcgacatttcttagagagtgcggctcccctggccatggacccttactcatgtgctctaactacgtacgccctgaccttgttaaggtcccccgccgcccctgaggctctccgcaagctcaggagtttggccattatgagagacggtgtgacacattggtcgctctctaacagttgggacgttgacaaaggtacatttttgtccttcagcgatcgagtcagtcaaagcgtggtctcggccgaggtggagatgactgcgtacgctctcctaacctacacactcctgggtgatgtggccgcagctctgccggtagtaaaatggctgagccaacagaggaatgccctagggggcttttcctccacacaagatacatgcgtggcgctccaggccctggcagagtacgcgattctctcctacgctgggggtataaatttgacagtcagcctggcgtccactaatctggattaccaggagacatttgaactacaccggaccaaccagaaggtcctgcaaactgcagccattccttccctcccaactgggctgttcgtgtctgccaagggtgatggatgttgtctaatgcaaatcgacgtcacctacaatgttcccgacccagttgccaaacctgcatttcagctcctggtctcactgcaggagccagaagctcaggggcgcccaccacctatgcctgctagtgccgccgagggatccagaggggactggccacctgctgatgacgacgaccccgcggctgaccagcatcaccaggaatataaggtgatgctggaggtgtgcaccagatggctacacgccggctcctcaaatatggccgtgttggaggtacccttactgtctgggttccgagctgacatcgagtctcttgaacagctgctgctagataagcacatgggcatgaaacgctacgaagtggcagggaggagggtgcttttctactttgacgaaatccccagccgctgtttgacctgtgttagatttagagcattgcgtgaatgcgttgtcggccgcacctctgcgttgccagtgtctgtttatgactactacgagcctgcattcgaggccacacgcttctacaatgtgagcacacacagccccctcgctagagagctgtgcgcaggaccagcatgtaatgaggtcgagagagccccggctcgaggacctggctggttccccggagagagcggacccgctgtagctccggaggagggcgctgcaattgcccggtgcgggtgcgaccacgactgtggagcccaaggcaaccccgtatgcggttctgacggcgtggtctatgctagcgcttgtcggctgagagaagcagcatgcaggcaagccgcccctctggaacccgccccaccatcttgctgcgctcttgagcagagactcccagcatctagtagttctacctacggagacgatctggctagcgttgcaccaggacctttacagcaggacgtgaagctcaatggagcaggattggaggttgaggattccgatccagagccagaaggcgaggctgaagatcgagttaccgccgggccccggcctcctgtgtccagtggaaatctggagagctcaactcagtctgcatctccctttcaccgatggggtcagactcctgcacctcagcggcattctggaagggtggtgggggctcacaggcccggcttgctgtcaccagtatttgtctactccccagctttccaaagcggcggggaggagggtttgtggatgagcaacacctgtacgctgagatag

SEQ ID NO: 9701 - DNA, 456 bp, Artificial Sequence
  Description of Artificial Sequence: Synthetic coding sequence
atggaggccaccggcaccgacgaggtggacaagctgaagaccaagttcattagcgcatggaataacatgaagtactcctgggtcttaaaaacaaaaacgtactttagtaggaattccccagtgctattgttgggcaagtgctatcacttcaagtatgaggacgaagataaaaccctccccgctgagtccggttgcaccattgaggatcatgtgattgcaggtaatgttgaggaattcagaaaagatttcattagccggatctggctcacttacagggaggagtttcctcagattgaagggtcagcacttaccactgactgcggctggggttgcaccttacgcacgggtcagatgctcctggcccagggactcatcctccactttctcgggagggcctggacatggccagacgcacttaatattgaaaactctgattctgaaagctggactagctag

SEQ ID NO: 9702 - DNA, 2616 bp, Artificial Sequence
  Description of Artificial Sequence: Synthetic coding sequence
atgcggaagccccggcggaagagccggcagaacgccgagggccggaggtccccgtccccatacagcctgaagtgttcacctacgagggagacacttacttacgcacaggcacaacggatcgtggaggtggacatagacggtcggttgcaccgcatctctatttacgatcctctcaaaatcattaccgaggatgagctaactgctcaggacatcaccgaatgtaacagtaacaaagaaaattccgagcagccacagttccctgggaaatctaaaaagcccagttcaaagggcaaaaagaaagagagttgtagtaaacatgcgtcagggacatcattccacctccctcaaccaagcttcaggatggtggattctgggatccagcctgaagcaccccctctccccgcagcctattaccggtacatagagaaacctcccgaagatcttgacgccgaggtcgaatatgacatggacgaggaggatctggcctggctggacatggttaacgaaaaacgacgcgtggacgggcactctttggtgagtgccgacaccttcgagttgctggtagacaggttggaaaaagagtcctatcttgagagccgatcatcaggcgctcagcaatcccttatcgatgaggacgcattttgctgcgtctgcctggatgacgagtgtcacaattctaatgtgatcctcttctgcgacatttgtaacctagctgtacaccaagaatgttatggcgtgccttatatcccagagggacagtggctttgcaggtgctgcctacagtcgccaagccgccctgtggactgcattttatgtccgaataagggaggagcttttaaacaaacatcggatgggcactgggcccacgtcgtttgcgccatctggatccccgaagtgtgcttcgctaatacagtatttttggaacctatagagggaatcgataacattccccctgctaggtggaagcttacctgctatatttgtaagcagaaggggctcggagccgcgatacagtgccacaaggtcaactgctatactgcctttcacgtcacatgtgcccaacgggcgggactgtttatgaagatcgagccaatgcgcgaaaccagtcttaatgggaccatcttcacagttcggaaaacagcttactgcgaagcgcacagccctcccggagccgctacagcaagacggaagggggacagtcctagatctatctccgagacaggggacgaagaaggattgaaagagggagacggtgaagaagaggaggaggaagaagtggaagaggaagaacaggaagctcagggaggcgtgtcagggtctcttaaaggggtgccaaagaagagcaaaatgagcctgaagcaaaaaattaaaaaggagccagaagaggcgggccaagataccccttccactttacccatgctcgcagttcctcagatcccgagctacagactgaacaaaatctgtagcggccttagcttccagcggaagaatcagttcatgcagaggctgcataattactggctgctgaagcggcaggcccgcaacggggtgccattgatcagacgtctgcattctcatctccagtctcaaaggaacgccgagcaaagggaacaggatgaaaagacctctgccgtgaaagaagaactgaagtactggcagaaattaaggcacgatttggaacgggccagactgctgatcgagctcattagaaagagagagaagctaaaacgagaacaggtaaaggttcagcaggctgccatggagcttgaattgatgcccttcaatgtgctgctgaggacaacgcttgaccttctgcaggagaaagacccagcgcatatatttgctgaacccgtgaacctaagcgaggtgcccgattatctcgagtttatcagcaagccaatggacttttctacaatgaggaggaagctcgagagccatctgtacagaacactggaggaatttgaagaggacttcaatctgattgtgacaaattgcatgaagtataatgccaaggacaccatctttcaccgagccgcagtcaggctgagagacctgggtggcgctattctgagacatgcacgccgacaggctgagaacattggttacgaccccgagcgcggtacgcacctccctgagagtcccaagttggaggacttctacaggttctcttgggaggatggtcgatcacttctcctccctttcgaggacaggggggatttggaaccactggagctcgtgtgggctaagtgtcgcggatatccatcttacccagctctgattattgatcctaaaatgcccagagagggactgctgcacaacggggtccccatcccagtcccgccattggatgttttaaaattgggggagcaaaagcaggctgaggctggagagaagctgtttctagtcctgttctttgataacaaacgtacatggcaatggcttcctagagacaaggtcttgcctctaggggtggaggataccgttgataagctgaaaatgctcgagggtcgcaaaacctctattcgcaagtctgtacaggtagcatacgatcgcgccatgatccatctgagcagagtgcggggacctcattcatttgtcacctcaagttacctgtag

SEQ ID NO: 9703 - DNA, 2700 bp, Artificial Sequence
  Description of Artificial Sequence: Synthetic coding sequence
atgctgctgctgctgctgctggcccccctgttcctgcggccccccggcgccggtggagctcagacccctaacgctacaagcgagggatgccagataatccatcctccctgggaaggcggcatccggtacagggggctgacacgggatcaagtgaaagccattaactttctgcctgtggactatgaaatcgaatatgtttgcagaggtgaaagggaggtggttggccctaaggtgcgcaagtgtctagccaatggttcgtggactgacatggacactccaagtcggtgcgtgaaccggacaccacactctgaaaggagagctgtgtatattggggcactcttccctatgtccggcggatggccaggcgggcaggcttgccagcccgcggtggagatggctctagaagacgtgaactctcgcagagacattttgcctgattacgaattgaaactgattcaccatgactcaaagtgcgatcctggtcaggcgactaaatatttgtatgaactgttatataatgatccgattaaaataattctgatgccagggtgctcatcagtgagtactctcgtcgcagaagccgcccgtatgtggaacctgatcgtgctttcctacggctcatcttcccctgccttgtcaaatcgtcagagattccctacattcttccgcacacacccgtcggccaccctgcacaacccaacacgcgtcaagctgttcgaaaagtggggatggaaaaagatagcaacaatacagcaaactactgaagtgtttacctctaccctggatgaccttgaggaaagagtcaaggaagccgggattgagatcacctttcggcaatcttttttcagtgaccctgccgtccctgtgaagaatctgaagcgccaggatgcgcgtataatagtgggcctcttttatgaaaccgaagcccggaaggtgttctgcgaggtgtataaagaaaggctgttcgggaagaaatatgtttggtttctgatcgggtggtatgctgacaattggtttaagatttacgaccccagcatcaactgcacagtggacgagatgacggaggctgtggaaggtcatataaccacagaaattgtgatgctgaatcccgctaatacacgctctatcagtaatatgacttcccaggagttcgtcgagaaactgacaaagcgcctcaaaagacatccagaagaaactggcggctttcaggaggctcccctagcctacgacgctatttgggccctcgcactcgctcttaataagacaagcggcggaggtgggcggtctggtgtgcgccttgaggacttcaattacaataatcagactatcaccgaccagatttacagagcaatgaacagctcatccttcgaaggcgtctcgggccacgtggtgttcgacgcctccggcagtaggatggcctggacattaatagaacagctccagggaggatcatacaagaaaattgggtattacgactctaccaaggacgatttatcatggagcaagactgataaatggattggagggtctccccccgccgaccagacactcgttatcaagactttcaggttcctttcccaaaagctctttatatcggtgagcgtgttgtcatctctgggcattgtgttggcagtcgtatgcttaagctttaatatctacaattcgcacgtgcggtacatccaaaattcccagccaaatctcaataatctgaccgcggtgggatgctcactagctttggcagccgtgttccccctgggactggatggctaccacatcgggaggaatcagtttccatttgtttgtcaagcccggctgtggctgctgggcctggggttttccctggggtacgggagcatgttcacaaagatttggtgggtgcatacggtgttcacgaagaaagaggaaaaaaaagaatggcggaaaaccctcgaaccatggaaattgtacgccacagtcggtctgctggtgggaatggacgtgctaactctcgctatttggcagatcgtggatcccttgcaccgtactatcgaaaccttcgccaaagaggagccaaaagaggacatagatgttagtatcctgccccagctggagcactgctcaagcaggaagatgaacacatggctcggaatattctacgggtataaaggtctgctgctactgcttggaattttcttggcttatgagacgaagtccgttagtacggaaaaaatcaacgaccatagagctgttggcatggcaatctacaatgtggctgtcttatgtttaatcactgcaccggtgactatgattttgtcttctcagcaagatgctgcattcgcattcgcctcactggccatagttttttcatcctatatcacgttagtggtactctttgtgcctaagatgaggagactcattacccggggcgaatggcagtctgaggctcaggacacaatgaagaccgggagttctaccaataataacgaggaggaaaagtctcggctcctggagaaggaaaatcgagaactagaaaagattatcgcagagaaggaggagcgcgtcagtgaattgcgacaccaacttcagagtcgccaacaacttcgaagccgtaggcaccctcctactccaccagagccgagtgggggtctaccgcggggtccacccgaaccacccgacaggctgagttgcgatggatccagagtccatctcctgtataagtag

SEQ ID NO: 9704 - DNA, 537 bp, Artificial Sequence
  Description of Artificial Sequence: Synthetic coding sequence
atggagaccttccccctgctgctgctgagcctgggcctggtgctggctgaagccagtgaatccaccatgaagattatcaaggaggaatttactgacgaagagatgcagtatgatatggcgaaatccggccaggagaaacagaccattgagattctgatgaacccaattctcctggtcaagaatacttctctcagtatgtctaaagatgacatgtctagtacgttactgactttcagaagcttgcattacaacgacccgaaagggaacagcagcggaaacgacaaagagtgctgtaacgatatgaccgtttggcgaaaagtcagcgaagctaacggctcctgcaaatggtcaaacaactttatccgcagtagtactgaggtgatgcgtagggttcatcgcgccccatcatgtaaattcgtgcaaaaccccggaatctcatgctgcgagtctttggagctggagaatacagtgtgccagtttacaaccggcaagcaattcccgcgttgccaataccactccgtcaccagcctggaatag

SEQ ID NO: 9705 - DNA, 2184 bp, Artificial Sequence
  Description of Artificial Sequence: Synthetic coding sequence
atgatcctgagcctgctgttcagcctgggcggccccctgggctggggattgctgggcgcttgggcccaggcctcaagtacgagcctgagcgacctacagtcatccagaactcctggggtctggaaagctgaagcagaagacacaggcaaggacccggtaggtcgtaattggtgtccctacccaatgagcaaattggtcacccttctggccctgtgcaaaaccgagaagtttctgatccatagccagcagccttgccctcaaggcgcccccgattgccagaaagtgaaggtgatgtatcgtatggcgcacaagccggtctatcaggtaaaacagaaggttcttacttctctggcttggcgatgctgccctggatatacgggacccaactgcgagcatcacggtcctatggctgtatggtgttggcccgaacccgatagtctgcaggctagattagggcagctccaacggaacctctcagagcttcatatgactacagcacgaagggaggaagaactgcagtatacattagaggatatgcgtgccactctcacccgacatgttgacgaaattaaagaactatatagtgaatcagatgaaacgttcgaccagataagtaaagtggagcgacaggttgaagagctccaggtgaaccacacagccttgcgcgagctgagagttattctcatggagaaatctctaataatggaagaaaataaagaggaagtggagaggcagctgcttgagcttaatctgacactacagcacctgcaaggcggacatgcagatctaatcaaatatgtgaaggattgcaactgtcaaaagctgtacctggatctggatgtgattcgagaaggacagagagacgccaccagggctctggaagaaacacaggtttcgctggacgagcgacggcagctggatgggtctagcctgcaggccttgcaaaacgccgtcgatgcagtgagcctggccgtagatgctcacaaggcggaaggcgagcgagcgagagcggccacctcccgacttaggtcacaggtgcaggccctggacgatgaggtgggtgcactcaaggccgcggccgcagaggcccgacacgaggttaggcagctgcactctgcctttgctgctctgctcgaggatgcacttagacacgaggctgtgttagccgctctgtttggggaggaggtcctcgaggagatgtccgagcagacacccggacccctgccactcagctacgagcagattcgagtggcacttcaggatgccgcctccggattgcaggagcaggcattaggatgggacgagctcgctgctagagtcacagctctggaacaggccagcgaacccccgaggcctgctgagcacctggagccatcacacgacgcgggtagggaggaggccgcaacaacagcactcgcaggcctggccagggagctgcagtccctctccaacgatgtaaaaaacgtgggaaggtgctgtgaggcagaagcaggagcaggggccgcctctttgaacgcgtctttgcacggactgcataatgctctatttgcaacacagaggagtctggagcagcaccagcggttgttccattcactgtttggcaacttccagggcttaatggaggcaaatgtgagcctcgaccttgggaagttgcagaccatgctttctaggaaggggaagaagcagcagaaagacttagaagccccacggaagcgcgataagaaagaagctgagccactcgtggatattagggtgaccgggccggtgcctggggccttgggcgccgctctgtgggaggccgggtctcctgtggcattttacgcatcattctccgaaggaacggccgcacttcagactgtgaaatttaataccacatatataaacatcgggtcctcctactttccggaacacgggtacttcagagctcccgaaagaggcgtgtatttgtttgcggtttccgtcgagtttgggcccggacccggtactggtcagctcgtgtttgggggccaccaccgaactcccgtgtgcacgaccggccagggcagcggcagcaccgctacagtatttgccatggcagaattgcagaaaggagagcgggtctggttcgaattgactcaaggatccataactaaacggagtctctcaggcaccgccttcggaggatttcttatgttcaaaacatag

SEQ ID NO: 9706 - DNA, 828 bp, Artificial Sequence
  Description of Artificial Sequence: Synthetic coding sequence
atgggcagcgccccctgggcccccgtgctgctgctggccctgggcctgaggggcctgcaggctgggggcgagtggcgcagacctcccgcccacagcccggtcccggcaccccctctgcgctttgcctcccctcattccccccaagggcccggtcctcgcctccctggtgctctgcttccagctgcctcaggccccctccagctgagggctctgaggcagcaggaccttccttctgcacttcctggcgtgggccaggtgcttgggccaggccgtggcgcccatttactcttacattgggaacgaggcaggagagtgggattgcggcaacagctgggactaagaaggggcgccggggggcgggctggcgggtcaactggtttgcggggggcacctttgctcagagaagtagcagcagttcgttgcgccgtccatgcggcgcgcgcacacggggccgccgatggtggtgccggaccggggcgacttcgtagggccgcacccagagctacaactcgacctcgcggcccaggctgcccaagacaccggctgaggtggaaactctggggcgatgcacagtgtctgccggaagacgaggtctcacctccagggggcggcggagctggaggtcagagagctaggtctagctgtggtcggccacggagactccagccggtgttgcctggccgccatggcggctccctgcgccacggccctctgggggtcaggcatcttccagctgctgttagacgcgaagggcccgacccggctctccacgtgagacccgaatgtctgcatcgagctggacacgacggtctgccactcccacactag

SEQ ID NO: 9707 - DNA, 351 bp, Artificial Sequence
  Description of Artificial Sequence: Synthetic coding sequence
atggccgccggcagcgcccccatgcagctgcacctgcgggccaccatccgaatgaaagacggactgtgtgtgccacggaagtggatctaccacctgaccgaagggagtacagacctaaggaccgaggggagaccagacatgaagaccgagctcttctctagttcttgcccgggggggattatgctgaatgaaaccggacagggttaccagaggtttctcctgtacaacagatcaccacatccacccgaaaaatgtgtagaagaattcaaatccctgactagttgcctcgatagcaaggcattcttgctaacaccacgcaaccaggaggcgtgcgagctcagtaataattag

SEQ ID NO: 9708 - DNA, 522 bp, Artificial Sequence
  Description of Artificial Sequence: Synthetic coding sequence
atgcactggaagatgctgctgctgctgctgctgtactacaacgccgaagcctctatgtgtcacagatggagtcgggccgtgctgtttcccgccgcccacaggccaaaaagatcctcatctttgcctctcaaccccgtcttgcagacctcacttgaggaagtggaactcctttacgagttcctgttggccgagcttgagatttctcccgacttacagatatccatcaaggacgaagaattggcctctcttcggaaagcctccgacttccgcactgtgtgtaataacgtgattcccaaatcgatcccagacatcagaaggctgtccgcatccctgagttctcatccaggaatactgaagaaggaagatttcgaacgtactgtcctgactttggcatatacagcttataggacggctctcagtcatggacaccagaaagacatctgggcacaatccttagtctccctctttcaagccttgcggcacgatctgatgcgaagcagtcagccgggcgtacccccttag

SEQ ID NO: 9709 - DNA, 1482 bp, Artificial Sequence
  Description of Artificial Sequence: Synthetic coding sequence
agcgaggccgtgtacctgaacgacagcacctacgacggccacaccgtcggagggctgcagtacgggggattagggcagttagcggatggggtagtcgggctggatgattttaggaaatctcaggaactgcgcgtatggcctggctatgactatgtggggtggtctaaccacagcttcagtagcggatatgtggagatggaattcgagtttgatagactgcgcgcttttcaggccatgcaagtgcactgtaataatatgcacactctgggggcgcggttgcccggcggggtggaatgccgattccgccgcggtcccgcaatggcttgggagggtgagccaatgagacataacctcggcggtaacttaggtgaccccagagccagagctgtcagtgtccccttgggcggccgcgtggcacggtttttgcagtgccgtttcttgtttgccggcccctggcttctctttagtgaaattagcttcatctctgacgtcgttaacaattcctcccctgccctcggggggacgtttccacccgctccatggtggccaccgggtccccctcctaccaacttttcctcactagagctggagccacgtggccagcaaccggttgccaaagcggaaggaagccctactgcaattttaatcggatgcctcgtggccatcatactcctgctgctgttgattattgcactgatgctctggcgactccattggcgcagactgctgagcaaggtcttggagtcacatcctaggacccgctctccgggcctcgtggggatccggccgaccctacttcccgtgtcaccaatggccctacgctgctgttccccaattcagcccacggcctcattttggccactgaccccggtccctcttgaagctagagcccccccacatcctccaggccccaatcctccgaccccacgcggggtcactggaggcaatacctatgccgtgcctgccctgcccccaggcgccgtcggcgacgggcctcctcgggtggactttcccaggagcaggctgaggtttaaggagaagctcggcgaaggccagtttggagaagtccatctgtgcgaagtagacagccctcaggatctcgttagtctcgactttccgctcaacgttaggaagggccaccccctgttggtagcggttaagatactgcggcccgacgctacgaaaaacgctagaaatgacttcctaaaagaagtgaaaattatgagccgcctgaaggacccgaatattattaggctgcttggggtctgcgtgcaggatgatccattatgcatgataacagactacatggaaaacggggacctaaatcagttcctgagcgcacaccaactcgaggataaggcggctgagggtgcaccaggagacggtcaagctgcccagggcccgacaatttcgtaccctatgttacttcacgtggcagcacaaatagccagtggaatgcggtaccttgccacactaaactag

SEQ ID NO: 9710 - DNA, 639 bp, Artificial Sequence
  Description of Artificial Sequence: Synthetic coding sequence
atgggcctgcacctgcggccctaccgggtgggcctgctgcccgacggccttctgttcctgctgttgcttttgatgctgctggctgacccagccctgcccgctggccgtcacccccccgtggtcttgggagataacaaccgcatcccagtcataggtcctttaaagattcgggagcagcagcggtccgcagtgtctacttcgtggctgctgccgtataactatacatggagcccagagaaagttttcgtacagacccccacaattaattataccctgcgggattataggaagttctttcaggacatcgggttcgaggacggatggctgatgagacaagacacagaaggtctggtcgaggcaactatgccccccggagtgcaactgcattgcctgtacggcaccggggttccaacgcctgactccttctattatgagtcattcccagatcgtgatcccaaaatctgcttcggcgatggcgatggaaccgtcaatctgaaaagcgcactgcagtgtcaggcatggcagtcacggcaagaacatcaggtgctcctgcaggaacttcctggttcggaacatatcgaaatgctggccaacgctaccacattagcatacctcaaacgtgtcctgcttggaccgtag

SEQ ID NO: 9711 - DNA, 654 bp, Artificial Sequence
  Description of Artificial Sequence: Synthetic coding sequence
atgagcgacctgctgctgctgggcctgatcggcggcctgaccctgcttctgctactgacactcttagctttcgccggttattcaggcctgttggctggggtggaggtctctgctggctccccccctattcgtaatgtgaccgtcgcctataaatttcacatgggattatatggcgagaccgggcgcctgttcaccgagagttgctcgatctctccaaagcttaggtctattgcggtttactatgacaatcctcacatggtacctccagataaatgccggtgcgctgtgggatcgattctgagcgagggggaagagagccccagtcccgagttaatcgacttgtatcaaaagtttggatttaaagtgttcagctttcccgccccctcccacgtggtgacagcgacattcccctatacaacgattctttcgatttggctggctacaagacgggtccaccccgccctggatacatacataaaagagagaaagctctgtgcttatccaagactggagatttaccaggaagaccaaatacatttcatgtgtccattagctaggcagggggacttctacgttccagaaatgaaggaaactgagtggaagtggagaggtctggttgaggcaattgatacccaggtagacggtactgggtag

SEQ ID NO: 9712 - DNA, 345 bp, Artificial Sequence
  Description of Artificial Sequence: Synthetic coding sequence
atgaagaccttcacctggaccctgggcgtgctgttcttcctgctggtcgacactggccactgtaggggcggacaatttaagatcaagaagattaatcagcggagatatcccagagccacagatgggaaagaagaggccaaaaaatgcgcctacacttttctggtcccagagcagagaattaccggcccgatttgcgttaatacaaaggggcaggacgcatccacgataaaagacatgatcactcgtatggatcttgagaacctaaaggatgtgctttcccgacagaaacgggaaattgacgtgttgcagttggtcgtggatgtggacggcaatatagtcaactag

SEQ ID NO: 9713 - DNA, 870 bp, Artificial Sequence
  Description of Artificial Sequence: Synthetic coding sequence
atgttcgtgctgctgtacgtgaccagcttcgccatctgcgccagcggccagcctagaggtaatcagctcaaaggagagaactattccccacgctatatttgcagtattccaggcctccctgggcctcctggccctccaggggccaatggcagtccaggcccgcacggcaggataggattgccgggtagggatggcagggatggacgtaagggggagaaaggggaaaagggaaccgcaggacttcggggcaaaaccgggccattgggtctggctggcgagaagggggatcaaggtgagactggaaaaaaggggcccattggtccagagggagagaaaggggaggtcgggcccattggtccccctggccccaaaggggaccgcggtgaacagggtgaccctggcctgccaggggtgtgcaggtgcggaagcatcgtactcaagtccgccttttcagtggggataacaactagctaccccgaggagagattgcccatcatttttaacaaggtcttgttcaatgagggtgagcattacaacccagccaccggcaaattcatttgtgcgtttcctggcatctactactttagctatgatattacgctggccaataaacacctggccattggtctggtgcataatggtcagtacaggatcaaaacatttgatgcaaacaccggcaaccacgacgtagcgagcgggtccacagtaatctacttacagccagaagacgaagtgtggctggagatcttcttcactgaccaaaatggtctgtttagcgatcccggatgggccgactctctcttctctggctttctgctgtacgtggatacagactacctcgactccatctcagaggatgatgagctgtag

SEQ ID NO: 9714 - DNA, 1002 bp, Artificial Sequence
  Description of Artificial Sequence: Synthetic coding sequence
atggtgagcaagagccggtggaagctgctggccatgctggccctggtgctcgttgttatggtgtggtactcaatctctcgggaggatcgctacattgaactgttttattttcccataccagagaagaaggaaccatgcctgcaaggcgaggcagagagtaaggctagcaagctctttggaaactacagcagagatcagcccatctttcttagactggaggactacttttgggtcaagaccccttcagcgtatgaactgccttatggcacaaaaggctccgaagacctgcttcttcgggtgctggccattaccagctcttcaatcccgaagaatatccagtccctgcgctgccgtaggtgcgtagtggtgggcaacggacaccgtttaaggaacagttctctcggggacgccatcaataagtatgacgttgttatccggctgaacaacgctccagttgcaggctatgaaggtgatgtggggtccaaaacgactatgaggttgttttaccccgagagcgcccacttcgatcctaaggtggaaaacaacccggatacgctgcttgtactagttgcctttaaggcgatggacttccattggatcgagacaatcctgtctgataagaagagggtacgcaagggattctggaaacaaccccccctgatctgggacgtcaaccccaaacagattcgtatcctgaatccattttttatggagatcgctgccgataagctgctgtctttgccaatgcagcagcctcgaaagattaaacagaaacccaccacaggcctgctggccatcactctcgctctacacttgtgcgatctggtccatattgccgggtttggctatcctgacgcgtataacaaaaaacagacaatccactattacgagcagatcactctgaaaagtatggccgggagcggccataatgtaagccaggaggctcttgctattaaaaggatgttagagatgggcgctattaaaaatctgacaagcttttag

SEQ ID NO: 9715 - DNA, 531 bp, Artificial Sequence
  Description of Artificial Sequence: Synthetic coding sequence
atgcggctgctgatcctgacctgcctggtggccgtggccctggccaggcccaaactgccattgcgctaccctgaacgcctgcagaatcctagcgagagctctgaacctatcccattggagtccagagaagagtatatgaacggcatgaacaggaggaacattcttcgagaaaagcagaccgatgagattaaagacacacgaaacgagagtacgcagaattgcgtggtggcagagcccgagaagatggagtcgtctatttcctcgtcttctgaagagcagttctgtcgtctcaacgagtacaatcagctgcagctccaagcagcccacgcccaggaacagatcagacgaatgaatgagaatagccacgtccaggttccgtttcagcagctcaaccagctggctgcatacccctacgccgtttggtattacccccagatcatgcagtatgtcccattcccacccttctccgatatttcgaaccctactgctcacgagaattacgaaaagaataacgtgatgctgcaatggtag

SEQ ID NO: 9716 - DNA, 279 bp, Artificial Sequence
  Description of Artificial Sequence: Synthetic coding sequence
atgaagctgtgcgtgaccgtgctgagcctgctggtgctggtggccgcattctgttcactggcgctctcggccccaatggggtctgatcctcctacagcatgctgttttagttacaccgcaaggaagctgcccaggaattttgttgtcgactattacgaaactagcagcctatgctctcaacccgctgtggtattccaaaccaaacgggggaagcaggtgtgtgccgacccttctgagtcctgggtacaagagtatgtttatgacctggaactcaattag

SEQ ID NO: 9717 - DNA, 1656 bp, Artificial Sequence
  Description of Artificial Sequence: Synthetic coding sequence
atgacctggcggatgggcccccggttcaccatgctgctggccatgtggctggtctgcggcagcgagccccacccccatgccaccatacgcgggagtcatggcgggaggaaggtgcctctggtgtcccccgatagctctcggcctgcgcgatttctacgacatactggcaggtctcgaggtattgaaaggtcaaccctggaggaacccaacctccaacctctacagagacgcaggagtgtgcctgtgcttcgcctggcccgaccaagcaggttccgggataaccgcatggacagacgcgaacacggtcatcgtgacccaaatgtggtgccgggccctcccaaacctgccaaagagaaaccaccaaagaagaaggctcaggacaaaatactgagcaatgaatatgaggaaaaatatgacctcagtcgcccgactgcctcgcagctggaagatgaacttcaagtgggaaacgttcctctgaagaaggcaaaggagtccaaaaaacacgaaaaactggaaaagcccgaaaaggagaagaaaaaaaagatgaagaatgagaacgctgataaactactcaagagtgagaagcaaatgaaaaaaagcgaaaagaagagcaagcaggagaaggaaaagagtaaaaaaaagaaaggggggaagacagaacaggacgggtatcagaagccgactaataaacattttacgcagtcgcctaaaaagtccgtggcggatctgcttggttcatttgaaggcaagcgaaggttgctcttaatcacagcccccaaagcggagaataatatgtacgttcagcagcgagacgaatatctggagtcattctgtaagatggctacacgtaagatttccgtcataactatttttggtccagtgaacaactctaccatgaagatcgatcattttcagctcgataatgaaaagcccatgagggtcgtcgacgacgaggacttggtggaccagcggcttatatccgaattaaggaaggaatacgggatgacctacaatgatttctttatggtcctcaccgacgtcgacctgagggttaagcagtactacgaagtgcccatcacaatgaagagtgtgttcgacttaatagatactttccagtctaggattaaggacatggagaaacagaaaaaggaaggcatcgtatgcaaagaggataaaaagcaatctttggaaaattttctgtctagattccggtggcgtagacggctactcgtgatctcggcgcctaatgacgaggactgggcctacagtcagcaactgtcggccctgtcagggcaggcttgcaactttggctctagcgtggtggagagagaggacgtgcccgcccaccttgtcaaagatattcgcaattactttcaggtttcacctgagtattttagcatgctattggttggaaaggacggaaacgtcaaaagctggtacccttcaccaatgtggtcgatggtgatagtgtatgatctcattgatagcatgcagctaaggcgacaggaaatggccatccagcagtctctcggcatgcgctgtcctgaggatgaatatgcagggtatggttaccactcttatcatcagggctatcaagatggctaccaggacgactacagacaccacgaaagctaccaccacggctacccatattag

SEQ ID NO: 9718 - DNA, 1245 bp, Artificial Sequence
  Description of Artificial Sequence: Synthetic coding sequence
atgggcgtgagcaagctggacatcctgtaccggcggctgctgctgactaagctgtttatccgcggctgggggcggccagaggacttaaagcgactcttcgagttccggaagatgatcggaaaccgcgaacgctgtcaaaacctggtttctagcgactatcccgttcacatcgacaaaattgaagaacagtcagattgcaaaatattagacggccactttgtgagcccaatggcccactatgttcctgatattatgcctattgagagcgtcatcgcccgattccagttcatcgtgccaaaagagtggaactcaaagtacaggccagtctgcatacatttagcaggtacaggcgatcatcactattggagacggagaaccctaatggcacgaccgatgattaaagaagcgcgtatggcttctctgctgctcgagaacccttattacggctgcaggaaaccgaaggatcaagtccggagctcgctgaagaacgtaagcgacctgtttgtgatgggcggcgcccttgtgctcgaatccgcagccctcctgcactggcttgagcgagagggttacggccctctgggaatgactgggatatccatggggggtcacatggccagccttgccgtgagcaattggcccaagcctatgcccctgattccgtgtctcagttggagcacggcaagtggcgtctttaccactaccgatagctttaaaatggggcaggaattcgtcaagcattttacctcttccgccgacaagctcaccaatcttaatctggtgtcccggacactgaatttagacatttctaatcaggtggtatcccagaagcccgcagattgtcacaattcttcaaaaacctctgttagcgcgaccagcgaaggactcttgttacaggacacctcaaagatgaaaaggtttaaccaaacattgagtacaaacaagtcgggatacacctcacgaaatccccagagttaccatctgctaagtaaggaacagagtcgaaattcactccggaaggagtcactcatcttcatgaagggagtgatggacgagtgcacacacgtggccaatttctcagtacctgtggatcccagtttgattattgtggtgcaggccaaagaggatgcctacataccaaggactggcgtccgatctctgcaggagatatggcctggctgtgaaatccgctaccttgagggagggcacattagcgcatacctatttaagcagggacttttcagatag

SEQ ID NO: 9719 - DNA, 300 bp, Artificial Sequence
  Description of Artificial Sequence: Synthetic coding sequence
atggagcggatcagcgccttcttcagcagcatctgggacaccatcctgacaaagcaccaagaggggatctacaatactatttgtctgggagtgttactgggacttccgttgctggttattatcactctcctgtttatatgttgccattgctgttggtcgccaccaggaaagagggggcaacagcctgagaaaaacaaaaaaaagaaaaaaaagaaaaaaaagaaagacgaggaggacctctggatcagcgctcagcctaagctcttgcagatggagaagcgcccatctctccctgtctag

SEQ ID NO: 9720 - DNA, 912 bp, Artificial Sequence
  Description of Artificial Sequence: Synthetic coding sequence
atgagcgagccccagcccgacctggagcccccccagcacggcctgtacatgctcttccttctggtgctggtgttctttttgatgggcctcgttggattcatgatctgccacgtgctcaagaaaaaggggtaccgctgccgcacatcccggggttcagagccagatgatgctcagctacagccacctgaagatgatgatatgaatgaagataccgtggagcggatcgtgaggtgcattatacagaatgaggctaatgcagaagcacttaaggaaatgttgggggatagtgagggagaaggaactgtccaattatcaagcgtggacgcaacttcttcattgcaggatggcgccccttcgcatcaccatacagttcacctggggagcgctgcgccctgtctgcattgctcacgatcaaaaagacctcccctcgtgcggcaggggcgctctaaagagggaaagtctagaccacggaccggtgaaacaaccgtgtttagtgttgggcgcttcagagtgacacacatcgaaaagcggtacggcctgcatgaacacagggacgggagtcccacggacagatcctggggctctggcgggggtcaggaccccggaggggggcagggcagcggaggaggccagccaaaagctggcatgccagccatggaacgcttgccaccggaacggccccagccccaggtgctggcctctccccccgtgcagaacggcggactgagagatagcagccttaccccgagggcactcgaaggaaatccaagggcttcggccgagccgaccctacgcgcaggcggccgcggtccaagtcccggcctgccaacccaagaagctaatggccagccaagcaagcccgacactagcgatcaccaggtctctctccctcagggagccggctccatgtag

SEQ ID NO: 9721 - DNA, 444 bp, Artificial Sequence
  Description of Artificial Sequence: Synthetic coding sequence
atgggccccgaggccctgagcagcctgctgctgctgctgctggtggcgagtggtgacgcagacatgaagggccattttgatccagcgaagtgccgatacgccctggggatgcaagaccggacaattcccgactcagacatatccgcctcctcttcttggtcggattcaacagctgctaggcacagccgactcgaatccagcgacggtgacggggcttggtgtcccgccggatctgtttttcctaaggaggaggagtaccttcaagttgaccttcagcggttgcatttggtggctcttgttgggacccagggacggcatgccgggggcctgggtaaagagtttagccggagctacagattgcggtattcacgggatggacggaggtggatgggctggaaagatcgatgggggcaggaggtcatttccgggaacgaggatccctag

SEQ ID NO: 9722 - DNA, 1173 bp, Artificial Sequence
  Description of Artificial Sequence: Synthetic coding sequence
atgggcgccaccaccatggaccagaagagcctgtgggccggcgtggttgtactgctgttgctccaggggggctctgcttataagctcgtgtgttattttaccaactggtctcaggatagacaggagccgggaaaattcaccccagagaatattgacccttttttatgcagccatctgatatatagtttcgcttcgatagagaataacaaggttattattaaagacaaatcagaggttatgttgtaccagactataaacagccttaaaacgaagaacccaaaattaaagatccttctttctattggcggctacctctttggttccaagggcttccatccaatggtggatagctcaacgtctcgactggaattcatcaattcaattatcctctttctgaggaaccataactttgacggacttgatgtttcctggatctatccagaccagaaggagaacacgcactttactgtgctaatccatgagcttgctgaggcgtttcagaaggatttcaccaaatctacaaaagaacgtctgttgctgactgccggagtgagtgccggcagacagatgatcgataattcttatcaggtagagaaactcgccaaggatctcgactttattaacctgctcagctttgatttccacgggagttgggagaagccactcattacaggtcataacagtcccctctccaaagggtggcaggatagagggccttcaagctattataacgtagaatacgcagtggggtattggattcacaaagggatgccttcagaaaaggtggtaatgggtatccctacctatggccacagcttcactctggccagcgcagaaaccactgtcggagcgccggcttcaggtccaggggctgccggacctataaccgaatcatccggttttctcgcctattatgagatttgtcagttcttgaaaggagccaaaatcacccgactgcaggaccagcaggtcccatacgctgttaaaggcaaccagtgggtgggctacgacgacgtgaaatctatggaaaccaaggttcaatttctgaagaacctcaaccttggaggcgccatgatctggagcattgatatggacgatttcacgggaaagtcttgtaatcaaggtccctaccccctggttcaggcggtgaagagaagcctgggatcattgtag

SEQ ID NO: 9723 - DNA, 297 bp, Artificial Sequence
  Description of Artificial Sequence: Synthetic coding sequence
atgaacaagcacttcctgttcctgttcctgctgtactgcctgatcgtggctgtgacatctctgcaatgtattacatgtcacctcaggaccaggaccgatcgatgcaggaggggatttggcgtgtgcacagcccagaagggggaagcctgcatgctgctgaggatctaccagcgtaacacactgcagatctcctatatggtctgccagaagttctgtcgggacatgacatttgatcttcgcaaccggacctacgtacatacttgctgtaactacaactactgcaactttaaactgtag

SEQ ID NO: 9724 - DNA, 600 bp, Artificial Sequence
  Description of Artificial Sequence: Synthetic coding sequence
atggcctggggcggcgtgcacacctgctgcttccacctgtgctgctgctgttcctggcctcagggcgccgtaccagaggagttacacaagcatccgggtcagaccttgcttttgcagtgtcagtattctcctaagcgcggaccatatcagcctaagtcatggtgtcaacagacgtcaccaagccggtgtacattgctggtgacctcctccaagccgtggaccgcggtccagaaaagtcactatacaatctgggataaaccaaatgcaggtttctttaatataacgatgatccagcttacccaaaacgatagtggcttctattggtgcggtatctacaacgccagtgagaatatcataaccgtcctgcgcaatatttccctggtggtcagcccagccccaacaactagcccgatgtggactttgccttggctccccacatctactgcctgggaaccccagatccaggagattaagttcagggcgcctaccgacagtacattatggaagtcacgtgcacccgcttgcctcggctccggggggccacgcttcttggtgctcgtgctgtgcggccttctgctcgctaagggccttatgttgtag

SEQ ID NO: 9725 - DNA, 2025 bp, Artificial Sequence
  Description of Artificial Sequence: Synthetic coding sequence
atgaccaccgacgacaccgaggtgcccgccatgaccctggcccccggacatgccgccttagagactcagactttgtctgccgaaaccagcagtagagccagcacgcccgcaggtcccattcctgaggccgaaactcgaggggccaagaggatcagcccagcacgcgagaccagatcctttacaaagactagtcccaattttatggtgctgatcgctaccagcgtagaaaccagtgcggcatccggatctcctgaaggcgctggaatgacaactgtgcagactattactggtagcgaccctcgggaagcgatatttgataccctgtgtaccgacgatagctccgaagaagcaaaaacactaaccatggatatcctgaccctggcacatacatctacagaagccaagggactgtcaagcgaaagcagcgcatctagtgattccccccaccccgtcatcacaccaagccgtgcttctgagagctcagctagctcagacgggccacacccagttatcaccccctctcgcgctagtgagagttctgcatcttccgacggtccgcatccagtcatcaccccctcaagagcctctgaaagttctgcttcctcggacggaccacacccagtgattacgcccagtagggccagtgagagcagcgcttccagtgacggcccgcaccctgtgattaccccctcacgagctagcgagtccagcgcttcatctgacggacctcaccccgtaattacaccatctcgcgctagcgaatcctctgcgtcctcagatggtcctcacccggttattacaccctctagagcctctgagtcctccgcaagttctgatgggcctcaccccgtaattaccccctcacgcgcctctgagtccagtgccagctcggacggaccacatcctgtgatcacaccaagcagagccagcgagagcagtgccagttccgatgggctacaccccgtcattactcccagccgggctagtgaatcatccgcaagcagtgatggccctcatccagtcatcaccccatcgcgtgcctctgaaagttccgcctctagcgatggcccccacccggttataacaccatcttggagccccggttctgatgtaaccctgcttgcggaggcactggtgaccgtgaccaacatagaagtgatcaattgctccataactgaaattgagactacaacgtcttctatccctggcgcctcggacacagatctgatcccaacagagggggttaaggcgagttctacgagtgaccccccagctcttcccgactctacagaggcgaagcctcatattactgaagtcaccgcctcagccgagaccctatccaccgccggaacaacagagagcgccgcccctgatgcaaccgtgggtaccccactccccacgaatagcgcaactgagcgagaggtaacagctccaggggccaccactctgagcggcgcactggtgaccgtgtccagaaacccattggaggagacaagtgcactctccgtggaaacaccttcctatgtcaaagtgtctggagccgcaccagtgtctatcgaggccggctctgcagtcggcaagacaactagcttcgccggatcgtccgcctccagctacagcccaagcgaggccgcactgaagaattttactcccagtgaaaccccgaccatggacatcgcgacaaaagggccattccctacaagccgggatcctctgccgtccgtgccaccaactactacaaatagttcccggggaacaaacagcacacttgcaaaaatcacaacatcggccaaaaccacaatgaaaccccccaccgccactccgaccacagcccgcacccgacccaccactgatgtgtcagctggtgagaacggcggctttttactccttagactttccgtggcttctcccgaagacctgaccgatccaagggtagctgaacgccttatgcaacagttacacagggaactgcacgctcacgcaccccatttccaggtgtctctgctgagagtgcgaagaggatag

SEQ ID NO: 9726 - DNA, 738 bp, Artificial Sequence
  Description of Artificial Sequence: Synthetic coding sequence
atgcaggccgcctggctgctgggcgccctggtggtgccccagctgcttgggtttggtcatggagcaaggggagcagagcgtgagtgggaaggtggttggggtggagctcaggaagaggagcgtgaaagagaggccctgatgttgaaacatctgcaggaagccctgggactgccagcaggccgtggtgacgagaaccctgccgggacggtggaaggaaaagaagattgggagatggaggaagaccagggagaagaggaagaggaggaggctacgcccaccccttcatctggcccaagcccgtcccctacgcctgaggatattgttacctatatcctaggccggctagctggcctcgacgcgggcttgcaccagctgcatgtcagactgcatgctctggacactagagttgtagagctgacacaaggcctccggcagctgcgaaacgcggcaggggacaccagggatgcggtgcaagctctccaagaagcccagggccgagctgagagagaacacgggcgcctagaaggatgtctgaaggggctgagacttggtcataaatgtttcctgctctctagggatttcgaagcccagcccagcgcctcgccacacccgctgagccctgatcagcctaatggggggacgctcgagaactgcgtggctcaagcttccgatgatggatcctggtgggatcatgattgccagcgtcggctgtattacgtgtgtgagttcccgttttag

SEQ ID NO: 9727 - DNA, 279 bp, Artificial Sequence
  Description of Artificial Sequence: Synthetic coding sequence
atgatctggcggagccgggccggcgccgagctgttcagcctgatggctctgtgggagtggattgccttgagtctccactgctgggttctcgccgtggcggccgtcagcgatcagcacgcgaccagtccttttgattggctcctctctgataaaggtccattccatcggagccaggaatatactgattttgttgatcgctcacgccaaggtttctccacacgatataaaatttatcgcaatatggggcatatttcttgctaccttctgctttgggaatag

SEQ ID NO: 9728 - DNA, 177 bp, Artificial Sequence
  Description of Artificial Sequence: Synthetic coding sequence
atggccgacatgcagaacctggtggagcggctggagcgggccgtgggaaggctggaggcagtgagccacacaagcgacatgcaccggggctacgcggactccccctctaaagcaggggccgccccttatgtgcaggcatttgattcactgctcgcagggcccgtggccgagtactag

SEQ ID NO: 9729 - DNA, 732 bp, Artificial Sequence
  Description of Artificial Sequence: Synthetic coding sequence
atgggccccgaggccctgagcagcctgctgctgctgctgctggtggcctccggcgacgccgacatgaagggccactttgacccggccaagtgtagatacgctctcggcatgcaggaccgtacaattcccgattctgatatatccgcttccagctcttggagtgactctacagcagctcggcactctcggttggagagcagcgatggggatggggcctggtgccccgcaggctctgtgtttcctaaggaagaggagtatctgcaagtagacttgcaaagactccatctagtcgcattagtgggaacacaaggcaggcacgccggcggcctcggaaaggaattctcacgctcttacagactgagatactctagagacgggcgaaggtggatgggttggaaagacaggtgggggcaggaagtaattagtggaaacgaagacccggagggcgtagtgctgaaagacttgggcccacctatggtcgcacgcttagtgagattctatccccgcgcagacagggttatgtctgtttgcctgcgtgtggaattgtatgggtgtctgtggagggactgctcaatgggagtttgggcatcgtggcagatggtgtggtggggatggatgacgttgggacgcgtgcgatcttgcggttccggccaggctatgactatgtgggatggcgcgaccaccgcctctcccgtcgcgatgtggcgatggtcactgtccctcacggggtag

SEQ ID NO: 9730 - DNA, 2535 bp, Artificial Sequence
  Description of Artificial Sequence: Synthetic coding sequence
atgggccccggcgcccccttcgcccgggtgggctggcccctgcccctacttgttgtgatggccgctggcgtggcccccgtgtgggcgtctcactctccccatctccctcgtccgcactcgcgcgtgcccccgcacccctcttcagagagacgtgctgtctatatcggggccctgttccccatgagtgggggctggccaggcggccaggcgtgtcagccagcggtggagatggcccttgaggacgtcaacagccggcgagatattctaccagactatgagctcaaacttattcaccatgatagtaaatgcgatcctggacaagcaaccaaatacttgtacgaactgctctataacgatcctatcaagatcatcctcatgcctggttgcagttcagttagcaccctcgtggctgaggctgccaggatgtggaatttaatagtgctctcatatggtagcagttcaccagcgctcagtaatcgccaacggtttcctaccttctttcgcactcacccttcagcaaccctccacaatccgacgcgtgtgaagctctttgaaaagtggggatggaagaaaatcgccaccatacaacagacaacagaggtatttacgtctactctagacgatctggaggaacgcgtgaaagaggctgggatcgagattaccttccgacagagctttttctcagatccagccgtgcccgtgaagaatttaaaaaggcaagatgctcgcatcatcgtgggactattctatgagacggaggccaggaaagtcttctgcgaagtatacaaagagcggctttttgggaaaaagtacgtctggttcttaatcggctggtacgctgataattggtttaagatttacgacccctcaatcaactgcaccgtggatgagatgaccgaggctgtggaaggccacatcactacagaaattgtgatgctaaatccggccaacacacggagtatctcaaatatgacaagccaagagttcgttgagaaacttactaaacggttaaaaaggcatccagaggaaacaggaggctttcaggaagctccactggcgtatgacgccatctgggcacttgctctggccttgaataagactagcggaggcggcggcagaagtggggtgaggctggaggatttcaactacaataatcaaactattacagaccaaatttatcgggcaatgaatagcagtagctttgagggcgtaagtggacacgttgtgtttgacgctagcggttcacggatggcttggaccctgattgagcagctccaggggggctcctataaaaagataggctactatgattctaccaaagatgacctgtcttggtctaagacagataagtggattgggggctccccccctgccgaccagacccttgtgattaaaacctttcggtttctgtcacagaagctgttcattagtgtgagtgtcctgtccagtctcggcattgtcctcgccgtggtctgtctgtccttcaatatttataattctcacgtgcggtacatccagaattcccagcccaacctcaataatttgaccgcagtgggttgtagtttagctctggcggctgtcttccccctcggacttgatggatatcacattggaagaaaccagttcccattcgtgtgtcaagcacgcctctggctgctcggcctgggctttagcctcggttatggctccatgttcaccaagatctggtgggttcataccgtgtttaccaaaaaagaggaaaaaaaagaatggagaaagactctggagccctggaagttgtatgccaccgtcggattgctcgttgggatggatgtactgacgttggcaatatggcaaattgtcgacccgttgcaccggactatcgagaccttcgccaaagaagagcccaaagaggacatcgatgtcagcattctcccacagctggagcattgttcctccaggaaaatgaacacatggctgggtattttctacgggtataaagggctgctgttattgttggggatctttttggcatacgagaccaaatctgtgagcacggaaaagattaatgaccatagggcagtcggaatggctatttacaatgtggctgtcctgtgcttgatcaccgccccagtgaccatgatcctttcttcacagcaggatgccgcctttgcctttgcgtccctggcaattgtgttcagctcgtatataacgctggtcgttctctttgtacctaagatgaggcgtctcatcacccgcggagaatggcagtcagaagcacaagacacgatgaaaactggttccagcacaaacaacaacgaggaagagaaaagtagacttctcgagaaggagaatcgtgaactggagaagatcatagccgaaaaggaagagagagtgtccgaactgagacaccagctacagagccggcagcagctccgttcccgccggcatccccctactcctcccgagccgagtggaggactcccgagaggaccccctgagccgcccgatagactatcttgcgacgggagccgcgtgcacctcttatacaagtag

SEQ ID NO: 9731 - DNA, 921 bp, Artificial Sequence
  Description of Artificial Sequence: Synthetic coding sequence
cggcggacctgcgccggccccggccgggccggcggcgcccggagcgcttcctggatgtcaagactgcgcgccttgctaggtctggggttactggtggccggaagtagagttccacgaatcaaatcccagactatagcttgccgctccggtcccacttggtgggggccccagcgcctgaatagcggagggcgatgggattctgaggtgatggcaagtactgtggtaaaatatctaagccaggaagaagcacaggcagtcgaccaagaactatttaatgaataccagttctccgtcgaccagctgatggagctagctggcctgtcatgtgcaacagccatcgccaaggcctatcctcctactagcatgtccagaagccccccaaccgtcctagtgatatgcggaccaggaaataacgggggcgatggactggtttgcgcaagacatctgaaattattcggttacgaaccaaccatttactatccaaagcgtccaaacaagcctctgttcacagcactggttacacagtgtcagaagatggatatccctttcctcggagaaatgccagccgagcccatgacaattgatgagctgtatgaacttgtagtggacgcaatcttcggattcagctttaagggggacgtgagggaaccctttcatagcattctctcagtccttaaaggcctgaccgtgccaatcgcttccatcgatataccttccggatgggacgttgagaagggcaacgctgggggaatccagccggacctcctcataagccttactgcccctaaaaaaagtgcgactcagtttacagggcgttatcattatctcggaggcaggttcgtgccccccgccttagagaaaaaataccagctcaatctgcccccctatccagacactgagtgcgtgtaccgactccaatag

SEQ ID NO: 9732 - DNA, 1137 bp, Artificial Sequence
  Description of Artificial Sequence: Synthetic coding sequence
tgatacagcggcgactacatggagcccgagaagcccggcgcccccctcttgcccccccccccccaaaattctgtgccacactatgccgaggccgatatagtaacactccagggtgtgaccgggggcaacacctatgcagtgccagcactgccccccggcgccgtgggggacggccccccccgggtggacttcccacgcagtcgcctccgcttcaaagagaaacttggcgagggtcagtttggtgaggtgcatctgtgtgaggtcgattcccctcaggacttagtctccctggatttccccctgaacgtcagaaaaggacatcccctcctcgtggccgtgaaaatattgaggcccgatgctacgaaaaatgcgtcattctcccttttcagtcgaaatgactttctgaaagaggtgaaaataatgagcaggctgaaagacccaaacatcataagactcctaggagtgtgtgtgcaggatgacccgctgtgtatgatcacggattatatggaaaatggagacctgaatcaatttctgtccgcacatcagcttgaagataaggccgcggaaggggccccaggggatggacaggccgcacagggccctaccatctcctatcccatgctgcttcacgttgccgcccagattgctagcggaatgaggtatctcgccaccttaaactttgtccatcgagatctggccacccggaattgtctcgtgggagagaacttcactatcaagatcgctgactttggcatgtctaggaacctctatgccggggactattacagggtccagggccgcgccgtgctccccattagatggatggcttgggaatgcatcttaatggggaaattcaccacagcttccgacgtttgggcctttggagtcaccctatgggaggttcttatgctctgtagggcacagccattcgggcagctgaccgacgagcaagtgattgaaaacgctggcgagttctttcgagaccaggggcgacaggtttacctgtcccggcctccagcttgtcctcaggggctctatgagctgatgctcagatgttggagcagggaaagcgaacaacgacctccattttcacagctccacaggttcctcgcagaagatgccctgaacactgtgtag

SEQ ID NO: 9733 - DNA, 762 bp, Artificial Sequence
  Description of Artificial Sequence: Synthetic coding sequence
atggccccctggagccaccccagcgcccagctgcagcccgtgggcggcgatgccgtgagccccgctctgatggttctgttgtgcttgggcaacctatctaaggcaaccctttgggcagagccaggctccgtgatctccagggggaacagcgtgaccatccgctgtcagggaacccttgaggcccaagagtaccggctagtaaaagaggggtctcccgagccatgggacacacagaacccgctcgaaccaaagaacaaagcgaggttcagcatccccagtatgaccgagcatcatgcagggagataccgctgttattactatagccccgctgggtggtctgagccgagtgacccgcttgagttggtggttacaggcttctacaacaagccgaccctctccgccctcccgtcacccgtggtgacatctggggagaatgtgaccttacagtgcggatctagactgcgctttgacaggttcatactcaccgaagagggggaccataagcttagttggactcttgatagtcagctgaccccatctgggcagtttcaggcgctgttccctgtgggcccagtgacaccctcacatcgttggatgctccgttgctatggtagccgacgtcacattctccaggtttggtctgaaccctcagatctacttgagatcccggtttctggcgaagaggccactgtgttttcctccacaatccagggctcacaaacgggctgtggggaactctacagacagggatctccatgctag

SEQ ID NO: 9734 - DNA, 288 bp, Artificial Sequence
  Description of Artificial Sequence: Synthetic coding sequence
atgcggaagccccggcggaagagccggcagaacgccgagggccggagaagcccgagcccctatagcctgaagtgttcccccacgagagagacactgacttatgctcaggctcagaggatcgtggaggtagacatcgacgggcgacttcataggatttccatttatgacccccttaagataatcactgaggacgaattgaccgctcaggacatcaccgaatgcaactccaacaaagagaacagtgagcaaccccagttccccggcaaatcaaaaaaaccgagttcttag

SEQ ID NO: 9735 - DNA, 1311 bp, Artificial Sequence
  Description of Artificial Sequence: Synthetic coding sequence
atgaagttccagggccccctggcctgcctgctgctggccctgtgccttggcagcggggaagctggtcccctccaatcaggcgaggagtccacagggactaatatcggtgaggcactgggccatggcctcggagacgccctatcagagggagtgggaaaggccatcgggaaggaagctggcggggctgcagggagcaaggtgagcgaggccctaggccagggtactagggaggcggtgggcactggcgtcagacaggttccaggcttcggagtcgcagacgcgctggggaatcgcgtcggagaggccgcacacgccctcggcaataccgggcacgaaatcggacgccaggctgaggacgttattcggcatggagcggatgcagtacggggttcctggcagggcgtgcctggacataacggggcttgggaaacgtcaggtggccacgggatcttcggtagccagggcggtctgggtggccaaggccagggaaacccgggagggcttggcactccctgggtgcatgggtaccctgggaattctgcgggcagtttcggaatgaaccctcagggcgctccgtggggccaaggggggaatgggggaccccctaattttggcactaacacccagggcgccgtcgcccagccaggctatggctctgtccgcgcgagcaaccagaacgagggatgcacaaaccccccacctagtggctccggcggcggctccagcaactcaggaggtggttccggttctcagtcaggatcttccgggtccgggagcaacggggacaataacaatgggagttcgagtggcgggtcctcctcagggagtagttccggtggctcctctggtggttcgagcggtgggagcagtgggaattctggcggcagccgcggagacagcgggtcagagagctcatggggaagtagcacaggcagtagctcaggcaatcacggcggctcagggggtggcaacgggcacaagcccggctgcgagaagcctgggaatgaggctcgtgggtcgggggaatccggaattcagggttttcgggggcagggcgtgtcatccaacatgcgcgaaattagcaaggaaggtaaccgcctcctgggcggctcaggcgataactacagaggacaggggtctagctgggggagcggtgggggggacgcggtagggggtgtgaacacagtaaactctgaaacctcacccggcatgttcaatttcgacacattctggaagaatttcaagagcaagttggggtttataaattgggacgcaattaataaagatcagcgctcaagtcgcataccttag

SEQ ID NO: 9736 - DNA, 240 bp, Artificial Sequence
  Description of Artificial Sequence: Synthetic coding sequence
atgcccgcctgccggctgggccccctggccgccgccctgctgctgtcactgttgctttttggattcactctcgtgagtggtactggtgccgaaaagaccggcgtttgtccagaattacaggcagaccagaactgtactcaggaatgtgtgtcagactcagagtgcgctgataaccttaagtgctgcagcgctgggtgcgccacattctgctctttgcctaatggccaactggcagaatag

SEQ ID NO: 9737 - DNA, 2130 bp, Artificial Sequence
  Description of Artificial Sequence: Synthetic coding sequence
atgggctgcctgtggggcctggccctgcccctgttcttcttctgctgggaagttggtgtgtcagggtcaagcgccggaccctccacacgccgtgctgacacagccatgactactgatgacactgaggtgcctgcaatgacattggccccaggccatgcagctctggaaacacagaccctttctgccgagaccagtagccgggcttccacacctgcgggaccgatacctgaagctgaaactcgcggggctaagcgcattagccctgcacgcgagactcggtcatttactaaaacctcgcccaattttatggtcctgatcgcaacatccgtggaaacctctgccgcctctggtagccccgagggcgctggaatgacaacagtccaaaccattaccggctccgatcctcgagaagccatatttgatacattgtgtacggacgattccagtgaagaggcaaaaaccttaactatggatatattgacactcgcccacactagtaccgaggctaaagggctgtcatctgaaagttccgcaagtagcgattcaccacaccccgtaatcacaccatcaagagcttcagagtcttccgcatcttctgatggacctcaccctgtcattactccatccagagccagtgaaagctcagcctcatccgatgggccccaccctgtaatcaccccctcccgcgcgtcagaatcttccgcctccagtgacggtccacatcccgtaatcacaccaagcagagcctccgaatcgtctgcttcctccgatgggccacaccctgtgattactccctctcgggccagcgagtcatctgccagctcggatggtccacaccctgtgataaccccaagtcgggctagtgagtcttctgcatctagcgatggtccccacccagtgattactccgtcccgggcctccgagagctctgctagtagtgacgggcctcatcctgtgattactccgagtcgggcctcagaatcctctgcctcctctgatggtccccaccccgtgattacccccagtcgagcatctgaaagctcggccagttcagatgggctgcaccccgtgatcactccaagtcgcgcctctgaatcatctgcgtccagcgatggtccgcatcctgtcataaccccatcacgggccagtgagagctccgctagttctgatgggccccatcctgtcatcacgccaagctggagccccggctcggatgtaacactccttgcggaggccctcgtcacagtcaccaatatagaagttattaactgctctatcactgagatcgaaactaccaccagctccattcccggcgcttcagacaccgacttaatcccgaccgagggtgtgaaggcttcctctacaagcgacccccctgccctgccagactccaccgaggcaaaaccacacataacagaggtgacagccagcgcggagactctgtctactgccggtacaaccgaaagcgctgcacctgacgctactgttggaacccctttacctaccaactcagctacggaacgggaagttactgcaccaggagccacaactctgagcggggctctcgtcactgtgtccagaaatccactggaggaaacttctgcactgagtgtagaaaccccttcctacgttaaggtttcaggagcagcaccagttagcatcgaggccgggagcgctgtgggcaagacaacatcttttgcaggatctagcgcctcttcttactccccttcagaagccgcgttaaagaatttcacgcccagcgagactcccacaatggacatcgccaccaagggcccctttccgacgagtcgggatccactcccctctgtcccgccaacaaccaccaattcctcgaggggtaccaacagcaccctggcaaaaataaccacttcggcgaaaaccaccatgaagccccccaccgctaccccaacaaccgcgcgaacccgtcctacgaccgatgttagcgccggcgagaatggcggtttcctgctgctaaggctgagcgttgcgtcgccagaagacctaacggaccctcgggtcgctgagcgcctgatgcagcagctccatcgcgaactgcacgctcacgcccctcatttccaagtgtctctcttacgggtccggagaggctag

SEQ ID NO: 9738 - DNA, 2067 bp, Artificial Sequence
  Description of Artificial Sequence: Synthetic coding sequence
atgctgcccaccgaggtgccccagagccaccccggccccagcgccttactcctcttacagttgcttctgccaccgacaagcgcttttttcccgaatatctggtcccttctggcggcccccggtagtatcacacatcaagacctcaccgaggaggcggccctgaatgttacactgcagctttttttggaacagcccccacctgggcggccaccactgcgcctagaagacttcctggggcgcacattgctcgccgacgacctgtttgcggcatattttgggcccgggtccagccggaggttcagggcagcactgggggaggtctcacgggccaatgcagcccaggatttcttaccaacttcccgcaatgacccggacctgcacttcgatgcagagagacttggccaaggtagagcccgtttagtgggcgctcttagggagaccgtggtggccgccagggccctggatcacacactggcccggcagcggttaggcgccgcactgcacgcccttcaagatttctactcccactcaaactgggtggagctgggtgagcagcaaccacaccctcacttgctatggcctaggcaggaactccagaacctcgctcaggtggctgatccaacttgttcagattgcgaggagctgagctgcccccggaactggctcgggtttaccctgctgacgtcaggatacttcggaacccacccccccaagccccccggcaaatgttcccacggcggccatttcgacagatcgagctcacagccacctcgtggaggcatcaataaggattctacgtccccagggttcagtccccaccacatgctgcatctgcaggctgctaagcttgccttgttagccagcattcaggcctttagtcttttacgctcacgcctgggcgatagagacttctcacgattgctggacattactccagcctcaagcctgtcatttgttcttgatacaacaggaagcatgggggaagaaataaacgcagctaagatccaggcaaggcacctcgtagaacaacgtcggggaagccccatggagccggtccattatgttctagtgccttttcacgatcctgggtttggacccgtcttcaccactagcgaccccgattctttctggcagcagctcaacgaaatccacgccttgggaggcggagatgagcccgaaatgtgcctgtccgccctgcagctcgccctgctccataccccacctttaagcgacatctttgtgtttactgatgctagccccaaggacgcctttctgactaatcaagtagaatccctgacgcaagaacgcaggtgtagggttacatttttagtgacagaggacacatccagggtacaggggagggcgcggcgtgaaattctatctcccctgaggttcgagccttacaaggccgtagctttagcgagcggaggcgaagtgatatttactaaagatcagcatattagggacgtggccgccattgtcggcgaatccatggcagcattagttacactgcctttagatcccccagttgtggtccccggacagccactggtcttttccgttgatggcctgttgcagaagatcaccgtccggatccacggagacatcagtagcttctggattaagaatccagcaggcgtgtcccagggccaggaagaaggcggcgggcccctgggtcacacacgcaggttcggccagttctggatggtgactatggatgacccacctcagacgggaacttgggagattcaggtcacggccgaggacacccccggtgtgagggtgcaggctcagacatctctcgattttctgttccactttggcatcccaatggaggacggtcctcacccaggactgtatccattgacccagcccgtagctggtctccagacacagctcttagtagagagtcagtcttggggctcctctgctgccttcctgccacgtcatccatcacgtggcccccggggctgcaggacacgaccaggggccctgggggcaagagggacatccggtgctagatcccctagaagcctcgctgtggctcatgctgctgtccatccctag

SEQ ID NO: 9739 - DNA, 1257 bp, Artificial Sequence
  Description of Artificial Sequence: Synthetic coding sequence
aacaacctgaacgtgggcagcgacaccaccagcgagaccagcttctcactttccaaggaagcccctcgagagcacttggatcatcaggcggcccatcagccattcccccggcccagattccgtcaggagaccgggcacccgagcctgcaacgtgacttccccaggtccttcttactggatctgcctaatttccccgacctcagcaaagccgacataaatggccagaaccccaatatccaggtcaccattgaggtcgtagatggaccggatagcgaggcagacaaagaccagcaccccgagaacaaaccctcttggtcagtcccatcccctgattggagagcgtggtggcagcggtccctctcactcgctcgcgccaactctggagatcaggactataagtacgactctactagcgatgactcgaattttttgaatccaccccgggggtgggaccacaccgctcccggccatcgcaccttcgagaccaaggatcagcccgagtatgacagcacagacggggaaggagactggagcctgtggagcgtttgctccgtcacttgtggcaacggcaatcaaaaaagaactagatcatgtggttacgcctgcacagccacagagtccaggacatgcgatcgacctaattgccctgggattgaagatacattccgaacagccgcaaccgaagtcagcctgctggccggtagtgaagaatttaatgccactaaactgtttgaggtggacacggacagttgcgaacgatggatgtcatgcaaatccgagttcctcaagaaatatatgcataaggttatgaatgatcttccatcctgcccctgctcctaccctaccgaggttgcttactctaccgccgatattttcgatagaatcaagcgtaaggattttaggtggaaggatgcctcaggaccaaaggaaaaactcgaaatttacaagcctaccgcgaggtactgtatccggtccatgctgagtcttgagtctactacccttgcggcgcagcattgctgttacggtgacaacatgcaactgatcacacgagggaaaggcgctgggactcctaacctcataagtactgagttctctgctgaattacactacaaggtagatgtcctgccatggatcatatgtaaaggagactggtcaaggtataacgaagcgcgaccacccaataatggccagaaatgtaccgaatctccctctgacgaggactatataaagcagtttcaggaggccagggaatactag

SEQ ID NO: 9740 - DNA, 693 bp, Artificial Sequence
  Description of Artificial Sequence: Synthetic coding sequence
atgcggctggccggccccctgcggatcgtggtgctggtggtgagcgtgggcgtgacttggattgtggtatcaattctacttgggggtccagggtccggatttccacgaatccagcaactgtttactagccctgaatcatccgtgactgctgcgccacgagctagaaagtacaaatgtggcctgcctcagccgtgccccgaagaacatttggcttttagagtcgtgagcggtgctgccaacgtcatcggccccaagatttgcttggaggataaaatgctgatgtcaagcgttaaagacaatgtgggccggggtttgaatatcgccctcgtgaacggcgtgagtggcgaactgatagaggcccgagccttcgacatgtgggccggggacgtcaatgatctgctgaaattcatccggccccttcacgagggcaccctggtgtttgtcgccagctacgatgatcctgctaccaaaatgaacgaagaaacgcggaagctgttttccgagctgggatcccggaatgctaaggaactggcgtttcgtgattcttgggtgtttgtgggcgccaagggcgtgcagaataagtccccattcgagcaacacgtcaaaaactctaagcactctaacaaatacgaagggtggccggaggctctggagatggaaggctgcattcctcggagaagcacagcgtcctag

SEQ ID NO: 9741 - DNA, 192 bp, Artificial Sequence
  Description of Artificial Sequence: Synthetic coding sequence
atgggccccgaggccctgagcagcctgctgctgctgctgctggtggcttcaggggatgctgatatgaagggccactttgaccctgccaagtgcagatatgccctcggcatgcaagaccgaacaatcccagacagcgacatcagcgcttcgagttcttggagtgattccactgctgcccgccatagccgctag

SEQ ID NO: 9742 - DNA, 1014 bp, Artificial Sequence
  Description of Artificial Sequence: Synthetic coding sequence
atgctgagcctgggcgcccacagcgtgaccaagacccagatcctgcagggcctggggttcaacctgactcataccccagagagcgctatccatcagggttttcagcacctagtgcattctctgaccgtcccgagcaaggaccttactttgaagatgggctccgcgctattcgtcaaaaaggaacttcaactccaagctaattttcttggaaacgtaaagaggctgtacgaggccgaggtttttagtacggatttcagtaacccatcgattgcccaggcaaggattaatagccacgtgaaaaagaaaacccagggtaaggtggtcgacatcattcagggcttagacctgctgacagccatggtgctcgtgaatcacattttttttaaagcgaaatgggagaaacctttccaccccgagtatacacgcaaaaatttcccattcctcgttggggagcaggtgaccgttcatgttcccatgatgcaccagaaagagcaattcgccttcggagtggatacagagctgaactgctttgtgctacaaatggactacaaaggagacgctgtggctttctttgtcctccctagcaaaggaaagatgcggcaactggagcaggctctaagtgcccggaccctgcgaaaatggagccatagcctgcagaagcggtggatcgaggtttttattccacgcttttctatctctgcgtcctataacctggagacgatcctgcctaagatggggatacagaatgtgtttgataaaaatgcagattttagcggcatcgccaaacgggactcattgcaagttagcaaggctacccacaaagcagtgttggacgtctccgaagagggtaccgaagcgaccgccgcaaccactacaaagtttatagtcaggtccaaggacggacctagctattttactgtgagctttaatcgaacttttctcatgatgatcacaaacaaagccacagacggtattttgttcttagggaaggtcgagaaccccaccaaatcgtag

SEQ ID NO: 9743 - DNA, 336 bp, Artificial Sequence
  Description of Artificial Sequence: Synthetic coding sequence
atgttcttcaccatcagccggaagaacatgagccagaagctgagccttttgctgctggtattcgggctgatatggggccttatgctgttgcactacacctttcagcagccaagacaccaatcatcagtgaaattacgcgaacagatcctggatctctctaagcgatatgtgaaagcgctagcagaagaaaacaagaataccgtcgacgtcgaaaatggcgcctccatggcgggatacgccgatctcaaacgcaccattgctgtgctcctcgacgacattttgcaacgtttagttaaactcgaaaacaaggtggattacatcgtggtgaacggatag

SEQ ID NO: 9744 - DNA, 498 bp, Artificial Sequence
  Description of Artificial Sequence: Synthetic coding sequence
atggagatgttccagggcctgctgctgctgctgctgctgagcatggggggcacatgggccagcaaagagcccctccgccctagatgcaggcccataaatgccactcttgcggttgaaaaggagggttgccccgtatgcattactgtgaatactacgatttgcgctgggtactgtcccaccatgacccgagtgttacagggtgtcctgcccgccctgccgcaggtcgtgtgtaactacagggacgtccgcttcgaaagcattcggttaccaggatgccctcggggcgtcaatcctgtagtctcatatgccgtggcactgagctgccagtgcgctctttgcagacggtccacaacagattgcggtgggcctaaagatcaccctctaacatgcgatgatccacggttccaagattccagcagcagcaaggcgccacctccaagcctcccctccccatcgaggctgcccggcccctcggatactccaatcctcccacagtag

SEQ ID NO: 9745 - DNA, 699 bp, Artificial Sequence
  Description of Artificial Sequence: Synthetic coding sequence
atggtgctgctgctggtgatcctgatccccgtgctggtgagcagcgccgggaccagcgcccactacgagatgttgggtacctgccgcatggtgtgtgatccttacggaggcacgaaagccccgagtacggctgccacccctgacagagggctcatgcaatcccttccaactttcattcagggacccccaatgggacccccaggggaaaagggcgagcctggacggcagggactcccagggccccccggagcccccggccttaatgcggcgggagccatctctgccgccacatactctactgtaccaaagattgccttttatgcaggcctgaaaagacagcacgagggctacgaagtgctcaagttcgatgacgtcgttacgaacctgggcaatcactacgaccctacgaccggtaagttcacgtgctcgatccccggaatatatttttttacctatcacgtacttatgcgcggcggagacggtacatcaatgtgggctgacctctgcaagaataaccaggtgcgagcctcggcaattgcccaagatgccgatcagaactacgattatgccagcaacagcgtcgtgctccaccttgagcccggagatgaggtgtatatcaagctggacggcggcaaggcccatggtggaaataataacaagtacagcacattctctggatttatcatctacgctgattag

SEQ ID NO: 9746 - DNA, 501 bp, Artificial Sequence
  Description of Artificial Sequence: Synthetic coding sequence
atgggccccgaggccctgagcagcctgctgctgctgctgctggtggccagtggagacgccgatatgaaagggcattttgacccggctaaatgtcgatatgccctggggatgcaagacagaactattccagactccgatatcagtgcctcgtcttcctggagcgattcaacggctgcaagacattcacgcctagagagttcagacggggatggcgcttggtgccccgctggcagcgtgtttcctaaagaggaagagtacctccaggtggatctccagcgtctgcacctcgtggcactggttgggacgcaggggagacatgctggagggctcggcaaggagtttagcaggagctatcggctacgatactcgagggatggtcgacgctggatggggtggaaggatcgatggggacaggaagttatttcgggcaatgaggaccccgagggagtggtcttgaaggatctcggccctcccatggtggcccgcctggtgcgtttctag

SEQ ID NO: 9747 - DNA, 627 bp, Artificial Sequence
  Description of Artificial Sequence: Synthetic coding sequence
atgatcatcaagcacttcttcggcaccgtgctggtgctgctggcctcgactactattttttctctggacttaaaactgattatctttcaacagcgccaggtcaaccaggaatctctgaagctgttaaacaagctgcagacactctccatccaacaatgtttaccacatagaaagaactttttactccctcagaagagcctttcccctcagcagtaccagaaaggacatacccttgccatcctccacgagatgctacagcagatcttctcgttattccgcgcaaatatatccctggacggctgggaggaaaaccacaccgaaaaattcctaatccagctccatcagcaattggagtatctcgaggcactcatgggcctcgaggctgagaagttgtcggggactctggggtctgataatctcagacttcaggttaagatgtactttaggcgcattcacgactacttggagaatcaggactattcaacatgtgcttgggctatcgtacaagtcgaaatcagccggtgcctgtttttcgttttctccctcacagaaaaattgagcaagcagggcagaccactgaatgacatgaagcaggaactaactacagagttcaggagtcctaggtag

SEQ ID NO: 9748 - DNA, 2241 bp, Artificial Sequence
  Description of Artificial Sequence: Synthetic coding sequence
atgcccttccggcacaagcccggcagcgtgttcagcgtggagggcgagaacctagatctggctatgagcaaagaagaggtcgtagcaatgattggagacgggccttgcgtggtaaaaactctgaccaggcatcacctctactgtgaaccacccgtcgaacagccgctaccccggcaccatgcactaagggaggctcccgacagcctgcctgaattcacagtgcagatgggcaaccttaggtttagcctcggccacgtgcagtacgatggagaatcaccaggggccttcccggtggctgcacaagttggcctgggtgtagggactagcctcctggcccttggcgtaataataattgtgcttatgtaccggcgcaagagcaaacaggcattgagagactacaagaaagtgcagatccaactagagaacctcgaatcctctgttcgggaccgttgcaaaaaggagttcactgacctcatgacagaaatgacagatctgacaagcgacttgcttggctccggtattccatttttagactataaagtctatgctgagaggatcttttttccaggacacagggagagtccccttcaccgggacctgggcgtgccagagtcccgtagacctaccgtggaacagggcctggggcaacttagcaatcttctcaactcgaaactcttcctgactaagttcatccatactcttgagtcacaacgcactttttcagctagggacagagcttacgtcgcctctttgctgaccgtggcacttcacggaaaactagaatacttcactgacatactcagaactctcctgagtgacctagtggcacagtacgtggccaaaaatcctaagctgatgctccgcagaactgaaaccgtcgtggagaaactcctcactaactggatgtccatctgtctctacacgttcgtcagagacagcgtaggcgagcccctgtatatgttatttcgtggaatcaaacaccaggttgataagggccctgttgactcagtgactggaaaggccaaatatacactcaacgacaaccggcttctccgcgaagacgttgaatatcgtcctctaaccctcaacgccctactagctgtgggtcccggcgcgggagaggctcagggggtaccggtgaaggtgcttgattgcgatactatctcccaggctaaggagaaaatgctcgaccagctgtacaagggggtgccgttgacccagagaccagaccccaggaccctcgatgtagagtggcgatcaggtgtggccggccacctcatcctatccgatgaggacgtcaccagtgaagttcagggcttgtggcggcggttaaataccctgcagcattataaggtgcctgatggcgccaccgtcgcactggtaccttgtctcactaagcacgtcttgcgcgagaaccaggattacgtccctggtgagcgcacccccatgttagaagatgtcgatgaaggcggaataaggccttggcacttggtcaagccgtccgatgagcctgaacccccccgccccagaaggggaagtctgcgcggtggtgagagggagcgtgcaaaagcaatcccagaaatctacctgacgcgtcttctatcaatgaagggaaccctacagaaatttgtagacgaccttttccaggttatcctgagtacctcaagacctgtacctctcgctgttaagtactttttcgatctgctcgatgaacaagcccagcaacacggcatctccgatcaggacacaatccacatctggaagacaaacagtctgcccctgcggttttggatcaacattataaagaacccgcagttcgtgttcgatgtgcaaacctccgacaacatggacgccgtgctgctggtgatcgctcaaacatttatggatgcatgcaccctggccgaccataaactcggccgggactccccgatcaataagctcctgtacgctcgggacatcccaagatataaacgcatggtcgagaggtactatgcggacatccgccagacagtgccagcatccgaccaggaaatgaatagcgtactggccgagctcagttggaactactcaggagacctgggtgcccgggttgctctgcatgagctgtacaagtatataaataagtattacgatcaaattattactgcactggaggaagatggaacagctcagaaaatgcaactcgggtaccgactccagcagatcgcagccgccgtcgagaacaaagttacagacctttag

SEQ ID NO: 9749 - DNA, 603 bp, Artificial Sequence
  Description of Artificial Sequence: Synthetic coding sequence
atggcctggggcggcgtgcacacctgctgcttccacctgtgctgctgttgcagttggccacagggcgcagtccctgaagagctgcacaagcaccctggccagactctcctgctccagtgccaatattcgcccaagagggggccgtaccaacccaagagctggtgtcaacagacaagtccatctcgatgcaccttactggtcaccagtagtaaaccatggaccgccgtccagaaaagccactacactatctgggacaaacctaacgccgggttctttaatatcaccatgattcagctgacacagaatgattcagggttttactggtgcggcatctacaatgcttccgaaaacattatcacagtcttgcggaacatctcgctggtggtatctccagccccgaccacaagccctatgtggacccttccgtggctcccaacctccacggttctcattacctcccctgagggtaccagcgggcacccctcgattaacggttctgaaactcgcaaaagcagggcccccgcctgcctcggttccgggggacctcgcttcctggtgctggtactgtgcggtctgcttcttgctaaagggctgatgctatag

SEQ ID NO: 9750 - DNA, 114 bp, Artificial Sequence
  Description of Artificial Sequence: Synthetic coding sequence
atgggctggctgacccggatcgtgtgcctgttctggggcgtgctgctaactgccagggcgaactatcagaacggtaaaaataatgttccgaggctgaagctgagctacaaatag

SEQ ID NO: 9751 - DNA, 525 bp, Artificial Sequence
  Description of Artificial Sequence: Synthetic coding sequence
atgcggctgctggccttcctgagcctgctggccctggtgctgcaggagacaggaaccgctagtctgcccaggaaagaacgtaagaggagggaggaacagatgccgagggagggcgacagttttgaggttctgcccctgagaaatgacgtgctgaatccggacaactatggtgaggtcatcgacctgagtaattatgaggagctgaccgactatggtgaccaacttcctgaagtgaaggttacctctctagcccccgcaacctccatttcccctgccaagagtacaaccgcccccggtaccccaagtagcaacccaactatgacgaggcctacgaccgctggacttcttctgtcatcacaacctaatcacgaggacatcccacctttgccccgccgtaccgcatacctgtacgcgagattcaaccgcataagccggataagagccgaagattttaaggggttgaccaagctgaagagaatcgacttatctaacaacctgatatcatccatcgataatgatgcttag

SEQ ID NO: 9752 - DNA, 657 bp, Artificial Sequence
  Description of Artificial Sequence: Synthetic coding sequence
atgggccgggtgttcctgaccggcgagaaggccaacagcatcctgaagagataccccagggctaatggcttttttgaagaaatccgccaggggaatatagaacgagaatgtaaggaggagttttgcaccttcgaagaagccagagaagcgtttgaaaacaacgagaaaaccaaagaattctggagtacctatacaaaagcccaacagggggaatccaaccgtggctccgactggttccagttctatctcacctttcccctcattttcggcctgttcattatcctgctggtgattttcctcatttggagatgtttcttgcggaacaagactcggagacaaaccgttaccgaggggcacattccattcccacagcacctgaacattatcaccccccctcccccaccggacgaggtgtttgattcctcaggactatcacccggtttcttgggctacgtggtgggccgcagcgattccgtgtctacgcgtctttcaaattgtgaccccccccctacatacgaagaggctaccggccaggtgaatctgcaacggtccgagactgagcctcaccttgaccccccacccgagtatgaagacatcgtgaacagcaatagcgcctccgctattcctatggttcctgtggtgacaacaattaagtag

SEQ ID NO: 9753 - DNA, 2535 bp, Artificial Sequence
  Description of Artificial Sequence: Synthetic coding sequence
atgggccccggcgcccccttcgcccgggtgggctggcccctgcccctcctcgttgtaatggccgcgggcgtcgcaccagtctgggcctcccattcaccacatcttcccaggccccattcaagagtgcctccacaccctagctcagagcggcgtgcagtatacataggtgcgcttttccccatgagcggcggctggcctggtggacaggcatgccagcctgctgtggaaatggcgctggaggatgtgaattctcggagagacatccttccggactacgagctgaagctgatccaccacgactctaaatgtgacccaggacaggctactaaatacctttacgaacttctgtacaacgatcctatcaaaatcattctcatgcctggttgctctagcgtgagtacactcgtggcagaggccgcacggatgtggaatctgattgtcctgtcttatggtagtagctcacctgccctgagcaacagacagaggttccccacattttttcggacacaccctagcgcaacgttacataaccctacccgcgtaaagctgtttgaaaaatggggatggaagaagattgctacgatacagcagacaaccgaggtgttcacctccactctggacgatctggaggagcgggtcaaagaggctggaattgagataaccttcagacagtccttctttagtgatccagccgtgcccgttaaaaatctgaaaagacaggatgctcgtattattgttggactgttctatgaaactgaagctaggaaagtcttctgtgaggtctataaggaaaggctattcggaaaaaagtacgtttggtttctgattggctggtatgctgacaactggttcaaaatctatgatccctctatcaattgtactgtcgacgaaatgaccgaggcagttgagggccatattacaacagagattgttatgctgaatccagcgaatactagaagcataagcaacatgactagccaggagtttgtcgaaaagctaacaaagagactgaagcggcaccccgaagagacaggcggctttcaagaagcccctctagcctacgatgcaatttgggcccttgcccttgcactcaataagacatcaggcggaggtggcagatctggtgtacgtctggaggacttcaattacaataaccagactatcaccgaccaaatttacagggctatgaattcatcttcattcgagggggtgagcggtcacgtggtgttcgacgctagtggcagtcggatggcctggacactaattgaacaattgcagggtgggtcttacaagaagataggttactacgatagtaccaaggatgacctcagctggagcaagacagacaagtggattggcggaagccccccggccgaccagacgctggtgataaagacttttcggttcctcagtcagaaactgttcatctccgttagcgtcctgtcgagtctgggtatagtactggccgtggtttgccttagcttcaacatctacaatagccacgtaagatacattcagaacagccaacccaatctgaacaacctgacagccgtggggtgctcactcgcgctggctgcagtgtttccactgggcctggacggataccacatcggtaggaaccagttcccttttgtgtgccaggcccggctgtggcttctgggcctgggattctctctggggtacggaagcatgttcactaaaatttggtgggtccataccgtgtttacgaaaaaagaagaaaaaaaggagtggcgtaagactctcgagccttggaagctttatgctactgtgggcctgctggtgggcatggatgttctcaccctcgcaatatggcagatagttgacccgctccataggacaatcgagacctttgctaaggaagagccaaaggaggatattgatgtgtcaatcctgccacaactggagcattgttcttctcgcaagatgaatacatggctgggcattttttacggctacaaaggcctgctgttgttgctgggcatttttctggcatatgaaaccaaaagtgtgagcactgaaaaaattaatgaccacagggcggtggggatggctatctacaatgtggcagttctgtgcttaatcaccgccccagttaccatgatcctctcctcacagcaggacgcagcttttgcctttgctagtctggccatcgtctttagttcctatattactttagttgtgctgttcgtgcccaagatgagacggctgattactcgcggtgagtggcagtcagaggctcaggacactatgaagactggatctagcactaacaacaacgaagaggagaaaagcagactgttagaaaaagagaatcgagaactggaaaagattattgccgagaaggaggagagggtgagtgagctccgacaccaactacagagcagacaacaattacggagccgcaggcatcctccaactccccctgaaccctctggtggactacctcgggggccgcccgagcccccagaccgcctgtcctgcgacggctctcgagtacacctgttgtataaatag

SEQ ID NO: 9754 - DNA, 2007 bp, Artificial Sequence
  Description of Artificial Sequence: Synthetic coding sequence
atggacctggtgctgaagcggtgcctgctgcacctggccgtgatcggcgcactactcgctgtcggcgccacaaaagttccccgtaatcaggattggttgggggttagtagacaactcaggacaaaggcctggaatcggcagttgtatccggaatggacagaggcccagaggctcgattgctggaggggtggccaggtatcgctcaaggttagcaacgacggcccaaccctgattggtgcaaacgcatcatttagcatcgcgcttaattttcccggctcccagaaggtgcttcctgacggccaagtgatctgggtgaacaacaccataattaacggttcgcaagtttgggggggtcagccagtgtatccacaggagacagatgacgcttgcatcttccccgacggtggtccatgccccagtggcagttggtcccagaaaaggtccttcgtgtacgtttggaagacatggggacagtattggcaggtactaggaggccccgtgtctggcctcagcataggaacaggacgggcaatgttagggacacacaccatggaggtcacagtctaccataggcgagggagtcgtagctacgtccctctggcccacagcagttcagcgtttacaatcacagatcaggttcccttttcggtgagtgtgtctcagctgagggcccttgacggagggaacaagcacttcttgagaaaccaaccccttacctttgcgctgcagctgcacgatccaagcggctacctggccgaagcagatctcagctatacttgggactttggggactccagtggtacattaattagccgggccctggtggtgacccacacttacctcgagccaggcccagtgactgcacaggtcgtcttgcaagcagcaatccctttgacatcctgtggcagctctccagtcccaggcacaaccgacgggcatcggccaaccgcagaggccccgaatactacggcagggcaggtccccacaaccgaagtagtggggacgacccctgggcaggctccaacagccgagccttccggtactacaagcgtgcaggtccctaccacagaggtgatcagtacagcacccgtccagatgcccaccgccgaaagtacaggaatgactccggaaaaggtgccggtatcagaagtgatgggtacaacccttgccgagatgtcaacccctgaagccactggcatgacacctgcggaggtttctatcgtggtgctctccggcaccaccgcagctcaggtcacgacaaccgaatgggtggagaccactgccagagagctgccaatacccgaacccgaggggcccgatgctagctccattatgagtactgagagcattaccgggtctctggggcctctcttagatggtactgctaccctgcggctcgttaagcgacaggtgcccctggattgtgtgctttatcggtacgggtcctttagcgtcacactggacatcgtccaaggaatcgaatcggcggaaatcctccaggccgtcccttcaggtgagggcgatgccttcgaactcacagtatcctgccaaggcgggcttcctaaggaagcttgtatggaaatctcctcccccgggtgtcagccacccgcacaaagactgtgccaaccggtcctgcctagcccggcatgccagctggtgctgcatcaaattttgaaaggtgggtctggaacctattgccttaatgtgtctctggccgacacaaacagcctggccgttgtgtccacacaactgattatgcctgtgcccggcattcttttgaccggacaggaagcgggactcgggcaggtgcctctgattgtgggcattctgctggtgcttatggccgtcgtactcgcatccttaatctatcgtcggcggctgatgaagcaggatttcagtgtcccccagctgcctcactcatctagccattggcttcggcttccaagaatcttttgcagctgtccgatcggcgagaacagcccactcctttccggacaacaggtttag

SEQ ID NO: 9755 - DNA, 525 bp, Artificial Sequence
  Description of Artificial Sequence: Synthetic coding sequence
atggccgacatgcagaacctggtggagcggctggagcgggccgtgggtagactcgaggccgttagccacacatctgacatgcaccggggatatgctgactcaccaagcaaggctggcgccgctccctacgtccaggcctttgattccctattggcaggtccggtggccgagtatcttaagatatccaaggagatcggcggcgacgtgcagaaacatgcagagatggtgcatactgggttgaaacttgagcgggcattgttggtgaccgcctcccagtgccagcagcctgccgagaacaaactgtccgacctgttagctcctatatctgagcaaattaaggaggttattacatttcgcgagaaaaacagaggttcaaagctctttaaccacctctctgctgtgagcgagtctattcaagcactcggctgggttgccatggcacccaaacccggaccttatgtgaaggagatgaatgatgccgctatgttctacacaaaccgggtcctcaaagagtataaggactag

SEQ ID NO: 9756 - DNA, 1368 bp, Artificial Sequence
  Description of Artificial Sequence: Synthetic coding sequence
atgctgcaccccgagaccagccccggccggggccacctgctggccgtgctgttagcattgttaggcactgcttgggccgaggtttggcccccgcaattacaggagcaggctcctatggcaggagccctgaatcggaaggaatccttcttgctgctgagcctgcacaatcgactcaggtcctgggtccagccgcccgctgctgacatgcgcagactggattggagcgactcgctcgcccagctggcccaggctagagccgcactctgcgggacccccacacctagtcttgcctcaggattatggagaactctccaggtggggtggaacatgcagctgcttcctgcaggcttggtatcgtttgtggaggtagtctcactgtggttcgccgaaggccagcgatacagccacgcggctggcgagtgtgcacgaaacgcaacctgcacgcactatactcagttagtgtgggccacatcgtctcagctgggctgcggcagacacctctgcagcgcaggacaggccgcaattgaggcgttcgtgtgcgcttatagtccccgggggaactgggaggtgaacggcaagacaattgtaccatataagaagggtgcctggtgcagcttatgtaccgcatcggtgtctgggtgttttaaagcttgggaccacgccggcggactgtgcgaagtccctaggaacccctgccgaatgtcttgccaaaaccatgggaggctgaatatttccacttgccactgccactgcccaccggggtacacgggtcgctactgccaggtccgctgtagcctccagtgtgtacatggtagattcagagaggaggagtgttcttgcgtgtgtgacattggctacgggggagcccagtgtgcaacaaaagtccatttccccttccacacatgtgatcttcgcattgatggcgactgcttcatggtgtcttccgaggctgatacttactatagggcccgaatgaagtgccagcgaaagggcggggtgctcgcccaaattaaatcacagaaagttcaggatatcctggccttttacctgggaagactggagactaccaacgaggtcatcgattccgatttcgagacccggaatttctggatcggtttgacttataaaaccgcaaaggacagctttaggtgggctaccggggaacatcaggccttcacaagtttcgcctttggacagcccgataatcatggcttagtgtggctttccgccgccatgggatttggaaattgcgtggagttgcaggcaagtgcagcattcaactggaatgatcagaggtgcaaaacgcgtaaccgttacatatgtcagtttgcccaggagcacatctcacggtggggtccgggttcttag

SEQ ID NO: 9757 - DNA, 297 bp, Artificial Sequence
  Description of Artificial Sequence: Synthetic coding sequence
atggtgctggccatgctgggcgccctgcacccccgggccggcctgtcactatttctccacttgatacttgccgtcgccctgctgcggtcccagccgctccgtagccagaggagtgtcccggaagcttttagcgcccctttagaactttcacaacccctgtcagggctggtcgatgattatggaatcctacctaagcatcctcggccacggggaccccgtcctttactatccagagctcagcagcggaagcgtgacggacccgacctggccgaatattactacgacgctcatctatag

SEQ ID NO: 9758 - DNA, 2742 bp, Artificial Sequence
  Description of Artificial Sequence: Synthetic coding sequence
atgggccccgaggccctgagcagcctgctgctgctgctgctggtggcctctggagacgcagacatgaagggacacttcgacccggctaaatgccgctacgccctgggcatgcaggatcggaccattcccgacagtgacatctctgcaagctcatcctggagcgattccactgcagctcgccattctaggttggaatcttcagatggcgatggcgcttggtgccccgccggttctgtgttccccaaagaggaggagtatctgcaagtcgacctgcagaggcttcacctcgtagcgctggttgggacacagggtagacacgcaggtggcttgggcaaggagttttctcggtcctatcggctgaggtattcccgggacggtcgtaggtggatgggatggaaagatcgttggggccaggaggtcatctcaggcaacgaagatcccgaaggtgtcgtcctgaaagatctcggccctccaatggtggcccgattggtccggttctatccccgcgctgacagagttatgagcgtgtgtcttagagtggaactgtacgggtgcctgtggcgagacggtctgctcagctacaccgctcctgtgggccaaaccatgtaccttagcgaagcagtgtacctgaatgattctacgtatgacggtcacacagttggcggtctgcagtatggaggccttgggcagctagcagacggagtcgtcggcttggatgacttcagaaagagtcaagaactgagggtttggccaggctatgactacgttggatggagcaaccatagtttcagctcagggtatgtcgaaatggagttcgagtttgaccgactgagggcatttcaagccatgcaggtgcactgcaataacatgcacactctcggcgctagactgcccgggggcgtggaatgccgatttagacgcggccccgctatggcctgggagggggagcccatgcggcataacctcggcggtaatctgggggatcccagagcaagagccgtatccgtgccgctgggcggacgagtcgccaggtttctgcaatgtaggttcctcttcgccgggccctggttgctgtttagcgaaatcagctttatatccgatgttgttaacaattctagtccggcacttggaggtacctttcccccagcaccttggtggcccccgggtccccccccgacaaacttcagtagcttagaactggagccaagaggccaacagccggtggcaaaagccgaggggagccctaccgccatcctcattgggtgtctggttgccatcatcctgctgctgttgctgatcatcgccttaatgctgtggagactgcactggcgccgcctgctttccaaagccgagcggcgggtactcgaggaggagctcacagttcatttaagcgtgccgggcgacacaatcctgataaataataggccaggcccccgcgagccacccccatatcaggaacctagacctagaggcaaccctccccattccgctccatgtgtccccaatggttctgctctgctcctgagcaatcccgcctatagactgcttcttgccacctacgcgagacctccccgaggaccagggcctccaacacccgcttgggcaaagcctacaaacacccaagcctactcgggggactacatggaacccgagaagccaggcgccccacttctgccaccccctcctcagaattctgtgcctcactatgctgaagctgatatagtaacactacagggagtgactggtggtaatacatatgcagtgcccgcccttccgccaggcgccgtcggtgacgggccccctagagttgatttccctagaagcagactgaggtttaaagaaaaactgggcgaagggcagttcggggaggtacacctgtgcgaagtcgactccccacaagatctggtgtccctggatttcccacttaacgtcaggaaagggcacccactgctggtcgctgtgaagattctccggcccgatgccacgaagaacgctcggaacgatttcttgaaggaagtgaaaatcatgagtcggctcaaggatccgaatatcattaggttgttaggtgtgtgcgtccaggatgaccctctgtgcatgatcacagattatatggaaaatggagacttgaatcagttcctttctgcacaccagctggaagataaggctgcagaaggcgctccaggagacggacaagctgcacagggtcccactatctcctaccccatgcttttgcatgtggctgcccagattgcaagtggtatgcggtatctggctaccttaaacttcgtgcatagagatctggccacgagaaactgccttgtgggcgagaactttaccattaaaatcgccgattttgggatgagtaggaatctttacgctggggactattaccgtgttcaaggccgcgcggtgttgcccattaggtggatggcatgggaatgcatactaatggggaaattcaccactgcctccgatgtgtgggccttcggtgtcactctgtgggaagttctgatgttatgccgggctcaaccttttggtcagttgaccgacgagcaggtgatcgagaacgcgggtgaatttttcagggaccaggggcgccaagtctacctgtcacggcctccagcatgcccacagggcctgtacgaacttatgctcagatgttggtctagggagtcggagcagcggccgcctttctcacagctgcaccggttcctagctgaagacgcactgaataccgtgtag

SEQ ID NO: 9759 - DNA, 678 bp, Artificial Sequence
  Description of Artificial Sequence: Synthetic coding sequence
tgagccgacctgcccagctgctggggcgccggcccctgctacaccgggcacaaggtgggagctctgcggagagatacagtaatatgttgctgccggcacggggattactcaaccccatgtctcttcacccccggcaagccttcccgaaaccctagtccgtggaaacggaccctctggaccttatcagccccctgggctggacccgctggctggactggtgaggagcagaacgccacgaagacggggctgataactcgtcgccctagacccctgcgaaggcgcccacacccagcgcctgcctccccgttgcccgaaattataaggggcaacatcccccgaatgctcggtaaattcgtcccggtgaactgggaacccccccaacccctgccgttcccgaaatatctgaggtgttatcgatgtcttctggagaccaaggagctgggatgtcttctggggtccgatatctgcctcactccagcagggtcttcatgtattaccctccacaagaagaacagttccgggagcgacgtgatggttagtgactgccgatctaaagagcaaatgtctgattgctcaaatacacgcacctcacctgtgagcggattctggatcttcagtcaatactgctttctcgatttctgtaatgatccacagaaccgcgggctttataccccatag

SEQ ID NO: 9760 - DNA, 405 bp, Artificial Sequence
  Description of Artificial Sequence: Synthetic coding sequence
atgccccggtgccggtggctgagcctgatcctgctgaccatccccctcgcgctagtggcaaggaaagaccctaagaagaacgagaccggcgtcctcagaaaactaaagcccgtgaacgcatcgaatgccaatgtgaagcagtgcctgtggttcgccatgcaggagtataataaggagtccgaagataagtacgtgttcttggtggtaaagacactacaggcccagttgcaggtcactaacttactggaatacctgatcgacgtggaaattgccaggtccgattgccggaaaccattgtcgactaacgaaatttgtgccattcaggaaaattccaagttaaagcgcaaactgtcttgctccttcttggtgggcgccctgccatggaacggagaattcacagtctag

SEQ ID NO: 9761 - DNA, 1182 bp, Artificial Sequence
  Description of Artificial Sequence: Synthetic coding sequence
atgcggaccctgttcaacctgctgtggctggccctggcctgcagccccgtgcacactactttaagcaagtccgacgccaagaaagcagcttctaagactttgcttgagaaaagccaattttccgataagcccgtgcaggacaggggattggtcgtgacagatctgaaagccgagagtgtggtgttagagcaccgttcctactgtagtgcaaaggcccgagacagacatttcgccggcgacgttctcgggtatgtcacaccttggaactcccatggttacgacgtcacaaaggtgttcggatctaaatttactcagatatcccctgtgtggctgcagctgaagcgaagggggcgggagatgtttgaggttactggcttacacgacgtagaccaggggtggatgcgcgcagtccgaaagcacgccaaggggttgcatatagtcccacggctcttatttgaggattggacttatgatgactttcgcaacgtgctggacagtgaggacgagattgaggaactctcaaaaacagtcgtgcaagtagccaagaaccagcacttcgacggcttcgtcgttgaggtttggaaccagctgctgagccagaaaagggtggggctgattcacatgttaacccacttggcagaagctttacaccaggcccgccttcttgcgttgctggtaatccctccagcaataacaccagggaccgaccaactagggatgttcacccacaaagaattcgagcagctggccccagtgcttgacggattctctctgatgacctatgattacagcactgcccaccagcctggcccaaatgcacccctaagctgggtgagggcgtgtgttcaggtattggaccctaaaagtaagtggagatctaagatacttttgggcctcaatttctacggaatggactacgcaactagcaaagatgcaagagaacctgtggttggtgcacgctatatacaaactcttaaggatcaccgcccccgtatggtttgggatagtcaggcctcagagcacttctttgagtacaaaaaatctcggtcgggaaggcacgttgtgttctacccaactctgaagagtctgcaggtgaggcttgagctggcaagggaactgggagtgggagtttccatctgggagctaggacagggcctcgattatttttatgatttgctgtag

SEQ ID NO: 9762 - DNA, 678 bp, Artificial Sequence
  Description of Artificial Sequence: Synthetic coding sequence
tgagccgacctgcccagctgctggggcgccggcccctgctacaccggtcacaaagtgggcgccctaagacgtgatacagtgatctgctgttgccgacacggcgattattctactccttgcctgttcaccccagggaaaccatcacgtaatccatccccttggaaacgcacactctggaccctgagcgcaccatgggccggccctgctggttggacaggggaggagcagaacgccactaaaacgggactgatcacccgtcggccaaggccgctgcggagacggcctcacccagcccccgcttcacctctgccagagatcattcgagggaacatacctaggatgctgggaaagtttgtgcctgtcaattgggaacccccacagcctctgccttttcctaagtacctgagatgttacagatgcctattagaaacaaaggaacttgggtgtttgcttgggagcgatatctgcttgacaccggctgggtctagctgcattacgttgcacaaaaagaacagcagcgggtcggatgtgatggttagcgactgtcgtagcaaagagcagatgagcgactgctccaacacaagaacaagtcccgtgtcggggttctggatattctcccaatattgctttctagacttctgcaatgatccgcagaatcggggtctgtacaccccctag

SEQ ID NO: 9763 - DNA, 1410 bp, Artificial Sequence
  Description of Artificial Sequence: Synthetic coding sequence
atgatgcggctgggcggccggctggtgctgaacaccaaggaggagctggcaaacgaacgactcatgacccttaaaatcgcagaaatgaaagaggctatgagaacactgatattccctccatctatgcacttcttccaggcgaaacacttgatagagcggtctcaggtattcaatatcttgcggatgatgcccaaaggcgccgccctgcacctgcatgacatcggtatcgtgaccatggactggctggtcaggaatgtcacctaccggccccattgtcacatctgtttcaccccccgtggtatcatgcagtttcggtttgcgcaccctactccgcgcccttctgaaaagtgctcaaagtggattctcctagaggattatcgcaaacgcgtgcaaaatgtaacggagttcgatgacagcctgctgcgcaacttcactctagtgactcagcaccccgaggtcatctacacaaatcagaatgtagtctggtccaaattcgagaccatcttttttaccatctctgggctgatacattacgcacctgtgttcagagactacgtatttaggtcaatgcaggaattctacgaggataacgtgctgtacatggaaatcagagctaggctcttgcctgtctatgaactgtcaggcgagcaccatgatgaagagtggagcgtgaagacttaccaggaggtggctcagaagttcgtggagactcatcccgagtttattgggatcaaaatcatatatagtgatcatagatcaaaggatgtagctgtgattgctgaatccattcggatggcgatgggactccggataaagtttcctactgtggtggccggatttgacctggtggggcatgaagatactggtcactcactgcacgactacaaagaagctctgatgataccagcgaaggatggagtgaagcttccttattttttccatgccggagagactgattggcaggggacgtcaatagatcgcaatattctggacgctctaatgctgaacactactagaataggtcacggattcgcgctttcaaagcatccagctgttcgaacctactcttggaaaaaagatatccccatcgaggtctgtccaatctcaaaccaggtcctgaagcttgtgtctgatctccggaaccaccctgtagccactctgatggctactggccatcccatggttatctcgagcgatgacccggctatgtttggcgcaaagggattgagctatgacttttatgaggtgtttatgggcattggtggaatgaaagcggacttgcgaacactaaagcagctggcgatgaattccattaaatactcaaccctgctggaaagcgagaaaaatacatttatggagatctggaagaagagatgggacaagtttatcgccgatgtcgctacaaagtag

SEQ ID NO: 9764 - DNA, 1137 bp, Artificial Sequence
  Description of Artificial Sequence: Synthetic coding sequence
tgatacagcggcgactacatggagcccgagaagcccggcgcccccttattaccccctcctcctcagaattccgtaccccattatgcagaagcggacattgtaactctgcagggggtgaccggaggtaatacctatgctgtgccagcccttccccccggtgccgtgggagatggtcctcctagagtggacttcccacgctcgcgccttcggtttaaagagaagcttggcgagggtcagttcggggaggttcacctctgcgaggttgattccccacaggacttggtgagtctggattttcctctgaacgtaagaaaaggacaccctcttcttgtggccgtgaagatcctgagaccggacgctaccaagaacgcaagcttcagtctatttagtcgcaacgattttctgaaggaagttaagataatgtctcggctaaaagatcccaatataatcaggctgcttggcgtatgtgtacaggatgatccactttgtatgattaccgactatatggagaacggagatctcaaccagtttctatccgctcaccaactcgaggataaagctgctgaaggggccccgggagacggtcaagccgcccagggtccgactatcagctatccaatgttgcttcacgttgccgcacagatcgcaagcgggatgagatacctggccacccttaatttcgttcacagggatttagcgactagaaactgcttagtcggcgaaaacttcacaatcaaaattgcagacttcggcatgtctaggaacttgtacgctggcgattactatcgcgtacagggacgcgccgtgttgcccatcaggtggatggcgtgggaatgcattctaatgggcaagttcacaaccgcgagcgacgtatgggcgttcggagttaccctctgggaggtcctgatgctctgcagggcacagccctttggtcagctcactgacgagcaagtgatcgagaacgcgggcgaatttttcagggatcagggcagacaggtctatttgtcccgtccccccgcttgccctcagggtctgtatgaacttatgctgcgttgttggagcagggagagcgagcaaaggcctcccttttcacagcttcatcgatttctagccgaggacgcactgaatacagtttag

SEQ ID NO: 9765 - DNA, 678 bp, Artificial Sequence
  Description of Artificial Sequence: Synthetic coding sequence
tgagccgacctgcccagctgctggggcgccggcccctgctacaccggccacaaggtgggcgccctgaggcgtgacacagtgatatgctgctgcagacacggggactactcaaccccatgtctgtttacacccggaaagccgagtcgcaatcccagtccttggaaacgtaccctgtggaccctgagtgccccctgggccggtcctgccgggtggactggagaagagcagaatgccaccaaaaccggattaatcacacgacggcctcgcccgcttcgccgccggccacatccggctccagccagtcccctgcctgagatcatacgcggcaatataccgagaatgctggggaagtttgtacctgtcaactgggaacccccacagccccttcccttcccaaaatacctacggtgctaccgttgcctgcttgagaccaaggagctggggtgtctgctcgggtctgatatttgtcttacccccgccggctcatcctgcattacactgcacaagaagaactcttctggtagcgatgtgatggtctcggactgccgctcaaaagaacagatgtccgactgctccaataccaggacctctcctgtgtcagggttttggatctttagccagtactgctttctggatttttgtaatgatccccaaaaccggggcttatatactccttag

SEQ ID NO: 9766 - DNA, 846 bp, Artificial Sequence
  Description of Artificial Sequence: Synthetic coding sequence
atgctgcccaagagccggcgggccctgaccatccaggagatcgccgcattggctagatctagcctacatggaatcagtcaggtcgttaaagatcatgtgacaaaacctacagccatggctcaaggacgggtggctcatctaatcgaatggaaaggatggagcaagccttctgactcgcctgccgcattggagtctgctttttcatcttatagcgacttaagcgaaggggagcaggaggctagatttgccgcaggcgtggccgagcagtttgctattgcagaggccaaattgagagcttggtcatcagtagacggagaggactcaaccgacgacagctacgatgaggattttgccggcggaatggacacagatatggcagggcagctccctctgggccctcacctccaggatctgttcaccggccataggttcagcagaccggtcagacaggggagcgtcgagccagaatcagactgcagtcaaaccgtgtcccccgacacgttgtgcagctccctgtgttccttggaagacggccttctaggaagcccggcaagactggctagtcagctcttaggagacgagctgctcctggctaaattacctccaagtcgtgagtccgcatttcgaagtctgggaccgttggaggcccaggacagcctgtataacagccctctaacggagagttgcctctcccccgccgaggaagagcccgctccctgtaaagactgtcaaccactgtgcccccccttgacggggagttgggagcggcagagacaagcttcagatctggcctcctccggcgtcgtcagcctggacgaggatgaagccgaaccagaagaacagtag

SEQ ID NO: 9767 - DNA, 1110 bp, Artificial Sequence
  Description of Artificial Sequence: Synthetic coding sequence
atgaagttccagggccccctggcctgcctgctgctggccctgtgcttggggagtggcgaggccgggccactacagtctggcgaagaaagcacggggactaacatcggtgaggcactaggtcacggactgggagacgcactctctgaaggcgtcggcaaggctataggcaaagaagccggcggtgctgccggctccaaggtgagtgaggcccttggccaggggacacgggaagccgttgggacaggggtcaggcaggtgcccggattcggcgtagccgatgccctcggaaatagggtgggagaagccgctcatgccctgggcaatacggggcacgagataggcagacaggctgaagatgtcattagacacggcgcggatgcagtgcggggttcatggcagggagtgcctggacacaatggcgcctgggaaacatccggaggacacggaatcttcggtagtcaaggcggactaggcggacagggacaggggaacccgggggggcttgggacgccctgggtccacggttaccctggcaactcagcagggtccttcggaatgaacccccagggtgccccgtggggacagggaggtaacggagggcctcctaacttcggcactaatacccagggcgctgttgcacagcccggctacggcagcgtaagggcctctaatcagaatgaagggtgtacaaatccacctcccagcggtagcggtggcggcagcagtaactctggcggtgggtcgggatctcagagcggatctagcggctctggtagtaatggtgataataacaacggtagcagctccgggggctcgagctctgggtcatccagtgggggttcttcaggcggttcatctgggggctcaagcggaaattcaggggggtcaagaggggacagcggctctgaaagttcttgggggtcttctactggttcaagcagcggaaatcacggggggtcaggtggaggaaatggtcacaagcctggcaatagcgaaacttcacctggcatgtttaattttgacaccttctggaaaaattttaaaagtaagcttgggttcatcaactgggatgcgataaacaaggatcaacgctcttcaagaatcccctag

SEQ ID NO: 9768 - DNA, 420 bp, Artificial Sequence
  Description of Artificial Sequence: Synthetic coding sequence
atgggccccgaggccctgagcagcctgctgctgctgctgctggtggcatcaggagatgcggacatgaaaggacactttgacccagccaagtgcagatacgctctgggcatgcaggatagaactatccctgattcagacattagcgcttcaagtagctggtccgactctaccgccgcgcggcactcacggcttgaatcttcagacggcgatggggcgtggtgtccagccggtagcgtatttcctaaagaggaggagtatctccaagtggatctacagcgactgcacctggtggccctggtggggacccagggccggcacgccggaggcctcggaaaggaatttagccgtagttataggctgcgctacagtcgggatggtaggaggtggatgggttggaaggatcgatggggacaggagtag

SEQ ID NO: 9769 - DNA, 516 bp, Artificial Sequence
  Description of Artificial Sequence: Synthetic coding sequence
atgcggcacaacctgggcggcaacctgggcgacccccgggcccgggcagtcagcgtgcccttgggcggccgggtcgcgcggttcctgcagtgcagatttcttttcgcaggtccatggctcctgttttcagagatttcctttatctccgatgttgttaacaactcttctccagccctgggtggaacatttcctcccgccccctggtggccaccaggccctccaccaacaaatttttctagtttggaactagagcccaggggtcaacaaccagtagcaaaggcagagggttcaccaacagccattctcatcgggtgtttggttgctatcatcctgctgctcctgttgatcattgcactcatgctctggcgcctgcactggagaagactattgtctaaagtgctggaatcgcatcctcggactcgctctcccggtctggtggggattcgtcccacacccctcccggtttctcccatggctttggttcacctctgtgaagtggacagtcctcaggattag

SEQ ID NO: 9770 - DNA, 192 bp, Artificial Sequence
  Description of Artificial Sequence: Synthetic coding sequence
atgggccccgaggccctgagcagcctgctgctgctgctgctggtggcctcaggtgatgccgacatgaagggccactttgacccagcaaaatgtcgatacgcactggggatgcaggacagaaccattccagattctgatattagtgcttcaagttcctggtcagatagcacagctgcccggcacagccgctag

SEQ ID NO: 9771 - DNA, 1137 bp, Artificial Sequence
  Description of Artificial Sequence: Synthetic coding sequence
tgatacagcggcgactacatggagcccgagaagcccggcgcccccctgctcccaccccctccacagaatagcgtgccccattacgcagaggccgatatcgtgactctccagggggtgacaggcggtaatacgtatgccgtgccagcactgcctcctggagccgtgggcgacgggccaccacgagtggatttcccacgttctagacttcggttcaaggaaaagttaggcgagggacagttcggcgaagtgcacttgtgtgaggtagacagccctcaggatttggtctctctcgattttcctctgaatgtgcgaaaggggcaccctcttctggtggccgtcaagattctgcgtccagacgccactaaaaacgctagtttcagcttgttctcacgcaacgactttctaaaggaggtgaagatcatgtcccgccttaaagaccctaacatcattaggttgctcggtgtgtgcgtgcaggatgaccctttgtgtatgatcacagactatatggaaaacggagacctgaaccagtttctgtctgctcaccagctcgaagataaggccgctgagggtgcccccggagatgggcaagcagcccagggccctaccatctcctatcctatgctgctgcatgtggcagcccaaatcgcctccggcatgcgctacctcgcaacactgaactttgtacaccgtgatttagctacccggaattgtctcgtgggcgagaactttaccattaagatagccgactttgggatgagcaggaatctgtatgcaggcgactactaccgagtccagggaagagctgtactgccaatccgatggatggcctgggaatgcatcctaatgggaaaatttactacagcttcagatgtgtgggctttcggagtgacattatgggaagtgcttatgttgtgcagagcacagcctttcggacaactgaccgacgaacaggtaatcgagaacgccggggaatttttcagggaccagggacgccaggtataccttagtcggccccctgcatgtccgcaggggctttatgagctgatgctgcggtgttggagtcgcgaaagcgagcagaggcccccattctctcaacttcatcggttcttggccgaagacgctttaaatactgtgtag

SEQ ID NO: 9772 - DNA, 2535 bp, Artificial Sequence
  Description of Artificial Sequence: Synthetic coding sequence
atgggccccggcgcccccttcgcccgggtgggctggcccctgcccctgctagtggtgatggcggcgggggtggcccccgtatgggcttcccactctcctcacctgcctcgcccacactccagagttccgccccatccttcatctgagagacgcgctgtctacattggagccctgttccccatgagcgggggttggcctggggggcaagcctgccaaccggctgttgagatggcactggaagacgttaactcacgccgcgacattctcccagactatgagctcaaactcatacaccatgactctaagtgtgatcctggccaggctactaagtacctgtatgagctgctttataatgatcccattaaaataattctcatgccaggatgtagttccgtttctacgttggtagctgaggccgcacgaatgtggaacttaatcgttctcagttatggttcaagcagcccagccctcagcaaccgccagagatttcctacctttttcaggacacacccgagtgccacccttcataaccccacccgggtgaaactatttgaaaagtggggttggaaaaagatcgccactatccagcagaccacagaggtgtttacctccacactcgacgacctggaggaacgcgtcaaggaagcgggcatagaaataaccttccgccagagttttttctcagaccccgcggtgcctgttaagaacctgaagcgccaggacgcgcggatcattgtggggctgttctatgagaccgaagctcgaaaagtgttctgcgaggtgtacaaggagcggctgtttggcaaaaagtatgtgtggtttctaatagggtggtatgctgataactggtttaagatatatgatccttcaatcaactgtacagtcgatgagatgaccgaggcagtggagggacacatcactaccgaaatcgtcatgctgaatccggccaacacccgcagcatttctaacatgacatcacaggaattcgttgagaagctgactaaacggttgaagcgccaccccgaagaaaccgggggcttccaggaagctccactcgcttatgacgctatctgggcactagcgctggcgttaaacaaaacctctggtggcggtggcaggagcggcgtacgacttgaggattttaattacaataatcaaacgattaccgaccaaatttacagggctatgaattcttcttcctttgaaggagtaagtggtcacgtagtcttcgacgcctccggatcacggatggcttggacgttgatcgagcagttgcaagggggcagctacaaaaagatcggctactacgactccactaaagatgacctgtcatggtccaagaccgataaatggattggtggctcccctcctgccgaccagacactggtgatcaagacatttcgattcctctcccagaaactgtttatatctgtgagcgttctgagctcacttgggattgtcctcgcagtcgtttgtttgtcattcaacatctataatagtcacgtgaggtatattcagaacagccagcctaacttgaacaacctgactgcagtcggatgtagcctggctcttgcagcggttttcccccttggactagatggttatcatattggccgcaatcagttccctttcgtgtgtcaagccaggttgtggctccttggtttaggctttagcctcggttatgggtcaatgtttaccaaaatatggtgggtgcatactgtcttcaccaagaaggaagaaaagaaggaatggagaaaaacccttgagccttggaaactgtacgcaactgtggggttgcttgtgggcatggatgtgcttacccttgcaatatggcaaattgtcgatcctcttcacagaactattgagacctttgctaaggaagagcccaaagaggacatcgacgtcagtatccttccgcagctggagcattgttcctccaggaagatgaacacatggctcggcatcttctatggatataaagggttactgctcctcttgggtatttttctggcctatgagacgaagtcagtctccacggagaaaattaatgatcaccgggcagtcggcatggctatctataatgtggccgtcttgtgcctcataaccgcaccagtcactatgattctgagctcgcagcaggatgctgcttttgcctttgctagtctcgccattgtgttctcttcatacatcacgctggttgttctgttcgtgccaaagatgcggcgcctgatcacaagaggcgagtggcaatccgaggctcaagacactatgaaaacaggctcttccacaaataacaacgaagaagaaaaatctaggctgttggagaaggagaatagagagctcgaaaagattatcgctgagaaggaggagagggtctccgagctgcgtcatcaactgcagtcccggcagcaactacggtcaaggcgacacccccctacccccccagagccttccggcgggctgccacgggggcctcctgagcctccggatcgtttatcgtgcgatggatcacgggttcacctgctctacaaatag

SEQ ID NO: 9773 - DNA, 339 bp, Artificial Sequence
  Description of Artificial Sequence: Synthetic coding sequence
atgctgaccgccgccctggcccccggcgccgccaacagccccaccacaaatccggtcatacttatcgtagacaaggtcctcgaaacacaagacctgaacggagacggactaatgaccccagctgaattaattaactttcccggcgtcgcattaaggccataccccccttatattggggtaggccccaattctaacatgtgttcacgatcagacctgcctgaggactccaacactctgtatcccggctctcacctctggctgaggcatgctttgaactcaaaggggaacctcgatgcaagactggatggaggcgagaaagccatgcagcctcagtggtag

SEQ ID NO: 9774 - DNA, 2676 bp, Artificial Sequence
  Description of Artificial Sequence: Synthetic coding sequence
atgctgcccaccgaggtgccccagagccaccccggccccagcgccctcctgctcctgcagctgcttctcccacccacttccgctttcttccctaacatatggtctcttctcgccgccccggggtctatcacgcaccaggatttaacagaagaagctgccttgaacgtgaccctgcaactgttcctcgagcagcccccacccggtcgcccccccctacggttagaggatttcctgggtcgaaccctcctagccgacgaccttttcgctgcctactttggcccaggcagttcaagaaggtttcgggcagccctgggtgaagtctcaagggccaacgccgcacaagattttctgccaacgtcaaggaatgaccccgatctgcatttcgatgccgagagacttggccaaggcagagctcgactagtaggggctttgagggaaactgtggtggcagccagggctttagaccacacccttgcccgccagcgcctgggtgcagctctgcacgctctacaagatttttacagtcattcaaactgggtcgaactgggggaacaacagccacatcctcacctgctctggcccaggcaggaactacaaaatctggcccaagtggcagaccccacatgctctgattgcgaggaactttcttgtcctaggaattggctgggtttcactctgttaacgtcagggtatttcggcacccatccaccaaagccaccaggcaagtgttctcacggcgggcatttcgatagatcttcgagccagcctccgcggggggggattaataaggacagtacttctcctgggttttcaccacatcacatgctccacttacaggccgctaaactcgcactgctggctagcattcaggccttcagcctgctcagatccaggttaggagaccgggacttttcaagactgcttgacatcacacctgccagctcattgtcatttgtcctggacacaaccggcagcatgggtgaagaaataaacgcagctaaaatccaggcccgacatctggtggagcagcggagagggagtccaatggaacccgtgcactacgtcctcgtcccctttcatgatcctgggttcggacccgtattcacaacatctgaccccgacagcttctggcaacaactcaatgagattcatgcccttggggggggcgacgagccagaaatgtgtttatcagcattacaattggctctcttacacactcctccgctctctgacatttttgtcttcacggacgcttctcctaaagacgcgtttttaaccaatcaggtggagagcttaacccaggagcgtagatgtagagttactttcctggtaaccgaagacacatctcgggtgcaggggcgcgcacgtcgagaaatcctgagccctttgagatttgagccatacaaggccgtcgccctcgcttcggggggcgaggtaatctttactaaggaccaacatatcagagatgtggctgccatcgtgggagaatccatggcggcactcgttacactgccccttgatccccctgttgtggtgccaggacagcctctggtcttttccgttgatggattgctacagaaaattaccgttcgcattcatggagatatttctagcttctggattaagaacccagctggcgtttctcaggggcaagaggaaggaggagggcctcttgggcatactaggagatttggacagttctggatggtcacgatggatgaccctccacagactggaacttgggaaatacaggtgaccgcagaagacacgccgggtgttagagtacaggcccagacctccttagactttctctttcacttcggcattcccatggaagatgggccccacccaggattgtaccctcttacgcagcctgtcgcggggcttcaaacccagctcctcgtggaagtgacgggactcggttccagagcgaaccctggggacccacaaccacacttctcccacgtgattctgcgcggggttccagaaggtgctgaactcggacaggtccccctggaacccgtgggtccacctgaaagaggtctgcttgccgcctcactcagtccaaccttacttagtaccccccgccccttttctctggagttgattggccaggacgcggccggcaggcggctacaccgggccgctcctcagccatcaactgtcgtgccagtgctgctagagctcagcggaccatcgggcttcctcgctccggggagtaaagtgcctctgagtctgcgcatcgccagtttttctggccctcaggatctggacctgagaacttttgtgaacccatcattttccttgaccagcaatctgtctagagctcacctggagttaaacgagagtgcctggggtcggctttggctggaagtgcccgacagcgccgcccctgacagcgtcgtaatggtgacagtgacagccggcggccgggaggccaatcctgtgcctcctacccacgcgtttctcaggctgctggtctctgcacccgctccacaagaccggcatactacaccaacgggcagctcggaccccatactgacaaccgccaccccagctttttcgccttttactttggttacacaaggtcgggcaggtgcagggctcgccgcggggtctccctggtgggggacggtgggcggcgtgctactcctcctcggcctggcatcatggtag

SEQ ID NO: 9775 - DNA, 2742 bp, Artificial Sequence
  Description of Artificial Sequence: Synthetic coding sequence
atgggccccgaggccctgagcagcctgctgctgctgctgctggtggcatccggtgatgccgatatgaagggacatttcgatccagccaagtgtaggtatgccctgggcatgcaagataggactattcccgactctgacatttccgcctcttcatcctggagcgattccacagccgccagacattccagactcgagtcttccgatggagatggggcctggtgccccgccgggtctgtgttcccgaaggaagaggagtatctgcaggtggacctgcaacgactgcaccttgtcgcgctggtgggaacacagggacggcacgcggggggcctgggtaaggagttctcccggagttaccgactgcggtactcaagagatggtcgccgctggatgggatggaaggataggtggggacaggaggtcatatcagggaacgaggaccccgaaggagttgtgctgaaggacttgggacccccaatggtggcccgcctcgtgcgcttttatcccagggccgaccgcgtgatgtccgtgtgtcttcgggtagagctctacgggtgtctctggcgtgacggactactgagttatacggcccccgtggggcagactatgtacctctcagaagccgtatacctcaatgatagcacatatgatggacacacagttggcggactgcagtacggtggactaggccagttggccgacggggttgttggattagacgattttagaaaaagtcaggagttgcgggtatggcccggatatgactatgttgggtggagcaaccattccttcagctcaggctatgtcgaaatggagttcgagtttgatcgcctccgcgcgtttcaagctatgcaagtacactgcaacaacatgcacaccctaggggccagactgcctgggggagttgaatgccgattcaggagaggaccagctatggcctgggagggcgaacccatgagacacaatctgggcggcaacctgggcgacccaagagcccgtgccgtgtccgttcccctgggcggacgcgtggcccgattcctgcagtgccgcttcttgttcgccggaccatggctcctcttcagcgagatctcattcatcagcgatgtagttaataattcctctcccgccctgggggggacattcccaccagccccttggtggccacctgggcctcctcctaccaactttagtagcttagaactggaaccaagaggtcagcagccagtggccaaggccgagggttcaccgaccgcaatcctcatcggatgtttggttgctataattcttttacttctactgattattgcattgatgctatggagactacattggaggcggctcctgtcaaaagctgaacgcagggtgcttgaagaggagctcactgtccatttgtcagttccaggcgataccatcttgataaataaccggcctgggcctcgggagccgcccccatatcaggagcccaggcctagaggaaatcctccccattccgccccttgcgtgcccaatggttcagcactgttgctgtcaaatccagcatatagactgctcttagccacgtatgcccggcctccacgcggacctgggccgcctacccctgcgtgggccaaacctacaaacacccaggcctactctggggattacatggagcccgagaagccgggtgctcccctgctgccacccccgccccagaactcagtacctcattatgcagaggctgacattgtgacgttgcagggagttactggaggtaatacttacgctgtgccagccctgcctcccggcgccgttggagatggccccccaagagtggacttcccgcggtcaaggctgcggtttaaagagaagttgggtgagggtcagttcggcgaggtacacctgtgcgaggtggattccccccaagaccttgtgtccctggactttccactgaatgtgcgcaagggccatccgctgctcgtggccgtcaagatcttacgccccgacgctacgaagaatgctcgaaacgatttcctaaaggaagttaagatcatgtctaggctcaaggaccccaatattatcagacttcttggggtctgcgtccaagacgaccccctctgcatgattacagactacatggagaacggcgatctgaaccaattcctctcagctcaccagcttgaagataaggcggcggagggcgcacccggggatggacaggccgcacagggccccacgattagttatccgatgctgcttcatgtagccgcccagatcgcctctggaatgcgatacctggctacactgaacttcgtccatcgcgacctggcgacacgaaattgcctcgtgggcgaaaactttactatcaagattgcagatttcgggatgagtcgcaatctgtacgccggtgattattatcgtgtgcaggggcgggctgtcctgcctattcgttggatggcgtgggaatgtatcctaatggggaaattcaccaccgcatcagacgtctgggcctttggcgtgactctctgggaggtcctgatgctgtgtcgtgcccaaccttttggccagctaaccgatgaacaggtcatcgagaacgcaggggagtttttccgcgaccagggtaggcaggtgtacctatcacggccccctgcgtgtccccaggggttgtatgagctgatgcttcgctgttggtcacgtgagtccgaacagcggccaccattctctcaactccaccggtttctggcagaggatgccttaaatactgtgtag

SEQ ID NO: 9776 - DNA, 390 bp, Artificial Sequence
  Description of Artificial Sequence: Synthetic coding sequence
atggccgccggcagcgcccccatgcagctgcacctgcgggccaccatccgaatgaaggacggcctctgcgttcctaggaagtggatctatcatctgactgagggtagtaccgatctccgtacggaggggaggcccgacatgaaaacagaactgtttagcagctcgtgccctggaggaatcatgctgaatgaaacggggcagggataccaacgattcctattgtataatcggtctcctcacccaccagaaaaatgtgttgaagaatttaaaagcctgacaagctgtttggacagcaaagccttcctactaacacctcggaaccagggaaaggggctgaaatcccataagacaggactcggactgacaaaatcaagcggggttactgggtag

SEQ ID NO: 9777 - DNA, 846 bp, Artificial Sequence
  Description of Artificial Sequence: Synthetic coding sequence
atgctgcccaagagccggcgggccctgaccatccaggagatcgccgcactggcccggagtagcctacacggaatcagccaggtcgtgaaagaccacgtcacgaagcctacagccatggcccaagggagggtggcccatctgatcgaatggaaaggctggagcaaacctagcgactcccccgcggctcttgagtccgctttctcaagctattcagacctctcagagggggaacaagaagcccgcttcgctgcaggagtcgccgagcagtttgcgattgctgaagccaagctgcgggcatggtcttcagtcgatggcgaggattctacggatgacagttacgatgaggactttgctggaggtatggataccgacatggccggacagcttccactgggacctcatctgcaggatctgttcacgggccatcgatttagcaggccagtccgccagggctccgtggaacccgagtctgactgtagccaaacggtcagtcctgatacattgtgctcatctctctgttcactggaagatgggcttctgggatcacctgcacggctggcatcacagctgctgggcgacgaactgctgctcgctaagctacctcccagcagagagtcggctttccggagtctgggtcccttggaggcccaagactccctgtataacagccccctgaccgagtcttgcctctcaccagctgaggaggagccagcgccctgtaaggattgccagcccctatgccctcctctgacgggctcatgggagcgtcaaaggcaggcttccgacctagcttcaagcggggtcgtgagtctcgacgaggacgaggccgagccagaagaacagtag

SEQ ID NO: 9778 - DNA, 444 bp, Artificial Sequence
  Description of Artificial Sequence: Synthetic coding sequence
atgggccccgaggccctgagcagcctgctgctgctgctgctggtggcatccggagacgccgatatgaaaggacattttgacccagcgaagtgccgatacgctctggggatgcaagaccgtactatccccgacagtgatatttctgcatcttcttcttggtcagacagcacagcagcgcgccattctcgcctggagtcttcagacggggacggcgcctggtgccccgccggatcagtgttccccaaggaggaagaatacctgcaggtagacctgcagagactccatcttgtagctttggtcggtacccaggggcgccacgccggtggactgggtaaagagttctccaggagctataggttgcgttacagccgggacggtcgccggtggatgggatggaaggatcgttggggtcaggaggtgattagcggtaatgaggacccctag

SEQ ID NO: 9779 - DNA, 2631 bp, Artificial Sequence
  Description of Artificial Sequence: Synthetic coding sequence
atgggccccgaggccctgagcagcctgctgctgctgctgctggtggcctccggagatgccgatatgaaagggcattttgaccccgccaagtgtcggtacgctctgggtatgcaggatcgcactattccagactctgacatttcggccagttccagttggtctgattcaaccgccgcccgccattcaaggctcgagagcagcgacggagacggcgcgtggtgtcctgcaggttccgtctttcccaaggaagaggaatatttgcaggttgatcttcagagactgcacttggtggctttagtgggcacccagggtcggcacgcgggggggctcggtaaagagttctctcggtcctatagactgcggtacagcagggatggcagacggtggatggggtggaaggataggtggggccaggaggtgatctcaggaaacgaggatcccgaaggcgttgtgctcaaagaccttgggccaccgatggttgctaggttagtacgcttctatcctcgtgccgatagggtcatgagtgtttgtttgcgcgtggagctctacggttgcctatggagggatggcctgctctcctataccgccccagttggtcagactatgtacttgagcgaagccgtgtatctgaatgactccacctatgatggccacaccgtcggggggctgcagtacggaggcctgggccaactggcagatggggtggtggggctagatgattttagaaagagccaggaactgagggtctggcctgggtacgattatgtcgggtggagcaaccactctttttcaagtggatacgtagagatggagttcgaatttgatagactgcgagcctttcaggccatgcaggtccattgcaacaatatgcacaccttgggggcccgtctgccagggggcgttgaatgccggttccgtcggggtcccgccatggcttgggagggagaacctatgcggcacaatctaggaggcaacttgggtgacccccgagcaagagctgtgtctgtgccgcttgggggcagggttgcccgcttcctgcaatgtcgtttcctgtttgccggaccctggttgctgttttcagaaatttcatttatctccgacgttgtgaacaatagcagcccggcactgggcgggacattcccaccagccccctggtggccccccggaccgccaccgactaacttttcttccctagaattagagccacgggggcaacaacctgtagcgaaggcagaggggtcccctacagccatcctcattggctgtctagttgctattatcctgctgctgcttttgattattgccctgatgctttggcggctgcattggcggagactgttgagtaaagccgagcggagagtgctcgaggaagaactgacagtgcacctctctgttccaggagataccattctgattaataaccgacctggaccacgagagcctcctccataccaggagcctcgccccaggggaaatccccctcattcggctccctgcgtgcccaacggcagtgcctactcaggagactacatggaaccagaaaagcctggcgccccactgcttcccccaccacctcagaactcagtgccccactatgctgaggcggacattgtgacactgcaaggcgtgactggaggaaacacgtacgccgttccggccctgccccccggcgctgttggtgatggtccccctagagttgatttccccaggagtcgcctccgattcaaagagaagttaggcgagggccagtttggggaggtgcacctctgtgaagtggatagtccccaggacttggtgtccttggacttcccactcaatgtgagaaaagggcacccactgctcgttgcagttaaaattctgcgtccagatgctaccaagaatgcacgtaacgatttcctgaaggaggtgaagatcatgtcacggctgaaggatcctaatattatcaggctcctcggtgtctgcgtacaggacgacccactgtgtatgatcacagattacatggaaaacggagacctgaatcagtttctttccgcccaccaactcgaggacaaagccgccgaaggagcaccgggtgacggacaagctgcccagggccccactatttcctatcctatgctccttcatgtggccgcacagatcgcgtctgggatgaggtacttagccaccctgaatttcgtccatcgagatcttgcgacccgaaactgcctagttggcgagaacttcacaattaaaatcgccgactttggaatgtcccggaatctttacgccggggactattacagagtccaggggcgagccgtccttcccattaggtggatggcctgggagtgtatactgatgggaaagttcacaactgcctctgatgtttgggctttcggagtgaccctatgggaggtgctgatgttgtgtcgtgctcaaccattcgggcagctcacggacgagcaggtgattgaaaacgccggcgagttttttagagatcaggggcggcaggtgtatctcagccggccccctgcatgcccacaggggctttacgagctgatgctgcgatgctggtctcgggaatcagagcagcgtccgcctttctcacaactgcacagattcctagcagaggacgcgttgaacacagtatag

SEQ ID NO: 9780 - DNA, 1749 bp, Artificial Sequence
  Description of Artificial Sequence: Synthetic coding sequence
atggacttcctgctggccctggtgctggtgagcagcctgtacctgcaggcggccgctgaattcgacggcagatggccgcgccagattgtcagtagtattggtctgtgccggtatggcggtagaatcgattgctgttggggttgggccagacagtcatggggtcagtgccagccattctacgtgttaaggcagcgtattgcccgcattcgatgtcagttgaaggcagtttgtcagccacgctgtaagcatggtgaatgcatcggacccaataaatgtaagtgtcaccctggctatgcaggtaaaacctgcaatcaagaccttaatgaatgcgggctaaagccccgcccttgcaagcatcgctgtatgaacacatacggcagttacaagtgttactgtctaaacggctacatgctaatgccagatgggtcttgcagctcagcgctcacctgtagcatggctaattgtcaatacggatgcgacgtcgtgaaaggtcagattagatgccaatgcccaagccccgggctccagctggcccccgatggccggacctgcgtcgatgtggacgagtgcgcaaccggtcgcgccagctgtccaaggtttcgacagtgtgtcaacaccttcgggtcctacatttgtaagtgtcataagggatttgatctgatgtacatcggtggaaaataccaatgccacgacattgatgagtgttcattgggacagtatcagtgctcatcattcgctcgctgttataatataagggggtcctataaatgcaagtgtaaagaaggataccaaggcgacgggttgacgtgtgtgtatatccctaaggtaatgattgagccatcgggacctatccacgttcctaagggcaacggcacaatcctgaaaggcgatacagggaacaacaattggattcccgatgtcgggagtacatggtggccccctaaaacaccctacatccctcccattattacgaatcggccaacttcaaagccaaccacacggccaacccctaaacctacccctattcctactccacccccgcctccacctctgccaacagaattacgcactcccttacctcctactactcctgaaagacccacaacaggcctcaccacaatcgctccggccgccagcacacctcccgggggaatcaccgtggacaacagggtccagaccgatccacagaaacctcggggcgatgtgtttattcctagacagcccagcaacgatttgtttgagatcttcgagattgagcgaggcgtctctgcggacgatgaggccaaagatgaccccggcgttctcgtccatagctgtaattttgaccatggcctgtgcgggtggattcgagagaaggataatgatctgcactgggagcccatccgggaccctgcaggaggccagtatcttacagtctcagcggctaaggctcccggtggcaaggccgcccggctggtccttccactgggaaggctgatgcatagcggtgacctctgcctgagctttaggcacaaagtgaccgggctgcattctggcactctgcaggtgttcgtgaggaaacacggagcccacggcgccgcactatggggccgcaatgggggacacggatggcggcagacccagattacgttacgcggggctgacattaaaagcgtagtcttcaaaggagagaagcggcgcggccataccggagagataggcctcgacgatgtcagtctgaagaaaggacactgctcagaggaacgctag

SEQ ID NO: 9781 - DNA, 1602 bp, Artificial Sequence
  Description of Artificial Sequence: Synthetic coding sequence
atgggcagcagccggctggccgccctgctgctgcccctgctgctgatcgtgattgatctgtccgattctgcggggattgggttccgccacctgccccactggaatacccgatgtcctctagcgagtcatacagatgactcctttacaggcagttccgcctacatcccttgcaggacttggtgggcactgttttccaccaagccttggtgcgtcagggtctggcactgttctcgatgcttgtgccagcacttactttccggcggatccggtctccaacggggtctgtttcatctcttggtccagaaatctaaaaagagctccacattcaagttctaccgccgacataaaatgcctgcaccagctcagaggaagctgctccccaggaggcacctgtcagagaaaagtcaccacatctccataccgagtcccgatatatcccacaaggggttaagaagtaagaggacccagccgtccgatcccgagacctgggagtcactccccagattagattctcagcggcatggcggccccgaattttcatttgatctgttacccgaggccagggccatccgagtgaccatcagctccggaccggaagtgagtgtgagattgtgtcatcagtgggcactggagtgcgaagagttgtcatctccctacgatgtgcaaaaaatagtatctggcggacacaccgtcgagttaccatatgagtttttactcccttgtctgtgcatagaggccagctatctacaagaagataccgtgcgccggaagaagtgtcctttccaaagctggcctgaagcttatggatcagacttctggaaatccgtgcatttcaccgattactcgcagcatactcagatggtgatggctttgaccttgcggtgccccttgaagctagaggcggctctgtgccagagacacgattggcacaccttgtgcaaggatctcccaaatgcaacagcccgtgaaagtgatgggtggtatgttctggagaaagtggatctccacccacagttatgctttaagttctcttttggtaactcttctcatgtggaatgtccccatcagactgggtccttaacgtcatggaatgtctctatggatacacaggcccaacagttaatcctgcacttctcttcccgtatgcacgcaaccttctctgcggcctggtcccttcccggactggggcaggatactctcgtaccaccagtatacaccgtatcacaagctagaggcagctctccagtgagtctggacttgattatcccatttctccggcccggatgctgcgtactcctgcatgcctccctcagttcacctggcggtgaggacgcatggctgatcggggtgggcggttcagtaccctccggcgtggcggtgagatgcccggtatgtctggaagcacctcttgtgagtggttgtctgttgcagacccccggcgcactcgatcccggaaccgctggcccgcctcatcctactggctgctgctcggggccacatcttccagctcccactgtccgaccaggacctagtgccgcttccgcacccccggctcgtggcggactcggtggggccgcggcacccggcggaagcgctggttag

SEQ ID NO: 9782 - DNA, 1293 bp, Artificial Sequence
  Description of Artificial Sequence: Synthetic coding sequence
atgggcgtgagcaagctggacatcctgtaccggcggctgctgctgaccaagctctttattagaggttggggtcgacctgaagacctgaaaagactgttcgagttccgaaagatgatcgggaacagggaaaggtgtcagaatctggtctcctccgactatccagtccacatcgataaaatagaggaacagtccgattgtaagatcctcgatgggcatttcgtttcgcccatggcccactacgtgcccgacatcatgcctatagagagtgtcatcgctcggttccagttcattgtgcctaaggagtggaactccaagtatcgtccagtgtgtatacatctcgccggaactggagatcatcactactggaggagaagaacgcttatggcccggccaatgattaaggaggcccgcatggcgtccctcctcctcgagaacccttattacggctgcaggaagcctaaggatcaggtcaggtcgtccttgaaaaacgtgagcgacctgtttgtcatgggcggcgcattggtgctggaatcagctgcattgctccactggttagaacgcgagggctacggacctctcgggatgaccggtatctcgatgggaggtcatatggcctctctggccgtcagtaactggccaaagcccatgcccctcatcccatgcctgtcatggagtacagcctccggtgtcttcacaacaactgactccttcaagatggggcaggagttcgtcaagcatttcaccagctcagccgacaaactaaccaatctcaatctggtgtcacgcaccttgaatctggatatcagcaaccaagtggttagccaaaagcctgccgactgccacaattcatcgaagacaagtgtttcagcgacatctgagggcctgctgttgcaggacactagtaagatgaagcgctttaaccagacgttgagcacaaacaagtccggctacacctcgcgtaacccccagagttaccacctgctcagtaaagaacagtctagaaatagcctgagaaaagagtcgctcatttttatgaagggagtcatggatgagtgtacacatgtcgccaacttttctgtcccggtcgatccaagtctcatcatagtcgttcaagctaaagaggatgcctatatcccgaggacgggtgtgaggagtcttcaagagatttggccagggtgcgaaatcagatacctggaaggcggacacatctcagcttatctttttaagcagggattattccgacaggctatctatgacgccttcgacaggtttctgcacaagtacgccaactag

SEQ ID NO: 9783 - DNA, 2631 bp, Artificial Sequence
  Description of Artificial Sequence: Synthetic coding sequence
atgggccccgaggccctgagcagcctgctgctgctgctgctggtggccagcggggatgcagatatgaagggccactttgaccccgcaaagtgccgctacgcccttggcatgcaggacagaacaatcccagactccgatatcagcgcctccagctcatggagtgactcaacagctgccaggcactcacggttggagtcttcagatggagatggcgcctggtgccctgcgggaagtgtgtttcctaaggaggaggaatatctgcaagtggatctgcagcgtcttcacttggtggctctggtcggaacacaggggcgacatgccggaggacttggtaaagaattttccagaagctacaggctgaggtattcccgagacgggcgcagatggatgggttggaaggaccggtggggacaggaggtgatcagcggcaatgaagaccccgaaggcgtggtcctcaaagatctgggccctcccatggtcgcccgtctggtgagattttacccccgagccgatcgcgtgatgtcagtgtgccttcgcgtagaactgtacggctgcctgtggcgcgacggcctcttgagttacacagcgccagtgggccagaccatgtacctgagcgaggcggtttacctgaacgattctacctacgacggacatacggtcggggggctgcaatacgggggtctgggtcaactggccgacggggtggtgggtttagacgacttccgaaagagtcaggagctgcgtgtgtggcctggctacgactatgttggctggtctaatcattctttctctagcggctacgtggaaatggagtttgagtttgacaggctgagggcatttcaagcaatgcaagttcactgcaacaacatgcacacactgggtgcccggctgccggggggcgtggagtgtcgcttccggaggggtccagctatggcgtgggaaggtgagcctatgcgccacaatctgggagggaacctaggtgaccccagagccagagccgtgtctgtccctcttggtggtagagtggcgagatttttacagtgtaggttcctcttcgcaggtccctggctacttttcagcgagatcagtttcatctcggatgtggttaacaactcttcccctgctctggggggcactttccccccagcaccttggtggcctcccggaccacctccgaccaatttcagtagcctggagctcgaaccacgtgggcaacagcccgtcgcaaaagccgagggttctcctaccgcaatcctgatcggctgtctagttgcaatcatcctcctgctgctgctgattattgccctgatgctgtggcgcctccactggagacgtttgctttctaaggccgagagacgcgttctcgaggaagaactgactgttcacttgtcagttcctggagatacaatcttgatcaacaaccggcccgggccacgggaacctcccccttatcaggagccacgaccccggggtaatccgccacactcagccccgtgtgttcccaatggatccgcgtatagtggagactacatggagcccgaaaagccgggcgcccctctgctgcccccccccccacaaaatagtgtgccgcactacgcggaagccgacattgtgactttgcagggcgtgacgggtggcaacacctacgcagtgccggccttgccacccggggccgtgggggacggaccaccacgcgtcgactttccacgctcgagattgcgcttcaaagaaaaactgggcgaaggccagttcggcgaggtgcatctatgtgaggtggattctccacaggacctggtctcgttagacttcccactaaacgtgcggaaaggccatccactgctggtagcggtcaagatcctgcggcctgacgctaccaagaacgctcggaatgatttcctgaaggaggttaagataatgtctaggctgaaggatcccaatatcatacgcttattaggagtatgtgtacaggatgatcctttgtgtatgatcacggactatatggagaatggtgacctgaaccagttcctttccgcccaccagttggaagataaggctgcagagggagctcccggggatggacaggcagctcagggaccgacaatctcttacccaatgctgttgcatgtcgccgcgcaaatcgcttctgggatgcgttacttggctacgctgaacttcgtgcatagggacttggcaacacgaaattgccttgttggagaaaattttaccattaagatcgcagacttcggaatgtctcgaaacctgtacgctggcgactattacagggtgcaaggaagagccgtgctcccgatccggtggatggcctgggaatgtattctgatgggcaagttcaccactgcctcagacgtatgggcattcggggtcacgctctgggaggttctgatgctttgccgggcccagccattcggtcaactgaccgacgagcaagtaattgagaacgccggggagtttttcagggatcagggacgccaggtgtatttgagccgtccaccagcctgtccacagggcctttatgagctgatgctgagatgctggagcagggagtcagagcaaagaccaccattttcccaactccatcggtttctggcagaagatgccctgaataccgtgtag

SEQ ID NO: 9784 - DNA, 237 bp, Artificial Sequence
  Description of Artificial Sequence: Synthetic coding sequence
atgggcagcggcctgcccctggtgctgctgctgaccctgctgggcagttcccatgggacaggccccggcatgacactgcagctgaaactgaaggagtcctttctgactaacagctcctacgaatcctcctttctggaactgctggaaaagctgtgcctgctcctgcaccttccttctggcacatccgtgactcttcatcacgcacgtagccaacaccacgtggtctgcaacacgtag

SEQ ID NO: 9785 - DNA, 2631 bp, Artificial Sequence
  Description of Artificial Sequence: Synthetic coding sequence
atgggccccgaggccctgagcagcctgctgctgctgctgctggtggcaagcggcgatgctgatatgaaggggcactttgaccctgccaaatgtaggtacgcgctcggcatgcaagatcgcacgatacctgactccgatattagtgcctcgagctcttggtcagacagtacagcagcccgacattcccggctagaaagctcagatggcgacggggcctggtgtccagccggctccgtttttcccaaggaggaagagtatctccaggtcgacctacagcggttgcacctggtagccttggtaggtactcagggccgccatgctggcggcctgggaaaagaattcagcaggagctaccgcctccgttactcacgagacgggcgtcgctggatggggtggaaagacagatggggtcaagaagttattagtgggaatgaagatccggaaggtgtagtgctgaaggatctagggccccccatggtggcgcgattggtgcgattttacccgagagcagaccgggtgatgtctgtgtgcctccgcgtcgagctatacggctgcttatggcgcgatggactgctgtcctacactgccccagttgggcaaaccatgtacctgtctgaggccgtctatctaaatgattctacgtacgatggtcacaccgtcggcggactgcagtacgggggcctgggacagctggccgatggcgtggttggcctggatgattttcggaaaagtcaggagctgagagtttggccgggctacgactacgtgggatggtccaatcactcattctcatccgggtatgtggaaatggaattcgagttcgatcggttgcgcgcatttcaggccatgcaagtccattgcaacaacatgcacactttaggtgctcgactccctggcggcgtggaatgccgtttccgccggggcccggccatggcttgggagggcgagccgatgcggcacaacctaggcggaaacctcggagaccctcgggcacgtgccgtcagtgtcccactaggcggccgtgtggcccggtttctgcagtgccgcttcttgttcgccggcccctggctcctgttcagcgaaataagctttatatccgatgtagtaaataattcctctcccgctctgggcggtacattcccccccgctccctggtggcctccggggcccccacctactaacttctcatctctggaactggaacctcggggtcagcagccagtggcgaaggctgagggctcccccaccgccattctcatcggttgccttgtggctataatcctcctactgcttttgattatcgcgttgatgctgtggaggctgcactggcgaagacttctctccaaagcagaacgccgcgtcctggaggaagagttgacagtgcatctgagtgtgcctggcgacacaatactaataaataatcgtcctggtccccgcgagccccccccttaccaggagccccgtccacgggggaatccacctcattccgctccgtgcgtcccgaatggcagtgcctacagtggagactacatggaaccagagaaaccgggagctcctttactgccacctcccccccagaattctgtcccacactatgcagaggctgacatagttaccctacagggcgtgactggaggcaacacctacgcagttccagctcttccacccggcgcggtcggcgatggccctcctcgggtcgacttcccccggagtcgtctgcgatttaaggagaagctcggagaaggccaattcggagaggtacatctctgtgaggtggactcaccccaggacctggtgtccctggacttccctcttaatgtgagaaagggccatccactgctagtcgctgtgaagatactgcgccccgatgccaccaagaatgccagaaacgatttccttaaagaggtgaagattatgtcacgtttaaaggacccaaatattatcaggctgttaggcgtttgtgtgcaggatgatccactctgcatgataaccgactatatggaaaacggggacctgaatcagtttctgagcgcgcaccagctcgaagataaggccgccgagggcgcaccaggggacggacaggcggctcagggccctactattagctatcccatgttgttgcacgtggccgcccagattgcgtcaggcatgcgatacctcgccactttgaattttgtacatagggacctcgctactaggaactgtctggtgggtgaaaattttacaatcaagattgccgattttgggatgtcccgaaacctatacgccggcgattattacagagtacagggccgcgctgtcctcccaatccggtggatggcctgggagtgcatcttaatgggcaagttcacgaccgcctctgatgtgtgggcgttcggcgtcaccctctgggaggttctgatgctgtgccgagctcagccctttggccagttgaccgacgagcaagtgatagaaaacgctggggagttctttagggaccagggaaggcaggtgtacctcagcagaccccccgcctgtcctcagggactgtacgagttgatgctgcgctgctggtctagggagtcagagcagaggcctccattcagtcagctgcacagattcctggctgaggacgctttaaacactgtttag

SEQ ID NO: 9786 - DNA, 1257 bp, Artificial Sequence
  Description of Artificial Sequence: Synthetic coding sequence
atgcggaccctgttcaacctgctgtggctggccctggcctgcagccctgtccacacaacactctcaaagtcagacgccaagaaggcggcttcgaaaaccttgttggagaaggtgaaattctgttcatgctgtccaggatggagtgctatggctaggtcctggctcaccgccaccagcgcgacacagtctcaattctccgacaagcccgtgcaagaccgaggtttagtggtgaccgacctgaaggctgagtccgtcgtgctggagcaccggagctactgttccgctaaggcccgcgaccgacactttgctggagacgtccttggctacgtcacaccatggaactcccacggttatgacgtaactaaggtcttcgggagcaagttcacccagatttcaccagtatggctacaactgaagcgccggggacgggagatgttcgaagtaactggcctacatgatgttgatcaaggatggatgcgcgcagtcaggaaacacgcaaaaggtctccacatagtgccacgtctactctttgaagactggacctacgacgattttcggaacgtgttagacagtgaagatgagattgaagagctgtccaaaacggtagttcaggtggcaaagaatcaacacttcgacgggtttgtcgttgaagtgtggaatcaactgctatctcagaagcgcgtaggcctgatccatatgctgactcatttggccgaagcactgcaccaggcaagactgctggccctccttgtcatccccccagcaataactccagggactgaccagttgggcatgtttacgcataaggaattcgagcagcttgcccctgttctcgacggcttcagtctcatgacttacgattatagtacagcacaccagcctggaccaaatgctccactgagctgggtgagggcgtgcgtacaggtgctagatcccaagtccaagtggcgttccaaaatactactaggtctcaatttctacgggatggactacgccaccagcaaagacgccagagaacctgtggtgggcgcgcggtacatccagactctcaaagaccatcggccaagaatggtgtgggacagtcaggcaagcgaacatttctttgagtacaaaaaaagcaggtctggcagacacgtcgtgttttatccaaccctaaaatcccttcaagttcgcctcgagctggcccgggaactaggtgtcggtgtcagtatatgggaactgggtcaggggctcgattacttttacgatctcctgtag

SEQ ID NO: 9787 - DNA, 390 bp, Artificial Sequence
  Description of Artificial Sequence: Synthetic coding sequence
atgcggaagccccggcggaagagccggcagaacgccgagggccggcggtcacctagtccctacagcctcaagtgttctcccacacgagaaaccctgacctacgctcaagcccaaagaatcgtcgaagtcgacatcgacggtagactacatcgaatatctatttatgaccctttgaaaattataaccgaagacgaattaaccgcacaggatatcacagagtgtaattccaataaagagaactcagaacaaccacagttccccggcaagagtaagaaacccagctctaaaggtaagaagaaggaatcatgcagtaagcatgctagcggaacaagtttccaccttcctcagccaagctttcgtatggtagactctggaatacaaccagaatag

SEQ ID NO: 9788 - DNA, 315 bp, Artificial Sequence
  Description of Artificial Sequence: Synthetic coding sequence
atgcgggtggtgaccatcgtgatcctgctgtgcttctgcaaggccgccgaattgcgcaaagcctcccctggctctgtgaggagtagggtcaaccatgggagggccggtggggggaggcgaggtagcaacccggtgaagaggtacgcaccgggcctgccatgtgacgtgtacacttacttacatgaaaagtacctcgattgccaggagcggaagcttgtgtatgtcctgccggggtggccccaggacctgctgcatatgctgctggcgcgaaataagattcggacgctgaagaataacatgttctccaaattctag

SEQ ID NO: 9789 - DNA, 639 bp, Artificial Sequence
  Description of Artificial Sequence: Synthetic coding sequence
gacttcggctactgcccccgggtgtactgcgagaaccagcccatgctccctattggtgttctagtgatggtgggattcacagttggtaaagtgccagtgccggacattcgcacatgccacttttgcttggtcgaagatccctctgtgggatgcatcagtggaagcgagaaatgcactatcagttcgagctcactgtgcatggtcattacgatctactacgatgtcaaggtccgctttatagtacgggggtgcggccagtacatttcctatcgttgccaagagaaacgcaacacgtacttcgcagagtactggtatcaggcacagtgctgccagtatgattattgtaactcttggagctctcctcagctgcaatccagcctcccagagcctcacgaccgtcctctcgccctgcccctctcagactctcagatacagtggttttaccaggcactgaatctctcactaccactacctaactttcacgccggcacagagcccgacgggctagaccccatggtcacgctgagcttgaacctcggcctctccttcgctgagctgagaaggatgtacctcttcttgaattcctccggccttctcgtcttaccgcaggctggacttctgactccccatcccagttag

SEQ ID NO: 9790 - DNA, 1005 bp, Artificial Sequence
  Description of Artificial Sequence: Synthetic coding sequence
atgctggccctggccaagatcctgctgatcagcaccctgttctactctctgctctcaggctcacacggcaaggaaaatcaggatattaacaccacacagaatattgccgaagtcttcaagactatggagaataaacccatctccctcgagagcgaggcaaatctcaactccgacaaggagaatataaccacctctaatttgaaagcttctcacagccctcccctcaatctgccaaataatagccacgggatcaccgatttttcttcaaactctagcgccgagcattctttgggtagtctcaagcctacctctactatcagcacctctcctccactgattcatagttttgtatcgaaggttccatggaacgctcctattgctgacgaagatctgcttcccatttctgcacaccctaatgctaccccggcgctgagttcggaaaactttacctggtctctcgttaatgacacagtgaagacccccgataacagctccatcacagtttccatcctgagctctgaacctaccagtcccagtgtaactccactgattgtggagcctagcggctggctcactacaaattctgactccttcactggctttacaccgtatcaggagaaaacaaccctgcagcccaccctgaagtttactaataattccaagctgttcccaaatacgtctgatcctcagaaggaaaacaggaataccgggattgtgtttggggccattcttggcgccatcttaggagtctctctgctgactcttgttggatacctcctgtgcggtaaacggaaaacggatagctttagccatcgcaggttatacgacgacagaaatgaacctgtgctgaggcttgacaacgctcccgagccttatgacgtctcctttggaaactcttcctattacaatcctactctcaatgactcggctatgcctgagtccgaggagaatgcacgggatggtatcccaatggacgatatcccacccctgcggacgagtgtctag

SEQ ID NO: 9791 - DNA, 987 bp, Artificial Sequence
  Description of Artificial Sequence: Synthetic coding sequence
atgggccccgccggctgcgccttcaccctgctgctgctgctgggcatctcagtctgcgggcagccagtgtatagcagccgagtagtcgggggacaggacgctgctgctggaaggtggccttggcaagtgtctttgcacttcgaccacaattttatttgtgggggaagcttagtaagtgaaaggcttatactcaccgcggcccactgtatccaacccacatggactacgttttcctacaccgtgtggttgggctctatcacagtgggggacagcagaaagcgggtcaaatactatgtgagcaagatagtaattcacccaaagtaccaagatacaaccgcggacgtcgccctgcttaaacttagttcccaggttactttcacaagtgctatcttaccaatatgtcttccttctgttactaagcaactggctattccacctttttgttgggtaactggctggggcaaagtgaaggaatcctctgacagagattaccactccgcattgcaagaagctgaggttcccatcattgatcgccaggcgtgtgaacaattgtataatccaatcggaatattcctgccagcgcttgaacctgtgattaaggaggacaaaatctgcgccggggacacccagaacatgaaggatagctgtaagggcgactccgggggtccattgtcgtgccacattgacggcgtttggatacagacaggcgtcgtgtcatggggccttgagtgcggtaagtctctgcctggcgtctacacgaatgtcatctactatcagaaatggatcaatgctactatctctagggcaaataatctggatttctctgatttcctgttccctattgtgctgctttccttggcccttctcagaccttcatgtgcctttggccccaacacaatccatcgggtcggaacagtggcagaggccgtggcttgtatccagggttgggaagaaaatgcgtggcgattttcgccacgtggcagatag

SEQ ID NO: 9792 - DNA, 453 bp, Artificial Sequence
  Description of Artificial Sequence: Synthetic coding sequence
atgcggttcatggccggccccgccggcagccagagcctgggccccctgtgctttcactcgtcaccacaggcactttacactgtgctgctgattgtactcgtcatgatgtcactcgtcttcgggaagttcgtgccagtcaattgggagccgccccagcctctaccatttcccaagtaccttcggtgctatagatgtctccttgagacaaaggagcttggctgcctgctgggttctgacatctgcctgacacctgccggctcttcgtgcattaccctacataaaaagaatagttccggctccgatgtgatggtgtctgactgtcggagcaaagaacagatgtcagactgcagcaacacacggacaagccctgtcagcgggttctggattttctctcagtactgtttcctcgatttctgcaacgatcctcagaacaggggactgtataccccttag

SEQ ID NO: 9793 - DNA, 234 bp, Artificial Sequence
  Description of Artificial Sequence: Synthetic coding sequence
atgcgggtggccggcgccgccaagctggtggtggccgtggccgtgtttctgcttaccttctatgtgatcagtcaggtgtttgaaatcaaaatggacgcttccctgggaaacctcttcgcaagatcagccctggatacggcagcccgctcaactaaacccccacggtacaagtgcgggatctctaaagcatgtcccgaaaagcactttgcctttaaaatggcctcaggagcatag

SEQ ID NO: 9794 - DNA, 1143 bp, Artificial Sequence
  Description of Artificial Sequence: Synthetic coding sequence
atggccctgacccccggctggggcagcagcgccggccccgtgcggccagagctgtggctcctactatgggcagctgcctggagactgggcgccagcgcttgcccagctctgtgcacatgcaccgggactacggtggactgccacggcaccggtcttcaggcaatccccaagaatatcccacgaaataccgaacggctcgagctgaatggcaacaacattacccggatacataagaacgattttgctggactgaagcagctgagggtactgcagctcatggaaaatcagatcggcgctgttgagcgcggcgcctttgatgacatgaaagaacttgagagattggacttaagcgagaacgcaatccaggccatcccacgcaaagcgtttagaggggctacagaccttaagaatttacaattagacaaaaaccagatcagctgcattgaagaaggggcctttagggcactgagggggctcgaagtgttgacgctgaataacaataacattactactatccctgtaagtagtttcaatcacatgccgaaactcagaacattcaggctacattcaaaccatctgttttgcgactgtcacctcgcgtggttgagccagtggctgaggcagcgaccaacaatcggtctgttcactcagtgtagtgggccagcctccctgcgaggtctcaatgtggccgaggtgcaaaaatcagaattttcctgtagcggtcagggtgaagctgggagggtacctacatgcaccctcagctccggatcttgccccgctatgtgtacctgttctaacggtattgtcgactgcagaggtaagggactgacagcaattccagcaaacctccctgagactatgactgaaatcaggcttgagctaaatgggataaaaagcatcccgccaggagcctttagtccttatcggaaactgagacgaattgatctgagtaacaaccagatagccgagattgcccccgacgcgttccaggggttgcgctctctgaactccctcgtactgtatggcaacaagataaccgacttgcctcgcggagttttcggaggactttacaccctgcaattgcttcttcttaatgcaaataagataaattgcatccgaccggacgccttccaggacttgtag

SEQ ID NO: 9795 - DNA, 558 bp, Artificial Sequence
  Description of Artificial Sequence: Synthetic coding sequence
atgcccggctggctgaccctgcccaccctgtgccggttcctgctgtgggcctttactatctttcataaagctcagggggatcccgcttcccaccccggtcctcattacctgctgccccccatccacgaagtaatccattcacaccgcggagcaacggctaccttgccgtgtgtcctggggacaacgcctccttcttataaggtcagatggtcaaaagtagaacctggggaattaagggagacgcttatcctgattaccaacggactccacgcacgaggatacgggcctttggggggacgcgcgcgtatgagacgcggtcatcggctggacgccagtcttgttattgccggtgtacgactggaagatgagggtcgctaccgctgtgagctaattaatggcatcgaagatgaaagtgtggcccttacactttccttagagggagtagtatttccatatcagccatccaggggaagataccagttcaactattacgaagctaaacaagcatgtgaggagcaggatggcaggctggccacctactcccaactctatcagtag

SEQ ID NO: 9796 - DNA, 375 bp, Artificial Sequence
  Description of Artificial Sequence: Synthetic coding sequence
atgctgatgctgttcgtgttcggcgtgctgctgcacgaggtgagcttgtctggccagaatgaagcaccacccaacacccattccatcccaggcgaaccgctctacaactacgctagtattagactacccgaggaacatattcctttctttctccacaacaaccggcacatagcaacagtctgccgcaaggactcactctgtccctataagaagcacctggaaaagctgaagtattgttggggctacgaaaagtcgtgcaagcccgagtttagatttgggtaccccgtatgcagctacgtggatatgggctggacagacacgttggagagcgcagaagacatcttctggaaacaggctgatttcggctatgcctag

SEQ ID NO: 9797 - DNA, 5859 bp, Artificial Sequence
  Description of Artificial Sequence: Synthetic coding sequence
atgcccgccctgggccccgccctgctgcaggccctgtgggccggctgggtgctgacgctgcagcccttgccaccaactgcctttacccccaacgggacataccttcaacatctggccagggaccctacatccggaacactgtacctgggagccaccaacttcctgtttcagctgtcgcctgggcttcaactggaagctacagtgtcaacaggacctgtgctggattcccgggattgcctcccccctgtgatgcctgatgaatgcccccaggcccaacccaccaacaaccccaatcagctgttgctcgtcagtccgggcgcactcgtggtttgtggctcggtccatcagggtgtgtgtgagcagcgccggctgggccaacttgaacaactattgcttcggccagagcggccaggggacactcagtatgtagcagccaatgacccagcagtgtctacagtgggactggtcgctcagggattggctggtgagccactgctttttgtggggcgcggatatactagtaggggtgtcggaggcggaatccctcccattactacacgagccttgtggccgcccgatccccaagccgctttctcatatgaggagaccgccaaactcgcagttggccgacttagcgagtacagtcatcactttgtgtctgccttcgctcgaggtgccagcgcttactttctgtttctcaggagagacctccaagcccagagccgggctttccgggcttacgtgtcgcgcgtgtgcctacgggatcaacactattattcatatgtggaactgccgctcgcctgcgagggcggtcggtatggcctgattcaggccgccgcagttgccacatcacgcgaggtcgctcatggcgaagtgctttttgctgcttttagctccgccgctccaccaaccgtggggcgaccgcccagtgcagccgccggcgcctccggggcctcagctctgtgtgcattccctctggacgaggtggataggctggccaaccggactagggacgcgtgctatacccgagagggaagggctgaagatggtacagaggtggcctatatcgagtatgacgtgaacagcgactgtgcccagctccctgttgatactttagacgcttatccatgcggttcagatcataccccgagtcccatggcctcccgtgttcccctggaggcgacccctatccttgagtggcccggcatccagcttaccgccgtggctgtcaccatggaggatggccacaccatagcgttcctgggagactcccaaggacagttgcaccgtgtgtatctgggcccaggctctgacggccacccttatagcacccaatccatccagcagggaagcgctgtctctcgcgatttgaccttcgacggcacatttgagcacctttacgtcatgacccagtcgacgttgttgaaggtgcccgttgccagctgtgcacagcacctggattgtgcctcctgtcttgcgcaccgggatccctattgcggctggtgcgtcttattggggcgctgcagtaggcggtctgagtgctctcgagggcagggccccgagcagtggttgtggagctttcagcctgagctcggttgtctgcaggtcgcagcaatgtcacccgcaaatatctctagagaagagaccagggaagtgtttctgagtgtgccagacttgcctccgttatggccaggagaaagctattcgtgccattttggggagcaccagagtcccgcactgcttacgggtagcggggtgatgtgccctagccccgatccctcggaagctccagtcctgccacgcggagccgattacgtgtccgtctctgtcgaactccgtttcggtgctgtagtgatagctaagacatctctaagtttctatgattgtgtagccgttaccgagctgcggccatctgctcaatgtcaggcttgtgtgtctagtagatggggctgtaattggtgtgtctggcaacatctctgtacccacaaggccagctgtgatgccggccctatggtggccagtcaccagagccctttagttagcccagacccccctgccaggggtgatggggattccgcggagctagaaggacctcctgccccgctgatcctgccatcaagcctggactaccagtacgatactcccggcttatgggagctggaggaagctaccctcggtgcctcttcctgtccatgcgttgagtccgtccagggcagtacccttatgcccgtgcacgtggagagggaaatcagactcctggggcgaaatttacatctgttccaggacggaccaggcgacaatgaatgtgtaatggaactcgaaggcctggaggtggtcgttgaagccagggtggaatgcgagccgcctccggacacccagtgtcatgttacatgtcagcaacaccagctttcatacgaggctctgcagcctgaactgcgcgtcggattgtttttacggcgggcaggccgccttcgagttgattcagctgaggggttgcatgtggtgctatatgattgcagcgttggccatggggattgcagccggtgtcagacagccatgcctcagtacgggtgcgtttggtgtgagggtgaacgcccaaggtgtgttacccgggaggcatgtggtgaggccgaggctgttgccacacagtgtccggcacccttaattcactcggtggaacccctgaccggtccagtggatggaggtactagagttaccattagagggagcaatttaggacaacatgtccaggatgtcctgggcatggttacagtcgctggagtgccatgcgcggtggacgctcaggaatacgaagtttccagctcactggtttgcattacaggagcatcaggggaggaggtcgctggggccacagcggttgaggtccccgggagagggcggggtgtgagcgagcacgatttcgcttatcaggatccaaaggtgcattccatttttcccgctcggggcccgcgggccggtgggacacgcctcacgctcaatggtagtaaactgttaacagggagacttgaggatatccgggttgttgtgggcgatcaaccatgtcatctcctcccagaacagcagtctgagcagcttagatgtgagacatccccccggccgacacccgccactctcccagttgctgtctggttcggcgctaccgagcggcgactgcaaaggggccaatttaaatacactctagatcccaacatcacatccgccggccccacgaagtcattcctgtctggggggagggaaatctgtgtgagaggacaaaatctagacgtcgtgcagactcccagaatccgagtgaccgtagtcagccgcatgctgcagcccagtcagggcctcgggcggcgccgaagagtggtccccgagactgcctgcagcctgggaccctcatgcagctctcagcagtttgaggagccgtgtcacgtgaactcatctcaattgataacatgtagaactcctgctctaccaggtcttccggaagacccctgggtccgggtggaattcatcctcgacaacctcgtcttcgacttcgcaacgttaaatcctaccccatttagctacgaggctgacccgaccctccaaccacttaatccagaagatccgacgatgccttttcgacataaacccggcagcgtctttagtgttgaaggggagaaccttgacctcgcaatgagcaaggaggaagttgtcgccatgatcggagatgggccatgtgttgtgaaaaccctcacacgccatcacctgtactgcgaaccaccagttgagcagccgcttcctcggcatcacgcactgcgggaggctccagactcgctccccgagttcactgtacaaatgggaaacttgcggttctctctgggtcacgtgcagtatgacggtgaaagtcccggcgcctttcccgtggcggcacaggtgggacttggtgtgggcaccagccttctggctttaggcgtgattataattgtgctgatgtacagaagaaagtctaagcaggccctccgcgattataaaaaggtgcaaattcagcttgagaacctcgaatcgagtgtgagggatcgctgtaaaaaggagttcactgatttgatgaccgagatgaccgatctcacttcagacctgctgggttccggcatccccttcctcgattataaggtctatgcagagagaatcttctttccaggtcacagagagagccctctgcacagagaccttggagtgccagagtcccgccgccccaccgtcgaacaggggcttggtcagttgagcaatctgctgaactctaagttattcctgaccaaattcatccacacccttgagtcccagcgcactttcagtgcccgcgaccgagcctatgtcgcgtcccttcttactgtggcactacacggaaaactcgagtattttactgacatactacgtactctactttcggatctggttgcccaatacgtggcaaaaaaccccaaactgatgctacggcggactgagacagtggtagagaagctcctgacaaattggatgtctatctgcctgtacacgtttgtgcgcgactctgtgggggaacccctgtatatgcttttccgggggattaagcaccaggtcgacaaagggccggttgacagtgtgaccgggaaggctaagtacactctgaacgataatagactgttgcgtgaagacgttgaatacagaccactcaccctcaacgcattactggcagtgggtccaggcgctggagaggctcagggagtgcccgttaaagtgctggattgcgatacaataagtcaggcaaaagaaaagatgctggaccagttatacaaaggggtccctctgactcagaggcctgatcctagaactctcgacgtggaatggcggtccggagtggctgggcacctgattctgagtgatgaagatgtcacgtctgaggtccaagggctctggagaagactcaacacacttcaacactacaaggtgccggacggcgcgactgtggcactggtgccatgcctcacgaaacacgtcctgagggagaatcaggactatgtccccggagagaggacccccatgcttgaagatgttgatgagggcggaatccgaccatggcatctggttaagccttctgatgaacccgagcctccgcgtccccggcgcggctcactcagaggcggggaaagagagcgcgctaaggctatccccgagatttacctgacaaggctgttgagcatgaagggaaccttacaaaagttcgtcgacgacctttttcaagtgatcttaagcacctctagaccagtcccgctggctgtcaaatatttttttgatctgttggacgagcaggcacaacagcacgggatctccgatcaagataccatacacatctggaagacaaactcacttccactgagattttggatcaatattattaagaaccctcaattcgtctttgacgtacagacatccgataacatggacgcagtgttgttggtcatcgcccagactttcatggacgcctgtacacttgccgatcataagctgggccgcgattcgcccattaataaactcttgtatgcccgggacatcccaagatataaacgaatggtggagagatactacgccgatatccgacagacagtgcccgcttctgaccaggaaatgaacagcgtcctcgctgaattgtcctggaactactccggtgacctcggggcccgggttgctctgcacgagctgtataaatatatcaataagtactacgaccagattatcacagccctggaagaagacggcacggctcaaaagatgcagttaggctacagattgcaacagattgccgctgctgtagagaataaggtgactgatctatag

SEQ ID NO: 9798 - DNA, 612 bp, Artificial Sequence
  Description of Artificial Sequence: Synthetic coding sequence
atgcggaccgtggtgctgaccatgaaggccagcgtgatcgagatgttcttagtgttattggtgactggggtacactcaaataaggagactgcaaagaagattaagcgccctaagttcaccgtgccccagatcaactgtgacgtgaaggcaggcaagataattgaccccgagttcatcgttaaatgtcctgcaggctgccaggacccaaagtaccacgtctatgggacagacgtgtacgcttcatattctagcgtctgcggggcggccgtgcattccggagtgttagataactccgggggtaagatcctggttcgaaaggtggccgggcagtcgggatataaggggtcatattccaatggagtgcaatcactaagtctcccgagatggagagaaagcttcattgtcttggaaagcaagcctaagaagggcgtgacgtatccctcagctctgacgtattcctcctcgaagagtcccgctgcgcaggctggcaagtgtagccgggtcattgaatcaaagcccagcgagtccatgaatacgcgtagagtgttgggcgatagcggagagatcaatattctcacggggcaggcccctctggcactcgccattttctag

SEQ ID NO: 9799 - DNA, 2511 bp, Artificial Sequence
  Description of Artificial Sequence: Synthetic coding sequence
atggagacccaggagctgcggggcgccctggccctgctgctgctgtgtttctttacatctgcttctcaggaccttcaagtaattgatctgctgaccgtcggggagtcccgccagatggttgcagtggccgagaagattagaactgcccttctgaccgctggcgacatctacctcctctcaacttttaggctcccgcctaagcagggcggggtgctattcggtctttattcccgacaagataacacccgatggctggaagccagtgtagttggcaagatcaataaagtgactaacgcgctgcattctatattaggcgagcaaacaaaggctctggttacccagctgacactgttcaaccagatcctggttgaactgagggacgatatcagggatcaagtgaaagagatgagccttatccggaacacaattatggaatgccaagtctgtggctttcacgagcagagatcccattgttcaccaaacccatgttttcgcggggtcgactgcatggaggtatatgaatatccaggttaccgctgtggaccctgccctcctggtctccagggcaacgggacccactgcagtgacataaacgagtgtgctcacgctgatccttgttttccaggatctagctgcatcaataccatgcccggctttcattgcgaggcttgcccgaggggctataagggcacccaggtgtcgggagtcggcatcgactatgctagggcttcgaagcaggtttgtaatgacatcgacgagtgcaacgacgggaataacggcggctgcgatccaaattcgatttgtactaatacagtcggttctttcaagtgcgggccctgccgacttgggtttctgggaaatcaatcccaggggtgcctccctgctcgcacttgtcattctcctgctcattcaccctgtcatattcatgcgcattgcctcttcgagaggaacggcgccgtgtcttgccagtgtaatgtgggttgggctggcaacggcaatgtttgtggcacagacactgatattgacgggtatcccgaccaggctctgccatgcatggataacaacaaacattgtaaacaagacaactgcctgctgacccccaactccggtcaggaagatgctgacaacgacggggtgggggatcagtgcgatgacgatgccgatggagatggaataaaaaacgtcgaggacaactgtagacttttccccaacaaagatcagcaaaacagtgatacagactccttcggcgacgcctgcgacaactgtcctaatgtgccaaataacgatcagaaagatactgatgggaatggtgagggcgatgcgtgcgataacgacgtggatggggatggcattcctaatgggttagacaactgccccaaggtgcccaatccactgcagaccgatcgggatgaagacggggtgggagacgcttgtgactcctgcccagaaatgtctaatccaacccagaccgatgcggactcagacttggtgggagacgtctgcgacacgaacgaggacagcgacggggatggacaccaagatacgaaagacaattgcccccaattaccaaacagtagccagttagacagtgataacgatggcttaggcgacgagtgcgacggcgatgatgataacgacggcattcctgattatgttccccccgggcccgacaactgccggctagttccaaaccctaaccagaaggactctgatgggaacggagtcggcgatgtgtgtgaagatgatttcgacaacgatgccgtggtggacccattggatgtgtgtccagagtccgcagaggtgacactgaccgatttccgggcataccagaccgtggtgctcgatccggaaggcgatgcacaaattgatccgaattgggtggttctgaaccagggtatggaaatcgttcagaccatgaatagcgatcccggcctggcggtcggctacaccgccttcaacggcgttgatttcgagggcacattccatgtgaacaccgtgaccgatgatgactatgccggctttctgttctcataccaggacagtggccgtttctacgtagtgatgtggaaacaaactgagcagacttattggcaggccaccccattcagagcagtggcccagcctggcttgcagctgaaggccgttacgtccgtaagcggaccgggcgagcacctccgcaacgcactgtggcatacaggacacaccccggatcaggtgcgacttctgtggactgacccaaggaatgtgggctggagggacaaaaccagctacaggtggcagctgttacacaggccgcaggtgggctacatccgcgtcaagctctatgagggtccccagttagtagcggactctggagtgattattgatacctccatgagaggcgggcgcttgggtgtcttctgtttctctcaggagaatattatctggtcaaatctgcagtaccggtgtaatgatacagttcccgaggacttcgagcctttccggcggcagctcttgcagggtcgcgtctag

SEQ ID NO: 9800 - DNA, 1311 bp, Artificial Sequence
  Description of Artificial Sequence: Synthetic coding sequence
atgtggcggtgccccctgggcctgctgctgctgctgcccctggccggtcacttagcgttgggcgcacagcagggtcgcggacggagggagctggccccaggactccacctaagggggattcgtgacgccggaggcaggtattgccaagaacaggatctctgttgccggggacgggccgacgactgtgccctgccatacctcggcgcgatttgctactgtgatctgttctgcaacagaactgtgagtgactgttgccctgatttctgggacttttgcctgggcgtacctccccctttccctccaattcagggatgcatgcacggtgggcggatctaccctgtgctcggaacatactgggataactgtaatcgatgctggcaggccgggaaccactctgccttttggggaatgacattggacgagggtattagatatcgccttggcactattcgtccttcatcttccgttatgaatatgcacgagatctatactgtgttgaaccccggcgaggttttaccaacggcattcgaggcttcggaaaaatggcccaacttaatccacgagccactggaccagggtaactgtgctggcagttgggccttctcaactgccgcagtcgcctccgaccgtgtctccatccacagtcttgggcacatgacacctgtgctttcaccccagaacctgctctcctgtgacactcaccagcagcagggatgccggggaggacggctggatggcgcttggtggtttctgagaaggagaggcgtggtgtccgatcattgctaccccttctcaggacgcgagagggatgaggccggccccgcccccccatgcatgatgcattccagagccatgggccggggcaagcgacaggccactgctcactgtccaaactcgtacgtaaacaataatgatatataccaagtaaccccggtctaccgcctggggtctaacgacaaagaaatcatgaaagaattgatggaaaacggcccagttcaggctctgatggaagtccatgaggatttcttcctgtacaaagggggtatctacagtcacacacccgtttcattgggcagaccagagaggtaccggcgtcacggaacccattccgtcaaaatcacgggctggggcgaggagacactgccggatgggagaaccctgaaatattggacagcagcgaacagctggggccctgcctggggggagcgcggacatttccggatcgtccggggagtcaacgagtgcgatatcgagagcttcgttctcggcgtttggggtcgcgtcggaatggaggatatgggtcaccattag

SEQ ID NO: 9801 - DNA, 942 bp, Artificial Sequence
  Description of Artificial Sequence: Synthetic coding sequence
atgagcgacctgctgctgctgggcctgatcggcggcctgaccctgctgttgctgctcaccctcctcgcttttgcaggctacagcggcctgttggccggagttgaagtatcggcaggatcacctccgataaggaatgttacggtggcttataagtttcacatgggtttgtacggcgagaccgggcggctctttactgagagctgctcgattagcccaaaactgaggtccatagcggtgtattacgacaatccccacatggtccctccagacaaatgtcgttgtgccgtcgggtctattctaagtgagggagaagaatcccccagtcccgaactcatagacttgtatcagaaattcgggtttaaagtgttctccttccccgcccccagccacgtcgtcaccgcgacatttccttacaccaccatcctgtccatctggctcgctactaggagggtgcatccagcacttgatacctatattaaggagcggaaattatgcgcttatccccggctagaaatctaccaagaagatcagattcatttcatgtgtcctttagctagacagggggatttctacgtgccagagatgaaggaaaccgaatggaaatggcgcgggttagtcgaggccatagatacccaagtcgatggaaccggagccgataccatgagcgatacctcatctgtctcacttgaagttagcccaggtagccgggagactagcgcagcaacattatcaccgggggccagttcccgtggctgggacgatggagatacccgaagcgaacactcatattctgagagcggggcttctggtagcagcttcgaggaactcgatctggagggagaaggaccattgggtgagtcacgtttagaccctgggaccgaacctttgggaaccacgaagtggctgtgggaacccacagctccggagaaggggaaagaatag

SEQ ID NO: 9802 - DNA, 213 bp, Artificial Sequence
  Description of Artificial Sequence: Synthetic coding sequence
atggtggcccccgccgcccgggtgttcctgcgggccgtgcgggccgccttaacatccactgtgcctgatcttttatgcctcctggcccggggctcaccgcgcggcttggcttcgggacggctgcctcttgcagtccattccgctcagcacggccccggaagcggcgcaccatggttgaggatcgccaggagggccttaagtcagcggatctag

SEQ ID NO: 9803 - DNA, 642 bp, Artificial Sequence
  Description of Artificial Sequence: Synthetic coding sequence
atggcccagctgttcctgcccctgctggccgccctggtgctggcccaggccccggcagctctagcagacgtgcttgaaggggattcctctgaagatcgtgccttcagagtaaggatcgcaggggatgccccactgcaaggagtcctaggaggtgctcttacaatcccatgccatgtccactatctcaggcccccccctagtcgacgggccgtgctgggttcccctcgggtcaagtggacattcctttctcgcggcagggaggcagaagtgctggtggccaggggggtcagagtcaaggtgaacgaggcatatagatttcgagtcgcactccctgcatacccagcatccctcaccgatgtgtccttggcattaagcgaattgaggcctaacgactccggtatttataggtgcgaggttcagcacggtatcgacgattcctcagatgccgtggaagtgaaggttaagggtgttgtttttctgtaccgggaaggctccgcccggtatgctttctcctttagcggggcccaggaggcctgtgccaggatcggagcacacattgccactcctgaacagttgtacgcagcctatctggggggctacgagcagtgcgatgcgggctggctcagcgaccagaccgtgtag

SEQ ID NO: 9804 - DNA, 237 bp, Artificial Sequence
  Description of Artificial Sequence: Synthetic coding sequence
atgggcagcggcctgcccctggtgctgctgctgaccctgctgggctctagccatgggacaggtccaggcatgaccttgcagctgaagctaaaagaatcattccttacgaactcgtcctacgagagctcttttcttgaactcctggaaaagctttgtctacttttgcatcttccatccggcacaagcgtgacactacatcacgcccggagtcaacaccacgtcgtctgcaatacatag

SEQ ID NO: 9805 - DNA, 651 bp, Artificial Sequence
  Description of Artificial Sequence: Synthetic coding sequence
atgagcgacctgctgctgctgggcctgatcggcggcctgaccctgctattgttgctcaccctcctggcgtttgcaggctatagtggactcctagcaggtgtagaggtctctgctgggagtcccccaataagaaatgtcaccgttgcatacaagtttcacatgggtctctatggggagaccggccggctgtttacagagagctgcagcatcagccctaagctacggagtatcgcagtctattatgacaacccccacatggtcccaccggacaagtgtcggtgcgcagtgggtagcatactctcagagggcgaggaatcacctagccctgagcttatcgacctgtaccagaagttcggattcaaagtattttcattccccgctccttctcacgttgtgaccgctacgtttccatatactactattttgagtatttggcttgctacccgccgagtccatccagctctggatacttacattaaggaaaggaagctgtgcgcctacccacggctggaaatttaccaggaagaccagatacattttatgtgtcccctggctaggcaaggagatttctatgtgcctgagatgaaagaaaccgagtggaaatggaggggactggtcgaagctattgatacgcaggtcgatggtacctag

SEQ ID NO: 9806 - DNA, 453 bp, Artificial Sequence
  Description of Artificial Sequence: Synthetic coding sequence
atgcggttcatggccggccccgccggcagccagagcctgggccccctgtgctttcatagctcaccccaagctctgtacactgtactcttgattgttctggtgatgatgtctctagtgtttggcaaatttgttcctgtgaattgggagcctccgcagccccttccttttcccaaatacctgagatgctatagatgcctgctggaaacaaaggaacttggatgtcttttggggtccgatatctgcctgacacccgctggatcatcttgcattacactacataaaaagaattccagcggcagtgacgtcatggtgtctgattgtagatccaaagagcaaatgtccgattgttctaacacccgaacctcaccagtgtcaggcttctggatattttctcaatactgcttcttggatttttgcaatgatccacaaaatagaggcctctataccccctag

SEQ ID NO: 9807 - DNA, 171 bp, Artificial Sequence
  Description of Artificial Sequence: Synthetic coding sequence
atgaagaccggcctgttcttcctgtgcctgctgggcaccgccgccgcaatccctacaaatgccagactcctgtcagatcactcaaagcccactgccgagactgtggcccccgataacaccgccatcccctcactcagggcagaagcagaagagaacgagaaagagacatag

SEQ ID NO: 9808 - DNA, 2346 bp, Artificial Sequence
  Description of Artificial Sequence: Synthetic coding sequence
atggccgtggccgaggtgagccggacctgcctgctgaccgtgcgggtcttacaagcacaccgtctccctagcaaggacttggtgacgcctagcgactgctacgttaccctgtggttaccaacggcttgttctcatagactacaaacgcgcacagtgaaaaacagcagcagtccggtatggaatcagtctttccacttccgcatccatcggcagctgaagaatgtgatggaactcaaagtcttcgatcaggatttagtgactggtgacgatccagtcttaagcgtcttgtttgatgctggcactcttagggcaggggagtttaggagggagtcatttagtctctctccccagggggaaggacggcttgaagttgaattcaggctgcaaagcttggcggaccggggcgagtggctcgtgtcaaacggcgttcttgtcgctagagaactgagctgtctgcacgtccagctggaggagaccggcgaccagaaatctagcgagcatcgcgtgcagcttgtcgtgccaggcagctgcgaagggcctcaggaggcatcggtaggcactggcacattcagattccattgccccgcctgttgggagcaggagcttagcattcggctccaggacgccccggaggagcaactcaaggcaccactatccgccctgccttctggacaagttgtgagactggtgttccctacctcacaagaacctctgatgcgcgtcgaactcaaaaaggaggccggactgagagaactagcagttcgactcggttttggaccatgcgctgaagaacaggcattcctatctagacgcaagcaagtcgtggctgccgctctccggcaggcactccagctcgacggggatttacaggaggatgagattcccgtcgtggctatcatggcaacaggtgggggaattcgagcaatgaccagcctgtacggacagctggccgggctgaaggagctgggtctcctggattgcgtaagctacatcaccggcgcttctgggtccacctgggccctggctaatctttacgaggaccccgaatggagccagaaggacctcgcgggcccaactgagctgctcaagacgcaggtaaccaaaaataaattaggcgtactggcgccttcccagctgcaacgctacaggcaggagctggcagaacgggcccgcctgggttatcccagctgcttcaccaacctttgggccttgataaacgaggcactcctgcatgacgagcctcatgatcataagctcagcgaccagcgggaggcattgtcccacggtcagaaccccctcccaatatattgcgcactcaatactaagggacagagtctcactacgtttgaattcggagaatggtgtgagttttccccctacgaggtggggtttcccaagtacggagctttcataccttctgaattgtttggctcagagttttttatggggcaactgatgaaacgcctaccagagagtagaatatgctttctcgaaggcatttggagcaacttatatgcagctaatcttcaagattcactctactgggcctcagaaccgtcccagttttgggaccggtgggtgcgtaaccaggcaaacctcgacaaggagcaggtacctcttctgaagattgaagaacctccatcgaccgctgggcgtattgcagaattcttcaccgatctgttgacctggcgcccactggcgcaagccacacataactttctaagggggcttcactttcacaaggactactttcagcacccacacttcagcacctggaaggccaccaccttagatgggcttcctaatcagcttacaccttccgagccccacctgtgtcttttggatgttggatatcttattaacacctcatgtctcccattgcttcagcctacgagagacgtggacttgattctgagccttgactataatctgcatggtgcatttcaacagttgcaactgttgggccgcttttgtcaggagcagggtattccatttccacctatcagtcccagtccagaagagcaattacagcctagggaatgtcacaccttcagtgacccgacatgccctggcgcgcctgccgtcttgcatttcccgctagtcagcgatagctttcgggaatactcagcccccggagtccgcaggaccccggaggaggcagccgctggagaagtgaacctttcctcatccgatagcccttatcattacaccaaggtcacttactctcaagaagatgttgacaagttactgcaccttacccactacaacgtgtgcaacaatcaggaacagttattagaagccctgagacaggcagtccagcgccgccgacagagaaggccccactag

SEQ ID NO: 9809 - DNA, 219 bp, Artificial Sequence
  Description of Artificial Sequence: Synthetic coding sequence
atggccgccgccacccggggctgccggccctggggcagcctgctgggactccttgggctcgtctcagccgccgccgccgcctgggatcttgcatctctgcgttgtacgctgggggcattctgcgagtgcgacttccgtcctgacttgccggagggttctgaagagcttggtcctagggagcctcactgcctgtggccacttcctctgccactcaggtag

SEQ ID NO: 9810 - DNA, 243 bp, Artificial Sequence
  Description of Artificial Sequence: Synthetic coding sequence
atgaaggtgttcttcctgttcgccgtgctgttctgcctggtgcagaccaattccggggatgttcctccgggcattcgcaacacaatttgccacatgcaacaggggatctgccgcttattcttctgccactctggcgagaagaagcgcgatatatgttctgatccgtggaatcgatgttgtgtgagcaacaccgacgaagagggtaaagagaaacccgaaatggacggacgctccggaatctag

SEQ ID NO: 9811 - DNA, 861 bp, Artificial Sequence
  Description of Artificial Sequence: Synthetic coding sequence
atgggccccgaggccctgagcagcctgctgctgctgctgctggtggcctcaggcgatgctgacatgaagggacactttgacccagctaaatgtcggtacgcactgggtatgcaagatcgaacaattccagatagcgatatttctgcatcaagtagctggtctgactccactgcagccagacacagccgtctagaatcgtcagacggcgacggtgcatggtgccccgctggaagtgtttttccaaaggaagaagagtacttgcaagttgatctacaacgacttcatctggtggccctggtgggtactcagggcagacacgccggtgggctcggaaaggagttcagccgcagctatagactcagatatagtcgcgacgggcggcggtggatgggctggaaagacaggtggggacaggaggtaatatctgggaacgaagatcctgaaggcgtcgtgctgaaggatctggggcctccaatggtagctcgtctcgtgcgcttctaccccagagcggaccgcgtgatgtcggtgtgtctgcgagttgaactgtacggatgcttatggcgtgacggcctcttgagctatacagcccccgtgggacaaaccatgtacctgagtgaggctgtttatcttaacgatagcacttacgatggacacacggtgggcggactgcagtatggcgggctcggacaactggccgatggcgttgtgggcctggatgacttccgcaagagccaggagctacgcgtctggcccggctatgattacgtggggtggagtaaccacagtttttcgtcgggctatgtcgaaatggagtttgagttcgatcgtttgcgtgccttccaagccatgcaagtgcactag

SEQ ID NO: 9812 - DNA, 858 bp, Artificial Sequence
  Description of Artificial Sequence: Synthetic coding sequence
atgcggggccagggccggaaggagagcctgagcgacagccgggacttggatggtagctatgatcaacttacagggcatccacccggccccacgaaaaaggctcttaagcaacgcttcctgaaacttttgccatgttgtggcccacaagccctgcccagcgtcagtgaaatcggcagggtgttcaggtttttgggagacagtagcttgccaagtgctctggcggctcccgcctcactccgccctcaccggcccagactcctggatcctgacagtgtggacgacgagttcgagttaagtacagtttgccataggccagaggggctggaacaacttcaggaacagaccaagtttacacgtaaagaactgcaggttctgtacagggggtttaagaacgagtgtcctagtggcattgtaaatgaagagaattttaaacagatttacagccagttcttcccccagggagattccagcacctacgcaactttcctctttaatgcattcgatactaaccacgatggctccgtttcattcgaagattttgtcgcaggcctgtctgtgattttacgcgggaccgtcgacgacagactgaactgggcttttaatctgtacgacctgaacaaggacgggtgcataaccaaggaggagatgctcgacatcatgaagagcatttatgatatgatggggaagtatacgtaccccgctctgcgtgaagaggcgccacgggaacacgtagagtctttttttcagaagatggataggaacaaagatggggtggttacaattgaagaattcatcgagtcctgccagaaggacgagaacatcatgcgctcaatgcaacttttcgacaacgtgatttag

SEQ ID NO: 9813 - DNA, 1311 bp, Artificial Sequence
  Description of Artificial Sequence: Synthetic coding sequence
atgcagggcacccccggcggcggcacccggcccggccccagccccgttgaccggagaaccttgcttgtgttctctttcatcctcgcagccgctctcggccagatgaacttcaccggcgatcaggtgctaagggtgttagccaaagacgagaagcaactgagtctgctgggggacttggaaggactgaaacctcagaaggtggacttttggcgtgggccggcccgcccctctctccccgttgacatgagagtccccttcagtgagctgaaagacataaaggcttatcttgaaagccatggcttagcctacagcattatgatcaaagacattcaggtgttgctcgatgaagaacggcaggcaatggccaagagccgtaggctggagagaagtacaaacagtttcagttattcatcttatcatacactggaagaaatatattcctggatagataattttgtgatggaacactccgatattgtgtccaaaatacagatcggaaactcatttgagaaccagtccattctggtgcttaaattctctaccggcggttctaggcacccagcgatatggatcgacacaggaatccactcaagagaatggattacccacgcgacgggcatttggactgcaaataagatcgtttctgattacgggaaagaccgcgtgctcactgatatcttgaatgcgatggatatctttatcgagctagtgacaaatcccgatggctttgctttcacccacagcatgaacagactgtggcgaaaaaacaaatcaatccgtccaggcattttttgcattggcgtggatctcaaccggaactggaagagtggctttgggggaaacggatccaattccaatccctgttcagagacataccatgggccaagtcctcaatccgaacctgaggttgctgccattgtgaacttcataactgcacatggaaacttcaaagcgttgatttccattcatagttacagccaaatgctgatgtatccctacggtaggctattagaaccagtcagcaatcaacgcgagttgtacgacctggccaaggacgctgttgaagccctgtacaaggttcatggaattgagtacatttttgggagcatctctacaacattgtacgtggcaagcggcatcactgtggattgggcctatgattctgggataaaatacgcgttcagtttcgaattgagggatacaggacaatacgggtttctgcttcccgccacccagattattcccacggctcaagagacatggatggctctgagaacaatcatggagcacacccttaaccatccatattag

SEQ ID NO: 9814 - DNA, 1218 bp, Artificial Sequence
  Description of Artificial Sequence: Synthetic coding sequence
atggacaccatcttcctgtggagcctgctgctgctgttcttcggcagccaagcctctcgatgcagtgcccaaaagaatactgagtttgctgtagatttatatcaagaggtgagcctttcccataaggacaatatcatcttttccccgttgggaatcacacttgtacttgagatggtgcagctgggggctaaggggaaagcccaacagcagattcggcagaccctcaagcagcaagagacaagcgctggagaggagtttttcgtgctcaaaagtttctttagcgctatatcagaaaaaaagcaggaattcacgtttaacctcgctaacgctttatacttgcaggagggctttactgtgaaggagcagtatctccatggcaacaaggagttttttcagtctgctatcaaacttgttgactttcaagacgccaaagcttgcgccgagatgatctcaacctgggtcgaacgtaaaaccgatggaaagattaaggatatgttctcaggagaagagtttggacctttgaccaggttggttctcgttaatgctatctattttaagggggattggaagcagaaatttcggaaggaggatacccagctgattaacttcaccaaaaaaaacgggtctacagttaagatcccaatgatgaaagcgctgctgcgcacaaaatatggatatttctctgagtccagtctgaattatcaagtcctggaactcagttataagggagacgagttttccttgattattatattgcctgcggagggaatggacatcgaagaggtagagaagctcattaccgcgcagcagattctgaagtggttgtcggagatgcaagaagaagaagtggagatctcattgcctcggtttaaagtagaacagaaagtcgatttcaaggatgttttgtactccctgaacatcacagagatttttagcgggggttgcgatctctccggcatcacagactctagcgaagtctacgtgtcacaggtgactcagaaagtgttctttgaaattaatgaagacgggagtgaagcagctaccagcaccggaatccacatcccagttattatgtctctggcccaatcccaatttatagcaaaccaccctttcttgtttattatgaaacacaaccctacggagtcgatcctgtttatggggagagtgacaaacccggacactcaggagattaagggcagggaccttgatagtttgtag

SEQ ID NO: 9815 - DNA, 300 bp, Artificial Sequence
  Description of Artificial Sequence: Synthetic coding sequence
atgctggccctgctggtgctggtgaccgtggccctggccagcgcccatcacggcggagagcactttgagggagagaaggtattcagggtcaatgtggaagacgagaaccacattaatatcattcgagaactggcctcaactacccagatcgacttctggaagccggactcagtgacccagatcaagccccacagcaccgtagacttccgcgtgaaggccgaagacactgttactgtagagaatgtcttgaagcaaaacgagctgcagtacaaggttctcatcagcaacctgcggaactag

SEQ ID NO: 9816 - DNA, 471 bp, Artificial Sequence
  Description of Artificial Sequence: Synthetic coding sequence
atgctgctgctgctgctgctggcccccctgttcctgcggccccccggagctggaggcgcacagaccccaaatgcgacaagcgagggctgtcagattatccacccaccatgggagggcggcatcaggtatcgaggcttaaccagagaccaggtgaaggcaattaactttctgcccgtagattacgagattgaatacgtgtgccgaggggaaagggaagtagtggggcccaaggtgaggaaatgcctggccaatgggtcttggactgacatggacactccatctcgatgcgttaggatctgtagcaagagctatctgactctcgagaacggcaaagtgtttttaacaggtggtgatctgcctgctctcgatggagcgagagtcgactttcgatgcgaccctgattttcaccttgttggatctagcaggtccatctgtagccaggggcagtggagcactcctaaaccacattag

SEQ ID NO: 9817 - DNA, 249 bp, Artificial Sequence
  Description of Artificial Sequence: Synthetic coding sequence
atgggccgggtgttcctgaccggcgagaaggccaacagcatcctgaagagatacccccgggccaatgggttcttcgaggagataaggcaaggcaatattgagcgcgaatgtaaggaagagttctgtacttttgaagaggcacgtgaagcatttgaaaataatgaaaagaccgggctagtgctgctgcctcgcctcgagtgttcctgcgaacatgggtcactgcagcctcagctccctgtgcccaaatag

SEQ ID NO: 9818 - DNA, 372 bp, Artificial Sequence
  Description of Artificial Sequence: Synthetic coding sequence
atgcagggcacccccggcggcggcacccggcccggccccagccccgtcgataggcgtaccctgttagtcttctccttcattctggccgccgctttgggtcagatgaatttcaccggcgaccaggttttgagagtcctggccaaagatgagaagcagctgtcactgttgggggatttagaaggactgaagcctcaaaaggtggacttctggcggggtcctgccagacccagcctcccggtcgatatgcgtgtgccattttctgagctgaaggatataaaggcgtacctggaaagccacggactagcctacagtataatgattaaagatatccaggtactgcttgatgaggagaggcaagccatggccaagtag

SEQ ID NO: 9819 - DNA, 840 bp, Artificial Sequence
  Description of Artificial Sequence: Synthetic coding sequence
atgggccgggtgttcctgaccggcgagaaggccaacagcatcctgaaacgatatcccagggctaacggttttttcgaggagatccgccaggggaacatcgagcgagaatgcaaggaggaattttgtacgttcgaggaagcccgggaggccttcgagaataacgagaagactattactggggtgatcctattggctgtgggagtgtggggcaagctcacgctgggaacctatatcagcctgatagctgaaaatagcaccaatgctccctatgtgctgataggaacagggacaactatcgtggtgttcgggctgtttgggtgctttgctacttgccggggttctccatggatgttaaaactttacgctatgttcctaagcctggtcttcttagctgagctggtggctggtatttctggctttgtcttcagacatgagatcaaggacacattccttcgaacttacaccgacgctatgcagacatataacgggaatgacgaaagatcaagggcagtggatcacgtacagcggagcctctcctgctgcggtgttcagaattataccaactggagtacatcaccctacttcctcgaacacggcatccccccttcttgttgtatgaacgaaaccgattgtaatcctcaggacttgcacaacttgacagtggcagctacaaaggtcaaccagaagggatgttacgatttagttacatccttcatggagacaaacatggggatcattgccggcgttgccttcggaattgccttctcccagctgatcgggatgctgctagcgtgctgtctgtcacgtttcatcaccgcaaatcagtacgagatggtgtag

SEQ ID NO: 9820 - DNA, 564 bp, Artificial Sequence
  Description of Artificial Sequence: Synthetic coding sequence
atgtggtgcgccagccccgtggccgtggtggccttctgcgccggcttactggtgagtcaccctgttctgacccagggccaggaggccggcggtcggcctggagcggactgtgaagtctgtaaagagtttctaaacagattctataagtccttgatcgatcggggcgtcaacttttctctggacacaatcgagaaggagctcatcagcttctgtcttgacacaaaaggcaaagaaaatagactctgctactatctgggtgctaccaaagatgctgccaccaaaattctttcagaggtgacaagacccatgtcagtccatatgccagcaatgaaaatctgtgagaaactgaaaaagctggactcacaaatctgtgaactgaaatacgagaaaaccttggacttagcttccgtggacttacgcaagatgcgggtagccgagctgaagcagatccttcactcctggggagaggaatgtcgagcctgcgctgagaagacagactatgttaatttgatccaggagttagctccaaagtatgccgcaacacaccctaagaccgagctttag

SEQ ID NO: 9821 - DNA, 1311 bp, Artificial Sequence
  Description of Artificial Sequence: Synthetic coding sequence
atgcagggcacccccggcggcggcacccggcccggccccagccccgtggataggcggacgctcctagtgtttagttttatcctggccgccgcacttggacagatgaatttcactggggaccaagtcctaagagtcctcgccaaagacgaaaagcaactatcccttctgggggacctggagggcctgaagccacagaaagttgacttctggcgggggcctgccaggccctccctacctgtagatatgcgcgtacccttttccgagctgaaagatatcaaagcatacctggagtcacacgggctggcttattccattatgatcaaggacatccaggtcctattagacgaagagcggcaggctatggctaaaagcaggaggctggagagaagcactaattctttttcctatagctcctaccataccctggaggagatctactcatggatcgacaatttcgtgatggagcatagcgacatcgtatctaaaattcaaatcggcaatagttttgagaatcagagcatcctggtgctcaagttttctacgggagggagcaggcatccagccatttggatagataccggcatccactcgagagagtggattacgcatgctacgggaatctggaccgctaacaaaatcgtcagcgactacgggaaggatcgcgtgctgaccgatatactgaatgcaatggacatctttatcgaactcgtaacaaacccagacgggtttgccttcacccacagtatgaatcgtctttggagaaaaaataagtcaatccggcctggcattttctgtatcggcgtggatctcaatagaaattggaaaagcggctttggaggcaacggatctaactcaaacccttgtagtgagacctatcacggcccgtctccgcaatcagagcctgaggtggcagccattgtcaatttcattacagctcatggcaacttcaaggcacttatttctatacacagttacagtcaaatgctgatgtatccttacggacgcctgctggaacccgtgtctaaccagagagagctgtatgaccttgccaaagatgcagttgaggcactttacaaggtacacggaatcgaatacatttttgggtcgatctccaccacactttacgttgcgtcaggcatcaccgtagattgggcgtatgacagtggtatcaagtacgcatttagctttgagctcagagatacaggccagtatggcttcttattgccagccacccagatcattccaactgcacaggagacctggatggcattgaggacaattatggaacataccctcaatcatccatactag

SEQ ID NO: 9822 - DNA, 450 bp, Artificial Sequence
  Description of Artificial Sequence: Synthetic coding sequence
atgggccgggtgttcctgaccggcgagaaggccaacagcatcctgaaacgctacccccgggctaatggtttttttgaggaaatccgccaggggaatattgagagggaatgcaaagaagaattttgtaccttcgaggaagccagagaagcattcgagaataacgagaagacgaaagaattctggtctacttacactaaagcacagcagggcgaaagtaaccggggcagcgactggtttcagttctatctgacgtttccgctgatctttggactctttatcattttattagtgatttttctgatctggcgttgttttcttcggaacaagactcgccgccaaacggtgactgaggggcacatcccatttccacagcacttgaatattattaccccccctcctcctccagacgaagtgttcgacagcagcggactgagcccaggcttcctttag

SEQ ID NO: 9823 - DNA, 936 bp, Artificial Sequence
  Description of Artificial Sequence: Synthetic coding sequence
atgctgtaccagaccatcaacagcctgaagaccaagaaccccaagctgaaaatcctccttagcattggcgggtatttatttgggtctaagggcttccatcccatggtggattctagtacctcacgtctggaatttatcaatagtattatattatttctgcggaatcacaactttgacggactggacgtttcctggatttaccccgaccagaaggagaatacacattttacagtcctcatccatgagctagccgaggcttttcagaaggacttcacaaaaagcactaaggagcggctactcctcaccgccggtgtctccgcgggaagacagatgatagataatagttaccaagtcgagaaactggccaaggacctggacttcatcaacctgttaagctttgatttccacggtagttgggaaaaaccactgatcacggggcataattccccactcagcaaaggctggcaggaccgcggcccatcatcctattacaatgttgaatacgcggtggggtattggatccataaaggcatgcctagcgagaaagtggtcatgggcatacctacctacgggcatagcttcaccctcgcctctgccgagaccaccgtgggtgcccctgctagtggccctggcgccgcggggcctataaccgagtcttctggattcctggcatactacgaaatttgccagttcctgaagggtgcgaagataaccaggctccaggaccaacaggttccctatgccgtgaaggggaaccagtgggtggggtatgatgacgtaaagagcatggaaactaaggtacagtttttaaagaacctgaacctcggcggggctatgatctggagcatcgatatggatgactttaccggaaaaagctgcaaccagggtccgtacccgttggttcaagcggttaagagatcactgggctcactgtag

SEQ ID NO: 9824 - DNA, 621 bp, Artificial Sequence
  Description of Artificial Sequence: Synthetic coding sequence
atggacaccatcttcctgtggagcctgctgctgctgttcttcggctcccaggcctcacgctgctcagcacagaagaacactgagtttgctgtggacctgtatcaagaggtgtcattgagccacaaggataacatcatattctcaccattggggataacactggtccttgaaatggtacaactcggtgcaaaaggcaaagcccagcaacaaatccggcaaacactgaagcagcaagaaacatcagcaggggaagagttcttcgtactgaaaagcttctttagtgccattagcgaaaaaaaacaggaatttacgttcaacctggctaatgctctgtacctgcaggaaggatttactgtgaaggaacagtatctgcacggaaataaggaattcttccagagcgcaattaaactggtggactttcaggacgcaaaagcatgcgcagagatgatcagcacttgggtggagaggaaaactgacgggaaaattaaggacatgtttagcggggaggaattcgggcctctcactcggctggtgctggttaatgctatctattttaaaggcgactggaagcagaagtttagaaaggaagacacacagttgatcaactttactaagaagtag

SEQ ID NO: 9825 - DNA, 1218 bp, Artificial Sequence
  Description of Artificial Sequence: Synthetic coding sequence
atggacaccatcttcctgtggagcctgctgctgctgttcttcggctcccaagctagccgttgctcagcccaaaagaataccgaatttgcagtggacctttaccaggaagtatctttgtctcacaaagataatataattttcagcccccttggaatcaccctcgtgctggagatggtccagctgggggccaaggggaaggcccagcagcaaatacgccagaccctgaagcagcaggagacatcagccggcgaggagttttttgtgctgaagtcctttttcagtgccataagcgagaaaaagcaagagttcacatttaacctggcgaatgctttatacttacaagaggggtttactgttaaagagcaatacctgcacggcaacaaggagttttttcagagtgcaattaaattggttgatttccaggatgccaaagcgtgcgcagagatgatttcaacctgggtggaacggaagaccgatggtaagataaaggacatgttctcgggggaggaatttggtcctctaacacggctggttctcgtaaacgctatctatttcaaaggggattggaagcagaagttccgaaaggaagatacccagctgatcaattttacaaagaagaatggttccactgtcaaaattccaatgatgaaagcgctgctgcgaaccaagtacggctacttttcagaatccagcctgaattaccaggttttggagttgtcctataaaggagatgaattctcgctgatcattattctgcctgcagagggcatggacatcgaagaagtggagaagttgatcaccgcccagcagattctgaagtggttgtccgaaatgcaagaggaggaagtcgagatctctctaccacgattcaaggtggagcagaaggtggactttaaggatgtactgtactctctaaacattacagaaatattttccggaggctgcgacttaagcggcattaccgacagttccgaagtatatgtgagtcaggtgacccagaaagtgttctttgaaatcaatgaggacgggagcgaagccgccacttctaccggaatccacatcccagttatcatgagcctggcacaatcccagttcatagcaaaccatcctttcctgttcatcatgaaacacaatccgacagaatccatcctgtttatgggacgggtgaccaatcccgatactcaggaaattaagggcagagaccttgactcactctag

SEQ ID NO: 9826 - DNA, 399 bp, Artificial Sequence
  Description of Artificial Sequence: Synthetic coding sequence
atgctgatcttctggaccatcaccctgttcctgctgggcgccgccaagggcaaggaggtgtgttatgaggatttggggtgctttagcgataccgagccctggggggggactgctatcagacccctgaagatactgccgtggagcccagagaaaatcggcacaaggttcctgctgtatacgaatgaaaacccgaataacttccagatcctgctgttatccgacccttctactatcgaagcctccaattttcagatggacaggaaaacgcgcttcatcatccatggctttatagacaagggtgacgagtcatgggtgaccgacatgtgtaaaaagttgtttgaggtcgaagaagtaaactgtatctgtgtcgattggaaaaaggggagccaggctacgtag

SEQ ID NO: 9827 - DNA, 606 bp, Artificial Sequence
  Description of Artificial Sequence: Synthetic coding sequence
atgaaggtgcacatgctggtgggcgtgctggtgatggtgggcttcactgtgggtaaggtacctgtcccagatatccgaacctgtcacttctgcctcgtggaggacccttctgtggggtgcatttccgggagtgagaaatgcacaatctcttccagtagtttgtgcatggtgatcacaatctactatgacgtaaaggtgaggtttattgtccgcggctgcggacagtacatctcgtacaggtgccaggagaagagaaatacctacttcgccgaatactggtatcaagcccagtgttgccagtatgactattgcaacagctggtcttcaccccaattacaatcttctcttcctgaaccccacgaccggcctcttgctcttcctctctctgatagccaaattcagtggttttatcaggcactcaatctgtctctaccacttcccaacttccatgccggtacagaacctgatggtctagatccaatggtgacactgtcgcttaatctcggtttgtcttttgccgagctccgcaggatgtatctgtttctgaattcctccggtctgctagtactgcctcaggccgggctgctgacaccacacccctcttag

SEQ ID NO: 9828 - DNA, 1086 bp, Artificial Sequence
  Description of Artificial Sequence: Synthetic coding sequence
atggccagcctgggcctgctgctgctgctgctgctgaccgccctgccaccgctgtggagcagttcactgcccgggctagacacagccgagtctaaggcgacaatagccgacctgatcctcagcgctctggagcgcgcaaccgtgtttctggaacagcgcttaccagagattaatttagatggaatggttggcgtgcgcgtgttggaagaacagctcaaaagcgtgcgtgaaaaatgggctcaggagcccctgctgcagcctctctcactacgagttggcatgcttggcgagaaactggaagcggcaatacagaggagtctccattacctgaagttgagcgacccaaagtatcttagagaattccaactcaccctgcagcctgggttttggaagctgccccatgcatggattcataccgacgccagtttggtgtaccccacttttggaccccaagactcattctccgaagaacgatctgatgtttgtctggtgcaactgctggggacgggtaccgactctagtgaaccctgtggactatctgacctttgcaggtccttgatgacaaagccaggctgttctggatactgcctgtctcaccagcttttgttcttcttgtgggcaagaatgagaggatgtacccagggaccactgcaacaatcccaagactacattaacctgttctgtgctaatatgatggacctcaaccgccgagctgaggccattgggtacgcctaccctacccgggatatcttcatggagaacatcatgttttgtggcatgggtggatttagtgacttttataagcttcgctggctggaagccattctttcctggcagaagcagcaggaaggatgtttcggggagccggatgccgaagacgaggagttaagcaaggctatccagtatcagcagcattttagccggagggttaaacggagggagaagcagttccctgacgggtgctcctcacataataccgccactgctgttgctgcgctggggggcttcctgtacattctcgctgaatatccccctgccaaccgagaacctcatccctcaactccaccccccccctcctcacggtag

SEQ ID NO: 9829 - DNA, 162 bp, Artificial Sequence
  Description of Artificial Sequence: Synthetic coding sequence
atgtggaccaacttcttcaagctgcggctgttctgctgcctgctggcagtgctcatggtggtcgtcctagtaataaatgtcacccaggtcgaatacctggaccacgagacggtaagcgccacgttcattgatagttctggccaattcgtctcctcccaatag

SEQ ID NO: 9830 - DNA, 1305 bp, Artificial Sequence
  Description of Artificial Sequence: Synthetic coding sequence
atggccagcctgggcctgctgctgctgctgctgctgaccgccctgccccccctgtggtcctcgagccttcccggactggataccgctgaaagcaaagccacaattgcagatcttattctctccgcgctggaacgagctacggtgttcttggagcagcggctcccggagatcaatctggacggaatggtgggagtgagagtcctagaggagcagctgaagtccgttcgggagaagtgggctcaagagccgttgttacagcccctcagtctgagagtgggaatgctgggtgagaagctggaggccgccatccagcgctcactgcattacctgaagctgtcagacccaaaatacctccgggagttccaacttacccttcagccaggtttttggaaactgcctcacgcctggatccatacagatgcatcccttgtgtaccccacgtttggaccccaagattcattcagtgaagagcgcagtgacgtgtgcttggtgcaactcctcgggaccggcacagattcgtcagagccgtgcggcctttctgacctgtgtcgctcccttatgactaaacctggttgcagcgggtactgcctcagccaccagcttctatttttcctttgggctaggatgaggggctgcacccagggccctctgcagcaatcccaggactatattaacctgttttgtgccaacatgatggatctgaaccgaagagcagaagccatcgggtacgcctatcccactcgagatatttttatggagaactccgtgacgggccatcccgtcttctacttacccctgtgcgacagtttcctgccacctaaggctgcacccgtgacagaactgtacactgatggaccagttatgttctgcggtatgggcgggttttcagacttctataagctccgctggcttgaagcaattctatcatggcagaaacagcaagaagggtgtttcggagaacctgacgcggaagatgaggaactgagcaaggccatccagtaccaacagcacttttctaggcgcgtgaagagaagggagaaacagtttcctgattcgcgaagcgtcgcacaggccggcgtgcagtggcggaatctgggctccctgcaacccctgccacccggcttcaaacaattctcgtgcctgatactaccttcttcctgggattacagatctgtgcctccctatctcgccaacttctatatttttctagtggagactgggtttcatcacgttgctcacgcaggattggagctccttataagcagagacccccctacgtccgggtcacagtcagtgggtctctag

SEQ ID NO: 9831 - DNA, 1311 bp, Artificial Sequence
  Description of Artificial Sequence: Synthetic coding sequence
atgcagggcacccccggcggcggcacccggcccggccccagccccgtcgatcggcgtacattgcttgtcttctcttttatcctggccgccgcactggggcagatgaatttcacgggggaccaggtcttgcgcgttcttgctaaggatgagaagcaactgtctctgttgggcgatctcgaaggtctgaagcctcaaaaggtggacttctggagaggacccgctagaccaagtcttcccgtggatatgcgcgtcccctttagcgagctgaaagatatcaaggcctacctggaatctcacggtcttgcctattcaatcatgattaaggatatccaggtcttactggatgaagagagacaggccatggcgaagagccgccgcctggagcggtccacaaacagtttctcctatagttcctaccataccttggaggagatttactcttggatcgacaatttcgtgatggaacactcagatatcgtgagcaagattcaaataggcaactcctttgagaaccaaagcatcctcgtgctgaagttctccacaggggggtccagacatccggcgatctggattgacacaggtattcactcaagagagtggattacccacgcaaccggtatctggaccgcgaataagatcgtctccgactatggcaaagaccgggtgttgaccgatatattaaacgccatggatattttcatcgaactagtgaccaaccctgatggctttgcatttacacactctatgaaccgtctctggagaaaaaataagtctatacgccctggaattttctgcatcggtgtcgatctgaatagaaactggaaatcaggtttcggagggaatggcagcaattcaaatccctgctccgaaacctatcacggcccatctcctcagagcgagcctgaggtggccgctatcgttaactttataacggcacacggaaacttcaaagccctcatatcaattcatagctactctcagatgttgatgtacccctatggcagactcctggagcccgtgagtaaccagcgcgagctctacgatttggcaaaagacgccgtggaggctctgtataaagtgcatggaatcgaatatatcttcggaagcatctccacaaccctatacgttgcttctggaataaccgtggattgggcatatgatagcgggatcaagtacgccttctctttcgaactgcgggataccggccagtatggattccttctgcccgctactcagataatccctacagcacaggaaacctggatggccctgcgaactataatggaacacaccctgaaccatccatattag

SEQ ID NO: 9832 - DNA, 1218 bp, Artificial Sequence
  Description of Artificial Sequence: Synthetic coding sequence
atggacaccatcttcctgtggagcctgctgctgctgttcttcggcagtcaagcctcaaggtgcagcgcccagaagaataccgaatttgctgtggatctttatcaggaagtgtcactgagccataaggataacataattttttcacctttgggaataacattagtcctggagatggtgcagctgggcgccaagggtaaagcccagcagcagattagacagaccctcaagcagcaggaaacctcggcaggggaggagttctttgtcctaaagagttttttttccgccatcagcgaaaagaaacaggaattcacgtttaacttagccaatgctctttacctccaggaggggttcacggttaaagagcaatacctgcatggcaataaagagttcttccaatcagcaatcaagctggtcgactttcaggacgctaaggcatgtgccgaaatgatatccacgtgggtggagcgaaagaccgacggcaaaatcaaagacatgttctctggtgaagagttcggcccgctcaccagacttgtcctcgtcaacgctatttacttcaagggggattggaaacaaaagtttcgaaaggaagatacccagctcattaatttcactaagaaaaacgggtcaactgttaagattccaatgatgaaggccctcctgaggactaaatatgggtatttcagcgagagctcgcttaattaccaggtccttgagctttcctacaagggcgacgagttctcgctcataattattctgccagcagagggtatggacattgaagaagtagagaaacttatcaccgcacagcagattctaaaatggctatccgaaatgcaagaggaagaggtggaaatatccctgcccagattcaaagtagaacagaaggtcgactttaaggatgtgctgtactccctgaacatcaccgaaatctttagcggcgggtgtgatctgagcgggatcacagattcctctgaagtttacgtcagtcaagtaacccagaaagtattcttcgagatcaatgaggacgggagtgaagctgcaacgagtactggcatccatatccctgttattatgagcctcgctcagagccaattcattgcaaaccatccattcctgttcattatgaagcacaatccaactgagagcatcctttttatggggcgtgtgaccaaccctgatactcaagagatcaaggggcgggatcttgactccctgtag

SEQ ID NO: 9833 - DNA, 510 bp, Artificial Sequence
  Description of Artificial Sequence: Synthetic coding sequence
atgctgtaccagaccatcaacagcctgaagaccaagaaccccaagctcaaaattcttttaagcataggcggttacttattcggttcaaaaggtttccaccccatggtggattcttctacatcccggctggagtttattaactcgattatcctcttcctgagaaatcataacttcgatgggctggatgtctcttggatctacccagatcagaaggaaaatactcacttcacagtccttatacacgaattagcagaagctttccaaaaggatttcacaaagtcaaccaaggagaggctgctgcttaccgccggggtatcagccggaaggcagatgatcgataattcttatcaggtcgagaagctagcaaaggatctagattttatcaacctgctctcgttcgactttcacggatcatgggagaagcctctcatcaccggccataactccccactgtctaaggggtggcaggacagaggccctagtagttactacaatgtagaatacgcttag

SEQ ID NO: 9834 - DNA, 1209 bp, Artificial Sequence
  Description of Artificial Sequence: Synthetic coding sequence
atggccagcctgggcctgctgctgctgctgctgctgaccgccctgccccccctatggtcctcatcccttcccggtctggacacggccgagtctaaggccacgattgccgacttgatcctctcggcattggaacgggccaccgtgtttctggaacaaaggctgccagagataaacctagacggcatggtgggagtccgagtgttggaggaacagctgaaaagcgtccgggagaaatgggcacaggagcccttgctgcaaccactgagcttgagagtgggaatgctgggggagaagctcgaggccgccatccaacggtccctgcattatcttaaactcagcgacccgaaatacctgcgcgaatttcagctgaccctacagcccggtttctggaagctgccccacgcttggattcacacagatgcctcactggtatacccgaccttcgggccacaagattccttttcagaagaacggagtgacgtgtgcctggtacaactgctgggtacagggaccgattccagcgagccctgcggtctgtccgatctgtgtagatcactgatgactaaacccggctgttccggctactgcctgtcccatcagcttctgtttttcctgtgggccaggatgcgggggtgcacacaggggccgcttcaacagtcgcaggattatatcaacttgttctgcgcaaacatgatggacctcaacagaagagccgaggccatcggctatgcgtaccctaccagggacattttcatggagaacattatgttttgcggcatgggtgggttcagtgatttttataaacttaggtggctcgaggctattctgagttggcagaagcagcaggagggctgttttggggagccagacgcagaggatgaagaactgtctaaggctatccagtatcagcagcattttagccggagagtgaaaagaagggagaaacagttcccagattctcggtccgtcgctcaggccggcgtgcagtggcggaatttggggtcgctgcagccgctgccacccggctttaaacagtttagttgcttgattttacccagttcatgggactaccggtcagtgcccccttatcttgccaatttctacatcttcttggtagagacaggctttcatcacgtagcacatgcgggcctggaactccttatcagccgagaccctcccacaagcggcagccaaagcgttgggctctag

SEQ ID NO: 9835 - DNA, 1680 bp, Artificial Sequence
  Description of Artificial Sequence: Synthetic coding sequence
atgtggaccaacttcttcaagctgcggctgttctgctgcctgctggccgttctcatggtggttgtgctggttatcaatgtcacccaggtcgaatacctagatcacgaaaccgtgtcagctacttttatcgatagctccggccagttcgtctctagtcaggtcaccgggatcagccggaatccttactgcggatacgatcagcagacacttagctcccaggagcggatggaggaggattctcttttagcggcccttcacagacaggttcctgatgttgggcctgtgcctttcgtgaagagcaccgatccttcttcctcatattttgttattctgaattcggctgcatttttcaaagtcggctcccaactggaagtacttgtgcatgtgcaggacttccaacggaaaccaaagaagtatggaggcgactatcttcaggcacggatccactcactgaagctgcaggctggcgccgtgggcagagtcgtggattaccagaatgggttctataaagtgttctttacgctgctgtggcccgggaaggtgaaggttagtgtttcactggtgcacccatcagaaggaatccgcgtgttgcagcgtctgcaggaggataaacccgatagggtatactttaagagcctattcaggtctggcagaatctctgagaccacagaatgcaacgtgtgtctaccggggaatctgcctctctgtaatttcactgatttatacaccggcgagccatggttttgcttcaagcccaagaagctcccatgcagttctagaattactcatttcaaaggtggctacctcaagggtctgttgaccgctgctgaatccgctttcttccagtccggcgttaatatcaagatgcccgttaattccagcggacccgattgggttactgtcatcccgaggagaatcaaggaaaccaacagtttagaactgtcgcagggttcaggaacatttccttctggctactattataaagaccagtggcggcctagaaaattcaaaatgcggcaattcaacgaccctgataacataacagaatgcctccagcgcaaggtggttcatttgtttggagatagcacaatccgccaatggttcgaatacttaacaacattcgtccccgatcttgtggagtttaatttgggaagtccgaagaatgttggacccttcctggcagtcgaccagaagcacaacatattgctgaaatatagatgccacggaccacctattcggtttacaactgtgttctctaatgagctgcactacgtggctaatgaactgaacgggattgtgggtggcaaaaataccgtggtggctatagcagtttggtcacacttttccacttttcctttagaagtctatatcaggaggctgaggaacataagacgggctgtggtgagactcctcgataggtcacctaagaccgttgtcgtgattaggacggcaaacgcacaagaactggggcctgaagtgtcgttatttaactctgactggtacaactttcagttggatactattttaaggcgcatgttcagtggtgtcggggtgtaccttgtggacgcctgggagatgacgcttgcccattacctcccccacaagctgcatcccgacgaagttattgtgaaaaatcagctggacatgtttctgtcattcgtgtgcccactggagacatag

SEQ ID NO: 9836 - DNA, 402 bp, Artificial Sequence
  Description of Artificial Sequence: Synthetic coding sequence
atggccatggtgagcgccatgagctgggtgctgtacctgtggatctccgcttgtgcaatgcttctctgtcatggctctctgcagcacacatttcagcagcaccatctccatcgtcctgaagggggcacatgcgaggtcatagctgcccaccgctgttgcaacaaaaacaggattgaagaaagaagccagaccgtaaaatgctcttgccttcccggcaaagtggccggtacaaccagaaacagaccttcatgcgtcgacgcttccatcgtgataggcaagtggtggtgcgaaatggaaccgtgcctcgaaggtgaggagtgcaaaacactgcccgacaactccggctggatgtgcgcaaccggcaacaaaattaagaccactagaatccaccctaggacatag

SEQ ID NO: 9837 - DNA, 606 bp, Artificial Sequence
  Description of Artificial Sequence: Synthetic coding sequence
atgaaggtgcacatgctggtgggcgtgctggtgatggtgggcttcaccgttgggaaagttccagtgccggacatccgtacttgtcatttttgtctggtcgaggacccctcagtgggatgcatcagtgggagcgagaagtgcaccatctcaagctcctccctgtgcatggtgatcactatttactatgatgtgaaggtgcgcttcattgtgagagggtgcgggcagtatatttcctaccggtgtcaggagaaaaggaatacctactttgctgagtattggtaccaggcacaatgctgtcagtacgactactgtaacagctggtccagtcctcaactccaaagcagccttccggagcctcatgacaggccattggcgctaccgctgagcgattcgcagattcagtggttctaccaggccctgaatttgtccctgccgctccccaactttcacgctggtactgagcctgatggcttagaccccatggtgactttgtctctcaatctgggattaagttttgccgagctccgcaggatgtacctctttctcaacagcagtggactactagtgttgcctcaggctggattgttgaccccacacccatcctag

SEQ ID NO: 9838 - DNA, 606 bp, Artificial Sequence
  Description of Artificial Sequence: Synthetic coding sequence
atgaaggtgcacatgctggtgggcgtgctggtgatggtgggcttcacagtggggaaagtgccggtacctgatattagaacttgccacttctgtctggtagaagaccccagtgtggggtgcatctccgggagtgagaagtgcacgattagttcttcatccttgtgtatggtcatcaccatctactatgatgttaaggtacgatttattgttcggggctgtgggcagtacatcagctatcgctgtcaggaaaagagaaacacatacttcgctgaatactggtaccaggctcagtgctgtcaatacgactactgtaattcgtggagcagtccacagttacagtcctccctaccagagcctcatgacaggccgttagccctcccactgagcgatagccagattcagtggttttaccaggccctgaacttgagtcttcctctgcccaactttcacgcaggtaccgagccagacggcctggatcccatggtcacgctgagcctgaatctgggcctgagcttcgccgagttgcgacgcatgtacttgtttctgaactcctctggtctgctagtgctgccacaggccgggctgctgacaccgcatccttcctag

SEQ ID NO: 9839 - DNA, 732 bp, Artificial Sequence
  Description of Artificial Sequence: Synthetic coding sequence
atgggccccgaggccctgagcagcctgctgctgctgctgctggtggcaagcggagacgccgacatgaaaggtcacttcgaccccgccaagtgtcgttacgcattgggcatgcaggaccgtactatcccggattccgatatcagtgccagctcttcctggtcggactccaccgcagctcgtcattcccggcttgagtcctccgatggtgacggcgcatggtgtcccgctggctccgtgttccctaaggaggaggagtatctgcaggtcgacttacagcgcctgcacctggtggctttggttggtacacagggacgacacgccgggggactgggcaaagagttttctcggagctaccggttaagatactctcgggacggcagaagatggatgggatggaaggaccggtggggacaggaagtgatctcgggtaacgaagatcccgaaggtgttgtcctcaaggatctggggcccccaatggtggctagactcgtgaggttttaccccagggctgatcgggtgatgtcagtatgcttgagggtagagttatacggctgcctgtggagagactgctccatgggagtctgggcaagttggcagatggtgtggtggggttggatgacactgggtcgtgtaagatcttgtggctctggacaggcaatgaccatgtgggatggggctacaacagcttcacccgtcgcaatgtggcgatggtcactaagtctgacagggtag

SEQ ID NO: 9840 - DNA, 258 bp, Artificial Sequence
  Description of Artificial Sequence: Synthetic coding sequence
atgaagatccccgtgctgcccgccgtggtgctgctgagcctgctggtcctgcacagtgctcagggcgctacactcggagggccggaagaggaatccactatcgagaattacgcctcacggcctgaagccttcaaggccgatgaattcctgaactggcacgcactattcgagagcatcaagaggaaactgcctttcctcaactgggacgctttccccaagcttaaagggctccgatccgcaaccccagacgcacaatag

SEQ ID NO: 9841 - DNA, 348 bp, Artificial Sequence
  Description of Artificial Sequence: Synthetic coding sequence
atgggccgggtgttcctgaccggcgagaaggccaacagcatcctgaagaggtatcctagggctaatgggttcttcgaagagataagacaaggaaatattgagcgggagtgcaaagaggaattctgcactttcgaggaagctcgggaggcatttgagaataacgagaaaacaaaagagttctggagtacatataccaaagcccagcagggagagtctaaccgagggtccgactggtttcaattttacctgacctttcctctaatctttgggttgtttatcattttattggtgatttttctcatctggcgctgtttcttgcgaaataagactaggcgccagactgtgtag

SEQ ID NO: 9842 - DNA, 606 bp, Artificial Sequence
  Description of Artificial Sequence: Synthetic coding sequence
atgaaggtgcacatgctggtgggcgtgctggtgatggtgggcttcactgtcgggaaggtcccagtgccggatatccggacttgccatttctgtctggtggaggacccctctgtgggctgcatctccggttccgagaaatgtactataagtagctccagtctttgcatggtgattaccatctactatgacgtgaaagttcgattcatagtcagggggtgtgggcagtacatctcctataggtgccaggagaaacgcaatacttatttcgcggagtactggtaccaggctcagtgctgtcagtatgactattgcaatagttggagtagcccccagttgcagtctagcctccctgaaccccacgatagaccactcgccttgccactgtctgactcacagatccagtggttttaccaggcgctgaatctgagcctgcccctccccaatttccacgctggcaccgagcctgacggactggatcccatggtcaccttgtcgcttaatctcggtctaagtttcgcagaacttcgtaggatgtatctatttttgaatagttccggattgctcgttctgccacaggcaggcctgctcaccccacacccatcttag

SEQ ID NO: 9843 - DNA, 1311 bp, Artificial Sequence
  Description of Artificial Sequence: Synthetic coding sequence
atgcagggcacccccggcggcggcacccggcccggccccagccccgttgaccgaagaaccctccttgtgttcagctttattcttgcggccgcactgggccagatgaacttcaccggggaccaggttctgcgggttcttgccaaagacgagaagcagctttcgttactcggcgaccttgagggactgaaaccacagaaggtggatttctggcgaggaccggcacggcccagtctgccagtggacatgagggttccgttctctgaactcaaagatattaaagcctatctggaatctcacggtttagcgtattcaataatgatcaaagatatccaggtgctcctggacgaagaacgccaggctatggctaaatctcgacgactggagcgcagtacgaactccttctcatacagtagctaccatacattagaagagatctactcctggattgacaacttcgtgatggaacactcagatatcgtgagcaaaattcagattgggaacagcttcgagaaccagagcatattagtcctgaaattttcaactggcggttcccgccatccagccatctggatcgataccggtatccacagccgggaatggattactcacgccaccggaatctggaccgccaataaaattgtaagtgattatggcaaagatagagtcctcactgatatcctgaacgcgatggacatcttcattgagctggtcacaaatccagacggattcgcctttactcactctatgaaccgcctctggaggaagaacaagagcattagaccaggtattttttgcataggcgtcgatctgaataggaactggaagagcggctttggggggaatggctccaactctaatccatgttccgaaacttaccacggcccctcccctcagagtgagcccgaggttgccgcaatcgttaactttattaccgctcatggtaacttcaaggctctgatctctatccacagctactctcagatgctcatgtacccttacgggcgcctgctggaacctgtttcaaatcagcgagagctatacgacctcgcaaaagatgccgtcgaagccctctataaggtgcacggcattgaatatatattcggcagcatctccaccacactgtatgtggcctcaggcattaccgtagattgggcttacgattcaggcataaaatacgcattttcttttgaactgagggacaccggccagtatggatttctcctgccggccacccagataattcctacagctcaggagacatggatggcgttgcgaaccatcatggagcataccttaaatcatccatattag

SEQ ID NO: 9844 - DNA, 606 bp, Artificial Sequence
  Description of Artificial Sequence: Synthetic coding sequence
atgggcgccaccaccatggaccagaagagcctgtgggccggcgtggtcgtgctgctcttactgcaggggggcagcgcatacaagctggtgtgctattttacgaattggtcccaggatcgtcaggagcctggcaaattcacccctgagaatattgatcctttcttatgttcccacctgatatactccttcgcctccatagaaaacaataaagtcatcatcaaggacaagtccgaggtcatgctctatcaaactataaactctctgaagacgaaaaacccgaagctgaagatcctgctgtccataggcggatacctgtttggctccaaaggattccatccaatggtagacagctcaactagtaggttggaattcatcaacagcatcattctgttcctacgaaatcacaacttcgatggactggatgtttcctggatctatcccgaccagaaggagaacacccatttcaccgtgttaatacacgagcttgctgaagccttccagaaggattttactaagtctacaaaagagcggctgttactcaccgcaggggttagcgccgggaggcaaatgatagacaactcttatcaggtggagaagctagcctag

SEQ ID NO: 9845 - DNA, 75 bp, Artificial Sequence
  Description of Artificial Sequence: Synthetic coding sequence
atgctggtggacggccccagcgagcggcccgccctgtgcttcctgttgttagcggtcgccatgtcctttttctag

SEQ ID NO: 9846 - DNA, 252 bp, Artificial Sequence
  Description of Artificial Sequence: Synthetic coding sequence
atgcggccccggggcctgccccccctgctggtggtgctgctgggctgctgggcttcagtgagtgcacaaactgacgccaccccagctgtcaccaccgagggtctgaatagcacggaggcagccctcgcaacctttgggacgtttccatccacacgtccaccagggacccctcgggccccgggaccaagtagcggaccgcgaccaacgcccgttaccgacggctctcactcggtaacgcaagccggcgtgtag

SEQ ID NO: 9847 - DNA, 1254 bp, Artificial Sequence
  Description of Artificial Sequence: Synthetic coding sequence
atgctggccctgctggtgctggtgaccgtggccctggccagcgcccatcacggcggcgaacattttgaaggcgaaaaagtttttagggtgaatgtcgaggacgagaatcatatcaatatcattcgcgagctggcgtctaccacccagattgacttctggaagcccgacagcgttacccagatcaagccccatagtaccgttgatttccgtgtgaaggccgaggatacagtgaccgttgagaacgtgcttaagcagaacgagctgcagtacaaagttcttatatctaatctgaggaacgtggttgaggcccagtttgactcccgcgtgcgcgcaactggacactcttatgagaagtacaataagtgggagactatcgaggcctggacccagcaagttgccacagagaaccctgcactaatttcacgatccgtgatcggcacaactttcgaggggcgagctatctaccttctgaaagtgggtaaggctggacagaataagcccgccatcttcatggattgtggttttcacgcacgggaatggattagtccagccttctgccagtggtttgtgcgtgaggctgtcagaacgtatggcagggaaattcaagtgactgagttgctggacaagctggacttttacgtgttacctgtcctcaacatcgatggttacatctatacctggacaaagtccagattttggagaaagactagatcaacgcacacagggtcttcctgcattggaaccgatccgaataggaattttgatgccggctggtgtgagattggggcgagtagaaacccctgcgacgagacatactgcggacctgccgcagaatcagagaaagaaacaaaggccctggccgactttatcagaaacaagctgtcaagcattaaggcatacttgacaatccactcctattcacagatgatgatctacccatacagctacgcgtataaactgggtgagaacaatgctgaactgaatgctctcgctaaggccacagtcaaggagttagcttctctccatggaacaaaatacacctacggcccaggcgccaccacaatctaccccgccgctggtggttcggacgattgggcttatgaccaggggatccgctacagtttcaccttcgagcttcgcgatacagggaggtatggattcctccttcctgaatctcaaatccgggctacatgtgaagaaacctttttggcaatcaaatatgtcgccagctacgtgctagagcatctatattag

SEQ ID NO: 9848 - DNA, 1680 bp, Artificial Sequence
  Description of Artificial Sequence: Synthetic coding sequence
atgtggaccaacttcttcaagctgcggctgttctgctgcctgctggccgtcctgatggtagtcgtgctcgtgattaatgtgacccaggtggagtacctggatcatgagactgtctccgctaccttcatagactctagtggccaattcgtttcatcccaagtcaccggtattagtcgcaatccgtactgtggttacgaccagcagacacttagctctcaagagaggatggaagaagatagtttgctggccgctctgcatcgccaggtcccagatgtgggacctgtcccctttgtgaagtctacagacccctcatcaagctattttgtcattttaaatagcgccgcttttttcaaagtgggcagtcagctcgaagtgctggtccacgtccaggattttcagcgaaagcccaagaagtatggcggcgattacctccaagcaaggatccacagcctgaagctccaggctggggccgtggggagggtggtcgactaccaaaacgggttctataaagtgttctttaccctcctctggccaggaaaagtgaaggtttccgtgagcttagtacatcccagcgagggcatcagagtcctccaaaggctgcaagaagataagcccgaccgggtgtacttcaaaagtctgtttcgttccggtcggataagtgaaactactgaatgtaacgtgtgcctccccggtaatctccccctgtgcaattttaccgacctctatacaggggagccgtggttttgcttcaaacctaaaaagttaccgtgttcgtctagaatcacacatttcaaaggcggctacttgaagggcctactcactgcggccgagtccgccttctttcagtctggcgtgaatattaagatgcctgtgaacagttccggccccgactgggtgacagtaatcccacgtagaataaaggagaccaactccctggagctgtctcagggctccgggactttccctagcggatactattataaggaccaatggcggccgcggaagtttaaaatgcgtcaatttaatgacccagataatataacagagtgcttgcagagaaaggtcgttcaccttttcggcgactctacgattagacagtggttcgaatatttaactacatttgtgccggatctcgtggaattcaatctgggtagccccaaaaacgtgggcccattcctggcagtggaccagaaacacaacattctgctcaaatacagatgccacgggccacctattaggttcacaacagtattcagtaatgagctgcactacgtagccaatgagcttaatggcatagttggggggaaaaacacagtggtggccatagcagtgtggtctcatttctccactttcccactggaagtatacataaggcgactcagaaatataaggcgggcggtggttcgcctgctggaccgaagccctaaaacggtggtcgttattcgcacagcaaacgcccaagagctcggaccagaagtgagcttattcaactctgattggtacaattttcagctagacacgatcctccgccgaatgttctctggggtaggcgtttatctggttgatgcgtgggagatgacactggctcactatctcccacacaaactgcatcctgatgaggttatcgtgaaaaaccaactggatatgtttctctcatttgtgtgccctctagagacctag

SEQ ID NO: 9849 - DNA, 99 bp, Artificial Sequence
  Description of Artificial Sequence: Synthetic coding sequence
atgcagggcacccccggcggcggcacccggcccggccccagccccgtagaccgccggacactgctcgtgttcagcttcatcctggcggcagccctctag

SEQ ID NO: 9850 - DNA, 180 bp, Artificial Sequence
  Description of Artificial Sequence: Synthetic coding sequence
atgctggccctgctggtgctggtgaccgtggccctggccagcgcccaccacgggggcgagcactttgagggagagaaggtgttcagggtaaacgtggaagacgagaatcacatcaatattatccgcgaattggcctcgacaacccagatagacttttggaaacctgactccgtgacttag

SEQ ID NO: 9851 - DNA, 303 bp, Artificial Sequence
  Description of Artificial Sequence: Synthetic coding sequence
atgcggccccggggcctgccccccctgctggtggtgctgctgggctgctgggccagtgtctccgcccagaccgacgcaactccagctgttacgaccgagggattaaattctacggaggctgcactcgctacatttggcaccttccctagtacacgccccccggggacaccaagggcccctggaccttccagcgggccgcgccccaccccagtcacagacggtggatatcatgttcctgcccccggtgtgcattctgatccaacaagtcggggtcagcccagatgctgctccctgtgtctctag

SEQ ID NO: 9852 - DNA, 234 bp, Artificial Sequence
  Description of Artificial Sequence: Synthetic coding sequence
atgcggagcccccggatgcgggtgtgcgccaagagcgtgctgctgtcccactggctgttcctggcctatgttctgatggtttgctgtaaactgatgagtgcttcctctcagcacctgagaggccacgccggacaccaccagattaaacagggaacatgcgaggtggttgctgtgcatcgttgctgtaataagaaccggattgaggaacgttcacagactgtcaaatgcagttag

SEQ ID NO: 9853 - DNA, 12 bp, Artificial Sequence
  Description of Artificial Sequence: Synthetic coding sequence
atgtggacctag

SEQ ID NO: 9854 - DNA, 402 bp, Artificial Sequence
  Description of Artificial Sequence: Synthetic coding sequence
atggccatggtgagcgccatgagctgggtgctgtacctgtggatcagcgcttgtgccatgcttctgtgccacggatccctgcagcacactttccagcaacatcatctccatagacctgaagggggcacatgcgaggtcattgcagcccaccggtgttgcaacaagaaccgtatagaagagcggtcccagactgtcaagtgctcctgcctgccaggcaaagttgccggtaccactagaaatcgaccctcatgcgtggacgcatccatcgtaatcggtaagtggtggtgcgagatggagccgtgccttgagggagaagagtgcaaaacattgccggataactccggatggatgtgtgctacagggaacaaaattaagactactcggatccacccccgtacctag

SEQ ID NO: 9855 - DNA, 600 bp, Artificial Sequence
  Description of Artificial Sequence: Synthetic coding sequence
atgaccatgcggcacaactggacccccgacctgagccccctgtgggtgttactcctctgtgctcacgttgtcacgttgctggtgcgagccactcctgtgtcacagaccactacggccgcgacggctagtgtgaggtccaccaaggacccctgtcctagtcagcctcccgtgttccccgcggctaagcagtgcccggccctcgaagtcacctggcccgaggtggaagtgcccctgaacggcaccctgagcctaagctgcgtggcgtgctcacggttccccaatttttcaatcctctactggctgggtaacgggtcttttatcgagcacctgcctggcaggctgtgggagggatccacgagccgcgagcgagggagcaccggtacgcaactctgtaaagccctggttttggagcagctaactccagccctccattcaacaaatttctcctgcgtgctggtggatcccgaacaggtggtccagcggcatgtagtcctcgcccaattgtgggtgagatccccgcgccggggcctccaggaacaggaagaactttgtttccacatgtggggcggaaaagggggcctgtgccagtcatccctgtag

SEQ ID NO: 9856 - DNA, 1044 bp, Artificial Sequence
  Description of Artificial Sequence: Synthetic coding sequence
atgggcgtggtgcagtacggcgacaaccccgccacccacttcaacttaaagacccacacaaactcaagagacctgaaaacggctatcgagaagatcacccagcggggcggtctgagtaatgttggcagagcaatctcctttgtcactaaaaacttttttagcaaggctaacgggaatcggagcggggcccctaacgtggtcgtcgtgatggtagatggatggcccaccgataaggtggaggaagccagtagacttgctcgagaatcggggattaacatcttctttattactattgagggggcagcagaaaatgagaaacagtacgtcgtggaaccaaatttcgctaataaggccgtgtgcaggacaaacgggttctactccctgcatgtccagtcctggtttgggctgcataagacccttcagccactggtcaagagagtgtgcgataccgatcgcctggcctgttcaaagacctgtctgaacagtgcagatatcggcttcgtgatcgatgggtcgagttccgttggtacggggaacttccggacagttttgcagttcgtgacaaacctaacaaaagagttcgagatttccgatactgataccagaatcggagccgtgcaatacacgtacgaacagagactggagttcggcttcgacaaatacagcagtaaacccgacattcttaatgccatcaaacgggtggggtactggagcggaggaacatcaacaggcgctgcaataaactttgccctagagcagctgtttaagaaatctaagcccaacaagcgaaagctcatgattctcatcaccgacggccgctcatatgacgacgtcagaatcccagcaatggcagcgcacctcaagggcgtaattacctacgccattggggtggcgtgggccgcacaggaagagctagaggtgattgctactcatccagctcgtgatcatagtttctttgtcgatgaattcgataacttacaccagtatgttccgcgcatcatacagaacatctgcacagaatttaactcacaacccagaaattag

SEQ ID NO: 9857 - DNA, 27 bp, Artificial Sequence
  Description of Artificial Sequence: Synthetic coding sequence
atgcagggcacccccggcggcggctag

SEQ ID NO: 9858 - DNA, 369 bp, Artificial Sequence
  Description of Artificial Sequence: Synthetic coding sequence
atgctgtaccagaccatcaacagcctgaagaccaagaaccccaagctgaagattttgctcagcatcggaggttacctttttggctccaaaggttttcacccaatggtcgactcttcaacaagccgactcgagttcatcaactctatcattcttttcctgagaaatcataacttcgacggcctggatgtttcatggatttatcccgaccaaaaggagaacactcacttcaccgtactgattcatgaactagcagaagcatttcagaaagatttcaccaaatcaactaaagagcgcttgctgctaacagcaggcgtgagcgctggacgacagatgattgacaatagttatcaggtggagaagttggcctag

SEQ ID NO: 9859 - DNA, 309 bp, Artificial Sequence
  Description of Artificial Sequence: Synthetic coding sequence
atgcgggtgagcggcgtgctgcggctgctggccctgatcttcgccatagtgacaacctggatgttcattaggtcctacatgagcttcagtatgaaaacaatccgtctgccgcggtggctggcagcctccccaacaaaggaaatccaggtgaagaagtacaagtgcggcctgatcaagccatgtcccgcaaattactttgcttttaaaatttgctcgggcgccgcaaacgttgtcgggccgacaatgtgcttcgaggacagaatgatcatgagccctgttaagaataacgtagggcgcggactcaactag

SEQ ID NO: 9860 - DNA, 660 bp, Artificial Sequence
  Description of Artificial Sequence: Synthetic coding sequence
atgaagctgctgctgtgggcctgcatcgtgtgcgtggccttcgccagaaagaggaggttccctttcatcggcgaggacgataacgatgatgggcatcctctgcacccctcacttaatattccctacggcatacgtaatttgcctcccccactttactatcgcccagtgaacactgtgcccagttatcccgggaatacttacacggacacgggccttccaagttatccctggattctgacctccccaggattcccctatgtctaccacatacgaggctttcctctggccacacagttgaacgtccctccattgccccccagggggttcccctttgtgcctccatccaggtttttcagcgcggctgctgctcccgccgcacccccaattgcagctgaaccggcggccgctgccccacttacggctacccccgtggcggcggagcctgcggctggcgctcccgtcgctgctgaaccagcagctgaggctccagtgggtgctgagcccgcggctgaggcccccgtggctgcagagcccgccgccgaggcaccagtgggagtggagcctgcggcagaggagccttccccagccgagcctgcgacagcgaaaccggccgctccagaaccacaccccagtccttctctcgagcaagctaaccagtag

SEQ ID NO: 9861 - DNA, 1869 bp, Artificial Sequence
  Description of Artificial Sequence: Synthetic coding sequence
atgggcaagagcgagggccccgtgggcatggtggagagcgccggccgggccggccagaagagacctggctttctcgaggggggtttgctacttctacttctgcttgtcactgcagctctcgtggccctgggcgtcttgtatgccgatcgtcgtggcaagcagctgcccaggctggcaagtcggctatgctttctacaggaggaacgcacattcgtgaagcgcaagccaagaggaatcccagaagcgcaggaagttagcgaagtttgtaccactcccggctgcgtaattgcggccgcacgaattctccagaatatggaccccactaccgaaccatgtgatgacttctaccagtttgcctgcggaggatggctgcgtagacacgtcattccagaaacgaatagcaggtactccatattcgatgttctgcgtgatgagttagaggtgatccttaaggcggtgttggagaacagtacagctaaagccaccgtgccccaggaagagagacatgacgtcatcgcgctttatcaccggatgggcctggaggagctgcagagtcaatttggactgaagggttttaactggacactgttcatccagacggtgctgtccagtgtgaagattaaactgctgcctgacgaagaagtggtcgtgtacggaattccttatcttcagaacctggaaaacatcatcgatacatactcagcgagaacgattcagaactaccttgtgtggcggctcgtgctggatcgcatcggcagtctatctcaacgctttaaagacacaagagtgaactatagaaaagccctcttcgggactatggtggaggaagtaagatggagagaatgtgtcgggtacgttaactcaaacatggaaaacgcagtgggatccctatacgtgcgggaagcgtttcccggcgacagtaaaagcatggtgcgcgaactcattgataaggtgaggacagtgtttgtggagacgctcgacgagctagggtggatggatgaggaaagcaagaaaaaggcccaggagaaagcaatgtctatcagggagcaaattggtcaccccgactacatcttggaggagatgaatagacggctggacgaggagtactctaatctaaatttctccgaggatctttatttcgaaaactccctgcagaatcttaaggttggagcccagaggtccctgcgcaaattgagagaaaaagtggacccaaatctgtggataattggcgcggccgtggtgaatgccttttactctcctaaccggaatcagatagtcttcccagccggtatcctgcagccccccttcttttctaaagaacagcctcaggcgctgaactttggcggcatcggaatggtgatcggacatgagatcacccacgggttcgatgacaatgggcggaacttcgataagaacggcaatatgatggactggtggtcgaatttctcaacccagcacttcagggaacagtccgagtgtatgatttaccaatacgggaactatagctgggatctggcagatgaacagaatgttaacgggtttaatacattaggcgagaacatcgcagacaacggcggggtgagacaagcatataaggcttaccttaagtggatggccgaaggcggtaaagatcagcagttgccaggtctcgaccttacgcacgagcagttgttttttatcaactacgcccaggtgtggtgcgggtcttatagacctgaattcgccatccagagtataaagactgacgtgcactcgccgcttaaatacagagtgctggggtcattgcagaaccttgccgcctttgccgatacattccattgcgccaggggcacccccatgcatcccaaggagcgatgcagggtctggtag

SEQ ID NO: 9862 - DNA, 168 bp, Artificial Sequence
  Description of Artificial Sequence: Synthetic coding sequence
atgggccccgaggccctgagcagcctgctgctgctgctgctggtggcctcaggcgacgctgatatgaagggacatttcgatccggcaaagtgtcgatatgcactgggcatgcaagaccggacgattccagacagtgacatttcggcatcttcttcatggtctgattag

SEQ ID NO: 9863 - DNA, 156 bp, Artificial Sequence
  Description of Artificial Sequence: Synthetic coding sequence
atgggccccgaggccctgagcagcctgctgctgctgctgctggtggcaagcggtgacgcagatatgaaagggcattttgaccctgccaaatgtcggtatgcgctgggcatgcaggaccgcacaatccctgactccgacatctccgccagctcttag

SEQ ID NO: 9864 - DNA, 1620 bp, Artificial Sequence
  Description of Artificial Sequence: Synthetic coding sequence
atgagcgagccccaggagaagaagctgagcgagaacaccgacttccttgctccgggtgtgtctagcttcaccgactcaaatcaacaagagtctattactaaaagggaagagaaccaggaacagccacgcaactactcacaccaccagttgaacaggtcttccaaacattcccaggggctacgcgatcagggcaatcaggaacaggacccgaacattagtaacggcgaagaggaagaagagaaagaaccaggtgaggtggggacccacaatgacaaccaggaacgaaaaaccgagctgccacgcgagcacgctaactccaagcaggaagaagacaacacccaatccgacgacatcctggaggagagtgaccagcctacccaagtcagcaagatgcaggaggacgagttcgaccagggcaaccaggaacaggaggacaactctaatgccgaaatggaagaggagaacgcctccaacgtgaataaacatatccaagaaacagagtggcagtctcaggaagggaaaaccggcctcgaagcaataagcaaccataaagaaaccgaggaaaagaccgtatctgaagctcttctgatggagccaaccgatgacggaaatactaccccgaggaaccatggtgtcgatgacgacggtgacgatgatggcgatgatggggggacagacggtccaaggcactcggcctccgacgattacttcattccctcccaagcatttctggaagcggaacgcgctcagtcaatcgcataccatctaaaaatcgaggaacagcgggaaaaggtgcacgagaacgagaatatcggaaccacagaaccaggtgaacaccaggaagccaagaaagcagagaatagcagcaatgaggaagagaccagttctgaggggaacatgagggtccacgctgtggattcttgcatgtcatttcagtgtaaaagggggcatatctgcaaggccgatcagcagggtaagccccactgtgtgtgccaagatccagtgacctgccctcctactaagcctctggaccaagtgtgcgggaccgataaccagacatatgcgagtagctgtcaccttttcgccaccaaatgccgcctggaaggcacgaagaaggggcatcagctccaactcgactattttggcgcttgcaaaagcattccaacttgtacggattttgaggtcattcagtttcccctaaggatgcgcgattggctgaaaaatattctgatgcagctttatgaggccaattcagagcacgctggctatctgaatgagaaacaaaggaacaaagtaaagaaaatatacctggatgagaagcgacttctggccggggatcacccaattgatcttcttctcagagactttaagaaaaattatcacatgtacgtgtatccagtccactggcagtttagcgagctggaccaacaccctatggaccgagttctgacccattcagaactcgcaccactgcgggcctctctcgtgcctatggagcattgtattacccgtttttttgaagaatgcgatccaaataaagataaacatatcactttaaaagagtggggtcactgtttcggcataaaagaagaagacatcgacgaaaatctgctgttctag

SEQ ID NO: 9865 - DNA, 591 bp, Artificial Sequence
  Description of Artificial Sequence: Synthetic coding sequence
atgccccacctggccagcctgttcaccgccagcagccggtgctgcccccatccgttgcggcccgagggatcgggagcaatggggcctgaggccctctcatcgctgctgcttctgctactggtcgcctcaggtgatgcagatatgaagggccattttgaccctgccaaatgtaggtatgcgctgggaatgcaggatcgtacaatacccgactccgatatcagcgcgtcctcctcatggtccgattccaccgccgctcggcactctcgactggaaagcagtgatggtgatggagcctggtgtccagcgggcagcgtgttccccaaggaggaggagtaccttcaggtggacctgcagagactccatctggttgcactggtcggcactcagggcaggcacgcgggaggcctcggaaaagagtttagcagaagctaccgtctaagatactctcgggacggaagacggtggatgggctggaaggaccggtgggggcaggaggtgattagcggaaacgaagatccagagggagtggtccttaaagatcttggacctcccatggtcgcccggctggtgaggttctatccccgggcgtag

SEQ ID NO: 9866 - DNA, 162 bp, Artificial Sequence
  Description of Artificial Sequence: Synthetic coding sequence
atgctgccctgcctggccctgctgctgctgatggagctgagcgtgtgcaccgtggccggtgacggcggagaagaacagaccctcagcacagaagctgagacgtgggtcatagtagccctggaagtcctacttggcagagggagtgacgaagggagggggtag

SEQ ID NO: 9867 - DNA, 126 bp, Artificial Sequence
  Description of Artificial Sequence: Synthetic coding sequence
atgggccccgaggccctgagcagcctgctgctgctgctgctggtggcatctggcgacgcagatatgaaaggacatttcgaccctgccaagtgtcgatacgcgctgggcatgcaggaccgcacgtag

SEQ ID NO: 9868 - DNA, 222 bp, Artificial Sequence
  Description of Artificial Sequence: Synthetic coding sequence
atgggccccgaggccctgagcagcctgctgctgctgctgctggtggcctctggcgatgccgatatgaagggacattttgatcctgccaaatgccggtacgctttgggcatgcaagaccgcactattccagacagtgacatctccgcttcctcatcatggtccgatagtaccgctgcgcggcattcgcggcttgagtcctcagatggggatggcgcctggtag

SEQ ID NO: 9869 - DNA, 369 bp, Artificial Sequence
  Description of Artificial Sequence: Synthetic coding sequence
atgggccccgaggccctgagcagcctgctgctgctgctgctggtggcctccggggatgccgacatgaaggggcactttgatccagctaaatgtcgctatgcgctgggcatgcaagaccgcactatacctgacagcgatatcagtgcctcatcctcttggtcagattccacagcagcacggcactcacggctcgagtccagtgatggggacggcgcctggtgtcctgccgggtctgtgttcccaaaggaggaggaatatctgcaagtcgacctccagaggctccacttggtggccctggtaggaactcagggtaggcacgcaggaggcctggggaaggagttctcgaggagttaccgactgaggtactag

SEQ ID NO: 9870 - DNA, 483 bp, Artificial Sequence
  Description of Artificial Sequence: Synthetic coding sequence
atgggccccgaggccctgagcagcctgctgctgctgctgctggtggccagcggggacgctgatatgaagggtcatttcgaccctgccaagtgtcgctacgccttaggcatgcaagatcggacaattcccgattccgacatttccgcttcaagctcctggtccgatagcactgcagcacggcactctcgcctagaatcatcggatggcgatggggcgtggtgcccggctggctccgtcttccctaaagaggaagagtaccttcaagtggacttacaaaggctgcacctggtggccctagtgggaacacagggacggcacgccggtgggcttgggaaagagttttctcgtagttatagactgcggtattcacgggacggccgccgatggatggggtggaaggatagatggggacaagaggtgatatctggcaatgaagatcccgagggtgtggtcttgaaggacctgggacccccaatggtctag

SEQ ID NO: 9871 - DNA, 540 bp, Artificial Sequence
  Description of Artificial Sequence: Synthetic coding sequence
atgggcagcagcggcctgctgagcctgctggtgctgttcgtgctgttggctaatgtgcagggacctgggctgaccgattggctatttcctcgcaggtgccctaaaatccgcgaggagtgcgagttccaggagagagatgtgtgcacaaaagataggcagtgccaggacaacaagaagtgctgcgtgtttagttgcggaaaaaagtgcctcgaccttaagcaagacgtgtgcgagatgccaaaggagactggtccttgtttggcgtatttcctgcattggtggtatgataaaaaggataacacgtgctctatgttcgtctatggcggctgccaggggaataacaacaacttccagtcgaaggctaattgccttaacacctgtaagaataaacagccttgtccaaaaataaaagtggaatgcgaagtcgaggagatcgaccagtgtactaagcccagagactgcccagaaaatatgaagtgctgcccattcagcagggggaagaaatgcctagatttcaggaaagccagcctgagcacatag

SEQ ID NO: 9872 - DNA, 438 bp, Artificial Sequence
  Description of Artificial Sequence: Synthetic coding sequence
atgctgttccggaaccggttcctgctgctgctggccctggccgccctgctggccttcgtgagcctctcactgcagttcttccacctcattcctgtgtcaacgcctaagaacggaatgtcctctaagtctcgaaaacgcattatgccggatcccgtgaccgagccaccagtcacggaccccgtgtacgaggccctcctgtactgcaacattccaagcgttgccgagaggtccatggaaggtcatgcgccccatcacttcaaactggtcagcgtccacgtgttcattcgccacggagaccggtatccattgtatgtgataccaaagacaaagcgtcccgagatcgactgtactctggtcgcaaatagaaagccataccacccgaagttagaagcctttatctcacacatgagcaaaggttcaggcgcgtccttcgaatag

SEQ ID NO: 9873 - DNA, 399 bp, Artificial Sequence
  Description of Artificial Sequence: Synthetic coding sequence
atgggccccgaggccctgagcagcctgctgctgctgctgctggtggcttcaggtgatgccgacatgaaggggcatttcgaccctgccaaatgtagatatgccctaggcatgcaagatcggactataccagactcagacatcagtgcgtcttcatcttggtcagattctaccgcagcccggcactctcgcttagaatcctcagacggtgatggggcttggtgtccagccggctccgtcttccccaaggaagaagaatatctgcaagtggacctgcagcggcttcatctggtcgccctggtcggaacccagggccgccacgctggggggctcgggaaggagttcagccgtagctacaggctgcgctattcgagggatggtcgtcgctggatgggttggtag

SEQ ID NO: 9874 - DNA, 306 bp, Artificial Sequence
  Description of Artificial Sequence: Synthetic coding sequence
atgggccccgaggccctgagcagcctgctgctgctgctgctggtggctagcggcgatgctgatatgaagggccactttgatcccgccaagtgccgatacgcactaggaatgcaagaccggactattcccgactctgatatctccgcttcctcttcttggtccgatagcaccgccgcacgtcacagccggctcgaatcttccgacggcgatggcgcgtggtgccctgctggatccgtctttcctaaagaagaggagtatctgcaggttgacctccagcgactgcacttagtggcgttggtggggtag

SEQ ID NO: 9875 - DNA, 393 bp, Artificial Sequence
  Description of Artificial Sequence: Synthetic coding sequence
atgctggcccccctgttcctgtgctgcctgcggaacctgttccggaagctaatttcttttcagccccctcaactcgggcggaccaatatgcattattctaagctgcctagaacagccattgagacggaattcaagcagaacgttggtcccccgccaaaggaccttactgccgaggtatattttccgtcaatcaagtctcgtagtcacctccctgccgtgttctataaccagtattttaaacaccctaaatgcgttggcgagtatggacctaagaatggagctgaacgccagatcgaggagagaaaagtgctccccacaacaatgatgttcagcatgttggccgactgtgtactgaagtccacacccatcccgattttgggagtggccatgtag

SEQ ID NO: 9876 - DNA, 420 bp, Artificial Sequence
  Description of Artificial Sequence: Synthetic coding sequence
atgcccgccatcgccgtgctggccgccgccgccgccgcctggtgctttcttcaggttgagagcaggcatctcgatgcgctcgccggaggcgccggccccaaccatggcaattttctggacaatgaccagtggctcagcaccgtctcccaatatgacagggataaatactggaaccgtttcagggatgatgactatttccgcaattggaatccaaacaagccttttgatcaggccttggacccctcaaaagacccgtgtttgaaggtcaaatgtagcccgcataaggtgtgcgtgacgcaggattaccagaccgccctctgtgtgtcacgaaagcacctactgccaagacagaaaaagggcaatgtcgcccagaaacactgggttggaccctccaacctcgtgaagtgcaagccatgctag

SEQ ID NO: 9877 - DNA, 510 bp, Artificial Sequence
  Description of Artificial Sequence: Synthetic coding sequence
atgcggctgctgatcctgacctgcctggtggccgtggccctggcccgcccaaaattacccttacgatatcctgagcgcctgcagaacccctccgagtccagcgagcccatcccactggaaagccgagaggaatacatgaatggaatgaatcgccagagaaatattctcagagagaagcaaactgatgagattaaaaattgcgtcgtggcagagcccgagaaaatggaatccagtatttcatcttctagcgaggagcagttttgcagactcaatgagtacaatcagttacagctccaggccgcgcatgctcaggaacagatccggcgcatgaacgaaaatagccacgtgcaggtgccattccagcagctaaaccagttggcagcctatccatacgctgtctggtactaccctcagattatgcagtatgtgccttttcccccattttctgacatatcaaatccgaccgcacacgagaattacgagaaaaacaacgtcatgctgcaatggtag

SEQ ID NO: 9878 - DNA, 921 bp, Artificial Sequence
  Description of Artificial Sequence: Synthetic coding sequence
atgaagaaggacgagccccccctggacttccccgacaccctggagggctttgaatacgcttttaacgagaaggggcagctcaggcacattaaaactggcgaaccttttgtgttcaattacagggaggacctgcaccggtggaaccagaagcggtacgaagccctgggcgagatcatcactaaatatgtttatgagctcctggaaaaagactgcaacctgaagaaggtatcaattcctgagggttacggagttatagtcctgaacccaaacgagaattacatcgaggtcgagaagcccaagattcatgttcagagctcctcggactcgtctgatgagcccgcagaaaaacgagaaaggaaagataaggttagcaaggaaaccaagaaacgtagggatttctatgaaaagtacaggaacccccaacgggaaaaggagatgatgcagctctacataagagagaacggcagtcccgaggagcacgctatttacgtgtgggaccatttcattgcccaggctgccgccgagaacgttttttttgttgcacattcatacggaggtttggccttcgtggagctgatgatacagagagaagccgacgttaagaataaggtgaccgcagtggcccttacggatagtgtgcataacgtgtggcaccaggaggccgggaagacgatcagggaatggatgcgggaaaattgctgcaactgggtgtcttcctccgagcctctcgatacttccgtagagtccatgctgccagactgtccgagagtaagtgccgggaccgataggcacgaactgacgtcatggaagtctttcccatcaattttcaagttctttaccgaagcctcagaggcgaaaactagctctctgaaaccggccgttacgagaaggtcacatagaatcaagcacgaggagctttag

SEQ ID NO: 9879 - DNA, 2862 bp, Artificial Sequence
  Description of Artificial Sequence: Synthetic coding sequence
tgacagctgtgctggctgcccctgctggcccccctgctgctgctgaggcctcctggcgtgcagtcagctggcccgatcagagctttcgtggtcccccatagccacatggatgttggttgggtgtacaccgtccaggaatcaatgcgagcatatgcagctaacgtttatacgagcgtcgtggaggagctggcacgtgggcagcaaaggcgattcattgctgtggagcaggagtttttccggctgtggtgggatggcgttgcctctgatcaacagaaatatcaggtcagacagctgttagaggaaggccgcctggagttcgtaatcggtggccaagtgatgcacgatgaggctgtgacccatctcgatgaccaaatcctgcaactcacggaggggcacgggtttctctatgagacatttggtatccggccccaattcagttggcacgtggatccattcggcgcaagcgcaaccacccccaccctgttcgcgctagcaggctttaatgctcatctcggatctcgaattgattatgacttaaaagcagccatgcaagaggcacgaggtttgcagtttgtctggaggggatccccctctctgtctgaaagacaggaaatttttacacacatcatggatcaatacagttactgcaccccatcacatatcccattcagcaacagaagcggattttactggaatggggtcgccgtgttccctaagcctcctcaggacggcgtataccctaacatgtcagagcccgtgacccccgctaacatcaatctctatgccgaagcactagtggctaacgtgaagcaaagggccgcatggttccgcaccccacacgtgctgtggccatggggatgcgacaagcaattttttaatgccagcgtacagtttgctaatatggaccccctcctcgaccatatcaacagtcatgcggccgagttaggggtttcagtacagtatgcaacattgggcgattatttcagggccctgcatgctttaaacgtgacctggcgggtcagggatcaccatgactttttaccttattcaacagagcccttccaggcttggacagggttttacacatcgcgcagctctttgaaaggccttgccaggcgcgctagcgctctgctttacgccggcgagtctatgtttactagatacttgtggcctgctcctcgcggccatttggaccccacgtgggcactgcaacagctgcagcaacttaggtgggcagtgtcagaagtgcagcaccacgacgcaataaccggcaccgaatctcctaaggtgagggatatgtacgcaactcatttagcctctggaatgttgggcatgcgtaagctgatggcaagcatcgtgctggatgaactgcaaccgcaggccccaatggcggcctcgtctgatgccggcccagcaggacatttcgctagcgtgtataatcctttagcatggactgtgacaacaatcgtgacacttaccgtgggtttcccaggcgtccgggtaactgatgaggccgggcatcccgtgcctagtcagatacagaatagtacagagactccatctgcctacgacctgcttatcttgaccactattcctggcctgtcatataggcattataatattcggccaactgccggagcgcaggagggcactcaagagccagccgccactgtggcaagtacactgcagtttgggaggagactaagaagaagaacctcgcatgcgggcaggtacctcgtgcctgtggcgaatgactgttacatcgtgttgctggaccaggacactaacctcatgcactctatttgggagcgccagtccaacagaacagtgcgggttacacaagagttcttggaatatcacgttaacggcgacgtcaagcaaggacccatttctgacaattacttattcacccccggtaaagctgctgtgccagcttgggaggcggtagaaatggagatagtggctggccagctagtcactgaaattcgtcagtacttctacaggaatatgacagcacagaactacacctacgctattcgaagcaggctgactcatgtgccccagggccatgatggtgaacttctttgtcatcgcatagaacaggagtaccaagccggccctctggagctcaacagagaggctgtcctacggacgagcaccaacctcaattcccagcaagtaatctattccgataacaacgggtaccagatgcagcgcagaccttacgtgagctatgtgaataacagtattgcacggaactattacccaatggtgcagtccgcctttatggaggatggaaaatcccgcctggtgctgttgtccgagagggctcatgggatcagttcccagggcaacggccaggtagaggtgatgctacatcggcgcctgtggaacaactttgattgggacctcggctacaaccttacacttaatgatacctctgtggtacatccggttctatggctgctgctcgggtcctggtctctcacaacggcactgagacaacggtccgcactggcactgcagcaccggcctgtagtcctattcggggatctggccggcacagccccaaagctgcctggtcctcaacagcaggaagctgttactctaccccccaacctccacttacagatactgtctattcccggatggaggtattcctcaaatcacacagagcactcacaaaacctccggaaggggcacaggggagaggcacaggccgacctgcggcgcgttctgttgaggctgtatcacctttatgaagtgggggaggatcctgtgctgtcccaacccgtcacggtgaacctagaggtcaacttccccacaccaatacagaccatttctcagggtagcaaaccttag

SEQ ID NO: 9880 - DNA, 459 bp, Artificial Sequence
  Description of Artificial Sequence: Synthetic coding sequence
atgcggttcaagaccaccgccaaggacggcctgctgctgtggcggggagacagccccatgagaccaaattcagacttcatctccctgggcctccgcgacggagctctagtcttctcgtacaatctggggagcggtgtggcaagcatcatggtcaacggatcattcaacgacggtcgttggcatagagttaaagccgtgcgcgatggtcagtccggtaaaataaccgtggatgattacggggcaaggaccggcaagtctcccggtatgatgagacagcttaacatcaatggcgctctatacgtgggtgggatgaaggagattgccctgcatacaaatcggcagtatatgcgcggactggttggctgcatttcccattttacccttagcacagactatcatataagccttgtcgaggatgcagtcgatgggaagaacattaacacatgcggcgccaagtag

SEQ ID NO: 9881 - DNA, 1701 bp, Artificial Sequence
  Description of Artificial Sequence: Synthetic coding sequence
atggacttcctgctggccctggtgctggtgagcagcctgtacctgcaggcagccgcggaatttgacgggcgctggccacgccagatcgtctctagtattggactatgccgatatggcggcagaatcgattgctgctggggttgggcccggcagtcctggggacagtgtcagccagtgtgccagccaagatgcaagcacggggaatgcattggccccaacaagtgtaaatgccaccccggctacgcgggtaagacatgtaaccaggatgagcacatccccgccccactggatcagggaagtgagcagccacttttccaaccgctcgatcatcaagctaccagcctgccatcacgcgacttaaatgaatgtggcctgaagcccaggccttgtaaacaccgttgcatgaacacctacggatcttacaagtgctactgcttaaatggctatatgctgatgcctgatgggagctgttcttcagcactcacctgttcaatggctaactgccagtatgggtgtgatgttgttaaggggcagattagatgtcagtgcccttccccaggcctgcaactggctcctgacgggcgcacttgtgtagacgtcgacgaatgtgccaccggcagggcgagttgcccacgcttccggcaatgtgttaatacattcggctcctacatctgtaagtgccataagggttttgacttgatgtacataggcggtaagtaccaatgtcacgacatcgacgagtgcagtctgggccagtatcaatgttcaagcttcgcaaggtgctataacattagggggtcatacaaatgcaagtgcaaggaaggatatcagggggatggactcacctgtgtctacatcccaaaagtgatgatcgagccctcggggcccattcatgtgccaaaaggaaacggaacgattctgaagggcgatacagggaacaataattggatcccagacgtgggatccacctggtggccccctaagactccatacatacccccgataattaccaaccgccctacaagtaaacccaccaccaggcctacccccaagccaacccctattccgacgccgccaccacccccacctctgcctacagagttacgcacaccgctccctccgacaactcccgaacggcctaccactggcctgaccacaattgctcctgctgcctctactcctccaggaggaatcaccgtggacaaccgagtgcaaactgacccccagaagcctaggggggatgtgttcagcgttctggtccattcctgtaacttcgaccacggcctgtgcggatggatcagggagaaggataacgacctgcattgggaacccattcgagatccagccggcggacagtacctgaccgtgtcagcagctaaggcccccgggggcaaagctgcacgtctggtcctaccacttggtaggttaatgcattccggcgatttatgtctgtccttccgtcacaaggttacgggcttgcattcaggcaccctacaggtctttgtgcgcaaacacggcgcacacggtgctgccctgtggggccgaaatggaggccacggttggcgccaaactcagatcacgctccggggagccgatattaaaagcgtcgtctttaaaggagagaaacggaggggccatactggagagattggcttggacgacgtcagtttgaagaaagggcactgcagcgaggaaagatag

SEQ ID NO: 9882 - DNA, 213 bp, Artificial Sequence
  Description of Artificial Sequence: Synthetic coding sequence
atgggccccgaggccctgagcagcctgctgctgctgctgctggtggcatccggggacgccgatatgaagggtcactttgaccctgcgaaatgtagatatgccctcggcatgcaggaccggactatccctgattccgacataagtgcctcctcaagctggtctgactccaccgccgcccgccacagccgtctggagtcctctgatggcgactag

SEQ ID NO: 9883 - DNA, 237 bp, Artificial Sequence
  Description of Artificial Sequence: Synthetic coding sequence
atgggccccgaggccctgagcagcctgctgctgctgctgctggtggcatctggtgatgctgatatgaaaggccactttgaccccgcaaaatgccggtatgccttaggcatgcaggacagaacaatcccggatagtgatataagcgcttctagttcttggagcgacagtacagccgcccgacattcgagactcgaatcaagcgacggcgacggtgcatggtgtcccgctgggtcctag

SEQ ID NO: 9884 - DNA, 339 bp, Artificial Sequence
  Description of Artificial Sequence: Synthetic coding sequence
atgcggttcaagaccaccgccaaggacggcctgctgctgtggcggggcgattctcccatgcgcccaaacagtgatttcatatcccttggtctcagagatggagctttggtttttagctacaatctggggtccggggtcgccagcattatggtcaacggaagcttcaacgacgggcggtggcatcgggtcaaagccgtcagggacggacagtcgggaaaaatcacagtagacgattacggggctcggacaggcaagagccccggcatgatgcggcagctgaacataaatggggccctgtacgtgggcggaatgaaagaaattgcccttcataccaactag

SEQ ID NO: 9885 - DNA, 2685 bp, Artificial Sequence
  Description of Artificial Sequence: Synthetic coding sequence
atgagcctgccccggtgctgcccccaccccctgcggcccgagggctccggagcaatgggcccagaggcgctgtccagcctgttactgctgctgttggtggccagcggtgatgccgacatgaaaggccacttcgaccccgctaaatgccgctacgcgctgggaatgcaggaccgtacaatacctgatagcgacatctccgcttccagttcctggtctgactcaaccgccgctcggcacagtcgcctcgaatcctctgacggggacggtgcatggtgcccagcaggtagcgtcttccccaaggaagaggagtatttacaggtcgatttacagaggctccacctggtggctcttgtcggcacccaggggcggcatgccgggggcctgggtaaggagttctctcggtcttacaggctacgttacagtcgggacgggcgcagatggatggggtggaaggacagatggggccaagaggtcatctcagggaatgaagatcccgagggagtcgtgctaaaggacctcggcccacctatggttgctcgccttgtcagattctacccccgggctgatagagtgatgagtgtgtgcctgcgtgtcgagttatacgggtgcctgtggcgcgatgggctcctgagctacaccgcacccgtgggtcaaaccatgtatttatcagaggcggtatatttaaatgacagcacatatgatggccatacggtgggaggcctccagtatggtggattgggccagctggcggatggcgtcgttggattggacgacttccgcaagtcccaggagctgcgagtttggccgggatatgattatgtggggtggtctaatcattcattttccagcgggtacgtcgagatggagtttgaatttgataggctgcgagcatttcaggctatgcaggtgcattgcaataatatgcacaccctgggcgcacggttgcctgggggtgtcgaatgcaggtttaggcgcggacccgccatggcgtgggagggcgagcctatgcgacacaatctaggtggaaaccttggcgaccctcgggccagagccgtgtctgtgccactgggcgggcgtgtggcacggtttctgcaatgtaggtttttgttcgctgggccctggctgctcttttccgaaatcagctttatatccgatgtcgtgaacaactcaagtccagcactcggaggcactttccctccagctccatggtggccacctggtccacctcctactaacttctcctctctggagctggagcctcggggccagcagccagttgccaaggcggaaggatccccaactgccatcttgataggctgtttggtcgccattatcctcctgcttcttctaattattgcccttatgctgtggcggctccattggagaagactgctatccaaagccgagcgcagggtgctggaggaagagctaactgtacaccttagcgtgccaggagataccatcctgatcaataatagaccaggcccacgggaaccccccccttaccaggagccgcgcccaagggggaacccgcctcactccgccccctgcgtccccaatggctctgcctactccggtgactacatggagcctgagaaaccaggtgccccccttctgcctcctcctccccagaacagcgtcccacattatgctgaggcagacatcgttacactccagggagttacaggggggaacacttatgctgttcccgccctgccccccggagccgtgggggatggaccccccagagtcgattttccacggtccaggctgcggttcaaggagaagctcggggagggccagttcggggaggtccacctgtgcgaggtcgactcaccccaagatctggtgtcccttgactttcccctgaatgtgagaaagggacatcctctgttggtggctgtgaaaatcctgcgcccggatgcaaccaaaaacgctaggaacgatttcttgaaggaggtcaagatcatgtctaggctgaaggatcccaacatcatccgtcttctgggggtatgcgtgcaggacgatcccttgtgtatgataacagattacatggagaatggcgacctaaaccaattcctctcagcacatcagctggaggataaagccgctgaaggggccccaggcgacggccaggccgcgcaggggccaacaatttcctaccccatgttgcttcacgtcgccgcccaaattgctagtggaatgaggtaccttgccactctgaacttcgttcatagggatttggccacaagaaactgtcttgttggtgagaactttacaataaaaatagctgacttcggaatgtcccggaatttgtacgcgggagactactaccgagtccaagggagggctgtgttgcccatccggtggatggcatgggaatgcatcctgatgggaaaatttactacagcaagtgacgtctgggcatttggcgtaacactgtgggaggttctgatgctctgccgggcacagcccttcggacagctcactgacgagcaggtcatcgagaacgctggcgagtttttcagagaccaagggagacaggtttatctgtctcgcccacccgcctgcccacaaggcctgtacgaacttatgctaagatgctggtcccgagagtcggaacaacgtccaccgttttctcagctccaccgctttttggcagaggacgccttaaacaccgtgtag

SEQ ID NO: 9886 - DNA, 384 bp, Artificial Sequence
  Description of Artificial Sequence: Synthetic coding sequence
atgggccccgaggccctgagcagcctgctgctgctgctgctggtggccagcggggacgccgacatgaagggccatttcgacccggcaaagtgtcgttatgccctcggcatgcaagatcgtaccataccggattctgacatcagcgcttcttcaagctggtcggactccacagcagcaaggcatagcaggcttgaatccagcgatggcgacggcgcctggtgccccgcaggaagcgtgttccctaaggaggaagagtacttacaggtcgacctgcagagactgcatcttgtagccttggtcggaacccaggggagacacgccggggggctggggaaggagttcagcaggagctatcggctccgatatagcagggatggaaggtag

SEQ ID NO: 9887 - DNA, 1113 bp, Artificial Sequence
  Description of Artificial Sequence: Synthetic coding sequence
atgaagaaggacgagccccccctggacttccccgacaccctggagggctttgaatatgctttcaatgagaaagggcagcttagacatatcaaaactggagaacctttcgttttcaactatcgtgaggatctccaccggtggaatcagaagaggtatgaggccttgggggagataattactaagtatgtctacgagctgctggagaaagattgtaatctgaagaaggtgtctatcccagtagatgcaacagagtctgagccgaagagctttatattcatgtctgaggacgccctcaccaatccccagaagctcatggtgctcatccacgggagtggtgtcgtcagagctggtcagtgggccagaagactgattatcaacgaggaccttgattctggcactcaaatcccatttatcaaacgcgctgttgctgaaggatacggagtgattgtactgaacccaaatgagaactatattgaagtggaaaaaccaaaaattcatgtgcaaagctcatccgatagctctgacgaaccggccgagaagcgtgagagaaaggacaaagtctccaaggaaacaaaaaaaagaagggatttctatgaaaaataccggaatcctcagcgggagaaggaaatgatgcaactgtatattagggaaaacggatcccccgaagaacatgctatctacgtgtgggaccatttcatcgcccaggccgctgctgagaacgtgttcttcgtggcccattcatacgggggtctggcttttgtggagcttatgatccagagggaagccgatgtcaagaataaagtaacagcagtggcgcttactgactccgtccacaatgtttggcaccaagaggcgggaaagactatacgtgagtggatgcgagaaaactgttgcaactgggtcagcagcagcgagcctctcgacacaagcgtcgagtcaatgcttcccgactgtcctagagtgagcgctgggacagacagacacgaactgacttcctggaagtcattcccctctatctttaagttctttacagaggctagcgaggcaaaaacgtcctctctgaagcctgcagttaccaggcgctcccaccggattaaacatgaagagctgtag

SEQ ID NO: 9888 - DNA, 435 bp, Artificial Sequence
  Description of Artificial Sequence: Synthetic coding sequence
atgaagaccggcctgttcttcctgtgcctgctgggcaccgccgccgccatcccaacaaatgcacgcctgttaagcgaccactccaaacctactgccgaaacagtggctcctgataacactgcaatcccgtctctgcgtgcagaggccgaagaaaacgagaaagagactgccgtgtccacggaagacgatagccaccataaggccgagaagtcttcagtgctcaaatccaaggaggaatcccacgagcagagcgcagagcaaggcaaatcgtctagtcaggaactgggattgaaagaccaggaggactccgatgggcatctaagcgtgaacctggaatatgccccaacagaggggaccctggatattaaggaggacatgtcagaaccccaggaaaaaaagctgtccgagaataccgattttctagcacccggctag

SEQ ID NO: 9889 - DNA, 1341 bp, Artificial Sequence
  Description of Artificial Sequence: Synthetic coding sequence
ctgaccctgcacagcctgacctgctacgaggacctggtgaccttcctgcaacagtcaatacaccagttcgaggttgggccttacggctgtatcttgttgaccctgtctgccatactgagcaggtctactgaactgattaggcaggatttcgacgtaccaaccagccacttgatcggtgcacatggctattgtacacaggagctggtgaatctgctgctgacgggcaaggccgtatctaatgtttttaatgacgtggtggaattggacagtggtgatgggaacatcacactccttcgagggatagccgctcgctctgacattgggttcctatccctgtttgagcattacaacatgtgccaggtcgggtgctttcttaagacccctagatttcccatctgggtcgtatgtagtgagtcacatttcagtatactcttttccctgcagcctgggctattgcgagactggcgcaccgaacgtcttttcgacctttactactatgacggactcgctaaccagcaggaacagatccggctcactattgacacgacccagacaataagcgaggacacagataatgacttggtgccgcctctggaactatgtatccgcacaaatataggaagcgccctgggtttcaaataccctgtcggaaacaaccaaaccgccgtccaggacaacgtgaaagtctctcttgctttcgggctctccattgccaccctcgctcagagtgtggggcacataagcggagcccacctaaaccccgccgtaactttgggactgctgctgtcctgccagattagtatctttagggcgctcatgtatatcatcgcccagtgcgtgggcgccattgtagccactgctattctgagtgggataacttcatccctcacaggcaacagtctgggaaggaacgacttggccgatggagtgaactccggccagggcttgggtatcgaaatcatcggaacactgcagctagtgctgtgtgtcttggccactacagaccggaggaggcgcgatctgggagggtccgctccactcgccattgggctttcagtggctctcggccatctgctggccatcgattacaccggctgtggaataaaccctgccaggagctttggttcagccgtgattacccacaattttagtaatcattggattttctgggtggggcccttcatcggcggagccctggccgtcctgatttatgactttatactcgccccaaggagcagtgatctgaccgatcgagtcaaagtgtggactagcggccaagtcgaggagtacgacctagatgctgacgacatcaattcccgggttgaaatgaaacctaagtag

SEQ ID NO: 9890 - DNA, 81 bp, Artificial Sequence
  Description of Artificial Sequence: Synthetic coding sequence
atgaagctgctgctgtgggcctgcatcgtgtgcgtggccttcgccagaaaaaacgcgggactaggttttctgtggctctag

SEQ ID NO: 9891 - DNA, 348 bp, Artificial Sequence
  Description of Artificial Sequence: Synthetic coding sequence
atgggccccgaggccctgagcagcctgctgctgctgctgctggtggctagtggtgacgccgatatgaagggccactttgatccagctaaatgtcgatacgcgcttggaatgcaggaccgcaccatcccagattccgatatctcagcctcatcctcttggtctgactcaacagctgctaggcactcaaggctggagagttcagacggtgatggcgcatggtgcccagccgggagtgtatttcctaaagaagaggaatacctgcaggtggatctgcagcgactacatctagtggccctcgtcggcacccaaggccgccatgcaggaggcttgggtaaggagttcagctag

SEQ ID NO: 9892 - DNA, 165 bp, Artificial Sequence
  Description of Artificial Sequence: Synthetic coding sequence
atgtacatccccctggaccccgactacaacgccgactgccccaacgtgaccgccccagtgtgtgcctctaatggacacacgtttcagaatgaatgtttcttctgcgtcgagcagcgcgagttccactatagaataaaattcgagaaatatggtaagtgtgactag

SEQ ID NO: 9893 - DNA, 351 bp, Artificial Sequence
  Description of Artificial Sequence: Synthetic coding sequence
atggtgctgctgcactggtgcctgctgtggctgctgttccccctgagtagtcgcactcagaagctgcctactcgtgatgaggagctcttccagatgcagatccgggacaaggcatttttccacgatagcagcgtgatacctgacggcgcagagattagttcatacctgttcagagatactcctaaaaggtatttctttgtggtggaagaagacaacactccattgtccgtcaccgttactccatgcgatgctcctctagagtggaaattatctctgcaagagctgcctgaggacaggtccggcgaagggagcggagatttggaacccctggaacagcagaaacagcaatag

SEQ ID NO: 9894 - DNA, 432 bp, Artificial Sequence
  Description of Artificial Sequence: Synthetic coding sequence
atgggccccgaggccctgagcagcctgctgctgctgctgctggtggcttccggtgatgctgacatgaagggtcactttgaccctgccaagtgtcggtacgctctgggtatgcaggataggaccatccccgacagcgatataagtgcttcaagcagttggtcggacagtaccgccgctaggcactctagactggagtcttccgacggcgacggcgcctggtgtccggccggatcggtattccctaaggaggaagagtaccttcaggtagacctgcagagacttcaccttgtggccctagttgggacccagggacggcacgccggtggtctcggcaaggaattctcccggagctacaggttgcgatatagccgagatggccggcgctggatgggttggaaggaccgctggggtcaggaggtgataagcggttag

SEQ ID NO: 9895 - DNA, 747 bp, Artificial Sequence
  Description of Artificial Sequence: Synthetic coding sequence
atggagctgctgcaggtgaccatcctgttcctgctgcccagcatctgtagttccaactctactggcgttctggaggcggcaaacaactctttggtggtcaccaccaccaaaccgagtatcacaacaccaaacactgaaagcttgcagaagaacgtggtgacaccgacaacgggtactacgccgaaggggaccataacaaatgagcttctgaagatgagcctcatgtccaccgcaacttttctcacctcgaaggacgaaggcctcaaggccacaactaccgatgtgcgcaagaacgattccatcatctcaaatgtgaccgtgacctccgtcaccctgcccaatgcagtgtctacacttcagagcagcaagcccaaatcctctgttctgcagcctgacgcgtcacccagtaagactggaacgctaacttccattcccgtcacaatcccagagaacactagccagagccaggtgatcggcactgaaggcgggaagaacgcaagtaccagtgccacaagtcggtcctatagttccataatcctgcccgtcgtgatcgcgttgatcgtcattacactgtccgtatttgttttggtgggcctctaccggatgtgctggaaggctgaccccggcacaccagaaaacgggaatgatcaacctcagtcagacaaggagagcgtcaaattactcacagtgaaaaccatctctcacgagagcggcgagcactctgcacaagggaaaactaagaactag

SEQ ID NO: 9896 - DNA, 363 bp, Artificial Sequence
  Description of Artificial Sequence: Synthetic coding sequence
atgaagaccggcctgttcttcctgtgcctgctgggcaccgccgccgcgatcccaaccaatgcccgcctgctctctgaccatagcaagcctacggcggagacggttgcaccggacaacacggcaattccttctcttcgggccgaagccgaggaaaacgagaaggagaccgccgtcagtaccgaagatgacagtcaccacaaggctgagaagtctagtgttctgaagagcaaggaggaaagtcatgagcaatccgcagagcagggcaaaagtagcagtcaggaactggggctgaaagatcaagaagactccgacggccacctgtctgtcaatttggaatacgccccaacagaggggaccctgtag

SEQ ID NO: 9897 - DNA, 339 bp, Artificial Sequence
  Description of Artificial Sequence: Synthetic coding sequence
atgggccccgaggccctgagcagcctgctgctgctgctgctggtggcctcgggagatgctgacatgaaaggacatttcgatcccgccaagtgtagatatgcattaggaatgcaggacagaacgatccccgactctgatatctccgcctcatcaagctggagcgattctacggccgcccgccactcacggttggagagcagcgatggtgacggcgcatggtgccccgccggcagtgtcttcccgaaagaggaagaatatctgcaagtggatttgcaacgcctgcatctcgtcgcccttgtgggtacccagggccgccacgccggaggcctggggaaatag

SEQ ID NO: 9898 - DNA, 513 bp, Artificial Sequence
  Description of Artificial Sequence: Synthetic coding sequence
atgggccccgaggccctgagcagcctgctgctgctgctgctggtggctagcggtgatgcagatatgaagggacacttcgaccccgccaaatgtcggtacgcactcgggatgcaggatcgcaccataccagattcagacattagcgcctcctcgtcttggtctgactctacagcagccaggcacagccgcctggagtccagtgacggtgacggcgcatggtgccctgccggtagtgtatttccaaaggaggaagagtatctccaagtggatctgcaacgattgcacttagtcgctctggtgggcacccaggggagacacgcaggcggactggggaaggaatttagcagatcatatcgtttacggtactcacgggacggcaggcgatggatgggctggaaggataggtggggccaggaggtcatcagcggaaacgaagaccccgagggggtggtgctgaaggatctgggaccccctatggtagcgaggttagttcggttctatccccgcgcttag

SEQ ID NO: 9899 - DNA, 417 bp, Artificial Sequence
  Description of Artificial Sequence: Synthetic coding sequence
atgggccccgaggccctgagcagcctgctgctgctgctgctggtggcctcaggcgacgcggacatgaaaggccacttcgatcccgcgaaatgtagatatgctctcggcatgcaagacagaaccattcccgactctgatatatccgcctcatccagttggagcgactccactgcggcgaggcacagccgtcttgagagcagcgatggggacggagcctggtgtcctgccggatccgtattcccaaaggaggaggagtacttgcaggtggatctgcaaaggctccatctggtcgccctggttggtacccaaggtcggcacgccggcggcttaggaaaggaattttcgagaagctaccgactccggtactccagggacgggcgtcgctggatgggttggaaggacaggtggggccaatag

SEQ ID NO: 9900 - DNA, 285 bp, Artificial Sequence
  Description of Artificial Sequence: Synthetic coding sequence
atggccgccttcccccacaagatcatcttcttcctggtgtgcagcaccctcacacacgtcgccttctccgggatctttaacaagcgggacttcactcggtggccaaagcctaggtgcaaaatgtatatcccacttgacccagattacaacgcagattgtccaaatgtcactgcgcccgtgtgtgccagcaacggccacactttccaaaacgaatgttttttttgtgtagaacagcgtgaattccattataggatcaagttcgagaaatacgggaaatgtgattag

SEQ ID NO: 9901 - DNA, 156 bp, Artificial Sequence
  Description of Artificial Sequence: Synthetic coding sequence
atgggccccgaggccctgagcagcctgctgctgctgctgctggtggcttctggagatgccgatatgaagggtcatttcgatcctgctaagtgcagatatgcattgggaatgcaggaccgtacgataccagactctgatatcagcgcttctagttag

SEQ ID NO: 9902 - DNA, 2760 bp, Artificial Sequence
  Description of Artificial Sequence: Synthetic coding sequence
atgggccccgaggccctgagcagcctgctgctgctgctgctggtggcctcaggagacgcagacatgaagggacactttgatccagctaaatgtcgctacgccctaggcatgcaggaccggactatcccagacagcgatatatccgcttcctctagctggtcagatagtaccgctgccagacatagcaggctcgaaagttccgatggcgacggcgcctggtgtcccgccggatcagtgttcccaaaggaggaggaataccttcaggtcgatctgcaacgtcttcacctcgtcgcccttgtcggaacccaggggaggcacgccggcggcctgggcaaggagttcagcagatcctacagactgcgctacagtagagatggcaggaggtggatgggctggaaggacaggtgggggcaagaggtcatatctggaaatgaggatcctgaaggtgtagtcctgaaggacctggggccacccatggttgctcgcttagttagattttatccacgcgctgatagagtcatgagtgtgtgcctccgagttgaactttatggctgcctgtggcgtgacggtcttctttcctacaccgcgcctgtggggcagactatgtatctgtcagaggccgtttatctgaacgactctacctacgacggccatacagtgggcggcctgcagtacggaggtctgggccagttagccgacggggttgtgggactggacgactttaggaaatcccaggagctcagggtttggcctggctatgactatgtgggatggagcaaccactcctttagctcagggtacgttgagatggaattcgaattcgaccgactgcgcgcattccaggccatgcaggtacactgtaataatatgcatactctgggggcgcgtcttccgggcggtgtcgaatgtcgcttcaggcgcggccctgctatggcttgggagggggagcccatgagacataacctgggcggtaacttaggagatccgagagcccgtgctgtgtccgtacctcttgggggccgcgttgccaggttcttacaatgtcggttccttttcgctggaccatggctgctctttagtgagatctcgtttatctccgatgtggttaacaactcatcacccgctctgggcggtaccttccccccagctccctggtggccacctggtccaccccctaccaatttttcatccctcgaactagaacccagaggtcagcagcccgttgccaaggctgaaggatccccaacagctattctcatcgggtgccttgtcgccattatattgttactcctccttatcattgcccttatgctatggcggcttcactggcgacgcctgctttccaaagcagagcgcagggtactcgaggaagaacttacggtccatctgtcggttcctggagacacaattcttataaacaaccgccctgggcctcgggagccccctccatatcaagaaccccggccccgcgggaatccaccacatagcgccccttgtgtgccgaatgggtcagctctgcttctctctaatccagcataccggctgttgctcgccacatatgctagacctcccaggggacccggccccccaacgccggcttgggccaaacccacgaatactcaggcctatagtggggattatatggagccagagaaacctggcgccccactcctacctcccccaccacagaactcagtgccacactatgcggaggccgacattgtgactcttcaaggggtcacaggaggcaatacctacgcagtgccggccctgcctccaggagcagtaggcgatggccctccccgggtggatttccccaggtctagactaagattcaaagagaagctgggagaagggcagttcggggaggtacacctctgtgaggtggatagccctcaggatctggtgtcactggacttcccactcaatgttcgaaaggggcaccccctcctggttgctgtgaagatcctgaggcccgatgccactaagaatgcttcattcagcctatttagccggaacgacttcctgaaggaggttaaaattatgtctcggctgaaagatccaaacataatcaggctgttaggggtgtgcgttcaagacgaccccttatgcatgattacagattatatggaaaacggggatctaaaccaattcctcagtgcccaccaactcgaagataaggctgccgaaggcgccccaggcgacggacaagctgcacaggggcctaccatctcttatcccatgcttctccacgtcgcagcccagatagctagtggcatgaggtatctcgccaccctgaactttgttcacagagatctggcaacacggaactgcctggtaggcgaaaacttcacgattaaaatagctgacttcgggatgagccggaacttgtacgcaggcgattactatcgggtccaagggcgcgccgtcttgcctattagatggatggcctgggagtgtatactcatgggaaaattcacaaccgcaagtgacgtatgggccttcggggtaactctgtgggaggtcctgatgctgtgtagggcacaaccgttcggacagctgacggatgaacaagtgatagagaacgcgggcgagttcttccgcgatcaggggagacaagtataccttagcaggcccccagcatgtcctcagggtctgtacgagctcatgcttcggtgttggagccgggagtccgagcagcggccaccatttagtcagctccataggttcttggccgaagacgcactgaacactgtttag

SEQ ID NO: 9903 - DNA, 318 bp, Artificial Sequence
  Description of Artificial Sequence: Synthetic coding sequence
atgggcgtgagcaagctggacatcctgtaccggcggctgctgctgactaaactcttcatccgaggttggggccggcctgaggacttgaaaaggttgttcgagtttaggaagatgatcgggaaccgcgaaaggtgtcagaatctggtctcgtctgactaccctgttcacatcgataagatcgaagagcaaagcgactgcaagatccttgatggtcactttgtgtccccaatggcacattacgtgccagacataatgcccattgagagcgttattgcccggttccagttcatcgttccaaaagagtggaattccaagtag

SEQ ID NO: 9904 - DNA, 126 bp, Artificial Sequence
  Description of Artificial Sequence: Synthetic coding sequence
atgaagctgagcggcatgttcctgctgctgagcctggccctgttctgcttcctgaccggagtattctcacagggggggcaagtcgactgcggcgaatttcaggatccgaaagtgtattgtacctag

SEQ ID NO: 9905 - DNA, 459 bp, Artificial Sequence
  Description of Artificial Sequence: Synthetic coding sequence
atgcggttcaagaccaccgccaaggacggcctgctgctgtggcggggggatagtcctatgagaccaaatagtgatttcatatcactgggcctgagggacggggctttggtctttagctataatttgggatctggagtggcttctatcatggtgaacggctccttcaatgacggccgttggcaccgagtcaaggccgtcagagacggacagtcaggaaagattacagtggacgattacggcgcccgcactggcaaatcccctggcatgatgaggcagttgaacattaatggcgcgctctacgtgggcggaatgaaggagatcgcactacacaccaataggcagtacatgcgcggtctcgtgggatgcatttctcattttaccctgtccaccgactaccatattagtctggttgaggacgcagtggatggcaaaaacatcaacacgtgtggggctaagtag

SEQ ID NO: 9906 - DNA, 1611 bp, Artificial Sequence
  Description of Artificial Sequence: Synthetic coding sequence
atggacttcctgctggccctggtgctggtgagcagcctgtacctgcaggctgcggccgagttcgacgggcgatggcctcgccagattgtgagttccatcggactgtgcaggtatggcggccgcatagactgttgctgggggtgggcacgtcagtcttggggacagtgtcagccagtctgtcaaccccgctgtaagcatggcgaatgcatcggaccaaacaagtgtaagtgtcacccaggctacgctggtaagacttgcaaccaggatctgaatgaatgtggacttaaacccaggccctgtaaacacagatgtatgaatacgtatggaagctataaatgctactgtctgaatggatacatgctcatgcctgatggctcctgttcgtctgctttgacgtgctctatggcaaactgccagtatggctgcgacgtagtcaagggccagatccggtgccagtgtcccagccccggactgcagctggcacctgacggaagaacttgcgtagatgtggacgagtgtgctaccggccgtgcttcctgcccccgctttagacagtgtgttaacacgttcggtagctatatttgcaagtgccataaggggttcgacttaatgtacattggtgggaaatatcagtgtcacgacatcgatgaatgcagtctgggccaatatcagtgctcctcctttgctaggtgctataatatacgggggtcttataagtgcaagtgtaaggaaggctaccagggcgacggtctcacctgcgtgtatataccaaaagtgatgatcgaaccctccggtcccatccacgtgccaaaaggcaatggaaccatccttaagggtgacaccggcaataataactggataccagatgtggggtccacctggtggccacccaagactccatacattcctcccatcatcaccaaccgtcccacatccaaacctaccactagacctactccaaaacccaccccgattcctaccccccctcccccaccacctcttcctacagagctccggactccgttaccaccgaccacccctgagcgtcctacaaccggcctgaccaccatcgcccctgccgcctcaaccccgccaggcggcatcactgtggataatagggtgcagactgacccacagaaacctagaggtgatgtcttctcggtgttggtgcatagctgtaatttcgaccacggcctctgtggctggatccgggagaaggacaacgacctgcattgggagccaatacgcgatcccgcggggggtcagtacctgaccgtgagcgccgcaaaggcccccggaggcaaggctgccaggctggtgctccctctcggccggttgatgcactctggagacctctgcctgtcgtttcgccataaggtgaccggcctgcactccggtacccttcaagtgtttgtccgcaaacacggtgcacacggtgctgccttgtggggcaggaatggcgggcatggctggcggcaaacccagattaccctgagaggcgcggacattaaatcagttgtgtttaagggcgaaaagcggagagggcatacaggagagatcggcctggatgatgtctctctcaaaaaaggacattgcagcgaagagcggtag

SEQ ID NO: 9907 - DNA, 288 bp, Artificial Sequence
  Description of Artificial Sequence: Synthetic coding sequence
atgctgttccggaaccggttcctgctgctgctggccctggccgccctgttggccttcgtctccctgagcttacagttcttccatctgattccggtgagcacccccaaaaatggaatgagttcaaagagcaggaaaaggatcatgccggatccagtgacagagccacccgtgacagaccctgtctacgaagccctactgtattgtaacatacccagtgtagccgagcgaagcatggagggacacgcaccacaccactttaagctcgtatctgttcacgtatttatatag

SEQ ID NO: 9908 - DNA, 213 bp, Artificial Sequence
  Description of Artificial Sequence: Synthetic coding sequence
atggccagcgacctgatccggaccatcctggccgtggccctgatctcaaagctcggcacggccgttgacgccgagttgatgccttctggtgctatcctgcagaacaagcgggagaacctgccccgtgtctgccatgccctggccttcctggggatggcccggtgtcaggacctgtttttagttcgacttcagggctggaaactgggcacctag

SEQ ID NO: 9909 - DNA, 417 bp, Artificial Sequence
  Description of Artificial Sequence: Synthetic coding sequence
atgggccccgaggccctgagcagcctgctgctgctgctgctggtggcctcaggcgatgccgatatgaaagggcacttcgaccctgccaagtgcagatatgctcttggtatgcaggatcggaccatccctgactcagacatctccgcctcgtcaagttggagcgattctaccgctgccagacatagtaggttagagagcagcgatggggacggggcatggtgtccagccggttcagtctttcctaaagaagaagagtacttgcaagtggacctgcaaagactccatttagtggccctggtgggtacacagggcagacacgcaggaggcctgggcaaggagttctcacgctcctatcggctgaggtacagcagggatggcagacgctggatggggtggaaagaccgttggggtcagtag

SEQ ID NO: 9910 - DNA, 219 bp, Artificial Sequence
  Description of Artificial Sequence: Synthetic coding sequence
atggccgtgagcgtgctgcggctgaccgtggtgctgggcctgctggtcctctttctcacctgctatgccgacgacaagcccgataagccggacgacaagcctgacgactccggaaaggatccaaagcctgactttccaaaatttttgtcactgctgggtacagaaataatcgaaaacgccgtcgagttcattcttcggtccatgagcaggagcacatag

SEQ ID NO: 9911 - DNA, 438 bp, Artificial Sequence
  Description of Artificial Sequence: Synthetic coding sequence
atggtgctgctgcactggtgcctgctgtggctgctgttccccctgagttcacgcacacagaaactccccacccgtgacgaagagctgtttcaaatgcagattcgtgataaggcattctttcatgactccagcgtaatccccgatggcgcagaaatatccagctatctgttccgggacactccgaagaggtatttcttcgtagtggaggaagataacacacctctttctgttaccgtcacgccatgtgatgctcccctcgaatggaaactgtccctgcaggagctccctgaagatcggagcggagaggggagcggggacctggagcctttagagcagcagaagcagcagattattaacgaggagggcactgagctcttctcctataagggaaacgatgtcgagtactttatttccagcagtagtccctcaggcctttag

SEQ ID NO: 9912 - DNA, 258 bp, Artificial Sequence
  Description of Artificial Sequence: Synthetic coding sequence
atgggccccgaggccctgagcagcctgctgctgctgctgctggtggcaagcggagatgccgatatgaagggccatttcgaccctgcaaagtgcaggtatgcattaggcatgcaggaccggacaatacctgatagtgatatttctgcttcaagctcttggtcagattccaccgctgcacggcacagtcgcctagaatcatccgacggcgacggcgcatggtgtcctgctggctcggtgtttcccaaagaagaagagtag

SEQ ID NO: 9913 - DNA, 1410 bp, Artificial Sequence
  Description of Artificial Sequence: Synthetic coding sequence
atgctgaaggtgcactaccccaagttcggcgtgagcgaggactgcctctacctgaatatatacgcgcctgcccacgctgacacagggagcaaactcccagtgttggtctggtttcccggtggcgcgtttaaaacaggatccgcctctatctttgacggcagtgccctggctgcctacgaagacgtgttagtcgttgtggtgcagtacagactcggcatttttggattcttcactacgtgggaccagcatgcgcctggaaattgggcatttaaggaccaggtggcagctctgagttgggtccagaagaacatcgagtttttcggaggggacccatcttctgtcacaatcttcggagaatcagctggggccatttcagtgagctcactgatcctgtccccaatggctaagggactcttccataaggccataatggagtcgggggtggctatcattccctacctcgaagcccacgactacgagaaaagcgaggacctgcaggttgtcgcccacttttgtggaaacaacgccagcgattccgaagcgctgctcaggtgtctacgcacaaagccatctaaagaactcttgaccctgagtcaaaaaacaaaaagttttacgcgggttgtcgacggtgctttcttcccaaacgagcctctcgatctactcagccagaaggcatttaaggctatcccctccatcataggagtgaacaaccatgagtgcggctttctcctaccaatgaaggaggcaccagaaatcttgtcagggagtaataagtccttggcacttcatctgatacagaacattctacacatcccaccacagtacttgcacctggtggcgaatgaatacttccatgacaagcacagcctgactgagattagggactctttactggacctgctaggagatgtgttcttcgtggtccccgctctgattaccgctcggtaccatcgcgacgctggagcaccagtatacttctatgagttcagacataggccccagtgctttgaggatacaaagcctgctttcgtcaaagccgaccacgccgatgaagtacggtttgtgtttggaggggctttcctgaagggagacatcgttatgtttgaaggcgctaccgaggaggagaaactcctgagcaggaagatgatgaagtattgggctaccttcgccaggacaggcaacccaaatgggaatgatttgtccctctggcctgcctataacttaaccgaacagtatctgcagttggatctaaatatgtcactgggccagaggctcaaagaacccagggtcgacttttggacgagcaccatccccctgattctttctgcctctgacatgttgcactcaccactatcttctctcacctttctgtccctactgcagccgtttttctttttctgcgccccgtag

SEQ ID NO: 9914 - DNA, 393 bp, Artificial Sequence
  Description of Artificial Sequence: Synthetic coding sequence
atgctgcccttcctgttcttcagcaccctgttcagcagcatcttcaccgaggctcagaagcaatactgggtgtgcaatagcagtgacgccagtatcagctatacttactgcggacgcgatctcaagcagctgtactttaacttgtatataacagtaaacactatgaacttgccaaagaggaaagaagtgatttgcagggggtccgatgatgactactctttctgtagagcattgaagggcgagaccgttaatacaacaatctcattcagcttcaaggggatcaaattttcaaagggcaaatacaaatgcgtagtggaggccataagtggcagtccagaagagatgttgttctgcctggaatttgtgatcctgcaccagccaaatagcaactag

SEQ ID NO: 9915 - DNA, 318 bp, Artificial Sequence
  Description of Artificial Sequence: Synthetic coding sequence
atgaagtgcaccgcccgggagtggctgcgggtgaccaccgtgctgtttatggcgcgagcaatccctgcgatggtggtaccaaacgctacacttctggaaaagcttctggaaaagtatatggatgaagacggcgagtggtggatagcgaagcagagaggaaagagagctataaccgataacgacatgcaaagtatactcgatctccataacaagctccggagtcaggtttatcccacggcatcgaacatggagtacatgacctgggatgtggaactggaaagatcagctgaaagctgggcagaatcctgcttgtggtag

SEQ ID NO: 9916 - DNA, 567 bp, Artificial Sequence
  Description of Artificial Sequence: Synthetic coding sequence
atgaccatggtgtgccaccggcccgagggcctggagcagctggaggctcagaccaacttcacgaagagagagttgcaggtcctttacagaggttttaaaaacgagtgtccgagtggagttgtcaacgaggacacatttaaacagatatacgcccagttttttccacacggcgacgcgtctacctacgctcactatttgttcaatgcattcgacacgacccaaaccggatcggtgaaatttgaagattttgtgaccgcactgtcaatcctgttgagggggacagttcatgagaagctacggtggactttcaatctgtatgacataaacaaagatggctacattaataaggaggagatgatggacattgttaaggcgatctacgatatgatgggcaaatacacatatcccgtgttgaaggaggacaccccaagacagcacgtcgacgtatttttccagaagatggataaaaacaaagatggaatcgtgaccctggacgagttccttgagtcctgccaggaagatgacaacattatgcgtagccttcaactgttccagaatgtgatgtag

SEQ ID NO: 9917 - DNA, 1275 bp, Artificial Sequence
  Description of Artificial Sequence: Synthetic coding sequence
atgccccccttcctgatcaccctgttcctgttccacagctgctgcctccgggcaaatggccacctcagggaaggcatgaccctgctgaagaccgaatttgccctgcatctgtatcagtctgtggctgcctgccggaacgagaccaactttgtgatttcacctgctggggtcagtttgcctctcgaaattttgcagtttggggcagaagggagcacaggtcaacagctggccgacgctttagggtacacagtacatgataagagggtgaaagatttcctccacgccgtgtatgccactctgcccaccagctctcaaggtaccgagatggagttggcttgttcactattcgttcaagtgggtactcctctgagcccttgcttcgtggagcacgtctcctggtgggccaactcctcattagagcccgccgacctgtctgaaccaaactccactgcaattcagacttcagagggagcctcccgggagacagcaggcggcgggccctctgaggggcctggaggctggccctgggaacaggtgtcggctgccttcgcccagcttgttctagtgagcaccatgtcgttccagggtacctggagaaagaggttcagtagcaccgacactcagatcctccctttcacctgtgcgtatggcctcgttctgcaggtgccaatgatgcaccagaccaccgaggtgaattacggtcagttccaggatactgccgggcaccaggtgggtgtactggagctgccctacctcggatctgcagtgtccctcttcctcgtcctgcctcgagacaaagatactccactctcacatattgaacctcatctcaccgcaagtaccattcacctgtggacaacctcactgcggagagcccggatggacgtctttctgccacggtttcggatacagaaccaattcaaccttaagagcattctgaactcatggggcgtgactgatctctttgatcccctgaaggctaacctgaagggcatctctggtcaggatggtttttacgtgtcagaagccatccacaaagccaagatagaggttctggaggaaggcactaaagccagcggagcaacagcactgctgctccttaaacggagtcgcatcccaatattcaaggccgatcgcccgttcatctatttcctcagggaaccgaacaccggtattacagtcttttttgacaggatccagataatttatcagtgcctgtctagtaacaaaggatcattcgtccattaccctctgaagaataagcacagtttttag

SEQ ID NO: 9918 - DNA, 1815 bp, Artificial Sequence
  Description of Artificial Sequence: Synthetic coding sequence
atggccgtgctggtgtgccccgccagctgccacggcctgaaggagttcaggatccgtcgaggaatgtggcgactgtgcttggtttattacttttatccagcatccagtacactttatgtcctgagaattgatgtcctgaattacacttccaaggatgagggaccatcagccgagggaccccaacggaacactagactgggatggattcagggaaagcaggtaacagtcctcggtagccctgtaccagtgaacgtattcctcggcgtgccatttgctgctccacctttggggagcttgagattcaccaatccccaaccagcatcaccttgggacaacctgcgcgaggctacatcctaccccaatctgtgtctccaaaattccgagtggttgttgctggatcagcacatgctgaaagttcattatcccaaattcggtgtttcagaagattgtttgtacttgaacatttatgccccagcgcatgcggacacgggttctaagctacccgtgctggtgtggttccctggaggcgcgtttaaaactggcagtgccagtatcttcgatgggtcggccctggcagcatacgaggatgttctcgtcgttgttgtgcagtataggttaggaatttttgggttctttactacttgggaccagcacgctccgggtaactgggcattcaaggatcaggtcgccgctttgtcctgggtacagaaaaatatagagttttttgggggtgatcccagctctgtgacaatattcggggaaagcgccggagcgatttctgtaagcagcctaatcctctctccaatggcaaagggtctcttccataaggccatcatggaatccggcgtggccatcattccttaccttgaagctcacgattacgaaaagtccgaagacttacaggtggtcgcccacttttgtggcaataatgcttcagactctgaggcgctgctgagatgtttacggacaaaaccatccaaagagctgctgaccctgtcgcaaaaaacaaaaagctttacccgagtcgtcgacggagcgtttttcccaaatgagccgctggacctcctgagccagaaagccttcaaggctatcccgagcattattggggtgaataaccatgagtgcggtttccttcttcctatgaaagaagcccctgaaatcctgtccgggtcgaacaaaagcctggcgttacacctcattcagaacatcttgcacattcctcctcagtacctacacctggtcgctaatgagtatttccacgataagcactctctgactgaaatcagagactcactgctggatctccttggcgacgttttcttcgtggtgcccgctctcatcactgccaggtaccacagagacgcaggggcccctgtgtacttttatgagtttcgacataggccccaatgtttcgaggataccaaacctgcattcgtcaaagctgatcacgctgacgaggtgcggtttgtctttggcggcgcctttttaaaaggggatatcgttatgttcgagggcgccactgaggaagaaaagctgctgtctcgaaagatgatgaagtactgggctacctttgctaggactggcaatcccaatggaaatgatctatccctgtggcccgcatataatttgaccgaacagtacctacaactcgatcttaacatgtccctgggccagaggctaaaggagcccagggtggatttctggaccagcaccatacctctgattttgtctgcttccgacatgctgcacagtcccttgagttcactcacattcctgtccttgctccaacccttcttctttttttgcgccccctag

SEQ ID NO: 9919 - DNA, 939 bp, Artificial Sequence
  Description of Artificial Sequence: Synthetic coding sequence
atgaacatctggggccagatctggcccaaggccgtgtacctggtgtgtaactattccccgaagggcaattggtgggggcacgcgccctacaaacatggtcgaccttgcagcgcctgtccccctagtttcggaggtggatgcagggaaaatctgtgctataaagaagggagtgacaggtactatccgccaagagaggaggagacaaatgagatcgaaaggcagcagtcccaggtgcacgacacccacgtaagaacaagatctgacgatagtagtagaaatgaggtcatctcggcccagcagatgtctcagatagttagttgcgaagtgcggctccgagaccagtgcaaaggtacaacttgtaaccggtacgaatgtccagccggatgcctggactcaaaagccaaggtgatcgggagtgttcattacgagatgcagtccagcatttgtcgagccgctattcactacgggattatagacaatgatggggggtgggtggacattactcgccagggacgcaagcattacttcattaagtccaatagaaatggaatccagacaattggcaaataccagtcggccaacagttttactgtgtcaaaagttacagttcaggctgtcacctgtgagaccactgtagagcagctttgcccgtttcacaaaccagctagtcattgcccccgggtttattgcccgcggaactgtatgcaggccaatccccactatgccagagtgatcggtaccagggtgtattccgatctgtcttctatttgtagagcagcagtccacgcaggagtggtacggaatcatgggggttacgtggatgttatgccagtggacaaacgaaagacatacattgcctcatttcagaacggaatctttagcgaatccctgcagaatcctccaggggggaaggccttcagggtgtttgccgtggtgtag

SEQ ID NO: 9920 - DNA, 777 bp, Artificial Sequence
  Description of Artificial Sequence: Synthetic coding sequence
atgatcgccatcagcgccgtgagcagcgccctgctgttcagcctgctgtgcgaagcctcaactgtcgttctgctcaacagcacagattcctcgcctcccaccaataacttcactgacatcgaggccgctctgaaggctcagctggatagcgcggacattccaaaagccagacgtaagaggtatataagtcagaacgatatgattgcgattctggattaccacaatcaggtgcgcggaaaagtgttccctcccgccgcaaatatggaatatatggtgtgggatgagaacctagcgaaatctgctgaagcctgggccgctacatgcatttgggatcatggaccgagctacctgctgcggttcctcgggcagaacctatctgttcgcacaggacgataccgctccattttacagctagtcaaaccctggtacgacgaggtgaaagactacgctttcccatatcctcaggactgtaatcctaggtgtccgatgcggtgcttcggccctatgtgtacccactacacacagatggtttgggcaacttcaaacagaattggatgtgccattcatacctgccagaatatgaatgtttggggctctgtttggaggagggcagtgtatctcgtgtgcaactacgctcccaagggcaattggattggggaagctccatataaggtgggagtcccctgtagttcctgtccaccctcttacgggggcagttgtacagacaatctgtgcttccctggtgtgacaagcaattacttgtattggttcaaatag

SEQ ID NO: 9921 - DNA, 1215 bp, Artificial Sequence
  Description of Artificial Sequence: Synthetic coding sequence
atgccccccttcctgatcaccctgttcctgttccacagctgctgcttacgcgcgaacggtcacctgagggaaggcatgactctgctgaagacagagtttgccctgcatttatatcagagcgtggccgcatgtcgaaacgaaaccaactttgtgatatcaccagcaggggtctcccttcccttggaaatcctgcagtttggtgcagagggcagtacgggccaacaattagccgatgcgctgggatatacggtgcacgataagagagtgaaagactttcttcatgctgtatacgcaacactacctacttcaagtcaggggaccgagatggaactggcctgctccctgttcgtgcaagtgggaactcctctctctccatgttttgtggagcacgttagctggtgggccaactctagtctggagcctgcagacctcagcgaacccaattccacagccatccagacaagcgagggagcttcccgcgaaaccgctggcggaggccctagtgaaggcccaggagggtggccttgggaacaggtgagtgccgctttcgcccaattggttctggtgtctactatgagctttcaggggacgtggagaaaaaggttctccagtaccgacacacagatcttaccttttacctgcgcctacggactggtgctacaagtccccatgatgcatcagactacggaagtgaattatggccagtttcaggacacagcgggacaccaggtaggcgtcctggaattgccatatctgggttccgccgtcagcctctttctggttctgcccagggacaaggacacgcccctgtcccatattgagcctcatctgaccgcctcaaccattcacctgtggacaacaagtctgcggcgcgctcggatggacgtgttcttgcccagattcagaattcagaatcagttcaacctcaagagtatcttgaattcttggggggtaacggaccttttcgaccccctgaaagccaatctcaaggggatctccggacaggacgggttctatgtgtcggaggctattcacaaggctaagatcgaagtgctcgaggaaggcacaaaggcctccggggcgaccgctctgctgctcttgaaaagatctagaatccccatctttaaggccgatagaccgttcatttactttttgagagaacccaacaccgggttcgtgttcagtatcggacgcgtgagcaatcccctggactag

SEQ ID NO: 9922 - DNA, 936 bp, Artificial Sequence
  Description of Artificial Sequence: Synthetic coding sequence
atgctgtaccagaccatcaacagcctgaagaccaagaaccccaagttaaagatcctgctttccattggaggctacctgtttgggagcaagggatttcacccgatggttgactcctccacctctcggctcgagtttattaactcaatcatcttgttcctgcgcaaccataactttgatggcctggatgtgtcatggatataccccgaccagaaagaaaatacacattttacagttcttatacatgaactggcggaagccttccagaaggatttcacgaaaagcaccaaggagaggctgctgctcacagccggagtgagcgccggtagacaaatgattgataattcatatcaagtcgagaagctggccaaggacctggatttcatcaacttactgtcgttcgactttcacggaagttgggagaagccacttatcaccggacacaactcccctctaagcaaagggtggcaggatagaggacccagttcgtactataatgtagaatacgctgtcggatattggattcataagggaatgcctagcgaaaaggttgtgatgggcatccccacctacgggcactccttcacacttgccagtgctgagacgaccgtcggtgcgccagcctccggccctggggccgctggtccaatcacagagagtagtggttttcttgcgtattacgagatctgtcagtttctcaagggagctaaaattacccgactgcaggatcagcaggtgccctatgccgtgaaggggaatcagtgggtcgggtacgacgatgtaaagtccatggagactaaagtgcagttcttgaagaatctgaatttgggcggcgctatgatctggtccatagacatggatgacttcacagggaaatcctgcaaccagggcccatatcccctggtacaggccgtcaaaagaagcctgggaagtctgtag

SEQ ID NO: 9923 - DNA, 555 bp, Artificial Sequence
  Description of Artificial Sequence: Synthetic coding sequence
atggccagcgagcggctgcccaaccggcccgcctgcctgctggtggccagcggcgcagctgagggggtatccgctcagagttttttacactgctttacgatggcttctaccgcatttaatcttcaggtcgccacgcctggaggtaaggctatggagttcgttgacgtcactgagtcgaacgcgagatgggtgcaggatttcaggttgaaagcatacgccagtcccgccaagttggaaagcattgatgagcctatctgcgcggtgggccacggtgtggcggctttgtgttgcgccacgaatgaagaccgttcatgggtttttgattcatattccctgacaggaccgagcgtgtgcgaactggtacgggccccaggattcgcccgcctccctctagttgtcgaagactttgtcaaggattccggcgcgtgtttcagcgcttcggaacccgatgcagtgcacgtcgtgctcgaccgacacctggtgactggccagaacgcttcttccaccgtcccagccgtgcagaacctgttgttcctctgcggcagtcgtaaatag

SEQ ID NO: 9924 - DNA, 1257 bp, Artificial Sequence
  Description of Artificial Sequence: Synthetic coding sequence
atgcggagcctgctgctgctgagcgccttctgcctgctggaggccgccctggccgccgaggttaaaaaacccgcagccgctgcagcaccgggcaccgctgagaagttgtcaccaaaagctgcgactttggcagaacgaagcgcaggactggcatttagcctctaccaggccatggccaaagatcaggctgtggaaaacatcttggtgtctcccgtcgtcgtcgcctcatctctcggtctggtatctctgggaggtaaagctactaccgcttcccaagctaaggccgtgctatcagctgaacagcttagagatgaggaggtccacgccggtctgggagaactgctgaggtccctctccaattccactgcccgcaacgtgacctggaaactgggtagccgattatacgggccctcttcggttagttttgccgatgatttcgtaaggagctctaaacagcactataactgcgagcatagtaagattaattttcgggacaagaggagcgctcttcagtctatcaatgagtgggcagcccagacaacagacgggaagctgcccgaagtgactaaagatgtggaacggactgacggggcccttctggtaaacgcgatgttctttaagccccattgggatgaaaaatttcaccacaaaatggtggataacagaggattcatggtgaccaggtcttatactgttggggtgatgatgatgcatagaaccgggctctataactactacgacgacgaaaaagaaaagctgcagattgtggaaatgccattggcccacaagctttcatccctgataatcctgatgccccatcatgtggaaccactggagagactggaaaaacttttgacaaaggaacaactgaagatctggatgggcaaaatgcaaaaaaaagcggtggctatctccctgccaaagggtgtggtagaggtgacccacgatctgcagaagcatctggccggactgggcctcaccgaagctatcgacaagaacaaggcagaccttagccgcatgagcgggaaaaaagatttgtacctggccagtgtgtttcatgccaccgcttttgaactcgatacggatgggaatccctttgatcaggatatctacggccgagaggagctccggagccctaagcttttctatgccgatcacccctttatctttttggtacgagacacccagtctggttccctgctgtttattggaaggctggtgcgtccgaaaggagacaaaatgagggacgagctgtag

SEQ ID NO: 9925 - DNA, 1425 bp, Artificial Sequence
  Description of Artificial Sequence: Synthetic coding sequence
atggaccggaaccccagcccccccccccccggccgggacaaggaggaagaggaggaagtggcgggcggggattgtataggttctacagtctatagcaaacactggctgttcggggtgctgagtggcctcatccagattgtttcacccgaaaacactaaatcctcatcggacgatgaagagcagctgactgagcttgacgaagagatggaaaatgaaatttgtcgcgtgtgggacatgtcaatggacgaagatgtagccttattcctccaggagttcaatgcccccgatatctttatgggcgtgctggccaaatcgaaatgtcccagattgagagagatctgcgtagggatcctgggtaacatggcatgctttcaggaaatatgcgtgtctatctcttcagataagaacctggggcaagtgctgttacattgcttatacgactccgatccacccactcttctggagaccagtcgcctgctgctcacctgtttgtctcaggctgaggtcgcaagcgtgtgggtggagcggatccaggagcaccccgcaatatatgacagcatctgcttcatcatgagcagtagtacgaatgttgacctgctagtaaaggtgggcgaagtggtggacaagctgtttgacctcgacgagaagctgatgctcgagtgggttaggaacggcgcggcacaaccattagaccagccacaggaggaatctgaagaacaaccagttttccggcttgtaccctgtatcctcgaagctgctaaacaggtcagatccgagaatcccgagtggcttgacgtgtatatgcacatactgcagctcctgaccacagtcgacgacggtatacaggctattgtgcattgtccagacaccggtaaggacatttggaacctcctctttgaccttgtttgtcatgagttctgtcagagcgacgaccctcctattatcctgcaggagcaaaaaacagtcctcgctagtgtattcagcgtgttgtctgcaatttatgcatctcagaccgaacaggaataccttaagatagagaaagtcgatttgcccctgatcgacagcctgattcgggttcttcagaacatggaacaatgtcagaagaagccggagaattctgcagagagcaataccgaagagaccaaaagaacagatctgacgcaagatgatttccacctgaagatcctgaaggacatcctgtgtgagtttctaagcaacatctttcaagcactgacgaaagaaacggtggcacagggagttaaagaaggccaattatcaaagcagaagtgtagcagtgcttttcagaaccttctgcccttttattcccctgtggtggaggacttcattaagatcctgcgagaggtggataaggccctggcagacgacctcgagaaaaacttcccctctctaaaggtacaaacctag

SEQ ID NO: 9926 - DNA, 438 bp, Artificial Sequence
  Description of Artificial Sequence: Synthetic coding sequence
atgctgacccggctggtgctgagcgcccacctgagcagcaccacctctcccccatggacacatgccgccatctcctgggagctcgacaacgtgcttatgccctctcctaggatctggccgcaagtgaccccgacaggacgaagtgcgagtgtcaggagtgaggggaatacttcgagtctttggaatttttctgcaggccaggacgtacacgcgatcgtcacgcggacctgtgaatctgtgctctctagcgccgtgtacactcacggatgcggctgtgttcggtctgcaacaaacatcacgtgccaatcttcggggcaacagaggcaggcggcaagacaggaggaggaaaactctatctgcaaagctcacgattctcgcgaggggaggttaggctaccctcttagtgcgcaccagcctgggtcaggggggcccaactag

SEQ ID NO: 9927 - DNA, 1728 bp, Artificial Sequence
  Description of Artificial Sequence: Synthetic coding sequence
tgaatcttcggcggcagcatccactacttccgggtgccccgggagtattggcgggaccgcctgctgaaaatgaaggcttgcggtctgaacactctcactacgtatgtgccctggaacctacacgagcctgagcgcggaaagttcgatttcagtgggaacctggacctcgaagccttcgtgttgatggctgctgagataggtctctgggtcattttgcggccaggaccctatatatgttctgagatggacctaggtggactgccgagttggcttctccaagaccctgggatgcgcctgcggaccacctataagggatttacagaggcggtagatctttattttgaccatttgatgtcccgggttgtcccattacagtataaaaggggggggccaattatcgcggtccaggtcgaaaatgagtacggtagctacaataaggaccccgcttacatgccctatgttaagaaagccctggaggaccgtggaatcgtggagctactgctaaccagcgacaataaagatggattatcaaaggggatcgtacagggagtgctcgccacaataaacctccagtcaacccacgaactgcagttgctcaccacctttctttttaacgtgcaggggacccagccaaaaatggtgatggaatattggaccgggtggtttgacagttggggaggacctcacaacattctggactctagcgaagtgctgaaaacagtgtccgccattgttgatgctggcagctcgatcaatctttatatgttccatggcgggaccaattttggcttcatgaatggagcgatgcatttccacgattataaatctgacgtcacttcttatgactatgacgccgttttgaccgaagccggtgattacaccgcaaagtacatgaaattgcgcgatttctttggaagcataagcggtataccgctgcctccgccgcccgatctgttacccaagatgccttatgaacccttgactcctgtgctgtacctttctctgtgggatgcactgaaatatctgggagaaccaatcaagagcgaaaagcctattaacatggaaaacttacccgtaaatggggggaacggtcaaagtttcgggtatatcctgtacgagacatcaattactagctcaggcattctatctggtcacgtgcacgacaggggccaagtgtttgttaacactgtgagcatcggcttcttagattacaagaccacaaagatcgccgtccccctgattcagggatatacagtgcttagaatactggtagaaaacaggggtagggtcaattacggagagaatatcgatgatcaaaggaaaggactgattggaaatctttatctcaatgattccccactgaaaaactttaggatttacagtcttgacatgaagaagtcgttttttcaacggtttggactggataagtggtccagcctgcctgagaccccaacactgccagccttttttctgggctcactgtcaatctcctctaccccttgcgacaccttcctgaaactggagggatgggaaaaaggagtggttttcataaatggtcaaaacctggggagatattggaatataggacctcaaaagaccttgtacctgcccggtccttggctttcttcggggattaaccaggtgatcgtttttgaggagactatggcaggacccgcactacaatttacagagactccccaccttggccggaaccaatacattaaatag

SEQ ID NO: 9928 - DNA, 255 bp, Artificial Sequence
  Description of Artificial Sequence: Synthetic coding sequence
atgcggaccctgttcaacctgctgtggctggccctggcctgcagccccgttcatactaccctatctaagtccgatgcgaaaaaggctgcctccaagaccctgcttgagaagtcccaatttagtgacaagcccgttcaagaccgcgggctggtagttacagatctgaaggcagaaagtgtggtgctggagcatcggtcctactgttctgctaaggctcgtgataggcacttcgcaggcgacgttctgggatattag

SEQ ID NO: 9929 - DNA, 744 bp, Artificial Sequence
  Description of Artificial Sequence: Synthetic coding sequence
atgcggagcctgctgctgctgagcgccttctgcctgctggaggccgccctagccgcggaggtgaaaaaacctgctgccgctgcagcgcccggtactgcggagaaactgagccccaaggctgccactctggccgagcgatccgcaggcctggcctttagcctgtaccaagcaatggccaaagatcaggcagttgagaacatccttgtatcgcctgtcgttgtggcctccagtctgggcctggtgagcctcggggggaaggctactaccgccagccaggctaaagctgtgctttctgcagagcaactgcgggacgaagaagttcacgctgggctgggtgagttattacgatctctgagtaattccactgctaggaatgtgacctggaaacttggctcacggctttatgggccgtcctctgtgtcatttgcagatgatttcgtgcgtagctctaagcagcactacaactgcgaacactccaagatcaattttcgcgacaagaggtctgccctccagagcattaacgaatgggccgcccaaaccacagatggtaaactacccgaggtgaccaaggatgttgagcggaccgacggcgccttgctagtcaatgctatgttcttcaagcctcactgggacgagaaattccaccacaaaatggtggacaatcggggcttcatggtgacgcggtcgtatacggtgggcgtgatgatgatgcatcgaactggtttgtacaactattatgattag

SEQ ID NO: 9930 - DNA, 117 bp, Artificial Sequence
  Description of Artificial Sequence: Synthetic coding sequence
atgcggaccctgttcaacctgctgtggctggccctggcctgcagccctgttcatacgacactgtctaagtcggacgcaaaaaaggccgcctcaaaaacccttcttgaaaaagtgtag

SEQ ID NO: 9931 - DNA, 750 bp, Artificial Sequence
  Description of Artificial Sequence: Synthetic coding sequence
atgcggagcctgctgctgctgagcgccttctgcctgctggaggccgccctcgctgccgaggtaaagaaacctgccgccgccgccgcgccagggacagctgagaagctgtcacctaaagctgcaacactggccgagcgctccgccggactcgccttctctctctaccaagccatggcaaaagaccaggcagttgagaatattctcgtgagcccagtagttgtcgcctctagcctgggactggtctctctgggggggaaagcgacaaccgctagtcaagccaaagccgtcctttctgctgagcagctacgggacgaggaagtccatgccggcctcggtgagctcttgagaagtctctccaactccaccgcacgtaacgtgacttggaaactgggtagtcggctctacgggccaagctctgtaagctttgcagatgatttcgtgcgatctagcaaacagcattacaactgtgagcactctaagatcaattttcgagataaacgttcagcgctccagagtattaacgagtgggcggctcagactacagatggaaaattgcccgaggtcaccaaggacgtggaaagaaccgacggggctcttttagtgaatgctatgttctttaagccacattgggacgagaaattccaccacaaaatggtggacaaccgcgggttcatggtgaccaggtcttatacggtaggcgtcatgatgatgcatagaacaggactctacaattactacgatgacgagtag

SEQ ID NO: 9932 - DNA, 201 bp, Artificial Sequence
  Description of Artificial Sequence: Synthetic coding sequence
atgaagcccctgctggtggtgttcgtgttcctgttcctgtgggaccccgtattagccggcataaattctctctcttctgagatgcacaagaaatgctataaaaatggtatctgccgcctggaatgctatgagtccgaaatgctggtggcctactgcatgttccagcttgagtgttgtgtgaaggggaaccctgcaccatag

SEQ ID NO: 9933 - DNA, 1002 bp, Artificial Sequence
  Description of Artificial Sequence: Synthetic coding sequence
atggtgagcaagagccggtggaagctgctggccatgctggccctggttcttgtggtcatggtgtggtacagtatttcaagggaagatcgctatatcgaactgttttactttccaatccctgagaagaaggagccctgtctgcagggggaggccgaaagtaaggctagtaagcttttcgggaactacagtcgggatcagcccatttttctgagactggaagactacttctgggtgaaaaccccgagcgcttatgaactgccttacgggaccaaaggcagcgaagacttacttctaagagttctggccatcacaagcagctctataccgaaaaacattcaatctctaagatgtcggagatgtgtggtagtcggaaatggccaccggcttaggaattcgtcactgggagatgctatcaataaatatgatgtcgtaatacgcctgaataacgctccagtagccggctatgagggcgacgtgggaagtaagacgaccatgcggctcttctaccctgaatctgcacatttcgatcctaaggtggaaaataaccccgacaccctcctcgtgctcgtggcattcaaagctatggacttccactggatcgaaactatactctcagacaaaaagcgggtaaggaagggcttctggaaacagccgcccctgatctgggacgttaatccaaaacagatcagaattctgaacccctttttcatggagatcgccgcagacaagctgctaagcctgccgatgcagcagcccaggaagatcaaacagaaacctaccacggggctgctggctatcacactggccctccatttgtgcgatctggtgcacatcgccggttttggatatcccgatgcttataacaaaaaacagaccatccattattacgagcagattacactcaaatctatggctggttccgggcacaacgtctcccaagaggcccttgcaatcaaaaggatgctcgagatgggcgcaattaagaacctcacaagtttttag

SEQ ID NO: 9934 - DNA, 645 bp, Artificial Sequence
  Description of Artificial Sequence: Synthetic coding sequence
atgcggcccaagaccggccaggtgggctgcgagacccccgaggagttgggtccaggaccgaggcagaggtggccactgctcctgctcggactggcgatggtcgcgcatggtttattgaggcctatggttgccccccagtcaggggatccggatcccggcgcctcagtggggtcctcccgatctagcctacgcagcctgtgggggagactgctgctgcaacccagtccacagagggcagacccacggtgttggcctcgcggcttttggagcgagcctcaatctctgtgttatgtgttcggcaccgggacgaaggtcacggtgctaggccagcctaaggccaaccctaccgtgactctgtttccaccctcgtctgaggagttgcaagccaataaggcaactctagtgtgtttaatctccgatttttatccaggggccgtcactgtcgcatggaaagcggacggtagtccagtgaaagctggggttgaaaccacaaaacctagcaaacagagcaacaacaaatacgccgcttccagctatctgagtcttacccccgaacagtggaagagccaccgttcatacagctgtcaggtgacccacgagggcagcacagtggagaagactgtcgccccaacagaatgctcttag

SEQ ID NO: 9935 - DNA, 1050 bp, Artificial Sequence
  Description of Artificial Sequence: Synthetic coding sequence
tgactgtacaagaaccggctgggcagcggcggccggggccggtgcattaagcagggagagaactggtactccccaacggagttcgaagcgatggcgggacgggctagttctaaagattggaaacggtccattcgctatgccgggcggcctttacaatgtctcattcaggatgggatcctcaatccccacgcagccagttgcacttgcgccgcttgttgtgatgatatgactctcagcgggcctgtacggctgtttgtgccatacaaacggagaaaaaaggagaacgagctccccaccactccagtgaaaaaggacagccctaagaatattacattactgccagccacagccgctactactttcacagtcaccccaagtggccagattacaacgagtggggctctgaccttcgatagggcatctacagtggaggccaccgcagtcatcagcgaaagccctgcgcagggggacgtgtttgcgggcgcaacagtgcaggaagcctctgtgcagcctccctgcagggccagtcacccggagccccactacccaggataccaagatagttgccaaatcgcacccttccccgaggccgctttaccaacctcgcatcctaaaatcgtcctcactagtctcccagccttggctgtccctccacccacccccacgaaagcagctccgccagccttagtgaacgggctcgagctgagcgaacctcggtcatggctttacctagaggagatggtgaactcattgttgaatactgcgcagcaattaaaaacactctttgagcaggccaagcacgcctctacatacagggaagcggccaccaaccaagcgaaaatccatgccgacgcagaaaggaaagaacagagttgcgtcaactgcggacgcgaagccatgagtgagtgcactggatgccataaggtgaattattgttccaccttttgccagcgtaagcgctggtcccttaccatgctcacctctctggtcagcatctcctggctaagggctattctgccatgccaaccgcccaaggttcttggtctatag

SEQ ID NO: 9936 - DNA, 600 bp, Artificial Sequence
  Description of Artificial Sequence: Synthetic coding sequence
atgagcctggacatccagagcctggacatccagtgcgaggagctgtcagacgcaagatgggccgagctgcttccactgctgcaacagtgccaagtggtgagattagacgattgtggcctgacagaggcccgctgcaaagacatctcttccgccctacgcgtcaacccggcgctagccgaattgaatcttcgaagcaacgagctgggagatgtcggggtgcattgcgttctgcaggggctccaaactccttcatgtaaaattcagaaactgagtctgcagaactgttgcttgactggggccggctgcggagtcctatcctctaccctcagaacgctgccaacgctacaagagctgcacttgagcgacaacctgctcggagacgccggcctccagttgctgtgcgaaggccttttggatcctcagtgcaggctggagaagttgcagctggaatactgctccctgtccgcagcttcttgtgaacctctggcctctgtactccgggccaaaccggacttcaaagaattaacagtttcgaataatgatatcaatgaggcaggtgttagagtcttgtgccagggcttaaaggactcaccatgttag

SEQ ID NO: 9937 - DNA, 465 bp, Artificial Sequence
  Description of Artificial Sequence: Synthetic coding sequence
atggccggcatccccggcctgctgttcctgctgttcttcctgctgtgtgccgtcggccaggtttcaccctactccgccccctggaagccaacgtggcccgcctaccggcttcccgtggttctgcctcagtcaacgctgaatttagcaaaacccgacttcggagccgaggctaagctagaggtgtccagcagttgtggtccccagtgccacaagggaacaccgctccccacatacgaagaggccaagcagtatctcagctacgagacactgtacgccaacggctctagaaccgaaacccaggtcggcatatatattttatcgagctcgggtgatggagcccagcaccgagacagtggcagttccggcaaaagtcgacgaaagcggcagatatatggatacgacagtcgcttcagcatttttggaaaagacttcttactcaattacccattttcaactagcgtctag

SEQ ID NO: 9938 - DNA, 936 bp, Artificial Sequence
  Description of Artificial Sequence: Synthetic coding sequence
atgggcatcatccagagcatcctggccaccagccgggactgctacagctttaagaagaagccaataccaaagaagcctacaatgctggcccttgcaaaaatacttctgatatcaaccctgttctatagtttacttagcgggagccacggcaaagaaaaccaggacatcaatactacacagaacatagcagaagtttttaaaacaatggaaaataaacctataagcctggaaagtgaggctaatctcaattcagacaaagaaaacatcaccaccagcaatctcaaagcaagccacagcccaccattgaatctgcccaacaattcccacggtatcacggattttagtagtaatagctctgccgaacatagcttagggagtctgaaacccacgtccacaattagcaccagtcccccccttattcatagtttcgtctcaaaagtgccgtggaacgcccctatcgctgacgaagaccttctacctataagtgcacaccctaatgcaactccagccctgagtagcgagaattttacttggtccttagtgaatgacaccgtgaagactcccgacaacagcagtattacggtgtctattctgagcagcgagcccactagcccctccgtcactcctctaatcgtcgaaccttccggatggttaaccacaaattctgacagttttacaggctttactccataccaagagaaaaccaccctgcagccaaccttgaagtttacgaataattccaaactgttcccgaatacaagcgatccccagaaagttttacggctggacaacgcgccagagccatacgacgttagtttcggcaacagtagctattacaaccccaccctaaacgactccgcaatgccagaatcagaagagaacgctcgggacggtatccccatggatgacatacccccactgagaactagtgtctag

SEQ ID NO: 9939 - DNA, 1404 bp, Artificial Sequence
  Description of Artificial Sequence: Synthetic coding sequence
atgctgatcttctggaccatcaccctgttcctgctgggcgccgccaaagggaaagaagtgtgttacgaagacctggggtgttttagcgacactgaaccgtggggcggcaccgcgattcggccactgaaaatcctgccttggtccccagaaaagatcggaaccagatttctcctttatactaacgaaaatcccaataacttccagatcctcctgcttagcgacccatccaccatagaagcgtctaattttcagatggatagaaagaccaggttcatcattcatggcttcattgacaagggcgacgaatcttgggtaactgatatgtgcaagaaacttttcgaggttgaggaggtcaactgcatctgtgtggattggaagaaaggcagccaggctacgtatacccaagcagcaaataatgtacgggtcgtaggtgcccaagtcgctcagatgctggacatcctgctcacagagtacagctacccaccctccaaggtgcacctgattggccacagcttgggcgcccatgttgctggggaagccgggagcaaaacacctgggctttcacgaataactggcttggatccagtggaggccagctttgaatctactccagaggaagtccgcctcgacccgtccgacgcggacttcgtggacgtgatacatactgacgctgcaccgctcataccctttctaggctttggcacaaaccaacaaatgggccacttggacttcttccccaacggtggcgagagcatgccaggctgtaagaagaacgccttatcacagattgtggatctagacggcatctgggctgggacccgagattttgtggcttgtaatcatctccgttcttacaagtattatctggaaagcatacttaatccggatggcttcgctgcctacccatgtacttcctacaaaagttttgaatcagacaagtgcttcccctgtcccgaccaagggtgcccacagatgggtcattacgctgataagttcgccggcaggacatcagaagaacagcaaaaatttttccttaatactggagaggcctcaaatttcgcacgctggaggtatggtgtttctataaccctttctggcagaaccgccacgggacaaatcaaagtggcactcttcggcaacaagggcaacacacatcagtattctatctttcggggaatcctgaaaccagggtctacccattcatatgagttcgacgcaaaactcgatgtggggaccatagaaaaagtgaagttcctgtggaataacaacgtcatcaaccctaccctgccaaaggtgggcgcaaccaagataactgtccaaaagggcgaggaaaagactgtctataacttttgtagtgaggacaccgttcgcgaggatacgctgctcactcttacaccttgctag

SEQ ID NO: 9940 - DNA, 81 bp, Artificial Sequence
  Description of Artificial Sequence: Synthetic coding sequence
atgcggaccctgttcaacctgctgtggctggccctggcctgcagcccagtacacacaaccctaagcaaatcagatgcatag

SEQ ID NO: 9941 - DNA, 549 bp, Artificial Sequence
  Description of Artificial Sequence: Synthetic coding sequence
atgcggcggatgtgggccacccagggcctggccgtggccctggccttgtcagttttgccaggtagcagagccctgcgacctggagactgcgaagtatgcatatcctacctgggtcggttctaccaagatctgaaagatagagatgtgaccttttcacccgcgactatcgagaacgagttgatcaagttctgcagggaagccaggggaaaggaaaacaggctgtgctattacatcggcgcgacagatgacgcggcaaccaagatcataaatgaggtaagcaaaccactggctcatcacattcctgtggaaaagatctgcgagaagctcaaaaaaaaggatagtcagatatgcgaactaaagtacgacaagcagatcgatctgagcacagtcgacttaaaaaaactgcgggtgaaagaactgaaaaaaatcctggacgattggggcgaaacatgtaagggatgtgccgagaaaagcgattatattaggaagataaatgagcttatgcctaagtacgctccaaaggccgcttcggctcgcactgatctgtag

SEQ ID NO: 9942 - DNA, 153 bp, Artificial Sequence
  Description of Artificial Sequence: Synthetic coding sequence
atgaaggtgttcttcctgttcgccgtgctgttctgcctggtgcagaccaatagcgtgcacatttctcatagggaggccagagggccttctttcagaatttgcgtggatttcctcggaccccggtgggctagaggctgctcaactggtaactag

SEQ ID NO: 9943 - DNA, 666 bp, Artificial Sequence
  Description of Artificial Sequence: Synthetic coding sequence
atgggcgccaccaccatggaccagaagagcctgtgggccggcgtggtagtgcttctcctgcttcagggcggatccgcatacaaactggtgtgctattttactaattggagtcaggaccggcaagaaccaggcaaattcacccctgaaaacattgatccctttctgtgttctcacctaatctattcgtttgcaagtattgagaataataaagtcattataaaggataagtctgaggttatgttgtatcagacaattaactctctcaagaccaagaatcccaaactgaaaatcctgctatccatcggtggctatttattcggcagcaaaggatttcaccctatggttgattctagcacatctagactggagttcatcaactccatcatcctgttcctccggaaccacaatttcgacggcctcgacgtttcctggatctaccctgaccagaaagagaatactcactttaccgtactgatccacgaacttgccgaggcctttcagaaggattttactaagtccactaaagagaggttactactcactgctggggtttccgccgggcgccaaatgatcgacaactcatatcaggtcgaaaagcttgctaaggaccttgattttatcaatctgctgtcattcgatttccacggatcttgggaaaaaccctag

SEQ ID NO: 9944 - DNA, 1257 bp, Artificial Sequence
  Description of Artificial Sequence: Synthetic coding sequence
atgcggaccctgttcaacctgctgtggctggccctggcctgcagcccggtgcatactaccctctctaagtccgatgctaagaaggctgcgtccaagacacttttagagaaggttaaattctgcagctgttgtcctggatggagcgcaatggcacggtcctggttaaccgctacctccgcaactcaatcccaatttagcgataaacccgtccaggacagggggttggtcgttacggacttgaaagccgagtccgtcgtgcttgaacacagatcctactgcagtgcaaaggcgcgggataggcacttcgccggagacgtccttggctatgtcacaccatggaattcccatggatatgatgtgaccaaagtctttggaagtaagttcactcaaatctcccccgtttggctacagctcaagcggcgtgggcgggagatgttcgaagtaacaggtttacacgatgtggaccaaggatggatgagagccgtccgtaaacatgctaagggccttcacattgtccctaggctgttgtttgaggactggacgtatgacgacttccgcaacgttctggactctgaggacgagatagaggagttgagtaagacggtggtgcaggtggctaagaatcaacacttcgatggattcgtggtcgaggtttggaatcagctcctgagtcagaagcgagtgggcttgatccatatgctgacccacctggccgaggccctgcaccaggcccgtctcctcgcattgcttgttataccgcctgcaatcacgcccggaacagatcagctgggcatgtttacacacaaggaatttgaacagctcgcccccgtgttagacggatttagtttgatgacctacgattactctaccgctcatcagccaggcccaaacgcaccactatcttgggttagagcctgcgtgcaggtgctggatcctaaatcaaaatggcgcagcaagattctactggggcttaacttctatgggatggactacgccacctcaaaagacgcacgtgagcccgtcgtaggggcccggtacatccagactctgaaagaccacaggccccgcatggtgtgggacagccaggcatcagaacactttttcgagtataagaaaagcagaagcggccgccacgtggtgttttaccccacactgaaaagtctgcaagtccgcttagagctcgctagggaactaggagtgggcgtctctatttgggaactggggcaaggactggactacttttacgacttattgtag

SEQ ID NO: 9945 - DNA, 612 bp, Artificial Sequence
  Description of Artificial Sequence: Synthetic coding sequence
atgcggagcctgctgctgctgagcgccttctgcctgctggaggccgccctggctgccgaggtcaagaagccagccgctgccgcagcacccggaaccgctgaaaagctgagtcctaaggccgcaactcttgcggaacggtcggcaggcctggcattctccctgtaccaggcaatggccaaggaccaggctgtcgagaacatacttgtgtctccagtggtggtcgcttccagtcttggattagtgagccttggaggtaaggctaccacagcgtctcaggcgaaggccgttctctctgcagagcagcttcgggatgaggaggtgcacgccggccttggtgaattacttcgctctcttagcaactcgacagccaggaatgtgacctggaagttgggaagtaggctctatggccccagcagtgtcagctttgccgatgattttgtccgcagcagcaaacaacattataattgcgagcactctaaaatcaacttccgggacaagaggtctgctttgcagagtattaatgagtgggctgctcagacaacggatgggaagttgcctgaggtgacgaaagacgttgagcgcacagacggggccctcctcgtgaacgcttag

SEQ ID NO: 9946 - DNA, 492 bp, Artificial Sequence
  Description of Artificial Sequence: Synthetic coding sequence
atgcggagcctgctgctgctgagcgccttctgcctgctggaggccgctctggccgcagaggtcaagaagccagccgccgctgccgcaccgggaaccgcagaaaaactgtcccctaaggctgcgaccctggctgagcgatctgcaggcctggccttttctctgtaccaagccatggccaaggatcaggccgtggagaatatcctggtaagtcccgtggtcgttgcctctagcttggggctggtaagcctggggggcaaagccacgacagcctcgcaggccaaagcagtgttgagcgccgagcagctccgggacgaagaggtgcatgcgggccttggcgagctgttgcggtctttatctaactctaccgcccgtaacgtgacctggaaattgggttctagattatacgggcccagttctgtgagctttgcagacgacttcgtgcgctccagcaaacaacattataactgcgagcattccaagataaatttttag

SEQ ID NO: 9947 - DNA, 570 bp, Artificial Sequence
  Description of Artificial Sequence: Synthetic coding sequence
atgagcctggacatccagagcctggacatccagtgcgaggagctgtccgacgcaaggtgggccgagcttttaccattgttgcagcagtgccaggtcgtgcgtctcgacgactgcgggctaacagaagcccgctgcaaggatatctccagcgccttgcgagtgaacccggctctggcggaacttaacctgcgctccaatgaacttggcgatgtcggggtgcattgcgtcttgcagggattacaaaccccctcgtgtaagatacagaagttaagcctgcagaactgctgcctgacaggtgccgggtgcggagtgctgtcctccaccctgaggacgcttcccacactccaggaactccatctctcagacaacctgctcggggatgcgggactgcaactactgtgcgagggcctgttagatccacagtgccgtctagagaagctgcagttagaatattgttccctgtctgctgctagttgtgagccccttgcttctgtgctgcgggcaaagcctgacttcaaggagctgactgttagcaataatgatatcaacgaggccggggtcagggtttag

SEQ ID NO: 9948 - DNA, 585 bp, Artificial Sequence
  Description of Artificial Sequence: Synthetic coding sequence
atgagcctggacatccagagcctggacatccagtgcgaggagctgagtgatgcgcggtgggctgagcttctccccctcctgcaacagtgccaggtggtcagacttgacgactgtggtctgaccgaagcccgctgtaaagatattagttccgcactgagggtgaatcctgctctggcagaacttaatctacggtcaaacgaactgggcgacgtgggggtccattgcgtgttgcaagggctccagacccctagctgcaagatccagaagctttcattgcagaattgctgcctaacaggagcgggctgtggggtacttagttccaccctgagaaccctgcccaccttacaggaattacacttatccgacaacctgctgggcgacgctgggttgcagcttctgtgcgagggcctccttgacccccagtgccgactcgaaaagctccagttggaatactgttccctgtcagcagcaagctgcgaacccctggcctcagtgctccgcgcaaagcccgattttaaagaactgacagtcagtaataatgatataaatgaggccggagtccgcgtcctctgtcagggcttgtag

SEQ ID NO: 9949 - DNA, 1086 bp, Artificial Sequence
  Description of Artificial Sequence: Synthetic coding sequence
atgggcatcatccagagcatcctggccaccagccgggactgctacagctttaagaaaaaacccatacccaaaaagcctacaatgctcgctctcgccaaaatcctgctcatctctaccctgttctactccctcctatccgggtctcatggcaaagagaatcaggatatcaataccacccagaacattgccgaagtgttcaagaccatggagaataagcccatttccttggaaagcgaggccaatcttaactctgacaaagagaatatcactacgtccaatttaaaggcgagtcactccccaccgctgaacctgcccaataactcacacgggatcaccgatttcagctccaatagttccgcagaacacagcctggggtctctcaagcccacctccaccatctccacctccccacccctcattcacagttttgttagtaaggtgccgtggaacgctcccatcgctgacgaagacttgcttcccatctcggcccaccctaacgccacacccgccctcagtagcgaaaacttcacatggagcctggtcaatgataccgtgaagaccccagacaattcatctatcacagtaagcatactcagttctgagccgacatctccctccgtgacacccctcatcgttgaacccagtggttggcttacgacaaatagtgattcattcacaggcttcacgccttatcaggagaagaccaccctgcagcccacacttaaattcaccaataattctaaactattcccaaacacctccgacccacagaaggagaacaggaatactggtatcgtttttggggccatcctgggcgctattctgggagtttcactcctcacattggtcggataccttctttgtggaaaacggaaaacagactcgttctcccatcgccggctttatgatgaccgcaacgagcctgttctgcggctagataatgccccagaaccctacgatgtctctttcggaaactcctcttactacaacccaaccctcaacgatagtgccatgccggaatctgaggagaatgcgcgggatggcattcccatggatgacatacctcccctgcgaaccagcgtgtag

SEQ ID NO: 9950 - DNA, 327 bp, Artificial Sequence
  Description of Artificial Sequence: Synthetic coding sequence
tgacccaagagcaagtggcggagcaagatcctgctgggcctgaacttttacggaatggactatgccacatcaaaggacgcacgggagcccgtggtcggcgcgcgttatattcagactctgaaagatcatcgcccgaggatggtttgggattctcaggcctccgagcacttcttcgaatataaaaaatcccggtcgggtcggcacgtggtcttttacccaactctgaagagcctccaagttcggctggaactagccagagagttgggagtgggtgtgtcaatttgggagttgggccagggtctggattatttttacgatctgctgtag

SEQ ID NO: 9951 - DNA, 504 bp, Artificial Sequence
  Description of Artificial Sequence: Synthetic coding sequence
atgcggagcctgctgctgctgagcgccttctgcctgctggaggccgcacttgcggccgaagtcaaaaaacctgccgccgcagctgccccaggtacagccgaaaaactcagccccaaagccgcgaccctggccgagcgaagtgcgggcctggccttctcattgtaccaggcaatggcaaaagaccaggcagtggaaaatatacttgtttccccggtagtagtagcttcatcactcggtctagtctctcttggtggcaaagccactacagccagccaggctaaagccgttctgtctgctgagcagcttagggatgaggaagtccacgccggacttggcgaattgctccgcagcctgagtaattctaccgcgcggaacgtcacctggaagctcggcagcagactgtacggcccttcctccgtttcttttgccgatgacttcgtgcgctcttccaaacagcattacaactgcgaacactccaaaattaacttccgggataagcgctag

SEQ ID NO: 9952 - DNA, 1209 bp, Artificial Sequence
  Description of Artificial Sequence: Synthetic coding sequence
atgatggtggccctgcggggcgccagcgccctgctggtgctgttcctggccgccttcctgcctccccctcaatgcacccaggaccctgccatggttcactacatttatcagaggtttagggtactcgagcaggggcttgaaaagtgcacccaggccacccgcgcatacatacaggagttccaggagttttccaagaacatcagcgttatgttgggccggtgtcaaacatataccagcgaatacaagtctgcggtgggaaatctggctcttcgcgtcgagcgagcccagcgtgaaattgactacatccagtatctgagagaggctgatgaatgcatcgaaagtgaggacaagaccttggctgaaatgctcctgcaagaggcagaggaagagaagaaaatccgaacattactaaacgcttcgtgcgacaacatgcttatgggcataaagtcgttaaagatagtaaagaaaatgatggatactcatggctcctggatgaaagatgccgtctacaattccccaaaagtctacctgctgatcggcagccgcaataacactgtatgggagttcgccaacattagggcctttatggaggataatacaaagcccgcaccacggaaacaaatcctcactctgagctggcaaggtacagggcaggtgatctacaaaggttttctgttcttccacaaccaggcaacatctaacgagattatcaagtacaatctccaaaagcgcactgtggaggaccggatgctacttccagggggagtgggacgggctcttgtgtaccagcactccccgagcacctacatcgatctggcagtggacgagcacggcctctgggccatccattcaggccccggtactcactcccacctcgtcctgactaaaatcgagcccgggacacttggggtagagcacagttgggatacgccttgtagaagccaggacgctgaagctagctttttgttgtgcggagtgctgtatgtcgtctattccaccggagggcaggggccccacaggatcacatgtatctatgacccgcttggaacgataagtgaggaggatctgccaaatctgttcttccctaaaaggcctcgctcccattccatgatccactacaatcccagagacaagcagctgtacgcgtggaacgaggggaatcagattatctacaagttacagacgaagaggaagttacccctgaagtag

SEQ ID NO: 9953 - DNA, 975 bp, Artificial Sequence
  Description of Artificial Sequence: Synthetic coding sequence
atgcggagcctgctgctgctgagcgccttctgcctgctggaggccgcccttgcagccgaggtgaagaaaccagctgctgctgctgctccgggcacagctgagaagctgagccctaaggccgccacactggccgaacgttctgcaggccttgctttcagcctctatcaggccatggcaaaggatcaggccgtagaaaatatcctcgtgtctccggtggttgtggcatcgagtctggggctcgtgtctttaggtggcaaggcaacaactgcctcccaggccaaagccgtgttatcagccgaacagctacgtgatgaagaagtgcacgctgggctaggggagctcctccggtccctgtccaacagtaccgcacggaacgtgacctggaagctggggtcccgcctgtacggtccaagctctgtgagctttgccgacgactttgtccggtcttcaaagcaacattataattgcgagcactccaagatcaacttcagagataagaggtcagccctgcaaagtataaatgaatgggctgcacagactacagacgggaaacttcctgaagtgaccaaggatgttgagcgcaccgatggcgcgttgttagtgaatgccatgttttttaagccccactgggacgagaaatttcatcataaaatggtggataaccgcgggtttatggtgacccgcagctataccgtgggagtgatgatgatgcacaggactgggctgtacaactattatgacgacgaaaaggaaaagctgcagattgttgaaatgccccttgctcataaactgtcctctctcatcattctgatgccgcatcacgtggagccactggaaaggttggagaaacttctgactaaagagcagctgaaaatctggatgggtaagatgcagaagaaggctgtggccatttctctccccaagggcgtggtggaagtaactcacgacctgcaagtccgcggggggcctgcttag

SEQ ID NO: 9954 - DNA, 990 bp, Artificial Sequence
  Description of Artificial Sequence: Synthetic coding sequence
atggtgagcaagagccggtggaagctgctggccatgctggccctggtgttggtggttatggtgtggtatagcatctccagagaggatagtttctacttcccaattccggaaaagaaagagccctgcctgcagggtgaggctgagagcaaagccagtaaacttttcgggaactatagcagagaccagccgatcttcttgagactggaggattacttttgggttaaaacaccgtctgcctacgaattaccttatgggacaaagggcagcgaggatttactgcttagggtgctggccattactagcagctcaatccctaaaaatattcaatctctgcggtgtagacgttgcgtggtggtcggcaacggccatcgacttagaaattcgagtctcggcgatgctattaacaaatacgatgtggtcattcgcctaaacaatgcacccgtcgcaggctatgagggggacgtcgggtccaagaccacaatgcgtttgttctatccagagagcgctcatttcgacccgaaagttgagaacaatcctgatacgctgctggtgcttgtggctttcaaggccatggattttcactggatcgagacgatcctgagcgacaaaaagcgagtgcggaaaggcttctggaaacagccccctctgatctgggacgttaatccaaagcagatccgcatcctaaacccattttttatggaaatcgcggccgataagctgctcagcctgcccatgcaacagccccgcaagataaaacagaagccaactactgggcttctggccatcacactggctcttcatttgtgtgatctggtacacatcgccggcttcgggtaccctgatgcttataataaaaagcaaaccatccattattatgagcaaattaccttgaagtctatggcgggtagtggccataatgtcagccaggaggctctggccattaaacgaatgctggaaatgggcgctatcaagaacctgacttccttttag

SEQ ID NO: 9955 - DNA, 351 bp, Artificial Sequence
  Description of Artificial Sequence: Synthetic coding sequence
atgcggaccctgttcaacctgctgtggctggccctggcctgcagcccagtgcacacgacacttagcaagagcgatgccaagaaggccgcgagtaagaccctgttggagaaatcacagtttagtgacaagcctgtgcaggatagaggcctagtcgttactgatctgaaagccgaaagcgtggtgttagagcaccgatcttattgcagtgcgaaggcccgcgatcggcacttcgccggagacgttcttgggtatgtgaccccctggaatagtcatggatacgacgtcaccaaagttttcggcagcaagtttacacagattagtcctgtgtggctacagctgaagagaaggtag

SEQ ID NO: 9956 - DNA, 282 bp, Artificial Sequence
  Description of Artificial Sequence: Synthetic coding sequence
atggacagcctgcggaagatgctgatcagcgtggccatgctgggcgccggtgccggcgtgggctacgcattacttgttatcgttaccccaggcgagaggagaaagcaggagatgctaaaggaaatgccactgcaggatcccagaagtagagaggaagctgctcggacgcaacaacttctcttggcaacattgcaagaggccgcaaccacacaggagaacgttgcatggcgtaaaaactggatggtgggcggtgagggcggggcgggaggtcggtccccttag

SEQ ID NO: 9957 - DNA, 255 bp, Artificial Sequence
  Description of Artificial Sequence: Synthetic coding sequence
atgcggcccaagaccggccaggtgggctgcgagacccccgaggagttgggccctggcccacggcagaggtggccgctgttactcctcggcctcgccatggtcgcgcacggcctgctccgaccaatggtggcccctcagtccggcgacccagatcccggagcaagcgttggttcaagtagatctagtctgaggtctctgtggggtcgttccgcacaaggccaaccccactgccattctgtccccgccctgctttag

SEQ ID NO: 9958 - DNA, 27 bp, Artificial Sequence
  Description of Artificial Sequence: Synthetic coding sequence
atgagcctggacatccagagcctgtag

SEQ ID NO: 9959 - DNA, 576 bp, Artificial Sequence
  Description of Artificial Sequence: Synthetic coding sequence
atgctgatcttctggaccatcaccctgttcctgctgggcgccgccaagggaaaagaggtctgttacgaagatctaggatgcttctccgacactgagccctggggcggcacagctatacgacccttgaaaattctcccttggtcaccagagaagattgggacgcgctttctgttatataccaacgaaaatcccaacaattttcaaatcctgcttctgtctgacccttccacaatagaagcctccaactttcagatggaccgcaagactcggttcatcatccacggatttatcgataagggagacgagagttgggtgaccgatatgtgtaaaaagttgttcgaggtggaggaggtgaattgtatatgtgtagattggaaaaagggaagtcaggctacatacacacaagcggcaaacaacgtaagagtggttggggcacaggtggcacaaatgctcgacattctcttaacagagtattcgtatccaccatccaaggtgcacctcattgggcattcgctcggcgctcacgtggcaggcgaggccggcagcaagacccccgggctcagccgcatcacctag

SEQ ID NO: 9960 - DNA, 123 bp, Artificial Sequence
  Description of Artificial Sequence: Synthetic coding sequence
atgagcctggacatccagagcctggacatccagtgcgaggagctgtccgacgcacgatgggcagaactcctgcccctacttcagcagtgtcaggtggtgagactagatgactgcggactgtag

SEQ ID NO: 9961 - DNA, 648 bp, Artificial Sequence
  Description of Artificial Sequence: Synthetic coding sequence
atgcggcccaagaccggccaggtgggctgcgagacccccgaggagttgggtcccgggccaaggcagcggtggcccctgctgttgctgggactcgccatggtagcacatggtctcttgcgcccaatggtggccccccagtccggcgacccggatcccggagcaagcgttgggagttcaagatcttccctaaggtctctgtggggaagtaggctgctcctccagccctctccacagcgcgctgaccctagatgctggccccgcggattctggagtgaaccccagtcactatgctacgtcttcggcactggtaccaaagtgaccgtgcttggccagccaaaggctaatccaacagtcactctgttccccccttcctctgaggagttacaggctaataaggctacactggtgtgcctgatctctgatttttacccgggcgcggtgaccgtggcttggaaggctgacggaagccccgtgaaagccggggtggagaccactaagccctcgaagcaatcgaacaataaatatgcggccagctcctacctgtctcttacgcctgaacagtggaaatcccaccgctcttattcctgccaagtgacccacgaggggagcaccgtcgagaagaccgtggctcctacggagtgcagttag

SEQ ID NO: 9962 - DNA, 999 bp, Artificial Sequence
  Description of Artificial Sequence: Synthetic coding sequence
atgtgccccgccggctggaagctgctggccatgctggccctggtgctagtggtcatggtgtggtactccatcagcagagaagacaggtatatcgagttgttctatttccccatccccgagaaaaaggagccctgccttcaaggcgaagcagagtctaaggcttctaagctgtttggcaactatagtcgggaccaacctatcttcctgagactcgaagactacttttgggtaaaaactccgagtgcctatgaactcccatatggcaccaaaggaagcgaggacctgctgctgcgggtccttgccataacttctagttcaatccccaaaaacatccaatccctccgctgcaggcgctgtgttgtcgttggaaacggccaccgcctgcgcaacagctccctgggtgatgccattaacaagtatgacgtggtgattcgcctaaacaatgctcccgttgcaggctacgagggggatgtcggttcaaagactaccatgagactgttttaccccgaatctgctcactttgatcctaaagtcgaaaataaccctgatactctcttagttcttgttgcctttaaggccatggacttccactggatcgaaactatcctttccgataagaagcgcgtgcgaaaaggtttctggaagcagccgccattaatctgggacgtgaacccgaaacaaattaggatcctaaatccattttttatggaaattgccgccgataagcttttgagcctgcctatgcagcagccacgtaaaatcaaacagaaacccactactggtttgttagcgattacgcttgcactgcatctgtgtgaccttgttcatatcgcgggcttcggatatcccgatgcttacaacaaaaagcagacgatccattactatgaacagattaccctgaaaagtatggccgggtctggacacaacgtttcacaagaggccctggcgataaagagaatgttagaaatgggcgccatcaaaaatcttacctcattctag

SEQ ID NO: 9963 - DNA, 888 bp, Artificial Sequence
  Description of Artificial Sequence: Synthetic coding sequence
atgcggagcctgctgctgctgagcgccttctgcctgctggaggccgctcttgcagcggaggtcaagaaaccagccgctgctgcggcccctggcacagcggaaaaactcagtccgaaagcagcgacactggcagagaggtccgccgggctggctttttccctgtaccaggcaatggcgaaagatcaagcagtagaaaacattctggtatcacctgtggtggtagcgtcatcactgggactggtaagtttgggcggcaaagcaactaccgcctcccaagccaaagctgtcctgtcagccgagcagctgcgggacgaggaagtgcacgccggtctcggcgaactgctaagaagcctgtctaactccaccgctaggaatgtaacgtggaagcttggatcgcgcctgtacggcccaagctctgttagctttgcagacgactttgtacggtcttccaaacagcattacaactgcgagcattccaaaattaattttcgggataagagatctgccttgcagtctattaacgaatgggccgctcaaactaccgacggaaagctcccggaagtaactaaggacgtggagcgaaccgacggggccctgcttgtaaacgcaatgttttttaaaccccactgggacgagaaatttcaccacaaaatggtggataatcggggattcatggtcactcgcagctacaccgtgggtgtcatgatgatgcaccgcactggtctgtacaattactacgacgacgagaaggaaaagctgcagatcgtggagatgccactggcccacaagctcagctctctgataattcttatgcctcaccatgtggaaccccttgaacggcttgaaaagttactcaccaaagaacagctcaagatctggatggggtag

SEQ ID NO: 9964 - DNA, 399 bp, Artificial Sequence
  Description of Artificial Sequence: Synthetic coding sequence
atgcggaccctgttcaacctgctgtggctggccctggcctgcagccctgtgcataccaccctgtccaaatctgatgctaaaaaggccgcatccaagactttactggagaagtcacaattcagcgacaagccagtccaggatagagggcttgtggttactgacttgaaggccgagtctgtggtacttgagcatcgaagctattgctctgccaaggcacgtgacagacattttgccggagacgtgctaggctatgttacgccttggaattcacacggttatgacgtaacgaaggtgttcggctccaaatttacccagatctcccccgtgtggttacagctcaagaggagaggacgcgaaatgtttgaagtgaccggcctccacgatgttgaccaaggctag

SEQ ID NO: 9965 - DNA, 360 bp, Artificial Sequence
  Description of Artificial Sequence: Synthetic coding sequence
atgcggaccctgttcaacctgctgtggctggccctggcctgcagccctgtacatacaactctgtccaaaagtgatgccaagaaggccgcatctaagactttgttagaaaagagccagtttagtgacaaacctgtccaggatagggggctggtggtgactgatttgaaagctgaatctgttgttctggaacataggtcttactgtagcgccaaagcccgcgacagacacttcgccggggacgttcttggctacgtcactccttggaacagccacggttacgatgtgactaaggtgtttggctctaaattcacgcagatctcgcctgtgtggcttcagctgaagcgccgcggccgagagtag

SEQ ID NO: 9966 - DNA, 390 bp, Artificial Sequence
  Description of Artificial Sequence: Synthetic coding sequence
atgcccatggccagcccccagaccctggtgctgtacctgctggtgttagccgttaccgaagcatgggggcaagaggccgtgattcccgggtgtcaccttcatcctttcaatgtcactgtaaggagtgaccgtcagggcacctgtcagggaagtcacgtggcccaggcctgtgttgggcattgcgagagtagtgcctttcccagccgttactctgtgctggtggccagtgggtacaggcacaatataaccagcgtgtcgcagtgctgcactatctctgggttaaagaaagtgaaggtgcagcttcagtgcgttggctctcgaagagaagaactcgagattttcacagcccgcgcatgtcaatgcgatatgtgccgcctctcgaggtactag

SEQ ID NO: 9967 - DNA, 1386 bp, Artificial Sequence
  Description of Artificial Sequence: Synthetic coding sequence
atgagcctggacatccagagcctggacatccagtgcgaggagctgagtgatgcacgctgggccgagctgctgccactgttacagcagtgtcaggtcgtgcggctggacgattgcggcctaaccgaggctcggtgcaaggacatcagcagcgcactccgcgtaaaccctgccttagcagagttaaacctccgtagcaacgagctgggtgatgtgggtgtgcattgtgtgctccagggcctccaaactccctcatgtaagatccaaaagctttcgttacagaattgctgcctgacaggcgcaggatgtggggtgttaagttccaccctgcgtaccctgcccaccctgcaagagctacacttatctgataatcttctgggcgacgctgggctccagctgctgtgcgaaggtctcctggacccccagtgcaggctggagaagctgcagttagaatattgtagcctctccgccgcgtcctgtgaaccactcgcctccgtgcttagagctaaacctgactttaaggaattgacggttagtaacaatgacattaacgaggctggggttagagttctttgtcagggcttgaaggacagtccttgtcagctggaagctctgaagctggagtcctgcggggtcacttctgacaactgtagagacctgtgcggcatcgttgcttctaaagcctcactcagagaactggcattggggtccaacaagctcggtgatgttggcatggccgagctgtgtcctggcttattacacccctccagcagacttcgcacactctggatatgggaatgcggtatcaccgccaaagggtgtggggacctatgcagagtcctgcgtgctaaggaatccctgaaagaactgagccttgccggaaacgagctcggtgatgagggggccagattgttatgtgagacactgctcgagcccgggtgccagctggagagtctgtgggtgaaaagctgttccttcaccgccgcctgttgtagtcacttcagcagcgttctcgcgcagaatagattcctcctggagctgcaaatctctaataaccgtcttgaagacgcaggagtgagagagctgtgtcagggactggggcagccgggcagcgttcttcgggttttgtggctcgccgattgtgacgtgtctgattcatcatgcagtagtttggctgctacattgctcgcgaaccactcccttcgcgaactggaccttagcaataactgcctcggggatgccgggatacttcaactggtagaatctgtaagacagcccggctgtctgttggagcagctcgtgctgtacgacatttactggtccgaggaaatggaagacaggttacaggccctggaaaaggataaaccctctctgcgcgtcatctcttag

SEQ ID NO: 9968 - DNA, 453 bp, Artificial Sequence
  Description of Artificial Sequence: Synthetic coding sequence
atgcggagcctgctgctgctgagcgccttctgcctgctggaggccgctctagccgcggaggtgaagaaaccagccgccgctgcagctcccgggacagccgaaaagttgtctcccaaggccgccaccctggcggaacgcagcgccggactggctttcagtctctaccaggctatggccaaggaccaagccgtcgaaaacatactcgtcagccccgtggtggtcgcaagctctctgggcctcgtgtcccttgggggcaaagctactactgcaagccaggccaaggctgtattatcagcggaacagctgagagacgaagaggttcatgctggcctgggcgagcttcttaggtctttgtccaatagcaccgcgagaaacgtgacctggaagcttgggtctaggctgtatggccccagtagtgtttcgttcgcagatgatttcgtgcggagttcatag

SEQ ID NO: 9969 - DNA, 1257 bp, Artificial Sequence
  Description of Artificial Sequence: Synthetic coding sequence
atgcggagcctgctgctgctgagcgccttctgcctgctggaggccgctttggctgcagaggtaaaaaaacccgctgctgccgctgcaccaggaactgcggaaaaactctctccaaaggcagcaacgctcgccgaacggtctgccggcctcgctttttcactgtatcaggctatggcgaaggatcaggcagttgagaatatccttgtcagtcctgtcgtggtggcatcttcgctagggctagtgagcctcggcggaaaagccacaaccgctagccaggctaaagcagtgctttccgcagaacaactgcgggacgaagaggtgcatgcaggtctgggcgagctgctgcggagcctttctaatagtactgccagaaatgtaacctggaaactgggatctcgcctctacggaccttccagtgtgtccttcgcagacgacttcgttagatctagtaaacagcactataattgcgaacacagtaagatcaactttcgcgacaagcgctccgcgctacagagtattaatgagtgggcggcccagaccacagatgggaagcttcctgaagtgaccaaggacgtcgaacgcaccgacggagctctgctggtcaacgcaatgttcttcaaaccacattgggatgagaagtttcaccacaaaatggtggataacagagggttcatggtcacgaggtcatacaccgtgggagtcatgatgatgcaccggaccggattgtacaactactatgacgacgagaaggagaaacttcaaattgtagaaatgccccttgcccacaagctctcatcgcttatcattctcatgcctcaccatgttgagccccttgaacgcctggagaagctactgactaaagaacagctgaagatatggatgggaaaaatgcagaaaaaggcggttgcaatatctctgcccaagggtgtggtcgaggtaactcatgacctccaaaagcatctggccggattgggtctgaccgaagccatcgataaaaataaggccgatctgagcaggatgagtggaaagaaagacctgtaccttgcatcagtctttcacgccactgctttcgagctggacacggacgggaaccccttcgatcaagatatttacggcagagaggagctccgatcccccaagcttttctatgctgatcaccctttcatattcctcgtcagggacacacaatctggttcgctcctctttataggtaggctcgttcgccccaagggcgacaagatgagggatgagctctag

SEQ ID NO: 9970 - DNA, 1002 bp, Artificial Sequence
  Description of Artificial Sequence: Synthetic coding sequence
atggtgagcaagagccggtggaagctgctggccatgctggccctggttctggtggtcatggtgtggtatagtatcagtcgcgaagatagatatatcgagctgttttatttcccgattccggaaaaaaaggagccctgcctgcaaggagaggccgaatcaaaggcctctaaattattcggaaattactcacgggaccagcccatctttttacgcctggaggactacttctgggtgaaaaccccttctgcctatgagttgccttacggtacaaaaggatccgaagacttacttcttcgggtgctggcaattacatcttccagtatacctaagaacatacagtcactgaggtgccgccgctgcgttgtggtgggaaacggccacagactcaggaacagctcccttggagatgctatcaataaatacgacgtcgtaatccgcttgaacaatgcccccgtggctggatacgaaggagacgtcgggagtaaaacaacaatgcggctgttctaccctgagagcgctcactttgaccccaaggtcgagaataaccccgataccctcctggtgctggttgcctttaaagctatggacttccattggatagagacgatcctgtctgacaaaaagcgcgtcaggaaggggttttggaaacagccccccctaatctgggatgtaaatcctaaacaaataagaattttgaatccgtttttcatggagatcgcagctgacaaattactctctctcccaatgcagcagccccgcaaaataaagcagaagcccacgaccggcctactggccatcacacttgcactgcatctttgtgacctcgtgcatatcgccggcttcggatatccagatgcatacaacaaaaagcagactatccactactacgagcagatcaccttgaagtctatggctggcagcgggcataatgtctctcaggaggcgctggctatcaaacggatgctggaaatgggcgcgatcaagaaccttacctctttctag

SEQ ID NO: 9971 - DNA, 987 bp, Artificial Sequence
  Description of Artificial Sequence: Synthetic coding sequence
atgtgccccgccggctggaagctgctggccatgctggccctggtgctggtggttatggtttggtatagcatttcacgcgaagactctttttacttccctatcccggagaagaaggagccttgcctccagggcgaagccgagtcaaaagcctccaaactgttcggaaattattcccgcgaccagccaatttttctcagactcgaggactacttttgggtgaaaaccccttcggcctacgagcttccttacggcaccaagggttccgaggatttgctcttgcgcgtgctcgctatcacctctagttctattccaaagaacattcagagcctacggtgccgtcggtgtgtagtggtcggaaacggacacagactgcgaaatagcagcttgggggacgccattaataagtacgacgtcgttatcaggctgaataacgcccccgtggcgggctacgagggtgacgtgggcagcaaaactacaatgcggcttttttatccggagagcgcccacttcgatcctaaggtggagaacaatcctgatacactactggtcctggtggccttcaaagccatggacttccattggatcgaaacgatcctttctgacaagaaaagagtacgaaagggcttctggaaacaaccgccacttatctgggatgtgaacccaaaacagataagaattctgaacccttttttcatggaaattgcggctgacaagctcctgtccctcccgatgcagcaacccaggaaaattaaacagaagcctactacaggcctactggctattaccctggcactacatttatgtgacctcgttcatatcgcagggtttggatatcctgatgcttacaacaagaaacaaacgattcactactacgagcaaatcaccctgaaaagtatggctggcagtggacacaacgtgtcacaggaggctctggcgattaaacgcatgctggagatgggcgcaatcaagaatttgacatccttctag

SEQ ID NO: 9972 - DNA, 585 bp, Artificial Sequence
  Description of Artificial Sequence: Synthetic coding sequence
atgaccatgcggcacaactggacccccgacctgagccccctgtgggtgctcctgctgtgtgcacatgtggtcacactgctggtaagggccactcctgtctcacagactacaacagccgccacagcgagcgtccgcagcacaaaagacccgtgtcccagccagccccctgtgtttccagctgccaaacaatgtcccgccctcgaggtgacttggcccgaagtagaggttccactcaacggcaccctgagcctctcttgcgtcgcttgctctcgctttcctaatttcagcatcctctactggctgggcaacggcagtttcattgaacaccttccaggcagactctgggagggttcgaccagtcgcgagcgcggttccacgggcactcagctgtgcaaggcactggtgctggagcaactgacgcctgcactgcacagtacaaacttctcttgtgtgcttgtagaccccgagcaggtggtgcagcggcatgtggtgctcgcccagctatgggcagggttgcgggctacattgccccccactcaagaggcactgccaagtagtcattcaagcccccagcagcaaggatag

SEQ ID NO: 9973 - DNA, 1386 bp, Artificial Sequence
  Description of Artificial Sequence: Synthetic coding sequence
atgagcctggacatccagagcctggacatccagtgcgaggagctgtccgacgcaaggtgggccgagctgctgccactgctccaacaatgccaagtagtaaggcttgatgactgtggactgacagaggcacgatgcaaagatatatcctcggcactgcgggtgaaccctgctctcgccgaactgaatctgcggagtaatgagttgggagatgtaggcgtccattgtgttttacagggcctgcagactccaagctgcaaaatacagaaactaagtctccaaaattgttgcctcactggcgcaggatgcggtgtgttgagttcgacactaaggacactcccaaccctccaggagctgcacttatccgacaatctgctgggggacgccgggctccagctactgtgcgagggcctgctggaccctcaatgccgcctggagaagctgcagctggaatactgctctctctctgccgcaagctgcgaaccgctggccagtgtgctgagggccaaaccggactttaaggagctgactgtttcaaacaacgatatcaacgaggccggcgtacgcgtgctgtgtcagggtctgaaggattcaccttgccagcttgaagccctgaagctggaaagctgtggcgtgacctcagataactgcagggatctatgtggaattgtggcatccaaagccagcttgcgcgaactggcactgggcagtaacaagttaggtgatgtcggcatggctgagttgtgtccaggactcctgcatccctcatcgcgcctccggacgttgtggatttgggagtgtggaatcaccgccaaaggatgcggcgacttatgcagggtcttgagggcaaaggagagcttgaaagaactgagcctggccggcaacgaactgggggacgagggcgctaggctgctatgcgagacactcttggagccgggttgtcaactggaaagtttatgggtcaaatcatgctccttcaccgctgcttgctgctcccacttttctagcgtgttggcccagaatagatttttgttggaactgcagatcagcaacaatcgcctagaggatgctggcgtcagagagctttgccagggattggggcaaccgggatctgtcttgcgcgtcctgtggctggccgactgtgacgtctcagactcatcctgttcatcactcgctgctacattgctcgcaaatcattccttacgagaactggaccttagtaacaattgcctgggcgacgcgggaatcttgcagctggtggaaagcgtccgccaacccggctgtttgctcgagcagctggtcctttatgatatttattggtccgaggagatggaggacaggctgcaagccctcgaaaaggataagccatctcttcgcgttatcagttag

SEQ ID NO: 9974 - DNA, 1995 bp, Artificial Sequence
  Description of Artificial Sequence: Synthetic coding sequence
atgccccaggcccccagcaccggcagcagcctgatccgggacccctctattgcacaccggaatacccagatcttgtggaccgaggcgggacgtgacctggctcaggacaccaggtacacaggggaggagagcctgaccatatttgtggacaaacggaaactttcgaagcgcgccgaaggctccgattccactacaaattcgagctcagtgacactggagactttgcatcaactcgccgcatcttactttatcgatagggactccacacttagacggctccaccacatccagattgcctccaccgcaataaaggtcactgagacccgcacaggacctctcgggtgctctaactacgataacctcgactcagtttcttccgtgctggtgcagtctcccgagaataagatccagctgcagggcctgcaggtacttctgccggactacctccaggagcggtttgttcaggccgcattatcctatatagcatgcaattctgaaggcgagtttatatgcaaagagaacgattgctggtgccattgtgggccaaagttccccgaatgtaactgccccagcatggatatccaggccatggaggagaatcttcttcggatcactgagacatggaaggcatataatagcgacttcgaggagtctgatgaatttaagttgttcatgaaaaggttgccaatgaactatttcctaaatacctccactataatgcacctatggaccatggattctaattttcaaagacgatacgagcaattagaaaactccatgaaacaactctttttgaaggcacagaagatcgtacacaagttattcagcctgtccaagaggtgtcacaagcagcctctgatctccctgcccaggcagcggacatccacatattggttgactcggatccaatcgtttctatattgtaacgaaaacggcttgctgggctccttttcagaggaaacccactcctgcacctgccctaacgaccaggttgtctgcaccgcatttctgccttgtaccgttggggacgcctctgcctgtctgacctgcgcccctgacaatagaacacgttgtggcacatgtaatacagggtatatgctgtcacagggcctgtgtaagcctgaggttgccgaatctactgatcattacattggctttgagactgacctccaagacctagagatgaaatacttactccagaaaaccgacagacggatagaagttcacgccatctttatctctaatgacatgcgcctgaactcgtggttcgacccgtcctggcggaaaagaatgctcttgaccctaaagtccaataagtacaagtcttccctggtccatatgatacttggtctttctcttcaaatttgcctgaccaagaacagtacccttgaacctgttttagccgtgtatgtcaaccctttcggcggaagccactccgagagttggttcatgccggtgaatgaaaattcctttcccgattgggagcgcacaaaactcgatcttccactgcagtgttacaattggacactgacactgggcaataaatggaaaacatttttcgaaacagtgcatatctatctgaggtcccgcatcaagagcaacggccctaacggcaacgagagcatctattacgaaccactagaatttattgatccaagtaggaatcttggctacatgaagatcaataacattcaggtctttggctatagcatgcattttgatccggaagcgatcagagatctgattctccagttggactatccgtacactcagggatcgcaggacagtgcactgttgcagcttctagagatccgcgaccgagtgaataaactcagccctcctggccagcgaaggctcgatttgttcagctgcctgctgcgacatcgtctaaaactgtccactagtgaggttgttagaattcaatctgccttacaagcctttaatgccaagctgcctaatacaatggattatgatacaaccaagctgtgctcatag

SEQ ID NO: 9975 - DNA, 459 bp, Artificial Sequence
  Description of Artificial Sequence: Synthetic coding sequence
atggcccgggactacgaccacctgttcaagctgctgatcatcggcgacagcggagtggggaagtcgtccctcctcctgcggttcgctgacaatacctttagcggctcttacatcacaacaatcggcgtggattttaagattcgcactgtcgagataaatggggagaaggtgaaactacagatttgggacacagccggacaggaacggttcagaaccattacctctacttattatagggggacacacggagtaattgtcgtctatgacgtgactagcgccgagagctttgtcaatgttaagcgctggcttcacgaaatcaaccagaactgtgatgacgtatgcaggattctggatgtacagctccatcacggcgcaggccctccttccaaagaacggcaaccagggaaaaccgctgccgccacgaccgagcgctgcggggaggcccacgaggagcagtag

SEQ ID NO: 9976 - DNA, 696 bp, Artificial Sequence
  Description of Artificial Sequence: Synthetic coding sequence
atgctgtacatcggcatcgccgagtacttcttcaagagcgccagcttcgcccacttcactgctggggtctttaatgttactctgtccaccgaagagattagtaaccatttcgtccagaacagccaaggcctgggcaacgttcttagccggatcgctgagatctacatcctgtcgcagcccttcatggtgaggataatggcaactgagccaccgattataaatttgcagccaggcaattttactctcgacatccccgctagtattatgatgctgacccagccaaagaacagtacagtcgagacaatcgtctccatggatttcgtggcctccacgtcagtaggcttggttatcctcgggcaacggctggtctgttccctgtccttaaatcgcttcaggctcgcactgcctgagagcaaccggtccaacatcgaggtgcttaggtttgagaatatactgtcctcgatactgcacttcggtgtgctccccctggccaatgccaaattgcagcagggattcccgctaagcaacccccataaattcttgttcgtcaattcagacatagaggtgttggaaggtttcctgctaatatctacagacctgaaatatgaaactagctcaaaacaacagccctcgttccatgtttgggaagggctgaacctgatcagcaggcagtggcgaggcaaatcagccccctag

SEQ ID NO: 9977 - DNA, 1911 bp, Artificial Sequence
  Description of Artificial Sequence: Synthetic coding sequence
atgaccacctggagcctgcggcggcggcccgcccggaccctgggcctgctgcttctagtggtcttggggttcctcgtgctccggcgcttagattggagtacccttgttccacttagactgaggcacagacaattaggcctccaggccaagggatggaatttcatgcttgaggactccacattttggatatttggaggctcaatccactacttccgggttccacgagagtattggagagacagactgctgaagatgaaggcctgtggactgaacacgctgaccacctatgtgccctggaacctgcacgaacctgagcggggtaagttcgacttcagtggcaacctcgacctggaggcatttgtgcttatggccgcagaaatcggcctatgggtgatcctacggcccggcccttatatctgttccgaaatggatttaggcggattgccgtcctggctccttcaagacccaggcatgagactgagaacaacgtacaaaggcttcacagaagctgttgatctctatttcgaccatcttatgtcccgtgttgtgcctttgcaatacaaaagaggcggtccaattattgccgttcaggttgagaacgagtacggcagctataacaaagaccctgcatacatgccatacgttaagaaggccctcgaggaccgcggaatcgtagaactgctcctgacgagcgacaacaaagacggtctgagcaaaggaatcgtgcagggcgtcctggccaccatcaacttgcagtctacccacgagcttcagctcctgacaacattcttgtttaacgttcaaggcacacaacccaagatggtaatggagtattggactggctggttcgattcctggggaggccctcacaacatactcgactccagcgaagtcttgaagactgtctctgccatcgtcgatgccggctcctcaatcaacctgtatatgtttcatggaggaaccaacttcgggttcatgaatggggccatgcacttccacgactataagtccgacgtgaccagttacgattacgacgcagtcttgacagaggcaggagactacacagccaaatacatgaagctgagggatttctttggaagcatcagcgggatcccgcttccgcccccaccagatcttcttcccaaaatgccgtatgagccactcaccccagtactctatctgagcctctgggacgccctaaaatacctgggggaacccatcaaaagcgagaagccaataaatatggagaacctgcccgtcaacgggggtaatggccaatctttcgggtatattctgtatgagaccagtataacgtcttctgggatcctatccgggcatgtccacgatcgaggccaagtgttcgttaataccgtgtccatcggattcctcgattataagaccacgaaaattgcggtacccctgattcagggttacaccgtgctgcggatcctcgtcgagaatcgaggacgggtgaattatggcgagaacatcgacgatcagcgcaagggactgatcggaaatctctacttaaatgattcccctctgaagaattttagaatctacagcctggacatgaagaagtctttctttcagaggtttggcctggataaatggtcgtctctgccagaaacaccgactctgcctgcttttttcctgggtagcctcagcatcagcagcaccccttgcgacacatttcttaaactggagggctgggaaaaaggcgtggtgtttattaatggccagaatcttgggaggtattggaacatcggaccacagaaaaccttataccttccaggcccttggctgtcgtccggaatcaatcaagttatcgtcttcgaggagactatggcaggccctgctctgcagtttactgaaaccccccatttgggaagaaaccagtacatcaagtag

SEQ ID NO: 9978 - DNA, 1374 bp, Artificial Sequence
  Description of Artificial Sequence: Synthetic coding sequence
atgggctgcagcctgcccctgagctgcatcatggtgcggagcgtggcgtgggctgggtttatggtgcttctcatgatcccctggggcagcgccgcaaagctggtgtgttactttacaaattgggcccaataccgacaaggagaagcgcgcttccttcccaaagacttggacccttctctgtgtactcacctgatatatgctttcgcaggcatgactaatcaccaactgtctaccactgaatggaatgacgagacactttaccaagagtttaatggtcttaagaaaatgttcaccgacatggttgccaccgcaaataaccgccagacatttgtaaattcagctattcgattcctgcggaagtattccttcgatggtcttgatcttgactgggagtatccaggctcacagggcagcccagccgtcgataaagaaagatttaccacactggtgcaggatctagccaatgccttccagcaggaggcccagacttcaggaaaggagagacttctgttatcagctgctgtccctgccggacagacctacgtcgatgccggatacgaggtcgataaaattgcgcagaacctggatttcgttaatttgatggcttacgactttcatggcagttgggaaaaggtcacgggccataacagccctctgtacaagagacaagaagaaagtggggctgcagccagccttaatgtagacgccgctgttcagcagtggctccagaaaggaactcctgcgagcaagttaatcctgggaatgccaacatacggtaggtcttttacccttgcttccagttctgataccagagtgggtgctcctgccacgggttccggcactccgggtccgtttaccaaggagggtggcatgctggcctattacgaggtatgttcctggaagggcgctactaagcaacgtatacaagaccaaaaggtgccttacatatttagagataatcagtgggtgggattcgacgatgttgagagctttaaaaccaaggtgagttacttgaaacaaaaagggctcgggggtgcaatggtgtgggcgttagatctcgatgacttcgctgggttttcgtgtaatcaggggagataccctcttatccagaccctccgccaggaactcagtttaccctacctgccttccggcaccccagagcttgaggtgccaaagcctggccagcccagtgagcctgagcacgggcccagtcccgggcaagatacattctgccagggtaaagctgacggtctgtacccaaatcctcgcgaaagaagctcattttatagctgcgccgctggccgcctgttccaacaatcctgtcccactgggttggtgtttagcaattcctgtaaatgctgtacatggaattag

SEQ ID NO: 9979 - DNA, 1125 bp, Artificial Sequence
  Description of Artificial Sequence: Synthetic coding sequence
atgtacgtgagcacccgggagcggtacaagtggctgcggttcagcgaagactgtttatacctgaatgtttacgcgccagcccgggcgcctggagacccacagcttcctgttatggtttggttccctggtggagccttcatcgtgggcgctgcatccagctacgagggctctgatctcgctgcccgagagaaagtggtgctggtgttcctgcagcacaggctggggatttttggattcctgagatggcgggggcgaacagatgattcacatgcccgaggcaactgggggctcctggaccagatggcagccctgcggtgggtgcaggagaacatcgcggccttcggaggcgacccagggaatgttacattatttgggcagtcagccggagccatgtcgatcagcggcttaatgatgtctcccttggcaagcggcctgtttcatagggccattagccagtccggcaccgcactcttccggctgttcataacttccaatcccctgaaagttgccaaaaaagtggctcacctcgcgggatgtaatcataactcaacacagatcctggttaactgtttgcgggcactttctggtaccaaggtgatgcgggtgtccaataaaatgcgcttcttacagctcaatttccagagggaccccgaagaaataatttggtcaatgtcgcccgtggtggacggcgtggttatcccagatgaccctttggtgctgttgacccagggtaaagtatcttctgtgccttaccttctgggcgttaacaatctagaattcaattggttactgccttacattatgaaatttccgctcaataggcaggcaatgcgcaaagagacaattactaagatgctctggtccacccgtacattgctgaacatcacgaaagagcaggttccactagtggtggaggaatatttagataatgttaacgagcacgattggaagatgctacgtaaccgcatgatggatattgtgcaggatgctactttcgtatacgcaactctgcaaactgcccactaccatcgggagacaccgatgatgggaatttgtccagccgggcacgcaaccacaagaatgaagagcacatgctcgtggatactgcctcaggagtgggcatag

SEQ ID NO: 9980 - DNA, 384 bp, Artificial Sequence
  Description of Artificial Sequence: Synthetic coding sequence
atgaagaccggcctgttcttcctgtgcctgctgggcaccgccgccgcaatcccaactaatgcacgattgctgagtgatcattcaaagcccacggccgagactgtcgctcccgacaacaccgcgatcccctccttacgggccgaagccgaagagaacgaaaaagaaacagcggtgtccaccgaggacgactctcatcacaaagccgaaaaatctagtgttttgaagtccaaagaggaatcccacgaacaaagcgccgagcagggtaaatcatccagccaggaacttggtcttaaagatcaggaggactccgatgggcatcttagtgtgaatctagaatatgcccctacagaaggaacactggacattaaggaagacatgtcctag

SEQ ID NO: 9981 - DNA, 285 bp, Artificial Sequence
  Description of Artificial Sequence: Synthetic coding sequence
atgcggaccctggccatcctggccgccatcctgctggtggccctgcaggcgcaggccgagcctttacaagccagggccgacgaggtggccgcagcccccgaacagattgcggcagatatacctgaggtagtggtttcccttgcttgggatgagtctctggcccctaagcaccctggcagtcgtaagaacatggcgtgctattgccggataccagcctgtatcgcgggagagcggcgatacggcacatgcatctatcagggaaggctttgggcgttctgctgttag

SEQ ID NO: 9982 - DNA, 414 bp, Artificial Sequence
  Description of Artificial Sequence: Synthetic coding sequence
atggccgccctgagccgggccctgggccccctgcggacccccgcccctcctctatggattggcctatttctggtcgctactggaagccaacagtcactcgcccagccactgcccggaaacacgaccgaggctacacctcggtcactaagggccagcggctcgctttgtgggccacatgccaaggctccttatctctgcgaagccacacacgagcctgcggccgcgcgcattagagcccaagtgcccgacactcgctggtcccgggtgggggggcaaaggttctacagccgggtcctttcgcctctgcacagaggtccgagcggacacacagaagcaagtgcacagaggagccacatggggaagttgaaggagccacagccacaggaccacaagccagggctgggcgcaagctag

SEQ ID NO: 9983 - DNA, 228 bp, Artificial Sequence
  Description of Artificial Sequence: Synthetic coding sequence
atgctgaaggtgcactaccccaagttcggcgtgagcgaggactgcttgtatttgaatatatacgcaccagcgcatgccgacacaggttccaagctcccggtgttagtatggtttcccggcggcgcctttaaaacaggcagtgcatccatttttgacggcagcgccctcgccgcttacgaagatgttctggtggtggtcgtccagtaccgcttaggcatctttggctag

SEQ ID NO: 9984 - DNA, 1491 bp, Artificial Sequence
  Description of Artificial Sequence: Synthetic coding sequence
atggcccccgcccggaccatggcccgggcccggctggcccccgccgactgtctgaattcattcactgccggggtacctggttttgtgctggataccaacgcaagcgtgtcaaacggtgctacgtttctggaaagccccacagtgcgcagaggatgggattgcgtgagagcttgttgtacgacacagaactgcaatctggctctggttgagctgcagcccgatcgcggagaggacgccattgccgcttgtttcctgatcaattgtctgtatgaacaaaattttgtctgtaagtttgctcctcgcgaggggtttattaactacctgactagagaggtgtaccgaagttatcgacaactcagaacccaaggttttggcggctcgggtattcctaaagcatgggctggcattgatctgaaagtccagcctcaggaacctctcgtccttaaagacgtagagaacacagactggaggcttcttagaggagacactgatgtgagggtagagcgaaaagaccccaaccaggtggaactctggggcttgaaggagggtacttacctgttccaattaaccgttaccagctcagaccatccagaggatactgctaacgttaccgtgacagtattgtctaccaaacagacggaggattactgtctagcctccaataaagtcggacgatgccggggctcttttccacggtggtactacgatcccacagaacagatttgcaaatcttttgtctacggaggctgtctcggtaataaaaataattatcttagggaggaagaatgcattctcgcttgtaggggcgttcaaggggggcccctgcggggatcctcaggggctcaggccaccttcccgcagggcccatctatggaaaggagacacccagtctgtagtgggacctgtcagccgacgcagttcagatgcagtaacgggtgttgcatcgattcgttcctcgagtgtgatgataccccaaattgcccggatgcatcagatgaagccgcatgtgaaaaatatactagtggtttcgatgaactgcaacgaatccattttccgtctgacaagggccactgtgttgaccttcctgacaccggcttgtgcaaagagtctataccacggtggtattataacccgttcagcgagcactgtgcacgctttacctacggtggatgctacggaaataagaacaatttcgaggaggagcagcagtgtctggaatcttgcagaggaatttctaagaaggacgtgttcggtctgcgccgcgagatccccatccctagtacggggtcagtggagatggcagttgccgtatttctggtaatatgcatcgtggtggttgttgcaatactaggctactgcttttttaagaaccaacgaaaagactttcacggccaccatcatcatccaccccccactccggcatcttccactgtttcaactacagaagacaccgagcacctcgtgtacaaccacacaactagacccttatag

SEQ ID NO: 9985 - DNA, 528 bp, Artificial Sequence
  Description of Artificial Sequence: Synthetic coding sequence
atgccccccggcacccgggcctgccgggtgccccggcccggccggagggcgcccaggcccaggcgtgacggggagccaggtggccacggggttgctcccgctagtgccgaggaggtgggggcccgccctgggctccgtgcagttgctcgtctgctgccccagcagcacttgcaggccggctacgtctgcgaacgaaaggatcttctggtcaacggatgctgtaatgtgaatgtgccctctacaaagcagtactgttgcgacgggtgctggcctaatggatgctgctccgcctacgagtattgcgtctcatgctgtttgcagccaaataaacagctcttgcttgagcgatttctgaaccgggccgctgtggccttccagaacctcttcatggcagtggaagatcatttcgagctgtgtctcgccaagtgcagaacttcttctcagtctgtccaacatgaaaatacctatcgggacccaattgccaagtactgttacggggaaagcccacccgaattattcccagcttag

SEQ ID NO: 9986 - DNA, 1881 bp, Artificial Sequence
  Description of Artificial Sequence: Synthetic coding sequence
atggacctggtgctgaagcggtgcctgctgcacctggccgtgatcggggctctactcgcagttggggctaccaaagtacccaggaatcaagactggcttggggtatcacgtcagctgcggacaaaagcatggaataggcaactttatcccgaatggacagaggcccagcgcctggattgttggcgaggcgggcaggtgagtctcaaagtcagcaatgatggccctacacttatcggcgccaatgcctcgttttctatcgccttaaatttccccggtagccagaaagtgctgcccgacggccaggtcatttgggttaacaacaccatcatcaacggggatcaggtgtggggaggtcaacctgtgtatccacaggagaccgacgacgcctgtatttttcccgatggtggaccatgtcccagtgggtcttggtcacaaaagcggtcttttgtgtacgtgtggaagacctggggacagtattggcaggtcctgggaggcccagtatcaggccttagtatcgggaccggcagagctatgctcggtactcataccatggaggtgaccgtgtatcataggaggggcagtaggtcatacgttcctttagcgcacagctcctctgcgtttacgataacggaccaagtgcccttttctgtgtcagtgtctcagctacgagccctggacgggggcaacaagcacttccttcgcaatcagccccttacttttgctcttcagctacacgatcctagcggttatctcgcggaggccgatctgtcgtacacatgggattttggtgactcttccggcaccctgatctctcgggcccttgttgttacacatacatatctagaacccggccccgtcactgcccaggtagttttacaggcggccattcccttgacaagctgcgggtcttcacctgtccctggaactacggatggtcatcggccaacggccgaggctccaaatacaaccgccgggcaggtgcctacaacggaggtcgtgggaaccacccccggacaggcccctacggctgaacccagcggtacaacttccgtccaggtacccactacagaagtgatctctacagcgccggtccagatgcctacagctgagagtactgccgcacaggtgactaccacagaatgggtggaaactacagctcgcgaattgcccattcccgagcctgaagggcctgatgcttcatcgatcatgtccaccgaatccatcaccgggtcgcttggccctctgctggacgggacagctacattgaggctggtgaagcgtcaggtgcctttagattgcgtgctgtatcgttatgggtccttttcggtgacactggatattgtccaaggaatcgaaagtgcagagatcttacaggccgtgccctccggcgagggcgacgcatttgaacttaccgtgtcttgtcagggaggtctgcccaaggaggcttgcatggagataagttctcctggttgtcagcctcccgcacaaaggctgtgtcaaccggtgctgccttctcccgcttgtcagctcgttttacatcagatacttaagggcgggagtgggacctactgcttgaacgtcagtctcgcggacactaattctctggctgtcgtctcaacacagctaataatgcctgtgcccggcatcttactgaccggccaggaagccggactgggacaagtccccctgattgtgggaattctccttgtcctgatggcagtggttctggcatccctgatctatcggcggcggctgatgaagcaggatttctcggtcccccagctgccccactcttcctcccattggctgagattaccccgaattttctgctcgtgccccattggcgaaaactcaccactgttatctggtcagcaggtctag

SEQ ID NO: 9987 - DNA, 1611 bp, Artificial Sequence
  Description of Artificial Sequence: Synthetic coding sequence
atgcccaccctgtgcagcagcttcggcctgcaggtgctgctgcccgaatatctgagagagcggttcgtagcagccgccctctcatacattacatgctcaagcgaaggcgagctcgtgtgcaaggagaacgactgctggtgcaagtgttcacccacttttcccgagtgcaactgtcctgatgccgacattcaggcaatggaagactctctcctccagatccaggattcctgggcaacacataaccggcagtttgaggagagtgaagaatttcaggcccttctgaaacggttgcctgatgaccgctttctcaacagtactgccatctcacaattttgggcaatggataccagtctgcaacatcgctaccagcaacttggcgcaggcctgaaagtgctttttaaaaaaacccacagaatcctcagaagactctttaacctctgcaagagatgccaccgtcagcctaggtttcgtttgccgaaggaaagctctccaaggtcgctgtcttattggtggaataggatccagtcactcctctattgtggcgaatcaaccttccccgggacgttcctcgaacagagccatagctgtacatgtccctacgatcagtcctcatgccaggggcctatcccctgcgccctcggcgaggggccagcttgcgctcactgcgcaccagataacagcacgaggtgcgggtcctgtaaccctggatacgtgctggctcagggcttatgccgccccgaggttgccgagagtctcgaaaactttctcggtctcgagacagatttgcaggatttggaactcaagtacctgctgcaaaagcaggactcaaggatagaagtccattccatcttcatcagcaatgatatgcgactgggaagctggttcgatccctcctggcggaagcgcatgctgctcacactgaagagtaataaatataagcctgggctcgtgcacgtgatgttagctctgtcgttgcaaatctgcttgactaaaaattccaccctcgaacctgtgatggcaatctatgtgaatcccttcggcggaagccactccgaatcctggttcatgcctgtgaacgaaggctcctttccagactgggagaggacaaatgtggacgctgccgcccagtgtcaaaattggaccataaccctggggaatagatggaaaactttcttcgagaccgtccatgtctacctgcgctcccgtattaagtctcttgatgatagcagtaatgagactatttactatgagccccttgagatgaccgacccctcgaaaaacctggggtacatgaaaataaatactttgcaggtctttggttattccttgccatttgatccagacgcaattcgagacctgatcctgcagttggactacccatacacgcaagggagtcaagacagcgcattgcttcagctgattgaactccgtgatagagttaaccagctcagtcccccggggaaagtccgtctggacctcttctcctgtctcctgcgtcatcgtctgaagctagccaacaacgaagtgggtcgtatccaaagttcgttgcgagcctttaatagtaaattacccaaccccgtggagtatgagacaggaaaattatgcagctag

SEQ ID NO: 9988 - DNA, 423 bp, Artificial Sequence
  Description of Artificial Sequence: Synthetic coding sequence
atgagccagagcatcgaggtgctgaacctgcggacccagcgggacttccaatacgtgctcaaaatggagacccaaatgaagggactcaaggctaaatttagacaaatcgaggatgaccggaagacactgatgaccaaacatttccaggagctcaaagagaaaatggatgaactcctccctctgatccctgtgttggaacagtataagacggatgctaagctaatcacccaattcaaagaggaaatacgaaatttgagcgctgtgctgacagggatccaggaagaaattggtgcttatgactatgaggagctgcaccagcgcgttctgtctctggagacccggcttagagattgcatgaagaaacttatagacttgaagaagagaaaggaggaggaaaaacggcagcagaagggggaagcctag

SEQ ID NO: 9989 - DNA, 1119 bp, Artificial Sequence
  Description of Artificial Sequence: Synthetic coding sequence
atggcctacatcgagcagcggcggatcagccacgagggcagccccgtaaaacccgtggccatcagggagttccagaagaccgaagacatgaggcgctacctgcatcagaacagagttcctgccgaaccctctagcctgctgtccttaagcgcctctcacaaccaactatcccataccgatctggaactgcaccagcgacgcgaacagttggtcgagaggaccaggagggaggcccagcttgccgccctgcagtatgaagaggagaagattcgcacaaaacagatccagcgcgacgccgtgctcgatttcgtgaaacagaaagcctcacagagtccacaaaaacagcacccacttctggatggtgtggatggtgaatgcccctttcccagtcggcggagtcagcacacagacgactcagctctatgcatgagcctatccggcctgaaccaagttggatgtgctgccactctgcctcactcctctgccttcacccccctgaaatcggatgatcgtcccaacgcattgttatcctcgcccgccactgagacagtacatcatagccccgcttactcatttccagctgccatccagcggaatcagccacagcgccctgaatccttcctgttccgagcgggcgtgcgtgcagaaacaaataagggccatgcttctcctctgcctccctccgctgcaccaactacagatagcactgatagtatcaccggccagaactctcggcaacgagaggaggagttggaactcatcgaccagttgcggaaacacattgaatacagactcaaggtttcactcccctgcgacctcggcgcggcactgactgatggtgtcgtgttgtgccatctggctaaccacgtacgacctaggtcagttcctagcatccatgtgccatcccccgctgtacctaaactgacaatggccaagtgccggcgcaacgtggaaaacttccttgaggcctgccgaaagattggggttccacaagagcagttgtgcttgccactgcatatcttggaggagaaggggctgtcgcaggtagccgtgaccgtgcaagcattgcttgaactggcaccgcccaagcagcagcaacaccagctctcagccgtgtag

SEQ ID NO: 9990 - DNA, 1242 bp, Artificial Sequence
  Description of Artificial Sequence: Synthetic coding sequence
atggagaacatgctgctgtggctgatcttcttcacccccggctggacgctcatagacggaagcgaaatggagtgggatttcatgtggcacctgaggaaggtacccaggatcgtgtccgagcgcacattccacctcactagcccggcgttcgaagcagacgcaaaaatgatggtcaacactgtttgcggaattgagtgccaaaaggagttaccgacgccctccctgtcagaattggaagattatctgagttacgagaccgttttcgagaatggcacaaggactctcacacgcgtgaaggtccaagatctggtgctggaaccaacccagaacattaccactaaaggtgtgtcggtgaggagaaaaaggcaggtatatggaacagattccaggttttcgatccttgacaaacgattcctgaccaactttccattttctacggcagtgaagttgtccactggctgctccgggattctgattagcccacagcacgtgctcactgcagcacactgcgttcacgatggaaaagattatgtaaagggctccaaaaaacttcgcgtaggattgctaaaaatgcgcaacaaatcggggggaaagaagcgccgggggtccaagagaagtcgacgggaagccagcgggggagaccagcgagagggaactcgggagcacctgcgagagagggccaagggggggcggaggaggaaaaaatcaggacggggccagcgcatagccgaggggcgcccgagttttcagtggacccgagtgaagaacacccacatccctaaaggatgggcacgggggggcatgggggacgccaccctggactatgattacgctttgctggagttaaagagagcacataagaaaaagtatatggaactcggaatatcgcctaccataaaaaaaatgccaggaggcatgattcatttctcaggattcgataatgatagagctgaccagcttgtttatcgattttgcagcgtgagcgacgaaagtaacgacctactgtaccagtactgtgatgcagagtctggtagtactggatcgggcgtgtacctgcggctgaaggatcctgataaaaaaaattggaaaaggaagattatcgccgtctattcaggacaccagtgggtggacgtccacggagtgcagaaagattacaatgtggccgttcgaatcacccccctgaaatatgcccagatctgtctgtggattcacggcaacgatgccaactgtgcctatggctag

SEQ ID NO: 9991 - DNA, 2541 bp, Artificial Sequence
  Description of Artificial Sequence: Synthetic coding sequence
atgttcaagtgctggagcgtggtgctggtgctgggcttcatcttcttagaatctgaaggccgcccaactaaggaaggaggatacggcttaaagagctaccagccgctgatgaggctccgtcacaaggagaagaaccaggaatccagcagagttaaagggtttatgatacaggacggcccatttggaagctgcgaaaacaagtactgcgggctgggaagacactgcgttacctctcgcgagactgggcaagccgagtgtgcttgcatggatttatgtaagaggcattataagcctgtgtgtggcagcgacggtgagttttatgagaatcactgcgaagtccatcgcgcagcatgcttgaagaagcaaaagatcaccatcgttcataacgaagactgcttcttcaagggagacaaatgtaagaccaccgaatattcaaaaatgaagaatatgcttttggatctgcagaaccagaagtatataatgcaggaaaacgaaaacccgaatggcgacgacatttcaagaaaaaagttgctggtcgatcagatgttcaaatactttgacgcggattctaacggactagtagatatcaatgagctgacccaggtcattaaacaggaagaattgggcaaagacctgtttgattgcacactctacgtgctgttgaagtatgacgactttaatgccgataagcatttggctctggaggaattctacagagccttccaggtgatccaactatctcttcccgaagatcagaaactgtccattaccgctgccacggttggccaatcggctgtgttgtcctgcgcaatccagggaacattacgtcccccaatcatttggaaacgtaacaatatcattctcaataatctggatctcgaggacattaacgatttcggcgacgatggcagcctctacattaccaaggtcaccactacccatgtagggaattacacttgttacgccgatggatacgagcaggtgtaccagacacatattttccaggtgaacgtgccccccgtgattagggtgtaccccgaaagtcaggctagagagccaggggtgaccgcctcattacgttgtcacgcagaggggatcccgaagccacaattgggctggctgaaaaacggcatcgatatcaccccaaagttaagtaagcagttgacgctgcaggccaacggttctgaggtgcacatatctaacgtccgctatgaggatactggagcatatacctgcatagctaagaatgaggccggcgtggatgaagacatctcatcactttttgtggaggactcggccaggaagacactggcaaatattctgtggagagaggagggtctggggatcgggaatatgttttatgtgttttatgaagatgggattaaagtcatccagcctatcgaatgtgaattccagcggcatattaaaccctctgaaaaactgttaggttttcaggatgaggtctgtcctaaggctgaaggtgacgaggtccagcgatgtgtgtgggcatctgccgtcaacgtgaaagacaagttcatatatgtcgcacagccaacattggatcgcgtgctgatcgtggatgtgcagagtcaaaaggtcgttcaggcagtgagcaccgatcccgtgccagttaaacttcattacgataagtcccacgaccaagtgtgggtattgtcttggggcaccctagagaagacctctcctactctccaggttataaccttggccagcggcaatgttccccaccataccattcacacccagcccgtaggcaaacaatttgacagggttgacgacttcttcatcccaacaacgactctgataattacccatatgaggttcggcttcattctgcacaaagatgaggctgcacttcagaagatcgacttggagacaatgtcctacattaagacaattaatctgaaagactacaaatgcgttccacaaagcctggcttatactcacttaggaggatattacttcatcggctgtaaaccagactctaccggcgccgtgtccccacaggtaatggtggatggcgtgaccgatagtgttatcgggttcaactcggatgtgaccgggaccccgtatgtttcccctgacggccactacctggtgagcattaacgatgtgaaggggctggtgagagtacagtatataacaatacgaggagaaattcaggaagccttcgatatctataccaacctgcacatcagcgacttggcatttcagcctagctttaccgaggcacaccagtacaatatatatggatcatcctccacacagactgatgtgctatttgtcgagctgtcatctggcaaggtgaagatgatcaagagtttgaaagagccactgaaggccgaggagtggccatggaataggaaaaaccggcagatccaggactctggcctgttcggacaatacttaatgacaccctctaaagattcactgtttatcctagatgggagactcaataaactgaattgcgaaattaccgaggtggaaaagggtaacaccgttatctgggtcggggacgcctag

SEQ ID NO: 9992 - DNA, 582 bp, Artificial Sequence
  Description of Artificial Sequence: Synthetic coding sequence
atgctgggcgtgctggagctgctgctgctgggcgccgcctggctggccggtcctgcaaggggccaaaacgagacagaacccattgtcctcgaggggaagtgcctggtcgtttgcgactcgaatccaacgtccgatccaaccggaacagcccttggaatcagcgttcgatctggatccgcaaaggttgctttctccgccattaggagtactaatcatgaaccaagcgagatgagtaatagaacaatgattatttacttcgaccaggtccttgtgaacatcgggaataattttgactctgaacgttcaaccttcatcgcgccaaggaaggggatctacagcttcaactttcacgtggtgaaggtctacaatcgccagacgatacaggtaagtctgatgctgaacgggtggccggttatcagcgccttcgctggtgatcaagacgtcacccgggaagccgcttccaatggcgtactgatccaaatggaaaaaggcgaccgcgcttatctcaaactggaacgggggaatttgatgggcgggtggaaatacagtacttttagcggttttctagtattcccactgtag

SEQ ID NO: 9993 - DNA, 813 bp, Artificial Sequence
  Description of Artificial Sequence: Synthetic coding sequence
atgcacggcagctgcagcttcctgatgctgctgctgcccctgctgttgttgttagtcgcaaccactgggccagttggcgcactgacagacgaagaaaagcggctgatggtggaattacacaatctgtatagggcccaggtgtccccaaccgcgtccgatatgctccatatgaggtgggacgaggagctcgctgcatttgctaaggcttacgcccgccagtgtgtctggggacataataaggagcggggccggcgaggcgagaacttattcgctatcactgacgaggggatggatgtgcctctcgcgatggaggaatggcatcatgagcgagagcactataacctttctgcagctacatgcagtcctggacagatgtgtgggcattatactcaagtcgtgtgggctaagactgaaagaataggatgcggctctcacttttgcgagaagttacaaggggtggaagagactaatattgagctcctggtgtgcaattatgaacctccgggcaatgtgaagggaaaaaggccttaccaggaaggcaccccatgcagccagtgtccaagcggatatcattgcaaaaattccctctgtgaacccatcggaagccctgaggacgcccaggacctgccgtacctagtgacagaagcacccagtttccgtgctaccgaagcatcagattctcgcaagatgggagctgaaggaccggataaaccctccgtcgtaagtggactcaactcaggccctgggcatgtatggggccctctgctggggctcttactgctaccgccgttggtcctggccggcatcttttag

SEQ ID NO: 9994 - DNA, 702 bp, Artificial Sequence
  Description of Artificial Sequence: Synthetic coding sequence
atggaccaggtgttcatgatcgacagcaagtgcgagagcggcaagggccgttgcagcttcaaccccaatgttaacaccgtgagcgtgatgattaacgaggaactgtttagcggaatgtacattgacttcatgggaaccgatgccgcaatatttaggtccctgactaaaagaaatgctgtgcggacggaccagcacaattctaaatggctgagtgaacccatgtttgtcgacgcccacgttataccggatggaaccgatcccaacgacgctaaagtgtactttttcttcaaggaaaagcttactgataacaaccggtctacaaaacagatacactctatgatcgcacgtatttgcccaaatgataccggcggcctgagaagtctggtcaataagtggacaaccttcctgaaggcacgcctggtgtgctccgtcacagatgaagacgggcctgaaactcactttgatgaactagaagatgtctttttgttagaaacagacaatccgcggactaccctggtatacggaatcttcaccactagttcctcagtcttcaagggcagtgctgtgtgcgtgtaccatctgtctgatattcagacagtgtttaatggacctttcgctcacaaggaaggacccaaccaccagttgataagctatcagggacggattccctacccacgccccggaacgaatacttgtgtatag

SEQ ID NO: 9995 - DNA, 1368 bp, Artificial Sequence
  Description of Artificial Sequence: Synthetic coding sequence
atgctgcaccccgagaccagccccggccggggccacctgctggccgtgcttttggctctcttgggcacagcgtgggctgaggtttggcccccccagctgcaggagcaggccccgatggctggggcactcaatcgcaaggaatcctttctgttgctctctcttcacaatagattgcgctcctgggtacagcctcccgcggctgacatgagaaggctggactggagcgactctctggcacaactcgcccaagctagggctgcattatgtggcatacctaccccttctctggcgtccggtttatggaggacattgcaggtgggctggaatatgcagttgctgccagccggcctggctagcttcgtcgaggttgtctccttatggttcgccgaggggcagcggtactcacatgctgccggggaatgtgccagaaacgccacatgcacccactacacccaattagtgtgggcaactagcagccagctgggatgtgggaggcatctttgctcagcaggccaggcggcaattgaggcattcgtgtgcgcctattcccctcggggtaattgggaggtcaatgggaagactattgtaccgtataaaaagggcgcctggtgctctttgtgtacggcttctgtgtctggatgcttcaaagcctgggatcacgccggaggcctatgtgaagtccctcggaatccctgtaggatgtcttgccagaaccacggacgcttgaacattagcacatgtcattgtcactgtccgcctgggtatacgggtcggtattgccaggtcagatgcagccttcaatgcgtgcacggcaggtttagggaggaggagtgctcctgtgtgtgcgacattggttacggaggagcccagtgtgcaacaaaagtgcattttcccttccacacgtgtgatctgcgcattgacggggactgtttcatggtgtcttcggaagctgatacatattacagggccaggatgaaatgccagcgtaaaggcggtgtgctcgcacagataaagtcgcagaaagttcaagacattctcgccttctaccttggccgactggaaactaccaacgaggtcatcgactctgatttcgaaacaaggaatttctggatcgggctgacttacaaaaccgctaaagacagctttcggtgggcaacgggagaacatcaggccttcacaagttttgccttcggccagccagataaccatggactcgtttggctttccgccgccatggggttcggaaactgtgtggaactccaggcatcagcggcctttaactggaacaatcagcgctgtaaaactaggaatcgatatatctgccagttcgctcaggaacacatctcgcggtggggacctgggtcttag

SEQ ID NO: 9996 - DNA, 462 bp, Artificial Sequence
  Description of Artificial Sequence: Synthetic coding sequence
atggcccggttctgggtgtgcgtggccggcgccggcttcttcctggccttcttagttctgcacagtaggttttgcggctcaccagtcctgagaaactttacctttgcggtgagttggcgcactgaaaaaattttgtataggctggacgtgggctggcctaagcacccagagtactttactggcactacattttgcgttgctgtggactccctgaatggcctcgtatacattggccagaggggtgataatatacctaaaatactggtcttcactgaggacggatatttcctaagagcatggaattacacagtggacacgccccatggtatttttgccgcctccactctgtacgagcagagtgtttggatcaccgacgttggaagtgattttatgatcctctggcttcatggtgagaacgggacaggacctgcaaagtttaacatcccccattctgtgacttag

SEQ ID NO: 9997 - DNA, 375 bp, Artificial Sequence
  Description of Artificial Sequence: Synthetic coding sequence
atgtggcggtgccccctgggcctgctgctgctgctgcccctggccggccacctcgcactgggcgcccagcagggtagggggcgccgggagctggctcctggactgcacctccgcggcatccgggatgccggcgggcgttactgccaggaacaggacctgtgctgtagggggcgggccgatgactgcgctctgccttatcttggagccatctgctattgcgatctgttctgcaacaggacagtgtccgactgctgccctgacttttgggatttctgtttaggggttcctcccccattcccacctatccaggccccggctaggcgaactggatcgggttccgtcaccaaaaatcatgcgtggtggattcaaacatag

SEQ ID NO: 9998 - DNA, 777 bp, Artificial Sequence
  Description of Artificial Sequence: Synthetic coding sequence
atgaagaccctgtacctggccgacaccttccccaccaacttccgggacagcgctggagccatgaagcagataaacgattacgtggccaagcagaccaagggcaagattgttgatctgttaaagaacctggatagcaacgccgtagtgataatggtgaattatatatttttcaaggctaaatgggagacttctttcaaccataagggcacccaggagcaggacttctacgtcacatctgaaactgttgttagagtccccatgatgagcagggaggatcaataccactacctgctggacagaaacctctcctgtagggtggtgggtgtcccttaccagggtaatgcaactgcgctcttcatcctacccagcgagggcaagatgcaacaggtggagaatggcctctccgagaaaactttgaggaagtggttaaaaatgtttaaaaagagacagcttgagctgtatctacctaagttttcaatagaaggctcttatcagcttgaaaaagtgctgccaagcctgggaatttcaaacgtgttcacatcccatgctgacttgagtggcatttccaatcattccaacatccaggtgtccgaaatggtgcacaaggccgtagtggaggtggacgaatccggaacccgggcagcggcagctaccgggaccatttttacctttaggtctgccagactgaactcccaacggctggtatttaataggccattcctgatgttcattgtcgataataatatactatttctggggaaggtgaatcgcccctag

SEQ ID NO: 9999 - DNA, 1731 bp, Artificial Sequence
  Description of Artificial Sequence: Synthetic coding sequence
atgatcgtgttcggctgggccgtgttcctggccagccggagcctgggacaggggctgctcttgaccctggaggagcacattgcacatttcctcggtaccggaggggccgccaccactatgggtaatagttgcatttgtcgtgacgactcaggcaccgatgatagcgtcgacacccaacaacagcaagcagagaattcagcagtcccaacagcagacacccgcagccagcctcgagatccagtccgccccccccgacgggggaggggaccccatgagccacggcggaaaaaacagaacgtcgacgggcttgtcctcgacacgctggcagttattcgcaccctcgtcgacaatgaccaagagccaccctacagtatgataaccctgcatgagatggctgagacagacgagggttggctcgatgtagtgcaatcacttatccgagttattccactcgaggaccctctgggacctgcggtcataacactactgctagatgagtgccccttgccaacaaaagacgcattacagaagctgaccgaaatcctcaacctcaacggtgaggtggcctgccaggatagcagccatcccgctaagcacagaaacacctccgcagtactggggtgcctggctgaaaagttggctgggcctgcttcgatcggactgttgagcccaggaatactggagtacctgctgcagtgtcttaagctgcagtcccaccctacagtgatgctgttcgcattaatagctctggagaagttcgcacagaccagcgagaataagctgactatctccgaatccagcatcagcgatcgacttgtcactttagagtcgtgggccaatgacccagattatctgaagaggcaagtgggattttgcgcccagtggagcctggataatctgttcctcaaggaagggcgtcagttgacttatgagaaggtcaacctttcctcgatccgcgcgatgctgaacagcaatgacgtgagcgagtacctgaaaatctccccacatggcttggaggcacgttgtgacgccagcagcttcgaatccgtacgctgtaccttctgcgtggatgccggcgtgtggtattatgaagtcacagtggtcacctccggagtgatgcagattggctgggccactagagattccaagtttctaaaccacgagggctacgggataggtgatgacgagtactcgtgcgcctatgacgggtgtcgccagctaatatggtataatgccagaagtaaacctcacattcatccttgttggaaggagggcgatacagtcgggttcctgctggacctgaatgagaaacaaatgatattctttttgaacggtaaccagctgcccccagagaagcaggtattctctagcaccgtttctggattcttcgctgctgcttcttttatgtcctatcagcagtgtgagttcaactttggcgcgaagcccttcaagtatcctcccagcatgaagttctccacctttaatgactatgcattccttactgctgaagaaaagatcatcctccctcgacaccggaggctggcactcctgaagcaggtgagcattagggaaaactgctgtagtctctgttgcgacgaggttgcagatacccagctaaagccatgtggacacagcgacctgtgcatggactgcgccctgcaacttgagacatgtccattgtgtaggaaagagattgttagccgaatccggcagatttctcacattagctag

SEQ ID NO: 10000 - DNA, 1359 bp, Artificial Sequence
  Description of Artificial Sequence: Synthetic coding sequence
atggccgacatgcaccggggctacgccgacagccccagcaaggccggagcagcaccctacgtccaggcattcgactctctgttagcaggaccagtggcggaatatctcaagattagtaaagagattggcggtgatgttcagaaacacgctgagatggtacataccggattaaagttggaaagggccctgctagtcaccgcctcgcaatgccaacaacccgctgaaaataaactttctgatcttctggcccctatctctgaacagataaaggaggtgataactttccgtgagaaaaaccggggttcaaagttgttcaaccatctaagtgcggtttcagagtccatccaggccctcggttgggtggccatggctcccaagccaggtccctatgtgaaggagatgaacgatgcggccatgttctatacaaatagggtgctgaaagagtacaaggatgtcgataagaaacacgtggactgggtgaaggcatatctatccatctggaccgagctgcaggcctacatcaaagaatttcatacaacgggcctcgcttggagcaaaacaggaccggttgccaaggaactatctggcctgccttcaggcccctctgcgggctcatgcccccctccaccacctccttgtccgcccccgccgcctgtgtccaccatcagctgttcttatgaatcagctagtaggtcttcacttttcgctcagattaaccagggagaaagcatcacgcacgccttaaaacatgtgagcgatgacatgaagacacacaaaaaccccgcactgaaggcacagtctggaccggtacgatccgggcctaagcctttctccgcaccgaagcctcagacgagcccatccccaaagcgcgcgacaaagaaggagcccgctgtgttggaacttgaaggaaagaaatggagagtggagaaccaggagaacgtgagtaacctggttatcgaggataccgagctgaagcaagtggcttatatttacaaatgtgtgaacacaacactgcagatcaaaggtaaaataaactctatcactgtcgacaattgcaagaaattaggcctagtttttgacgatgtggtgggaatcgtggagattatcaatagtaaggacgtgaaagtgcaggtcatgggtaaggtacccaccatcagcattaataagacagacggatgccatgcttatctctctaagaatagtctcgattgcgagatcgtctccgcaaagtcctccgagatgaacgtgttgattcctacagagggaggcgattttaatgaattccccgtacccgaacagttcaaaaccctttggaatggtcaaaaacttgtgacaacggtgactgagatagcggggtag

SEQ ID NO: 10001 - DNA, 1533 bp, Artificial Sequence
  Description of Artificial Sequence: Synthetic coding sequence
atgggccggcccacccagtggcccagcctgctgctgctgctgctgctcccgggccctccccctgtcgccgggttggaagatgccgctttcccacatcttggtgaaagtttgcaacccttgcctcgtgcttgtccactgcggtgttcgtgcccacgggtcgacacggtagactgcgacggcctagacttacgcgtgttcccagacaatattactcgggctgcccagcacctgagtctgcaaaataatcagctgcaagagttgccgtataacgaattaagtagactctccggactgcgaactctgaatcttcacaacaacctgatcagttcagagggacttcccgatgaggcgttcgagtctctcacccaattgcagcacttatgcgttgctcacaacaagctgtcagttgctccccagtttctgccccgcagcctgagggttgccgacctagcggctaaccaggtgatggaaatctttcccctcacctttggtgagaaacctgccctgcggtccgtttacctgcacaacaatcagctctccaatgcaggcttaccgccagatgccttccgcggttcagaggcgattgcgactctcagcctgagcaataaccagctctcctatctcccgccctctctccctccttccctggaaaggttgcatctccaaaataatttaatttccaaagttcctagaggtgcactgtcccgacagacccagctgagggagttgtatctgcaacataatcagctgactgactcaggcctggacgcaaccacattcagcaagctccactcgcttgaatacctggacctctcccataatcagctgaccactgtccccgcagggttgccaaggacactagccattctacacctgggccggaatcgtattagacaggttgaggcagcccgattgcacggggctagagggctgcgttatctgctgctccagcacaatcagttggggagcagcggcctgcccgccggggccttacggcccctgcgggggctacatactcttcatctgtacgggaacggcctcgaccgcgttccacccgccttgccacgaagactccgagccttggttttaccgcacaaccatgtggctgccctcggggcccgcgatctggtggctacgccaggcctgacagaactgaacctcgcatacaatcgtcttgcaagcgcccgcgttcaccacagagcttttaggaggcttagggccttgaggtctcttgacttggccggcaaccaactgacgcgactcccaatgggactgccaacaggtcttaggacgttgcagctgcagagaaatcagttgagaatgttggaaccagagcctctggccggcctcgatcaactccgggagctcagtttggctcataatcgtctgagagttggagacatcggccctggcacatggcatgagttgcaggctctccaagtcagacacagattggtgtctcatacagtgcccagggcccccccatctccctgtctgccatgccatgtgccaaacattctggtttcatggtag

SEQ ID NO: 10002 - DNA, 114 bp, Artificial Sequence
  Description of Artificial Sequence: Synthetic coding sequence
atgaacagcaccctgaacttcttcatccagagctacaacaacgccagcaatgatacttatttgtaccgtgtacagaggcttatacgcagccaaatgcagcaggttcactgttag

SEQ ID NO: 10003 - DNA, 1266 bp, Artificial Sequence
  Description of Artificial Sequence: Synthetic coding sequence
atgggccggcccacccagtggcccagcctgctgctgctgctgctgctcccaggcccccctcccgtcgctggcctcgaagacgctgcctttccccatctcggcgagagtctacagccgctgcccagagcatgtccacttcggtgcagttgtccgagagtggataccgtggactgcgatgggctcgacctcagagtcttccccgataatattaccagagccgcacagcacctgagtcttcagaacaatcagctccaggagctcccatataatgagctgtcccgattatccggcttgcgcaccctgaacctacataacaacctcatcagctcagaaggcctgcccgatgaagcttttgaatccttgacccagttacaacatctgtgcgtggcccacaataaaaataatctgatcagcaaagtgcctcggggggccttatctagacagactcaactgagggagttgtacctgcagcataaccaactcactgacagtgggctggacgccaccacctttagtaagctccattccctggaatacttggatctgagccacaatcagcttaccacggtccccgcagggctgcccaggacgctggctatattacacctgggccggaatcgaatacgacaggtggaggcggccagacttcacggagctcgtggtttgcgctacctgctgctgcaacataaccagttagggagtagcggcctgccagccggggccctgaggccgctacgcgggctccacaccttgcacctatacggaaacggactagaccgtgtgcctcccgctttacctcgtcggctgcgcgccttagtgttgccacacaatcatgtggccgcgctcggcgcccgcgatttagtggccacacccgggctcacagaactcaacctggcttacaaccgcctggcatctgctcgggtgcaccatcgagcttttaggagactgagggcgctaagaagcttagatttagctggcaaccagttgaccagactgcctatggggttgcctacaggactgcgcactctccagctgcaacgtaatcagctgcgtatgctcgagcccgagcctctcgcaggcttggatcagttacgcgagctgagtctcgcccacaatcgcctgcgggtgggcgacatcggacccggtacatggcacgaactgcaggcactgcaggtcagacatcgtctggttagccacacagtccctcgggcaccaccttccccctgcctgccttgtcatgtacctaacatcctggtgagctggtag

SEQ ID NO: 10004 - DNA, 993 bp, Artificial Sequence
  Description of Artificial Sequence: Synthetic coding sequence
atgagcagctggagccggcagcggcccaagagccccggcggcatccagccccacgtgtctcgcaccttgtttctgttgttgttactggctgcatctgcttggggcgtgacactctcccccaaggattgccaagtcttcagatcagatcacggaagttccatctcatgccagccccctgctgaaattcccggttacctgccagctgacaccgtgcatctggctgtggaattcttcaatctcacacacctccccgcaaacctgttacaaggcgctagcaagctgcaggaattgcatctgagctctaacggcctggagtctctctcacctgaatttctgcgccctgtaccccagctcagagtccttgatcttacgcgcaatgccttggtcctgaaagagaatcagttggaggttctggaggtgagctggctccacggactgaaggccctgggacacctggatctgtcaggaaatcgcttacggaagttaccccccggcctgttggcaaacttcactctcttgcgcaccctggatctcggtgagaaccaattggaaactctccccccagacttgctgcgcggacctttacaactcgagcgcctgcacttagaggggaataagctccaggtcctcggaaaagacctgttactccctcagcccgaccttcggtacctgtttctgaatgggaataagctcgcccgagtggccgctggggctttccagggcctccgacagctcgatatgctggaccttagcaacaatagcttagcgtcagttccggagggcctgtgggctagcttgggacagcccaattgggacatgcgcgatggatttgacatttctggcaacccctggatctgcgaccaaaacctctctgacttatacagatggttacaggcacagaaggataagatgtttagtcagaatgatacccggtgtgctggtccggaggccgtcaaggggcagaccctcctcgcagtggctaagagccaatag

SEQ ID NO: 10005 - DNA, 1815 bp, Artificial Sequence
  Description of Artificial Sequence: Synthetic coding sequence
atgatgcgggccgtgtgggaggccctggccgccctggccgccgtggcttgcttagtgggtgctgttcgcggcggccctggcctgagcatgtttgccggccaggccgcccagcccgatccgtgctcagacgaaaatgggcaccctcgacggtgcatcccagactttgtcaatgccgctttcggtaaggacgtgagagtctcatcaacgtgtggcaggccacccgcgcggtactgtgttgtcagcgagcgaggtgaggagcgactgcgatcttgtcatctgtgtaacgccagtgaccctaagaaagcccatcccccagcgtttctgacggatttgaataacccccacaaccttacctgttggcagagcgaaaattatttacagttccctcataatgtcacactaacactgtccctcgggaaaaagtttgaagtgacttatgtgtctctgcaattctgctcacccaggcctgagtccatggccatctataaaagcatggactacggccgaacttgggtgccttttcagttctattctactcagtgccgcaaaatgtacaacaggccgcaccgagcccccattaccaagcaaaatgagcaagaagccgtgtgtaccgacagccacaccgacatgaggcccctgagtggtgggctcattgccttctccaccctggacggccggccgtcggcccatgatttcgataattctccagtgttgcaggactgggtgactgccacagacatccgagtggcctttagtaggttacatacatttggcgatgaaaacgaggatgacagtgagctggccagggacagctatttctatgccgtatctgacctgcaagtcggagggcgctgtaagtgcaatggccatgctgctcgctgtgtgagggatcgcgacgatagcctggtctgtgactgccgtcacaatactgcgggaccagaatgtgaccgctgcaagccatttcattacgaccgcccttggcaacgggccaccgcaagagaagcaaacgagtgtgtcgcatgcaattgcaacctgcatgccaggcggtgccggtttaatatggagctctataagctgtctggaaggaagagtggtggcgtctgcctcaactgcaggcataacactgcaggacgccactgccactattgtaaggagggctactatcgggatatgggtaagcccattacccacaggaaggcttgtaaggcatgcgactgtcaccccgtgggtgctgctggcaagacctgtaatcaaactacaggtcaatgcccttgtaaagatggggtgacaggcattacatgcaatcggtgcgcgaagggctatcagcagtccagatcacccattgcgccctgtataaaaatcccagttgccccacctacaaccgctgcatcgagtgtggaggaacccgaggattgtgattcctattgcaaggctagcaaaggcaaattaaaaattaacatgaaaaagtattgcaaaaaggactatgccgtgcagatacatatcctaaaagccgataaagccggagactggtggaaattcacagttaatattatttccgtttacaaacagggaacctcccggattcgccgtggagaccagtccttatggatccgcagccgtgacatcgcgtgcaaatgccccaagattaagcccctgaagaagtacctcctcttgggtaatgccgaagattctcccgatcagtcaggcatcgttgccgacaagtcttccctcgtgattcagtggagagacacctgggctcgcaggttacggaaattccaacagcgcgagaagaaaggcaaatgtaaaaaagcctag

SEQ ID NO: 10006 - DNA, 948 bp, Artificial Sequence
  Description of Artificial Sequence: Synthetic coding sequence
atgggccaggaccgggaggagaccaacatcgagctgctggtgtgcaattacgagcctccagggaatgtgaagggcaaacggccctaccaggaagggactccatgtagccagtgtccttctggctaccattgtaaaaattcgctctgcgaacctattggcagtcccgaggatgcgcaagacctgccatacctggtcacggaagccccaagcttcagggccactgaggcctccgattccagaaagatggggacacccagctctctcgcaacggggattccagcctttctagtgacggaagtctccggatcgttagcaacaaaggcccttcccgcagtagagacacaggccccaacctctttagccacaaaggacccgccttcgatggccacagaagctcccccttgcgtcaccacagaggtgccgtctatacttgctgcacactctctcccaagcctggacgaggaaccagtgacattcccaaaaagcactcatgtgcccattcctaagtcggcagataaggtaaccgacaaaactaaggttccttcgaggagtccagaaaattctttggatccaaagatgagcctcaccggtgcacgagagctgcttccccacgcacaggaagaagctgaggctgaggcagaactgccaccgtccagcgaggtgctggcgagcgttttccctgcacaggacaagccaggagaactgcaggctacactggatcatactggccacacttccagcaagtctttgccaaactttcctaacacttctgccaccgccaacgccaccggaggacgcgcgcttgccttacagagcagtcttcctggagccgagggccccgacaaaccaagcgtcgtgtcagggttgaattccgggcctggacacgtttggggacccctgctgggattgcttcttctccccccacttgtgttggccggcatcttttag

SEQ ID NO: 10007 - DNA, 207 bp, Artificial Sequence
  Description of Artificial Sequence: Synthetic coding sequence
atgcaggtgagcaccgccgccctggccgtgctgctgtgcaccatggccctttgtaaccaggtgctgagtgcgccgcttgctgctgatacacccaccgcctgctgtttcagctataccagtagacagattcctcagaacttcattgcagattacttcgagacttcttcccagtgctccaaaccttccgtgatggcagcccctgggtag

SEQ ID NO: 10008 - DNA, 3369 bp, Artificial Sequence
  Description of Artificial Sequence: Synthetic coding sequence
atgagcctgcaggagatgttccggttccccatgggcctgctgctgggtagtgtgctcttagtggctagtgcgccagccacactcgagcctccgggatgtagtaataaggagcagcaagtgacagtgagccacacgtacaaaatagatgtccctaagtcagctctggttcaagtggacgccgatcctcaacctctcagcgacgatggtgcatctctgctggccctgggcgaggcgagagaggagcagaacatcatttttagacacaacattcggctgcagacacctcagaaggactgcgagcttgctggctcagtccaggacctgctagcgagagtgaagaagctggaagaggaaatggttgaaatgaaagaacagtgtagtgctcagcggtgctgccagggtgtaacggacttatccaggcactgttctggacacggcacatttagtctggaaacctgttcctgccattgcgaggaggggcgagaaggcccagcctgcgaacggctcgcctgcccaggagcttgctcgggtcacggcaggtgtgtcgacgggcgctgcctctgccacgagccatacgtgggagcggattgcgggtaccccgcatgcccggaaaactgctcaggccacggagagtgtgtgcgtggcgtgtgtcagtgtcacgaggactttatgtccgaagactgttcagaaaagaggtgtcctggggactgttctggtcacggtttttgcgacaccggcgagtgttactgcgaggaggggtttactggtctggattgtgctcaggtggtcacaccccagggcttgcaactgctcaagaataccgaggatagtttgctcgtctcgtgggagccctcgtcccaggtggaccactacctcctgtcatactatccgcttggcaaagagctctctggcaagcaaatccaagtgcctaaagagcaacacagctatgagattctgggtttactgcctgggacaaaatatattgtgacactccggaatgtaaagaacgaggtgtctagttcaccgcagcaccttctagctaccaccgacttggccgtgctgggcacagcgtgggtcactgacgaaacggagaactctctggacgtggagtgggagaatccgtcaaccgaggtggactactataagctcaggtatgggccaatgaccggccaggaggttgcggaagtgacggtcccaaaaagttcggaccccaagtctagatacgatattacgggtttgcaccctggaaccgagtacaaaatcacggttgtgcccatgaggggagaactggaaggtaaacctatcctgctgaacgggcggacagaaattgactccccaacaaatgttgtgacagaccgggtgaccgaagataccgcaaccgtgtcctgggatcctgtccaggctgtgatagacaaatacgtcgttagatacacttccgcggatggagacactaaggaaatggcagttcacaaggacgaaagctctaccgtgctgacaggcctcaagcccggtgaggcctataaagtctacgtttgggctgagagggggaatcagggtagcaagaaggcagacacaaacgcactgaccgagatcgactcaccagcaaatctggtgaccgatcgagtcacggagaacacggccacgataagctgggacccagtgcaggctaccattgaccggtacgtggtccggtatacctcagccaaagacggtgagacccgcgaggtgcccgttggaaaagagcagtcaagcacagtgttgacagggttgaggcccggtgtagaatatactgtgcacgtgtgggctcaaaagggggcacaggagtctaagaaggccgacacgaaagcccagacagacatagactctccccagaacctggtgacagattgggtaacagaaaatacagctaccgtgtcatgggatcctgtccaggctaccatcgaccgctatgtggtacattatactagcgcgaacggagaaactcgagaggtgcccgtcggcaaggaacaatcaagcacagtgctgactggcctgagacccgggatggagtacacagtacatgtctgggcgcagaaaggaaatcaggagagcaagaaagccgatactaaagctcaaacagagattgatgggccaaagaacctcgtgaccgactgggtcaccgagaatatggccaccgtctcgtgggatcctgtccaagcaactatcgataagtatatggtgagatacacatcagccgatggagagactcgagaggtgcctgtcggcaaggagcatagctcaacagtgctgaccgggctgaggcctggaatggaatatatggtgcacgtttgggctcagaaaggagcgcaggaatcaaaaaaggctgataccaaagctcagactgaactggatccaccccgcaatcttcggccgtctgccgtcacacagtccggaggaatactcacctggacacccccatccgcacagattcacggctacatattgacttaccagtttcctgatgggacggtgaaagaaatgcagctaggacgggaagatcagagatttgctctgcagggcctggaacagggtgccacctatcccgtgtcactggtcgccttcaaaggggggcgccgcagtaggaacgtgagtactacactatccacagttggggctcgatttccacacccatctgactgctcacaggtgcaacagaacagcaatgccgcttcaggcctgtatactatttatctccacggagacgcttctagaccactccaggtatattgcgatatggagacggacggcggtggttggatcgtgttccagcgtagaaataccggacagcttgattttttcaaaaggtggcgatcctacgtcgagggatttggtgatcctatgaaagaattctggttgggactggacaagctgcacaacttgactaccggaactccagcgagatacgaagtgcgggtggatcttcagaccgcgaatgagtcagcctatgcgatctatgacttttttcaggttgcatcgagtaaagaaagatacaagctgactgtgggcaaatacagggggacggcaggggatgcactcacctaccacaacggatggaagtttaccacttttgacagggacaacgatatcgctctaagcaactgcgcccttacacaccacggtggctggtggtataagaattgccatctggccaatccaaacggaagatatggtgagacaaaacacagcgagggagtgaactgggagccatggaagggccacgaattctcaatcccctacgtggagctgaagattaggccccacggatacagcagagagcccgtcttaggacgcaaaaaaaggaccctcaggggccggctcagaacgttctag

SEQ ID NO: 10009 - DNA, 897 bp, Artificial Sequence
  Description of Artificial Sequence: Synthetic coding sequence
atgctgcaccccgagaccagccccggccggggccacctgctggccgtcttgctcgcgctcctaggcactgcctgggccgaggtctggcccccccaattacaggagcaggcacccatggccggtgctctgaatcgaaaggagagctttctgctgttgagcttacataatcgccttcggtcttgggtgcaaccccccgcggccgatatgaggaggctggactggtccgattcactgaattggctgaagccaggccccctctggaacccaaaccccgagcctggtgtgagacctgtcgcacaccctgcctcaggcttggagcatgcagcctgccctcgggcatggcgccctcttctcaagtggtccttatggtttgctgaaggccagaggtattcccatgcagccggagaatgcgcaaggaacgctacatgcacccattacactcagctggtgtgggccaccagcagccagctgggttgcggaaggcacctgtgctccgcaggtcaggcggcaatcgaggccttcgtttgtgcttactcccccagaggaaactgggaggtgaacggtaagacaatcgtgccctacaaaaagggcgcatggtgttccctatgtaccgcctcggtatccggttgttttaaggcctgggatcacgccggagggctgtgcgaagttcctcgcaatccttgtaggatgtcctgtcaaaaccacgggcgtcttaatatatccacttgtcattgccactgtccaccgggctacaccggaagatactgccaggtgcgctgcagtctgcagtgtgtgcacggcagattcagagaggaggagtgcagttgcgtgtgcgatatcggctacgaaccctctgtgcctcctcggtgcatctttccctctacacccgttacctag

SEQ ID NO: 10010 - DNA, 1728 bp, Artificial Sequence
  Description of Artificial Sequence: Synthetic coding sequence
atggacctggtgctgaagcggtgcctgctgcacctggccgtgatcggtgcgcttctggctgtcggggcaacgaaaggctctcaggtgtggggcgggcagcccgtgtaccctcaggaaactgatgacgcttgcatcttccctgacggaggcccatgcccatcaggctcctggtctcagaaacgatcttttgtgtatgtttggaagacttggggccagtattggcaggtactaggcggccctgtcagcggtctgagtataggcaccggccgagccatgctaggcacacatactatggaagtaactgtgtaccacagaaggggaagtagatcctatgtgcctctggcacatagtagcagtgcctttacgattacagatcaggtgcctttctccgtaagcgtttcccagctgcgagctttggatggcggcaacaagcattttttgagaaatcaaccacttacgttcgccctgcaactgcatgatccctccggctacctcgccgaggcagatctgagctacacctgggatttcggagactcctccggcaccctgatcagcagagcacttgtggtgacccacacttacctggagcctggcccagtgaccgcccaggtcgtgctccaggccgctatcccactgaccagttgcggatccagtccagtgcccgggactaccgatggacaccggccaaccgccgaagctcctaacaccacagccggccaggtcccaactacggaagtggtgggaaccacccccggacaggcacccaccgcagagccctcaggcaccactagcgtccaagtgccaacgaccgaagttatttccaccgcgcctgtgcagatgcctaccgccgaatctaccggcatgacccctgaaaaagtacccgtatctgaggtgatgggcaccactctggccgaaatgtctacacccgaagccacaggtatgactcccgctgaggtgagcatcgtcgtgctgtccggaaccacggctgctcaggtgaccaccaccgagtgggtggagactacagctagagagttaccaattcccgagccagaggggcctgatgcttcaagtataatgtcaacagagtccatcactggttccctgggcccacttctggatgggaccgccactctgcggcttgtcaagagacaggtgcctctcgattgcgtgctctatcgctacgggagctttagtgtgaccctggacattgtacagggaatcgaatcagctgagatcctgcaggctgtaccgagcggggagggagacgctttcgaacttaccgtgtcctgtcaggggggtcttcccaaggaagcctgcatggagatcagcagccctggctgccagcccccggcccagaggctttgccagcccgtgttgccttcacccgcatgccaattggtgctccatcagattctgaaaggaggctctgggacttactgcctgaacgtgtcactcgcagacaccaattctctggcagttgtctctacccagctgattatgcccgggcaggaagctgggctgggccaggttccattgattgtaggcatcttgttagtcctgatggccgtggttctggcaagtctaatatataggcgaagacttatgaaacaggatttttctgtgccacagttgccccactcatcctcacattggttgcggctgccacggatattttgctcctgtcctatcggtgagaactccccacttcttagcggacagcaggtgtag

SEQ ID NO: 10011 - DNA, 330 bp, Artificial Sequence
  Description of Artificial Sequence: Synthetic coding sequence
tgaagcggccagagcctgaagagcctgaacgccagcagcggccacttggcccttattctctctagcatcttcggactactcctgctggtgctgtttatactgtttctcacttggtgcagggtgcagaaacagaagcacctcccactgagagtgtctacacgaagaaggggatctctcgaggaaaacttgttccacgaaatggagacatgcctcaaaagggaagatccccatggcaccagaaccagcgatgatacgcctaatcacgggtgcgaggatgccagcgatacaagcctgcttggcgtgctcccagcctccgaagctacgaaatag

SEQ ID NO: 10012 - DNA, 312 bp, Artificial Sequence
  Description of Artificial Sequence: Synthetic coding sequence
atgagcggccggggcaagggcggcaagggcctgggcaagggcggcgcgaaaaggcatcggaaggtgctgcgggataatatccagggaattacaaagcccgctattcggcgcttggccagacggggaggggtgaaaagaattagcggcctgatttacgaagaaacgcgcggagtgctcaaggtctttcttgagaacgtcatacgggatgcagtcacttatacagaacacgcgaagcggaagactgtaaccgccatggacgtggtgtatgccctcaagcgccagggcagaactctgtatgggttcggcggatag

SEQ ID NO: 10013 - DNA, 2889 bp, Artificial Sequence
  Description of Artificial Sequence: Synthetic coding sequence
atgctgcggcggcccgcccccgccctggcccccgccgcccggctgctgctggctggattgctgtgcggcgggggcgtgtgggcagccagagttaataaacacaagccatggcttgagcccacttaccacggcatagttacggagaacgacaacaccgtcctcctggatcctcccctgatagcgttggataaggacgcaccattacggttcgccgagtcattcgaggtgaccgtgacgaaagaaggtgagatttgcgggttcaagattcatggccaaaatgtcccgtttgatgcagttgttgtggataaaagcacaggggaaggcgtgatccgtagcaaggagaagctcgattgtgaactacagaaggactactcattcactatccaagcatatgactgcggaaagggacccgatggaacaaacgtaaagaagtcacacaaggccacggtgcacatccaggtgaatgacgttaacgagtacgcgccagtgtttaaggaaaagagttataaggccactgttatagaggggaaacagtacgatagtattttgcgcgtagaagccgtcgatgctgactgtagtccccaattcagccaaatctgcagctacgagataatcactccggacgtcccttttaccgtggataaagacgggtacataaagaatacggaaaaactcaattacggcaaagagcatcaatataaacttacagtcaccgcatatgattgtgggaagaagcgggcgaccgaggacgtgttggtgaagatcagtattaagcccacctgtactcccgggtggcagggttggaataacagaatcgagtacgagccaggcacaggggctctggcagtttttccaaacatccacctagagacttgcgacgagcccgtggcttccgtgcaggcgacagtcgagctggagacatcacatattggtaaggggtgtgaccgagacacctattctgaaaagtcgctccaccggctgtgcggtgccgcggccgggacagcagaattgctgccatccccctccggaagcttaaactggactatggggctgcctacggataacgggcacgattctgatcaggtgtttgaatttaatggaacccaggcagttagaatcccagatggggtagtctctgtgtcccccaaggaaccatttactatatccgtctggatgcgtcatggccccttcgggagaaaaaaagagaccattctttgtagtagcgataagacagatatgaatagacatcactactccctgtatgtccacggttgtcggttgatcttcctgttccgacaggatccttcagaggaaaagaagtataggccagctgagttccactggaagctcaaccaggtgtgcgatgaggaatggcatcattacgttttaaatgtggaattccccagtgtgaccctgtatgttgacgggacttcacacgagccgttttccgtaactgaagattaccctctgcaccccagtaaaatcgaaacccagttagttgtgggagcctgctggcaaggcggcgacctgcatatgacccaattttttcgtggaaatctcgctggtttgaccctgaggagtggcaaactggctgacaagaaggtcatcgactgtttgtacacttgtaaagaaggcctcgatctccaggttttggaggatagcggcagaggggtgcaaatacaggcccacccgtcccagctggtgctcaccctcgaaggcgaagacttgggtgaattggacaaggcaatgcagcacatctcttacctgaacagtcggcagttccctaccccaggcatccgaagactgaagataacatcaaccataaagtgttttaacgaagctacttgtatatcagttccgccggtggacggctacgtcatggtcttacagcctgaggaacctaagatctctttgtccggggtacatcactttgcccgcgcagcaagcgagttcgagtcaagcgaaggcgttttcctatttccagagctgaggattatctccaccatcacgagagaggtcgagcctgagggggatggagctgaagaccctaccgtacaagagtccctggtaagcgaggagattgtacacgaccttgacacatgtgaagtgacagtggaaggggaagagcttaaccatgagcaggagtctctggaagtagacatggcccggctccagcagaaggggatagaagtctctagcagcgaacttggaatgacattcactggggtcgacacgatggcctcttacgaggaagtgttgcaccttttgagatatcgaaattggcatgcacgtagcctcctggacaggaaattcaagcttatttgtagtgaactgaatggcaggtacatcagtaacgagttcaaggtagaggtcaatgttatccatactgccaatcccatggaacacgcaaaccacatggccgcgcagccacagttcgtacacccagaacaccgttcctttgtcgatcttagcgggcataacttggcaaatccacacccttttgcagttgttcccagtaccgccacggtggtgattgtcgtgtgtgtgtcctttctcgtgtttatgatcatactgggcgtgtttcgaatccgcgctgcacatcgccgaaccatgcgagatcaggacaccggaaaggaaaacgagatggactgggacgattctgctttgaccatcaccgtgaacccgatggagacctatgaggatcagcacagcagtgaggaggaggaagaagaagaagaggaggaggaaagcgaagatggtgaggaggaggatgacattactagcgctgagagtgagtcatctgaggaagaggaaggagagcagggcgacccccagaacgctacaagacagcaacagctagagtgggatgacagcactttatcttattag

SEQ ID NO: 10014 - DNA, 912 bp, Artificial Sequence
  Description of Artificial Sequence: Synthetic coding sequence
atgctgcaccccgagaccagccccggccggggccacctgctggccgtcctgctggcgttactggggacagcctgggccgaagtgtggcccccacagctccaggagcaagcaccaatggctggggctcttaacagaaaagagtcattcttgttattgtctctgcataatcggttgaggtcctgggtgcagccccctgcagccgacatgaggcggctggactggagcgacagccttgctcaattagcccaggctcgcgccgccttatgcggcacaccaacaccctccctcgcaagcggcctctggcgtacgttacaagtcggctggaatatgcagctgttgcctgccgggttggtgagtttcgtcgaagttgtaagtttgtggtttgctgagggccagagatactcgcacgctgcgggagagtgcgctcgcaatgccacatgtacgcactacacacagttggtgtgggctactagctcacagctcggatgtggccggcatctttgcagcgccgggcaggccgcaatcgaggcatttgtttgcgcgtatagcccccggggtaattgggaggtcaatggcaagactattgttccctacaaaaagggcgcgtggtgtagtctatgcactgcctctgtgtcggggtgctttaaagcttgggatcacgcaggaggtctgtgtgaggtaccgagaaatccctgtagaatgagctgccagaatcatggtcgtctcaacatcagcacttgtcattgtcactgccctcccggctacactgggcggtactgtcaggtaaggtgctcactccagtgtgttcacgggcgattccgagaggaagagtgctcatgcgtgtgtgatatcggatacggagaaccctccgtccctcccagatgtatatttccctccactccagttacctag

SEQ ID NO: 10015 - DNA, 1356 bp, Artificial Sequence
  Description of Artificial Sequence: Synthetic coding sequence
atggaggccaccggcaccgacgaggtggacaagctgaagaccaagtttatctcagcctggaataacatgaaatacagctgggtgctgaagacaaaaacctacttctcccggaacagccccgtcctcctcttggggaaatgctatcactttaagtacgaagacgaagataaaactcttcccgccgagtcaggctgcaccatagaggatcacgtgatagcaggcaacgttgaggagtttcgtaaggatttcatctctcgaatttggctcacttatagagaagaattccctcaaattgaaggctctgccttgaccacagactgcggatgggggtgtacgctacggacagggcagatgcttttggcccaaggcctgatccttcacttcctcggacgcgcatggacgtggccggatgccctgaacatcgagaatagtgattctgaatcctggactagtcacaccgtaaagaaatttacggccagttttgaagcttctctatcaggtgagagagagtttaaaactcctactatctccctgaaggagactataggaaagtatagcgacgaccacgaaatgcggaatgaagtgtaccacaggaaaatcatctcttggtttggagacagcccactcgccctgttcgggcttcaccagcttattgaatacggtaaaaagtctggcaaaaaggccggtgactggtacggaccggccgttgtggctcacatattgcgtaaagcagtggaagaagctcgccacccggatctgcaggggatcactatttacgtggctcaagattgcaccgtatataattctgatgttatcgacaaacagtcagcgtccatgacctctgacaacgcagatgacaaggcggttattatcctggtgccagtgcgactcggaggagaacggactaacaccgactacctcgagttcgtgaaaggcattctgtccctggagtactgcgtgggcattattggcgggaagcctaagcagtcttattacttcgcgggatttcaggatgattcactgatttacatggatcctcactactgtcagtcatttgtcgacgtgagtatcaaggactttcctcttgaaacattccactgccctagcccgaaaaaaatgtcattcagaaagatggatccctcttgcaccattggtttttattgtcgtaacgtgcaagatttcaagcgcgccagtgaagagatcaccaagatgctcaagttttcttcaaaggagaaatatcctctcttcacattcgttaacggccactcacgcgactacgacttcacctccacaacaactaatgaagaagatctgtttagcgaggacgaaaagaaacagaaaaagaaaaagaagtag

SEQ ID NO: 10016 - DNA, 1557 bp, Artificial Sequence
  Description of Artificial Sequence: Synthetic coding sequence
atgcggacctgggactaccggtggagcctggccctggtggcccagaccggcgttcactgctgtaacctttcctccctgcagcctcttccgccgaggttcaaacggtttagttgcctgagcctaagcagtggttgggattattccaatagtggcaatatgaaacctccactgcttgttttcatagtctgtttattatggctcaaggatagtcactgcgccccgacctggaaggataagactgcaatatcagagaacttgaagtctttctccgaggtcggcgaaatagatgcagatgaggaggtaaaaaaggccctgactggcatcaagcagatgaaaatcatgatggagagaaaggagaaggagcacaccaacctgatgagcacactgaagaaatgtcgggaagagaagcaagaggcgctaaagctcttgaatgaagtccaagagcacctcgaagaggaggaacggctttgccgcgagtcacttgccgactcctggggcgaatgtaggtcatgtctcgagaataattgtatgcgcatctacacgacgtgccagcctagttggtcatctgttaagaacaaaattgaacgctttttcagaaagatataccaatttcttttcccctttcacgaggacaatgagaaggaccttccgatttctgaaaaactcattgaagaggatgctcagttgacccagatggaagatgtgttctcccagcttacagtggacgttaatagcttgttcaaccgatcctttaatgtttttcgacagatgcagcaggagttcgaccagacctttcagagtcattttatatccgacacagacctcaccgaaccctatttcttccctgccttcagtaaggaaccaatgacaaaagcagacttggaacagtgctgggacattcccaacttctttcagctcttttgtaatttcagtgtgagcatttacgagtctgtctccgagactatcacaaaaatgctaaaggccatcgaggatttgccaaaacaagataaagctccagatcacggcggactcattagcaagatgctcccaggccaggataggggcctctgcggcgaattggaccagaatttatctcggtgctttaagttccacgaaaagtgtcaaaagtgtcaggcgcatctttccgaggattgtccagatgtgcctgctttgcacacggaactggatgaggctatccgactggtcaatgttagtaaccaacaatacgggcaaatcctgcaaatgacaagaaagcacctggaggacactgcgtatttggtagagaagatgagaggccaattcgggtgggtctccgaactcgccaatcaggcccccgaaaccgaaattatcttcaactctattcaagttgtaccccgaattcacgaaggcaatataagtaagcaagatgagaccatgatgactgatctatccatactacccagctctaattttacgctgaagatccccttggaagagtccgctgaatccagtaacttcataggttacgtcgtggcaaaagcgctacagcactttaaggagcactttaagacctggtag

SEQ ID NO: 10017 - DNA, 1716 bp, Artificial Sequence
  Description of Artificial Sequence: Synthetic coding sequence
gtggagatgcggaagtggagcagcgagcccggccccgagcccgacaccgtcgaggcagtgatagaatatatgtacacaggacggatccgggtgtcaactggaagcgtgcacgaggtgctagagctcgcggacagattcctcttgattcggctcaaggagttctgtggcgaattcttgaaaaagaagcttcacctgtcgaattgcgtagccatccattccctggctcacatgtataccctctctcaactggctttgaaagctgccgatatgatacggcgcaatttccacaaggttatccaggacgaggaattttacactcttcccttccacctgattcgcgattggctgtcggatcttgaaatcactgtcgacagtgaggaagtactctttgaaacagtgcttaaatgggtgcaacgtaatgccgaggaacgagagagatattttgaggagctgtttaaacttttgagactgtcccagatgaaaccaacctatctgacaagacatgttaagcccgagcgcctcgtggctaacaacgaagtgtgtgtcaaactcgtggccgatgctgtggagcggcacgctctgcgggcagagaacattcagtctgggacctgtcagcatcccacttcgcatgtgagtctcttgcccagatatgggcagaatatggacgtgatcatggttatcggcggcgtctctgaaggaggtgactacttgtcggagtgcgtggggtactttgtggatgaagaccgttgggtgaaccttcctcacatccataaccatctggatggtcacgcggtcgccgtgaccgagagctacgtttacgtggccgggtctatggagccaggctttgctaaaacagttgagcgctacaatcccaatctgaatacttgggagcacgtgtgcagcctcatgacaaggaagcacagctttggtctgacagaggttaaaggcaagctgtattccattgggggacacggtaatttttcacctggctttaaggatgtgacagtctacaatcctgagctcgacaaatggcataacctagaatccgcacccaagatcctgcgcgacgttaaagccttagctatcgaggaccgcttcgtgtacatcgctgctaggacccctgtggatagagacaccgaagatggactcaaggcagtgattacttgctatgacacggagaccagacagtggcaagacgtcgaaagcctgcctttgatcgataactactgcttcttccagatgagcgtagtcaactccaacttctatcagacggcctcttgctgtcccaagtcctattgcctcgaaaacgaggaagcagtgcgaaagatcgcttcgcaggtcagtgacgaaattctcgagagcctcccccccgaagttctgtccatagagggagctgctatctgttactataaggatgatgtgttcattatcggaggttggaaaaatagcgatgacatagataagcagtacaggaaggaagcctacagatactgcgcagagagaaagcgctggatgcttcttccacccatgccccaacctaggtgcagagctaccgcttgtcatgtgagaataccctataggtacctgcatggaacgcagaggtatccaatgccacagaacctgatgtggcagaaagacagaatacggcaaatgcaggaaatccacagacacgctctgaacatgcggcgggttccatcctcacaaattgaatgctag

SEQ ID NO: 10018 - DNA, 729 bp, Artificial Sequence
  Description of Artificial Sequence: Synthetic coding sequence
atgctgaagaagatcagcgtgggcgtggccggcgacctgaacaccgttactatgaaattggggtgcgtgctgatggcttgggccctctatctgtccttgggcgtgctctgggtggcacagatgctgttggccgccggatgccacgctgaattgttcccagctccaatacttagagctgtgccctccgctgaaccacaggctggctctccaatgacacttagttgtcagaccaagctgcccctgcagcggagtgccgccagactgcttttttcattctataaagatggcaggatcgtacagtcaagggggttaagttcagagttccagatcccaacggcttccgaggatcactcaggctcttattggtgcgaggctgctacagaggacaatcaggtatggaagcagagcccccaactggagattagggtgcagggcgcttcttcaagtgcagctccgcccaccctaaaccctgccccccaaaagtcggctgcccccggcacagcgcccgaggaagcgcccggccctctccccccgccacctacaccctcgtccgaggaccctggattcagttcgccacttggtatgccagaccctcatctgtaccatcagatgggcctcctgcttaaacatatgcaggacgtcagagttttactgggacacttactgatggagctgcgagaacttagtggccataggaaacctgggactaccaaagcaactgccgagtag

SEQ ID NO: 10019 - DNA, 1392 bp, Artificial Sequence
  Description of Artificial Sequence: Synthetic coding sequence
atgtacgtgagcacccgggagcggtacaagtggctgcggttcagcgaggactgcctgtacctgaatgtctacgcaccagccagggcccctggcgatcctcaattgccggtaatggtgtggtttcctggaggcgcgttcatcgtgggagctgcttcatcatacgaggggagcgatctcgcagcccgagaaaaggttgttctagttttccttcagcatagactggggattttcggtttcctcagcaccgacgatagtcatgcacgggggaattggggtttactggaccagatggccgccctcaggtgggtgcaggagaatatagccgcctttggaggggatcctggaaacgtgacactattcggccaatctgctggcgccatgtctatcagcggccttatgatgtctcccttggcctctgggctgtttcaccgcgccatttcccaatcaggtaccgctctgtttagacttttcattacctcaaaccccctcaaggtggcgaagaaggtggctcacttagctggttgtaatcacaacagcacccaaattttggtgaattgtctgagggccctttctgggacaaaggtgatgcgggtgtctaacaaaatgaggtttcttcaattgaattttcagagagaccccgaggaaattatttggagcatgtcgcctgtggtggatggcgtggtgattccagacgaccccctggtcttgttgacgcaaggcaaggtgtcatccgtcccatacctcctcggcgtgaataatctggagttcaactggttgctcccctacatcatgaagtttcctttgaaccgtcaggcaatgcgcaaggaaaccatcactaaaatgctctggagcacccgcaccctgctgaatatcactaaagaacaggtccccctagtggtggaagagtacctggataacgtgaatgaacacgattggaaaatgcttcgcaacaggatgatggacatagtgcaggacgcaaccttcgtgtatgccaccttacaaaccgcccattaccacagagacgctgggctgccagtttacttgtacgagttcgaacaccacgccagaggaatcatcgtcaagccacgtaccgacggagctgaccacggggacgagatgtattttctgtttgggggtccgttcgcaaccggtctcagtatgggaaaggagaaagcactctccctgcagatgatgaaatattgggcgaatttcgccagaactgggaatcctaacgacgggaacctgccgtgctggcctaggtataataaagatgagaagtatcttcagctcgacttcactactagggttggcatgaaactcaaagagaaaaaaatggctttctggatgagcctctaccagtctcaacgccctgaaaagcagagacaattttag

SEQ ID NO: 10020 - DNA, 1215 bp, Artificial Sequence
  Description of Artificial Sequence: Synthetic coding sequence
atgttctaccacgcctacgacagctacctggagaacgccttcccctttgacgagttacggcctctgacatgtgacggacacgacacttgggggagcttttcccttacattgatcgacgcactggataccctgctaattctggggaacgtaagcgaatttcagcgagtcgtggaggtgcttcaggacagcgtggactttgatatcgacgttaatgcatcagtgtttgaaacgaatatcagggtggtgggcggccttctgtccgcccatctactgagcaaaaaagcaggggtcgaggttgaggcaggctggccttgttctggacctttgttgcgtatggccgaggaggctgctcggaagttgctgccggcattccaaaccccaactggtatgccttatggcacagtgaacctgctacacggggtaaatcctggcgaaacgccggtgacatgcacagcagggattgggacctttattgtggagtttgctactcttagttctctgacaggagaccctgtatttgaagacgtggcccgagttgccctgatgcgactttgggaaagtagatccgacattgggctcgtgggcaaccacatagacgtgttaacaggcaagtgggtggcacaggatgctgggatcggagccggcgtggattcctatttcgaatatctggtgaaaggggccattttactgcaagacaaaaagctaatggctatgttcctggagtataacaaggccatcagaaactacaccagattcgacgattggtatctgtgggtgcagatgtacaagggcacagtctcaatgccggtcttccagagtctggaggcttactggcctggccttcaaagcttaatcggtgatattgacaatgcgatgcgcacattcctgaattactataccgtttggaaacagttcgggggacttccagagttttacaatataccccagggatataccgttgagaaacgggaaggttacccactccgcccagaactgatcgagtcagccatgtatctctacagggctactggtgacccaactcttttggaactgggacgtgatgccgtcgagagcatagagaagatttccaaagttgagtgcggatttgctacagtttccgtgtgcatggccccccggacgggaaagagcctcccattactactgaagtccctgttcaaaggcagagcactgggcgtccttacctatcagcactag

SEQ ID NO: 10021 - DNA, 1281 bp, Artificial Sequence
  Description of Artificial Sequence: Synthetic coding sequence
atgggctggaccgacaccctggagagcgccgaggacatcttctggaagcaggcggactttgggtatgcgagggaaagattggaagagatgcatgttctctgccaacctaaggaaacctccgacagctctctagtctgtagtagatacttacagtattgccgggccacaaatctttatttagatctgcgcaatataaagcggaatcatgatagattcaaagaggatttttttcagagcggagaaattggtggtcactgtaagctcgatatccgcacactgacaagcgaaggacagagaaaaagtccattacagtcttggtttgccgaacttcaaagttacacacaactaaacttccgcccgatcgaggatgctaaatgcgatatcgtgattgagaaacctacctatttcatgaaactggacgctggggttaatatgtaccatcacttttgtgacttcatcaatttatatattacccagcatgtgaataacagcttcagtacagacgtctacattgttatgtgggatacatcaagttacggatatggcgatctgttcagtgacacatggaacgcattcacagactatgatgtcattcaccttaagacctacgacagcaagcgcgtgtgttttaaggaggccgtgttttcactcctaccgaggatgagatacgggctcttttacaataccccactgatcagtggttgtcagaacaccggacttttccgagctttcgctcaacacgttttgcacagacttaacatcacgcaggaaggaccaaaagacgggaaaattagggtcacaatactcgcaaggtccactgagtatcgcaagatactcaaccagaacgaattggtcaatgctctcaagacggtctccacatttgaggtacaaattgtggactataagtaccgcgagttgggattcttggatcagctccggatcacacacaacaccgacatttttatcggaatgcacggggcaggactcacccatctcctcttcttaccagactgggcagctgtgttcgaactctataattgtgaggacgagcgatgctaccttgatttggcgaggctccgtggggtgcactacattacctggcgaagacagaacaaggtcttccctcaggacaagggacaccacccaacccttggtgaacatccgaaatttacgaactactcctttgacgtcgaggaattcatgtacctggtgcttcaggccgctgaccatgtcctgcagcaccctaagtggcctttcaagaagaagcacgatgaactttag

SEQ ID NO: 10022 - DNA, 1098 bp, Artificial Sequence
  Description of Artificial Sequence: Synthetic coding sequence
atgaagctgggctgcgtgctgatggcctgggccctgtacctgagccttggtgtgctgtgggtggcacagatgctactggtcgcaagtagcttttccgccgccagctttgaaacccttcagtgtgaaggccccgtttgtactgaagagtcatcttgccacaccgaggacgatcttacagacgctagggaagctgggttccaggttaaggcctacacttttagtgaaccttttcacctgatagtctcttacgattggttgatcctgcaaggtcctgccaaaccagtgttcgagggcgacctcctggtacttcgatgtcaagcatggcaagattggccactgacccaggtgaccttttacagagatgggtccgcactggggccccctggcccaaatagagagttctccattacagtggttcaaaaagcagattctggccactatcattgttccgggatattccagagccctgggcctggaattcccgaaactgctagtgttgttgctatcacggttcaagaactattccccgccccaattctgagagccgtcccttccgccgaaccacaggcagggtcccccatgaccctgagctgtcagaccaaactgccgctccaaaggagcgcggccaggcttctgtttagtttttataaagatggtagaatcgtccagtccaggggattgtccagtgaattccagattcccacagcctctgaagatcattcaggctcatattggtgtgaggcagccactgaggataaccaagtgtggaagcaatctccgcagcttgagatccgagtccagggagcctcatcatcggcagctcccccgacccttaatcccgctccacagaagtcagcagctccggggaccgcccccgaggaggcacccggccctcttccgccaccccctacccctagttctgaggatcctggattcagttctcctcttggcatgccggaccctcacctgtaccatcagatggggctactccttaaacatatgcaggatgtccgcgtgctgcttggccaccttttaatggagctgcgcgagctgagcgggcacaggaagccgggaaccacaaaagccactgcagagtag

SEQ ID NO: 10023 - DNA, 1407 bp, Artificial Sequence
  Description of Artificial Sequence: Synthetic coding sequence
atgcggtggatcctgtgctggagcctgaccctgtgcctgatggcccaaacagcattaggggcgttacatacgaagagaccacaggtggtgacgaagtatggaacactgcaggggaagcagatgcacgtcggcaagacccctatacaggtttttttaggcgtacctttttcacggcccccgctggggatcttacggttcgcacctcccgagccacctgaaccgtggaagggtatacgcgacgccacaacataccctccaggctgtctgcaggagtcatggggccaactggcgagcatgtatgtatctacacgggaacgatataaatggctgcgattcagcgaggattgtctctatttgaacgtctacgcaccggctcgcgcccccggggaccctcaactgccagttatggtttggttccctggaggcgcattcattgttggggcggctagctcctacgagggaagcgatttggcagcccgtgaaaaggtcgttctggtgtttctccagcaccggcttggcatctttggcttcttgtcaaccgacgactcacacgccaggggtaactggggattgctcgatcagatggcagcgcttcggtgggtgcaagagaatatcgctgcgtttggaggggatccgggcaacgttacactattcggacagtcagcaggggctatgtccatcagcggtctgatgatgtcaccgctcgcctctggattgttccatcgggccatatctcaaagcgggaccgctctcttcagactgtttattacgagtaaccccctcaaagtggctaaaaaggtggcgcacttagccgggtgtaaccacaacagtacccagattttagtaaattgtctgcgggcgttgtccggtactaaagttatgagggtttcaaacaagatgcggttcctacagctgaattttcaaagagatcccgaggaaattatctggtcgatgagccctgtcgtcgatggcgtcgtcatcccagacgatcctctcgtgctgctcactcaggggaaggtcagctcggtaccttacctgctgggggttaataacctggaattcaactggttactgccctatatcatgaaatttcctctgaatcggcaggccatgcgaaaagagacaattacgaaaatgctctggtccactcgaactcttttgaacattactaaggaacaagtgcccctcgtggtggaggaatacctggacaacgtcaatgagcatgactggaaaatgctgagaaatagaatgatggacattgtccaggacgccacctttgtttatgctacactccaaaccgcacattaccaccgagagacacccatgatgggcatctgtcctgcaggccatgcaaccaccaggatgaagtcaacctgcagttggatcctgccccaggaatgggcttag

SEQ ID NO: 10024 - DNA, 756 bp, Artificial Sequence
  Description of Artificial Sequence: Synthetic coding sequence
atgagcagctacggctacggcgacctgttcagcgacacctggaacgcgttcaccgactatgatgtgatccacctaaagacctatgatagcaagcgggtgtgctttaaagaagcagttttttccctcctgccacggatgcgctacggcttattttacaacacgcctcttatcagtgggtgccagaataccggccttttccgcgcctttgcccagcatgtgcttcacaggctgaatatcacgcaagaaggcccgaaggatgggaagatccgggtgacaatcctggcacggtcaaccgagtaccgaaaaatcctgaaccagaatgagctagtcaatgccctgaaaacagtctccacatttgaggtgcagattgtcgattataaatatcgcgagctcggctttctcgaccagctccgcataacccacaacacggatatattcatcggtatgcacggggccggcctaacccacctcctgttcttgcctgattgggctgccgtgttcgagttgtataactgtgaggatgaaaggtgttacctggatttagcaaggctgcggggagtacactacataacctggagacgtcagaacaaagtcttccctcaggataagggccaccaccccacactcggcgagcaccccaagtttacaaattacagctttgatgtagaagagttcatgtatctcgtcctccaggccgccgaccatgtcctgcaacatccgaaatggcccttcaaaaagaagcacgacgagctctag

SEQ ID NO: 10025 - DNA, 927 bp, Artificial Sequence
  Description of Artificial Sequence: Synthetic coding sequence
atgatccccgtggagctgctgctgtgctacctgctgctgcaccccgtggacgcaacttcatatgggaagcaaacaaacgttctgatgcactttccactgtccctggagtcacagactccgagtagtgaccccctgagttgccagttcctccaccccaagtctctccccgggttttcccatatggcacctctaccaaagtttctggtatctttggccttacggaatgccctggaagaggccggatgccaggctgatgtgtgggccttgcagctccagttatacaggcagggcggcgtgaatgctacacaagtgctgatccagcacctgaggggacttcagaaaggtagatctacagagcgcaacgtaagtgtggaggcccttgcctccgctctgcagctactcgctcgcgagcagcagtccaccgggagagtgggccgcagtctgcccactgaggactgcgaaaacgagaaggaacaagccgttcacaatgtggtgcagctgcttccgggagtgggaaccttctataatctgggcacagctctttattacgctacgcaaaactgcctgggcaaggctcgggagcgggggagagacggggcaatcgatctgggctacgacctgctcatgacaatggctggaatgtcgggcggacccatgggactggctatctccgccgccttaaagccagccttgaggtctggcgtgcagcaactgatccagtactatcaagatcaaaaggacgcaaacataagccagccagagactacgaaggaaggactccgagctattagcgacgtgtccgacctggaagaaactaccacactggcatctttcatttctgaagtggtctcatctgcgccttactggggatgggcaattattaaaagctacgatcttgatcctggggccggatccctcgaaatttag

SEQ ID NO: 10026 - DNA, 2862 bp, Artificial Sequence
  Description of Artificial Sequence: Synthetic coding sequence
atgcgggtgctggcctgcctgctggccgccctggtgggcatccaggctgttgaaaggctcagattggctgatggtccccacggctgtgctggccgactggaagtgtggcatgggggcaggtggggaactgtttgcgatgatgggtgggacctaagagacgccgccgtggcctgcaggcaacttgggtgcgggggcgcgctggcggcaccaggcggcgccttttttggcgaaggtgccggcccagtatggctgtctgagctggcttgcaggggcaatgagggccagttgggactctgtcatcacagggggtggaaagcccatatctgtagccatgaggaagatgccggcgtggtgtgcgccgggcagcgggtggccaatagtcgcgatgactctaccagcccattggatggcgctccttggccaggcctgctgctggagttgtcaccatctactgaagagccgctggtgactcacgccccgcgcccggccggaaatccccagaacgcttcaaggaaaaagagcccgcgacccaaacaggcgaagtcaactagggcccctttgctcactacaggcgcacctaggcaagaacgcctgcgcctggtgagcggaccacatcggtgtgccggacgattggaagtctggcacggcggcaggtgggggactgtgtgcgatgacggttgggacctgagagatgccgcggtcgcttgtagagagctgggttgcggcggtgcattggctgctcctgggggcgctcggtttggcccgggagcgggacccgtgtggatggacgacgtaggctgcggcggcggcgaacaggcgttaagagactgtccacgtagcccctgggggcggtccaattgtgatcattccgaggatgctggcctagtgtgcaccggtcccgcccctagacttcgcctcgctgatggtccacacggctgtgctgggcggctcgaagtatggcatggcgggcgctggggctccgtttgtgacgacgcatgggatctgcgcgacgcagccgtcgcttgcagagagctcgggtgtgggggagcattggccgcgcccggcggcgcctttttcggcgagggttccggaccgatcatcttggatgacctgaggtgtcgcggcaatgaaaccgcgctgcgcttctgtcccgccaggccttggggacagcatgattgtcatcatcgagaggacgcaggtgccgtgtgcgatgggatgcccctggggtacgtgccccccaccgctccgacagactctaacaatagcacaccaagagaagccgctagccgtccccccagcaccatgacttcgcaagcaccgggcaccgctggagttagtccacctcctgctagccctacagttctttgggagccaggccctgaggctggaagtccacaactgcggctggttgccgggccatcaaagtgctcaggcaggctggaggtttggcatgaccagagatggggtacagtgtgcgatgattcttgggacatgagggacagcgctgtcgtctgcagggagctgggatgtggtgggccccaacagcctgatcctgctgccggccgctttggctggggcgccggccccatatggctcgacgatgtgggctgcgtggggactgaggcctctttgagcgactgccctgctgccccttggggaaaacacaactgcgctcataatgaagacgtgggagttacctgcacagggccaccgggactggacagcataagtgaccccttcagctggtcatggatccccggtcttggtcgtgacagagatgcctggctcccaggggaacttgctacgaaaccctcggcatccgtgactgcctcagttcttgagaaaaccaccacaaaggcgccggggaagatgcccaaaagcaccaaaaaatgggtgaccaagaatgcaaagcggcctaccactcagccaccagttatgcctacaaccaagcattcaagggcccagagcccgccagatctcacctcacaaacaaccgctgccttgacgaccgaagcctccaggcggcccacctcagagtttacacgtagacccacaaccgaggctccccagagatggacatcccacacgacagctaccttaacaccacaagcgccaagagaacgtacgactaaaacaatggctatgctaacaacgcagggacctcaggagatgaccagcgaatctaccatcaagagcattccacaggcctcactggaaccctcagcggagatccctgagggttctcctgagtcacccaaagaccccgccccatccccctcagtcagcaccactggagagtcaggtttattccgcgtcaggctggcagacggaccgaatcggtgcgccgggagattggaggtatggcatgctggcagatggggaacagtttgcgacgacaattgggatttgcgggatgcaacagtggcatgttgggagctcgggtgcggaaaggtgagaccaagggttggcaaaacacactacggaccagggaccggaccgatttggctcgatgatatgggctgcaagggttccgaggccagcctctcggactgcccttctggcgcctgggggaaacacaattgcgaccacgaggaagatgtcggtctcacttgcacagggtacactgactatgatgactatccaccatggacatgggaccccacgtcgagagaggacctggctaaggggactacgaccgcgggagtaccaggacacacactgccatggagaactacccggcggccaggcagcagctcacctgcaatccgcagacttcccgacactgaacccgaagcaggtttgagagaggtcatgctccttgtacaaggactgcctggactccagcggctgcccagtccgtag

SEQ ID NO: 10027 - DNA, 474 bp, Artificial Sequence
  Description of Artificial Sequence: Synthetic coding sequence
atgctgcggaccgagagctgccggccccggagccccgccggccaggtggcagcagcatccccccttctcctcctgctcctgctgctcgcatggtgtgcaggcgcatgtcgcggtgctcctattctgcctcagggtctgcaacctgagcaacaactccagttatggaacgagatcgatgatacctgcagcagcttcctgtccattgactctcagccacaagcttccaacgcacttgaggagctgtgctttatgataatgggaatgctccctaagccccaggaacaggacgaaaaggataatacaaaacgctcaagcgtggtgcaccccctgttgcaactggttcctcacctccacgaacggcggatgaagcgcttccgggtggatgaggagttccaatctcccttcgcttcacagtctaggggctactttctctttcgacctaggaatggcaggagaagcgccgggttcatttag

SEQ ID NO: 10028 - DNA, 1545 bp, Artificial Sequence
  Description of Artificial Sequence: Synthetic coding sequence
atgcccagcaccgtgctgcccagcaccgtgctgcccagcctgctgcccactgccggggctgggtggagcatgagatggattctctgctggtcactgactctatgcctgatggcccagaccgcactcggtgctttacataccaagaggccccaggttgtgacaaagtatggcacccttcaggggaagcagatgcatgtagggaagacgccgatccaggtgttccttggtgtgcctttcagtcgcccaccccttgggatactccgttttgctcctcctgagcctcccgagccatggaaggggattcgagatgctaccacatatccgccaggctgcttacaggagtcctgggggcagttagcttctatgtatgtgtccacccgcgaaaggtacaagtggctgagattttctgaagactgcctgtatctgaacgtctacgcccccgcccgcgcacctggagacccccaattgcccgtaatggtttggttccccggcggagccttcattgtcggagctgcctccagctacgaagggagtgaccttgccgcaagagagaaagttgtccttgtgttcctgcagcaccggctcggtattttcggatttctctcgaccgatgactcccatgctcgaggcaactggggccttctcgaccagatggctgcccttaggtgggtgcaggagaatattgccgctttcggtggcgacccaggcaatgttaccctattcgggcagtcagcaggggccatgtctatttctgggctgatgatgagtcccctcgccagtggtctgttccatagggcgatcagtcagagtggcactgcgttgtttagactttttattaccagtaacccattgaaggttgctaaaaaggttgcccacctcgcaggctgcaaccacaattctacgcagatattagtgaactgcctgcgggctctcagtgggactaaagtcatgcgcgtgagcaataagatgagattcttacagctcaactttcaacgggatccggaagagatcatttggagcatgagtcccgtggtggacggagtggtcattcccgatgatcccctcgtgttgctgacacagggcaaggtgtcaagcgtaccctaccttcttggagtcaacaacctcgagttcaattggttgttaccatataatatcacaaaggagcaggtgccccttgtagttgaggaatacctggacaatgtaaatgaacacgactggaagatgctgaggaacaggatgatggacatcgtacaagatgccactttcgtctacgcaacactccagacggcacactaccaccgcggtcttagcatgggtaaggagaaagccctttccctccaaatgatgaaatactgggcaaattttgcgcgaaccggaaacccaaacgacggaaatctgccttgctggccccggtacaataaggatgaaaaatacctgcagcttgattttacaacacgggttggcatgaagctgaaagaaaaaaagatggcattctggatgtcattatatcagtcacaacgaccagagaaacagaggcagttctag

SEQ ID NO: 10029 - DNA, 1062 bp, Artificial Sequence
  Description of Artificial Sequence: Synthetic coding sequence
atgagcaaccccacccagaccgacgccgacagcgacctggtgggcgacgtttgcgatacaaatgaagactctgatggagacgggcaccaggacaccaaggacaactgccctcaactgccaaattcaagccagcttgattccgacaatgatggtctgggagacgaatgcgacggagacgacgacaacgacggcatacctgattatgtcccacctgggccagataactgccgactagtacctaacccaaaccaaaaggactcagacggcaatggcgtgggcgacgtgtgcgaagatgacttcgacaatgatgcagttgtcgaccctctcgacgtgtgcccggagagcgcagaggtcaccctgacagactttcgggcctatcagaccgtggtcctcgaccccgagggcgacgcgcagatcgaccccaactgggtagtacttaaccaaggaatggaaatcgtccagaccatgaattcggaccctggactggccgtaggctataccgccttcaacggcgtggattttgagggcaccttccatgtcaacaccgtgaccgacgacgactacgccggctttctgttcagctaccaagattctgggcggttctatgtggtgatgtggaaacaaacagaacagacctactggcaggccacccctttccgcgctgtggcccagcctggcctgcagcttaaggcggtgacgtccgtgagcggaccaggtgagcatctcagaaacgcactgtggcacactgggcatacgccagaccaagtaagactgctgtggacagaccccaggaacgtcggctggcgggataaaacgagctaccgctggcagctgctgcacagaccacaggttggctatattagagtcaaactatatgagggcccccagttggttgctgactctggagtgatcatcgataccagtatgcggggcgggaggctgggtgtcttttgttttagccaggaaaatattatctggagtaatctacagtatcgctgcaacgacacagtgccagaggattttgaacctttcagacgccagctcctgcagggcagggtctag

SEQ ID NO: 10030 - DNA, 1074 bp, Artificial Sequence
  Description of Artificial Sequence: Synthetic coding sequence
atggagatcgagcacaccctggaccagatgatcagcaaggtgggcaaccacatcgatgtgcttacaggcaaatgggtcgcacaggacgccgggataggcgccggcgtggacagttactttgagtacctcgtgaaaggggccattctgctccaggataagaagctaatggccatgttcctggaatacaacaaggcgatacgcaactatacacggtttgatgattggtatttgtgggtgcagatgtataaaggtactgtgtcaatgccagtatttcaaagcctggaggcctactggccaggactgcagtcgctgatcggtgacatcgataatgccatgaggacctttctgaattactatactgtctggaagcagttcggcggccttcctgaattttacaacatacctcagggctacacagtagaaaagcgagaagggtatcctctgagaccagagcttatcgaaagtgctatgtatctgtacagggctaccggcgacccaaccctgctggagctgggtcgagacgccgttgagtctatcgagaaaatcagcaaagtggagtgcggcttcgccaccatcaaagacctaagagatcataaacttgataataggatggaatcattcttcctcgccgaaactgtcaagtacctgtacctcctgttcgaccctaccaatttcatccacaacaacggatccacttttgatgcagtgattactccctatggtgaatgtatccttggcgccggcggttatatattcaacacagaggcccatcccatagatccagcggccctccactgctgtcagaggctgaaagaagagcaatgggaggtggaagacttaatgagagagttctactccttaaagcgatctcggtccaagtttcagaaaaacaccgtgtcaagcggaccctgggagccccctgcccgtccgggtaccctcttcagtccggaaaaccatgaccaagccagagaaaggaagccggccaaacagaaagttcctctcctgtcatgcccctctcagccatttacatccaaactcgccttacttggccaagtgttcctggatagtagctag

SEQ ID NO: 10031 - DNA, 1341 bp, Artificial Sequence
  Description of Artificial Sequence: Synthetic coding sequence
atgctgcaccccgagaccagccccggccggggccacctgctggccgttcttcttgccctgctggggacagcctgggccgaagtgtggccaccacagctgcaggaacaagcaccgatggcgggggcgctcaaccggaaagagtcttttctgttgctcagcctacacaaccgactccggtcctgggtccaacctccagccgctgatatgaggcggctcgactggtctgacagcctagcgcagctcgcgcaggccagggccgctctctgcggcatccctaccccctccctcgcctctgggctgtggcgcacactgcaggtgggatggaatatgcaacttctgccagccgggctggccagctttgttgaagtcgtttctctgtggttcgcagagggccagcggtattcccacgcagccggtgagtgcgcgagaaacgcaacatgcacgcattatacacagctggtgtgggccacaagctcacaactcggctgtggtcggcatttatgctccgcgggacaggccgccatcgaagcatttgtgtgcgcgtacagccccaggggcaactgggaagtcaacggcaagacaattgtcccatacaagaaaggagcctggtgctcactttgtactgcgtcagtctcgggttgctttaaagcttgggatcacgcgggagggctgtgcgaggtgcccagaaacccctgcagaatgtcttgccagaatcacggacgactgaatatctcaacctgtcactgtcactgtccacctggctacaccggtaggtattgccaggtacgatgtagcctccagtgcgttcatggacgctttagagaggaggaatgcagttgtgtgtgtgacataggctatggtggtgcccagtgtgccacgaaggtgcactttcccttccacacctgcgatcttcgaattgatggcgattgctttatggttagctccgaggcggacacttattaccgagcgaggatgaagtgtcagagaaaaggcggggtcctggcccaaattaaatcccaaaaggttcaggacatactcgccttctatctagggcggctggagacgaccaacgaggtaattgattccgacttcgagacccgcaacttctggattggcctcacttacaagactgccaaagattccttccgatgggcaactggcgaacaccaggcatttacctcctttgcttttggacaacctgataaccatggcttcggcaattgcgttgagttgcaagccagcgcggcatttaattggaacaaccaaaggtgtaagactcgcaaccgctacatctgtcagttcgctcaagaacatatatccaggtgggggcccgggtcttag

SEQ ID NO: 10032 - DNA, 900 bp, Artificial Sequence
  Description of Artificial Sequence: Synthetic coding sequence
atgggcggcccccgggccctgctggccgccctgtgggccctggaggccgctggaacagcggcactgagaatcggagcgttcaatatccaatccttcggcgattctaaagtgtcagaccccgcgtgtggatccatcatagccaagatcctggccgggtacgacctggccctagtgcaagaggttcgcgatcccgatctctccgccgtgtccgccctcatggaacagattaattccgtgtcagagcacgaatactcttttgtgagctcccaaccattaggcagagatcagtacaaggaaatgtatctctttgtgtatagaaaagacgcagtatccgtcgtcgacacatacctttatcctgaccccgaagatgtgttttcccgtgaacctttcgtggtgaaattttcagccccgggaacaggcgagcgtgctccccccctcccatcccggcgagcgctcaccccgccacctcttcccgccgccgcacagaacttggtactcattccactgcacgctgctccacaccaggcagtcgcggaaatcgatgccctttatgatgtttacttagatgtgatcgacaaatgggggaccgatgatatgctctttctcggtgactttaatgctgattgctcttacgtcagggctcaagattgggccgcgatccggctccggtccagtgaggttttcaaatggctcattcctgactccgccgacaccaccgtggggaattcagattgtgcctatgaccgtatcgtggcctgtggcgcccggctccggaggtctctgaaaccacaaagcgccaccgtacacgatttccaggaggaatttggtctggaccagacccaggctctggcgatctctgaccacttccccgtggaagtcaccttaaagttccataggtag

SEQ ID NO: 10033 - DNA, 1458 bp, Artificial Sequence
  Description of Artificial Sequence: Synthetic coding sequence
atggacaacaacaagcactgcaagcaggacaactgcctgctgacccccaattcggggcaggaggacgctgacaacgatggtgtgggagaccaatgtgacgacgatgccgacggggacggtatcaaaaacgtagaggataactgccgactgttccccaataaggatcaacagaactctgataccgacagtttcggtgacgcctgcgacaactgtccaaacgtgcctaataacgaccaaaaggacaccgacggtaacggtgagggcgacgcctgtgataatgacgtggatggggacggcatccccaatggcctcgataattgcccaaaggtgccaaacccattgcagaccgaccgggacgaggatggtgtgggagatgcctgtgattcctgtcccgagatgtcaaaccctacacagaccgacgccgacagcgatctcgtaggggacgtgtgcgacactaacgaggacagcgatggcgatgggcatcaggatactaaagacaattgtccacagctgcccaacagtagtcagctggattcggataatgatggccttggtgacgagtgcgacggcgacgatgataatgatggtattccagactatgtccctcctggaccagacaactgccgtctagtccctaaccctaaccagaaagactctgacggaaatggggtgggcgacgtgtgcgaagacgactttgataatgatgccgtggttgatccactggacgtgtgtcctgaaagcgccgaagttacactgaccgatttcagggcctatcagacggttgtactcgacccggagggtgacgcccagatagacccgaattgggtggttctgaatcaggggatggaaatcgtgcaaacaatgaattcagaccctggactggcagtcggctataccgcattcaacggcgtggactttgagggcacgtttcatgttaatactgtaaccgacgatgactatgctggctttctcttcagttaccaagactctggacggttttacgttgttatgtggaaacaaacagaacagacctactggcaggcaactccctttcgggctgtggctcagccaggcctgcagttgaaggcggtaacaagcgtctctgggccaggagaacatctgcgcaatgccctgtggcacactgggcacaccccagatcaggtgcgtctcctgtggaccgatccaaggaacgtgggatggagagacaagacctcctatcggtggcagctattacaccgcccacaagtagggtatatccgtgtcaaattgtatgagggaccacagctggtagccgactctggggtgattattgatacttctatgcggggcggccgccttggagtgttttgtttctcgcaggagaatataatctggagcaatctccagtatagatgcaatgacacagtccctgaagactttgaaccctttagaagacagcttctccagggacgggtctag

SEQ ID NO: 10034 - DNA, 2358 bp, Artificial Sequence
  Description of Artificial Sequence: Synthetic coding sequence
atgaagcacaccctggccctgctggcccccctgctgggcctgggccttggcctggccctgagtcaactcgcggccggagccaccgactgcaagttccttggtcccgctgagcacctcactttcacaccagcagccagagcccggtggttagctccgagagtgcgcgcacctggactgcttgactcgttgtacggtaccgtaagaagattcctcagcgttgtgcaactgaacccgttcccctctgagctggtgaaagctttgctgaatgaactggcaagtgtaaaagtaaatgaagtcgtccgttatgaagccgggtacgtagtgtgtgccgtcattgcaggcctttatttacttttagttcccacggctggcctgtgcttctgctgctgccgatgccacagacgatgcggaggtagagtgaaaactgaacacaaggccttggcctgcgaacgggccgcactgatggtatttctactgctgaccacattacttctgctgatcggagtcgtgtgtgccttcgtcacaaaccaacgaacccacgagcagatggggccgagtattgaggcgatgcccgagacactgctgtctttgtggggtctagtgagtgacgtaccacaggagttgcaagctgtcgcacagcagtttagcctgcctcaggaacaagtctcggaggaactcgatggtgtaggtgtgtctattgggtccgctatacacacacagcttcgaagctcagtgtatccacttctcgccgcagtgggcagtctgggtcaagtgctccaggttagcgtccatcatctgcaaactctaaacgccacagtggtggagttacaggctgggcagcaggacttggagccagccattagagagcaccgcgacagattgctcgagttgctccaggaggcaagatgccaaggagactgcgcaggcgccctgagctgggcccggacactcgaacttggggcggattttagtcaggtcccgagcgtcgaccacgtcctgcaccagctgaaaggagtcccggaggctaacttttcgtccatggtgcaggaagaaaattctacgtttaacgcgctcccagcactggctgccatgcagacctccagtgtggtacaggagttgaaaaaggccgtggcgcagcagcccgagggagtgaggactctggcagaggggtttccaggacttgaggctgcctcccggtgggcccaggcactgcaggaggtggaagaatcatctcggccttatctgcaggaggtgcagaggtatgagacctatcggtggattgtcggctgcgtgctgtgttctgttgtgttgtttgtagttctgtgcaacttactgggccttaatttgggcatctgggggctaagcgctagagatgacccctcccatcccgaggcaaaaggcgaggccggagcccgcttcctcatggccggtgtgggcttaagcttcctgtttgctgccccactgatcctgcttgtttttgccacttttctggttggtggcaacgtccagaccctggtctgccagagttgggagaacggggagttgtttgagtttgcagacacgcctgggaatcttccgccttcaatgaatttatcgcagctgttgggtctacgcaaaaatatctctatccatcaggcttaccagcagtgtaaggaaggagcagcgctatggacagtattacagctgaacgatagttatgatcttgaggaacacttggacataaatcagatccagcggcctgttgtcaagacttccatggagcagttggcccaggagctgcaaggcctggcccaggcccaagacaattctgtgctgggacagaggctgcaagaggaggctcaggggctgcgcaatcttcatcaagaaaaagtggtgcctcagcagtccttggtggcgaagttaaatttgtctgtgcgcgccctggagtcttccgcgcctaatttgcagctagaaacgagcgatgtgctggccaacgtcacttacttaaaaggagaactgcctgcttgggccgcccggatccttcgcaacgtgtctgaatgttttcttgcccgcgagatgggatatttctcacaatacgtggcgtgggtcagagaggaggtgactcaaaggattgccacctgccagccattatcgggagctctggacaattctagggtgatcctgtgcgacatgatggctgacccttggaatgccttctggttctgtctagcctggtgcacgttcttcctgatcccttccatcatttttgctgtcaaaacttccaagtacttcaggcctataagaaaaagactttcatcaacctcgagcgaggagacacagctgtttcacattcctagggtgactagcttgaaactgtag

SEQ ID NO: 10035 - DNA, 792 bp, Artificial Sequence
  Description of Artificial Sequence: Synthetic coding sequence
atgggccgggtgctggaggaggcccggttcgccgtggccttcaccgagtccatgaaagagatggcacaggcccaatggaaggccaggcagataagcctggctgtcacatcggcagtccccgtgcagccccacgccaaaggcaaggtatacgttcagagccaaggcatagcgacaacccccaacgccgcctttaactggaacacgttcctgcagcgctccgaaataaatcagtccgccgataatttgcacatctttctcctgatttgcggcctgaggcaggtcaaagatccattatacctcgtagacgccttctctgcctggcatcaggaggaaccgaatgttcatctggtaatcgttgggccagaggtggatccagtatttacgcgtgaggtcaaggccaaagtgaagcgtgcggcgggagttcgtttaattggcgaaatgccacaggaagacctgcatgctgtggtgaagaattgttttgcggtggttaattcttcagtgtccgagggcatgagcgctgctatcctggaggcaatggatctcgaggtgccggttctcgccaggaacatccccggcaacgccgctgttgtcaaacatgaagtgactggcctgcttttctcgaatccccaagagttcgttcatctggctaaaagactggtctctgatccagctctggaaaaggaaatcgtggtgaatggacgcgaatatgtgcggatgtaccactcgtggcaagtggaaagggatacttatcagcagctcatccgtaagctcgagggcagcacggaagattag

SEQ ID NO: 10036 - DNA, 456 bp, Artificial Sequence
  Description of Artificial Sequence: Synthetic coding sequence
atgaagaccgccgtgatgaaggagctgtacagcttcctgcaccaccaaaatagatatggcagcgagcaagaatttgtggatgatctaaaaaatatgtggttcggcttatattctagaggcaacgaggaaggtgatagctcaggatttgagcatgtcttttccggtgaagtgaaaaaaggtaaagtgacagggttccacaattggatcagattttatcttgaagaaaaagaagggctggttgattattattcacacatctacgacgggcccgtccctgtgaagcccggcagaatatcactaagctgtcccgacatctatttaggtcaggtgcatctttgggaatggcaggaagtccaccggcactccctgcactccgtgttccacctgatcgaattgagggcccgcaagggacacgagggatcgtgtgagacggaagtgctgtcgagccttgactag

SEQ ID NO: 10037 - DNA, 363 bp, Artificial Sequence
  Description of Artificial Sequence: Synthetic coding sequence
atgctgccccagtggctgctgctgctgttcctgctgttcttcttcctctttctattaacaagaggctccctgtcacccacgaagtataatctccttgaactcaaggagtcttgcatccgcaaccaggattgcgaaacgggctgctgccaaagagcccccgacaactgtgagagtcattgtgccgaaaagggctctgaagggtccctgtgccagactcaggtgtttttcggtcaataccgcgcgtgcccttgtttgcggaatctgacatgcatctacagcaaaaatgagaagtggctgagcatcgcttacggccgctgccagaagataggcagacagaaactagccaaaaagatgtttttctag

SEQ ID NO: 10038 - DNA, 951 bp, Artificial Sequence
  Description of Artificial Sequence: Synthetic coding sequence
atggccgaggccgccctggaggccgtgcggagcgagctgcgggagttcccagcagccgctagggaactctgtgtacctttggcagttccctacttagacaaacctccaacacctctgcatttctaccgggattgggtctgcccaaatagaccatgtattattcggaatgcactgcagcattggcccgcactccaaaaatggtcattaccctactttcgagccacagtgggctctacagaggtgagtgtggctgtgacaccagacggttacgctgacgctgtcagaggcgatcggttcatgatgcccgcagaacggcgcctgcccctcagcttcgtccttgacgttctggaaggtcgggcccaacaccccggggtgttgtacgtccagaaacagtgtagcaatctcccttcagagctccctcagctgttacctgatctggagtcccacgtgccatgggcgtcagaggctctcgggaagatgcctgacgcagttaacttttggctgggcgaagctgcggcagtgaccagtttgcacaaggaccattatgagaatctctattgcgtcgtatctggagaaaaacatttcctctttcaccctccatccgacagaccatttatcccttatgagctgtacactcctgctacgtaccagctgacggaagaggggacatttaaagtcgtggacgaggaagctatggagaaggtcccatggatcccactggaccccctcgcccctgacctcgccaggtacccctcctattcccaggcgcaggctctacgttgcaccgtgcgggccggagagatgctgtacctccctgccctctggtttcatcatgtgcagcagtcccagggctgcattgctgtgaacttctggtatgatatggagtacgacctgaagtactcctactttcagttgttggatagcctgactaaggcatccgggctggactag

SEQ ID NO: 10039 - DNA, 657 bp, Artificial Sequence
  Description of Artificial Sequence: Synthetic coding sequence
atgggccgggtgttcctgaccggcgagaaggccaacagcatcctgaagcgttacccgagggccaatggcttcttcgaagaaatacgtcaggggaacattgaacgcgaatgtaaggaggaattttgtacctttgaggaggctcgggaggcgtttgagaacaatgaaaagactaaggaattttggagtacctatactaaggcccagcaaggcgagagcaacagaggctccgactggttccagttctatctgaccttccccctgatcttcggcctgttcataatcctactggttatcttcttaatctggaggtgttttctcagaaataaaacaaggagacagacggtgactgaggggcatattccatttccccaacatctcaacataatcacaccaccccccccaccagatgaagtgtttgatagcagcggcctttcccccgggtttctgggctatgtggtgggtagatcagactccgtctctacacgactttccaactgcgaccctcctccaacttacgaagaagctacaggccaggtgaacttgcagaggtccgagactgagccacacctcgatccaccacctgaatatgaagacatagtgaactcgaattctgcatcggctattccaatggttccagtggtgacaaccattaaatag

SEQ ID NO: 10040 - DNA, 909 bp, Artificial Sequence
  Description of Artificial Sequence: Synthetic coding sequence
atggccatgttcctggagtacaacaaggccatccggaactacaccaggttcgacgactggtatctgtgggtccagatgtataaaggaacagtcagcatgccggtgtttcagagcttggaggcctactggccaggcctgcagtctctgataggcgacatagacaacgcgatgaggaccttcctcaactactacactgtgtggaagcaatttgggggtctccctgagttctacaacattccacagggttataccgttgagaagcgagagggttacccattacgaccggagttgatcgaaagcgcaatgtacctttatcgcgctaccggagatccaacgctgcttgagctgggacgcgatgctgtagaaagcattgaaaaaatcagcaaagtagagtgcggatttgctaccatcaaggatttgagggatcacaaacttgataaccgtatggaatcctttttccttgctgaaactgttaagtacctatacttattattcgatccaacaaacttcattcataacaatggatcaacgtttgatgcagtgatcacgccctacggcgagtgcatcctgggggccggcggctatatatttaataccgaggctcatccaattgaccccgccgctttacattgctgccagcgactgaaggaagaacagtgggaagtcgaggacttaatgcgtgagttttattctctgaagaggtcacggtctaagttccagaaaaatacagtctccagcggcccctgggaaccccccgctcgccccgggacactgttctctccagagaaccacgatcaggcacgcgaacggaaaccagctaaacagaaagtgcccctcctcagttgtccgtctcaaccatttacctccaaacttgcactgctgggccaagtcttccttgactctagctag

SEQ ID NO: 10041 - DNA, 459 bp, Artificial Sequence
  Description of Artificial Sequence: Synthetic coding sequence
atgctggtggacggccccagcgagcggcccgccctgtgcttcctgcttctggccgtggcaatgtcattctttgggagcgccttgagcatcgatgagacgagagctcatttattgcttaaggagaaaatgatgagactcggagggcggttggttcttaacactaaagaggagttagccaacgaacgccttatgacactgaagatcgcggagatgaaagaagcaatgcggactctgattttcccaccaagtatgcacttttttcaggccaaacatttgatcgaacgcagtcaggtctttaatatcctgagaatgatgcccaaaggcgcagccctgcatttacatgatatcggaatcgttactatggactggctggtcagaaacgtgacctatcggcctcactgtcatatttgctttacacctcgcggaattatgcagtttcgtttcgcccaccctacctag

SEQ ID NO: 10042 - DNA, 3951 bp, Artificial Sequence
  Description of Artificial Sequence: Synthetic coding sequence
atggagccccggctgttctgctggaccaccctgttcctgctggccgggtggtgtctgcccggccttccatgccctagcaggtgtctgtgcttcaagtctactgtgagatgcatgcaccttatgctcgaccacattccacaggtcccacagcagaccactgttctggatctgaggttcaacaggatccgagaaattcctggatccgcctttaagaaactcaaaaacctgaatactttgctcctgaataacaaccatattcgaaagatttcccgcaatgcgtttgaaggtctagagaatctcctatacttgtatctgtataagaacgagatccacgcactggacaaacagacattcaagggcctcattagtctggaacacctttacatccacttcaaccaattagaaatgcttcagcctgagactttcggggatctactgcgactagagaggcttttcctccacaacaataagctaagcaaaattccagccggatccttcagtaaccttgactccctgaagcgactccggttggactcaaacgcattagtctgtgactgcgacctgatgtggctaggggaactactgcaagggtttgctcaacatgggcatacccaggccgcagccacttgtgagtatcctaggcgactacacgggcgtgccgtggcatctgtgactgtcgaggaattcaactgtcagtcaccccgcatcacttttgagccccaggacgtggaagtgcctagcggtaatactgtttacttcacttgtcgggcggagggcaacccgaagcctgaaatcatttggattcataacaaccactcgctggatctggaggacgatactcgccttaatgtctttgacgatggcaccttgatgatccgcaatacacgggaatccgatcagggagtctaccaatgtatggcacgcaactccgccggggaggctaaaactcagtctgcgatgttgaggtactcatccttgccagctaaaccctctttcgtgatccagccccaggataccgaggtactgataggaaccagcactactcttgaatgcatggccactggtcatccccaccccctcattacctggacccgcgataatgggctggaactggacggcagtcggcacgtggcgacgagcagtggactgtatcttcagaacatcacccagagggatcacggcagatttacctgtcacgccaataatagccatgggacagtccaggctgcagcaaacattatagtccaagcgcctccccagttcactgtgaccccaaaggaccaggtcgtgttggaggaacacgccgtcgaatggttgtgcgaggctgatggcaaccctccaccagtcattgtctggaccaagacgggaggacagttgcccgtcgaagggcagcacactgtgttgtcaagcggtacgctccgcattgacagagcggcccagcacgaccagggccagtacgaatgccaggctgtgtcctccctgggagtgaaaaaggtgagtgtgcaactgaccgtcaaacccaaagcactcgccgtgttcacacaattacctcaggacacttcggtggaggtaggaaaaaatatcaatatatcttgtcacgctcaaggcgaaccgcagccaatcatcacgtggaataaagagggggtacagataacggagtcggggaaattccacgtagacgacgagggtactctcacaatttacgatgcagggtttccggatcaggggcgctatgagtgcgtcgcgcgcaatagcttcgggttggccgtcacaaatatgtttctgacggtgaccgccattcaaggacgccaggcaggcgacgactttgtggaaagtagcatactggacgctgttcagagagtggacagcgccataaattctacacgacgacacctcttcagtcagaaaccccacacgtctagtgacctcttagcccaattccattacccacgcgatcctctgatcgtggagatggcccgcgctggcgagatcttcgaacatactctgcagctgattcgagagcgagtgaaacagggcttaaccgtagatctggaaggtaaggagttcagatacaatgatttagtgtcccctcggtccctgagcctgattgcaaatttgtcaggctgtaccgcaaggagacctctacccaattgtagtaatcggtgcttccacgcgaagtacagagcccacgacggtacatgcaataacctccagcagccaacgtggggcgctgcactgaccgcctttgctcgcctgttgcaacccgcctacagagatggtattcgagccccacgtggcctcggactacccgtcggttcccgacagcccctcccgcctccacgcctcgtggcaaccgtatgggccagggcggctgctgtcacccctgatcattcgtacactagaatgctgatgcactggggatggttcttagaacatgacctggatcacacggtcccagctctgtccacggctcggttttccgacggcaggccatgctctagcgtttgtaccaatgatcccccttgctttcccatgaacaccaggcacgcggatcctagaggaacacacgctccttgtatgctgttcgcgaggtcttctccagcatgtgcttccggccggccctcagctactgtcgactctgtgtacgcccgtgagcagataaatcaacagacggcttacattgatggtagtaacgtttatgggtcgtccgagagagagagccaagctctgagagaccccagcgtcccccgggggctgcttaaaacaggatttccatggccacctagcggcaagcctctgctcccctttagcacaggaccccccaccgagtgcgctaggcaggagcaggagtcaccctgcttccttgctggcgatcacagagccaacgaacacttagcactcgcggctatgcataccctctggttccgtgagcacaaccgcatggctacagaactctctgccctgaaccctcattgggaaggcaacacggtatatcaggaggcacgaaagattgtgggcgccgaattgcaacacatcacctacagccactggttgcctaaggttttaggagatcccggcaccagaatgcttagaggctatcgaggatataatcctaatgtcaatgccgggattatcaactccttcgctacagccgcatttcgctttggtcatactttgattaatcccattttgtacaggctgaacgcgacccttggagaaatttctgagggacacctccccttccacaaagccctttttagtccttctaggatcatcaaagagggcggcatcgatcccgttcttcgtggactgtttggggtggctgctaaatggcgcgccccaagctatctgctgtctcccgagctgacacaacggctctttagcgctgcgtacagcgccgccgtagacagcgcggctacaatcattcagaggggtcgggaccacggtattcccccatacgtagacttccgggttttttgtaatttaactagcgtgaagaatttcgaggatctccagaatgagattaaggatagtgaaatccggcagaagctgaggaagctctatgggagtcccggcgacatcgacctttggcctgctttgatggtggaagatctcattcctggcacaagggttgggcccacgctaatgtgcctcttcgtgacccagttccagaggctgagagacggtgatcggttctggtacgaaaaccctggagtgttcacaccggcacagttgacacagttaaaacaggcttcacttagcagagtgctgtgcgacaatggcgattccatccagcaggttcaggccgatgtatttgttaaggcagagtacccccaggactacctgaactgcagcgagatcccgaaggtggatttaagagtgtggcaggattgctgcgccgacaagcaggctgggggcactccggaggctgggagggtttaccgctgctag

SEQ ID NO: 10043 - DNA, 891 bp, Artificial Sequence
  Description of Artificial Sequence: Synthetic coding sequence
atggaccccagcaagatcgcccacaccgagtaccccgtgaacaccattatcatccatgaggacttcgacaataatagcatgagcaataatattgccctgcttaaaaccgatactgcgatgcactttggcaacctcgtgcaatcaatctgtttcctgggccggatgctgcataccccccccgtgcttcagaactgctgggtgagcggctggaatccgacatccgctactggcaaccacatgaccatgtctgtgctgcgtaagatctttgtgaaagacctagatatgtgtcccttatacaagttacagaaaaccgaatgcggatcccatacaaaggaggaaacaaagaccgcgtgtctgggcgatcctggctctccaatgatgtgtcagctgcagcagttcgacctgtgggttttgagaggagtcctcaactttggtggcgagacatgcccaggcttattcctgtacacgaaggtggaagactacagcaagtggataacaagcaaagcagagcgcgccggcccaccactctcctccctgcaccactgggaaaagctcatcagtttcagccatcacggacctaatgcgactatgacccagaagacatactctgacagtgaattgggtcacgtgggatcctatctgcagggtcagcgccggaccatcacccattcaaggctgggcaattcatcgagagactcactggacgtgagggagaaagatgtgaaggaatccggacgatcacccgaagcatccgtgcaaccattatactacgattactatggcggagaagtgggagagggaagaatttttgccgggcagaatcgactttaccagcctgaagagataatcctcgtatcgtttgttctggtctttttctgtagctcaatttag

SEQ ID NO: 10044 - DNA, 2808 bp, Artificial Sequence
  Description of Artificial Sequence: Synthetic coding sequence
atgcggaagccccggcggaagagccggcagaacgccgagggccggcggtctccatccccttactctctgaaatgttccccaacacgagaaaccctcacttatgctcaggcccagagaatagtggaggtagacatagacgggcgattacatagaataagtatttacgatcctctaaaaattattactgaagatgagctgaccgctcaggacatcacagaatgcaacagcaacaaggagaattctgagcaaccacagtttcccggcaagagcaaaaagccatcctccaagggtaagaagaaggagtcttgcagcaagcatgcttccggtacaagctttcacttaccccaaccttcattccggatggtggattctggaatccagccagaggctcctccactgcctgcagcgtattacaggtacattgagaagcctccagaggatcttgacgctgaggtcgaatatgacatggatgaagaggatcttgcctggctggatatggttaatgagaaaaggcgcgtcgatggccactctttagtgtctgccgatacctttgagctactcgttgatcgcttggaaaaggagagttacttggagtctcgctcctcaggggctcagcagtcccttattgatgaggatgcgttttgctgcgtgtgtcttgatgacgaatgccacaattcaaacgtaatcctcttctgcgacatttgcaaccttgcagtgcatcaagaatgttacggggtgccatatatcccagagggccagtggttatgtaggtgctgtctgcagtcaccttcccgtccagtcgattgtatcctgtgtccgaataaggggggcgcatttaagcagacaagcgacggacactgggctcacgtcgtgtgcgccatctggatccccgaggtttgcttcgcaaacactgttttcttggagcctattgagggaattgataatataccccccgctaggtggaagctcacttgctatatatgtaagcagaagggtctgggcgctgccatccagtgtcataaagtgaattgttatacagcctttcacgtcacatgtgcccagcgggccggcttgtttatgaaaatcgaacctatgcgggaaacctccctcaatggcacaatttttacagtgcgtaagacagcatattgcgaggcgcactccccccccggagccgccactgcccgccgcaaaggcgattcgccccgatctatctccgaaacaggcgatgaggagggcctaaaagagggcgacggggaagaagaggaggaggaggaagtggaagaagaagagcaggaggcccagggaggagtgtctggttccctgaaaggtgtgcccaagaagagcaaaatgagtttgaagcagaagatcaagaaagaaccagaagaagccggacaggataccccttccacactgcccatgctggccgtccctcaaatcccctcatatagactgaataagatctgtagcgggctctcattccagagaaagaatcagttcatgcaacgcctccataactattggctcctcaagaggcaagctaggaacggtgtgcccctgatccgtagattacactcccacttgcagtctcaaagaaacgccgaacaaagagaacaagacgagaaaacctcggccgtgaaggaagagttgaaatactggcagaagctccgtcatgatttggaacgggccagattacttattgagctgatcagaaagagggaaaaactgaagcgcgaacaggttaaagttcagcaagccgcaatggaactggaattaatgccatttaatgtgctgttacgcactacactggatctgttacaagagaaagaccctgcgcatatatttgctgagcctgtcaacctgtcagaagtgcctgactacttggagtttatctcaaagccgatggacttttcgaccatgcggcgcaaactggagagccacctgtaccgtacgcttgaagagtttgaggaggattttaatctgattgtaactaactgcatgaaatacaacgccaaggatactatttttcatagggcggccgtcagattgcgggatttaggcggcgcaattctgcgacacgctcgcagacaggcggagaacataggatatgaccctgaacggggcacacaccttcctgagtccccgaagttagaagacttctaccggttcagttgggaagatgggatgactaacggctttggcaagcatacagaaagtggatcggacagtgagtgctcacttggtttgagcggcggtctggcttttgaggcttgctcaggcctgactccccctaagaggagccggggaaaacctgccctctccagagtgcctttcctcgagggcgttaacggcgacagtgattacaatggctcagggcggtcactgctgctcccctttgaggataggggagacctggagcccctggagctggtgtgggctaaatgcagaggatacccctcctacccagccctgatcatagatcccaaaatgccgcgcgaagggctgctgcataacggcgtaccaatccccgtgcccccacttgatgtcctgaaattgggcgaacagaagcaagctgaggctggcgagaaactgtttctggttctgttcttcgataataagcgcacatggcagtggctgccccgtgataaagtgttgcctctgggggttgaggacaccgtggataaactgaaaatgctcgaaggccgaaagacatctattagaaaatccgtgcaggtcgcttacgatagagcaatgatacatttgagccgggtccgcggtcctcactccttcgttacatctagttatctgtag

SEQ ID NO: 10045 - DNA, 270 bp, Artificial Sequence
  Description of Artificial Sequence: Synthetic coding sequence
atgaagaccggcctgttcttcctgtgcctgctgggcaccgccgccgctataccaacaaacgctcgcttactgagcgatcacagcaagccaaccgccgagacagtggccccagacaatactgcaatccctagcctccgcgcagaagccgaggagaatgaaaaagagactgccgtcagcaccgaggacgacagtcaccataaggccgagaaatccagtgtacttaagtccaaagaagagtcccacgaacagagtgctgagcagggaaagtag

SEQ ID NO: 10046 - DNA, 657 bp, Artificial Sequence
  Description of Artificial Sequence: Synthetic coding sequence
atgggccgggtgttcctgaccggcgagaaggccaacagcatcctgaaacggtacccccgcgccaacggctttttcgaggaaattcgccagggtaacatcgaacgagagtgtaaggaggaattctgtacgtttgaggaggctagagaagcctttgagaacaatgagaagaccaaggaattctggtcaacctatactaaagctcaacagggggagagcaatcgtggaagcgattggttccagttctacctcacattccctctaattttcggcctcttcattatcctcctggtgatcttcctaatctggcgttgcttcctgcgcaacaaaactcgcaggcagactgttaccgagggccacatcccatttccccagcacctgaacatcataacccccccgcccccccccgatgaggtgttcgactcttccgggctctctcctggtttcctgggatatgtcgtggggcggagcgacagcgtctctactaggctctcaaactgcgacccccctcctacatacgaggaagccaccggacaggtgaatctgcagcgaagtgaaaccgaacctcacctggacccaccacccgagtatgaagacattgtgaacagtaatagcgcttcagctatacctatggtgccggtcgtcacaaccattaaatag

SEQ ID NO: 10047 - DNA, 540 bp, Artificial Sequence
  Description of Artificial Sequence: Synthetic coding sequence
atgagcctgggccccgaggtgttcctgggcccccccgaggcccagagcttcctgtcatcccacactcgaatcccaagggcaaatcattgggaccttgaactcctcacccctggcaacctcgagcgagagtgtctcgaggaaaggtgttcatgggaagaggccagggaatatttcgaggataataccttgaccgagagattctgggagtcttacatatacaatggcaaaggggggagagggcgcgtcgatgtggcctctttagcagtggggctgacaggcggaatcctcctgatcgtgctggccggactcggagccttctggtatttaaggtggcgccagcataggggtcagcagccatgtccccaggaagccggactgatttctcctctgtccccgctgaacccgttaggacctccgaccccactgccaccaccccccccccccccccccggcttacccacatatgagcaggctctggccgcgtccggggtccacgatgccccacccccaccatacacatcccttaggcggccccactag

SEQ ID NO: 10048 - DNA, 765 bp, Artificial Sequence
  Description of Artificial Sequence: Synthetic coding sequence
atgaccctggaggacatcgtgcagcgggaggtgtggggcaccgtggtggcgcgtggagcccccgcaccccctggtccggtgcctactcgcggggcggcttcaagaagactgtccgtgtcccccgcttctacctcagagacgtccctctaccaggtccttttaggggcaaggcaattagtgcagccaggccctcacgcaatgtacgcaagagtgagacaggtagagagtaacccgctgtatcagggtactgcctcttctgcggatgtggctttggtcgagcttgaggcgcccgtacccttcactaactatatattaccggtctgtctacctgacccatctgttatttttgaaaccgggatgaactgctgggtgacaggctggggtagcccgtcagaggaggacctccttcccgaaccccgaatcctgcagaaacttgccgtcccgatcatcgacacgccaaaatgcaacttattatattcgaaggacaccgaattcgggtatcagcccaaaacaatcaagaacgacatgctgtgtgcaggctttgaagaaggaaagaaagatgcgtgtaagggtgatagtggggggccgctggtgtgccttgtgggacagtcctggctgcaggcaggggtgatcagctggggggaaggctgcgcccgacagaacaggccgggcgtgtatatccgcgtcacagcccaccacaattggatacatagaatcattcctaaactgcaatttcaacctgcccgtctgggtggccaaaaatag

SEQ ID NO: 10049 - DNA, 1899 bp, Artificial Sequence
  Description of Artificial Sequence: Synthetic coding sequence
atgaccccccccgtgctgaccaccgccgagaccagcgtgaagccctcagtcagtgctttcactcacagtccccctgagaatacaactggaatcagcagcactatttcctttcactccagaacactgaacctgactgacgtaatagaggagctggcacaggcttcaacccagaccttaaagtctacaatcgcctccgaaactaccctttctagtaaaagtcaccagagcactacaacccgaaaagcgataatccggcattcaaccatccccccgttcctgagctcctccgctaccctgatgcctgtccccatatctccgcccttcacacagagagcagtgaccgacaacgtggcaaccccaattagcgggctgatgacaaacacagtggtgaagctacacgagagctcccgccacaacgctaagcctcaacaattggtggccgaagtggccacctctcccaaggtgcaccctaatgctaagttcaccattgggacgacccattttatttactctaacttgctacattcaacccctatgcccgcactaacaacagtcaagtcgcagaattctaagcttaccccatcaccttgggcagaaaaccagttctggcacaagccctattctgagatcgccgaaaaaggcaaaaaaccggaggtgtccatgttggctacgaccgggctgtccgaagcaaccaccctggtgagcgactgggacggccaaaagaacactaagaaatccgattttgacaaaaagcccgtccaggaggctacaacctccaaactccttccattcgactccctctcaagatacatctttgagaagccgaggatcgttgggggtaaggcagccagctttacaatacccgctaactctgatgcatttctcccatgcgaagctgtgggcaaccccctgccgaccatccattggacacgggtcccatctggactggatttatctaaacggaaacagaattcacgcgtccaagttttacctaacgggactttgtctattcagagggttgagattcaagatcgtggtcagtatctgtgcagtgcaagcaatctattcgggacagaccatcttcacgtgaccctctctgttgtgagttacccccctcgcatcctagaaaggcgtaccaaggaaatcaccgtgcatagcggttcaactgttgaacttaagtgcagggcggaggggcgacccagcccaacggttacctggattctggctaaccagacagtggtctctgaaagtagtcagggatctcggcaggcggtggtaacagtggatgggacgctggtgctacacaatttatcgatatatgacagagggttctataagtgcgtggccagcaatcccgggggacaggattcgctcttggtcaagatccaggtgatagcggccccaccagtcatcctggaacagaggcggcaggtcatcgttggaacatggggagagagccttaaactgccatgcaccgcaaaagggaccccccagccctcggtgtactgggtgctaagcgatggaactgaagttaaacccttacagttcacaaactcaaagctgttcctgtttagcaatggtaccttgtacatcagaaacctcgcctctagcgacagagggacctacgagtgcatcgccacctcgagtacaggctctgagagaagagtggtcatgctgactatggaggagcgggtcacttcacccaggatcgaagcagccagtcaaaaaagaactgaagtgaactttggggataagcttctgctgaactgtagcgctaccggcgaacctaaaccacagataatgtggaggctgccctctaaggccgtcgtcgatcagcagcaccgggttgctgcgggctcgaccagtaccctgatggatccctgtctgctggaccagtag

SEQ ID NO: 10050 - DNA, 681 bp, Artificial Sequence
  Description of Artificial Sequence: Synthetic coding sequence
atggacatcatcgtgctgctgcccaagggccactgcaccaagatccaagagcttcagatgactacagtcctcaaacagaacgtgcatgttttcggggtggaaggcaatagtgacgaactagacgaacccatcaagaccgtctttgcggatgtggcgttcgtgaaaaaacacaacttgatgagcttgaacagtattaattggtcaagggtcctggttcagatggctcatcattttttcgcttacttccagtgtaccccatcgcttgatactcaccccttgccactcgtggaggttgtggtccctactggcgctgccggcaatcttgcagcggggtatatcgcccagaaaataggccttccaattcgtctcgtggtggccgttaataggaatgatataattcaccgcactgtacaacagggggatttttctttgtccgaagctgtcaagtccacccttgcatccgctatggacattcaggttccgtacaatatggagagggtgttttggctgctgagcggctctgatagccaggtgactcgcgctttgatggaacagtttgaacgcacgcagagcgtgaacttacctaaggagctgcacagtaagcacagccctgtgttgccgaggccttgcctgtgctcccaagttcctgggagctgccccggctgctggcctgatccctag

SEQ ID NO: 10051 - DNA, 729 bp, Artificial Sequence
  Description of Artificial Sequence: Synthetic coding sequence
atgttccagaccggcggcctgatcgtgttctacggcctgctggcccagacccttccactcaatgtgaatcccgcactacccttgagtccaaccggactggccggtagtctgacgaacgcgctcagtaacggacttttatctggcggcctcctgggtatcctggagaacttgccacttctggatatcctgaagccaggaggcggcaccagcggagggctgctcggcgggttgctgggcaaggttacgtccgttattcctggactgaacaacatcattgacattaaagtgactgatcctcaattgcttgagctcggtctcgtccagtcaccagacgggcataggctgtatgtcacaatcccacttggaattaaattgcaagttaacactccgctggtgggggcttctttactgaggctcgcggtgaagctcgatataacggctgaaatcctggcggtcagggataaacaggagcggattcatctggttctgggggactgcacgcactcccctggctccctccagatctcactgctcgacgggctggggcccctgccaatccaaggactcctggacagcttgaccggtatccttaacaaagtgctcccagagctggtgcagggtaacgtgtgcccactggtaaatgaggttctgagaggtttagatatcactctcgttcatgatatcgtgaatatgttgatccacggcctccaattcgtcattaaggtctag

SEQ ID NO: 10052 - DNA, 1422 bp, Artificial Sequence
  Description of Artificial Sequence: Synthetic coding sequence
atgagcctggaggccagcctgtgcagcctggaggagtgcgccgcctttcagccttcttccccatcgccactgcaaccacaaggtcccgttaagtctaacaatatagtcacagtgacagggatatctctctgtctgttcattattatcgcaaccgttctcatcactctgtggaggcggttcggtcggccagcaaaatgtagtacaccagcgcgccataactctattcactctccctcatttagaaagaactcagacgaagaaaacatctgcgaattgtccgaacaaaggggctcctttagtgacggaggggatggacccactggtagccccggggataccggtattcccctgacatacaggcgatctggacctgtgcctcccgaagatgatgctagcggttcagagtctttccagagtaatgcacaaaaaatcatccccccattgtttagttatagactggctcagcaacaactcaaggagatgaagaagaagggcctcactgagactacgaaagtttaccacgtgtctcagtctccactgaccgatacagcaattgatgccgcacccagcgcaccactggacctcgaatccccagaggaagcggctgccaataagtttcgcattaaaagcccctttcctgaacagcctgctgtttcggccggggaacgtccaccatccagattggacttgaacgtcactcaggccagctgtgcgatctcaccatcacaaaccctcattcggaagtctcaggcgaggcatgtcggctctagagggggtccatctgaaagaagccacgctcggaatgcacatttcaggaggactgcttcattccatgaagccagacaagcacgccccttcagggagcggtctatgtccactctgaccccgcggcaagctcccgcctatagctcccgtacaagaacctgtgaacaggcagaagatcgcttcagaccccaaagtcgtggtgcccatttatttcctgagaagttggaacattttcaggaagcaagcggtaccagaggcccattaaaccctcttccaaaatcgtataccttgggtcagcccttgcgcaagcctgacctgggtgaccatcaagccggcctcgtggcggggattgagagaaccgaacctcatagggctcgtcgcggaccaagtccttcacacaaaagcgtgtctagaaagcaaagttcgccaatctccccaaaagataattatcagcgcgtaagctccctctctccctcgcaatgtcgcaaggacaagtgtcaaagctttcccactcatccagagttcgccttttacgataacaccagtttcggcctaactgaggccgaacaacgcatgctggatttaccaggctatttcggctccaacgaagaggacgaaaccacttctacactgtctgttgaaaagctcgtgatttag

SEQ ID NO: 10053 - DNA, 2310 bp, Artificial Sequence
  Description of Artificial Sequence: Synthetic coding sequence
atgctgagcaagaagggcatcttcccctggatcctgacctgcatcagtgaggaaatggcattccggaccatatgtgttctagttggtgtgtttatttgctcaatatgcgtaaagggcagttcacagcctcaggcacgggtgtatcttacctttgatgagcttagggagactaaaacatccgaatacttctccctgtctcaccatccattggattatcggatcctgctgatggacgaggaccaggatcgtatctatgtagggtcaaaggaccacatcctgtccctaaacattaacaacattagccaggaagccctttctgtgttctggccagcatccacgatcaaagtcgaggaatgtaagatggcagggaaagaccctacacatggttgtgggaatttcgtgcgcgtgattcagacctttaaccggacacatttgtatgtctgtggtagcggagccttttcccctgtatgcacgtaccttaacagaggtcgacggtctgaggaccaagtctttatgatagacagcaaatgcgaaagcggcaagggcaggtgttcttttaatcccaacgttaatacagtgtctgtcatgattaacgaggagcttttcagtggcatgtatatcgactttatggggacagacgcagccatattccgtagcctgactaagcgcaatgctgtaaggaccgaccagcacaattctaaatggctgagcgagcctatgtttgtggacgcgcatgttatccctgatggaacggaccctaatgatgctaaagtctactttttctttaaggaaaagctgaccgataacaaccgtagcaccaagcaaatccactcaatgattgcccgaatttgtccaaatgacacgggcgggcttcgcagtctggtaaataagtggaccaccttcctaaaggctcgcctcgtgtgcagcgtaactgacgaggacggccccgagactcactttgacgaactcgaggacgtgttcctgctggaaaccgacaacccccgcacgacgctggtgtatggcatctttaccacctcgagctccgtgtttaagggctcggcggtgtgcgtgtatcacctaagtgacattcaaacagtgttcaatggacccttcgcacacaaggaggggcctaaccatcagctcataagctatcaaggccgaattccttacccgaggccaggaacctgtccaggcggtgcctttacaccaaatatgcggactactaaagaattccctgacgatgtggtgacattcattagaaatcatcctttgatgtacaatagtatttatcctatccacaaacgacccctgatcgtacgcatcgggactgactataaatatacaaaaatcgcagtggatcgggtcaatgctgcggacggtagatatcatgtgcttttcctggggacagatagagggacagttcagaaggtcgttgtgctcccgaccaacaactccgtgtctggcgagttaattcttgaagaactggaggttttcaagaaccacgcaccaatcactactatgaaaatcagctccaaaaagcaacagctctacgtgagctcaaacgagggcgttagccaggtgtcactccacagatgccacatttacgggaccgcctgtgcagattgttgtctagctagagacccatattgtgcatgggacgggcacagctgtagccggttttatcccactggcaaacgccggtcccgtaggcaggacgtccgccacggaaatccactcacccagtgccgcggatttaatttgaaggcctatcggaacgcagctgagatcgtacagtacggggttaagaataacacaacctttctcgaatgcgcccctaaaagcccgcaggcctctattaaatggctcctccagaaggataaggacaggaggaaggaagtcaaattaaacgaacgaatcattgccacctcccagggcctgctgatccgttcagtccaggggagcgatcaggggctgtaccattgcattgccactgagaattccttcaaacaaacaatagctaaaatcaactttaaggtgctggatagcgagatggtagctgtagtaacagataagtggtcaccatggacctgggcatcaagcgtgagagctcttcccttccatcctaaggatattatgggagcgttctcccacagtgagatgcagatgattaaccaatattgtaaggacactcggcagcagcatcaacagggtgatgaaagccagaaaatgaggggagattatggcaaactcaaggcactgataaattccaggaaaagccgaaaccggcgtaaccagctgcccgagagttag

SEQ ID NO: 10054 - DNA, 942 bp, Artificial Sequence
  Description of Artificial Sequence: Synthetic coding sequence
atgcccggctggctgaccctgcccaccctgtgccggttcctgctgtgggcttttacaatctttcataaagctcagggggacccagccagccacccaggcacaactccaccaagttataaagtccgctggtcaaaggttgaacctggggagctgcgcgagactctgatcctcatcactaatgggctgcacgcccgaggttacggacctcttggcggtagagcccgcatgaggcgaggccatcggctggatgcttctctggtaattgctggcgtgcgcctggaggacgaggggcgctataggtgcgagttgataaacgggatcgaggacgaaagtgtagctctgacattatctcttgagggggtggtgttcccatatcagccctcaagggggagataccagtttaactactatgaagcaaagcaggcctgcgaagagcaagacgggaggctggcaacctactctcaattgtatcaggcctggacggaggggctcgattggtgtaatgcaggctggctgctggagggctccgtgcgttaccctgtgcttactgccagagcaccctgcggcggccgtggcaggcccggaatccggtcctatggccctcgcgaccgtatgcgcgataggtatgatgctttttgcttcacatccgcactggctgggcaggtatttttcgttcctggccgcttaactctgagtgaagcacatgccgcatgccggcgtcggggtgccgtggtggccaaggtgggacacctttacgcagcatggaaattcagtggcctggaccagtgcgacggtggctggctggccgacggatccgtgcgttttccgatcacaacccctcgtccaagatgcggggggctacctgacccaggcgtccgctcttttggcttcccacgaccccagcaggcagcatacggcacctactgttacgctgagaattag

SEQ ID NO: 10055 - DNA, 1089 bp, Artificial Sequence
  Description of Artificial Sequence: Synthetic coding sequence
atggcctggaccttcgagtgcagccggaccaccagccccgagcccctctcgacctctccatgccggaccaccagttcaagaaattccccaaccatgagctgtccggcctccgtagcctgtgagccctctactagtactaccacctcgtctccccccaaggcttgtctcacgaggccaagttctccctcgcccagctgcagcacctcagcctggcacaataagaataatctgatctccaaagtgccacgaggtgccttatcaaggcaaacacagcttcgggagttgtatttgcagcacaaccagctcacagactctggtttggacgcgacgaccttttctaagctgcactctttggaataccttgacctttcccacaatcagttgacaactgtgccagccggccttcccaggaccctggccattctgcatctgggacggaatcggatccgacaagttgaggccgctagactccacggagctcgcggacttcggtacctcttgctgcaacataaccaattaggaagcagtggcttgccagccggagctcttcgcccgctgcgaggactgcatactctccacctgtacggaaatgggctcgatagagttcctccagccctgcctcggagactaagagcgctggtcctaccacataaccatgtggccgccctgggggctagagacttggtcgctactcccggtctgaccgagctgaacctcgcctataacagattagcttccgccagggtgcaccaccgggccttcaggcgattaagagccctacgttcgctggatctcgccgggaaccagctcacccggctgccaatgggcttaccaacaggactgaggactcttcagcttcagcgcaaccaactgcgcatgctagaacccgagcctttggccggacttgatcaactgcgagagctatcactcgctcacaataggctcagggtgggtgacatcgggccggggacttggcatgagttacaggccctccaggtcagacacaggctcgtctctcataccgtgcccagggcacccccctcgccttgtttaccttgtcacgtgccgaacattctcgtgtcatggtag

SEQ ID NO: 10056 - DNA, 900 bp, Artificial Sequence
  Description of Artificial Sequence: Synthetic coding sequence
atgctgcaccccgagaccagccccggccggggccacctgctggccgtgctactagccctgctcggcactgcatgggctgaggtatggccaccacagctgcaggagcaggctcccatggcaggcgctcttaataggaaagagtcctttttattgctctctctgcacaatagacttaggtcatgggtgcagccgccagcagccgacatgcgaaggctggactggtcagactcgctggcacagctggcgcaaggtagccccctgtggaaccccaaccctgaaccgggcgttagaccagtcgcacatcctgcctctggactggagcatgccgctgcccccagagcctggtgccctttatcaaagtggagtctgtggtttgccgagggacagcggtactctcatgctgcaggagagtgcgctcgcaacgccacctgtacccactatactcagctggtgtgggctacttcttcccagctgggctgcggtcggcacttgtgtagtgccggacaggccgcaatagaagcgttcgtatgcgcctactctccaagaggaaactgggaagtgaacggtaagacaattgtgccttacaaaaaaggagcatggtgtagcctgtgcacagcctcggtctcaggctgtttcaaggcctgggatcacgccggcggcctgtgcgaagtgcctagaaacccttgcaggatgtcatgccagaaccatggcaggctcaatattagtacttgccactgccattgcccacctgggtacaccgggaggtactgtcaggtccggtgtagtctgcagtgcgtccacggtaggtttagagaggaggaatgctcttgcgtgtgtgacattggctatgaacccagtgtcccgccacggtgcatcttcccctctacccctgttacttag

SEQ ID NO: 10057 - DNA, 1047 bp, Artificial Sequence
  Description of Artificial Sequence: Synthetic coding sequence
atgctggacaccaacctgatcctgctgcccctgttccagttcatcgtacccaaagagtggaacagcaaataccgacctgtctgcatccacttggctggaaccggggaccatcactactggaggagaaggacactaatggccaggccaatgatcaaggaggcaaggatggctagcttactccttgaaaatccttactacggatgtagaaagcctaaggatcaggtcaggtcctccttaaagaatgtgagcgacctgttcgtgatggggggggcactggtactcgagtcagccgctctgctgcattggctggaacgcgagggctatgggccactcggcatgaccggcatttcaatgggaggccatatggcatctcttgccgtgtcaaattggccaaagccaatgccgcttataccttgcctgagttggtcaactgccagtggtgtgttcacaaccaccgactcgtttaaaatggggcaggagtttgttaaacattttacatcttctgccgataaacttacaaacctgaatctggtgagtaggactctgaacctggacatctcaaaccaggttgtctcccaaaaacccgccgactgccacaacagcagtaaaacaagcgtgagcgctaccagcgagggtttgttgctgcaagatacctctaaaatgaagcgattcaatcagacactgtctactaacaagagcggctacacatcaaggaaccctcagtcttaccatcttctgtccaaggaacaatcaagaaattcattacggaaagaatctctgatctttatgaaaggagttatggacgaatgcacacacgttgccaacttctctgtgccagtcgatccaagtctcattatcgtggtacaggctaaggaggacgcctatatcccccgcactggggtgcggagtcttcaggaaatctggcccggatgtgagataaggtacttagaggggggacacatatctgcctacctgtttaagcagggcctttttcggcaggccatctacgacgcatttgatagattcctgcataagtacgctaactag

SEQ ID NO: 10058 - DNA, 1044 bp, Artificial Sequence
  Description of Artificial Sequence: Synthetic coding sequence
atgcgggcctgcatcagcctggtgctggccgtgctgtgcggcctggcttgggccgatctgtactctgctcctacttcctgccaaggaaggtgttacgaagcattcgacaaacaccatcaatgtcattgcaatgctagatgccaggagttcggaaactgctgtaaggacttcgagtctttatgctccgaccacgaggtgagccactcctcagatgcgatcactaaggaggagattcaatccatctcagagaaaatataccgtgctgacacaaacaaggcgcagaaagaggatatcgttctgaattcgcaaaactgtatttccccttccgaaacacgcaatcaggtggacagatgtcccaaacctcttttcacctacgtgaacgaaaagctgtttagtaagcccacctacgcagcattcatcaatctgttaaacaactaccagcgagcaaccggccacggagagcatttctctgcacaggaattggcggagcaggacgcattcctgagggaaattatgaagactgctgtgatgaaagagctatacagctttctgcaccaccagaaccgctacggaagcgagcaggagttcgtcgatgatctcaaaaacatgtggtttggcctgtatagcagggggaacgaggaaggcgacagttctgggtttgagcatgttttcagcggggaagttaaaaagggaaaagttacaggcttccacaactggattcggttctacttggaagaaaaggaagggctcgtggactattactctcatatatacgacggcccctgggactcctacccagatgtactagcaatgcagttcaattgggatggctactataaggaagttggatcagcgttcataggaagttcccctgagttcgagttcgccttatacagcctttgctttattgctcgtcctgggaaggtgtgtcaactttcgctcggagggtacccgctcgcagtgcggacttatacctgggacaagagcacttatggaaacgggaagaagtacatagcaaccgcctatatcgtgtcctccacatag

SEQ ID NO: 10059 - DNA, 864 bp, Artificial Sequence
  Description of Artificial Sequence: Synthetic coding sequence
atgctgaagaagatcagcgtgggcgtggccggcgacctgaacaccgtgactatgaagctcggctgtgttttgatggcttgggccctatacctgtccttgggagtcctgtgggtggcccagatgctactcgccgctagctttgagaccctgcagtgtgaagggcctgtgtgcaccgaggaatctagttgccacacagaagacgaccttactgacgcgcgtgaggcaggcttccaggttaaggcctatacatttagtgagccgtttcacctgatcgtcagttatgagttgttcccagcccccatcctgcgggcagttccttcggcagagcctcaggctggctctccgatgacactgtcctgccagactaagctgcccctccaacggtccgcagcccgactactgttttctttctacaaagatgggagaatcgtacagtccagaggtctttcatcagagttccagatcccgacggcttcggaggaccactctggatcatattggtgtgaggccgctacagaagataaccaggtctggaaacagagccctcagctggaaatcagggtgcaaggagctagctcatctgctgccccccctactctaaacccagctccgcagaaatccgccgccccggggaccgccccggaggaggctccaggaccgctgccaccacctcccacaccctccagcgaggatcccggtttcagttcacctcttggaatgcccgatccacacctataccatcaaatggggctgctgctgaaacacatgcaggatgtccgagtactactgggccatctcctcatggaactaagggagctctccggccatagaaaacctggcactaccaaagccactgccgagtag

SEQ ID NO: 10060 - DNA, 1815 bp, Artificial Sequence
  Description of Artificial Sequence: Synthetic coding sequence
atgatgcgggccgtgtgggaggccctggccgccctggccgccgtggcctgcctggttggggctgttagaggcggacctgggttgtcaatgttcgctggacaggcagcccagcctgacccttgctccgacgaaaatgggcatccccgaaggtgtatacctgattttgtgaatgccgcattcgggaaggatgtgcgagtgagctccacatgcggacgccctcccgctaggtattgtgtggtgtctgagcggggggaggaacgtctaagatcttgtcatttatgtaatgcctcggaccctaaaaaagctcaccctcctgccttcctgaccgatctcaacaacccccacaacctcacgtgttggcagtccgagaattaccttcagtttccacacaacgtaacactgactctttccctggggaagaaattcgaagtcacctatgtgtctctacagttctgctcccctagacctgaatccatggctatctacaagtctatggactatggaaggacatgggtgcccttccagttctacagtacacagtgtagaaagatgtacaacagaccccatagggccccaatcacgaagcagaatgaacaggaagccgtgtgcaccgactcacataccgacatgaggccgttatccgggggcctgatcgctttctctacccttgacggtcgcccttccgcccacgattttgataattcccccgtgttacaggattgggtgaccgctacagatattcgcgtggctttctcccgactccacaccttcggtgatgagaatgaggacgacagcgaactggcacgagacagctacttttacgctgtgtcggatcttcaagtcggggggcgctgcaagtgcaacggccacgctgcccggtgcgtgagggacagggatgactctttggtttgtgactgtcgccacaacacagcaggtcccgagtgcgataggtgcaagccctttcattatgatagaccttggcagagagcaaccgccagagaggccaatgaatgtgtggcttgcaactgcaacttgcacgctagaaggtgcaggtttaatatggaactctacaaactctccggccgcaagtcgggtggagtatgcctgaattgccgccacaatacagctgggaggcactgccattattgtaaggaaggttactaccgagatatgggtaagcccatcacacatcgcaaggcttgtaaggcctgtgattgccacccagtgggagccgccggaaaaacctgtaaccagaccacaggtcagtgcccctgtaaggatggagttacaggcatcacatgcaaccgctgcgcaaaggggtaccaacagagtagaagtcccatcgcaccatgcatcaagataccggtcgccccccccacaacagccgctagtagcgtggaggaacctgaggactgtgattcctactgcaaggccagcaaaggcaagttaaagatcaatatgaaaaagtattgtaaaaaggactacgccgtccagatacacattctgaaagctgataaggcgggagattggtggaagtttaccgtgaatataatctcagtgtataagcaaggtaccagtaggatccggcgcggcgatcaatctctctggattcgtagtcgtgatatagcatgtaagtgtccaaaaatcaagcctttaaagaagtatctccttctggggaacgcagaagattcaccagaccagagtggaattgtcgcagataagtcctccctcgtgatccaatggcgtgacacatgggcacgccggctgcgcaagttccaacagagggaaaagaaaggcaagtgtaaaaaagcctag

SEQ ID NO: 10061 - DNA, 1005 bp, Artificial Sequence
  Description of Artificial Sequence: Synthetic coding sequence
atgcggagcgccggcggccggggcgagatcaaggtgcggcgggagttacagcccagcaagcaggtcagcggcctgacaaaccacgccagaaccgggcaggaaaagagaaacttacagaggcttgttctggaaacccctagccaaaacatcttcttctctccagtatctgttagcacctccctcgctatgctgagtctaggcgcccacagcgtcaccaagactcagatcctccagggcctaggattcaatttaacacacacccccgagtccgcaatccaccagggttttcagcacctggtgcattccctcaccgtaccctccaaagaccttacgcttaaaatggggtcggctctgtttgttaagaaggaactccagctacaggcaaactttctcgggaatgttaaacggttatacgaagctgaggtcttctccacggattttagtaatcccagcatagcacaggccaggatcaacagtcatgtgaaaaaaaagacccaggggaaagtcgtggatattatccaaggactggacctgctgacagccatggtattggtgaaccatatcttctttaaagctaaatgggaaaaaccattccaccctgagtacactcgaaaaaatttccctttcctggtgggagaacaggttaccgttcatgtgcctatgatgcaccagaaggaacaattcgcattcggcgtggataccgaactgaattgcttcgtactgcaaatggactacaagggagacgccgtggcttttttcgtgcttccgagcaagggaaagatgaggcaactggaacaggccctgtccgcccgaacacttcgcaagtggtcacactcgctgcagaagaggtggatcgaggtatttatccctcgattttcaatctcagccagctataacctggagactattctgcctaaaatggggatacagaatgtgttcgacaaaaacgctgatttcagcggtatagcgaaaagagacagcctgcaggtcagcaaagttagctag

SEQ ID NO: 10062 - DNA, 1065 bp, Artificial Sequence
  Description of Artificial Sequence: Synthetic coding sequence
atggcccccgcccggcggcccgccggcgcccggctgctgctggtgtacgctggcctcttggcggcagcggccgccggcttagggagcccagaaccaggcgcaccttctcgcagccgggctcggagggagcctccaccgggaaacgaactgccacgcggccccggcgaaagccgagctggcccagcagcacgacctcccgaaccgactgcagaaagagctcatagtgtggatcctcgagatgcttggatgctgttcgtgagacagtcagataaaggggtgaacggaaagaagagaagcaggggtaaagccaaaaagctcaagtttggcctgccagggccacctggccctcccggtccgcagggcccccccggccctatcattccccccgaggctctcctcaaagagttccaactactgctcaaaggggccgtccgccagcgcgaacgagccgagccagagccctgtacctgcggccccgctggccctgtcgcagcttcactggcccctgtatccgctacggctggcgaggatgacgacgatgttgtcggagatgttctggctctacttgctgcaccgcttgcccctggaccccgcgcaccacgagtagaagccgctttcctctgccggctcagacgtgacgcgctggtggaacggcgggctttgcacgagctgggcgtctactacctccctgacgccgagggggcatttaggagagggccaggattgaatctcacctctggccaatatcgagcgcctgtcgcggggttctatgcgctggccgcaactctgcatgtcgcactcggcgagcctccccgcagagggccccctcggccccgggatcacttgcgcctgctgatttgtattcagtctaggtgccagagaaacgccagtttggaggccatcatgggattggagtccagctcagaattattcacaatcagcgtgaacggtgttctttaccttcaaatgggccagtggactagtgtatttctggacaacgcctcgggttgtagcttaacagtgaggagtggtagccacttttcagcagtgctgctcggcgtctag

SEQ ID NO: 10063 - DNA, 2685 bp, Artificial Sequence
  Description of Artificial Sequence: Synthetic coding sequence
atgagcctgccccggtgctgcccccaccccctgcggcccgagggctcaggagcaatgggccctgaggccttgtcttctctcctactgctgcttctggtggcatctggagacgcggacatgaagggccattttgatccagctaaatgtagatatgcactgggcatgcaggaccggacaattcccgacagcgacataagtgcaagctcaagttggagtgactccacagccgcacgtcactcacggctggaaagtagcgacggagacggcgcctggtgtcccgctggttcagtgttccctaaggaggaagaatatctgcaggtggatctccagagactccacctggtagctctggtgggcacccagggaagacacgcaggtggcctgggtaaagaattttccagatcttacagactgagatattctcgggatggacgtcgttggatgggatggaaagatagatggggccaggaagttatctccggaaatgaagatcccgaaggcgtggtgttaaaagatctcggcccccccatggtggcacgactcgttaggttctatcctagggctgatagggtgatgtccgtctgtttgcgcgtggagctgtacggttgcctgtggcgggacgggttactgtcttacactgccccagtggggcagacgatgtaccttagcgaggcagtgtacctcaatgacagtacctacgacggacatacagtcggcggactacagtatggggggctcggccagctggccgacggagtggtcggcctcgatgacttcaggaaatctcaggagttgcgcgtgtggcccggctacgactatgtaggctggtcaaatcacagtttctcctccggttatgtcgaaatggagtttgagttcgacaggttgagagcatttcaggccatgcaggtgcactgcaacaacatgcataccctgggcgctcgcttgcctggcggcgtggagtgtcgttttagaaggggccccgctatggcttgggaaggagaacctatgcgccacaatctcggggggaatctgggagatccccgagcaagagctgtgagcgtgccactgggagggagggttgcgaggtttctacagtgtaggttcctattcgcaggaccatggctcctgttctccgagatcagctttatatcagatgtcgttaacaatagctcccccgcactcggtgggacgtttccaccagccccatggtggccaccgggcccaccccctacgaacttttcatccttggaactagagcccagaggccaacagccggtcgcaaaagccgagggctcacctacagcaattttaatcggctgcctggtagccataatactgcttctcctgctgatcatcgcgttgatgctgtggagattgcactggcgccgcctcctgtccaaggcggaaaggcgcgtcttagaggaagaactcaccgtgcacttaagcgttccaggcgatacaattctgatcaacaatcggcctggtccacgcgaaccccccccttaccaggaaccccgtcctcgagggaaccccccgcacagtgcaccttgcgttcccaatggaagcgcgtatagcggagactacatggagccggaaaaaccaggtgctccacttcttccccctccacctcaaaactccgtacctcactatgctgaagccgacattgtaaccctccagggcgtgaccggagggaatacttacgctgtccctgcgctgccaccaggtgctgttggcgatggccctcccagggtggactttcccaggtcccggcttcggttcaaagagaagctgggggaaggtcaattcggcgaggtgcacctgtgcgaggttgacagcccccaggatctggtttccctggattttcctctgaacgtgagaaaagggcatcccctactggttgctgttaaaattctgaggcctgacgcgacaaaaaatgctcggaatgactttctgaaggaggtaaagataatgagcagattgaaggaccctaacatcattcgactgcttggtgtatgcgtgcaagatgacccactgtgcatgattaccgactacatggagaacggtgacctgaaccagtttttgtctgcacatcagctggaggacaaggctgcggaaggcgcccctggcgacggacaggccgctcaaggcccaactatttcctaccccatgctccttcatgtggctgcccagattgcttcaggcatgaggtatttggctacactgaacttcgtacacagggacctggcaactcggaattgtctggtgggcgagaacttcacgattaaaattgccgactttggaatgtcccgaaacctttacgcgggcgattattacagagtccagggcagggctgtgctgcctattagatggatggcttgggaatgtatcttgatgggcaagttcaccacggcctccgatgtctgggcatttggtgtgaccttgtgggaagtgctcatgctttgccgtgcacagccattcgggcagttgaccgatgagcaagtaatagagaacgcaggggaattcttcagggatcagggtaggcaggtgtacctgagccgaccacccgcttgcccccaggggttgtatgagctaatgctgcgctgttggagccgggaaagcgaacagagaccacccttcagtcagctccaccgctttctggccgaggatgctctcaatacggtgtag

SEQ ID NO: 10064 - DNA, 2685 bp, Artificial Sequence
  Description of Artificial Sequence: Synthetic coding sequence
atgagcctgccccggtgctgcccccaccccctgcggcccgagggcagtggcgcaatgggtcctgaagccctgagcagccttctgctgttgctcttggtggcttcaggtgacgccgatatgaaggggcattttgatccagcgaaatgcagatacgccttaggcatgcaggacaggacaatccccgacagtgacatcagcgcttcctcgagttggagtgactccacggcagcaagacactctaggctggaaagtagcgacggcgacggcgcctggtgccctgccgggtccgtctttcctaaggaagaggaatacctgcaagtcgacctgcaaagattacatctggtggccctcgttgggacccaaggaaggcatgcaggtgggttgggaaaggagttctctcgttcttaccggctcaggtatagtcgtgacgggcggcgatggatggggtggaaggaccgctggggccaggaggtgatctccggtaacgaggatcccgaaggcgtggtcctcaaggacctggggcccccaatggtggccagactggtgcggttttatccccgggccgaccgagtgatgtcggtgtgtttacgcgtcgagctatatggatgcctgtggcgtgatggtctcttgagctacacagcacctgtcggacagacaatgtacttatctgaggcagtctatctaaacgacagcacgtacgacggccacacagttggtggactccaatatgggggcctcgggcagctcgccgatggtgtggttggtctcgacgatttcagaaagtcacaggagctgagagtgtggcccggctacgactatgtgggctggagcaatcactcttttagtagtggatacgtagagatggaatttgagtttgaccgattgagagcctttcaagcgatgcaggtccattgcaacaatatgcacacgctgggcgcaagattacctgggggcgtcgagtgtagatttagacgcggacccgccatggcttgggaaggagaaccaatgaggcataacctgggaggcaacctcggcgaccccagggcgcgggcagtctcagtgcccctgggaggacgggtcgccaggttcttacaatgccgatttttgtttgccggtccctggttgttgtttagcgaaatctctttcatatctgatgtggtcaacaatagcagcccagccctcgggggaacattcccgcctgccccatggtggccccctggccccccaccaaccaattttagctcactcgagctggaaccaagagggcagcaacccgtggcaaaggccgagggctcccctacagcaatacttattggctgtctagtagctattatcctactgctcctcttgattatcgcattgatgctgtggaggttacactggcgaaggttgctgagtaaggctgagcgacgggtgctggaggaggaattgactgtgcacctgtctgtccctggcgatacaatccttatcaacaatcggcccggcccccgcgaaccccccccttaccaggagccaaggccgagaggcaatcccccacactcggcgccatgcgtcccaaatgggagcgcttactctggggactatatggagcccgagaaacctggagcaccgcttctcccccctcctccccagaattccgtgcctcactacgccgaagccgatattgttacgcttcagggtgtgactggcggcaatacttatgctgtcccggctctgcctcctggggctgttggggacgggcccccacgcgtggactttccacgttccaggctgcgatttaaagagaaactcggcgaggggcagtttggagaggttcatttatgtgaggttgatagcccgcaagatctggtttcgctcgactttcctctgaatgtgcgcaaaggtcatccattgctagttgccgttaagatcctcaggccagatgctacaaaaaatgcccggaatgattttcttaaagaagtcaaaattatgtcacgccttaaagatccaaatataatccgactactgggggtgtgcgttcaggatgatccactctgtatgatcactgactacatggagaatggcgaccttaaccagttcttgagcgcacatcagctggaggacaaggccgccgagggcgcccctggcgacggccaggcagcccagggcccgactataagctatccaatgctcttacacgtggccgcccagattgccagtggtatgagatacctcgccactctgaatttcgtgcaccgggacctggccacccggaattgtctggtgggtgagaactttacaattaagatcgctgacttcggtatgtctcggaatttatacgctggggattattaccgtgttcaaggtagggctgtcctgcctatcaggtggatggcatgggagtgcatcctgatgggaaagtttaccacagcctccgacgtgtgggcctttggcgttactttgtgggaagtacttatgctttgccgggcccaaccgttcggccagctcactgacgagcaggtgatcgaaaacgctggggagttcttccgagaccagggcagacaggtttacctgtccagaccacctgcttgtcctcagggcctctatgagttaatgctgaggtgctggtcacgtgagtcggaacagagaccaccattttcccagttgcaccgcttcctagccgaggatgcactgaataccgtgtag

SEQ ID NO: 10065 - DNA, 2886 bp, Artificial Sequence
  Description of Artificial Sequence: Synthetic coding sequence
atgctgctgctgctgctgctggcccccctgttcctgcggccccccggtgccggtggggcgcagacaccgaatgccactagtgagggatgtcagataatccatcccccctgggagggagggatcagataccggggcctgacaagggatcaggttaaggccattaacttcctaccagtcgattacgagattgagtatgtgtgcagaggcgagcgcgaagtggtgggcccgaaagtgcgtaaatgccttgccaacggatcctggaccgatatggacacaccaagtcgctgtgtacggatctgtagtaaatcatacctgacactggaaaacggcaaggtgttcctcaccggaggcgatctgccggctctggatggggctcgcgtggattttcgctgcgaccctgactttcacttggtaggcagctcccgttccatctgttctcagggccaatggtccacccctaaacctcattgccaagtgaaccgaacaccccactccgagcggcgggctgtgtatatcggagcgctatttccaatgtccggggggtggcccggaggccaggcctgccagccagccgtagaaatggccctggaagacgtcaatagccggcgtgacattctgccagattatgagctgaaactgatacaccacgacagcaaatgtgaccccggccaggcgacaaaatatctgtacgaactgttatataacgatcctatcaaaatcattctaatgcccggctgcagctctgtgtccactcttgtggcagaagcagcccgcatgtggaatctgatcgtgcttagctacggatccagctctcctgctctgagtaacagacaacgatttcctacctttttcagaactcacccaagcgccaccctccacaatcccacacgggtgaagctctttgagaagtggggctggaagaaaatagcaaccatacaacagacaactgaggtgtttacctccacgctggacgatctggaagaaagagtaaaggaggcgggaatcgaaataacatttcgccagagttttttctctgatcctgccgtacctgtgaaaaatctaaagcggcaggacgccagaattattgtcgggctattctatgagacagaggccaggaaggtgttctgcgaggtgtataaagaaagactcttcgggaagaagtacgtgtggttcctgattggctggtacgccgataactggtttaagatctacgacccttcaatcaactgcactgtggacgaaatgaccgaggctgtcgaggggcacatcaccacagagattgtgatgctgaaccctgcaaatacccgatcaattagtaacatgacatcccaggagttcgtggaaaaacttacaaagaggttaaaaaggcatccagaagagactgggggtttccaggaagctcccctcgcgtacgatgccatctgggccttggcccttgcacttaacaaaacctccggcggtggcggccgatctggggtgagactcgaagactttaattacaacaaccagaccataacagatcagatatatcgggccatgaattcttctagcttcgaaggagtctccggccacgtcgtctttgatgcaagcgggtctcgaatggcctggacactcattgaacagctgcagggaggctcatacaagaagataggatactacgatagcaccaaggatgacctctcatggagcaagacggataagtggattggtgggtctccccccgctgaccagaccttggtgatcaagacctttcgatttctgtctcagaaattgtttatcagcgtaagtgtattgtcgagccttggcatagtgcttgccgtagtgtgcctcagctttaatatttacaactcccacgtccgctacattcagaacagtcagccaaatctgaataatctaacagccgtgggttgtagtcttgcactggctgcagttttccccctgggactggatgggtatcacatcggcagaaaccaattcccgtttgtttgccaagctcgactttggctgctgggcctgggattctccctgggctacggttcaatgttcacaaagatctggtgggtccatacggtgtttacgaaaaaagaagaaaagaaagagtggaggaagacgctcgaaccttggaagctatatgcgaccgtaggcttgctggtgggcatggatgtcctgacactggctatttggcagattgtcgaccccctgcacagaaccattgagacgttcgctaaagaggagcccaaggaggatatcgatgtgtctattctgccacagttggagcactgctcatcaaggaagatgaacacctggctcggcatattctatggctacaagggcctgctgttactgttgggcatttttctggcatacgagactaagtccgtctctacggaaaagattaatgaccaccgggcagtgggtatggcaatctacaatgtggcggtgctttgtctgatcaccgccccagtgacaatgatcctgtccagtcagcaggacgctgccttcgcattcgcgagccttgctattgttttctcaagctatattacactagtcgtcctgttcgtccccaaaatgaggcgtttaatcaccaggggcgagtggcaatctgaggcacaggacacaatgaagacgggatcatccaccaataacaatgaagaggaaaaaagcaggctgctcgagaaagagaatagagaactcgagaagattatcgcagaaaaggaagagcgggtgagcgagctccgccaccagcttcaaagcagacaacagctgcgcagtagacgacaccccccaactccgccagagcccagcgggggcctcccaagaggcccacccgagcccccagatcggttgagctgtgacgggtcccgagtgcacctgttatacaaatag

SEQ ID NO: 10066 - DNA, 2559 bp, Artificial Sequence
  Description of Artificial Sequence: Synthetic coding sequence
atgctgcccaccgaggtgccccagagccaccccggccccagcgccttgctcctgctgcaactgctcctgccgcctacttctgccttttttccaaacatctggtccctcctggccgctccaggctccatcactcaccaggacttaacagaagaggctgcacttaatgtgacacttcaactgttcctggaacagcccccacctggccgaccaccactgcgcctggaagactttctaggcaggactcttcttgctgacgacctttttgccgcatacttcggacccggctcctctcgccggttccgggccgcgctgggggaggtgtctcgggcgaacgcggcccaggactttttgccaacaagccggaatgatcctgatctccatttcgatgctgagcggctgggccaggggagagcccggctggtgggcgcgctgcgggagactgttgttgccgccagagcgttggatcacactctcgcccgccagcgcttgggagcggccttacacgcgttgcaggatttttattcacacagtaactgggtcgagctgggcgagcagcagcctcacccccatctcctttggcctagacaggagctacagaatctggctcaagtggccgatcccacatgtagcgactgcgaagagttatcctgtccgcgtaactggctcgggtttacactcttgacatcaggatattttggcactcaccccccaaagccaccaggcaagtgctcacacggcggacacttcgataggtcctcaagtcagccccctcggggagggatcaacaaagactctaccagtcctggattctccccacaccatatgctgcacctccaagctgccaaactggcactactggccagcatccaggctttttcactgctgagatcacgtctgggggatagagacttcagcagactcctggatattaccccagcctccagtctcagctttgtactagacaccacaggtagtatgggcgaggaaataaatgctgccaagatccaagcgcgccacttagtggagcagagacgcggcagcccgatggagcctgtccattacgtactggttcctttccacgatccaggatttggtcccgtctttactacctctgaccctgactccttctggcagcaactgaacgagatacacgccctgggggggggcgacgagcctgaaatgtgcctcagtgcgctgcagctcgccctcctgcacacaccacccctgtccgacatctttgtcttcaccgacgcctcaccaaaagacgcctttctgacgaatcaggttgagagcctgacgcaggagcggcgttgtcgagtgacctttcttgtgactgaggatacctcacgggttcagggacgggcaaggagagagatcttgagtcctctccgcttcgagccctataaagccgtggcgctcgcctctggcggagaagtcatcttcaccaaggaccaacatattcgcgacgtggctgctattgtcggcgagagcatggcagcattggtcaccctgcctctagatccccctgttgtggttcccggacagcctttagtcttcagtgtggatggactcttgcagaaaatcaccgttcgaatccatggtgacatttcctccttctggatcaaaaatcccgccggcgtttcgcagggacaggaggaggggggtggccctcttgggcacacacggcgctttggccagttttggatggttaccatggatgatcccccccagactgggacctgggaaatccaagtgaccgcagaggatacacctggtgtgcgggttcaggctcagacgtcactagacttcctgttccatttcggcatccccatggaagacggccctcacccggggctctatcccctgacacagccagtggccggactgcagacgcagctgctcgtggaggttactggactcgggtcaagagcaaaccccggtgatccccagccccactttagtcacgtgatactgcgcggagtcccagagggcgccgaattagggcaggttccactagagccggtgggccctccggaaagaggcctgctagctgccagcttgtcaccgactctattatcaactcctcgaccattctcactggaactcataggccaggacgccgctggtcgacggcttcatcgagctgcacctcaaccaagcactgtcgtccccgtcctgttagaactgagcgggcccagtggattcttagcgcccggatccaaagtccccctcagcctaaggatcgccagcttttcagggccccaagacctcgacctgagaaccttcgtgaacccgagtttttcacttacttctaacctttcacgagcccatcttgaactaaacgagtcagcctggggtcgactgtggctggaggtccccgactccgcggcccctgacagcgtagtgatggtgactgttactgccggaggtagggaagccaaccccgtgccgccaactcacgcttttctgagactgctggtgagtgcacctgcaccgcaggtgcggaatcattatttcccaagccaggggcccgcccaccacccttaccgtcttatatag

SEQ ID NO: 10067 - DNA, 756 bp, Artificial Sequence
  Description of Artificial Sequence: Synthetic coding sequence
atgccccacctggccagcctgttcaccgccagcagccggtgctgcccacatccccttcggcccgagggatctggagcaatgggtcctgaggccctgagttccttactgctgctgctgctggtggcttccggagatgccgacatgaagggccacttcgacccggccaagtgcagatatgccttggggatgcaagataggactattcccgactcagatatcagtgccagctctagctggagcgactcaacagccgcccgccatagtcgcctagaaagttctgacggggacggggcatggtgccccgccgggtctgtcttcccgaaagaggaggagtacctgcaggtggatctgcagcgcctccaccttgtcgcgctggtaggtacgcagggaagacacgccggagggctggggaaagagttttcccgttcttaccgcttacgctattcccgtgacggtcggcgctggatgggatggaaagacaggtggggacaagaggtcatatccggcaatgaggaccccgagggcgtggtgctgaaggacctgggtcctcctatggtagcaagactggtgcggttctaccctcgcgcggatcgcgtgatgtccgtttgcctcagagtcgaactgtacggatgcctgtggcggggggagtggctgtccttcttggggatttgcttcctgtcccgcgggctcgaggggggcgagtgcggagagtgggcatcaagaatcccaagcccagccgggaagctctctctgtag

SEQ ID NO: 10068 - DNA, 726 bp, Artificial Sequence
  Description of Artificial Sequence: Synthetic coding sequence
atgaagttcatcctgctgtgggccctgctgaacctgaccgtggccctcgctttcaaccccgactatacggtgtcctccacccccccatacttagtgtatttgaaatcagattacctcccctgtgccggcgtactgattcatccactttgggttatcacagcagcccactgtaacctcccaaagctgcgggttatcctaggcgtcaccattcccgccgactctaatgaaaaacacctgcaggtgatcggctacgagaagatgatccaccatccacatttttctgtcacctcaatcgatcacgacattatgctcattaagctgaagactgaggctgagctgaatgactatgttaagctggccaatctaccctaccagacaattagcgaaaacacaatgtgctcagttagtacttggtcatataatgtgtgtgacatatacaaggagcccgacagcctgcagacagtgaacataagtgtgatttccaagccgcagtgccgagatgcatataaaacttacaatatcaccgagaacatgctctgcgtgggaatcgtccccggcagacggcagccttgcaaagaggtctccgctgcccctgccatttgtaatggaatgcttcagggcattctcagctttgccgacggatgtgttttacgagccgacgtgggcatatacgccaaaattttttactatataccctggatcgaaaacgtgattcagaacaactag

SEQ ID NO: 10069 - DNA, 1536 bp, Artificial Sequence
  Description of Artificial Sequence: Synthetic coding sequence
atggccaagggcctgagcgtgcagaacgacaagcaccccggctaccagccagcactgctgttgtcccccggggccccgctgtttgctgatggccccgcgtacgccctgttgcatctactgctgcacgaaggaaaagctgagatggccgaccaggccgccgcgtggcttacgcgccagggatcattccagggcggtttcaggtctacacaggacactgttatcgccctggacgcactctccgcatattggatcgcttcacacaccacagaggagcgaggactgaatgtcactctctcttcaactgggagaaacggatttaaaagtcatgcattgcagctcaacaaccggcagattcgtgggttagaggaggagctacagtttagcctggggtctaagattaatgtcaaagtcggcggaaattccaaggggacccttaaagtgttgcggacctataacgtcctggatatgaagaacacaacctgtcaggacctgcagatcgaggtgaccgtgaaaggtcacgtcgaatacacaatggaggccaatgaggattatgaggattacgagtacgatgaactccctgcaaaggacgaccctgacgccccactgcaaccggtgaccccactgcaattgtttgagggaaggaggaatcggagacgcagagaagcccctaaagttgtggaagaacaggagtctagggtgcattataccgtttgcatctggcgcaatggaaaagtaggcctatctgggatggcgatcgctgacgttactctgttgtcaggattccatgccctgcgagctgacctggagaagctgacctccctctccgacaggtatgtcagccacttcgagaccgaagggcctcacgttttgctatattttgactcagtaccaactagcagggaatgcgtgggattcgaggccgtccaagaggtgcctgtaggactagtacagcctgccagcgccacattgtatgattactacaaccccgaacgccgatgtagcgtgttctacggggcaccatcaaaaagcagattgcttgccactctgtgctctgcagaggtttgtcagtgtgcagaggggaagtgcccccgtcagcggcgtgcgctcgaacgcgggctacaggatgaagatggctatcgcatgaaattcgcctgttattatccccgggtggagtatgggttccaggtgaaggtattgagggaggacagtcgcgctgcttttcggctctttgagaccaagatcacccaggttttacacttcaccaaagacgtcaaagccgcagctaatcaaatgcggaactttctggtcagggcctcctgtagacttcggctggaacctggcaaggagtacctgattatgggtctcgacggcgccacttacgacctagaggggcatccccagtacctattggactctaacagttggatagaagagatgccatccgagcgcttatgccggtcgactcgacaacgggctgcgtgtgcccaactgaatgattttttgcaggagtacgggacccaagggtgccaggtgtag

SEQ ID NO: 10070 - DNA, 2067 bp, Artificial Sequence
  Description of Artificial Sequence: Synthetic coding sequence
atgctgcccaccgaggtgccccagagccaccccggccccagcgcccttctcctactccaactcctcctgccaccgacctctgcattttttccaaatatttggtcactgttagccgcccccggaagcattacacaccaggacctgactgaggaggctgctctgaacgtaacattacagcttttccttgagcagccacccccggggcgcccccccctgagactcgaggatttcctgggacgcaccctgctggccgatgaccttttcgccgcctatttcgggccaggttccagtcgaaggtttagggcagccctcggcgaagttagccgcgcgaacgccgcccaggacttcctacctacgtccagaaatgatcccgatctgcattttgacgccgagagactcgggcagggccgtgctcgcctggtgggcgctctccgcgagacagtcgttgccgctcgcgccctggaccatacccttgcccgccagaggcttggagctgcccttcacgctctccaggacttctacagccacagtaactgggtggagttgggcgagcagcagccgcatccccaccttttgtggcctcgccaggaactgcagaacctggcccaggtagcggaccctacatgctccgactgtgaggaactgtcctgcccccggaattggctaggattcaccttgctgacgagtggctactttggcacacacccaccaaaaccgcccggcaagtgctcgcacggagggcacttcgaccgatctagcagccaaccacctcggggcggcatcaacaaggacagcactagtccgggttttagtccacatcacatgcttcacctccaggctgccaagctggcactactggcctctatccaggcattcagtctactccggagtagattaggggatagagatttctctcgcttgttagacataacccctgcatccagcctgtccttcgtgctcgatacaaccggcagtatgggggaggagattaatgcagcgaaaatccaggcgcggcacctcgtggagcagcgacgtgggagccctatggagcctgttcattacgttctggttccctttcatgacccaggtttcggccccgtgttcacaactagcgatcctgactctttctggcagcagcttaatgagatccacgcactcggagggggggatgagccagagatgtgcctgagcgctctgcaactcgccctgctccacacacccccactgtcggatatatttgtcttcacggatgcttctcctaaagatgctttcctgacaaaccaggtcgaatccctgacacaagaaaggcgatgcagagtcacattcttggtcaccgaagataccagtagggtgcaaggccgggctcggagggaaattctgtcccccctgcggtttgagccctacaaggctgtggctctcgcttcggggggtgaggtgatctttacaaaggatcagcatatacgcgatgtcgccgcaattgtgggcgaatcgatggcagccctcgtcacactgccactggacccgccagtcgtggtaccagggcaacctctggttttcagtgttgatggattgcttcagaagattacagtcagaatccacggcgacatctcaagcttctggataaagaaccctgctggagtcagccaaggtcaggaggagggcggcggaccattgggacacacacgacgctttgggcagttctggatggtcaccatggacgatcctccccagacggggacgtgggagatccaggtcaccgccgaggacacccccggggtccgggtgcaggcacaaactagcctagacttccttttccatttcggtatccctatggaagacgggcctcacccggggctgtatcccctgacacaaccagttgccgggttacagacgcaactgttggtggaaagccaatcttggggctccagtgccgcctttctcccacgacatccttctagagggccccgcggctgcagaaccaggccgggagccctaggagcgcgcgggacatcaggtgcgagaagtccgcggtcactggcagtggcccatgcggcagtgcacccatag

SEQ ID NO: 10071 - DNA, 2559 bp, Artificial Sequence
  Description of Artificial Sequence: Synthetic coding sequence
atgctgcccaccgaggtgccccagagccaccccggccccagcgccttgttactgctgcagcttttgctcccgccaacctccgcctttttccctaatatctggagtctgctggcggcaccggggagcattacccatcaggacctgaccgaagaggctgctctcaatgtgacactgcaactgtttctggagcagcctccacctggccgcccacccttgcgattagaggacttcctgggccggactttgctggctgacgatcttttcgccgcctactttgggcctggaagttcacggcggttccgcgctgcgctgggcgaggtgagccgggctaatgccgcccaggattttctgccaacctctcggaatgatccagatctccatttcgatgccgagagactgggtcagggaagggctagactagtgggggccctgcgggaaaccgtcgtggctgctcgggctctagatcataccctggccaggcagaggctcggtgcagctctacacgccttacaggacttttactctcatagcaactgggtggaactgggggaacaacagccccacccccacctactgtggccgcgccaagagcttcaaaatctggcccaagtggcggacccaacttgctccgattgcgaggaactgtcctgcccccggaactggcttggcttcacactactgacatctggctacttcggtactcatcctcctaaacccccaggcaagtgctctcacggaggccattttgaccgcagctcctcccagccacctcggggtggcatcaataaggacagtacttcacccgggttctcccctcaccatatgctgcaccttcaggccgcgaaactggccttacttgccagtattcaggctttcagtcttttgagatctcggctgggggaccgcgatttctctaggttgctggacatcacccctgcatcatccctttctttcgtgctggatacaacgggatcaatgggagaagaaattaacgctgccaaaatccaggcaagacacctggtggaacaacgtcgtggttcccccatggaacccgtacattacgtgttagtgccatttcatgaccccgggtttgggcctgtcttcacaaccagcgatccagacagcttctggcagcagctgaacgaaattcacgctttgggaggcggggatgagcctgaaatgtgcctctcggctttgcaattggcattgcttcacaccccaccattgtccgatatttttgtctttacagatgcatcacccaaagatgccttcctgacaaaccaggtggagtccctaacccaagaaagaaggtgccgcgtgacattccttgtgaccgaggatactagtcgtgtacaaggccgagccaggcgcgaaatcctgagtccactcagattcgagccttataaggccgtggctctggcctcagggggcgaagttatctttacaaaagatcaacacatccgtgacgtggctgcgatcgtcggcgagtcaatggccgcacttgttacattgccattagacccccctgtcgtcgtccccggacaacctttggttttcagtgtcgatgggctgctgcagaaaatcaccgttcgcatccatggagacatctccagcttctggattaagaatcccgcgggagtgtcgcagggtcaggaggagggaggaggccccctgggtcacacgcgccggttcggccagttttggatggtaacaatggacgatccaccacagacaggaacatgggagattcaagtcaccgccgaggatacgcccggggtcagggtgcaggcacagacatcgctcgatttcctgtttcacttcggcattccaatggaggatggtcctcatccaggtttgtatcccctgactcaacctgtggccggacttcagacgcagcttttggtagaggtgacaggcctaggatcacgagccaaccccggtgaccctcaaccccacttcagccatgtgatactgcgcggcgtcccggaaggagccgaactcggccaggtgcccctcgagcctgttggcccgccagaaagaggtctgttagctgcaagcctgtcacccacactgctgagcactccacggccttttagccttgagctgatcggccaggatgccgccggccgccgcttgcaccgagcagcccctcagcctagcaccgttgtgccggtacttctagagttgagcggcccgagtggcttcctggcacctggcagtaaagtccctctgagcctgcgtatagccagtttctccgggcctcaagatctcgacctgaggactttcgtaaatccatcatttagtctcactagcaatctcagccgagctcaccttgaacttaacgaatccgcatggggtagactctggcttgaagtgcctgattcagccgccccagactctgtggtcatggtgacggttactgctggcggacgagaagctaaccctgtccctccaactcatgctttcctgcgactcctggtttcagcccccgcacctcaggttaggaatcattacttccccagtcaaggccctgcacatcacccttaccggttaatctag

SEQ ID NO: 10072 - DNA, 1737 bp, Artificial Sequence
  Description of Artificial Sequence: Synthetic coding sequence
atgctgctgctgctgctgctggcccccctgttcctgcggccccccggagccggcggggctcagacccctaatgccacgtccgaaggctgccagattattcaccccccatgggagggcggaattcgatatcggggattgacccgggaccaggtaaaagccattaattttttgccggttgattacgagattgagtatgtatgccggggagagagggaggtagtcggccctaaggtgcgcaaatgtctggcaaatgggtcatggacagacatggacaccccttcccggtgtgttaggatctgctccaaatcatacctgacgctggagaatggcaaagttttcttgacgggtggggacctccctgctcttgacggagccagggtggactttaggtgcgaccctgatttccacctggtcggctcctcacgatctatctgttctcaggggcagtggtctactcccaagccccactgtcaggtgaacaggactcctcatagcgaacgaagagcagtctacattggagctctgttccctatgtctgggggttggccgggtggccaggcctgccaacccgccgttgaaatggccctggaagacgtaaattctcgccgggacatccttcctgattacgagctgaaattgatccatcacgactctaaatgcgacccaggtcaggccactaaatacctctacgaacttttatacaacgaccccattaagatcatactaatgccagggtgttcatcagtgagtacccttgtggccgaggccgccagaatgtggaatttgattgtgctgtcctacggatcctcatcgcctgctctctccaatcgacagcggtttcctacattttttcgtactcatccttcggccacccttcacaacccaactcgggtcaagctgtttgagaagtggggatggaaaaagattgctactatacagcagacaaccgaagtatttacgtcaacgctggacgatctggaagaacgggtgaaggaggccggtatagaaatcacattcagacaaagcttcttctcagaccctgctgtgcctgtgaagaacttaaagaggcaggacgcccggataatcgtcggccttttttacgaaaccgaagccagaaaagttttttgtgaggtctataaggaacggctgttcggcaaaaagtacgtatggtttctgattggctggtatgccgacaattggtttaagatttacgatccgagcatcaactgtactgtggatgaaatgacagaggcagtggaaggccacattacaactgagattgtgatgttgaatccggcaaatacccggtccatatcaaatatgacctcccaggaattcgtggagaagctgaccaagagactcaagcgccatcctgaagagacaggcggctttcaggaggcacctctggcctacgatgcgatatgggccctggccctggcactcaataagacaagcggaggcggaggacgatcaggcgttagactggaagactttaactacaataatcaaacaatcactgaccagatctacagggccatgaacagtagttcattcgaaggagtgtccggccacgttgtcttcgatgcttccggaagccggatggcgtggacactgattgaacagcttcagggcgggtcatataagaagatcgggtattacgacagtacaaaggatgatctgtcctggagtaagaccgacaaatggatcgtcatatcccgaacccattctccgacttag

SEQ ID NO: 10073 - DNA, 1326 bp, Artificial Sequence
  Description of Artificial Sequence: Synthetic coding sequence
atggagttcgagttcgaccggctgcgggccttccaggccatgcaggtccattgtaacaacatgcacacactgggggcaagactgcctggtggcgtggagtgtcggttcagacgcggcccggccatggcttgggaaggagagcccatgcgccataacctgggaggaaatctcggggacccaagagcacgggctgtcagcgtacctctggggggccgagtagcgaggttcctacagtgcaggttcctgtttgccgggccctggttgttattttccgaaatctcctttatcagcgatgtggtcaataactcttctcctgccctgggcggaacatttccccccgcaccttggtggccccccggacccccccctacgaacttttcgtctctggagctcgaacctcgcggccagcagcccgtggccaaggcagaggggagccccaccgcaatactgatcgggtgtctcgttgctataatcctccttttgctgctgatcatagctcttatgctgtggcgactgcactggcggaggctactgtcgaaggtactggaatctcatcccagaacacggagccctggtcttgttggtatacgccctactccccttccagtgagccccatggcactgcgatgctgctcccccattcagcctaccgcctcattctggccactcacccctgtgccactggaggcgcgcgcgcccccacatcccccaggaccaaaccctcccaccccacgaggcgtcaccggtggtaatacatatgctgtgccggccctgcctcccggcgctgtaggcgacggaccacccagagtagactttccccggagtaggctgagattcaaggagaagctcggcgagggtcaattcggtgaagtgcacctgtgtgaggtggattccccacaggacttagtgtcccttgacttcccccttaatgtgagaaaaggccatcccctgctcgtggcagtgaagatcctgcggcctgatgctactaaaaatgcccgaaacgacttcctgaaggaggtgaagattatgagccgacttaaagacccgaacatcattcgactgctcggggtgtgcgtacaggacgacccgttatgcatgatcactgattatatggaaaacggtgaccttaaccaatttctatctgcgcaccagctggaagataaggcagctgaaggtgcccccggcgacggccaagcagcccagggacctaccatctcatacccaatgctgttgcacgttgctgcccagatagcatcaggcatgcggtatttggctaccctgaactttgtacatttttggggcgagcggcacagattcctacattag

SEQ ID NO: 10074 - DNA, 2685 bp, Artificial Sequence
  Description of Artificial Sequence: Synthetic coding sequence
atgagcctgccccggtgctgcccccaccccctgcggcccgagggcagcggggcaatgggcccagaagcactgtccagtctgctgctgttattgttggtggcaagtggcgacgcagatatgaagggccacttcgatccggcaaaatgtaggtacgctctgggcatgcaggatcggacaatcccagatagcgatatttcagcttcgtcctcttggtcagattctacagccgcaaggcattcgcgcctcgaatccagcgacggcgatggggcctggtgccccgccgggtcggtattccccaaggaagaagaatacctgcaggtggacttgcagcggttacatctcgtggccctggtcgggacccagggaaggcacgcaggtggcctcggaaaggaattcagtagatcatacaggttgcggtacagtcgggatggaaggagatggatggggtggaaagaccggtggggtcaagaggtcatctcaggtaacgaagacccagagggggtcgtactgaaagacctggggccccctatggtggcgagattagttagattctacccacgcgcggacagagtaatgtctgtctgcctgagggttgagctgtacggctgtctttggcgggatggacttctgagttatacagctcctgtaggccagacaatgtatctgtctgaagcagtctatcttaacgatagcacttatgacggccacacagtcggagggctccaatacggaggacttgggcaactagccgacggcgtggtcggtctggacgattttcggaaatcgcaggagctgcgcgtatggccagggtatgattatgtggggtggtcaaaccacagtttctcttctgggtacgtagaaatggagttcgagtttgacagactgagggccttccaggccatgcaggtccactgtaataatatgcacacactgggagcccggctccccgggggagtggagtgcaggttcaggcgaggacccgccatggcatgggagggagagcctatgagacacaacttgggcgggaacctaggagaccccagggcgcgggctgtgagcgtacccctcggaggcagagtcgctcgcttccttcaatgtaggttcctcttcgccggcccctggcttctcttctccgagatcagcttcatctccgacgtcgtgaataactcatctcctgcgctcggtgggacctttccccctgcaccctggtggccacctggaccgccccccacaaacttttccagcctggagctggagccacgcggccaacagcccgttgccaaagcagagggctcccccaccgcaattctcatcggctgcctcgttgcaattatcctgctgctgctgctgattatcgccctcatgctctggaggctgcattggcgaaggctactgagcaaggcagagcgtagagtgctggaagaggagctgacagtccatcttagcgtgccaggagacacaattctgatcaataaccgacccgggccacgggaacccccaccttaccaggaaccgaggcctcgcggaaatcctccccacagcgcaccctgtgtaccaaatggctcagcatatagcggggattatatggaacctgagaaaccaggtgcccccctgctccctccaccaccacagaatagcgtgccccattatgccgaagctgatatcgttacattacagggagtgacagggggcaacacatacgctgtgccagccctcccccctggcgccgtaggtgacgggcctcctagggttgacttcccccgaagtcgcttaaggtttaaagaaaaactcggcgaggggcagttcggggaggttcatttgtgtgaggtcgatagtccgcaagatttagtttccctggattttccactgaacgtcagaaaagggcaccccctcctagtcgcagttaagatcctgaggccagacgctaccaaaaatgctaggaacgactttctgaaggaggtcaagatcatgtctagacttaaagaccctaacatcatccgactgctaggggtgtgcgtccaggacgacccgctgtgtatgattacggattatatggagaacggtgacttgaaccaattcctgagcgcccaccagttggaagacaaagctgctgagggagcgcctggtgacggtcaggctgcccagggtccgaccatatcctaccctatgttgctacacgtggctgcacagattgcgagtggcatgaggtacttagccacattaaatttcgtgcacagggatctcgctaccagaaactgtcttgtcggtgaaaatttcaccattaaaatcgccgatttcggaatgtccagaaatctgtatgctggagattattacagggttcagggtagggctgtcctgcctatacgttggatggcctgggagtgcatccttatggggaaattcacaactgcgagcgacgtgtgggcatttggggtgacactatgggaggttttgatgctgtgtcgagctcagccattcggccagctgactgatgagcaggtgattgaaaacgccggggagttcttccgggatcagggaagacaagtgtacctgagtagaccacctgcatgtcctcaggggttatatgagcttatgttgcgatgctggagcagggaatctgagcagaggccgccttttagtcagcttcatcggttcttggccgaagatgctctcaatacagtgtag

SEQ ID NO: 10075 - DNA, 216 bp, Artificial Sequence
  Description of Artificial Sequence: Synthetic coding sequence
atgcccgccggcgtgcccatgagcacctacctgaagatgttcgccgcctccctcctggctatgtgcgcgggagccgaagttgtacacaggtactacaggcccgatcttactatacccgaaatcccaccaaaacgaggggagctcaaaaccgaactgttaggccttaaggaacgtaagcataagccccaagtgagccagcaggaggagctcaagtag

SEQ ID NO: 10076 - DNA, 2760 bp, Artificial Sequence
  Description of Artificial Sequence: Synthetic coding sequence
atgggccccgaggccctgagcagcctgctgctgctgctgctggtggcttccggcgatgcggatatgaagggccatttcgaccctgcgaagtgccgatatgccctggggatgcaggataggacgatccctgattcagacatatctgcaagttcgtcttggtccgacagtaccgctgctcgtcactcaaggttggaaagctctgatggagacggcgcttggtgccccgcaggctccgtgtttcctaaggaggaagagtacctgcaagtggacctgcagcggctccaccttgtggctttggtgggtacacaaggacgacacgcggggggactggggaaagaattcagccgcagctatcgtctgcgctacagtagagacgggcgcagatggatgggctggaaagatagatggggccaagaagtaatttctgggaacgaagatcctgagggggttgttctgaaagacttagggccccctatggtggcgcggctggtgagattctatccaagagcagacagggtaatgtcagtttgcttgagagtggaactgtacggatgcttatggcgggacggccttctttcatatactgccccggtgggccagacaatgtatctgagcgaggctgtgtatctgaatgactctacatacgacgggcacacagtgggaggacttcaatatggcgggttgggacagctcgccgatggagtggtgggactggacgacttccgcaaatctcaggaactgagagtgtggcctggctatgattacgtggggtggtccaatcacagcttttctagtggctatgtggagatggagttcgagtttgatcgtctgcgggctttccaggcaatgcaggtgcactgtaataatatgcacacgcttggcgcccggcttccgggaggcgtagagtgccggttcagacgcggtcctgcaatggcctgggagggcgaacctatgcgacacaatctcggcggaaatctcggagatccaagggctagagccgtatcagtgccccttggaggacgcgtggcaagattccttcaatgtagatttcttttcgccggtccgtggctgctattcagcgaaataagttttatttctgatgtggtgaacaattcctctcccgctttgggcgggacgtttcctccggcaccatggtggccccccggtccacccccaaccaacttttcatccttagagctggagcctcgcggccaacagccagtagccaaggccgaaggcagcccaaccgcaattctgatcgggtgcttggtcgcgatcattctactcctgttgctaatcatcgccctgatgctctggcgtcttcactggaggcggctcctcagcaaggccgaaaggcgtgtgttagaggaggagctaaccgtgcatctctcagtacccggcgatacgattctgattaataaccggccaggtccacgtgagccccccccttaccaggagcccagacccaggggcaacccaccccatagcgctccttgcgtgcccaatggtagcgcgttattgctgtccaacccagcatatcgcctgctcctggccacatatgcccggcctcctaggggcccaggcccccctacaccagcctgggctaaacctactaacacacaggcttattctggtgactatatggagccagaaaagcctggcgccccgctgttacccccccctccccagaatagtgttccacactacgcggaggccgatattgtcaccctccagggagtgacaggtgggaatacttatgccgtccccgctctcccccccggagccgtgggcgacggccccccgagggtggatttcccacgttccagactgcgatttaaagagaaactgggcgagggccagttcggagaagtgcacctgtgcgaagttgactccccccaggacttggtgagtctcgactttccattgaacgtcagaaaggggcatcctctgctcgtggctgtgaaaatactgcggcccgacgccacaaaaaacgccagcttctcactgttttcaagaaatgacttcttaaaggaagttaaaattatgagcaggctgaaggacccgaatatcattcgcctgctcggggtgtgcgtgcaggacgatccattgtgcatgatcacggactacatggagaatggggacctcaaccagttccttagtgctcatcagcttgaagacaaggctgcagagggcgcgcccggtgacgggcaggccgcgcagggccccaccatcagctatcctatgctgctccacgtggccgcacagatcgcttcagggatgagatatctggccacactcaactttgtgcaccgagatctggccacccgcaactgcctggtgggcgaaaactttacgataaagatcgctgattttggcatgagtcgtaacctctacgccggagattactacagagtgcagggcagggcagtgctgccaataagatggatggcttgggagtgcattcttatgggtaaattcaccactgcgtcagacgtttgggcattcggggtgaccctctgggaagtgctgatgctgtgtcgggcccagcccttcgggcagttgaccgatgaacaggtcatcgagaacgccggtgagtttttcagggatcagggtcgtcaggtctacttgagcaggcctccggcatgtccccaagggctctacgagctgatgctgcgatgttggagccgggagtcagagcagagaccacccttttctcaactccatcgatttttggcagaggacgcgctaaatacagtctag

SEQ ID NO: 10077 - DNA, 447 bp, Artificial Sequence
  Description of Artificial Sequence: Synthetic coding sequence
atgcagaccttccccgtggccggcgccctggaccccgccatcctggacaccagctcaccccaggccctttataccgtcctcttgatcgtgctggtgatgatgtcacttgtgttcggcaagttcgtccccgttaactgggagcccccccagcctcttcccttcccaaagtatctcagatgctacagatgtctgctcgagaccaaggagctgggctgcctactgggaagcgatatttgcctgactcccgcaggcagcagttgcatcaccctgcacaagaaaaactcttcaggaagcgatgttatggtatcagactgcagatcaaaagagcaaatgagcgactgcagcaacacacggacaagtccggtcagtggcttctggatcttctctcaatactgctttttagatttttgcaacgatcctcagaacagaggcctgtatactccctag

SEQ ID NO: 10078 - DNA, 5097 bp, Artificial Sequence
  Description of Artificial Sequence: Synthetic coding sequence
atgcggctgctgtggggcctgatctgggccagcagcttcttcaccctgtcactacagaagcccagactcttgttgttctctccatcggtggtgcatttgggcgtgccactgtcggtgggggtccagctccaggatgttccccgtggtcaggtggtcaaagggagtgtgttcctccgtaacccttccagaaataatgttccctgctcgcccaaagtcgatttcactttgtcgtctgagagggactttgctctgttatcccttcaggtccccctgaaagacgccaagtcttgtgggctgcaccaactccttagaggacctgaagtccagcttgtggcccacagcccctggttaaaggattccctgtcgcggacaaccaacattcagggcataaacctgctcttttcttctagacgaggccatttgttccttcagactgaccagcctatctacaatcccggacagcgggtgaggtacagggtatttgccttggaccagaaaatgagaccctccacagatacgatcactgtaatggtggagaattcccatggtttgagagtgaggaagaaagaagtgtacatgccgagctccattttccaagacgatttcgtgataccagacatctccgaaccgggcacatggaaaatctccgcccgattttccgatggcctggagtctaactcttccacccagtttgaggtgaagaagtatgtactgcccaacttcgaggttaagatcaccccagggaagccctacattctgactgtgccgggacacctggatgaaatgcagttggatattcaggcgagatatatctacggtaagcccgtccagggagtggcctacgtgaggttcggcctgttagacgaagacggcaagaaaacttttttcaggggattagagagccagaccaagctggtgaatggtcagtctcacatctctctctccaaggctgaattccaggacgccttggagaagttaaatatggggattactgaccttcagggactccggctgtacgtagccgcggccattatagaatatcctggaggggagatggaggaagctgagctcacgagctggtacttcgtatcttctcccttcagtctggacctgtccaaaaccaaaagacatttggtgcccggtgccccattcctcttgcaggccctggtgagagaaatgtccggcagtcccgccagtggcataccagtgaaagtgtctgctaccgtgtctagccccggaagtgttcccgaagtccaggatatccagcagaacacagatgggagtggacaggtcagtatcccaatcattatccctcagactatttccgaattgcagctgtctgttagcgccggcagcccacaccctgctatcgcaagactcactgtggccgcccccccatctggcggaccagggtttctgtcaatagagcggcctgacagtagacccccaagagtgggggatacactcaacctaaacctcagagccgtaggttccggagctacgttcagtcactactattacatgattctgtctcgggggcagattgttttcatgaaccgggagcctaagcggaccctcacctcggtttcggttttcgtggaccaccacctggcaccatctttctattttgttgctttttattatcacggcgaccaccctgtggcgaactctttgcgcgtagatgtgcaagctggggcatgcgaaggcaagttggagctgagcgttgacggtgcgaagcagtacaggaacggagagagcgtgaagctgcatctcgagacagatagtctagctctggtggcccttggagctctcgacactgcactatatgctgccgggagtaagagccacaaacccctcaacatggggaaagttttcgaggccatgaattcatatgacctcggatgtgggcccggcggcggagacagtgccttgcaggttttccaggcagcggggttagcgttttctgacggcgaccagtggacgctgagtcgtaagcgattgagttgtccaaaggaaaagactacgcgcaagaaacgcaacgtgaactttcagaaagcaatcaatgagaaacttggccagtacgcttccccaacggccaagcgctgttgtcaggatggtgtaacacggcttcctatgatgcggagctgtgagcagcgtgcggcccgagtgcagcagcccgattgccgggagccttttctctcctgttgtcagttcgccgaatctctgcgcaagaagagtagggacaaaggccaggctggactccaaagagcactcgaaatcctgcaagaagaggaccttattgacgaggacgacattcctgtcagatcattttttcctgagaactggctctggagagttgagacggtggatcggtttcagattctgacattatggctgcctgatagcctgactacttgggaaatacatggtctctcgttatcaaagacaaaaggtctatgcgtggctacacccgtgcaactgcgcgttttccgcgaatttcatctccatttgcgacttcccatgtctgtgcgcagatttgagcagcttgagctgcggcccgtgctgtacaactacttggataagaatctgactgtgtccgtgcatgtgtcccctgtagaaggactctgcctcgccggagggggagggctcgctcagcaggtgctggtccccgcaggaagcgcacgccccgtggcttttagtgtcgtacccacggctgccgcggcagtgtccctgaaggtagtcgcccgtggctcattcgaatttcccgtcggtgatgcagtgtcaaaggtgttacagatagaaaaggaaggcgctattcatcgtgaagagctcgtttatgagctgaatccgttggatcaccgcggcagaacactggagatacccggcaactccgaccccaatatgattccagacggggacttcaatagttacgtccgggtgacagcttccgatcctctggataccttaggatccgaaggggcactcagtcctggcggcgtcgcctcgctcttaaggttgccaaggggatgcggagagcagacaatgatttacctggcgcccacgttggctgcatctcggtatctagacaagaccgagcagtggtcaaccctcccacctgaaacgaaggaccacgccgtggatctcatccagaagggttatatgagaatccagcaattccgtaaggccgatggcagctatgctgcatggctgagcagaggcagctctacctggctcacagccttcgtgctgaaggtgctctcgctcgcgcaggagcaggtggggggctctcctgagaaactgcaagaaacatccaactggttattaagtcaacagcaggcagacggctctttccaggacttgagccctgtcattcaccgttccatgcaaggcggcttggtgggaaacgatgagactgtcgcgctgaccgctttcgtcactatcgccctgcatcacggactggccgtgtttcaagatgaaggggcggagcctctcaagcagagggtggaggctagcatatctaaagcaagttcattccttggagaaaaggcatcagctggcctgctaggagctcatgccgccgcgatcactgcctatgccctcacgcttaccaaagctcctgctgatctccggggtgtagcacacaataacctcatggctatggctcaggagactggcgacaacctgtattgggggtcagtgacaggaagtcagtcaaacgccgtctcccccactcctgcaccacgcaacccttccgatcccatgccccaagctccggctctgtggatcgagacaaccgcctacgccctgctgcacctgctactccatgaagggaaggccgagatggctgaccaggccgccgcctggctgacaaggcaaggcagttttcaagggggctttcgcagtacacaggacacggtcattgcacttgatgccctgagtgcgtactggatcgcctcacacactacggaagaacgcggcctgaacgtcacactttcaagcacaggcaggaatggatttaagtcgcatgccttacagctcaacaatagacagatcaggggcctcgaagaagaactacagttcagcctcggctctaaaattaatgtgaaggtgggtggaaactcgaaaggaactctcaaagtgcttaggacttataatgtgctagacatgaaaaacaccacttgccaagacctacagatcgaggttactgtcaaaggccatgtcgagtatactatggaggccaatgaggactacgaagattacgagtacgacgaactgccggcaaaggacgatcccgacgctccactccaaccagttacccccctgcagctttttgaggggcggagaaaccggagacgaagagaggccccaaagttgacgtcattgtcggaccggtacgtatcacacttcgaaacagagggaccacacgtgctcctctactttgattcagttcccacttctagagaatgcgtcggcttcgaggccgttcaggaggttcccgtaggcctggtgcaacccgcctctgcaactctatatgactactacaatccagagaggcgctgttcagtgttttatggcgcgccttccaaatcaagactcttagctaccctgtgctctgctgaagtgtgtcagtgtgcggaggggaagtgtccacgccagcggagggctttggagcgcggcctgcaggacgaagacggctatagaatgaaatttgcctgttactacccccgggtggaatacggtttccaagtgaaggtgctccgggaggatagtagggcagcttttcgactgttcgaaacaaaaataacgcaggtgctacacttcacaaaggacgtgaaggccgccgcgaatcagatgcgaaactttctcgtcagagcctcgtgccgactacgactggagcctggaaaggagtatctgatcatgggcttggacggcgccacttacgatctggaagggcacccccagtacttgctggatagcaacagctggatcgaagagatgcctagcgagaggctgtgccgatcaactagacagcgggctgcttgtgcccagctcaacgatttccttcaagagtatggcacacaaggttgccaggtgtag

SEQ ID NO: 10079 - DNA, 1986 bp, Artificial Sequence
  Description of Artificial Sequence: Synthetic coding sequence
atggacctggtgctgaagcggtgcctgctgcacctggccgtgatcggcgcactactggccgtgggggccaccaaagtcccacgaaaccaggactggttaggggtgtcacgacaacttagaactaaggcttggaacaggcagctgtatcctgaatggacggaagctcagcggctagactgctggaggggtggccaggtgtcactgaaggtcagcaacgacggccctaccctgataggagcaaacgcttccttctccatcgccctcaattttccaggaagccagaaagttctgcccgatgggcaggtgatatgggtgaacaacaccattatcaatggctctcaggtgtggggaggccagcccgtgtacccccaggagaccgatgacgcctgtatttttcccgacggcggaccgtgcccaagtggcagttggagccagaagcggtccttcgtatacgtttggaaaacatggggacagtactggcaggtgctgggagggcccgtttccggacttagtattggaaccggccgggcaatgctgggtactcataccatggaagtgacagtgtatcatcgcagggggagcagaagttatgtccctttggcacatagttcctccgcatttactatcacagaccaggtcccgttttccgtgtcagtctcacagctgagggcccttgatggtggtaataaacactttctcaggaatcagcctcttacctttgcactgcagctacacgatcccagcggttacctggccgaggcagacctgtcctacacatgggactttggggactcctctggcaccctgatctctcgagctctagtggttactcacacatatctggagcccggtcccgtcacagctcaggtggtcctccaggcggctattccgctgaccagctgtggatcgagccccgtccctggtacaaccgatggtcatcggcctaccgccgaggctcccaatacgacagctggtcaggtacctacaactgaagtcgtggggaccacccccggacaggcccccaccgcagaaccaagtggcaccactagcgttcaggtgcccaccaccgaagttatttccaccgcgcccgtgcagatgccaaccgctgaatctaccggaatgactcccgagaaggtacctgtgtccgaagtcatggggaccaccctggccgagatgtccacacccgaggccaccggaatgacccccgcagaggtctcaatcgttgtgctgagcggtacgaccgccgcccaagtaacgaccacagaatgggtcgagacaacggcaagggaattgcctattccagagcctgagggcccggatgcttcatccatcatgtcaactgagtctatcactgggagcttgggtcccctgcttgatggaaccgcgacactgagattggtgaagcggcaggttcctctggattgcgtattgtaccgttacggcagtttctccgttacacttgatattgtgcagggtatcgagtctgcggaaatcttgcaagctgtcccttcaggcgaaggcgatgccttcgagctaacagttagttgccagggcgggcttcccaaggaagcttgcatggagatctcttccccaggatgtcagccaccggcacagaggctgtgtcaacctgtgctgccatctcccgcctgtcagcttgtcctccaccagattttaaaagggggttcaggcacttattgcctaaatgtgtctttagcagacactaactctctcgcagtcgtctcaacccagctgataatgcctggacaagaagcaggcctcgggcaagttccactgatcgtcggcatactgctggtgctcatggcagtggtcttggcaagcctgatctatcgaagacgccttatgaagcaggatttctctgtgccccagctacctcactcttctagccattggttgagactcccaaggatcttctgcagctgcccgatcggtgagaattctccacttctgagtggtcagcaggtgtag

SEQ ID NO: 10080 - DNA, 516 bp, Artificial Sequence
  Description of Artificial Sequence: Synthetic coding sequence
atgcggcacaacctgggcggcaacctgggcgacccccgggcccgggctgtctccgtgccattagggggtcgagtggcccgctttttgcagtgtcggtttctcttcgctggcccctggcttctgttctcggaaatctcttttatctctgatgtggtgaacaattcatccccggcgttaggcggcacctttcctccggccccatggtggccaccgggccccccgcctacaaatttttcaagtctggagctagagccccgcggccagcagcccgtagccaaggcagaggggagcccgacagcaatcctgattggctgtttggttgcaattatcctgttattgctgctgattatcgccctgatgctgtggagactgcattggcggcgactcctgagtaaggtgttagagagtcacccccgaacccgctcaccagggcttgtgggcatacgacctacaccgctgcccgtctcccccatggctctcgtgcacctttgcgaagtggactccccccaggattag

SEQ ID NO: 10081 - DNA, 1986 bp, Artificial Sequence
  Description of Artificial Sequence: Synthetic coding sequence
atggacctggtgctgaagcggtgcctgctgcacctggccgtgatcggcgccctcctggcggtgggagccacgaaggtgcctagaaatcaagattggctcggcgttagtcgacaactccgcactaaggcatggaacagacaactatacccggaatggacagaggcgcagaggctcgactgttggcgaggagggcaggtgtccctgaaagttagcaatgacggccccactcttattggcgccaatgccagctttagcattgctttaaactttccggggtctcaaaaggtgctcccagacggccaggtgatttgggtgaataacactatcatcaatggctctcaggtttggggcggccagcctgtttacccccaggaaaccgatgatgcttgcatctttcccgacggcggtccttgcccttctggctcctggtcgcagaaacgctcattcgtgtatgtctggaagacttgggggcagtattggcaggttttgggcggcccggtgagcggactgtctatcggaacaggtcgggcaatgctgggcacccacactatggaggtgacagtgtaccaccggcggggcagtcgcagctacgttcctctcgcccactcttcgtccgctttcactatcaccgatcaggtgcccttctcggtgagcgtgtcccagctgcgagcgcttgacggaggaaacaaacacttcctcagaaaccagccacttactttcgctctgcagctccacgacccctctgggtacctggcagaagccgatttatcctacacatgggactttggggacagctccggcactcttatttcccgagctctggtggtcactcatacctatctggagcctggtcccgtaactgcacaggtggtcctccaagctgcaattcccctaaccagctgcggatccagcccagtgcctggaacgaccgatggccatcgccctactgcagaggcccccaacaccacagccggccaggtcccaaccaccgaagtggtggggactactccagggcaggctccaaccgcagagccttccggtaccacctccgttcaggtgcctacaactgaggtgatttccaccgcccctgtccaaatgccaaccgctgaatctaccggcatgaccccagaaaaggtacccgtgtccgaggtgatgggcaccaccttggccgaaatgtcaacaccagaggcaactgggatgactccagctgaagtcagcatcgttgttctgagcggcaccactgcagcccaggtgactacaacagagtgggtggaaaccacagccagagagttgcctatccctgagccggaaggccctgatgccagctcaattatgtcaaccgagagcataaccggatctttgggtccgctgttagacggaacagcgaccctccgactggtgaaacggcaggttcccctggactgtgtactgtacagatacggctcctttagcgtgaccctagatattgtgcaaggaatcgagagtgccgagattctacaggcagttccttcgggcgagggagacgcatttgagcttaccgtttcttgccagggaggactgccaaaggaggcgtgtatggaaatttcctccccaggctgtcagcctccggcacagcgcttgtgccagccagtgctgccttctcctgcctgtcaacttgttctgcatcagattctcaagggagggtccggtacttactgtcttaatgtgagtctggccgatactaactccttagccgttgtgagtacacaactgataatgcccggacaggaggctggtctcggccaggtcccactcatcgtgggcatcttattggtgctcatggcggttgtgcttgccagcttaatttataggaggcgcttaatgaagcaagattttagcgtacctcaattgcctcactccagtagccactggctccgactccctagaattttttgttcttgcccaataggagagaacagcccattgttgagcggccagcaggtgtag

SEQ ID NO: 10082 - DNA, 1737 bp, Artificial Sequence
  Description of Artificial Sequence: Synthetic coding sequence
atgctgctgctgctgctgctggcccccctgttcctgcggccccccggggctggcggcgctcaaaccccgaacgccacctcagaaggctgtcagatcattcacccgccgtgggagggtggcatacgttaccgcgggctcacacgcgatcaggttaaggccataaacttcctgcccgtggactacgaaattgaatatgtttgcagaggcgagcgggaggtggtcggtcccaaggtgaggaaatgtctggccaacgggtcgtggaccgatatggacaccccgtcacggtgtgtgcggatctgctctaagtcttacctgacccttgagaacggaaaggtttttctgaccggaggcgatttacctgctctggacggagctcgcgttgacttccgttgtgatcccgattttcacttggtgggctctagtcgatctatttgttcccaggggcagtggagcacacccaagcctcattgtcaggttaaccgcactccccacagtgagagaagagccgtgtacatcggggcccttttccctatgagtgggggctggccaggagggcaggcctgccagcctgccgtggagatggctttggaagatgtgaatagccgccgcgatatcctgcccgactacgagctaaagctcatccaccacgatagtaagtgtgatccaggtcaggccaccaaatatctctacgaactcctgtataatgaccccataaagattattctaatgccaggctgttccagtgttagtacactggtcgccgaggccgccagaatgtggaacttgattgtgctgtcttatggctcgtcatcacctgccctaagcaataggcagcgcttcccaacctttttccgtacccatcccagtgccacactgcataacccaactcgagtgaaactctttgaaaaatggggttggaaaaaaatcgcgacaatccagcagactacggaagtcttcacctcgactcttgatgacctggaagagcgagtgaaggaagccggcatcgagatcactttccgacagagcttcttctcggatcctgctgtgcccgtgaagaatctcaaacggcaggacgctagaatcatcgttggcctgttttacgagacagaggcacgtaaggtcttttgtgaggtatacaaggagagactcttcggcaaaaaatacgtgtggtttcttattggctggtatgccgacaattggtttaaaatatatgacccaagtatcaattgtacagtggacgagatgacagaggctgtggaaggccacatcaccacggagatcgtcatgcttaatcctgcaaatacccgaagcatctcaaacatgacatcacaggagttcgttgaaaagctaacaaagcgtctcaaacggcatcccgaggaaactggcggcttccaagaggcccctcttgcctacgacgcaatctgggccctggcactcgcactcaacaagacttctggtggaggtgggcggtctggcgtgcgactggaagattttaattataacaaccagaccatcaccgatcagatttacagagcgatgaactcgtcttctttcgagggagtttctggccatgtggtgtttgacgcttccggctctagaatggcttggacgctgatcgagcagcttcaggggggctcctacaaaaaaatcggctattacgactccactaaagacgatctgtcatggtcaaaaacagacaagtggatcgtcatctcgaggacacacagccctacctag

SEQ ID NO: 10083 - DNA, 1326 bp, Artificial Sequence
  Description of Artificial Sequence: Synthetic coding sequence
atggagttcgagttcgaccggctgcgggccttccaggccatgcaggtacactgtaataacatgcacacgctcggcgccagactacctggtggagtagagtgccggttcagacggggtcccgcaatggcatgggagggcgagcctatgcgccacaacctcggcggaaacttgggcgatccccgcgcccgggctgtatccgtccctttaggaggccgcgtggccagattcttacagtgtcgcttcctctttgcaggcccatggctcctgttcagcgagatctccttcatctctgacgtggtgaacaacagtagccccgcgttaggtggtactttcccccccgcaccttggtggccccccggcccaccccctaccaacttttcgagcctggagttggaaccccgggggcagcagccagtggctaaagctgagggctcacctaccgccatcctgataggctgtctggtggcaatcattctcctgctcctactgataatagccctgatgctgtggagactccactggaggcgcctactatctaaagtgcttgagagtcatccgcggacaaggtcccctggattggtgggaattcgccccacaccgttaccggtatcaccaatggccctgagatgttgcagtcctattcagccaactgcatccttctggccactgacgcctgtcccgctagaagcccgtgcgcccccgcatcctcccggcccgaatccacccactccacgcggggtcacaggggggaacacctacgccgtacccgcactcccaccaggggccgtcggagatgggccacctagagttgactttccaaggtccaggctcagattcaaagagaagctcggtgaaggacagttcggagaagtgcatctatgcgaggtcgattccccccaggatttagtgagccttgattttccactgaacgtacggaaaggccatcccctattggtggccgttaagatacttcgcccagatgcaacaaaaaacgctaggaacgattttctaaaagaagtcaaaattatgtcaagactaaaagacccaaacattatccggttgttgggtgtgtgtgttcaggacgaccccttgtgtatgatcacagactacatggagaatggcgatcttaaccagtttctgagcgcccatcagctagaggataaagcagcagagggtgcacctggggatggccaggctgctcagggacccacgataagttatccgatgctccttcatgtggcggcccaaattgcgtccggcatgcgctatctcgcaactctgaatttcgtgcatttctggggtgagcgtcaccgttttctccattag

SEQ ID NO: 10084 - DNA, 447 bp, Artificial Sequence
  Description of Artificial Sequence: Synthetic coding sequence
atgcagaccttccccgtggccggcgccctggaccccgccatcctggacacttcatcaccacaggccctctacaccgtcctgcttattgttttggtgatgatgagtctggtattcggaaagtttgttcccgttaactgggagcctcctcagccacttcctttccctaagtacttacggtgctacagatgtttactcgagacaaaagagctcgggtgcctgctgggttccgatatctgtctcacaccggcaggcagcagctgcatcacacttcataaaaagaattcatctggttctgatgtgatggtctccgactgtagatcgaaggaacagatgagtgattgtagtaatacgcgcacctcccccgtgagcggattctggatcttcagccagtactgcttcctggatttctgtaacgacccacagaatcggggcctttatacgccttag

SEQ ID NO: 10085 - DNA, 732 bp, Artificial Sequence
  Description of Artificial Sequence: Synthetic coding sequence
atgggccccgaggccctgagcagcctgctgctgctgctgctggtggcctccggcgatgcggacatgaaaggccactttgatcccgcaaaatgccggtatgccttggggatgcaggaccgcactatcccggattcagacatatctgccagctcgtcatggagcgacagtacggccgcccggcactcccgcttggagtcatcggatggggacggcgcctggtgccccgcgggcagcgtcttcccaaaggaggaggagtacctgcaggtggacttgcaaagactccaccttgttgctctggtggggacgcagggcaggcacgccggcggcctgggaaaagagttttctcgaagctacagactaaggtactctagggacggtcgcaggtggatgggctggaaggacagatggggacaagaggtgatatcaggcaatgaagatccagagggggttgtgttaaaagatctcggccctccaatggtcgcccgactagttcgcttttaccctcgagctgaccgcgtgatgtctgtgtgtctccgtgttgaattgtacggctgcctgtggcgggattgctctatgggcgtgtgggcttcatggcagatggtctggtggggttggatgaccctaggccgggtgagaagttgcggctcaggccaggctatgaccatgtgggatggtgctactacagccagccccgtggccatgtggcggtggagcttatcactgaccggatag

SEQ ID NO: 10086 - DNA, 732 bp, Artificial Sequence
  Description of Artificial Sequence: Synthetic coding sequence
atgggccccgaggccctgagcagcctgctgctgctgctgctggtggcctccggtgatgcagacatgaagggacattttgatccagccaaatgtcgctacgctctaggcatgcaggaccgaactatccctgacagcgacatctcggcttcaagctcttggagcgattcgacagcagcccgacacagcagactggaatccagcgatggtgacggggcttggtgtccagcaggcagcgttttccccaaggaggaggaatacctccaggtggatcttcaaagactccatctcgtggccctcgtgggaacacagggaaggcacgccggaggccttggcaaggagttctctcgctcttatcggctgcgctatagtcgggatgggaggcgttggatgggttggaaagatcgctggggacaagaagtgatatctggcaatgaggaccccgagggcgttgtgttgaaagacttaggtccaccaatggtagctaggttagtgagattctatcccagagctgaccgcgtcatgagtgtatgtctgcgcgtggaactatacggatgcctttggcgcgactgcagtatgggagtctgggcaagctggcagatggtgtggtggggatggatgactctgggtcgagtccggtcctgcggaagcggccaggccatgacaatgtgggacggggctaccaccgcgtcaccagtggccatgtggcggtggtccctgtcattgaccggctag

SEQ ID NO: 10087 - DNA, 1224 bp, Artificial Sequence
  Description of Artificial Sequence: Synthetic coding sequence
atgcggctgctggcctggctgatcttcctggccaactggggcggcgcacgcgctgagccagggaagttctggcatattgcagatctgcatcttgatccggactacaaggtctctaaagacccctttcaagtgtgtcctagcgcggggagccagcccgttcctgacgcgggcccttggggggactatttgtgcgactctccatgggcactcataaactctagtatctacgctatgaaggagatcgagcccgagccggatttcatcttgtggacgggcgacgacactcctcacgtaccggacgagaagctcggagaggctgccgtacttgaaatcgtggagcggctaacgaaactaatccgggaagtattccctggggccttttattgcgaaaagctcccggggcccagcggcgctggcaggatcgtggttctgaatactaatctgtactatacttccaatgccttgaccgcagatatggctgatccagggcagcaatttcagtggctcgaagacgtactgacagatgcctctaaagcaggcgatatggtgtatatcgtcggccatgtaccccccggattttttgaaaaaacccaaaacaaggcgtggttccgcgaggggttcaacgagaaatacctgaaggttgtgcgcaaacaccacagagtgatcgccgggcagttcttcgggcaccatcataccgactcatttcgaatgctctacgacgatgccggagtacccatttccgcaatgtttatcacccctggcgtgaccccttggaaaaccacacttcccggtgtggtgaacggcgccaacaaccctgctatccgcgtatttgagtacgatagagctacattgtcgctgaaggatatggtgacttactttatgaatctcagtcaggccaatgcacagggcaccccacgttgggagttggagtaccagctgacagaagcctacggcgtgccagacgcaagcgcccacagtatgcacacagtgttggacaggatcgctggggaccagtccactctgcagcggtactacgtttataacagtgtaagttacagcgccggagtgtgtgatgaggcctgttctatgcagcacgtttgcgcaatgcgtcaggtcgacatcgacgcttatacaacttgtctctacgccagcgggaccacccccgtcccccagctgccactccttctgatggcactgctcggcctgtgcacattggtcctgtag

SEQ ID NO: 10088 - DNA, 756 bp, Artificial Sequence
  Description of Artificial Sequence: Synthetic coding sequence
atgccccacctggccagcctgttcaccgccagcagccggtgctgcccccatccattgcgccctgaaggctcaggggccatggggcccgaggccctctcaagcctgctcttgctccttctggtcgcatcgggcgacgccgatatgaaaggccacttcgaccctgcaaaatgtagatatgccctcggcatgcaagatcggaccatcccggactctgatattagcgcaagctccagttggtctgattcaacggctgctcgccactcaagactggagagttccgatggtgatggtgcctggtgcccagctggttccgtgttccctaaggaagaagagtatctgcaggtcgaccttcagcggctgcatctcgtggccctggttggaacccagggccgacatgcggggggtctgggcaaagaattctcacgcagttacaggctacggtacagtagggacgggagacgatggatgggatggaaggatcgatggggacaagaggtcattagcgggaacgaggatccggaaggagttgtactgaaggacctgggaccacccatggttgctcggctcgttagattctatccacgggccgatagagtgatgtctgtctgcctgagggtggagttgtacggctgcctgtggaggggcgagtggctctcgtttttagggatctgtttcctgtcgcgcggactcgaagggggggagtgtggtgaatgggcctcccgaattccctcaccagcagggaagttatcgctatag

SEQ ID NO: 10089 - DNA, 756 bp, Artificial Sequence
  Description of Artificial Sequence: Synthetic coding sequence
atgccccacctggccagcctgttcaccgccagcagccggtgctgccctcacccgttgcgtcccgaggggtctggagccatggggcctgaggcactgtcgagcctgctgctactccttctggtggctagtggggatgccgacatgaagggtcactttgatcctgcaaagtgtcgctatgcactgggcatgcaggatagaaccattccagatagtgacatatctgcctcctcctcttggtctgactccactgcagcaagacacagcaggttggagtcatccgacggcgatggggcgtggtgcccagcaggctcagtattcccaaaagaagaagagtatctgcaggttgatctccaacgcttacaccttgtcgctctggtggggacgcaggggcgacacgctggaggtctgggaaaggagttctccaggtcatataggctgaggtactcccgagatggaagaagatggatgggatggaaagaccgctggggccaggaggtcatctcaggaaatgaagaccctgaaggtgttgtcctgaaggatctgggtccacccatggtggcacggttagtgagattctaccctcgggctgatcgggtcatgagcgtctgtctgcgagtcgagttgtatgggtgtctgtggcggggagaatggctttcattcttgggaatttgcttcctttcacgcgggttggagggcggagagtgcggcgaatgggcttcccgaattccctctcctgctggcaaacttagtttgtag

SEQ ID NO: 10090 - DNA, 456 bp, Artificial Sequence
  Description of Artificial Sequence: Synthetic coding sequence
atggacctggtgctgaagcggtgcctgctgcacctggccgtgatcggcgccctcttagccgtaggggctactaaggtgccaaggaatcaagactggctgggagtgtcccgccaactgcgtacaaaagcatggaatcgacagctgtatccagagtggaccgaagctcagcgcctggattgttggcggggcggccaagtgagtcttaaggtgtcgaacgatggcccgacactgatcggggctaacgcctccttctctatcgccctcaatttcccaggatcacagaaggtgctgcccgatgggcaggtcatctgggtgaacaatacaattataaacgggagccaggtgtggggcgggcaaccagtgtatccccaagagaccgacgatgcatgcatatttcccgatggcggaccgtgcccaagcggaagctggagtcaaaaaagatcttttgtttactag

SEQ ID NO: 10091 - DNA, 216 bp, Artificial Sequence
  Description of Artificial Sequence: Synthetic coding sequence
atgcccgccggcgtgcccatgagcacctacctgaagatgttcgccgctagcctcctggccatgtgcgccggagccgaagtcgtgcatagatattacagacctgatcttacaataccggagattccccctaaacgcggggaactcaagacggaattactgggtctaaaagagcggaagcataaacctcaagtgtctcaacaagaggagctgaaatag

SEQ ID NO: 10092 - DNA, 447 bp, Artificial Sequence
  Description of Artificial Sequence: Synthetic coding sequence
atgcagaccttccccgtggccggcgccctggaccccgccatcctggacacatcctccccgcaagccctgtacacagttttgctaattgttcttgttatgatgtccctggtgttcggcaagttcgtaccagtaaattgggagcctccccagccattaccattccccaaatacctgaggtgttatcggtgtctcctggagaccaaggaattgggctgcctccttggatccgatatctgtcttacccccgccggtagcagctgcatcacgctacacaagaaaaattcttccggctctgatgtgatggtgtcggattgcaggtccaaggaacagatgtctgattgtagtaatacacgaacttctcccgttagcggtttttggatcttttcacaatactgctttctggacttctgtaacgatcctcagaacagaggcctgtacaccccatag

SEQ ID NO: 10093 - DNA, 447 bp, Artificial Sequence
  Description of Artificial Sequence: Synthetic coding sequence
atgcagaccttccccgtggccggcgccctggaccccgccatcctggatactagctcccctcaggccttatataccgtgctcctgatagtgctggtcatgatgtcactcgtcttcgggaaatttgtgcctgtgaattgggaacctcctcagcctctgccattccccaagtacctgcgttgctaccgatgccttctggagaccaaggagcttgggtgtctgttggggtccgatatatgtctgacccccgccggttcttcctgtattaccctgcacaagaaaaacagctccggcagtgacgtaatggtgtcggactgcaggagtaaggaacagatgtctgactgtagcaacacacggacatctcctgtttccggattctggatcttttcacagtactgttttctggatttctgtaatgacccacagaaccgaggactctacactccatag

SEQ ID NO: 10094 - DNA, 1326 bp, Artificial Sequence
  Description of Artificial Sequence: Synthetic coding sequence
atggagttcgagttcgaccggctgcgggccttccaggccatgcaggttcattgcaataatatgcatacgttgggagcccggttgccaggaggtgttgagtgtagattcaggagggggcccgccatggcgtgggagggggagcccatgcggcataatctgggaggaaacttgggcgacccaagagctagagccgtgagcgtgcctcttggtggacgggtcgccagatttctgcaatgcagatttctgttcgccgggccttggttactctttagcgagataagcttcatcagtgatgttgttaacaatagttcacctgcattgggcggaacgttccctcctgctccatggtggcctcctgggccgccccccacgaatttttccagcctggagctggaaccccgaggccaacagccggttgccaaagccgaaggatctccaacagccatcctgatcgggtgcttggtggccattattcttctgctcctgctaataatcgctctcatgttgtggagactccattggcgacgcttactgagcaaagtgttagagagccaccctagaacacgcagccccggtttggtaggaatccgaccaacaccattacctgtgtcaccaatggcgttacggtgctgctccccaatacagcctacagcttccttctggcctctgacaccagtgccactggaagcacgcgctccccctcaccctcccgggccaaatccccctactccccgaggagtgaccggtggcaatacttatgccgtcccagccctgccaccaggggccgtaggtgacgggcctcctcgggttgattttccgcgaagtcgactgcgctttaaggagaagctgggagagggccagtttggagaagtgcatttgtgtgaagtggactcacctcaggatctggtgagcttggactttccattaaacgttagaaaaggtcatccactccttgttgcagtcaagattttgcggcctgacgccaccaagaacgcacgaaatgactttctcaaggaggttaagatcatgagccgcctgaaggacccaaacattatcaggctcctgggtgtgtgcgtacaggatgaccccctttgtatgattaccgactatatggagaatggcgacctaaatcaattcctgtccgcccaccagttagaggataaagcggccgaaggggccccgggcgacggacaagcagcgcagggaccaacgatcagttatcccatgctcctccacgtggcggcacagatagcttcaggcatgcggtatctggccaccttgaactttgtgcatttctggggggaaagacacaggttcctgcattag

SEQ ID NO: 10095 - DNA, 2067 bp, Artificial Sequence
  Description of Artificial Sequence: Synthetic coding sequence
atgctgcccaccgaggtgccccagagccaccccggccccagcgccctgctgctgctgcagctgctcctaccaccaacaagcgctttctttccaaacatttggtcacttctcgcggccccaggctcaatcactcaccaggacctgacagaggaggcagcactgaatgtgactctacagctgtttttggagcagcctccaccgggaagaccacctcttcgactggaggatttccttgggaggactctcttagcagatgacctatttgcagcctatttcggccccggatccagtaggcggttccgagcagctctaggcgaggtgagccgagcaaacgccgcccaagacttcctccctactagccgtaatgatcccgatttgcacttcgatgcagagaggctcggacaaggcagagcacggctcgtgggggccctgcgggaaactgttgtggcagcccgggcgttagaccatactctcgcccggcagagactgggggccgcgcttcacgccctgcaagacttctactcacattctaattgggttgaactgggagagcagcaacctcaccctcacctcctgtggcccaggcaagaacttcagaaccttgcacaggtcgcagatcctacttgtagcgactgcgaggaattaagttgccctaggaactggctgggttttacactgctaaccagcgggtacttcggcacacacccacccaagccgcccggaaagtgctcacacgggggccacttcgaccgatcatctagccagcctcccagaggaggcatcaataaagactcaacatctccgggctttagcccccaccacatgcttcacttgcaagcagctaagctggcgctactggccagcatccaggccttttccctcctaagaagcagactgggcgacagagatttctcacgcctcctcgacataacgcccgctagttctctgagcttcgtcctcgacactactggcagcatgggtgaagagatcaacgctgccaagatccaggccagacatctcgtggagcagagaagaggctctcctatggagcctgtgcattacgtgcttgtacctttccacgaccctggctttggaccagtctttacgactagcgaccccgacagcttctggcagcaactgaacgaaatccacgctctcggtggcggcgacgagccagaaatgtgtctctctgctcttcagctggccctgcttcatactccgcctctaagtgacattttcgtcttcactgacgcctccccaaaggacgcattcctcaccaatcaggtggaatccctcacccaagagaggcggtgtcgtgtcacatttctggtgactgaggatactagccgcgtgcagggaagggcccgccgcgagattctctcccccttgcgatttgagccttataaggccgtagctctggcgagtggcggagaagtgatcttcaccaaggatcagcacattcgcgatgtagccgctatagtgggcgagtctatggctgctctggtcacccttccactggatccaccagtcgttgtaccaggacaacccctggtgttctccgtggatggactcctgcagaaaatcactgtacggatccacggcgatatctccagtttttggattaagaatcctgctggcgtgtcgcagggtcaggaggaaggcgggggcccactgggccacacgagacgtttcgggcagttctggatggtcactatggatgacccgcctcaaaccgggacgtgggagattcaggttacagcggaagacaccccaggagtgcgcgtgcaggcccagacgtccctggatttcctcttccactttggaatcccgatggaggatgggccccaccctggtctgtaccctctgacccagcctgttgcgggtcttcagacccagttgctggtggagtctcagtcttggggctcaagtgctgcatttttgcctcgacacccaagtcgcggcccacgggggtgccggactcgtccaggcgcgttgggagcccgtggtactagtggcgcaagaagccctaggtcactggctgttgcccatgctgccgtgcatccttag

SEQ ID NO: 10096 - DNA, 1326 bp, Artificial Sequence
  Description of Artificial Sequence: Synthetic coding sequence
atggagttcgagttcgaccggctgcgggccttccaggccatgcaggtacactgcaacaatatgcacaccctgggagcgcgcctgcccggcggagtggagtgccgattcagaagaggacccgcaatggcctgggaaggtgagcctatgcggcataacctgggaggaaatttgggggaccccagagctagagctgtgagcgtgccactcgggggccgggtagcacggttcctgcagtgccgattcttattcgcgggcccatggctcctgttctccgaaatctcattcattagcgacgtagtgaacaattcgtcacctgccctcggcggaaccttcccacctgctccatggtggcctccaggaccaccgcctacaaactttagcagcctagaactcgagccccgcggccaacagcccgtagcaaaagctgaaggatccccaacagccatattgattgggtgcctggtcgccatcatcttgctcctattactgatcatagccctcatgctgtggcggttacactggcgtcgtcttctcagtaaggtgctggaatcccacccgcgcacccggtcccccggattagtgggtattagaccaaccctgcttcctgtctctccaatggctctgagatgctgcagccctattcagccgacagccagcttctggccactgactcccgtgccactcgaagccagagctccgccccatcccccaggtcccaatcctccgacacccagaggggttaccggcgggaatacatacgccgtgcccgcccttcctccaggggccgttggcgacgggcccccacgggtagactttccacgctccagactgcggtttaaggaaaaactcggtgagggacagtttggggaagtgcacttgtgtgaggtagactcacctcaagatcttgtgtctttagactttcccctgaacgtccggaagggccatccccttcttgtcgcagtgaagatactcagaccagacgccaccaagaacgctagaaacgacttcctaaaggaggtgaaaattatgagcaggctgaaagatccaaatatcatccgccttcttggagtgtgtgtgcaggacgaccccctgtgtatgatcacagactacatggagaacggagacctgaaccaatttttatccgcacaccagctagaagataaggcggccgagggagcaccgggggatggacaggctgcccagggccctaccattagctatccaatgctgctgcatgtggccgcccagatcgcttccggaatgagatacctcgccaccctgaacttcgtgcatttttggggagaaaggcataggtttctgcattag

SEQ ID NO: 10097 - DNA, 2559 bp, Artificial Sequence
  Description of Artificial Sequence: Synthetic coding sequence
atgctgcccaccgaggtgccccagagccaccccggccccagcgccttactgctgttgcaacttttactgcctccaacaagcgcattcttcccaaacatctggtctcttcttgcggcccctggctccattacacatcaagacctcaccgaggaagccgctctcaacgtaacgctccagctttttctggagcagccccctcctgggcggcctcccctgcggctagaagatttcctcgggcgaacgctgctggccgacgatctcttcgccgcttattttgggccggggtcttcccggcgcttccgcgcggccctcggagaggtcagtcgggcaaatgcagcacaggacttcctccccacctccaggaatgaccccgacttgcacttcgacgccgaaagactaggacagggccgcgctaggctcgtcggggccctaagggagacagtagttgccgctagggctctggatcataccctagcaaggcagcggctgggcgccgcactccatgctctgcaggatttctattcacactcaaattgggtggaattgggggagcagcagcctcacccacaccttctctggccccggcaggagctacaaaatcttgcacaggtggccgatcctacatgctccgactgtgaggaactgagctgcccacggaactggcttggtttcactctgctcacatcgggttacttcggaacccacccccccaagcctccgggcaaatgcagtcatggggggcacttcgaccggtctagttcacagccgccaagaggcgggatcaataaagactccacgtccccgggattctccccccatcatatgcttcacttgcaagctgccaagctggccctgctggcttcaatccaggccttctccttactgaggagtcgactgggcgaccgcgacttcagtcgtctcctagatatcacaccggcgagctcactctccttcgtccttgacaccaccgggtctatgggagaagaaattaatgctgcaaagatccaggcccggcacctggtagaacagcggcgaggatcaccgatggaaccggtacattacgtgctggtcccctttcatgacccaggcttcggaccagtgtttacaactagcgacccagactcattttggcagcagctaaatgagattcacgccttgggcggtggcgatgaaccagagatgtgcctgtctgctctgcagctggctcttctgcacacgccaccattaagcgatatctttgtgtttactgatgcctctccgaaggatgcctttttaacaaatcaggtggaatcactcacccaggagagaaggtgtcgtgttacttttctggttacagaagacacctctcgggtacaggggagggcgagaagggagattttatcaccgctcagatttgagccgtacaaagcagtggctctggccagcgggggagaggtgatcttcacaaaagatcagcacatcagagacgtcgcagcaatcgtgggtgaatccatggccgccttagtaaccctccccttggacccccccgtggtggtccccggccagcccctcgtgttcagcgttgacggcctcctgcagaagattacggtgaggattcacggagacattagctcattttggataaagaatccagccggggtgagccagggtcaagaagagggtggagggcccctagggcatacccggcgatttggacaattctggatggtcacaatggatgaccccccacaaactggaacttgggaaatacaggtaaccgctgaagacacacccggcgtccgcgtgcaagcccagacaagcttagacttcctgtttcattttggcattcccatggaagacggccctcatcctgggttgtaccctctgacacagccagtagcgggccttcaaacacagctccttgtggaagttacggggctcggttcccgggcaaaccccggagacccacagcctcatttttcccatgtgattctgagaggagtccctgagggagccgaactgggacaagtgcccctggaacctgtgggaccaccagaacgagggcttctcgctgcttcgctgagccccacccttctgagtacacctcgaccattcagtctggagcttatcggtcaggatgccgcaggcagacgcctgcacagggcagcaccccaaccgagtactgtggtaccggtgcttctggaactgtccggaccgtccggttttctcgctccagggagcaaagtcccactttctttacgcatcgcttccttctctggacctcaggacttggacctgcgcacatttgttaacccttccttctccctgacttctaatcttagtcgggctcacctggagctgaacgagagtgcgtggggtcggttgtggcttgaggtgccagatagcgctgcacccgattcagtggtaatggtgacagtaacggcaggtggtagagaggccaaccccgttcccccaacccacgctttcctcagattattagtctccgctccggcgccccaggtgcgcaatcattatttcccatcacaaggtccagctcaccacccttaccgcttgatctag

SEQ ID NO: 10098 - DNA, 732 bp, Artificial Sequence
  Description of Artificial Sequence: Synthetic coding sequence
atgggccccgaggccctgagcagcctgctgctgctgctgctggtggccagcggggacgctgatatgaagggacactttgaccccgccaaatgcagatatgcactcggaatgcaggacagaacaatcccagacagtgacatttccgccagttcttcatggtccgactccacggccgcccgccactcgcgtttggagtcatctgacggcgacggcgcttggtgccctgcaggaagtgtcttccctaaagaggaggagtatctgcaggttgacctccagcggcttcaccttgtcgcattagtggggactcagggaaggcatgcggggggactcggaaaagaattctcgagaagttatcggttgcgttactcccgcgacgggagaagatggatgggctggaaggatcgatggggtcaggaggtcatttcagggaacgaggacccagagggtgtcgtacttaaggatctgggaccgcctatggtcgcaaggctcgtccgcttctacccaagggcagatcgtgtcatgtctgtgtgcctgcgggtggagctgtatggatgtctgtggagagattgttctatgggagtttgggccagctggcagatggtatggtggggctggatgacgctggggcgtgtacgaagctgtgggtctggccaggcaatgacgatgtgggacggcgcgacgacagcaagccccgttgctatgtggcgctggagcttgagtcttacaggatag

SEQ ID NO: 10099 - DNA, 2760 bp, Artificial Sequence
  Description of Artificial Sequence: Synthetic coding sequence
atgggccccgaggccctgagcagcctgctgctgctgctgctggtggcttccggtgatgctgacatgaaaggccactttgacccggccaagtgtcggtatgcattgggaatgcaggacaggaccattccagactctgatatcagcgccagctccagctggtcagattccactgcggcccgacattccaggttggaatcttccgatggagacggggcttggtgcccagctggtagcgtgttcccgaaagaggaggagtatctccaggtggatttgcaacgattgcacctagtcgccttagttggcacccagggacggcacgcggggggtctgggtaaagagttctcaaggtcttaccgcctcagatacagtcgggatggccgcaggtggatgggatggaaggatagatggggacaggaagtgatctcaggcaacgaagacccagaaggcgtggtactgaaggaccttggtccacctatggtggcacgcttggttagattttatccgcgtgccgatcgagtgatgtccgtgtgcctgagggtcgagctctacggctgtctgtggcgagacggtctgctctcttacaccgcacccgtgggacagactatgtatctgtctgaagccgtgtatcttaatgactcaacttacgacggccacacagtaggcggactccagtacggcggactcgggcagctcgccgatggtgttgtgggattggatgattttcgcaaaagtcaggagttaagagtgtggcctgggtatgattatgtgggttggagtaatcacagcttctcatccggttacgtagagatggaattcgagttcgacagactgcgagccttccaggctatgcaggttcattgcaacaacatgcacacgctgggcgcgaggcttccaggcggtgtggagtgtcgttttcggcgcggcccagccatggcttgggagggcgaacccatgcgacacaacctcggcggtaacctcggagaccctcgagcgagagccgtctccgtccctctgggaggtagggtcgctagattcctgcagtgccggtttcttttcgccgggccctggctccttttcagtgagattagcttcatctcagatgtggtgaacaattccagcccagccctgggtggaaccttcccacccgccccatggtggccaccggggccaccgcccacaaatttttcatctttagagctggagcctcgtggccagcagcctgttgccaaagcagagggcagcccaacagctatcctcatcggatgccttgtggccatcatcttgctactccttctcataattgccctgatgctgtggcgcttacattggaggcggctcctcagcaaagccgagcgccgggtcttggaggaggaactgacagtgcacttgtctgtgcccggcgatactatccttatcaacaaccgccccggccctagggaaccccccccctatcaggaaccaagacctcgggggaacccccctcatagtgctccctgtgttccaaacggatcagcccttttgctgagcaatcctgcctatagactgttgctagcaacctatgcgaggccacctaggggacctggcccacccacccccgcatgggcaaagccgacaaacacacaggcatactctggagactatatggaaccagagaaacccggcgcccccttgctcccacccccccctcaaaatagtgttccccactatgctgaagctgatatcgtgaccctgcagggggtgacaggtggaaatacctacgcggtaccagctcttccccccggggccgttggcgacggcccacctcgggttgatttccccaggtcgaggctgcgctttaaagaaaaacttggggagggacagtttggcgaggtacacttgtgtgaggtagactctcctcaggatttggtgagcctggactttccactgaatgtgagaaaagggcatccactgttggtggcagttaagattctaagacccgacgcgaccaagaacgcctctttctcactcttcagtagaaacgacttcctcaaggaagttaagattatgtctcggctcaaggatcctaacatcattagactgctgggggtttgtgtgcaagacgatccactgtgcatgatcaccgattacatggagaacggcgacttgaatcagttcctgagcgctcaccaactggaagataaggcagccgagggggcgccaggtgatggccaggcagcccaaggtcctactatcagttatccgatgttgctgcatgtggccgcccaaatcgcatccggcatgcgctacttagctacactgaatttcgttcatagggatctagcaacaaggaactgtttagtcggcgagaacttcactatcaagattgcagacttcggaatgagtcgtaacctgtacgcaggagactactaccgggttcaggggcgagcagtgctgcctatcaggtggatggcatgggagtgcatcctaatggggaagtttacgacagcctccgatgtttgggcatttggggtgactctgtgggaggtgctgatgctgtgtcgcgctcagccatttggacagctgacggacgaacaggttattgagaatgccggggaattcttcagagatcaaggtaggcaagtctatctctctcggccccccgcctgtccccagggtctctacgagctgatgctgcggtgctggtcaagagagtccgagcaacggcccccgtttagccagctgcatcgattcctggccgaagacgcactgaacactgtgtag

SEQ ID NO: 10100 - DNA, 2700 bp, Artificial Sequence
  Description of Artificial Sequence: Synthetic coding sequence
atgctgctgctgctgctgctggcccccctgttcctgcggccccccggtgcggggggagcccagactccgaatgctacgtcagagggttgccaaattatccatccgccttgggaaggaggtatacggtaccgaggattgacacgagatcaggtcaaggccatcaattttctccccgtagactacgaaatagaatacgtgtgtcgcggggaacgggaggtggtgggccccaaggttagaaagtgcttagccaatggctcgtggaccgatatggataccccctctagatgtgtcaatcgcaccccacattcagagagacgggctgtctatataggcgctttgttcccaatgtccggcggctggcccggaggccaagcctgccagcctgcagtagagatggctttagaagatgtaaactccagaagagacatattgcctgactacgaactaaagctcatccatcacgactctaagtgtgatccagggcaggccaccaagtacttgtatgaactgttgtataacgatccaatcaagatcattctgatgcctggctgttcctctgtatcaaccctggtcgcagaagcagcacgtatgtggaaccttatcgtcctctcttacggatcgagttccccagctcttagtaaccgacagcgcttcccaaccttttttcggacacacccgtcagccactcttcataaccctacacgggtgaaactatttgagaaatggggttggaaaaagatcgcaacaatccagcagactaccgaggtcttcactagcacgctcgatgacctcgaagaacgcgtgaaggaggccggcatagaaattacctttagacagtctttcttcagcgacccagcagtgccagtgaaaaatctgaagagacaggatgcaaggatcattgttggcctgttctatgagaccgaggcacgcaaagttttttgcgaggtttataaggagcgactcttcgggaagaaatacgtgtggttcttgataggctggtacgcggacaattggttcaagatttacgatccttctatcaactgtacagtggacgagatgactgaagcagtggaaggtcacatcacaactgagattgtgatgctgaaccctgccaatacccggagcatctccaatatgacgtcacaagaatttgtggagaaattgaccaaacgccttaaacgccaccccgaggagaccggcggctttcaggaagctcctctggcgtatgacgcgatctgggcccttgcacttgccctgaataaaacctccggaggcggaggtcgctctggtgtccggctggaagacttcaactacaacaaccagacgatcaccgatcagatctatcgcgctatgaactcgtcctcctttgaaggcgtgagcgggcacgtggtattcgacgcatccggaagtcgcatggcatggaccctgatagagcagctgcagggcggctcatacaagaaaatcggatattatgactccacaaaagatgatctgtcctggtccaaaaccgacaagtggatcggcggctccccacccgccgaccaaacactggtgatcaagacgtttaggtttctctcccaaaagctttttatttctgtcagcgttctctccagcctgggaatagttctcgccgtggtatgcctgtcttttaacatttacaacagtcacgttcgttatatccaaaactcacaacctaacctcaacaacctgacagccgtagggtgcagccttgcgcttgctgctgtgtttccgctcggactggacggctaccatatcgggcgcaaccagttcccattcgtctgccaggccagactgtggctcttaggactgggcttttctcttggttacggttccatgttcacaaaaatatggtgggtgcatacagtcttcaccaagaaagaggaaaagaaagagtggaggaagaccctggaaccctggaagctgtatgctacagtgggcctgctggttggcatggacgtgttgacattagctatctggcagatcgtagacccattacacagaaccatcgaaacattcgccaaggaagagccgaaagaagatattgatgtgtcaatcctgccacagctcgagcactgtagcagccggaagatgaacacgtggttagggatcttctatgggtataaaggactgcttttactgttgggaattttcctggcttacgagacaaagagcgtgtcgactgaaaaaattaacgaccacagggccgtgggcatggcaatctataatgtagcggtgttgtgcttaataacggctcccgtgacgatgattctttcgtctcagcaggatgccgcgttcgccttcgcaagcctcgctatcgtgttctcttcttatattacactggtggtcctctttgttccgaaaatgaggaggctcatcactcggggagaatggcaatctgaggctcaggataccatgaaaacgggctcaagtaccaataacaatgaagaggaaaaatcaagactgctggaaaaagagaacagagagctggaaaaaattatcgctgagaaggaggaaagagtgtcagaacttagacaccagttgcaatcacgccaacagctgcggtcacgcaggcatcctccaactccaccagagccatcggggggcctgccaaggggtccccctgagcccccagaccggctcagctgtgacggctctagagtgcacctactatataagtag

SEQ ID NO: 10101 - DNA, 447 bp, Artificial Sequence
  Description of Artificial Sequence: Synthetic coding sequence
atgcagaccttccccgtggccggcgccctggaccccgccatcctggatactagctctccccaggctttatatacggtgttactgatcgttctcgtgatgatgagcctggtcttcggaaagtttgtccccgtcaattgggaacctccacaaccacttcctttcccaaaatatctccggtgctacaggtgtctcctggaaactaaggagctgggttgcctgttgggaagcgacatctgtcttacacccgccgggtcaagttgtataactctgcataagaaaaattctagcggctcagacgtgatggtgtccgactgcagatccaaagaacaaatgtctgactgcagtaacacaagaacgtccccagtcagtgggttttggatattctcgcagtactgttttttggatttttgtaacgacccccaaaacagaggcctctacactccctag

SEQ ID NO: 10102 - DNA, 516 bp, Artificial Sequence
  Description of Artificial Sequence: Synthetic coding sequence
atgcggcacaacctgggcggcaacctgggcgacccccgggcccgggccgtatccgtcccactcggcggccgcgtcgctcgcttcctccaatgtcgatttcttttcgctgggccttggttgctattctcagagattagctttatcagtgatgtggtgaataatagttcccctgcacttggtgggacctttccccccgccccctggtggcctcctggcccgcctccaacaaacttctcgagccttgaactggagccccgcggacagcaacccgtagcaaaggccgagggaagccccacagccatcttgatcgggtgcctcgtcgccatcatcctcctactacttctgataattgcgttgatgctctggcgactgcactggcgcagactgctctcgaaggtgctggagtcccatcctcggaccaggtctcccggtctggtgggaatccgacccaccccgctgcctgtctctccaatggcgctggtccacctgtgtgaggtggatagtccccaggattag

SEQ ID NO: 10103 - DNA, 666 bp, Artificial Sequence
  Description of Artificial Sequence: Synthetic coding sequence
atgaccacccagctgcgggtggtgcacctgctgcccctgctgctggcttgctttgtccagacaagccccaagcaggagaaaatgaagatggattgccataaagacgagaaaggtaccatctatgattacgaggctattgccttaaataaaaatgaatatgtgtccttcaaacagtacgtcggaaagcacatcctgtttgtgaatgtggccacctactgcggtctcactgcacaatacccagagttgaatgctctgcaggaagagctgaaaccctacggtctcgtcgttctgggcttcccttgcaatcagtttggcaaacaggaaccaggagataataaagagattctaccaggcctcaaatacgtgcgcccaggcggtggctttgtcccatcgtttcaactgttcgaaaaaggagatgtaaacggtgagaaagaacaaaaagtgttcagttttctgaagcattcatgcccacacccctctgaaattttaggtaccttcaagtcgatctcttgggacccagtgaaggtacacgatatccgatggaacttcgagaagttccttgtcgggcctgatggtatccccgtgatgcgatggagccatagagctaccgtgagttcagtgaaaaccgacatcctggcctatcttaagcaattcaagaccaaatag

SEQ ID NO: 10104 - DNA, 447 bp, Artificial Sequence
  Description of Artificial Sequence: Synthetic coding sequence
atgcagaccttccccgtggccggcgccctggaccccgccatcctggacaccagctctccacaagcactgtacacagttctgctgatcgtgttagtgatgatgtcacttgtcttcggaaaatttgtacccgttaactgggagccaccacagcccctccctttccccaagtacctccgatgctaccggtgtctgctcgagaccaaagagcttggatgcctccttggctccgatatctgtttgacacccgcagggagcagttgtatcactttacacaagaagaactccagtggaagcgatgtcatggtgagtgattgtaggtcaaaggagcagatgtcagattgtagcaacacacggacatcccccgtgtccggcttctggattttttcacagtattgttttttggacttctgcaatgatcctcagaatagaggcttgtataccccgtag

SEQ ID NO: 10105 - DNA, 1737 bp, Artificial Sequence
  Description of Artificial Sequence: Synthetic coding sequence
atgctgctgctgctgctgctggcccccctgttcctgcggccccccggcgcaggtggggcacagacaccaaacgcaacgtccgaagggtgccagatcattcaccccccctgggagggcgggatacgctaccgaggacttactagagaccaagtcaaagccattaactttttgccagtggactatgaaatcgaatatgtttgcaggggagagcgggaggtcgtggggcctaaggtgaggaaatgcttggccaacggaagttggactgatatggacactcccagcaggtgcgtgcgaatctgttctaagagttatctgaccttggaaaacgggaaggtgttcctgaccggaggagatttgcccgctcttgatggagctagagtggactttaggtgtgaccccgatttccacttagtcggctcttctagatccatttgcagtcagggccagtggagtacacctaagccacactgtcaggtaaatcggactccccattctgagcggagagccgtctacataggcgctttgttccctatgtcaggaggatggcctggcggccaagcttgtcagccagctgtcgagatggctctggaggatgtgaactctcgccgagatattctgcctgattacgagcttaagcttatccaccacgattccaagtgtgaccccggccaggccacaaagtacctctacgaactcctgtataatgaccccatcaaaattatcctgatgcccggatgctcaagcgtatctactctcgtcgctgaggcagctcggatgtggaaccttatcgttctgagctatggttcctcatctcccgccctgagcaatagacaacggttcccgaccttctttaggacccatccttccgccacccttcacaatcctacccgggtcaagctgttcgagaagtggggatggaaaaaaatcgcgactattcagcaaaccactgaagtctttacttctaccctggatgacttagaggagcgcgtgaaagaggcaggaatcgaaataacgttcagacagagcttcttcagtgaccccgccgttcctgtgaaaaaccttaagcggcaggatgctaggataatcgtggggctcttttacgagacagaagctcgaaaggtgttctgcgaggtgtataaggagagactcttcggcaagaaatatgtgtggtttctaataggctggtacgcagacaactggttcaagatatacgacccttccataaactgcacagttgatgaaatgacagaagctgtggaggggcacattactactgaaattgtgatgctgaaccctgccaatactcgctccatctccaacatgacatctcaggaatttgttgagaagttaacaaagcgccttaagcgccatccagaggagacgggtggttttcaggaggccccgctagcctacgatgctatctgggccctggctttggctcttaataagacaagtgggggcggcgggcgctccggcgtgcgcttagaggattttaactacaataaccagaccattacagatcagatctacagagccatgaactctagctctttcgagggggtttctggccacgttgttttcgacgcctcaggttccagaatggcctggaccttgatagagcagctgcagggtggatcgtacaagaagatcggctactatgacagcacgaaagatgacctctcctggtcaaaaaccgacaaatggattgtaatttctagaacacactctccgacttag

SEQ ID NO: 10106 - DNA, 1737 bp, Artificial Sequence
  Description of Artificial Sequence: Synthetic coding sequence
atgctgctgctgctgctgctggcccccctgttcctgcggccccccggcgccgggggggctcaaaccccaaatgccacatcagagggctgccagataattcaccccccatgggaagggggcatacgatacagaggtctgactcgggatcaggttaaggcaataaattttctgccagtcgattacgaaatcgaatatgtttgtcgaggcgagcgagaagtggtgggacccaaggtgcggaaatgcctcgcaaatgggtcttggactgacatggatacacctagtagatgcgtacgcatctgctcaaagtcctatttaacccttgagaatggcaaggtttttttaactggtggggatctcccagccctcgacggcgcccgcgtcgattttagatgtgatcccgattttcatctggtcggcagctcgaggtccatctgttctcaaggtcagtggtctacccccaagcctcattgtcaggttaatagaaccccacactccgaacgtagagctgtttatataggggcccttttcccaatgagcggagggtggccgggggggcaggcttgtcagccagccgtggagatggccttagaagacgttaactcaagacgcgacattctgcccgattatgagcttaaactgatccatcatgacagcaaatgtgaccccggacaggcaactaagtatctctacgagctcctctataacgaccccattaaaatcatcctcatgccaggatgctcctccgtgagcacgttggtagccgaggccgccaggatgtggaatctaatcgtgctgtcatacggaagtagctccccagcactgagcaacaggcaaaggtttcctacattctttaggacccatccttccgctaccctgcacaatcctaccagagtgaagctcttcgaaaagtggggctggaagaagattgcaaccatccaacagacgaccgaggtgtttacatctaccctggatgacttagaagagagagtgaaagaggccggcattgagattaccttcagacagtctttctttagtgacccggcagttccagttaagaacctgaaaaggcaagatgccagaatcatcgtgggactattctatgagacagaggccagaaaagttttctgtgaagtctataaagaaagactgttcgggaagaagtatgtatggtttttgattggctggtacgctgacaactggttcaaaatttacgacccgtctattaactgcaccgtggatgagatgactgaagccgtggaggggcacattaccaccgagattgttatgttaaatcccgcaaatacaaggtccatctcaaacatgacgagccaggagtttgtcgagaaactgacaaagagactcaaacgtcaccccgaggagaccggcggatttcaggaggcccccttagcctatgacgccatctgggccctggccttggctctgaacaaaacgtccggagggggtggacgctctggcgtccgattagaagatttcaattataataatcaaactattacagaccaaatttatcgagcaatgaactcgagttcttttgagggagtaagcggccacgtggtgttcgatgcatcagggagccggatggcctggactttaatcgaacagctgcaaggtggcagctataaaaagatcggctattatgacagcacaaaggatgatctgtcgtggtccaaaactgacaagtggatagtgatttcgcgaacacacagtccaacatag

SEQ ID NO: 10107 - DNA, 756 bp, Artificial Sequence
  Description of Artificial Sequence: Synthetic coding sequence
atgccccacctggccagcctgttcaccgccagcagccggtgctgcccgcatccgttgcgacctgaaggatccggcgcaatgggccccgaggccctgtcctcactgctgcttctgttacttgtggcttcaggagacgctgacatgaaagggcactttgatccagccaagtgcaggtacgcactgggaatgcaagatcggaccattcccgactcagacatctctgcttcgtccagctggtccgacagcacagccgcccgacactctaggctggagtcctccgatggcgatggcgcctggtgccctgctgggtcagttttcccaaaagaggaagagtatctccaggttgatctgcaaaggctgcatctggtggccctcgtaggcactcagggtcgacacgcggggggcctcggcaaagagtttagtcgatcctatcggctccgttacagccgcgacggccgtcggtggatgggctggaaggacaggtgggggcaggaagttatttctggcaacgaggatccagagggtgttgtattgaaggatctcggaccccctatggtggctcggctggttagattctacccgagggctgaccgggtcatgtcggtctgcctgcgtgtcgaactgtatggttgcttgtggcgtggggaatggctgagctttctcggcatctgttttctgtcaagaggtctggaaggaggtgagtgcggcgaatgggcttcgcgcatccccagtcccgccggcaaattaagcttatag

SEQ ID NO: 10108 - DNA, 1764 bp, Artificial Sequence
  Description of Artificial Sequence: Synthetic coding sequence
atgcggccccggggcctgccccccctgctggtggtgctgctgggctgttgggcatcggtgagtgcacagactgatgccactcccgcagtcactactgagggattaaatagtaccgaggcagctctcgctaccttcgggaccttccctagtacccgtcctccagggacaccacgggcgcctggcccttccagtggaccccgcccaacgccagtaacagatgtggccgtgttgtgcgtgtgtgacctgtccccggcccagtgcgatataaattgctgttgtgaccccgattgtagtagtgtggactttagtgtgttcagcgcatgcagcgttccggtcgtgacaggcgatagtcaattttgttctcagaaagccgtaatctattctctgaacttcaccgctaacccccctcaaagagtattcgagctcgtagaccaaatcaaccccagtattttttgtatccatatcaccaactacaaacccgccctgtcttttatcaatccggaggtccccgatgagaataacttcgatacactcatgaaaacctctgacgggtttacccttaatgccgaaagctatgtgtcgttcacaacaaagctggacattccaaccgctgctaagtatgaatatggcgtccctctgcaaactagcgatagcttcctgagattccctagttcccttacatcatctttatgcacggataacaatccagccgcttttctcgtgaatcaggccgtcaaatgtacaagaaaaatcaatctggagcaatgcgaagaaattgaagctttgtcgatggctttctatagcagtcccgaaatcctgcgcgttccagacagtcggaagaaagtcccgattactgttcagagtatcgtgatacagtccctgaacaaaaccttaacacggcgagaggacaccgatgtgttgcagcccacactggtcaacgccggccacttctcactgtgcgtcaacgttgtactggaggttaagtacagtctgacatacaccgacgctggcgaagttaccaaagccgatttatcttttgttctggggactgtgtcttcagtggtggttccgcttcaacaaaaattcgaaatccactttcttcaggaaaatacccaacccgtgcctttgtccggtaatcccggctatgtggttgggctccctttggctgctggattccagccacacaaaggcagtggaatcatccaaactacgaatcgctatggccagctgacaattctgcactctactacagaacaggattgtctggcgctggagggggtgcgcactcccgtgctcttcggctataccatgcagtctggatgtaagttgcggttgacgggagcgctcccatgtcaactggttgcccagaaggtgaagagtttgttgtgggggcaggggtttccagattacgtagccccctttggaaattctcaggcccaggacatgctggactgggtgcctattcactttatcacccaaagcttcaaccgaaaggatagctgccagctgcccggcgctttggttattgaagttaaatggacaaagtatggatccctgctcaatccgcaggcaaaaatcgtcaatgtgactgctaatctgatcagcagcagtttcccggaagccaattcaggtaatgaacgcacaatcctgatcagcaccgcagtgacctttgtcgacgtctctgccccagccgaagccggatttagagccccccccgccattaatgccagactccctttcaacttcttctttcccttcgtgtag

SEQ ID NO: 10109 - DNA, 2067 bp, Artificial Sequence
  Description of Artificial Sequence: Synthetic coding sequence
atgctgcccaccgaggtgccccagagccaccccggccccagcgccctgctcctgctgcagctgctgttgccacccacctccgctttcttccccaacatttggtcattactcgcagctccgggttcaatcacgcatcaggatctgacggaagaagcagctttaaacgtgacactacagctgtttctcgagcagcctccccccggacgcccaccactgcgcctggaagatttcctgggacggactctgctcgctgacgatcttttcgctgcatacttcggcccagggtcaagccgtagatttagggcagctctgggggaggtctcccgggcaaatgcagcacaggatttcctccccacaagtcgaaacgaccctgacctacattttgatgccgaacgcctgggccaaggcagagcccgtctggtgggagctctgcgagaaacagtagttgccgccagggcactcgaccatacactcgcacgccagcgattaggggcggctctgcacgcgctgcaagatttctacagccatagcaactgggtcgaactgggcgaacagcagccacatccccacttactttggccaaggcaggagcttcagaacctggcgcaggtggctgacccaacgtgctccgactgcgaggaactctcttgccctcggaattggctgggattcactctgctgactagtggatattttggcacgcacccgcctaaacctcctggtaagtgttcacacggcggccacttcgaccgatcatcaagccagccgcccagaggaggtattaataaggatagtacctctcctggcttctcccctcatcacatgttgcacctccaggccgcaaaacttgcgctgctggcttccatacaagccttcagtctgctgagatcaaggttaggcgatagggacttttcccggctgctggatatcactccagcttcatccctgagtttcgttctggacacaacaggcagtatgggcgaggaaatcaacgctgccaagatacaggctcggcacctcgttgagcagagacgaggatcgcccatggaacccgtgcactatgtccttgtgcctttccacgaccccggcttcgggccagtttttacgacgtctgatcctgacagtttctggcagcagcttaatgaaatccatgcactcggcggtggcgacgagcctgagatgtgcctttcagccctgcagctggccctgctgcatactccgcctctcagcgacatattcgtctttaccgacgcttctccgaaagacgcctttttgaccaatcaggttgagtcactgacccaggaaagacggtgtcgggtcacatttctggttactgaagataccagtcgagtgcaggggagggcccgccgcgaaatccttagtccactgagattcgaaccttataaggctgtggctttagcgtcaggaggagaagtgatcttcaccaaagaccagcatattcgcgatgtcgcggctattgttggcgagtcaatggcggccttagtgaccctgccgttagatccccccgtagtggtgccaggccagccgctcgtgttctcggtggatggcctactgcagaaaatcacagtaaggatccatggagatatctcctctttttggatcaagaaccctgcaggagttagccaagggcaagaggaggggggtggcccactgggacatacacggcgattcggacagttctggatggtgacaatggatgatcccccgcagacagggacctgggaaatccaggtgacagctgaagacacccctggggtgcgtgttcaggctcagacctccttggactttttgttccacttcgggatcccaatggaggacggaccccacccaggactgtatcccctcactcagcccgttgccgggttgcagacccagctgcttgtggagagtcagagttggggatcttccgcagccttcctcccccgacacccgtctcggggccctagagggtgtaggacgcgccctggtgcccttggagccaggggaacttccggggctaggtcacctaggtctctagctgttgcacacgccgcagtgcacccctag

SEQ ID NO: 10110 - DNA, 303 bp, Artificial Sequence
  Description of Artificial Sequence: Synthetic coding sequence
atgaccacccagctgcgggtggtgcacctgctgcccctgctgctggcgtgcttcgtgcagacctcacccaaacaggaaaagatgaaaatggattgccataaggatgaaaagggaacaatttatgattatgaggcaattgccctcaataaaaacgagtatgtgtccttcaaacagtatgtgggtaaacacatcctgtttgtgaacgtggctacttattgcggactgacagcacagtatcccggaatgagtgtgcagggggaggatctgtaccttgtaagttccttcttaagaaaaggaatgtag

SEQ ID NO: 10111 - DNA, 705 bp, Artificial Sequence
  Description of Artificial Sequence: Synthetic coding sequence
atgaagaccctggccggcctggtgctgggcctggtgatcttcgacgccgccgtcaccgctccgaccctggaatcaattaactacgatagcgagacctacgacgcgactctggaggacctggataatctgtataattacgaaaacatccccgtcgataaggtcgagattgagatcgcaactgttatgccatctgggaatcgcgagctcttgacccctccgccccagcccgaaaaagctcaggaggaggaggaggaggaagaaagcactccccgactcatcgatggcagtagcccgcaggaaccagaatttaccggtgtgttgggcccccacaccaacgaggattttcctacctgcttgctgtgtacatgcatttccaccacagtctactgtgatgaccatgaactagacgcaatccccccactgccgaagaatacagcctacttctactcacggttcaatcgaataaagaagattaacaaaaacgattttgccagcttgtctgacctgaaacggatcgacttgaccagcaacctgatcagcgagatcgacgaggacgctttccgtaaactgccacagctgcgggaattggttttaagagataataaaattcgccagctacctgagctgcccaccaccttaactttcattgacatttccaacaatcgcctgggccgcaagggtatcaaacaggaggccttcaagtag

SEQ ID NO: 10112 - DNA, 2559 bp, Artificial Sequence
  Description of Artificial Sequence: Synthetic coding sequence
atgctgcccaccgaggtgccccagagccaccccggccccagcgccctcttattgctgcagctccttctcccacccacaagcgccttctttcctaatatctggagcctcctggccgccccaggcagcattactcaccaggacttgacagaggaggccgctcttaacgttactctccagttgttcctggaacagcccccccctggccgcccgccattaaggctagaagattttctcggtcgcaccctcctggcagatgacctctttgctgcctactttggccccggatcgtcacgccgtttccgtgcggcactgggcgaagtaagcagagcaaatgcagcacaagattttttacccactagtaggaacgacccggatctgcacttcgatgccgaaagattaggacaaggacgggcaagactagtgggggcattacgggagactgtcgtggccgcccgtgctctggaccacaccctggcccgacagcgactgggcgccgccctgcacgcgttacaggatttctattcccatagcaattgggtggagttaggagaacagcagccccacccgcatctgctgtggccaagacaggagctccaaaatctggctcaagtggccgaccccacttgttctgactgtgaagaactttcttgcccaaggaactggttaggcttcacactcctgacttccgggtattttggcactcatcctccgaagccgccaggcaaatgcagccacggcgggcactttgacaggagctctagtcaaccccctagagggggaattaacaaagacagcacaagccctgggttctcccctcaccacatgctgcatctccaggctgctaagctcgctttgctggccagcatccaggccttcagcctgctgagatctcgcctgggagacagagatttctctagactcctcgatataacacccgcgagttccctgtctttcgtattggacaccacaggttctatgggggaagagatcaacgccgcaaagatccaagcaagacatctcgtggagcagcgacgagggtcacccatggaacccgtgcattatgtgctggtaccgttccatgaccctggttttgggcccgtgtttaccactagtgatccggactccttttggcagcagttgaacgaaattcacgctttgggggggggggacgagccggagatgtgtctcagcgctctccagctggcactgttacacacacctcctctctccgacatcttcgtgttcacagacgcctcccctaaggatgccttcctgaccaatcaggttgaatcgctgacccaagagagaagatgtcgcgtgaccttcctggtcaccgaggatacctccagggtccagggtagagcccgtcgcgagatcctttcacctctccgctttgagccttataaggcagttgctcttgcaagcggtggcgaggtgatctttactaaagatcagcatatccgggatgtggctgcgatcgtcggcgagtctatggccgcgttagtcaccctaccactcgatccgcccgtcgtggtccctggtcagccccttgtgtttagtgtggatggattattacaaaagatcacagtgcggatacacggtgacatctcaagcttttggatcaagaacccagctggtgtctcacagggccaggaagaaggcgggggtccattagggcatactcgacgttttgggcagttctggatggtcactatggacgatcctccccagactggcacatgggagattcaggtgacagcagaggatacacctggggtgagagtccaggctcagacatcactcgatttcttatttcattttgggatccccatggaggacgggccacacccaggcctatatcccttgacccaaccagtcgctggactgcagacccagttactcgtcgaggttactgggctcggcagcagggctaatccaggcgatcctcagccacacttttcacacgtcatactgagaggagtgccagagggcgcagaattaggacaagtacccttggagccagtgggacctccagagcgcgggctgttagcggccagtttaagtcctacactgctctcaactccccgccccttctctttggagctaatcggacaggatgccgctggtaggcggctccatcgtgctgctcctcagccatctaccgtcgtccccgtcctccttgagttgtctgggcccagcggttttctggcaccaggctcaaaagtgccactcagtctgcggatcgcaagcttttccggaccccaggatcttgacctgcgcacctttgttaatcccagcttcagtctaacgagtaacttatcccgtgcccatctggagctgaatgagagcgcttggggaaggctgtggctcgaagtcccagatagcgccgcgccagattctgttgtcatggtaactgtgaccgccggcggcagagaagccaatcctgtgccacctacacatgcattcctgcgtttgctggtgtcagccccggctccacaggtgcgcaatcactatttccccagtcaaggacccgctcaccacccgtaccggctgatttag

SEQ ID NO: 10113 - DNA, 2760 bp, Artificial Sequence
  Description of Artificial Sequence: Synthetic coding sequence
atgggccccgaggccctgagcagcctgctgctgctgctgctggtggctagcggtgatgccgacatgaagggccatttcgacccagccaaatgtagatatgcacttggaatgcaggaccgcaccatccctgatagcgatatctccgcgagctcctcttggagtgactcaacagccgcacgccacagtcgcctggagtcgagcgatggcgacggtgcatggtgtccagcgggctcagtgttccccaaagaggaggaatacttgcaggtggatctccagagactacatttggtggcccttgtgggtactcaggggcgtcacgcaggaggcctcggtaaggagttcagtcggagctataggctgagatacagtagggatgggcggagatggatggggtggaaagatagatggggacaggaggtgatcagtgggaatgaagacccagagggggtggtccttaaagacctgggcccaccgatggtggcccgtctagttcgcttttatccaagggctgacagagtcatgagtgtgtgcctgcgagttgagttatacggatgtctctggcgggacgggctgctcagctataccgccccagtgggacaaaccatgtacctctccgaagcagtgtatttgaacgattctacgtacgatggacacactgtggggggccttcagtacggcggcctgggccaattagccgatggggtcgtaggcctggatgatttcaggaaatcccaggaattgagagtctggcctggatacgattatgtgggatggtctaaccatagcttctcatctggatacgtcgaaatggagtttgagtttgaccggcttcgggcattccaggccatgcaagtgcactgtaacaatatgcacaccttaggcgccagactgccaggtggagtggaatgtcggttcaggagagggcctgccatggcatgggagggtgaacctatgcggcacaatctgggtggtaacctgggagatcctcgcgcaagagctgtatccgtgccactaggtggtagggtggccaggttcctgcagtgtcggttcttgttcgcaggcccgtggctgctgttttctgagattagttttatctctgacgtggtgaacaatagtagcccagccctcggcggtacctttccccctgctccctggtggcctcccgggccccctcctacaaatttttcttccttagagttggagcctaggggccagcagcccgtggccaaagccgaggggagtcccacagcaatcctcatcgggtgtctggtggccataattctcctgctgctgcttatcattgcacttatgctgtggcgcctgcattggcggaggctgctgagcaaggctgaacgacgtgtgcttgaggaagaactgacagtacatctgagcgtacccggggacacaattttgattaacaatcgccctggtccccgggagccgcccccataccaggaaccccggccgagaggaaatcctccccactcggctccctgtgtgccgaatggtagcgcgctgctgctctcaaaccccgcctatagactgttgctggctacttacgctagaccccctcggggaccaggccctccgactcccgcctgggccaaaccaaccaatactcaggcctacagtggcgattatatggagccggaaaagcctggtgctcccctactgccccccccacctcaaaatagtgttccccattacgccgaggctgacattgtaacgctacagggggtgactggaggcaacacgtacgccgttcctgctttgcctcctggcgcagtgggcgacggcccaccccgcgtcgatttcccacgttcacggctccgcttcaaggagaagcttggagagggtcagtttggcgaagttcacctttgcgaagtggactctcctcaggatctagtctcgttggatttccctctgaatgtaaggaaggggcaccccctcctcgtcgccgtgaaaattctgagacccgacgcgacgaagaatgcgtccttcagtctattcagtcgaaacgatttcctgaaggaagtgaaaattatgtcaaggttaaaggatccaaacatcatccggctgctgggagtgtgcgtccaggatgacccattgtgtatgatcacagactacatggaaaatggggatctaaatcagtttttaagtgctcaccagttagaggataaggccgcagaaggtgcccccggtgatggccaggcagcccaaggaccgacaatcagctacccgatgctcttgcatgtcgccgcccaaatcgcaagtgggatgcgttatctagctacactgaacttcgtgcaccgtgatttggccaccagaaactgccttgtcggagagaatttcaccattaagattgccgatttcggaatgtcgcgaaatctctacgcaggcgactactaccgcgtacaggggagggcggtgctccccattcgttggatggcatgggagtgcattttgatgggaaaatttaccacagcttctgatgtgtgggcattcggagtaactctgtgggaagtcttaatgctctgtcgtgctcagcccttcgggcagttgactgacgaacaagtaatagaaaacgccggtgaatttttccgcgatcagggccggcaagtttacctgtcacggcctcctgcgtgcccccaggggctgtatgagctaatgcttcgttgctggtctcgggaatcggaacagagacctcccttttcgcaattgcatagattcttagccgaagatgcgctaaatactgtgtag

SEQ ID NO: 10114 - DNA, 1737 bp, Artificial Sequence
  Description of Artificial Sequence: Synthetic coding sequence
atgctgctgctgctgctgctggcccccctgttcctgcggccccccggagctggtggggctcagactcctaacgccactagtgaaggctgccaaatcatacatcctccttgggagggtggaatcaggtatagaggcttgacacgtgatcaggtgaaggctatcaactttctgcccgtggactacgagatcgagtacgtgtgccgcggcgaacgggaagtcgttggccccaaggttaggaaatgtctcgccaacgggagctggacggacatggatacgccatcccgctgcgttcggatctgttctaagtcctacctgactttggagaacggcaaggttttcctcacaggcggcgacctgcccgccctggacggagcacgcgtggatttccgttgcgaccctgattttcaccttgtggggtcttccaggtccatttgttcacagggccagtggagtaccccaaaacctcactgtcaggtgaaccgcacccctcactctgaaaggcgcgccgtgtatattggcgctttatttccaatgagcggagggtggcctggaggacaggcatgtcaacctgcagtcgaaatggcactggaagatgtgaacagcaggagggatatcttaccagactatgaactgaagctgatccatcacgactctaagtgcgacccgggccaggccactaagtatctgtacgaactcctgtacaacgatccaatcaagattattcttatgccagggtgctcctcagtcagtacattggtggcggaagcagccagaatgtggaacctgatagttctttcctacggcagttcctctcctgcattatccaaccgccagaggttccccactttctttcgcactcatcccagtgctacacttcacaaccctactagagtaaaactgttcgagaagtgggggtggaaaaagatcgcaacaatccagcagacaactgaagttttcacgtctactttggatgacttggaggagcgcgtaaaggaggccggcatcgagatcaccttccgacaatccttcttttcagaccccgcagtgcccgtcaaaaatctgaagcggcaggacgccagaatcatcgttggactgttctatgagaccgaggctaggaaggtgttctgcgaggtttacaaggaacgcctctttggtaagaaatacgtgtggtttctgatcggctggtacgctgacaattggttcaagatttacgacccttccatcaactgtactgtcgatgagatgaccgaggccgtggaggggcatatcactacagagatcgtgatgctaaaccccgccaatacgaggtcaattagcaacatgacttcccaggagttcgttgagaagctgacaaaaaggctcaagcgccacccggaggagaccggcggcttccaggaggctcccttagcatacgacgcaatatgggctctcgccctggcactgaataagacttcagggggaggcgggagaagcggcgttagactggaagatttcaattataacaaccaaacaatcactgaccagatttatagagcgatgaattcatccagtttcgagggcgtttctggacacgtcgtgttcgacgcttctggttcacgaatggcatggaccctgatcgagcaactgcaggggggtagttacaaaaagatcggctactatgacagtacaaaggatgacctctcttggagcaagacagacaagtggatcgtgatttccagaacccacagcccgacgtag

SEQ ID NO: 10115 - DNA, 516 bp, Artificial Sequence
  Description of Artificial Sequence: Synthetic coding sequence
atgcggcacaacctgggcggcaacctgggcgacccccgggcccgggctgtcagtgtgcccctgggtggtagagttgccagattcctgcaatgtaggttcctcttcgctggtccttggttactgttctcagaaatttcattcattagtgatgttgtgaacaatagttctcccgcgttaggcgggacctttccacccgctccgtggtggcctcctggcccacctccaactaattttagcagcctggaactggagcctcgtggccagcaaccagtagccaaagccgaaggttcacctactgccattctgatcggctgtctagtcgctattatcctgcttttattgctgataatcgctctgatgctgtggagactccactggagaaggcttctctctaaggttcttgagtctcatccccgaactcggtcccctggcctcgttgggatccgacccacacctctgcccgtttctcctatggcacttgtgcacctgtgtgaggtggattcaccccaggattag

SEQ ID NO: 10116 - DNA, 2067 bp, Artificial Sequence
  Description of Artificial Sequence: Synthetic coding sequence
atgctgcccaccgaggtgccccagagccaccccggccccagcgccttgctgctccttcagctgctgctcccgcctacatcagcatttttccctaatatttggtctctactcgcagctcccgggtctatcacccaccaggatctgacggaagaggccgctctaaacgttactttacagctgttcctggaacaaccacctcctggaagaccacctctgagactagaggatttccttgggcggactttactagcagatgacctcttcgccgcatacttcggaccagggtccagccgcagattcagagcggctctgggtgaagtgtctagagcgaatgccgcgcaggactttttgcctacctcaaggaacgatcccgacctgcatttcgacgctgagaggctgggccagggccgggcacgtcttgtcggggctttgcgcgaaaccgtggtggctgcaagggcgttagaccacaccttggcccgccagcggctcggcgcagctttgcatgccttacaagacttctacagccactctaactgggtggagttgggtgagcaacaacctcacccacacctcctgtggcctcgccaggagcttcagaacctggcccaggtggccgaccctacctgcagtgactgtgaagagctctcttgtccaagaaactggttgggattcacactgttgacctccggatacttcggaacccaccctccaaagcctcccggaaaatgctctcacgggggccacttcgataggtcatccagccagccaccccgtggtgggataaacaaggatagcacatctcctggattcagtccccatcacatgttgcacctccaggcggccaagctggccttgcttgcttcaattcaggctttttctctcctcaggtcgcgactcggtgacagagacttttctcggctgctggatatcactcccgcaagttctctttccttcgttttggacactacaggttccatgggcgaggagatcaacgcagccaaaattcaggctcggcacctcgtcgagcagaggcgaggctcgcccatggagcccgtgcactatgtgcttgtaccttttcatgatcccgggttcggcccggtcttcaccacctctgatcctgattccttctggcaacagttgaacgaaatccacgccctggggggcggagatgaacccgagatgtgtctcagtgcactccagttggctctccttcacacccctccgctgagtgatatatttgtgtttacggatgcaagtccgaaagacgcattccttactaatcaggtcgaaagcctgacccaggaacggcggtgcagagtgaccttcttagtgactgaggacaccagtagagtgcagggacgggccagacgggagatcctgagcccactccggtttgagccatacaaagccgtagctctggcaagcggcggcgaagttatttttactaaggaccaacacatccgggacgtggccgcgattgtgggcgagtccatggccgctctcgtaactcttccactagatccccctgtggtggtgcctggacagcctcttgtgttcagtgtagacggactcttacagaagatcacagtgcgtattcacggtgacatttccagcttttggattaaaaacccagctggcgtctcccagggccaggaggagggcgggggaccgctgggccacacccgacggttcggccagttctggatggtcaccatggacgacccacctcagactggaacctgggagatccaagtcacagccgaggacaccccaggcgttcgcgttcaggcccagacaagcctggacttcttattccacttcgggattcccatggaggacggcccacatcccggcttgtacccactgacccagcccgtggctggattacagacacaactcttagtagagtcccagagctgggggtcgagcgccgcttttctgcctcggcatccctctagaggacctcgtggatgtcggacaagacctggagccttaggtgctcgcggcacatcaggcgcacgtagccctaggagtttggcagttgctcatgccgcagtacatccgtag

SEQ ID NO: 10117 - DNA, 5097 bp, Artificial Sequence
  Description of Artificial Sequence: Synthetic coding sequence
atgcggctgctgtggggcctgatctgggccagcagcttcttcaccctttctctgcagaaaccaaggctgctcctgttctcaccctctgtagtgcatctaggcgtgccgctgagtgttggtgtccagctgcaagacgtgccaagaggacaggtcgtaaaaggaagtgttttcctgaggaatccaagccggaataacgttccctgcagcccaaaagtagactttacactgagctctgagcgggactttgcgctgttgtctctgcaggttcccctgaaggatgccaagtcttgtggtctgcatcagctcctgcgcgggcctgaggttcagctggttgcccactcaccctggctcaaagacagcttaagcagaactaccaacatccaaggtattaatctgctgttctccagccgaagggggcatctgttcttacagactgaccagcctatctacaacccaggtcagagagttaggtatagagtcttcgcactggaccagaagatgcgtcctagcaccgatactatcactgtcatggtcgaaaattctcacggactccgcgtgcgaaaaaaggaagtttatatgcctagttcgatttttcaggacgacttcgtcattccagacatcagcgagcccggtacctggaagatctcagcgagattctccgatgggctggagtctaacagctccacgcagtttgaggttaaaaaatatgttctacccaacttcgaggtgaagataaccccagggaagccctacattctgacagtccctgggcatttagacgaaatgcagctggatatccaggctaggtatatttacggaaagccagtacagggggtggcctacgtcaggttcggactgctggacgaggacgggaaaaaaactttcttccggggtctggagtcccaaaccaagctggtcaacggccaatctcacatatctctgagcaaggctgaattccaggacgcactggaaaagcttaatatgggaatcactgatctgcaaggtctgaggctatatgtggccgcagccatcattgaatatcccgggggcgagatggaggaggccgagttaacttcctggtacttcgtctcctctcctttctccttggacctgagcaagacaaaacggcatctagtgcctggagccccattcctgttacaggccctggtgagggagatgtccggatctcccgccagcggaatacccgtgaaggtcagcgctactgtgagctcgcccggcagcgtgccggaggtgcaggacattcagcagaacaccgacggctccgggcaggtgtcaatccccattataatcccacagactatatctgagctgcagctgtccgtgtctgccggatcccctcaccctgccattgctagactgaccgtagccgcacctccctccgggggccccggatttttgtcgatcgaacgcccggacagcagaccacctcgcgttggcgataccctgaatttgaacctacgcgcggtaggcagcggagctaccttctcacactactactacatgattctgagtagaggccagatcgtcttcatgaatagagagccaaaacggacactgacttccgttagcgttttcgtggaccatcatctcgcccctagcttttacttcgtggcattctactaccacggtgaccacccagtggccaattcattaagggttgacgtgcaagccggcgcatgtgagggcaagttggaactctccgttgacggagccaagcaatatagaaacggcgagtcagtgaagctgcacctagagactgattcattagctttagtggctctgggagcactggacactgctctctacgctgccggttccaaaagtcacaagcctctcaatatgggaaaggtgtttgaagccatgaactcctacgatctcggatgtggacctgggggaggagacagtgccctgcaggtgttccaggccgctggtctcgctttttccgatggggatcagtggactctgtccaggaaaagattatcatgtccgaaggagaagacaacaagaaaaaagcgcaatgtcaattttcagaaggcaataaatgagaaattgggtcagtacgcttccccaacagccaagcgctgctgccaggatggagtaacacggctgccaatgatgcgctcttgcgagcagagggctgcccgggtgcagcagcctgattgccgtgaaccatttttgtcatgctgccagttcgccgagtcactgagaaagaaaagccgcgacaagggccaggccggcctgcagagggcgctggagatccttcaagaggaggatctgatcgatgaggatgacatcccagttcgctcgttttttccggaaaactggttgtggcgtgtagagacggttgatagattccagattctcacactgtggttaccagactccctaaccacttgggagatacacggcctgtccttgagcaagacaaaaggtctctgcgtggccacccccgtgcagctcagagtattccgggaattccacctgcatctgcgtctgcctatgtccgtgcgccggtttgaacagctggaacttagacctgtcctctataactacttagataagaatctcacggtctccgtgcacgtctctcccgtggagggcttgtgtttggccggcggaggcgggctagcccaacaggttcttgtgcctgccggaagcgcccgacccgtcgcattctccgtggtgccaacagccgctgccgccgtgtccctgaaggtcgtggcacggggctcgtttgaattccctgtaggagacgctgttagcaaggtgctgcagatagaaaaggaaggggctatccacagggaggagctggtgtatgaactcaacccactggaccataggggtcgaacattagaaatccctggaaattctgaccctaatatgatcccggacggtgatttcaattcctatgtacgcgtcacagcctctgaccctctggatacattgggcagtgaaggcgccctctccccaggtggagtggcctcacttctacgattgccccgcggctgtggtgaacaaaccatgatctacctggcacccactctcgccgccagccgatacctggacaaaactgagcagtggagcactcttccacccgaaaccaaagatcacgcggtcgacctgatccagaagggatacatgcggatccagcagttccgaaaagcggatggctcgtacgccgcctggctttctcggggatcaagcacctggctgacagcgtttgtcctaaaggttcttagcctagcgcaggaacaggtgggcggctctccagagaaactgcaagagacatctaactggctgctcagccagcagcaggcggatgggagtttccaagacctgtccccggtcatccacagatcaatgcaaggcggcctggtagggaatgacgaaacagtcgccctcaccgcctttgtcacaatcgctctccatcatggcctggccgtattccaggatgaaggggctgaacccctgaagcagagggtggaggcctcaatatcgaaagccagcagctttcttggagaaaaggcgagcgctggattattgggagcccacgcagccgctatcaccgcttacgcgttaaccttgacgaaagcacccgcagacctcaggggagttgcccataacaatctgatggccatggcacaagagactggagacaacctttactgggggtccgtcacaggatcccagtccaacgccgtgtcacctacgccggcccccaggaatccctctgatccgatgccacaggctcctgccctctggatcgagactacagcatacgctctcctgcacctgctgctgcatgaaggaaaggcagaaatggccgatcaagcggccgcctggttaacgcgacaaggctcgtttcagggagggtttcgttctactcaggataccgtgatcgctttagacgctctcagcgcctattggattgcctcccacacaacggaagagagaggtctgaatgtgacgctgagctcaactggtcgtaacggatttaaatcacatgcacttcaactcaacaatcggcagattcgcggcctcgaagaagagctgcagttctcgctcggctctaaaatcaatgtaaaggtcggcggcaacagcaaggggacactgaaagtgttacggacttacaatgtgcttgatatgaagaacaccacctgccaggatctccagatcgaagtgaccgtcaagggacacgtcgagtacaccatggaggccaacgaagactacgaagattacgaatacgatgaattaccagccaaagacgatccagacgcccccttacagcccgtcacccccttacagctttttgaagggcggcggaacagaaggcggcgtgaagctcctaaacttacatccttgtccgatagatatgtcagtcattttgagacagaaggacctcatgtgctactctacttcgacagtgtccctacctctagagagtgtgtgggctttgaggccgtgcaagaggtcccggtcggccttgtgcaacctgcgtcagccactctctacgactactacaatccggagagacgttgttctgtgttctatggggccccaagtaaatctagactcctggctacgttatgttctgccgaggtgtgccagtgtgcagaaggaaaatgcccccgtcagaggagggcgcttgaacgagggctgcaggacgaggacggttatcgaatgaagttcgcctgctactaccctagggtggaatacggattccaggtgaaagtgctgagggaggactcgcgcgccgcgttccgactgtttgaaacgaaaatcacacaggttctccactttactaaggacgtgaaggcggctgccaatcaaatgaggaacttcctcgtgagggctagttgccggctgcggctggaacctggcaaggagtacttaattatggggctagacggggcgacatatgacctagaggggcatccgcagtatttgcttgatagtaattcatggattgaagaaatgccaagcgagcgcctttgccggagtacccgccagcgcgcggcctgcgctcagctcaatgactttctacaagagtatgggacccagggctgccaggtgtag

SEQ ID NO: 10118 - DNA, 726 bp, Artificial Sequence
  Description of Artificial Sequence: Synthetic coding sequence
atgaagttcatcctgctgtgggccctgctgaacctgaccgtggccctcgcctttaatcctgattatacagtgtcctccacccccccgtacttggtgtacctcaaatccgactacctgccttgcgctggggtcttgatccatcccctgtgggttatcacggctgcccactgtaatctccctaaattgagagtgattttaggtgttactataccagctgacagcaacgagaagcacctccaagtgataggctatgagaagatgatacaccacccacacttctcagtgactagcattgaccacgatataatgctcattaagctcaaaactgaggccgagctaaatgattacgttaaacttgccaatctgccataccagactatttctgagaacactatgtgctccgtctcgacctggtcatataacgtctgcgatatctacaaagagccagactccctgcagacagtgaacatatctgttatttctaagcctcagtgtcgtgacgcctacaagacttataatattacagagaacatgctgtgcgtaggcatcgtgcccggtcgtaggcagccttgcaaggaggtctccgcggcaccagcaatttgtaatggaatgctgcaaggaattctgtcattcgctgacggctgtgtacttcgagctgacgtaggcatctacgccaagattttttactatatcccctggatagaaaacgttatccagaacaattag

SEQ ID NO: 10119 - DNA, 732 bp, Artificial Sequence
  Description of Artificial Sequence: Synthetic coding sequence
atgggccccgaggccctgagcagcctgctgctgctgctgctggtggcttctggtgatgcagatatgaaaggccatttcgaccccgccaaatgtagatatgccttgggaatgcaggacaggaccattcctgactcagatatctccgccagctcttcgtggagcgacagcactgctgcaagacattccaggctggaaagctctgatggagacggggcttggtgccccgctggctcagtgttcccaaaagaagaggagtatctgcaggtggatctgcagcgactccacctggtggctctagtggggactcaggggaggcacgccggcggactgggcaaagagttcagccggtcctaccgccttcggtactcacgagacggccgtagatggatgggatggaaagatcgatggggacaggaggtgatctcaggaaatgaggaccctgagggagttgtcttgaaagacctggggcctccaatggtagctcgcctggtgagattctatcctcgtgccgaccgcgtgatgtctgtgtgcctgcgggtggagttgtacggctgcctgtggcgggattgctcaatgggagtctgggcatcctggcagatggtatggtggggctggatgaccctcggaagagtgcgcagttgtggttcaggtcaggctatgactatgtgggatggagcgaccactgcgtcgcccgtggccatgtggaggtggagtctcagtttaacgggttag

SEQ ID NO: 10120 - DNA, 1986 bp, Artificial Sequence
  Description of Artificial Sequence: Synthetic coding sequence
atggacctggtgctgaagcggtgcctgctgcacctggccgtgatcggagcactccttgcagtgggcgccactaaggtgcccagaaaccaagattggctgggtgtaagcagacaactccgaactaaggcctggaaccgtcagctttatcccgaatggaccgaggctcaaaggttggattgctggcgaggcggacaggtcagtcttaaagtgagtaacgacggacccacattgattggagcgaacgcctccttcagtatcgcactaaatttcccaggctcccagaaggttctgccggacggtcaggtgatttgggtgaacaataccattatcaatgggagccaggtgtggggggggcagccggtgtatcctcaggaaaccgatgatgcgtgcatcttcccagacggcggtccgtgtccctccggctcatggtctcagaaacgatctttcgtgtatgtgtggaaaacatgggggcaatactggcaagttcttggcggtcctgtctctggactttccatcggtacaggcagggcaatgctgggcacacatacaatggaagtgaccgtatatcaccgacggggttcacgatcttatgtgcctctagcccactcctccagcgctttcaccatcaccgatcaggtccccttcagcgtttctgtgtcccaactgagggccctggacgggggtaataagcactttctgcgcaatcagccattgacattcgcgttgcagttgcatgatcctagcggttacctcgccgaagccgacttgtcctatacatgggacttcggcgactcgtcaggtactctcatctctcgggctctggtggtgactcatacatatcttgaacccggcccagtcacagcacaggtggtccttcaggcggccatcccgctcacgagctgtggaagcagccctgtcccaggtactacagacggacacaggcctacagctgaagccccaaacactacagccggccaggtcccaaccacagaggtggtcggtaccacacccgggcaggcccccacggccgaaccgtcaggtacgacatccgttcaggtgcccaccacagaggtgatctcgaccgcccctgtgcagatgccgacagccgagagcacagggatgactccagaaaaagtccctgtttcggaggtaatgggaactacattggccgaaatgagtacccccgaggctaccgggatgacacctgcggaggtatcgattgtggtgctttccggtactacagcagctcaggtcaccaccaccgagtgggttgagacaacagcgcgggaactgccaatccctgagccggaaggccctgatgcatcttccataatgtcgaccgaatcaattacagggagtttgggtccacttttagatggcaccgccactctccgcttagtcaagcggcaagttcccctcgattgcgtgctgtatcgctacggaagcttttctgtgacactcgatatagtgcagggaattgagagcgccgagatcctgcaggcagtgccatcaggagaaggtgatgctttcgagctgacagtttcatgccaaggcggccttcccaaggaagcatgtatggaaatttcttctccaggctgccaaccacctgctcagcgtctgtgccagcccgtgctcccaagcccagcgtgtcagctggtcctgcatcagatactgaaaggaggatctggcacatactgtctcaatgttagtctcgcagatacaaactccctcgccgtggttagcacccagttgatcatgcccggtcaagaggcaggcctagggcaggtcccactgatcgtcggcattttactggtgttaatggctgtggtccttgcctcgctgatttataggcggcgtcttatgaagcaggacttctccgtgccccagttgcctcacagctcttcccattggctcaggcttccaagaatattttgtagctgccccatcggcgagaattcgcctctcttgagcgggcagcaggtgtag

SEQ ID NO: 10121 - DNA, 2760 bp, Artificial Sequence
  Description of Artificial Sequence: Synthetic coding sequence
atgggccccgaggccctgagcagcctgctgctgctgctgctggtggcttctggagacgccgatatgaagggacatttcgacccggccaagtgtcggtacgcactcggaatgcaggacagaaccattcccgattccgatatctccgcctctagctcttggtccgactccacggccgcaagacatagcaggttggagagttcggatggcgacggagcgtggtgccccgcgggctcagtcttccccaaggaggaggagtatcttcaggtcgacttacaaagactacacttggtcgcactggtgggaacacaagggcgacacgccggcggcctgggtaaggaatttagcaggtcctaccgactgaggtattctagagacggccgcaggtggatgggatggaaagatagatggggacaggaagttatctctggtaacgaggatccagagggagtggtgctgaaggatttggggccgcctatggtagctcggctggtgcggttctacccgagagccgatcgtgtcatgtccgtttgtttgagagttgaattatatggatgcttgtggcgagacggcctacttagctacacagctccagtgggtcagaccatgtacttgtctgaggcagtttacctcaacgattcgacctatgacggccataccgttggggggctgcagtatggagggttaggtcagctggccgacggggtggtgggtctggacgacttccggaagtctcaggagctacgcgtgtggcccggctatgattacgtgggctggagcaatcattctttctcgtcgggctacgttgaaatggaatttgaattcgacagactcagggcatttcaggcgatgcaagttcattgtaacaacatgcatacactgggagctagattaccagggggtgtggagtgtcgctttcgccgcggaccggccatggcctgggagggcgagcccatgcggcacaacctgggaggtaacctgggggatccaagagcacgcgctgtctcagtccctttaggtgggagagtggcacggtttctccagtgtagattcctgtttgccgggccttggttgctgttctcagaaatatcattcatatctgatgtggtaaacaactcaagtcctgcactgggtggtacctttccccccgctccttggtggccacctggtccaccacccactaacttctcctctctagaactagagcctagaggacagcaacctgtagccaaagcagaggggtcccctacggcaatcctgattggctgcctggtcgccattatccttcttttactcttaatcattgccctgatgttgtggcggttgcactggaggcgtctgctgtcaaaagcagaaagacgggtgcttgaggaggagctgactgtacatctgtcggtgcccggagacaccatcctgatcaataatcgtcctggcccacgagagccacccccttatcaggaacctcggccgcgcgggaacccgccccatagcgctccgtgcgtgccaaacggctccgcgttgttgttgtccaatcctgcttacagacttcttctggcgacatatgcccggccccctagagggcccggtccaccgacacctgcctgggctaagccaacaaatacacaggcatattctggagactacatggaacctgagaagcccggggcgcctcttttaccccctcccccacaaaacagcgtaccccactacgctgaggctgacattgttacgctccagggggtcacagggggaaacacctacgcagtccctgctctgccccccggtgctgtgggcgacggacccccacgggtcgactttccaagatcccggctgagattcaaggaaaagcttggagagggtcagtttggcgaagtgcacctctgtgaggttgattctccacaagatcttgtttcccttgacttcccactgaatgtccgcaagggccaccccctgctggttgcggtgaaaattcttaggcctgacgccaccaaaaatgcttccttcagtttgttctcccgcaacgatttcctcaaagaggttaaaatcatgtccagacttaaggaccccaatataattcgcctgttgggggtctgcgtgcaggacgatccattatgtatgatcaccgattacatggagaatggggacctgaatcagttcttgagcgcacaccagctggaggataaagcagctgaaggcgcccccggcgacggacaggcagcgcaggggcccaccatttcttaccctatgctgctgcacgtggcggcacagatcgcatcggggatgaggtatttggccactctgaacttcgtccacagggatctcgccacgagaaattgcctagtgggtgagaacttcactatcaaaatcgccgattttggaatgagcagaaatttgtacgcaggagactactatagagtccaagggcgggccgtcctgcctattagatggatggcctgggagtgcatattaatgggaaaattcacaaccgctagcgacgtgtgggctttcggtgttacgctctgggaggttctgatgctgtgtcgagcgcagccctttgggcaattaaccgacgaacaagtcatagagaatgccggggaatttttccgggaccaggggcgtcaggtgtacctgtcaagacctcccgcatgtccacagggcttatatgaactgatgctaaggtgctggagcagggagagcgagcagcgtcctcctttttctcaattgcatcgatttcttgccgaggatgcgctgaataccgtctag

SEQ ID NO: 10122 - DNA, 216 bp, Artificial Sequence
  Description of Artificial Sequence: Synthetic coding sequence
atgcccgccggcgtgcccatgagcacctacctgaagatgttcgccgcttcattgctcgcgatgtgtgctggggccgaagtggttcataggtactatcggcccgatctaacaattcccgagattccccccaagcggggagagctcaaaaccgaactccttggactgaaagagcgcaaacataagcctcaggtgagccagcaggaagagctgaagtag

SEQ ID NO: 10123 - DNA, 2685 bp, Artificial Sequence
  Description of Artificial Sequence: Synthetic coding sequence
atgagcctgccccggtgctgcccccaccccctgcggcccgagggcagcggcgctatgggcccggaggctcttagcagcctgttactcctactgttggtggccagcggagatgcggatatgaaaggacatttcgatcccgccaagtgcagatatgctctgggaatgcaggacaggaccatccccgacagcgatatctccgctagcagttcctggtctgattccactgcagcccggcattcccgcttggagtcgagcgatggagacggagcatggtgtccagctggcagcgtctttccaaaggaagaggagtacttgcaggtagaccttcagagacttcatctggtcgccctggtcggcactcaaggaaggcacgccggcggcctcgggaaagaattttcgagatcatatcgactgcgctacagccgggacggtagacgctggatgggatggaaggatcgttggggccaggaggtcatctctggcaatgaagatccagaaggggtcgtactgaaggatctggggccgcctatggtggccagactggtgaggttctaccctagggctgaccgagtgatgagtgtctgtttaagagtggagctgtacgggtgtttatggcgagatggtctcctatcttacactgccccagtgggtcagacaatgtacctgagcgaggctgtatatctgaacgactccacatacgacggccatacagtggggggcttgcagtacgggggtctggggcagctggcagacggcgtagtggggctggacgactttcgtaagtcccaagagcttagagtgtggcccggttacgattacgtgggctggagcaatcacagctttagtagtggatatgtggagatggagttcgagttcgatcgcctcagagcattccaggctatgcaggtgcactgtaataacatgcacactctgggggcaaggctgcctggcggagtggagtgtcgattcagacgagggccagccatggcttgggaaggcgagcctatgcgccacaatctgggagggaacctcggtgatccaagagctcgcgctgtgtcagtcccgttgggaggccgagtcgcgcggttcctgcaatgtaggttcctttttgcaggaccatggttgcttttctccgagatcagtttcattagtgacgtcgtgaataactcctctccagccttgggcggaacctttcccccagcgccatggtggcctcctgggccgcccccaacgaacttctcatcactagagctcgaaccccgcgggcagcaacctgtcgccaaggccgagggtagtcccaccgctatcctgataggctgtctagtggccatcatacttttacttctgctgatcatagctttgatgctgtggaggctgcattggcggcgactcctgagtaaagccgagaggcgagtattggaagaggaactgaccgttcacctgagcgtgccaggcgacaccatcctgatcaacaacaggcccggcccccgggagcctccgccttatcaggagcctcggccacggggtaaccccccccacagcgccccatgcgtcccaaacgggagtgcttattcgggtgattacatggaacccgaaaagccaggggctccactgctgcctcccccccctcagaactcagtaccacattacgcagaagctgatatcgtgactctacagggcgtcaccggaggcaacacctatgctgttcccgccctgcccccgggtgctgttggcgatggtcctcctagagttgattttcctcggtctcggctgcggtttaaagaaaagctgggggaaggacagttcggtgaagtccatctgtgtgaggtggactcaccacaggacttagtctcactggattttccgctgaacgttcgcaagggacaccctctacttgtggcggtcaaaatcttacggcccgatgctaccaagaatgctcgcaacgacttcctaaaagaggtgaagattatgtcaagattgaaggatccaaatatcatcagattgttgggcgtgtgcgtccaggatgacccactctgtatgatcactgattatatggaaaacggcgatctgaatcagtttttaagcgcacaccaactggaagataaggctgcagaaggcgccccgggggacggccaagccgctcagggccctacaatcagctatcccatgttattacacgtggctgctcagatcgcgagtggcatgcgctatctcgcaacattaaacttcgtccatcgggatcttgccacccggaattgtcttgtgggtgaaaattttacaatcaagatcgccgactttgggatgtccaggaacctgtacgcaggcgattactatcgcgtgcagggtagagcggttctcccaattagatggatggcctgggagtgtatacttatgggtaagttcaccaccgcttcagatgtttgggcttttggcgtgaccttatgggaagtgctgatgctgtgcagggctcaaccatttggtcagctcacagacgagcaggtcatcgagaatgcgggagagttcttcagagatcaggggcgccaagtctatctgagcaggccgcctgcatgtccgcaaggattgtacgagttaatgctgcgatgctggtctcgggagtctgagcagcggcctcccttcagccagcttcaccgctttcttgctgaagacgcactaaatacagtgtag

SEQ ID NO: 10124 - DNA, 273 bp, Artificial Sequence
  Description of Artificial Sequence: Synthetic coding sequence
atgcagctgttcctgctgctgtgcctggtgctgctgagcccccagggcgcaagtctacaccgccaccatcctcgcgaaatgaagaaacgggtggaagatcttcacgtgggggcaaccgtggccccgtctagtcggagagattttactttcgatctctatagagctctcgccagcgctgctccctctcagtccattttcttttctcccgtgtcaataagcatgagcctcgcaatgctctccctaggggctgggtcaagcaccaagatgcagtag

SEQ ID NO: 10125 - DNA, 618 bp, Artificial Sequence
  Description of Artificial Sequence: Synthetic coding sequence
atgatgcggaccctgatcaccacccaccccctgcccctgctgctgctgccacagcagctgttgcaactcgtgcagtttcaggaggtggacacggactttgatttccctgaagaggataagaaagaggagtttgaggagtgtctggaaaagtttttctctactgggccggccaggccaccaacgaaggaaaaagtgaagcggcgtgttctgattgaacccggcatgccgctgaaccatattgagtattgtaatcacgaaatcatgggtaagaacgtctattacaagcaccggtgggttgcagagcactactttctcctgatgcagtacgatgaattgcaaaagatttgttataatagattcgttccatgcaaaaacggaatccgcaagtgcaatcggtccaagggcctggtggagggcgtgtattgcaacctcacggaagctttcgaaatcccggcatgtaagtatgaaagcctctacaggaaaggctatgtgctcatcacgtgctcctggcagaatgagatgcagaaacggatcccccacacaatcaacgacctagtcgagccccctgaacatcgctctttcctctctgaagacggtgtctttgtgatctctccatag

SEQ ID NO: 10126 - DNA, 30 bp, Artificial Sequence; identical to SEQ ID NO: 5113
  Description of Artificial Sequence: Synthetic coding sequence

SEQ ID NO: 10127 - DNA, 600 bp, Artificial Sequence
  Description of Artificial Sequence: Synthetic coding sequence
atgagcttcagcgccaccatcctgttcagcccccccagcggcagcgaagcacgctgctgttgttgtgcatgcaaatccgagaccaacggaggcaataccggaagccagggagggaatccccctcctagcacgccaatcacggtgaccgggcatggactggcagttcaatcatctgagcagttgctacatgtgatttatcagcgagtggacaaggccgtgggcctggctgaagctgcactcggtcttgctagagcaaacaatgaacttctcaaaagactccaagaggaggtgggcgacctccgacaaggcaaggtatcgattccggacgaggacggggaatcccgggctcacagttccccgccagaagagcccgggccacttaaggagtctcctggcgaggcctttaaggccctgtcggctgtggaagaagagtgcgacagcgttggatccggggtgcaggtggtgattgaagagttaaggcagctgggagccgcgagcgtgggccctggccctctcgggtttcctgccacacagagggacatgcgccttcctggctgtactctggcagcaagtgaagctgccccactgctgaatccttag

SEQ ID NO: 10128 - DNA, 633 bp, Artificial Sequence
  Description of Artificial Sequence: Synthetic coding sequence
atgagcgccggcaagatgatgcggaccctgatcaccacccaccccctgccactgttacttctcccacagcagctcctgcaactggtgcagtttcaggaggtcgataccgatttcgattttcctgaagaggacaaaaaggaagagtttgaggagtgtctggaaaagtttttctcaacaggaccggcacgtcccccgacaaaggagaaagtgaaaagaagagtgcttatcgagccaggaatgcccctgaatcacatcgagtactgcaaccatgagatcatgggcaaaaacgtatattacaagcatcgctgggtggccgagcactattttctccttatgcagtacgatgagctgcagaagatctgctacaaccgctttgtcccatgtaaaaatgggataagaaaatgtaaccggtctaaggggttagtcgagggggtgtactgcaatctgactgaggcctttgaaatcccggcttgcaaatacgaatctctttatagaaagggatatgtgctaattacgtgctcgtggcagaacgaaatgcaaaagaggatcccgcacacgattaacgacctcgtggagccccctgagcatagatcctttctcagtgaagacggcgtgttcgttatcagcccgtag

SEQ ID NO: 10129 - DNA, 1221 bp, Artificial Sequence
  Description of Artificial Sequence: Synthetic coding sequence
atgcagctgttcctgctgctgtgcctggtgctgctgagcccccagggagcctccctgcaccgacaccacccccgggagatgaaaaaacgggtcgaagatttacacgttggggcaaccgtggcaccttccagtcgtcgggatttcaccttcgatctgtatcgggccctcgccagcgccgctcccagccagtccatcttcttttcgccggtctccatatccatgagcctggccatgttatcactcggagcggggtcctcaacaaaaatgcagattttagaaggattgggcctgaatttgcagaagtctagtgagaaggaacttcaccgtgggtttcagcagctgctgcaagagctcaatcaaccacgggacgggttccagctctcactggggaacgccctgtttactgaccttgtcgtcgacctgcaggacacatttgtgagtgctatgaaaaccctgtacctggccgatacattcccaacaaatttccgggattcagccggggctatgaagcagatcaatgattacgtcgccaagcagactaaaggaaagattgtcgatctgttaaaaaatttggactctaacgccgtggttattatggtgaactacattttcttcaaagccaaatgggagaccagctttaaccacaagggcacccaggaacaggacttctacgtcacgtccgaaaccgtggtgagggtgccaatgatgagtagagaagatcagtaccattatctcctggacagaaatctctcgtgccgggtggtgggcgttccctaccagggtaacgcgactgcactgttcatcctgccctccgaagggaaaatgcagcaggtcgagaacggtttgagtgaaaagacactaagaaagtggctgaagatgttcaaaaagagacagctggaactgtacctgcctaagttctctatcgaggggagttaccagctggaaaaagtgctgccaagcttgggcattagtaatgtgtttacatctcacgcagacctttccgggatctccaatcatagcaacattcaagtgagcgaaatggtgcataaggcagtggtagaggtggacgagagtggcacccgtgcagcagccgccaccggtactatatttacttttcgcagcgcccggctcaactctcagcgcctcgtgttcaatagacctttcctgatgttcattgttgacaataacattttgttcctcggcaaggtcaataggccatag

SEQ ID NO: 10130 - DNA, 600 bp, Artificial Sequence
  Description of Artificial Sequence: Synthetic coding sequence
atggagaccttccccctgctgctgctgagcctgggcctggtgctggccgaagcctctgagtcaacgatgaaaataatcaaagaggagttcaccgatgaggagatgcagtatgatatggccaagtctggccaagagaaacagacaattgaaatactgatgaatcccatattacttgttaagaacacctccctgtcaatgtccaaggatgatatgtcaagtactctcctcacctttagatctcttcactacaacgatccgaagggcaatagctccggcaatgataaggaatgctgtaatgatatgaccgtgtggaggaaagtgtctgaggcaaacggctcctgcaaatggtcaaataactttattaggtcatccactgaggtaatgcgaagagttcaccgagctccaagctgcaagtttgtgcaaaatccagggatttcttgctgcgagtctctcgaactggagaatacagtctgccagtttactactggcaaacaatttccccgctgccagtatcattcggtcacttccttagaaaagattcttaccgttcttaccggccattctctgatgagctggcttgtttgcggctctaaactgtag

SEQ ID NO: 10131 - DNA, 411 bp, Artificial Sequence
  Description of Artificial Sequence: Synthetic coding sequence
atgagcttcagcgccaccatcctgttcagcccccccagcggcagcgaggctcggtgttgctgctgcgcctgtaagagcgaaacaaatgggggaaatactggttcccaaggtgggaaccctccgccgtcgactccaataacagtgacaggccacggactggccgtacagtcttcagagcagctgctgcatgtgatttaccagcgagtggataaggctgtggggctcgcagaggctgcactgggcctcgcccgagccaacaacgaattgctgaagagactgcaggaggaggttggagacctcagacaaggaaaagtttctatacctgacgaggatggtgagtctagggcacactcttccccccctgaggagcctgggcccttaaaggaatcacccggagaagcattcaagtag

SEQ ID NO: 10132 - DNA, 252 bp, Artificial Sequence
  Description of Artificial Sequence: Synthetic coding sequence
atgagcttcagcgccaccatcctgttcagcccccccagcggcagcgaggcccgatgctgctgctgtgcttgcaaatctgagaccaatgggggaaataccgggtcccaaggaggaaaccctccaccatccactcccatcaccgttacaggccacggacttgccgtgcaaagctccgagcaattgctgcatgtgatctatcagcgcgtggacaaagcggtggggctggcggaggctgcccttgggcttgcatag

SEQ ID NO: 10133 - DNA, 30 bp, Artificial Sequence; identical to SEQ ID NO: 5113
  Description of Artificial Sequence: Synthetic coding sequence

SEQ ID NO: 10134 - DNA, 519 bp, Artificial Sequence
  Description of Artificial Sequence: Synthetic coding sequence
atgcagctgttcctgctgctgtgcctggtgctgctgagcccccagggtgcctcactccacaggcatcacccccgcgagatgaagaagagggtggaggacttacacgtaggggccactgtggccccaagctccagacgggactttacattcgacctttaccgcgctctggcgtccgccgccccatctcagtcgatcttcttctcacccgtcagcatttcaatgtcactagcgatgctgtcactcggagccgggtctagcaccaaaatgcagatcctggaaggcctcgggctaaacctgcaaaagagctccgagaaagagctgcacagaggtttccagcagctgttgcaggagctgaaccagccgcgggacggtttccagctttccctcgggaatgcattgtttaccgatcttgtggtcgacctgcaagataccttcgtatcagccatgaaaaccttgtatctcgctgacaccttccccacgaatttccgcgacagtgcgggggccatgaaacagatttag

SEQ ID NO: 10135 - DNA, 615 bp, Artificial Sequence
  Description of Artificial Sequence: Synthetic coding sequence
atgcccggcggcaagaaggtggccggcggcggcagcagcggcgccactccgactagcgcagccgccactgcccccagtggagtgcgtcggctggagacatccgaggggacatccgcgcaacgggatgaagagccagaagaagagggcgaggaagacctgcgcgacgggggcgtgccattttttgtaaacagaggaggcttgccagtggacgaagcaacatgggaacggatgtggaagcacgttgccaagatccaccccgacggggagaaagtagcacagcgcattagaggagccactgacttacccaagataccgattcccagtgtccccacatttcagccctccacccctgtccccgaaaggctggaggcagtccagcgctatatcagagagctacaatataaccatactggcacccaattctttgaaataaagaagtcccgaccactcaccggactcatggatctggctaaagagatgacgaaagaagctctgcccatcaaatgcctcgaggcagttattctggggatgtaccccagctcacctgagggagaaggatctggcctcttatgggcctccgcttcctgtagtgagagtgaaggaggtgtagggtag

SEQ ID NO: 10136 - DNA, 1221 bp, Artificial Sequence
  Description of Artificial Sequence: Synthetic coding sequence
atgcagctgttcctgctgctgtgcctggtgctgctgagcccccagggcgcatctctgcacagacaccacccgcgggagatgaaaaagagggtggaagatctacacgtaggcgccactgtagctccgtcgagccgacgggacttcaccttcgacctgtaccgcgctctcgcctctgcagcgccttcccagagcattttcttcagtccagtaagcataagtatgtcgcttgctatgctgagcctcggggctggatcaagtacaaaaatgcagatcctcgagggtcttggcctgaacctccagaagtcttccgagaaagaacttcatcgcggcttccagcaactactgcaggaactgaatcagcccagagacggcttccagctgagcctgggcaatgcgctgttcaccgatctcgtggtcgacctacaagacaccttcgtgagcgccatgaaaacgttatatcttgcagacacattccccactaatttcagagactccgctggagccatgaagcagattaacgactatgtagccaagcagacgaagggcaagatcgttgatctgctgaagaatctggattccaatgccgttgttatcatggtgaactatatcttcttcaaagccaaatgggagacttcattcaaccacaaaggcactcaggaacaagacttctacgtaacttcagagaccgtggtccgcgttcccatgatgagcagggaggaccaataccactatttactcgacaggaacctgagctgccgtgtggtaggtgtcccctatcaagggaacgcaaccgccctgttcatattgccctcagaggggaagatgcagcaagtggaaaacggactgagtgagaagacgctccggaagtggctgaaaatgtttaaaaaacggcagcttgaactgtaccttccaaagttcagcattgaggggtcttaccaactggagaaggttctgccttcactgggcatcagtaatgttttcacgagccatgcggatttaagtggcatcagcaatcacagcaacatccaggtctcagaaatggtgcataaagccgtggtggaggtagacgagagtgggactcgcgccgcggcagccactggtacaatatttaccttcagaagcgcccgcttgaattcgcagaggctggtctttaatagacctttcctgatgttcatcgtcgacaataatatcctgttcttgggcaaagtgaaccgtccttag

SEQ ID NO: 10137 - DNA, 3837 bp, Artificial Sequence
  Description of Artificial Sequence: Synthetic coding sequence
atgcggctgctgctgctggtgcccctgctgctggcccccgcccccgggagcagtgcccccaaggtacggcggcagtccgacacttgggggccatggtcgcagtggagcccatgctcgaggacatgcggcggtggcgtatcgttccgtgaacgaccgtgctattcacagaggcgagatggtgggtcttcctgtgtgggacccgctagatctcaccgatcctgcagaaccgagtcatgccccgacggcgcacgtgattttagggctgagcaatgtgctgaattcgacggagcagagtttcagggacggagatatagatggctcccatactattcggcgcccaataagtgcgaacttaattgcattccaaagggtgagaatttctactacaagcatagagaagctgtggtggacggtaccccttgtgagcccggaaagcgggacgtttgcgtggacggttcgtgccgggtcgtcgggtgtgatcacgagctcgattctagcaagcaagaagataaatgcctgcggtgtggcggggatggaactacctgctacccagtagccggtacctttgacgctaacgacctttctcgcggatacaaccagatattaatcgttcccatgggagccacatcgattctgattgatgaggccgccgccagtaggaattttctggctgtgaaaaacgtgcgcggggaatattatcttaatggacactggaccatagaggcagcgagggctctgcccgcagctagcacgattctgcactacgagagaggggctgaaggcgatctggctcccgaacggttgcacgcccgcgggccaacaagtgagcctctggtgatcgaactgataagccaagagccaaatccgggagtccactatgagtatcatctgcccttacgaaggccctcccccggtttttcttggagtcatggtagctggtcggattgcagcgccgagtgcggcggggggcatcaaagcaggttggtgttctgcacgatcgatcacgaggcgtaccctgatcacatgtgtcagaggcaacctcggcccgccgacagaaggagctgtaacctccacccttgccccgagactaaaagatggaaggctggtccatgggcaccttgtagcgcctcttgcggagggggatcccagagcaggtccgtgtactgtatatcttctgatggtgccggtattcaggaagccgtggaggaggcggagtgtgccggactgccaggcaagcctcccgctatccaagcgtgtaatcttcagcgctgtgcggcctggagtcctgagccttggggcgaatgctctgtgtcttgtggggtgggagtgcggaagaggagcgtcacatgtagaggagagcggggcagcctgttgcacacagcagcctgcagtttggaggaccgaccgcccctaaccgagccctgcgtccatgaggactgtccattgctgagcgatcaggcgtggcatgttggaacatggggtttgtgttcaaagtcttgtagcagcgggacgcggcggaggcaggtcatttgtgccattgggcccccttctcactgcggatccctccagcactcgaaacctgtggatgtggagccgtgcaatacccagccgtgtcacttgccacaggaggttcccagtatgcaggacgtccatacccccgcgagcaacccatggatgccactgggccctcaggagtcgcctgcctccgattcgaggggacaatggtgggccgcccaagaacacccgagcgcaagaggcgatcaccgaggagagaggggggacccacgaggggaccagggcacacatctgagtgcattgggtccggcaccgtcattgcagcagccaccatatcaacagcctcttagatcagggagcgggccccacgattgccgccactctccccatggctgttgtcctgacggtcacaccgccagcttgggaccccaatggcagggatgccccggcgctccctgtcaacagtctcgctatggctgttgtcccgatagagtttctgtcgccgaagggccgcaccacgccggctgcactaagtcttatggaggtgacagcaccgggggcatgcctcgttccagagcagtggcttccactgttcacaatacgcaccagccacaggctcagcaaaatgaaccatctgaatgtcgcggttcccaattcggctgctgctatgataacgtagccaccgcagccggcccactgggcgaaggatgcgtcggccagcctagtcatgcttatcctgtgagatgtcttctcccttcagctcacggtagttgtgctgattgggcagccaggtggtacttcgtggctagcgtcggacaatgcaatagattttggtatggcggttgtcacggcaacgcaaataacttcgcctcagaacaggagtgcatgagtagctgtcagggcagcctccacggaccgaggcgaccccaacctggggcgtcgggcagatcgacacataccgacggtggaggatcgagccctgctggcgagcaggaaccctcacagcaccgcactggtgccgctgttcaacggaaaccctggccttcaggtggtctctggagacaggaccagcagcccggaccgggagaagcaccccacacccaggcctttggtgagtggccatggggacaggaattaggaagtagggcgcccggcctcggtggcgacgctggctctcccgcccctcccttccacagcagctcttatagaatctccttagccggagtagagcccagcttggtccaggctgctctcggccagcttgtgcggctgtcatgctccgacgatactgctccagaaagccaggccgcatggcagaaggatggccagcccattagcagcgaccgccaccgtctgcagttcgacggctctctcataatccacccgttgcaggccgaggatgccggcacctactcttgcggtagcacaagaccaggacgggacagtcagaaaatccagctgagaatcatcgggggggatatggcggtgctcagcgaagccgaactgagccggttcccccagcccagggatccagcgcaggactttgggcaggctggtgccgccgggccactgggagcgatcccctcctcgcacccacagccagccaatcgattgagattagatcaaaaccagccccgagttgtcgatgcctctcccggccagcgcattcggatgacttgccgcgcagagggctttccaccgccagctatcgaatggcaaagagatgggcagcctgtgtctagtcctcggcatcaactacagcctgacggttcacttgtgatttctcgtgtcgcagtcgaggatggcggcttttatacttgcgtggcttttaatggtcaggacagagatcagaggtgggtgcagttaagggtcctcggggagctgacaatctcagggctacccccaacagtcacagtgccagaaggagacaccgccagattgctgtgcgtggttgctggggaaagcgtcaatatcagatggtctaggaatggtcttcctgtgcaggcagacgggcacagagtacaccagtctcccgatggcaccctcttaatatacaacctgcgggccagggatgagggatcctacacctgcagcgcctatcaggggtcgcaggccgtgagccgctctacagaagtgaaggtggtatctcctgcgccaactgctcaacctcgagatcccgggcgcgattgtgtggaccagccggagctcgccaattgtgacctgattctgcaggcccaactgtgtggcaatgaatattactcctcattctgctgcgccagttgctcaaggttccagccccatgcccaacctatttggcagtag

SEQ ID NO: 10138 - DNA, 261 bp, Artificial Sequence
  Description of Artificial Sequence: Synthetic coding sequence
atgcagctgttcctgctgctgtgcctggtgctgctgagcccccagggtgcaagcttacatcgccaccatccaagagaaatgaagaagcgagtcgaagatctgcatgttggggctacagtcgcccctagttctaggagagacttcacttttgacctttacagggctcttgcaagcgcagcaccatctcagtctattttcttttctccagtaagcatctctatgtccctggccatgctgtctttgggcgctggctcctcctag

SEQ ID NO: 10139 - DNA, 906 bp, Artificial Sequence
  Description of Artificial Sequence: Synthetic coding sequence
atgcagctgttcctgctgctgtgcctggtgctgctgagcccccagggcgcaagcctgcatcgccaccatccgcgggaaatgaagaaaagggtggaagatctgcacgttggcgctacagtggctccaagtagtcggcgcgactttacgttcgatttatatagggcactggcttccgcggcacctagtcaatccattttctttagtcctgtctcaatttccatgtctctcgccatgctgtctttaggtgctggctcttcaactaaaatgcagattttggaagggctggggctgaaccttcagaagtccagcgagaaggagttgcatcggggctttcagcagctgctccaagagctgaaccaacctcgagatggcttccagctgtcactagggaatgccttgtttacagatctagtcgtggatctacaggataccttcgtctccgcaatgaagacactgtacttagctgatacattccccactaatttccgggattcagcaggtgccatgaagcagattaatgactacgtggctaagcagactaaaggtaagatcgttgacctcttgaagaacctggactcaaacgcagtggtgattatggtgaactatatattttttaaggctaaatgggagacaagctttaaccataagggtacgcaggaacaggacttctatgtgaccagcgagaccgttgtacgggttccaatgatgagtcgggaggatcaatatcactacctcctggatcgaaacctgtcctgtagggtagtgggagtgccgtatcagggaaacgcaacagcactgttcatcctgccctccgaaggcaagatgcagcaagttgagaacgggctcagtgaaaaaactctgaggaaatggctcaaaatgtttaagaagcggtactttcagacctag

SEQ ID NO: 10140 - DNA, 411 bp, Artificial Sequence
  Description of Artificial Sequence: Synthetic coding sequence
atggagaccttccccctgctgctgctgagcctgggcctggtgctggccgaggcatccgagtcaacaatgaagatcatcaaggaagagttcacagacgaagaaatgcagtatgacatggctaaaagtggtcaggaaaagcagacgatcgagatccttatgaatccaattctcttagtgaaaaatacatccctctctatgagcaaagacgatatgtcctccacccttttgaccttccgcagcctgcactacaacgatcccaagggtaatagctccggcaacgacaaggagtgctgcaatgacatgacagtctggcggaaagtgagcgaagccaatggtagttgtaaatggtctaacaatttcattcgctccagtaccgaagtgatgcggagagtgcatcgcgcaccttcttag

SEQ ID NO: 10141 - DNA, 1221 bp, Artificial Sequence
  Description of Artificial Sequence: Synthetic coding sequence
atgcagctgttcctgctgctgtgcctggtgctgctgagcccccagggcgcatccctgcatcggcaccaccctagagagatgaaaaagcgggtagaggatcttcacgtgggagcgaccgtggctccatctagtagacgcgatttcactttcgacctctacagagcgctcgcctctgctgcaccttctcagagcatctttttttcacctgtctcaatctcaatgagcctggccatgctatcattgggtgctggaagctccactaaaatgcagatcctggaaggcctgggactgaaccttcaaaaatcatctgagaaggaattacaccggggtttccagcagctcttgcaggaactcaaccagccacgcgatgggtttcaactgtccttaggaaacgcactgttcacagacctcgtggtggatctccaggatacttttgtgtcggccatgaagaccctatacctcgctgacacattccctactaatttccgggatagcgcaggagctatgaagcagatcaacgactatgttgccaaacagacaaaaggaaagattgtagatctgttaaagaacttggactctaatgccgtcgtgatcatggtcaactacatcttcttcaaggccaaatgggagacctcatttaaccacaagggcacccaggagcaggacttttatgtaaccagcgaaacggttgtgcgagtgccaatgatgagcagggaagaccagtatcattacctgttggaccgaaatctgagttgccgcgtagtaggggttccttatcagggtaatgccacagctctgttcatcctacccagcgaaggcaagatgcagcaggtcgagaacgggctctcagaaaaaacgttaaggaagtggctgaaaatgttcaaaaagcgacagctggagctctatcttccgaagtttagtatagaaggctcctatcagttagagaaagtgctcccgtcactgggaattagtaatgtgtttacatctcatgcggatctcagtggcatttccaaccacagcaatattcaggtctccgaaatggtgcacaaagccgtggtggaagtggatgaatcagggacccgggcggccgccgccacagggaccatcttcacgttcagatcagcacgtctcaattctcaacgcctcgtgtttaaccggccgttcctcatgtttatagtggacaataatatactctttctggggaaggttaatcgtccttag

SEQ ID NO: 10142 - DNA, 618 bp, Artificial Sequence
  Description of Artificial Sequence: Synthetic coding sequence
atgatgcggaccctgatcaccacccaccccctgcccctgctgctgctcccacaacagttgctgcagctggtgcagtttcaggaggttgataccgacttcgattttccagaggaggataaaaaagaggaatttgaggaatgcctagagaaatttttcagtaccggaccagcaagacctcctacaaaagagaaagtgaaaagacgtgtcctgattgaacccggcatgccattaaatcatattgagtattgtaaccatgaaattatgggaaaaaatgtctactataagcaccggtgggtcgctgagcactacttcctgttaatgcaatatgacgagctgcagaaaatttgctacaatcgcttcgtgccctgcaagaacgggatccggaagtgtaaccggagtaaggggctcgtggaaggcgtgtactgcaacctcaccgaagcgttcgagatccctgcatgcaaatatgaaagtctgtataggaaaggctacgtgctgataacctgcagttggcaaaatgagatgcagaaacggatccctcacacgatcaacgatctggtcgagccaccagaacatcgaagctttttgtcagaagacggcgtattcgttatctcgccctag

SEQ ID NO: 10143 - DNA, 240 bp, Artificial Sequence
  Description of Artificial Sequence: Synthetic coding sequence
atgagcttcagcgccaccatcctgttcagcccccccagcggcagcgaagcgcggtgctgctgctgtgcgtgcaaatcagaaacaaatggcggaaacaccggttcccaaggagggaacccacctcctagcacccccataaccgtgaccgggcacggactcgctgttcagagctccgagcagctgttgcacgtcatttatcaacgggtggataaagccgtgggtctggcggaggcggcctag

SEQ ID NO: 10144 - DNA, 618 bp, Artificial Sequence
  Description of Artificial Sequence: Synthetic coding sequence
atgatgcggaccctgatcaccacccaccccctgcccctgctgctgctgccccagcaactgttacagctcgtccaattccaggaagtggatacagatttcgattttcccgaggaagataaaaaggaagagtttgaagagtgcctggaaaaattcttctcgactggccctgctcgcccccctaccaaggagaaggttaagcgcagagtcttaatcgaaccgggaatgcctctgaatcacatcgaatactgtaaccatgaaattatgggaaaaaacgtctactacaaacatagatgggtcgcggaacattattttctgctaatgcaatatgacgagctgcagaaaatctgctataatcggttcgtcccctgtaaaaatgggatccgaaaatgtaaccggtccaagggcctggtagagggagtgtattgcaacttaactgaggcgttcgaaatcccagcgtgcaaatacgaatctctgtaccgaaagggatatgtgctgattacctgtagctggcagaatgaaatgcagaaacggattccgcatacaatcaacgatcttgttgagcctcccgaacacagatctttcctgagcgaagacggagtgttcgttatcagcccctag

SEQ ID NO: 10145 - DNA, 3789 bp, Artificial Sequence
  Description of Artificial Sequence: Synthetic coding sequence
atgcggctgctgctgctggtgcccctgctgctggcccccgcccccggcagctccgcaccaaaggtgcgcaggcagagtgacacatggggaccatggagtcagtggtcaccctgctcacgtacttgtggtggtggcgtctctttccgcgaaaggccctgctactcccaacggagggatgggggctccagttgtgtgggacccgctaggtcacatcgtagctgccgcacggagtcttgtccagatggcgcccgtgactttagggcagaacagtgcgctgaattcgatggagcagaattccagggacgtagatatagatggctaccgtactacagcgcacctaacaagtgcgagctgaactgtatacccaagggcgagaacttttattacaagcacagggaagcagtagtagatggcaccccttgcgagcctggaaagagggatgtatgtgttgatggaagctgtcgtgtggtcgggtgtgatcatgaactggactcctccaagcaggaagataagtgtttacggtgcggtggcgacggtaccacatgttatcctgtggcaggcacctttgatgccaatgacttatcccgtgggtataaccagatacttatcgtccccatgggggccacctcaatcctgatcgatgaggctgctgcatctcgaaacttcctggcagtcaagaacgtccggggagaatactacctgaacgggcattggacaatagaagccgctcgcgcgctgccagcagcatcgacaattctgcactatgaacgcggcgccgaaggggatctggcccctgagagactgcacgcacgtgggccaacctccgagccattagttatagagctcatctctcaagagccaaacccaggtgtgcattacgagtatcacctgccactgagaaggccctccccgggtttctcttggtctcacggcagttggtcagactgttcagcagaatgcggtggaggtcaccagtcgcggcttgtgttctgtactattgaccatgaagcctatcctgaccacatgtgtcaacggcagccccggcccgctgacaggcggagctgcaacctgcacccatgcccagagacaaagaggtggaaggccggaccatgggcaccatgtagtgcctcttgtggagggggaagtcagagtcggtcagtttactgtattagctccgacggcgccggtattcaggaggcagtcgaagaagccgagtgtgccggtctcccagggaaaccacccgccatacaggcgtgtaacttgcaacgctgcgcagcctggagcccagagccctggggagagtgctctgtgtcatgcggcgtgggagtgcggaagcgaagcgtcacctgtaggggagaaaggggcagcctcctgcatacggctgcttgcagcctcgaggaccgccctccattaaccgaaccctgtgttcacgaggattgtccccttctaagtgaccaggcatggcatgttggaacatggggcctctgcagcaagtcctgctccagcgggacaaggcgcagacaggtgatttgcgctattggacctcccagtcattgcggctcccttcagcattcaaaacccgtcgatgtggagccatgcaatacacagccctgccacctaccccaggaggtgccatcaatgcaggacgtccacacgcctgcctcaaatccttggatgcccttagggcctcaagagtcacctgcgtcagactccaggggacagtggtgggccgcccaggaacacccttcggcaaggggggaccacaggggcgaaagaggggaccctcgtggagatcaggggactcacttatccgcgctaggcccagcaccttcgcttcaacagcctccataccagcagcctctccggtccgggtccggaccgcacgactgccgacacagcccacatgggtgctgccctgacgggcataccgccagcttaggacctcaatggcaggggtgtccaggcgctccttgtcagcaatctcgctacgggtgctgtcctgacagagtgtccgtagccgaggggccccatcacgccggctgtactaaaagctatggaggcgatagcacaggcggtatgcccagatcccgagccgttgccagcactgtacataacacacatcagcctcaggcacagcagaatgagcccagcgaatgcagaggtagccagttcggatgttgttatgacaacgtcgccacagctgctggccctctaggcgaaggctgcgtggggcaacctagccatgactgggctgcccgctggtattttgtggcgagcgttggccaatgtaatcgcttctggtacggcggctgtcatggcaacgcaaacaattttgcaagcgaacaggagtgtatgtcgagttgtcaggggtccttacatggaccccggagaccccagccaggagcgtccggacgaagcacacacactgatggaggcggatcaagtcccgcaggcgaacaggagccaagccagcaccgcactggggcagccgtccagcgcaagccatggccatctggcggtctgtggcggcaggaccaacaaccgggtcctggcgaagcgccccacacacaggcttttggcgagtggccctgggggcaggaattagggagcagggccccaggccttggaggtgacgccggatcccctgcccctccattccattcatcaagctatcggatctctctggctggcgtcgaaccatcccttgtgcaggccgctcttggacaattggttaggttatcatgtagtgatgatactgctccagagtcacaggcagcatggcagaaggacggccaacctatctcttctgacagacaccggctgcagtttgatggaagccttatcattcaccccctccaggcagaggatgcaggaacgtattcatgtgggagcaccagacctgggcgggacagtcagaagatacagcttaggattatcggaggcgatatggccgtcctgagcgaagctgaactcagcagatttccacagccaagagaccctgcacaagatttcgggcaagccggagccgctggaccattaggagccataccgtcatcgcacccgcagcctgcaaacaggttgaggttagatcaaaaccagccaagggtcgtggatgcatctccaggacaacgcattaggatgacatgccgggcggaaggcttcccaccacctgccattgagtggcagagggatggccagcctgtcagcagccctcgccaccagctacagcccgatggcagcttggttatctctagggtcgccgttgaagacggaggcttttacacctgtgtcgcctttaacggacaggacagggaccagcgctgggtacagcttagggtgctcggtgagttgacaatttcagggcttcctcccacagttactgtgcccgaaggagacacagcccggttactttgcgtggttgcaggcgaatcagtaaatatacgctggagccgcaacggcctcccagtccaggctgacggccacagagtgcaccagtctccagacgggaccctgctgatatataacctgcgagcgcgtgatgaggggtcttatacttgcagtgcctaccagggtagtcaggccgttagtcgcagtacagaggtgaaagttgttagcccagcaccaacagctcaacctagggacccaggacgggactgcgtggaccagcctgagttggcaaattgcgacctgattctccaggctcaactctgtggaaacgagtactacagctcattttgttgcgcctcttgctctcgcttccagccccacgcacagccaatctggcaatag

SEQ ID NO: 10146 - DNA, 321 bp, Artificial Sequence
  Description of Artificial Sequence: Synthetic coding sequence
atgagcttcagcgccaccatcctgttcagcccccccagcggcagcgaggccagatgctgttgttgtgcatgcaagtccgaaaccaacggcgggaatacaggctcccagggtggcaacccccccccatcaacacccatcactgtgacaggccacggactggcagtgcagtcctccgaacagctgctgcatgtcatctaccagcgggtggacaaggctgtgggccttgccgaggccgccctaggtctagcccgcgctaacaatgagttactcaagcggctccaggaggaggtgggtgacctgaggcagggtaaggtaagctag

SEQ ID NO: 10147 - DNA, 444 bp, Artificial Sequence
  Description of Artificial Sequence: Synthetic coding sequence
atggccctgcagcggacccacagcctgctgctgctgctgctgctgaccctgctcggtctgggtctggtgcagccttcttacgggcaggacgggatgtatcaacgatttctacggcagcacgtccatcctgaggaaaccggtggatctgatcgatactgcaaccttatgatgcagagacgcaaaatgacactctaccactgtaagagattcaataccttcatacacgaagatatctggaacattcgttccatatgtagcacaacaaacatccagtgcaaaaacggtaagatgaactgccatgagggggtggtcaaggtcacggactgtcgcgacaccggtagctctcgggccccaaactgtcggtatcgtgccattgccagtactcggcgcgtggttattgcttgtgaagggaacccacaggtccccgtgcactttgacggttag

SEQ ID NO: 10148 - DNA, 435 bp, Artificial Sequence
  Description of Artificial Sequence: Synthetic coding sequence
atgcagctgttcctgctgctgtgcctggtgctgctgagcccccagggagcttcactgcatcggcaccacccccgcgaaatgaaaaagcgcgtggaggacctgcatgtgggtgctacagttgcccctagttctcgtagagattttacatttgatttgtaccgtgccctcgcaagcgcagcaccgtctcaaagcatctttttcagcccggtaagcatcagcatgagcttagcgatgctttctcttggagctggttcttccaccaagatgcaaatcctcgaaggactcgggctgaaccttcagaaatcctctgaaaaggaactccatagaggctttcagcagctgttacaggagctgaaccagcccagggatggattccagctgtcgctggggaacgccctcttcaccgacctggtcgtggatctgcaggacacttag

SEQ ID NO: 10149 - DNA, 540 bp, Artificial Sequence
  Description of Artificial Sequence: Synthetic coding sequence
atgggcagcagcggcctgctgagcctgctggtgctgttcgtgctgctcgccaatgtgcagggacccggcctgacggactggctatttccaagacgctgtccgaaaattcgggaagagtgcgaattccaggagcgcgacgtctgcaccaaagatagacagtgccaggacaataagaaatgttgcgtgttcagctgcgggaagaagtgcttagacctcaagcaagatgtttgtgaaatgccaaaagagacggggccctgcctggcatactttctgcattggtggtatgacaagaaagataatacctgtagcatgtttgtttacgggggctgccagggcaataataataactttcaaagtaaggcaaactgtctgaatacctgcaagaataaacaaccgtgtcctaaaatcaaggtcgaatgtgaggtagaggagatagaccaatgcacgaagcctcgggattgccccgagaatatgaagtgttgcccgttttcacgtggcaagaaatgtctggatttcagaaaagcctctttaagcacctag

SEQ ID NO: 10150 - DNA, 444 bp, Artificial Sequence
  Description of Artificial Sequence: Synthetic coding sequence
atggccctgcagcggacccacagcctgctgctgctgctgctgctgactctgttgggattgggcctagtgcaacctagctacggccaagatggcatgtatcaacgctttctgcgccagcacgtgcatccagaggaaacaggcggctctgatcgctactgcaacctgatgatgcagagaagaaagatgaccctgtaccattgcaaacgatttaacacattcatccacgaggatatttggaacatcaggtcaatttgctccacgacgaacattcaatgtaagaatggcaagatgaattgtcatgagggcgtggttaaggttaccgactgtcgagacacagggtcctcccgtgctcccaactgccgatatcgagcaatcgcctccacaaggagggtggtgatcgcgtgcgaggggaaccctcaagtcccggttcattttgacggatag

SEQ ID NO: 10151 - DNA, 600 bp, Artificial Sequence
  Description of Artificial Sequence: Synthetic coding sequence
atggagaccttccccctgctgctgctgagcctgggcctggtgctggccgaggcctccgaaagcactatgaagatcattaaagaagaattcacagacgaggaaatgcaatatgatatggctaaatctggccaggaaaaacagaccatcgagatattaatgaatccaatcctgctggttaaaaacacctcactctccatgagcaaagatgacatgtcctctaccctgcttacttttcgctccctgcactacaacgatcctaagggcaatagcagtggaaacgacaaggagtgctgtaatgatatgacagtttggcggaaggtttctgaggctaatggcagctgcaagtggtccaacaactttattcggtccagcaccgaagttatgcgacgcgtgcatagggctccctcatgtaaattcgtccaaaacccaggcatatcctgctgcgagtctctggaactggagaatactgtgtgtcaattcacaacagggaaacagttcccacgctgccagtatcactccgttacgagcctggaaaaaattttgaccgtgctaactggccattccctcatgagctggttggtgtgtggaagtaaattatag

SEQ ID NO: 10152 - DNA, 153 bp, Artificial Sequence
  Description of Artificial Sequence: Synthetic coding sequence
atgagcttcagcgccaccatcctgttcagcccccccagcggcagcgaagcaagatgctgctgctgtgcttgcaagtcagagacgaatggcgggaacactgggtcccaggggggtaatccgcctcctagtactccaattacggtcacagggtag

SEQ ID NO: 10153 - DNA, 75 bp, Artificial Sequence
  Description of Artificial Sequence: Synthetic coding sequence
atgcagctgttcctgctgctgtgcctggtgctgctgagcccccagggagcttccttgcaccggcaccatccctag

SEQ ID NO: 10154 - DNA, 633 bp, Artificial Sequence
  Description of Artificial Sequence: Synthetic coding sequence
atgagcgccggcaagatgatgcggaccctgatcaccacccaccccctgccattactgttactgcctcagcaactgctgcagctggtgcaatttcaagaagtggatacagacttcgactttcccgaagaggacaaaaaggaggagtttgaggagtgtctggagaagtttttctctaccgggcccgcgaggcctccaacaaaagagaaagtcaagaggcgggtcttgatcgagcctggtatgccccttaaccatattgagtactgcaatcatgaaataatgggcaagaatgtatactacaaacaccggtgggtcgcagaacactacttcctcctcatgcaatacgacgagctccagaagatttgctacaaccggttcgttccttgcaagaatggaatccgcaaatgcaatcgctcaaagggcctcgtcgagggagtgtactgtaacttgacagaggcctttgagattcccgcatgcaaatacgaaagcctgtatcgaaaaggctatgttctcattacttgtagttggcagaatgaaatgcaaaaaagaataccgcacacaataaatgacttggtggaacctcccgaacaccggtcattcctgagcgaagatggggtctttgtaatctccccctag

SEQ ID NO: 10155 - DNA, 36 bp, Artificial Sequence; identical to SEQ ID NO: 5142
  Description of Artificial Sequence: Synthetic coding sequence

SEQ ID NO: 10156 - DNA, 444 bp, Artificial Sequence
  Description of Artificial Sequence: Synthetic coding sequence
atgatcatcatggtgatcatcttcctggtgctgctgttctgggagaatgaggtgaacgacgaagctgtcatgagcaccctggagcacctgcacgttgattatccgcaaaatgatgtgccggtgcccgcgcgctattgcaaccacatgatcattcagcgggttatccgagaacctgatcacacctgcaagaaggagcacgtgtttatacacgagagacctcgaaagatcaacggcatatgtataagtcccaagaaagtagcatgccaaaatctgagcgccattttttgttttcagagcgagactaagtttaagatgaccgtatgccaacttatcgaaggaaccaggtacccagcctgtcggtaccactattcaccgaccgagggatttgtgcttgtaacctgtgacgacctgaggcctgattcctttctggggtatgtgaaatag

SEQ ID NO: 10157 - DNA, 696 bp, Artificial Sequence
  Description of Artificial Sequence: Synthetic coding sequence
atgcagctgttcctgctgctgtgcctggtgctgctgagcccccagggggcctcactgcatcgccaccatccccgagagatgaagaagagggtggaggacctgcacgttggcgctacagtcgctccttcttcaagacgggacttcaccttcgatctgtaccgcgccctcgcatctgctgctccatcccagtctatcttcttcagccctgtgtcgatttcgatgagcttagcaatgctctctctgggagccggatcctccacaaaaatgcagattctggaggggctagggctaaatttgcaaaaaagcagcgagaaagagctgcacagaggattccagcagttgttgcaggagctcaaccagccaagggacggctttcagctgtctctaggtaacgccttgttcactgatctggtagttgacctgcaggacactttcgtttccgctatgaaaaccctttatctggccgatacatttcctaccaacttccgcgattctgccggcgctatgaagcagataaatgactatgtcgccaaacagactaaaggcaagattgttgacctacttaaaaacctcgacagtaacgcagtggtgataatggtgaattatatttttttcaaggccaaatgggaaacttcattcaaccacaaaggaacgcaggaacaagacttttacgttacaagcgagactgtggtctag

SEQ ID NO: 10158 - DNA, 1626 bp, Artificial Sequence
  Description of Artificial Sequence: Synthetic coding sequence
atggccaagttcggcgtgcaccggatcctgctgctggccatcagcttaacaaagtgtttggaatcgactaaactgctcgcggacctgaagaagtgtggagatcttgagtgcgaggcactcattaatcgggtcagcgcaatgagggactatcgcggcccagactgccggtatttgaacttcactaagggggaggaaattagcgtctatgtgaagttggccggggaacgcgaggatctttgggccggtaaaggtaaggagttcggctactttccacgagacgcggtacaaatagaggaggttttcatttccgaagaaatccagatgtccaccaaggagtccgactttctttgcttattaggggtttcatacactttcgacaatgaggattcagaactgaatggggactatggcgaaaacatatacccatatgaagaagacaaagatgaaaagtctagcatctatgagagtgactttcagatagagcctggtttctatgctacctatgaatctacactgttcgaggaccaggtcccagccctggaggccccggaggacatcgggtccactagcgagagtaaggattgggaagaagtagtagtggaatccatggaacaagacaggatcccagaggtccatgtaccgccctcctctgctgtgagcggagtcaaagaatggtttgggctgggaggcgagcaagccgaggagaaggcctttgagtcggtcatcgaacctgtacaggagagttctttccgctcaagaaaaatcgctgtcgaggatgaaaacgacctggaggaactgaacaatggcgagccccagacagaacaccagcaagaatccgaaagcgagatcgatagtgtgcccaaaactcaaagtgagcttgccagcgaatccgaacatatacccaagcctcagtcaacgggatggttcgggggcggttttacttcttatctgggattcggcgatgaagatactggtctagaattgatcgccgaggaaagcaatccaccactacaggatttccctaattccatttcaagcgacaaagaagccactgtgccttgcacggaaattctcaccgaaaagaaggacactatcaccaacgacagtctgtccctgaagccttcctggttcgactttgggttcgctatattgggtttcgcctacgcaaaagaagataagatcatgctcgatgaccggaagaatgaggaggacggcggggctgatgagcatgaacatccactcacaagcgaattggaccctgagaaagaacaggagatcgagaccataaagatcattgagacagaggaccaaatcgataagaagcctgtctcagaaaagaccgacgaatccgataccatcccgtacttgaagaaattcctgtataatttcgataatccgtggaactttcagaatatcccaaaagaaaccgagctacccttccccaagcaaattctggaccagaacaacgtgattgaaaacgaagagaccggtgagttctctatcgataactaccccaccgataatacaaaagttatgattttcaagagctcatatagcctgagcggttggtacgaaaacatatacattcgaatctacttcatcttcaagcacaacctgttcctatag

SEQ ID NO: 10159 - DNA, 1245 bp, Artificial Sequence
  Description of Artificial Sequence: Synthetic coding sequence
atgaaccccaccctgggcctggccatcttcctggccgtgctgctgaccgtgaagggcttgctcaaaccgtccttctctccgagaaattacaaagccttatcggaagtgcaaggatggaaacaaagaatggccgcgaaagagttggcccgacaaaatatggatctcgggtttaaacttttgaaaaaattggccttctacaacccaggccggaacatcttcttaagcccactcagcattagcactgcatttagtatgctatgtctgggcgcccaggatagcacactggacgagatcaagcagggatttaacttcagaaagatgcctgagaaagatctgcatgaaggatttcactatattattcacgagctgacccagaagacccaagacttaaagctgtccatcgggaacactctttttatcgatcagaggctccagccccaacggaaattcctcgaagacgcaaagaacttctattctgcggagaccatcctgaccaattttcagaacctggagatggctcagaaacagatcaatgacttcatctcccagaaaacccacgggaagattaacaacttgattgagaacatcgaccctgggaccgttatgctgctggccaattacatattcttccgggctcggtggaagcacgaatttgatccaaatgtcacaaaggaggaggactttttcctggagaaaaatagttccgtgaaggttcctatgatgttccggagtggtatttatcaggtgggctacgatgacaagttatcatgtacgattctcgagatcccctaccagaagaacatcaccgcgatcttcattctccctgacgaaggcaagctgaagcacttagagaaaggcctgcaggtggacacctttagtcggtggaagactctgctctctaggcgggtggtagacgtcagtgtgcctcgcctacacatgacagggactttcgatttgaaaaaaactctctcatacatcggcgtgtcaaaaatttttgaagagcacggcgatctgaccaaaatcgcaccccataggagccttaaagttggggaagcagttcacaaggcagaactcaagatggacgaacgagggaccgaaggcgccgctggcactggtgcccagactctgccaatggaaacccctctagttgtaaagatagacaagccgtacttactgctgatatacagtgagaaaattccatctgtgctgttcctggggaagatcgtaaatcccatcgggaaatag

SEQ ID NO: 10160 - DNA, 618 bp, Artificial Sequence
  Description of Artificial Sequence: Synthetic coding sequence
atgatgcggaccctgatcaccacccaccccctgcccctgctgctgttgccccagcagctgctacaactcgtgcaattccaggaggtcgacacagatttcgacttccccgaggaggataagaaggaggaattcgaagagtgcctggaaaagtttttctccactggaccagctaggccccctactaaagagaaagtgaaacgccgagtcttgattgagcctgggatgcctctgaatcacatcgagtattgtaaccatgagatcatgggcaagaacgtttattacaaacatcggtgggtcgctgaacattattttttactgatgcagtatgacgagttgcagaagatctgctataaccgttttgtcccttgtaaaaatggcatccggaagtgtaatcgtagcaagggcctcgtggaaggtgtctactgtaatctgacagaggcctttgagatccccgcctgtaaatatgaatccctttataggaaaggatacgttctgataacatgcagttggcaaaatgaaatgcagaaaaggataccacatactattaacgaccttgttgagccacctgagcacaggagctttctatctgaagatggagtttttgtgatctctccatag

SEQ ID NO: 10161 - DNA, 516 bp, Artificial Sequence
  Description of Artificial Sequence: Synthetic coding sequence
atggagaccttccccctgctgctgctgagcctgggcctggtgctggcagaggccagtgagtccacaatgaagattatcaaggaggaattcactgatgaggagatgcaatatgatatggcaaagtctggccaggagaaacaaaccattgagattcttatgaaccccattctactggttaaaaacaccagcctaagcatgagtaaagatgacatgtcttccaccttgttgactttcagaagcctccattataatgatcccaaagggaatagcagtggaaatgacaaagagtgctgcaacgatatgactgtatggaggaaggtctctgaggcgaacggatcctgcaagtggtcgaataactttataaggtcgagcacagaggtgatgcgccgggtgcaccgagctccatcctgcaaatttgtgcagaaccctggcattagctgttgcgagtcactagaactcgaaaataccgtgtgtcaattcactaccggaaaacagttccctcgttgtcaatattag

SEQ ID NO: 10162 - DNA, 633 bp, Artificial Sequence
  Description of Artificial Sequence: Synthetic coding sequence
atgagcgccggcaagatgatgcggaccctgatcaccacccaccccctacccctgctgctgctgccccagcagctgcttcagcttgtgcagttccaggaggtggatactgactttgactttccagaggaggataaaaaagaagaattcgaagagtgtctggaaaagttcttctctacaggacccgccaggccaccaactaaggagaaagttaaaagaagggtcctgatcgaacctggaatgcctctgaatcacattgaatattgtaaccatgaaatcatggggaaaaatgtctattacaagcaccgctgggtggccgagcactacttcctcctcatgcagtatgacgaactgcaaaaaatttgttacaatcggtttgtgccctgtaagaacggcattaggaagtgcaacaggtcaaaaggcctagtggaaggcgtgtactgcaatctcacggaagcattcgaaattcccgcgtgcaagtacgagtccctgtaccggaaggggtacgttctgatcacctgttcttggcagaatgaaatgcaaaagcgcatcccccacacaatcaacgacctagtagaacctcccgaacatagatcatttctgtccgaggatggtgtcttcgtgatcagtccttag

SEQ ID NO: 10163 - DNA, 537 bp, Artificial Sequence
  Description of Artificial Sequence: Synthetic coding sequence
atggagaccttccccctgctgctgctgagcctgggcctggtgctggctgaggccagtgagtccacaatgaagattataaaggaagaattcacagatgaagagatgcagtacgatatggcaaagtcgggccaggaaaagcagacaattgagatcctgatgaacccgatcctgttagttaaaaatacaagcttgtccatgagcaaagacgacatgtcaagcactctactcacttttaggtccttacattacaatgatccaaagggaaatagctctggcaatgataaagaatgctgtaatgatatgacagtgtggagaaaggtctccgaggcaaatggatcatgtaagtggtccaacaactttatccgctcttctacggaggttatgagaagggtccaccgtgcaccctcctgtaagtttgtccagaaccctggaatctcttgctgcgaaagcttagaattagagaacactgtgtgccaatttacaactggtaagcagttccccaggtgccagtatcacagcgtaacttcactagaatag

SEQ ID NO: 10164 - DNA, 474 bp, Artificial Sequence
  Description of Artificial Sequence: Synthetic coding sequence
atgcagctgttcctgctgctgtgcctggtgctgctgagcccccagggtgcaagcttgcacagacaccatcctagagaaatgaagaaaagagtggaagatctgcatgtcggggccacagtggcgccgagttctagacgagatttcacttttgacttgtaccgagctctagcttctgccgccccaagccagagcatcttcttttcccccgttagtataagtatgagcctagccatgctgtctctcggcgcgggaagtagcactaagatgcagattttggagggcttaggtttaaatctgcagaaatcctctgaaaaggaactgcatcgggggttccagcagctcctgcaagaattgaaccagccccgggatgggttccagctgtctctgggaaacgctctctttaccgacctggtcgttgatctgcaggatacatttgtcagcgccatgaagacattatatctggccgacacctag

SEQ ID NO: 10165 - DNA, 1035 bp, Artificial Sequence
  Description of Artificial Sequence: Synthetic coding sequence
atgcccccccggatgctggtggcccccctgcccctgcacttcctgctagccgccgtgagctcggaaaaccggagtggacgaaggcaatggcaacaggccgtggccgcaggatccgggccgggccgaaatagtagccgggctatccattggtccctaccaagggccctggtgcccgcaaccggtacaagggcttcggggtcccagaaacggcagagacccccaaaggggcaggaggcgctctggagcaggcctcacagccgacatagcgctgagcgcgccggaggttcccattctgaccctggacgccttagtgctccattaggacttgggctgccttccggccgaggtaggttaaccgctatgcccggacgtgcgcctttgcgtaccgtgccaggcgccctgggcgcttggctcctgggcggactgtgggcgtggactctctgtggcctttgcagcctgggagccgtgggtgccccacgcccatgccaagctccacagcaatgggaaggacgacaagtgatgtatcagcagtcttcgggtagaaatagtagagccctcctatcgtatgacggtctaaaccagagggtgcgcgtgctggacgagcgcaaggcactcattccctgtaaacggttgttcgagtacattttgctgtataaggacggggttatgtttcagatagaccaggccacaaagcaatgtagtaagatgactctgacccagccatgggaccctctcgacataccccagaactctacttttgaagatcagtattccatcgggggccctcaggagcagatcactgtgcaagaatggtccgacaggaaatccgcgcgatcctatgaaacttggataggaatctacaccgtgaaggattgctatcctgtgcaagagacttttaccatcaattattctgtcattctgtcaaccaggttctttgacatccaactggggatcaaggacccatcagtctttacaccaccaagcacttgtcagatggctcagctcgagaagatgtcagaggactgttcatggtag

SEQ ID NO: 10166 - DNA, 321 bp, Artificial Sequence
  Description of Artificial Sequence: Synthetic coding sequence
ggccagcccaaggccgcccccagcgtgaccctgttcccccccagctcagaggagctgcaggccaataaggcaacattggtgtgcctggtctctgacttctatcctggtgctgtgacggttgcctggaaggccgacggtagccctgtcaaggttggcgttgaaactacaaaaccgagtaagcagtcgaacaacaagtatgctgccagctcctacctttctctaacacccgaacagtggaaatcccacaggtcgtactcctgtagggttactcatgaggggtccacagtggagaaaaccgtcgccccagctgagtgtagctag

SEQ ID NO: 10167 - DNA, 672 bp, Artificial Sequence
  Description of Artificial Sequence: Synthetic coding sequence
atgcggctgcagcggccccggcaggcccccgccggcggccggcgggcccctagaggcgggcggggtagcccctacagacctgaccccgggaggggagccagacgcctccgtcggttccagaaaggtggggaaggagcaccacgggcggacccaccttgggcccccctgggtacgatggcgctacttgcattgcttctcgtggttgctttacccagagtgtggaccgatgcaaatctgaccgcacggcagcgcgacccagaagacagccagaggactgacgagggtgacaacagggtgtggtgccatgtgtgcgagagagaaaacaccttcgagtgccaaaacccgcggcggtgcaagtggaccgagccctactgtgtgattgccgctgtgaagatcttccccagattcttcatggtcgctaagcagtgctccgccgggtgtgcagccatggagcggccaaaaccagaagagaaacgctttctgctcgaagagccaatgcccttcttttaccttaagtgctgtaaaatcagatattgcaacctggaaggcccaccgattaatagctctgtcttcaaggagtacgccggctccatgggtgagtcctgtggcgggctgtggctagccatcctcctgctcctagcttctatcgctgcaggactctccctgtcttag

SEQ ID NO: 10168 - DNA, 408 bp, Artificial Sequence
  Description of Artificial Sequence: Synthetic coding sequence
atgacccccacccccaccgccgcctggaccccccccccccccctgcggcctagcgccgccgcagctggggcacagtgccgcagttgcccctttagaggtggctgtgcgccatccactgcacggactcccccagcctgtatgcgaccagctggcccatgcgctccccccacatggcctgccccctccaccaccacctctacatgtaccagcaggcgagccgggtgcaccgcctcttcagcttcctatagcacccttgccgcggcttgcagcttgcgccgcagtggcgtgaggtggcctccctcgagcgcttacagcacctgggccttcgcatcatgctgtgcctcatctgcttcttgcagatgctgctgctgctgctgggccgcaggagcttggacgtccgcctggtag

SEQ ID NO: 10169 - DNA, 1542 bp, Artificial Sequence
  Description of Artificial Sequence: Synthetic coding sequence
atggcccccgcccggaccatggcccgggcccggctggcccccgccggtattcctgcagtggccctctggctcttgtgcacgttgggactgcagggaactcaggctggcccgccccccgccccgccaggcctccccgctggcgccgactgtctgaacagctttacagcaggcgtacccggattcgtcctcgacacaaatgcctcagtcagcaatggagccacatttctggaaagtcccactgtgcggcgggggtgggattgtgtgagggcatgttgcaccacccagaactgtaacttggctttggtcgagttgcagcccgatcgcggggaggatgctattgccgcctgttttctgatcaactgcctgtatgagcagaattttgtttgtaaattcgctccaagggaggggttcataaattacttgaccagggaagtatacaggagttatcggcagcttcggacacagggatttggagggtccggcatacccaaggcctgggctggcatagacctcaaagttcagccccaggagcccctggttctcaaggatgtggaaaatacagattggcggcttctcagaggtgatactgatgtcagagttgaacgtaaggaccccaatcaagtagaactttgggggcttaaagaaggcacctatctgtttcagctgacagtaaccagctccgatcaccccgaagataccgccaatgttacagtaacagtgctgtccactaagcagacagaggactattgtttagcatcaaataaggtgggcaggtgtcgaggaagctttcctcgttggtactatgacccaacagagcaaatctgtaagagcttcgtatacgggggctgcctaggcaacaagaacaactaccttcgggaggaagaatgcatcttggcgtgtcggggggtgcagggaccatctatggagagacgtcaccccgtgtgtagcggcacgtgtcaaccaactcaatttcgatgtagcaatgggtgctgtatcgacagctttttggagtgtgatgatacaccgaactgtcccgacgcatctgatgaggcagcctgcgagaagtacacatctggctttgatgaactgcagagaattcatttcccaagcgacaagggacactgtgtggacctcccggatacaggactgtgcaaggaatctataccacggtggtactacaacccattcagtgagcattgtgcaagattcacctatggtggatgctacggcaataaaaataattttgaagaagaacagcagtgtttggagtcttgcagaggtatcagtaagaaagatgtgttcggtcttagacgggagatccccataccaagcactggatcagtagaaatggccgtggcagtgtttctcgtgatttgtatcgtggtggtcgtggcgattcttgggtactgctttttcaagaatcagcggaaagattttcacggccaccaccatcatcctcctcccaccccagcaagctcgaccgtgtccaccaccgaggatactgaacacctcgtgtacaaccatacgacccgccccctgtag

SEQ ID NO: 10170 - DNA, 1341 bp, Artificial Sequence
  Description of Artificial Sequence: Synthetic coding sequence
atgctgcaccccgagaccagccccggccggggccacctgctggccgtgctgctggctctcctgggaacagcctgggcggaagtgtggcctccccagcttcaggaacaggctcctatggcgggcgcccttaacaggaaggagagttttctgctccttagccttcacaaccgcctgcggtcatgggtgcaacctccggctgcagacatgcgccggctggactggtccgactcgctggcccagctagctcaggcacgggccgctctctgcggtattcccaccccatcgctggcctctggcctttggcgaacgctccaggtggggtggaatatgcagctgctgcctgccggccttgccagctttgtggaggttgtgagcctctggtttgctgagggccagcgctattcccacgccgcaggggaatgtgctcgcaacgccacctgcacgcactacactcagctggtgtgggccacatcttcacaactgggctgtgggcgccacctgtgttccgccggccaagctgcgatagaggcctttgtgtgtgcctattcgccgaggggcaattgggaggtgaacgggaaaaccattgtgccttacaaaaaaggggcctggtgctccctttgcacagctagtgtaagcggttgtttcaaagcatgggaccacgcaggcggactttgtgaggtgccccgaaatccgtgcagaatgagttgccaaaatcacgggcgcctgaacattagtacatgtcactgtcattgcccacccggctatactggcagatactgtcaagttagatgctctcttcaatgtgtgcacggacggtttagggaggaggaatgctcgtgtgtttgcgacatcggttatggcggggcacagtgcgccacaaaggttcacttcccattccatacctgtgacctgagaatcgacggcgactgtttcatggtaagttcggaagccgacacatattacagggcacgcatgaagtgccagcggaagggcggtgtgcttgcacagataaaaagccagaaagtgcaggatatattggccttctatctgggccgtctcgaaactaccaacgaagtcatcgatagtgactttgaaacccgtaatttttggatcgggctgacttataagacagcaaaggactcattcagatgggctacaggcgagcatcaggcttttactagcttcgcgtttggccaaccagacaaccacggctttggaaactgcgtcgagctgcaagctagcgccgctttcaactggaacaaccagagatgcaaaacaaggaacaggtatatttgccagttcgcacaggagcacatctctcgctggggccccggcagctag

SEQ ID NO: 10171 - DNA, 936 bp, Artificial Sequence
  Description of Artificial Sequence: Synthetic coding sequence
atgggcgtgatggccatgctgatgctgcccctgctgctgctgggcatttccggcctgctcttcatttatcaagaggttagccggctatggtctaagtctgccgtgcagaacaaggtagtggttattactgacgccatctctggtctaggaaaggaatgtgcccgggtatttcacactggaggtgctagattagttctctgcggaaagaactgggaaagattggagaacctgtacgacgctctaattagtgtagctgacccaagtaagaccttcacgcccaagctggtgcttttggatctgtccgatatcagttgcgtcccagatgtcgctaaggaggtgttggactgttatggttgcgtcgacattctgattaacaatgcatctgtgaaggtcaagggccccgcccataagatctcacttgaactcgacaagaaaatcatggacgccaattactttgggcccattacgctgacgaaggctctactgcccaacatgatctcacgcagaacggggcagatcgtccttgtgaataatatacaggggaagttcggcattccattcaggacaacctatgcagctagtaaacacgccgccttgggcttttttgactgtctgcgtgcagaagtggaggaatatgatgtggtgatctcaaccgtcagtcctacgttcatccggtcttatcacgtgtacccagaacaggggaactgggaagcctcaatctggaagttctttttcagaaaacttacctacggtgtccacccagtggaggtcgcggaagaagtcatgcgcacagtgcgcaggaagaaacaagaggtgttcatggccaatccaataccaaaggccgccgtgtacgtacggaccttcttcccagagttctttttcgctgtggtggcatgtggggtaaaggagaaacttaatgtgccagaggaagggtag

SEQ ID NO: 10172 - DNA, 594 bp, Artificial Sequence
  Description of Artificial Sequence: Synthetic coding sequence
atggccaagaacggcctggtgatctgcatcctggtgatcaccctgctgctggaccaaaccacaagccacaccagtcgcttaaaggcaaggaaacactccaagaggcgggtcagagataaggatggagaccttaaaacgcagattgaaaaactttggaccgaagtgaatgcattaaaagaaatccaggctctccagactgtgtgcctacgcggtacaaaggtccataagaaatgttacttagcatctgaaggcttgaagcacttccacgaagccaacgaggactgtatatccaagggagggatccttgtcattcccaggaactccgacgaaatcaatgctctccaggattatggtaagaggtccctgcctggcgtaaatgacttctggcttggcatcaatgatatggtcaccgaaggcaagttcgtcgacgtgaacgggatcgcaatttccttcctcaactgggaccgggcccagcctaacggcggcaagcgggaaaattgcgtgcttttcagccagagcgcacaaggtaagtggtcagatgaggcttgtcggagctccaaaaggtacatctgcgaattcactattcctcaatag

SEQ ID NO: 10173 - DNA, 705 bp, Artificial Sequence
  Description of Artificial Sequence: Synthetic coding sequence
atgaaggtgctgctgctgaccggcctgggcgccctgttcttcgcctactactgggacgacaacttcgaccccggcgggttggactatctggtactgaaccacataggcggtgcaccagccggtacgcgggcccgaagcccccaggccaccagatggctaatgcaagtgaacttcgtcagctacgtacagctgacttcacgggctcttccctctctcacagattctaagggatcactggtggtggtgtccagcttactgggtcgggtgcccactagtttctcaacgccatacagcgccgctaaattcgcactggatgggttttttggcagcttgagacgcgaacttgatgtccaggacgtaaatgtggccataacaatgtgtgtgctgggcctacgcgatcgagcatcagcggccgaggccgtgcggagctccacatcccggccccgccagcctgagcataggggagttcctttgcagagtcaaacagcgatgtttctgcccccgacagtgccaggagctcggacactgaccgaaacacctctacgagggtggcctcagcctaagatgaaatcttcacgacagaaaagcaaaacagagaaaaatgacggtcatctagagcctgtcacggcttgggaagtgcaagtcccaagagtccggaggctctgcagaggactcgcccgacctcatttatttggccacgactag

SEQ ID NO: 10174 - DNA, 228 bp, Artificial Sequence
  Description of Artificial Sequence: Synthetic coding sequence
atgaaggtgctgctgctgaccggcctgggcgccctgttcttcgcctactattgggatgataactttgaccctgcatctcttcagggagctcgggtgctcctgaccggagctaacgcaggagtcggggaggagctggcttaccattatgctagactgggcagtcatttagttttaaccgctcacactgaggcactcctccaaaaggccggctggaccacgtcttgttag

SEQ ID NO: 10175 - DNA, 225 bp, Artificial Sequence
  Description of Artificial Sequence: Synthetic coding sequence
atgcagcccagcgagatggtgatgaaccccaagcaggtgttcctgtctgttctcattttcggtgtagccgggctactactgttcatgtatctgcaggtatggatcgaggagcaacacacgggcagagtggagaaaagaagagagcaaaaagtgacatcaggctggggacctgtgaagtaccttagaccagtgccacgaatcaagccacaggtcagccatgcttag

SEQ ID NO: 10176 - DNA, 861 bp, Artificial Sequence
  Description of Artificial Sequence: Synthetic coding sequence
atgaaggtgctgctgctgaccggcctgggcgccctgttcttcgcctattactgggatgacaactttgatccagctagtctgcagggggctcgcgtgctgctcacaggggcaaacgccggagtgggcgaggagttggcataccactatgccagactgggatcccatttagtgctgaccgcgcatacagaggcacttttacagaaggttgtggggaattgccgaaagcttggcgcgcctaaggttttctacatcgctgccgatatggccagccctgaagccccggagtccgtcgtccagtttgccctggacaagctgggcggcctggattatctggtccttaaccatatcggcggtgccccagcaggtacgagggcacgatctcctcaagctactcggtggctgatgcaggtgaatttcgtttcctatgtccagctcacttctagggctctgccctctcttactgattccaagggtagtctggttgtcgtgagtagtctcctgggccgcgtcccaactagcttttccacaccctattcagcggcaaaatttgcgctggacgggttttttgggagccttcgcagggagctggatgtacaagatgtcaatgtggccatcaccatgtgtgtgctgggtctgcgggacagagctagtgcagccgaggctgtgcgcggtgtgacacgcgtcaaagccgcgcccggtcccaaagctgccctcgcagtgatacggggcggggcaacccgggcggcaggagtgttctatccatggcgatttcgcctgctgtgcctgttgagacggtggctgccccgccctcgggcgtggttcatccgccaagagttaaacgtcaccgccgccgcagcctag

SEQ ID NO: 10177 - DNA, 459 bp, Artificial Sequence
  Description of Artificial Sequence: Synthetic coding sequence
atgcaggtgaacttcgtgagctacgtgcagctgaccagccgggccctcccatcattaactgactctaaagggtccctggtggtagtctcaagccttctgggccgagtgcctacatctttttccaccccttattccgcagcaaagtttgcactggatgggttcttcgggagtctccggcgggaactggacgtgcaagatgttaatgtggccatcacaatgtgcgttctggggcttagggaccgcgcatccgcagccgaggccgttaggggcgtcacacgggttaaagccgcaccaggacccaaggccgctttggctgtgattagaggcggagcgacgcgtgctgcaggcgtgttctacccatggcgttttcgcctcctttgtctcctcagacggtggcttccccgtccccgtgcctggtttatacgacaagagcttaacgtgaccgccgcggccgcttag

SEQ ID NO: 10178 - DNA, 2856 bp, Artificial Sequence
  Description of Artificial Sequence: Synthetic coding sequence
atgcgggtgctggcctgcctgctggccgccctggtgggcatccaggcagtagagcgcctcagattggcagatggcccgcatgggtgtgccggacgcttggaggtgtggcatggcggacgctggggaacagtatgtgacgatggttgggatctccgcgacgctgccgttgcgtgcagacagctgggatgtggaggtgcactcgccgcccccggcggcgcgttttttggcgagggagccggtcctgtatggctgagcgagctggcatgtcgcggcaatgaaggccaactgggcctctgtcaccataggggttggaaagcacacatttgcagccacgaagaagacgcaggtgtagtgtgcgccggtcaaagggtggccaatagccgcgatgacagcacgagcccgctggatggcgccccttggccaggcctgttactcgaattgagtccttctacggaggagccactagttacacacgcccccagaccggccggaaatccacaaaacgcctcccggaagaagagccctcgccccaaacaggcgaaatcaaccagggccccgttgcttaccaccggtgccccccggcaggagagacttagactggtgtctggcccccaccgttgcgccggaagactcgaagtgtggcacggcggaagatggggtaccgtttgcgatgatggctgggatctcagagacgccgctgtcgcttgcagggaactcggctgcggcggcgccttggccgcaccgggcggggcgagattcggtcccggtgctggtcctgtgtggatggatgatgtcgggtgtggcgggggtgagcaggcactgcgagactgtcctcggtcaccttgggggagaagtaactgcgaccattctgaagatgcaggactggtgtgcacagggccagcgccacgactcaggcttgccgatgggccccatggctgtgctgggagacttgaggtgtggcacggggggcggtgggggtccgtgtgcgacgatgcatgggatttgcgcgatgccgcagttgcctgccgggaactgggatgtggcggggctctcgccgcaccgggcggcgccttctttggagagggctccggtcctatcatcttagatgaccttcgctgccggggaaatgagacagcattgcgtttctgcccagctcgcccttgggggcagcatgattgccaccacagagaggacgcgggggccgtctgcgatggaatgcctctggggtacgtacccccgactgcacctaccgacagcaacaactcgaccccaagggaagccgcgtctagaccgcctagtacaatgacatcgcaggcacctggaaccgccggcgtcagccctccgcccgctagtcctactgttttatgggaacccggacccgaggctggaagtcctcagctcaggcttgtcgccggacccagcaagtgttcaggccgcctagaggtttggcacgatcagcgttggggaacggtatgcgacgatagttgggacatgcgcgacagtgctgtcgtgtgcagagagttaggatgcgggggccctcagcagcccgatcctgctgccggcaggttcggttggggcgccggacctatttggctggacgacgtgggatgtgtagggacggaggccagtttatcggattgccccgctgctccatggggcaaacacaattgcgcccacaacgaggatgtgggggtcacctgcacagggccacctggtctggacagtatcagcgatcctttctcctggtcttggatccccggactgggcagagatagggacgcttggctgccaggggaactagcaaccaagccttcagccagtgtgaccgcctctgttttggaaaaaaccactacgaaagctcctggcaagatgccaaaatcgacaaagaagtgggtgactaaaaatgccaagcgacccactacacagccaccagtaatgcccacaacaaagcacagtagagcacagtccccaccagacctgacttcccaaaccacggccgccttaaccacggaagcctcgcggaggccaaccagcgagtttacaagaaggccaaccacggaagcaccgcaacgatggacatctcataccaccgcaacactcactcctcaagccccccgcgagcgaaccaccaaaactatggctatgctcactacgcagggaccgcaggagatgaccagcgaaagcaccatcaagtccatacctcaggcgtccctggagccgtcagcggaaatccccgagggatccccggagtccccaaaagatcccgcccccagcccatccgtgagtacgactggagaatctggacttttcagggtgaggctggctgacggccccaacagatgtgcgggcaggctggaggtttggcacgccggaaggtggggaactgtatgtgatgataactgggatttacgcgacgccactgtagcctgttgggagctgggttgcggaaaggtgcggcctcgggtgggcaagacacactacggacctggtaccggcccaatttggctcgatgacatggggtgcaaagggtcagaagcctccctatcagactgtccctctggggcgtggggaaaacacaactgtgaccatgaagaggatgttggcctgacatgtaccggctataccgactatgatgattacccaccttggacctgggatccaacctcacgtgaggatctggccaagggcacaaccaccgccggggtcccgggccacacccttccctggagaaccacacgtcgacccgggtcaagtagtcctgcaatccggagattgccagacactgaacccgaggctggcgcccccaggggggacgcaccaagaagcagaacggcgagggtagccgccccaccatag

SEQ ID NO: 10179 - DNA, 8430 bp, Artificial Sequence
  Description of Artificial Sequence: Synthetic coding sequence
atgaccctggagggcctgtacctggcccggggccccctggcccggttgctcttagcttggagtgctctcttgtgtatggctggtggtcagggaagatgggacggggcactggaagcagccggcccaggtagagtgcggaggcggggaagcccgggaattcttcagggcccaaacgtatgcggctctcgcttccatgcctattgctgtccaggctggcggacatttcctgggagaagtcagtgtgtggtccccatatgtcgccgcgcatgcggagaaggcttttgtagccagcccaacctgtgtacttgtgcagacggcactctcgcgccttcttgcggagttagccgcggtagcggatgttctgtgtcctgcatgaacgggggaacctgtcgcggagcatcatgcctgtgccagaaaggctacaccggcactgtttgcggccagcctatctgcgacaggggctgccataacggcggacgatgcatcggtccaaatcgatgcgcttgcgtctacggtttcatggggccgcagtgtgagcgggactacagaacaggcccttgtttcgggcaggtggggcccgaagggtgtcaacaccaattgactggcctcgtgtgtaccaaagcactctgctgtgcaacagttggcagggcctgggggctgccatgcgaactgtgtcctgctcagcctcacccttgccgccggggatttatccctaacatccataccggcgcatgccaggatgtcgacgaatgccaggctgtgccgggcctatgccaaggtggatcttgcgtcaacatggttgggagcttccattgtagatgcccagtcggccatcgccttagcgatagttctgcagcctgtgaggattacagagctggtgcttgtttttcggtactcttcggagggcgttgcgcaggcgatctagccgggcactacacgcgacgtcagtgttgttgtgacagaggccggtgttgggcagcgggaccagttcccgaattatgccctcctagaggtagtaacgaattccaacaattgtgtgctcagcgcttgcctctgctgccgggccatccgggattgttccctggacttttggggttcggcagcaacggtatgggtccacccctgggccctgcccggctaaatcctcacggatccgacgctcggggaatcccaagtctgggcccaggtaactccaatattggcaccgccacactcaaccagaccatcgacatttgtcggcacttcacaaatctgtgtcttaatggtcgctgtctgccaacgccaagcagctaccgctgcgaatgcaacgtgggatacacccaggacgtcaggggcgagtgtatcgacgtagacgaatgtacctcatctccgtgccaccacggggattgcgtgaatattccaggcacctaccactgcaggtgctacccaggattccaggcaacccccactcggcaggcatgtgtggacgtcgatgagtgcatcgtctccggaggtctttgccacctcggacgttgcgttaataccgagggctccttccagtgcgtctgcaatgccggctttgaactgagtcccgatggaaaaaactgcgtcgatcacaacgaatgcgctacgtccactatgtgcgtgaacggcgtgtgcttaaacgaggatggatcatttagttgtctgtgcaagcccgggtttctcctggccccaggcgggcactactgcatggacatcgacgagtgtcagactccaggcatttgcgtcaatgggcactgcacaaatactgagggaagcttcaggtgccaatgtctggggggactggcagtgggcaccgatgggagagtatgtgtagacacacatgtccgtagcacttgctacggggccatcgagaaaggcagttgtgcacgtccctttcctggaacagttaccaagagcgagtgttgctgtgccaacccagaccacggattcggggaaccatgccagctgtgccccgcaaaggatagcgccgagtttcaagccctctgttcttctggtttaggaattaccacagacggtagagatatcaatgagtgtgccctggaccccgaagtttgtgcgaacggcgtatgcgagaatctccgcggatcatatcggtgcgtctgcaacctggggtatgaagccggggcttcagggaaagattgcaccgatgtagatgagtgcgcccttaactcattgctgtgcgacaacgggtggtgtcaaaattcccccgggagctatagctgtagctgccctccggggtttcatttctggcaagacactgaaatatgtaaggacgttgatgaatgtttgagcagcccctgtgtgtcaggggtgtgtcggaacttggcaggatcttacacctgtaagtgtgggcccggcagcaggctggatccttccggcacgttctgtcttgacagcaccaaaggaacctgttggctgaagatccaagaaagccgctgtgaggtcaatctgcagggcgcctccctgagatccgagtgctgcgcgaccctgggagccgcctggggctctccttgtgagcggtgcgaaatagatccggcctgcgcccggggcttcgcacggatgacaggcgtgacctgtgatgacgttaacgaatgtgaaagttttccaggggtatgtccgaacggaaggtgcgttaacaccgccggctcgtttcgctgtgagtgcccagagggtttgatgttggacgctagcgggagattgtgcgtcgatgtcaggcttgaaccctgcttcctgcgatgggatgaggacgaatgcggcgtaacattgcccgggaaataccgaatggacgtgtgctgttgcagtatcggagccgtttggggggtggagtgtgaggcatgtcctgacccggagtccctggaattcgcttctttgtgtccgcggggactgggatttgccagccgtgattttctgtcaggtcgccctttctacaaagatgtgaacgagtgtaaagtctttcccggcttatgcacccatggcacctgccgcaataccgtgggatcttttcactgcgcttgtgctggcgggttcgccctagacgcccaggagcgtaactgtactgatatcgacgagtgtcgtatctcacccgatctgtgcggccaggggacctgtgtgaacacccccgggtccttcgagtgcgagtgttttccaggctacgaatcaggatttatgctcatgaagaattgtatggatgtggatgagtgcgcaagggaccccttgttgtgccgtggcgggacttgcactaataccgacgggtcctacaagtgccagtgccctcccgggcatgagttgaccgcaaaaggcactgcttgcgaggacatcgatgagtgctctctcagtgatggcctttgcccacacggacagtgtgtgaatgttattggcgcttttcaatgttcctgtcatgctggattccagtccaccccggaccgccaaggctgcgtggacatcaatgaatgtagggtccagaacggaggttgtgacgttcattgcattaacacggagggtagctatcgctgcagctgcggacaaggctactcactgatgcctgacggtcgcgcctgtgctgacgtagatgaatgtgaagagaaccctcgtgtgtgcgaccaaggacattgcaccaatatgcctggtgggcaccgctgcctatgctacgacggcttcatggccacacccgacatgagaacatgtgttgatgtcgacgaatgcgaccttaatcctcatatctgtctgcacggggactgtgagaacactaagggctctttcgtgtgccattgccagctaggatatatggtaagaaagggggcgacagggtgctccgatgtcgatgaatgtgaggttggaggccacaattgcgacagtcatgcatcctgtctaaatattccgggcagcttttcttgcaggtgcctgccaggatgggtgggagatggctttgagtgccatgacctggacgaatgtgtgtcacaggagcacagatgctccccgcgtggcgactgccttaatgtgccggggtcctatcgttgtacatgccggcaaggtttcgcaggagacggattcttttgcgaagaccgggacgaatgtgcagagaatgtggacctttgcgataacgggcagtgcctcaatgcccctggcgggtacaggtgtgagtgcgagatgggctttgatccgaccgaagatcacagagcttgtcaagatgtggatgaatgtgcccagggcaatctttgcgcctttggcagctgtgagaatctgcccggaatgtttaggtgtatctgtaatggggggtacgaactcgataggggtggtggtaactgtaccgatatcaatgaatgcgcggatcctgtgaattgtatcaatggggtgtgtattaatacgcccgggtcttatctttgctcctgtccccaggatttcgagctgaacccatccggggtagggtgcgtcgatacaagggccgggaattgcttcctggagacccatgaccggggtgattcaggaatctcatgttcggcagaaatcggcgtgggagtcactcgcgcttcctgctgctgctcactggggcgggcttggggaaacccctgtgaattgtgtccaatggccaatactactgaatatcgaaccttgtgccccggaggggagggtttccagcccaacagaattactgtgatactggaggacatagacgaatgccaggagctgcccgggctttgccaggggggagactgcgtaaacaccttcgggagtttccaatgtgaatgtccacctggctatcacctgagtgagcacacgcgcatctgcgaggacattgacgaatgctccacacactcgggtatttgtgggcctgggacttgttataacacattgggaaactatacctgcgtgtgcccagctgagtaccttcaagttaacggcggtaataactgtatggacatgcggaagtcagtctgttttcgccattacaatggaacatgccagaatgagctggcattcaatgttacccgcaaaatgtgttgttgttcctacaacatcggtcaagcttggaaccgcccatgtgaggcttgccctactcctatttctcctgactaccagatcttgtgtgggaaccaagcgcccggatttctcaccgatattcacaccgggaaacctcttgacatagatgagtgcggggagatcccagccatctgcgccaacggcatctgtataaaccagattggctccttcaggtgcgagtgtcccgctggatttaactacaatagcatactcctggcatgtgaggatgttgatgaatgcggtagccgcgaatcaccgtgtcagcaaaatgcggactgcattaacatccccggttcttataggtgtaagtgcactagaggctataagctctcaccgggaggggcatgcgtagggagaaacgagtgccgagagatccccaacgtctgtagccatggagattgtatggacaccgaagggtcgtacatgtgtctgtgtcaccgcggatttcaggcctcagccgaccagactctgtgtatggacatcgatgagtgtgatagacagccatgcgggaacggcacatgtaaaaacattatcggatcatacaactgcttatgctttcccggatttgtggtgactcacaacggggactgcgtcgatttcgacgaatgcaccactctcgtcggccaggtctgtaggttcggtcattgtctcaatacagcggggtcatttcattgtttatgtcaggacgggtttgagcttacagccgatggtaagaattgcgtggacaccaacgaatgtctctcgttggcagggacttgtcttcccggcacttgtcagaacctggagggaagcttccgatgtatctgccccccaggtttccaggtgcagtccgaccactgcatagacattgatgagtgtagcgaggagccaaacctctgcctgttcggtacatgcactaattcacccgggtcctttcaatgcttatgccctcctggattcgttctgtccgacaacggccaccgctgttttgacaccaggcagtccttctgcttcacacggtttgaggcggggaagtgctcagtcccaaaggccttcaacacgacaaaaacccgttgctgctgcagcaagcgtcccggcgagggctggggagacccatgtgagttgtgccctcaggaaggatccgctgctttccaggaactgtgtccctttggacacggcgccgtgccgggtcccgacgacagccgggaggatgttaacgagtgtgcagaaaaccccggcgtctgcactaacggtgtttgtgtcaacactgacggctcgtttaggtgtgagtgcccctttggctacagtctggactttacaggaatcaactgtgttgacaccgacgaatgctctgtcggtcacccttgtggccagggcacctgcaccaatgtcattggcggatttgaatgtgcctgtgcagacggctttgaacctgggttgatgatgacatgcgaggacattgatgaatgttcattgaacccgctgctgtgcgcttttaggtgtcataatactgagggatcctatttgtgcacctgcccagctggatacactctcagagaggacggtgctatgtgcagggacgtagacgagtgtgccgatgggcaacaggactgccacgctcgggggatggagtgcaaaaatctcattggcacctttgcctgtgtgtgtcctccgggaatgaggccattgcctggctctggagagggctgcaccgacgacaacgagtgtcatgcacagcccgacctctgtgtgaacgggcggtgtgttaataccgctgggagcttccgttgcgactgcgatgaaggattccagccttcccctacacttactgaatgtcacgatatcaggcagggcccatgctttgcggaagttttgcagactatgtgcaggagcttgagcagctcctccgaggccgtgaccagagcagagtgctgttgcgggggggggcgtggctggggccctagatgcgagctttgccccctcccgggtacctctgcctaccgcaaactctgtccgcacggttccggctatactgccgaagggcgggatgtggatgaatgcaggatgctggcccatctttgcgcccacggtgagtgcattaactccctggggagcttccggtgccactgtcaagcgggctacactccagacgcgaccgctaccacctgtctggatatggacgagtgcagccaagtccccaagccttgcaccttcctctgtaaaaatacaaagggctcattcctgtgcagttgtcctaggggctatctgctggaggaggatggccggacgtgcaaggacctggatgagtgcacctccagacagcacaactgccagtttctctgcgtaaatactgtcggcgccttcacgtgccgctgcccacccgggtttactcaacatcaccaggcttgtttcgataacgacgagtgtagtgcgcagccaggcccctgtggtgcccatggtcactgtcataacactcctggcagctttagatgtgagtgtcaccaaggattcacccttgtttctagtgggcacggatgcgaagacgtgaatgagtgtgacggaccccataggtgtcagcatggatgtcagaaccaactgggcggctatagatgttcctgcccccaaggcttcacccagcatagccagtgggcccagtgcgtcgatgagaacgagtgcgccctgtctccaccaacttgcgggagcgcgtcgtgcagaaacacacttgggggctttcgttgcgtgtgcccttctggttttgacttcgatcaggcactcggtggatgtcaggaagtggatgagtgcgccgggcgccgcggtccctgtagttattcatgcgctaataccccagggggctttctttgtgggtgtccgcagggctactttagagcaggccagggccactgtgtctctggcctgggcttctctcccggaccacaggacacacctgataaagaggaactgctttcatcagaggcatgctatgaatgcaaaattaacggactctccccaagagaccggcctcgccggtccgcccaccgagaccaccaggtgaatttagccaccctggacagcgaagctttgttgaccttggggctcaacctgtcccatctggggcgcgctgagagaatcctggaacttaggcccgcgttggagggcctggagggaaggatccgctatgtcattgtgagaggcaacgaacagggcttttttcgcatgcaccatctgagaggggtgtcttccctgcaattagggaggcgccgcccagggcccggcacataccgcctagaagtcgtgtcacacatggccgggccttggggggtgcagccagagggacaacccgggccatggggtcaggctcttcgattgaaggtccagcttcagctgctgtag

SEQ ID NO: 10180 - DNA, 291 bp, Artificial Sequence
  Description of Artificial Sequence: Synthetic coding sequence
atgcgggtgaccagcgccacctgcgccctgctgctggccctgatctgcagcgtgcaattgggcgacgcttgtctcgacatcgacaaattgttggccaacgtagtctttgacgtgagtcaagacctgctgaaggaggagctcgctagatataatccctcccccctgactgaggagagtttcctgaatgtgcagcagtgcttcgctaatgtgagcgttactgagcgtttcgctcacagcgttgtcatcaaaaagattttacaatctaatgattgtattgaagccgccttctag

SEQ ID NO: 10181 - DNA, 1890 bp, Artificial Sequence
  Description of Artificial Sequence: Synthetic coding sequence
atgcagcaggacggcctgggcgtgggcacccggaacggcagcggcaagggtcgcagcgtgcatccttcttggccttggtgcgccccaagacctctgcggtacttcggacgggacgctagagcccgaagagcccaaaccgcggccatggcattgctagccggcggtttgtcaagaggtctaggctcccaccctgcggcagctggtagagatgctgtcgtgttcgtgtggctcctcctaagtacctggtgcacagcgccggcccgcgccatccaggttacagtttcaaatccttatcatgtggtgattctcttccagccagttaccttgccctgcacatatcaaatgacctccaccccaacgcagcccattgtgatctggaaatataagtctttttgccgggacagaattgccgatgctttttccccagcgtctgtggacaatcagctgaatgctcagctggcggcaggaaacccagggtacaatccttatgtcgaatgtcaggatagtgttagaacagtacgcgtggtcgcaaccaaacaggggaatgctgttacccttggcgattactaccaaggcagaagaatcacaatcaccggaaatgccgatctcactttcgaccagactgcatggggggactctggcgtctactactgctccgtggtgagcgcccaagacctccagggtaacaacgaggcatacgcagaactgattgtgttagattggctgttcgtggttgtggtttgccttgctgcctttctgatttttcttttgttaggaatatgttggtgccagtgctgcccacacacctgctgttgttacgtccggtgtccctgctgtccagacaagtgctgttgtccagaagcgctgtatgctgccggaaaggcagccaccagtggtgtgccttccatctatgctccaagcacatacgcgcacctgtcaccagccaagacgccgccccctcccgcaatgataccaatgggcccagcttacaacggctacccaggcggctacccgggagacgtggataggagttcaagcgcgggaggccagggctcatacgttcccctattacgcgacaccgattcatctgttgcatctgttcgctcaggatatagaatccaagcatcccagcaagacgacagtatgcgcgtgctgtactatatggaaaaggagttagcaaacttcgatccttctagacccggccccccttctggccgtgtggaaagggccatgtccgaagtgacttcactgcacgaggacgattggagatcgcgcccaagtcgcgggcccgccctcactccaattagagatgaggaatggggaggtcacagcccccgctctccacggggctgggatcaggaaccggccagagagcaggctgggggcggctggcgcgctcgtcgcccacgggctagaagtgttgacgccttagatgacttgacccccccatccactgccgaaagtggctctcgtagccctacaagtaatggcggaaggtctagggcgtatatgccccccagaagcagatctagagacgatctatatgaccaggatgacagcagggattttccgcggagcagggatccgcactacgacgactttaggagtagagagagaccgcccgctgatccacgaagtcaccaccatcgtacacgcgacccaagagacaatggttcccggtccggagatctgccgtatgacggaagattgctggaggaggccgtaagaaagaagggctctgaggaaaggcggaggccccataaagaggaggaggaagaggcgtattatcccccagcccctccaccttacagtgaaactgatagtcaggcaagcagagaacgacgtttgaaaaaaaatctcgcactcagtcgggagtcgttggtcgtttag

SEQ ID NO: 10182 - DNA, 591 bp, Artificial Sequence
  Description of Artificial Sequence: Synthetic coding sequence
atgtccagacggtctatgctcctggcttgggccctcccatcccttctgagactaggggctgctcaggaaacagaggatcctgcctgctgtagccccatagtgcctcgcaacgagtggaaggcccttgcctccgagtgtgcccagcacctgagccttcctctcagatatgtcgtagttagccatacagccggatcctcttgcaacaccccggcatcgtgccagcaacaagctcgtaatgtacagcactatcatatgaagaccttggggtggtgtgacgtcgggtacaacttcctgattggagaagatgggctggtttatgaggggaggggctggaacttcacaggcgcacatagtggccacttgtggaaccccatgagcatcggcatcagcttcatggggaactacatggacagggtccctacgcctcaagccattcgggctgcccagggcctgctcgcatgcggggtggcgcagggggctctccgcagcaactatgtgctcaagggccaccgcgacgtgcagcggacactttcaccaggaaatcagttataccatttgattcagaattggcctcactataggtctccttag

SEQ ID NO: 10183 - DNA, 1056 bp, Artificial Sequence
  Description of Artificial Sequence: Synthetic coding sequence
atggaggctttcgctcttgggcctgccagacgcggacgaaggcgcacgagagccgctgggtctctgctcagcagggccgcaatactgctgtttatctcggccttcttggtgcgcgtgccctcatcagttgggcatttggtccgcctccctcgcgcatttcgcctcactaaggattctgttaagattgtcggctctacctcgttccccgtgaaagcttatgtgatgctgcaccaaaaatctccccatgtactgtgtgtgacgcagcagctgcgtaacgccgagctgattgacccctctttccaatggtacggcccaaagggcaaggttgtgtctgtcgaaaacaggactgctcagatcacgagtactgggtcacttgtcttccagaatttcgaggagtcaatgagcggtatttacacatgtttcctagaatacaagccaactgtcgaagaaatcgttaagagactgcagctaaagtacgccatttacgcttaccgggaaccacattattactaccaattcacagctcgatatcacgcagctccctgtaacagcatatacaacatcagcttcgaaaagaaattactacagatactcagcaagctgcttctcgatctgagctgcgagatatccctcctcaaatctgaatgtcaccgggtgaagatgcagagagccggactacagaatgaacttttttttgctttcagtgtgtcttccctggatacagaaaagggccctaagcgttgcacagatcataattgcgagccctataaacgcctgtttaaggctaagaatctgatcgagagattcttcaaccagcaagtggagattcttggtcgccgtgctgagcaacttccacagatatattatattgaaggtactctgcagatggtttggattaatcgatgctttccgggttacggtatgaacgtgcagcagcaccccaagtgtcccgagtgctgtgtcatttgttctcccggatcttataaccccagagatgggatccactgtctacagtgcaactcctctctcgtgtatggagcaaaaacgtgcctgtag

SEQ ID NO: 10184 - DNA, 420 bp, Artificial Sequence
  Description of Artificial Sequence: Synthetic coding sequence
atggaaacgaacgtgtttcacctcatgctttgcgtcacatcagccagaacacacaaaagcacttcactgtgtttcggacacttcaattcctacccatccctgccgttaatccacgacctgctgctggagatcagtttccaactcagcgccccacatgaggacgcgaggttgaccccggaagagctggagcgcgcttctctcctgcaaatcctgccagaaatgctgggagccgaaaggggggatattttacgcaaagcagactcgtccacaaatatcttcaatccaagaggcaacttgcggaaattccaggacttctctggccaggatcccaatattttactgagccacctcctggctcgaatctggaagccctacaagaagcgagagaccccagactgtttttggaagtactgcgtgtag

SEQ ID NO: 10185 - DNA, 606 bp, Artificial Sequence
  Description of Artificial Sequence: Synthetic coding sequence
atggggtctggacgacgggctctgtccgcagtcccggcagtgctgctagtactcactctacctggcctgcctgtgtgggcacagaatgacactgagccaatagtgctggaggggaagtgtttggtggtctgcgacagtaatcctgctaccgactccaaagggtctagctcttcccccctcggcattagtgtgcgggctgcgaacagtaaagtcgctttcagtgcagtccgctctacaaatcacgagccaagcgagatgagcaataaaactaggattatctatttcgatcaaatcctcgtgaatgtcggtaacttttttactcttgaatccgtcttcgtcgcccctaggaagggaatctacagttttagctttcacgttattaaggtttaccagagccaaacaattcaagtcaacttaatgctgaatggtaagcccgtcataagcgccttcgctggggataaggatgtgactcgggaggccgcaacgaatggagtcctgctctacctggacaaagaagataaggtctacctgaagcttgaaaaggggaacctggtcgggggttggcagtactcaactttttcgggttttctagtttttcccctgtag

SEQ ID NO: 10186 - DNA, 264 bp, Artificial Sequence
  Description of Artificial Sequence: Synthetic coding sequence
atgaaggtgttgcgagcttggctgctgtgcttgctcatgctgggcctcgctctgagaggagccgcttcgcgaacgcaccgccacagcatggaaattcgtaccccagacatcaatccagcatggtatgcttctcgtggaattcgccctgtcggtaggttcgggcgaagacgagcaacactgggcgatgtacccaaaccagggttaaggcccagactcacgtgtttccccctcgagggaggcgcaatgagcagccaagacgggtag

SEQ ID NO: 10187 - DNA, 1098 bp, Artificial Sequence
  Description of Artificial Sequence: Synthetic coding sequence
atgcctggcggtaaaaaggtggctggcggagggtcatccggggctacaccaaccagtgcggctgctacagccccttctggagtcagaagacttgaaacttctgagggcacttccgcccagcgcgacgaggaaccagaggaggaaggagaggaggacctgcgagatggaggcgtgcccttctttgtcaaccgcggaggcctccctgtggacgaggcaacttgggaacgtatgtggaaacacgtcgcaaagatccaccccgacggcgagaaagtcgctcagcgcatacgaggggctacagatctgccaaagatacccattccttccgtgccgacctttcagccctcaacccctgtccccgagagactggaagccgtgcagcgctacatcagggagcttcaatacaaccataccggcacccagtttttcgagattaagaaaagtcgccctctcacaggtctcatggatcttgcgaaggagatgaccaaggaggcgctgcccattaagtgtctggaggccgtcatccttgggatatacctcaccaacagtatgcctacccttgaacgttttcccatctcttttaaaacttacttttcgggtaattacttcaggcatattgttctgggagttaacttcgcaggccgatatggggcactgggcatgtccaggagagaagatctaatgtataaacccccagcctttcggacgctgagcgagctggtgctggattttgaagcagcttatggcagatgctggcacgtactgaaaaaggtcaaactagggcagtctgtgagccacgatccccattcagtggaacagattgagtggaagcacagcgtcttggacgtggagcggctgggtcgagatgactttagaaaggaactcgaaagacatgcacgggatatgaggttgaaaatcggtaagggaaccggccctccatctccaactaaggatcggaagaaggacgtgtcgtcaccacagagggcacagagctctccccatagaaggaactccagatctgaacgaagacccagcggggataagaaaacgtcagaacctaaagccatgcctgacctcaatggctaccagatccgagtttag

SEQ ID NO: 10188 - DNA, 1377 bp, Artificial Sequence
  Description of Artificial Sequence: Synthetic coding sequence
atggcttgggcaagtaggttgggcctgctactggcgctccttcttcctgtggttggggctagcacccccggtacggtggtacggcttaacaaagcagccctttcatacgtgagcgaaatcggtaaagcacctctgcagagagctcttcaagtaaccgttccacactttctggactggtccggagaagcattacagccaaccaggataagaatactgaacgtacacgtgccccgattgcaccttaagttcattgccggatttggagtgcggctactcgccgctgctaatttcaccttcaaagtatttcgcgcacctgagcccttagaactgactcttcctgtggaactgctcgctgatacaagagtaacccagtctagtattcgaaccccagtggttagcattagtgcttgcagcctgttcagcggccacgcgaacgaatttgacgggtccaactccacttcccacgctctgctggtactcgtccaaaagcacatcaaagcagtccttagcaacaaactatgtctttcaatcagtaacctcgttcagggggttaacgtgcatctgggtactctaattgggctgaatcctgtgggtcccgagagtcagatcaggtatagtatggtaagcgtcccaaccgtgaccagcgattatattagtctcgaggtcaatgcagtcctttttttgctggggaagcctatcatactacctacggacgccactccgtttgtccttcccagacatgtgggaacagaaggaagcatggctaccgtggggctctctcagcaactgtttgattcggccctgctactcctgcagaaggccggagccctaaacctggacattacgggccagctgcgctccgacgacaatctcctgaacaccagtgccctgggcagactcatccctgaagtggctaggcagttcccagagcctatgccagtggtgctcaaggtccgactaggcgctacacccgtggccatgttgcacaccaacaacgcaacactgagattgcagcccttcgttgaagtgttggctaccgcatccaacagtgccttccagtccctgttctcccttgatgtggtggtaaatctgaggttgcaactgtcagtgtccaaagtgaaactgcaaggtacgactagcgtgttaggcgacgtgcagctaaccgtcgccagtagtaacgtggggttcatcgatactgatcaagttcgtacccttatgggaacagtgtttgaaaaacccctattggaccatctgaatgccctgctcgcaatgggcatcgccctgccaggggtcgtcaaccttcactatgttgccccagagatttttgtgtacgaggggtatgttgttattagcagtggcctgttctatcagtcatag

SEQ ID NO: 10189 - DNA, 1815 bp, Artificial Sequence
  Description of Artificial Sequence: Synthetic coding sequence
atgatgcgtgcggtatgggaggctttggccgcactcgcggctgtggcttgtctggtgggcgctgtgcggggaggcccaggcctgagcatgtttgccggacaggcggctcagccggatccatgctcggatgagaatggccatccccgacgttgtattccggatttcgttaacgcggcattcggcaaggatgttcgcgtgagttccacatgcgggcgaccacctgctcgctattgcgtggtttccgaacgtggggaggagagactcaggtcctgccacttatgtaatgcatcggatcctaagaaggcccatccgcctgcctttcttacagacctgaacaatccacacaacttgacctgctggcagtccgaaaattacctacaattcccacacaacgtgaccttgacgttatccctgggaaagaaatttgaggtgacttacgtgtccctccagttttgttcccctcgtccagaatccatggcgatctataaatcaatggactatgggagaacttgggtgccgtttcagttttactccacacagtgtaggaaaatgtacaatagaccccatcgcgcaccaataacaaaacaaaatgagcaagaggctgtgtgcactgactctcacaccgacatgcgcccactgagtggcggtttaattgccttctctaccctggacgggcgtccttccgcccacgacttcgataactcacccgtcctgcaagactgggtgactgccactgacatcagggtggccttcagccggctccacactttcggcgatgaaaatgaagacgattcagagctggctcgggattcctacttctatgccgtgtccgatctgcaggtcggaggaagatgcaaatgtaacggtcatgccgctaggtgcgtgcgcgaccgagacgatagcctggtatgcgattgccggcacaataccgccggaccggagtgcgacaggtgcaaaccgtttcactacgaccggccatggcagcgcgctactgcaagagaggccaacgagtgcgtggcctgcaactgcaatctgcatgctaggcggtgtcgattcaacatggagctgtacaagctctccggacgcaagtcagggggtgtctgcctcaattgccggcataacacagctgggcgtcattgccattattgtaaggagggatattatcgcgacatgggcaagcctatcacacatcgcaaagcttgtaaggcatgcgactgccaccccgtgggggcagcgggaaagacctgtaatcagacgaccggccagtgcccatgcaaggacggagtgactggaattacttgtaaccgttgtgctaaaggctatcagcagagccgaagcccaatcgctccttgcatcaaaataccggtcgctccgccaacaacagccgcaagctcagttgaggagcccgaagattgcgactcctattgcaaagcaagtaaaggtaagctaaagatcaatatgaaaaaatattgcaaaaaggactacgctgtgcagattcatattttaaaggccgacaaggcaggtgattggtggaagtttacagtcaatataatctctgtgtacaagcaaggaacctcgcgtattaggagaggcgatcaaagcttatggatccggtccagggatatcgcgtgcaagtgtccaaagattaagcccctaaagaaatacttgctcttaggtaatgccgaagacagccccgatcaaagtgggattgtcgccgataaaagctccttggtgattcagtggagagacacctgggccaggcgactgcggaagttccagcagagagaaaaaaaaggcaagtgcaaaaaggcctag

SEQ ID NO: 10190 - DNA, 675 bp, Artificial Sequence
  Description of Artificial Sequence: Synthetic coding sequence
atgcctggaagagctccgctgagaacagtgcctggggctctcggagcatggttgctggggggactctgggcctggaccctctgcggtctgtgctcactgggggcagtcggggcaccacgcccatgccaggcccctcagcagtgggagggacggcaggttatgtaccaacaatcctccgggcgtaattctcgggcactactatcgtatgacggattgaaccagagagtccgagtgctggacgaaagaaaagccctcatcccttgtaaaaggctttttgagtacatcctgttatataaagatggtgtgatgttccagatcgaccaggccacgaaacaatgcagcaagatgacactgacccaaccatgggatccgctggacatacctcaaaattccacttttgaggatcagtattctatcgggggtccgcaggaacaaatcactgtgcaggaatggtccgatcggaagagtgcccgaagttacgagacttggatcgggatctataccgtcaaggattgctatcctgtgcaggaaacgttcaccatcaattacagtgtcatcctaagtacccggttcttcgatattcagctgggcattaaagacccaagcgtcttcacacccccttctacttgccagatggcccagctagaaaagatgtccgaagactgcagctggtag

SEQ ID NO: 10191 - DNA, 5105 bp, Artificial Sequence
  Description of Artificial Sequence: Synthetic coding sequence
atgggattccttccaaaactattgctattggccagtttttttcctgcgggacaggctagctggggagtgagctccccccaggatgttcaaggcgtaaagggaagttgcctgctcatcccctgtattttctcttttccagctgatgttgaggtgcctgatgggattacagccatttggtactatgactacagcggtcagaggcaagtggtgtcacacagcgccgatcctaaactggttgaggctaggttcagggggcgaaccgaattcatgggcaatcccgaacaccgcgtctgtaacttacttctgaaagacttgcagcctgaggacagcgggtcatacaatttcaggtttgagatttctgaggtaaatagatggagtgatgtcaaaggcactctggttaccgtaacggaggagccgagagtccccacaatcgctagccccgtcgaactgcttgagggaactgaggtggactttaattgcagcaccccctacgtgtgtctgcaggaacaggtgagactccaatggcaaggccaagacccggcaaggtcagtgacattcaactcccagaaattcgaacccaccggcgtcggacacctggagaccctgcatatggcaatgtcatggcaggaccacggtcgtatcctacggtgccagctgagtgtggctaatcaccgggctcaatctgagatacatttacaggtgaagtacgcccctaagggcgtgaagattctgctatcaccctcagggcgaaacatacttccaggcgagttggtgactctcacctgccaggtcaactcgagctacccggctgtaagctctatcaagtggctgaaggatggggttcggttacagacaaaaacaggggtgctgcatttaccccaggctgcttggagcgatgcaggggtctacacttgccaggctgagaacggtgttgggtctctggtgagccctcccatttcgctgcatattttcatggcagaggtgcaggtatctccagccggtcccattctcgaaaaccagactgttacactcgtgtgcaacacaccaaacgaagccccatctgatttgaggtacagctggtacaaaaatcacgtgctgcttgaagatgcacactctcatacacttcgccttcatcttgcaactagggccgataccgggttctacttttgcgaagtccaaaacgtgcacggctccgaacggagcggtcccgtcagtgtggtggtgaatcacccccctttgacccccgtgctgaccgcttttctcgaaacccaggccggtctggtggggatattgcattgttcggtcgtatccgaacctctggcgactctcgtactgagccacggtgggcacatacttgcttccacatcaggcgattccgatcattctcctagatttagcggcacatccgggccaaactctcttaggctggagatcagagacctggaggagacggactcaggcgagtataaatgttctgcaacgaattccctgggcaacgccacgtcaactttggacttccacgcaaatgcagcacgacttttgattagtcccgcagcggaagttgtcgagggacaggcagtcaccctcagctgccgatccggcttgtcgccgacacctgacgcccgtttttcatggtacttaaacggcgctttgctacacgaaggacctgggtcttccctcctgcttcccgcagcatcttcaacggatgctggctcctatcattgccgagccagggacggacattcagccagtggacctagtagccctgcagttctgaccgtgctttatccccctcgccaaccgacattcaccacccgtctcgatctggatgccgctggtgccggagcaggccgaagaggattactattgtgccgggtggacagtgatccacctgctaggctgcagttgttgcacaaggatagagtggtggctacatcacttccctcaggaggaggatgttctacctgcggcggttgcagccccaggatgaaagtgactaaagctcccaatctcctcagggtggaaattcataacccactgctggaggaagaaggcctgtatttatgtgaggccagcaacgccttaggaaatgcgtccacctccgcgacgtttaacggccaggccactgtgcttgccattgcccctagccacacacttcaggaaggaacggaggctaatctgacttgcaatgttagtagagaagccgcagggagcccagcgaatttctcatggtttagaaacggtgtgctttgggctcagggaccattggaaaccgtaactttgctgcccgtcgctaggacagatgctgctctctacgcctgtcggatcctgacagaggccggagctcagttgtccacgccggtgctactgtccgttttgtatcccccagatcgccctaaattgagcgccctcctggacatgggtcaggggcacatggcactatttatttgtacagtggacagccggccactcgccctcctggctttgttccatggcgagcatcttctagccacatcacttggtcctcaggtacccagtcacggcagatttcaggctaaagctgaggccaattccttgaagctggaggtgagagaattaggcctgggcgactcggggtcttaccgatgcgaggctactaatgtgctaggctcttccaatacttctctgttcttccaggtacgcggtgcttgggtccaagtgtcacccagtccagagctgcaagagggccaagccgttgtgttatcttgtcaggttcacactggtgtgccagaggggacatcctaccgatggtatagagatggccagccccttcaggagtcaacctcggcaacgctgcgctttgcagctattaccctcacccaggcaggtgcttaccactgccaggcccaggccccagggtcagctacaacgtccttggctgcgcctatttccttacatgtctcatacgctcccaggcacgtgactctgacaacactgatggatacaggccctgggagactgggactccttctgtgccgagtagactcagaccctcccgctcagctgaggttgctgcacggcgacaggctagtggcatctacactgcagggcgtgggaggtccagaaggctcttctcccagactgcacgtagccgtagcccctaatactttaaggctggagattcacggagctatgctggaagacgagggcgtctacatctgcgaggcttctaacacactgggccaagcttccgcaagtgccgacttcgacgcccaggccgtcaacgtccaggtgtggcctggagcaaccgtcagggagggccagttggtaaatctcacttgcctggtgtggacaacccaccctgcccagttgacttacacttggtaccaagacggtcaacaacggttggacgcgcactctatccctctgccaaacgtgaccgtgagggatgcaacttcctatagatgcggtgtcgggcctcctggacgcgcaccacggctctcccggcctatcaccctggacgttctatacgctccaagaaacctacgcctgacctatttgttggaatcgcatgggggacagctggcactggttctgtgtaccgtcgattcccgaccacctgctcagcttgctctctcccacgcaggccgattgctggccagctccactgccgcttctgtgcctaacactctcaggctagagcttcggggacctcagcccagagatgagggtttttacagctgttccgccaggagcccccttggccaggccaatacctcccttgagctgcggctggaaggagtccgtgtgatcctggcccctgaggcagccgtgcccgaaggggctcccatcaccgtaacatgtgcagatccagctgcccatgctcccactctgtatacatggtatcacaacggacgctggctgcaagaaggccctgccgcttccctctccttcctggtagctacccgcgctcacgccggtgcctattcctgtcaggcacaagacgcacagggaacaagaagctcgaggccagcggctctacaggtgctctacgctcctcaggacgcggtgctgtcaagctttagagacagcagggcccgaagcatggccgtgatacagtgtaccgtagacagcgagccacctgcagagctggccttatcccacgatggaaaggtccttgctaccagttccggcgtgcacagcttagcgagtggcaccggccacgtccaagtcgcaagaaatgcactgagactgcaggtgcaagacgtgcctgccggtgacgacacttacgtttgtacagctcagaatctattggggagcatatctacaattgggaggttgcaagtggaaggcgcacgggtagtcgccgagccagggctggatgtgcctgagggcgcagccctcaacctctcctgtcggttactgggcggtcctggcccagtcgggaacagcactttcgcgtggttctggaacgatcgtcggctgcacgccgaacccgtgccaaccctcgcatttacacatgttgctcgggcacaggccggaatgtatcactgtctcgcagagctaccaactggggctgccgcttccgcgccagtcatgttgcgggtgctgtatcctcctaagacacctaccatgatggtgttcgtggagcccgaggggggacttagggggattctcgactgtagggtggacagcgaaccgttggccagtttgacattgcaccttggctctcgactagtcgcgtcctcccagccgcagggtgcacctgctgaaccacatatccacgtgttagcgagccccaatgcactgcgggtggacattgaagccttgagacctagcgaccagggcgaatatatctgctcagcatcgaacgtattagggtcagcctctacgtccacatacttcggcgtcagggcactccaccggttacaccagttccaacagctgctgtgggtacttgggctactggtcgggctactcctcttgctgctcggtcttggcgcttgctacacctggagctctctgatattgatgcagccccacgtccgacctcagcccgtccctcatccgtgggccgaccaatggtgttgcctgcctagcggaggggagtccggacaaaatctata

SEQ ID NO: 10192 - DNA, 708 bp, Artificial Sequence
  Description of Artificial Sequence: Synthetic coding sequence
atgacagtcctcgccccagcgtggtctcccaccacctatctgctgctgctgcttttattaagctccgggttgagtggtacacaggactgttcttttcaacacagtcctatatcctccgactttgccgtcaaaattagggaattgagcgattacctgctccaggactatccggtgacggtggcctctaacctgcaggacgaggagctttgcggaggcctctggcggcttgtattagcacagcggtggatggaacgccttaagaccgttgccggaagtaaaatgcagggtctgctggagcgggtgaacaccgagatccacttcgtgaccaagtgtgccttccaaccccctccatcctgtctacgttttgtccaaaccaacatatcccgactgttgcaggaaacatccgaacagctggtcgccctgaagccttggattactcgccagaacttctccaggtgtcttgagctccagtgccagccagactcatctaccctgccaccaccttggtcacctcgccctctggaggccactgcacctaccgccccacaaccacctctactcctgctactgttgctccccgtcggattactcctactcgctgccgcttggtgtctgcactggcagcggactcgcaggagaactccaaggccgggtgaacaggtccctcctgtgccctccccccaagaccttttgcttgtggagcattag

SEQ ID NO: 10193 - DNA, 3297 bp, Artificial Sequence
  Description of Artificial Sequence: Synthetic coding sequence
atgaccttacaagaactcgttcacaaagccgcatcttgctacatggacagagtggcagtgtgcttcgacgagtgcaataatcaactgcccgtatattacacctacaagacagtggtgaacgcagcttccgagctttccaactttctgcttctccactgtgacttccagggaatcagagaaattggcctttattgtcagccaggtatcgatcttccctcgtggatactcggcattctgcaggttccggctgcatatgttcccattgaacctgatagtccaccatcgctgagcacccatttcatgaaaaagtgtaatctcaaatatatcctcgtggagaaaaagcagatcaacaagttcaaatcttttcatgagacccttctgaactacgacacattcactgttgaacacaacgatttggtgctatttagattacactggaagaacactgaggtgaatctgatgctaaacgacggcaaggagaagtacgaaaaggaaaagatcaaatccatatcaagcgagcatgttaacgaagagaaagcagaggagcacatggacctgagacttaagcactgtcttgcctacgtcctgcataccagcggtacaactggtatacccaagatcgtgcgcgttccgcataagtgtatagtgcctaacattcagcactttcgggttttgttcgacatcacccaggaagatgtactgtttcttgcttcaccgctcacattcgatccgtccgtggtggagatctttttggcactgtcatctggtgcaagtctcctgatcgtgcctacctctgttaaattactgcctagtaaactcgctagtgtgctcttttcacaccaccgtgtgactgtcttgcaagccactcccacccttctcagacggttcggaagtcaattgatcaaatctactgtactctccgcaaccacctcacttcgtgtcctggctctcggaggtgaggcctttccttcgctgactgtgctaaggagctggaggggcgagggaaataagacacagatcttcaacgtgtatggcatcacagaggtttcatcatgggctaccatctacagaattccagaaaaaactttaaattctactctgaagtgcgagctccccgtgcaactggggtttccactgttagggacagtcgtcgaagtaagggacacgaacgggttcactattcaggaaggaagtggacaggtcttcttaggcggtcgaaatcgagtatgctttcttgacgacgaagtgaccgtacccctgggcaccatgagagcaacgggggacttcgttaccgtcaaagatggtgaaatcttttttttagggaggaaagactcacagattaagcgtcatgggaaacggctgaacattgaactggtgcagcaggttgcggaggaattgcagcaagtggaatcttgtgctgtcacctggtataaccaggaaaaattgattctgttcatggtcagcaaggatgcctcagtgaaagagtatatttttaaggaactccagaagtatctcccgtctcatgcagtgccagacgagctggtgctgattgactccttaccattcacctcccatgggaagattgacgtgtctgagctgaataaaatctaccttaactacattaacctcaagagcgagaacaaactgtctgggaaggaagatttatgggaaaaactgcagtatctctggaagagtactcttaacttaccagaggatctcctgcgcgtgccggatgaaagccttttcctgaactctgggggagactcacttaaatccattcgcctcctgtcagaaatcgaaaaattggtaggcaccagcgtacccggactattggaaattatactctcttctagtattctggagatatacaaccacatcctgcagaccgtagtgcccgacgaggacgtgacttttcggaagtcttgtgccaccaagagaaagttgtctgatattaaccaggaagaggcctctgggacgagcctacatcagaaagctattatgacatttacctgccacaacgagattaacgccttcgtggtgctctctagggggtcccagattttgtcactcaattccacgcgcttcttgactaaattgggacattgttcttcagcctgtccctccgatagcgtaagtcagaccaacatccagaatttgaaaggcctaaactctcctgtgcttattgggaaaagtaaggatcctagctgtgttgctaaggtgtcagaggagggtaagcccgctatcggtacacagaagatggagctgcatgtgcggtggaggagtgacactgggaagtgtgttgacgccagccctttggttgttatccctaccttcgacaaaagcagcacaaccgtctatattggtagtcactcccatcgtatgaaggctgtggatttttacagcggtaaggtaaaatgggaacagattctgggggatcggatcgagtctagcgcatgtgttagcaagtgcggcaattttatcgtggtagggtgctataacggattagtttacgtgcttaaatcaaattcaggggagaaatactggatgttcaccacagaagacgccgtcaagtcatctgcgacaatggaccccaccaccggacttatctacatcggtagtcatgatcagcacgcatacgctctcgatatctatcgtaaaaagtgcgtgtggaaatcgaagtgcggcggtactgtgttttcctctccctgtctgaacctgatccctcatcatctgtattttgccactctggggggactcctgcttgccgtgaacccagcaactggcaacgtgatctggaagcattcttgcgggaagcccctgtttagcagccctcagtgttgcagtcagtatatctgtataggctgcgtggacggtaacctactgtgtttcacacacttcggagaacaggtttggcagttctccacatcagggccaattttcagttccccctgtacttctccttcggaacagaagatttttttcggaagtcatgactgtttcatttattgttgtaacatgaaaggccaccttcagtggaagttcgaaaccacttccagagtctacgccaccccttttgcgttccataattataatggatctaatgagatgctgcttgcggcagcttccaccgatgggaaagtgtggatactcgagtctcagtccggtcaacttcaatctgtgtatgaactccctggagaggtgtttagttcccctgtagtacttgagagtatgcttatcatagggtgtagggacaactacgtgtactgtctggacctcctcggtggcaatcagaagtag

SEQ ID NO: 10194 - DNA, 774 bp, Artificial Sequence
  Description of Artificial Sequence: Synthetic coding sequence
atggcgtctaaaatcggttcccgaaggtggatgctgcaactgattatgcagctgggatcagtgctcttgaccagatgtcctttttggggctgtttttcccagcttatgctctatgccgaaagagctgaagccagaagaaaacctgatatacctgtgccatatctgtattttgatatgggcgctgccgtgctgtgtgcctcatttatgtccttcggggtgaaaaggcgttggttcgccctaggggcagcactgcaattggctatttccacgtatgccgcttacattgggggatatgtgcactacggggattggctgaaagtgcggatgtacagtcgcacagtggctatcatagggggattcctggtcctcgcttccggcgctggcgagctgtacagacgtaagccacggtctcggagcctccaaagtactggccaggtatttctgggcatctacctgatctgcgttgcatactcactccaacattcgaaggaagatcggctcgcatacttgaatcatctgccaggcggagagctgatgattcagttattctttgtgctctacggaatcttggccctggcattcttatctgggtactacgtgactctcgcagctcagatcctcgcagtgttgcttcccccagtgatgctcctcattgacggtaatgtcgcttactggcataatacccgcagggtagaattttggaatcagatgaagttgctgggcgagtcagtcgggatcttcggcaccgctgtgattctggcaacagatggatag

SEQ ID NO: 10195 - DNA, 2118 bp, Artificial Sequence
  Description of Artificial Sequence: Synthetic coding sequence
atggagaagccacgctccatcgaggagacaccgtctagtgaaccgatggaagaggaggaagatgatgacttagagctgtttgggggatacgactcattccggagctacaattcgtcggttgggagcgagagtagtagctacctggaagagtccagtgaagccgagaatgaagatagagaggctggcgaattgccgacatccccactgcacttactgtctcccggaaccccccgttccctcgatggtagcgggtccgagccagccgtgtgtgagatgtgtgggattgtaggcaccagagaagcgttcttttccaagaccaagcgcttttgttccgtgagctgctcacggtcttacagttcaaattcgaagaaagcctccattctcgcaagactccagggaaagccacccaccaagaaagctaaggtgctgcacaaggctgcttggagtgcaaagattggcgcatttctacactctcagggcaccgggcaactcgcagatggcacgcccacaggccaggatgctctcgttctgggcttcgactggggcaagttcctaaaggatcatagttataaagcagccccagtttcatgtttcaagcatgtgcccctttatgatcagtgggaagacgtgatgaaaggcatgaaggttgaagtgctcaatagtgatgctgttctacccagtcgtgtgtactggattgcttcagtaattcagacagccggttacagggtgctgctgcggtatgagggatttgaaaacgacgcttcccacgatttttggtgtaatctagggacggttgacgtccatcccatcggctggtgcgccatcaactcaaaaatcctcgtgcctccacggaccattcacgccaagtttaccgactggaaaggctacctgatgaagagactggtggggtctagaactctgcccgttgactttcacatcaagatggttgagtctatgaagtacccctttaggcaaggcatgcgcctggaagtggtggataaatcacaggtgtcacgcacgagaatggccgtcgtcgacacggtgatagggggtcggctgcgtctgctctatgaggacggggattccgatgacgacttctggtgccacatgtggtccccattaatccaccctgttggatggtcaagacgggtcggccacggaattaaaatgagcgagcggcgttcggatatggctcatcaccccacttttagaaagatatactgtgatgccgtaccttacctcttcaagaaggtccgagccgtgtatactgagggcggatggtttgaagagggcatgaagttggaggccatcgacccattgaatctgggcaacatctgcgttgctactgtctgtaaggttctcctggatggatacctgatgatatgtgtggacgggggacccagcacagatggcctcgattggttctgttatcatgcctcaagtcatgccatctttcccgcaaccttttgtcaaaagaatgacatagagctgacccctccaaaaggctacgaggctcagacttttaattgggagaattacctggaaaaaaccaaatctaaagccgcaccttcccggctgtttaacatggattgtcctaatcacggattcaaagtcggcatgaagctggaagctgtggatctgatggagcctagactgatctgcgttgccaccgtgaagagggtcgtgcaccgtctcctgtcaatccactttgatggatgggatagcgaatacgaccaatgggttgactgcgagtcccctgacatctaccctgtgggctggtgcgaactgaccggctaccagctgcagcctcctgtcgctgcagaacctgccacgcccctgaaggccaaggaggccaccaagaagaaaaagaaacagttcggcaaaaagagaaagaggatcccacccaccaagactcggccactcaggcaagggagtaagaagccccttttagaggatgacccccaaggtgccagaaaaatcagcagtgaacctgtgcctggcgaaataatcgccgtgcgggtgaaggaagagcacctggacgtggcctcaccggataaagctagctctccagaactgcccgtcagcgtagagaacattaaacaggaaacagatgattag

SEQ ID NO: 10196 - DNA, 2103 bp, Artificial Sequence
  Description of Artificial Sequence: Synthetic coding sequence
atgtcccgccgtacacggtgcgaggatctcgacgagctacactatcaggacaccgactctgacgtgcctgaacagagggacagcaagtgtaaagtcaaatggacccatgaagaagatgagcaactgagagcgctggtccgacagttcggccagcaagactggaagtttttggcttctcattttcccaacagaaccgaccaacagtgtcagtatcggtggctgagagtgctgaacccagacctggtgaaaggaccctggacaaaagaggaagatcagaaagtgattgagttggtgaagaagtacggcaccaaacagtggactttgattgctaagcacctgaagggacgacttgggaaacaatgcagggagagatggcataaccacctaaatccagaagtgaagaaatcatgctggacagaagaagaagacaggataatctgcgaggcacataaggtactgggtaatcgctgggctgaaatcgcaaagatgctgcccggacgaaccgacaatgccgtgaagaatcattggaacagcactatcaaaaggaaggtggatacgggcggattccttagcgagtccaaagactgcaagccccctgtctatttgctgctcgaactagaagacaaggacggactgcagtccgcacaacccacagagggccagggatctttactcaccaactggcctagcgtgcctccaacaattaaggaagaagagaactccgaagaggagttggcggcagccactacctctaaagaacaggagcctatcggtaccgatcttgatgctgtgagaacccctgagccccttgaggagttcccgaaacgggaagatcaagagggtagtcctcctgaaacatccttgccgtacaagtgggtagtggaggcagctaatcttctgattccagctgtagggtctagcctgtccgaagcgctggacttgattgagagcgatcctgatgcatggtgcgacttgagcaagtttgacctacccgaggagccttcagctgaagactctattaacaattctctggtacagctgcaggctagccaccagcaacaggtgttacccccacgccagccatctgctctggtaccatctgttaccgaataccggctggatgggcacaccatttccgatctcagtcggagtagtagaggagagctgatacccatcagccccagcaccgaagtgggcggatctggcatcggcaccccgcctagtgtcctaaagcgacagcgcaagcggagggtggccctgtctcccgttacggagaattctacaagtctcagcttcctcgacagttgcaactctttgacacccaagtccacaccagtgaaaacactgccattctcccctagccaatttctgaatttctggaataagcaggacactttggagctagagtcccccagccttacctccacacctgtctgttcacagaaagtggtggtcaccacacctctccatagagacaaaacaccactgcatcagaagcacgccgctttcgtgacacctgatcagaagtacagcatggacaacacaccccatactccaaccccatttaagaacgccttagaaaaatacgggcctttgaagcctttgccacagaccccccatctggaggaagacttaaaagaagtgcttcgtagtgaggctggtatcgaacttattattgaagacgacatacgccctgagaaacaaaagagaaagcctggcctcaggcgctcaccaattaagaaggttagaaagagcctggccctggacatcgtcgacgaggatgtcaagctgatgatgtcaacactgcctaaatctctgtctctgccaacaacagctcctagcaattccagctcgctcacactatcaggcatcaaggaggataattcacttctgaaccaaggtttcctgcaggctaagcccgagaaagcagcggtcgcccaaaagcctcgctcacacttcacaacccctgcccctatgagcagtgcgtggaagacagttgcctgcgggggtacacgcgaccaacttttcatgcaggagaaggcacggcagctcctaggcaggcttaagccatcccacactagtcgtactcttatcctgtcatag

SEQ ID NO: 10197 - DNA, 528 bp, Artificial Sequence
  Description of Artificial Sequence: Synthetic coding sequence
atgttaagaacagaggtgccgcgtctccccaggagtaccacagccatcgtttggtcgtgtcacctcatggcgacagcgtcggcaatggctgggccaagctccgagacaacctcagaagagcagctgataacgcaagaacccaaagaggctaattcaaccacatcacagaagcaaagtaagcagcgtaagagaggccgacatgggccacggcgatgtcactcaaactgccgcggtgattcgtttgctacatatttcagacgagttctgaagcaggtccaccaaggcctcagtctctccagagaagccgtgtctgtgatggactctctggttcacgacattctggatcgcatcgccaccgaagcgggacgattagctagatccaccaagaggcagacaattaccgcgtgggagacccgtatggctgtgcggctgttgctgcccggacagatgggcaagcttgccgagtccgaggggaccaaggccgtcctcagaacaagcctatatgctattcaacagcagcggaaatag

SEQ ID NO: 10198 - DNA, 624 bp, Artificial Sequence
  Description of Artificial Sequence: Synthetic coding sequence
atggctccgtttgaacctctcgcatcaggtattctactgctactgtggctcatagcaccgtcacgcgcatgcacgtgtgtgccaccccacccacagacagcattctgcaacagcgacttggtgatcagggcaaaattcgttggcacacctgaagttaatcagaccacgctgtaccagcgatacgagattaagatgaccaaaatgtacaaaggatttcaggccctcggcgatgccgcagacatcagattcgtctacacacccgcaatggagtctgtgtgcggttactttcacagatctcataatcgaagcgaagagtttttgattgccggtaagctgcaggacggcctcctgcacataaccacatgtagctttgtggccccatggaacagcctgagcctggcacagaggcgaggctttacaaaaacttatacagtggggtgcgaggagtgcaccgtctttccatgcctgtctataccctgcaagctacaatcaggcacacactgcttatggacggatcagttgttgcagggttctgagaaggggtttcagtctcgccaccttgcttgtctacccagagagccaggtctgtgtacatggcagtctcttcggagccaaatcgcctag

SEQ ID NO: 10199 - DNA, 1686 bp, Artificial Sequence
  Description of Artificial Sequence: Synthetic coding sequence
atggcagatcacaaccccgactccgacagcactccgaggacgcttctgcgcagggtccttgacaccgcagacccacgtactccaagacgccctagatctgcaagggcaggggctcggcgtgcactgttggagacagcctcccctcgtaagctgtcaggtcagacacgcactatcgcacgtggcagatctcatggagctagatcagtgggacgctcagctcacatacaggcctctgggcacctggaggaacagactcccaggaccctgttgaagaacatactgctcacagcgcctgagagctcaattcttatgccggagagtgtagtaaagcctgtaccagctccgcaggcggtgcaaccgagccgacaagaatcaagctgtggctcgcttgagttgcaactgccagaactggagcctccaaccactttagcccctggactacttgcacctggtaggagaaagcagcgacttcgcctgtctgtcttccagcagggcgtggatcagggcctgagcctctcccaggaaccccagggtaacgcagacgcctctagcttgactcggagtctgaatttgacattcgccacaccgctgcagccccagtctgttcagagacctgggctggctagaagaccacccgctcggagagcggtagacgtgggtgcttttctgcgcgacctgcgcgatacgagcctggccccacccaatatcgttctggaagatacacagcccttttctcagcctatggtgggaagtcctaacgtctatcattccctcccttgcacccctcataccggcgctgaggatgccgagcaagcagccggtagaaagacgcaatcgtccggccctggccttcagaaaaacagtcccggtaagcccgctcagttccttgccggagaggctgaagaggttaacgcctttgccttaggctttctgagcacttcctccggtgtctccggcgaggatgaagtggaaccactccacgacggggtcgaggaagcggagaaaaagatggaagaagagggagtgtcagtgtctgagatggaagctacaggggctcagggacctagccgcgttgaagaagctgagggacacaccgaggttaccgaggccgaaggaagtcagggaacagcggaagcagatggacccggtgctagtagcggggacgaggacgcctccgggagggccgctagtccggagagcgccagctctacccctgaaagtctgcaggctaggcgacaccaccagttcctggaaccggctccggcaccaggagccgctgtgctctcatctgagccagctgagcccctcctcgtgagacatcctcctcggccaagaacgaccggccctcgcccaaggcaagatccacataaggctggcctctcccactacgtgaagctctttagtttctacgccaagatgcccatggagcggaaggcactggaaatggttgagaagtgcctggacaagtactttcagcatctctgtgatgaccttgaggtcttcgcagcgcatgcaggaaggaaaacagtgaagcccgaagaccttgaactgctgatgaggaggcagggcttggtgactgaccaggtttcgctccacgtgttagtggagaggcacctccctttggaataccgtcagctcttgattccgtgtgcctattccggcaattctgtcttccctgcacaatag

SEQ ID NO: 10200 - DNA, 1134 bp, Artificial Sequence
  Description of Artificial Sequence: Synthetic coding sequence
atgacagacgatgagtcagagtcagttttatcagattcacatgagggctcagagctggagctaccggtaatccagctttgtggactggtcgaggagctgtcatacgtcaactctgcactcaagaccgaaactgaaatgtttgaaaaatactacgccaagcttgagccacgggatcaacggcctcccaggctgtccgaaataaaaatctcagcggctgactatgcacagtttagggggaggcggagaagcaaatctcgcacgggtatggatcggggagtcggtctcactgccgaccagaagctggagctcgtgcagaaggaggtcgcagatatgaaggatgacttgcgccacacaagagcaaatgccgagagggatctgcagcaccacgaggccatcattgaggaggcggagatccggtggagtgaagtttcaagagaggtccacgaatttgaaaaggatattctgaaagcgattagcaagaagaagggcagcattttagccacgcagaaggtcatgaagtacattgaggacatgaatcgcaggcgggataacatgaaggagaagctccgtctcaaaaacgtgtcccttaaagttcagaggaagaagatgcttttgcagttgcgacaaaaggaggaggtgagcgaagccctgcatgacgtggacttccagcagcttaagatcgagaacgcacagtttctcgagacgattgaggcacgcaaccaggagctgacgcagctgaagttgagctccgggaacactctgcaggtgctaaatgcctataaaagtaaactgcacaaagccatggaaatctacctgaatctggacaaggagatcctcctccggaaagagttgctagagaagatcgagaaagaaaccctccaggtggaggaggaccgcgcaaaggctgaagcggtaaacaagcggttacgcaaacagcttgccgaatttcgcgctccccaggtgatgacctacgtacgggaaaagattttgaatgctgacctggagaagagcatcaggatgtgggagaggaaagtggagatcgccgaaatgtctcttaaaggccaccgaaaagcctggaatagaatgaaaatcactaacgaacagctgcaggctgactaccttgctggaaaatag

SEQ ID NO: 10201 - DNA, 1548 bp, Artificial Sequence
  Description of Artificial Sequence: Synthetic coding sequence
atggaggcacgggaacccggtaggccaacgcctacctaccacttagttcctaacacctcgcaatcgcaggtagaggaggatgtgtcatcccctccacagcggagcagcgaaaccatgcagcttaagaaggagataagccttctaaacggcgtttctcttgtggtggggaatatgattggcagcggtattttcgtctctcccaaaggagtcctggtgcatactgcgtcctacgggatgtcattaatagtctgggcgattggtggactatttagcgtagttggcgcactgtgctacgctgagcttggaactaccattaccaaaagcggtgccagctatgcttacatcctagaggcttttgggggttttatcgctttcattcgactctgggtctctctccttgtggttgagcccacgggtcaggcaatcatcgctattacctttgcaaattacataatccaaccctcctttccatcctgtgatcctccttacctggcatgccgcctgttggctgccgcttgtatctgtctgctgacatttgtgaattgcgcctatgtcaagtggggcaccagagtgcaggacactttcacgtatgccaaggttgtcgcccttattgccatcatagttatgggcctggtgaagctgtgccaggggcactcggagcacttccaagatgccttcgaagggtcctcttgggacatgggcaacttgtcccttgcactctattctgcgctcttcagctatagtggctgggatactctgaattttgtcacagaagagatcaagaatcccgaacgaaacctaccactggctataggaatctctatgccgatcgtgaccctgatttacatcctgaccaatgtcgcttattacacggtactgaatattagcgacgtacttagctctgacgctgtggccgtaacattcgcagaccaaacattcggtatgtttagttggaccattcccatagcagtcgccctgtcttgtttcggtggtctgaacgccagtattttcgcatccagcagactgttcttcgtcggcagccgtgaggggcacctgccagatctgctctctatgattcacatcgaaagattcactccaatccccgcacttctcttcaactgcactatggccctgatttatctcattgtcgaggacgtgtttcagcttattaactatttttcgttctcatactggttttttgttggactttctgtggttggacagctctatctcaggtggaaggaaccgaaacgacctcgacccctgaagttaagtgtgtttttcccgatcgtcttctgcatttgttccgtgttcctggtgatcgtgcccctttttactgatacaattaacagcctgatcgggataggcatcgccttgagtggagtacctttttactttatgggggtgtacctgcctgagtcccggaggcccttgttcatccgaaatgttctggccgcaataacccggggaacacaacagctttgcttttgtgtcctgacagagttagacgttgcggaggaaaagaaggatgagcgcaaaactgactag

SEQ ID NO: 10202 - DNA, 1623 bp, Artificial Sequence
  Description of Artificial Sequence: Synthetic coding sequence
atgaacggggaggccatctgctctgccctccccactataccatatcataaactcgcagatttgcgctatttgtccaggggtgcctcgggaactgtatcttctgcccgtcatgcagactggcgtgtccaggttgcagtaaagcatctgcacattcacacacctctgctcgattctgagcgcaaggatgtgctgcgggaggccgagattctgcacaaagcaaggttctcatatatcctgcccatcttgggtatatgtaatgaacctgagttcttaggcatcgttactgaatacatgcctaacggctcgctgaacgagctccttcaccgaaaaaccgaatatcctgacgtggcttggccactgaggttccgcatcctccacgaaattgccttaggcgtgaactacctgcataatatgaccccccctcttttgcaccacgacctgaagacacagaatatactgctggataatgagtttcacgtgaagatcgctgatttcggattatcgaagtggaggatgatgtctcttagccagtctagatcatcgaagagcgccccagagggtggtacgatcatctacatgcctccagagaactatgagcccggacaaaagagcagagcctccatcaagcatgacatttatagctacgccgtaataacctgggaggtgctgtccaggaagcaaccgtttgaggacgttactaatcctctgcagattatgtatagtgtatctcaaggacaccggcctgtaatcaacgaggagtcactgccttacgacatccctcaccgggctaggatgatcagccttatagagagcggttgggcacagaatccggatgaacgtcccagcttcctgaaatgcctcattgaactggaacctgttctgagaactttcgaggagattacctttctcgaagctgtaattcagttaaagaagactaagctgcagtccgtttcttcagcgatccacctgtgcgacaagaaaaagatggagctgtcacttaatatacccgtgaaccacgggccacaggaggagtcatgcggatcttcccagctgcatgaaaactcggggagccccgagaccagtcgctccctccctgcccctcaggacaatgactttctgtcaaggaaagcacaggattgttattttatgaaactgcatcactgcccaggtaaccactcatgggatagcacaatttcaggttcccagcgcgcagccttctgcgatcataaaactacaccctgttcctccgcaatcatcaacccactgagcactgccggtaacagcgaacgcttgcagcccggtatcgcccagcagtggatacagagcaaaagggaggacattgtaaatcagatgactgaggcttgcctcaatcaaagcctagacgctctgctgtctcgggatctcataatgaaggaggactacgagctcgtgtccaccaagccaaccaggacaagtaaggtgcggcaattattagatacaaccgacatacaaggcgaggagtttgcaaaggtcatagtccagaagctaaaagacaacaaacaaatgggtctgcagccatacccggaaattctggtcgtgtctcgaagtcctagcctcaacctgttacagaacaaatctatgtag

SEQ ID NO: 10203 - DNA, 2079 bp, Artificial Sequence
  Description of Artificial Sequence: Synthetic coding sequence
atgcgggcttgcgccggaagcacgagggaagccggtagcggagctcaggatttgtcaacgttactgtgcctcgaagaatcaatggaagagcaagacgaaaaacctccagagccgccaaaggcatgtgctcaggatagctttctccctcaagagatcatcatcaaagtggagggcgaagataccggctctctcaccatcccgagccaggagggcgtcaatttcaagatcgtgacggtcgattttacacgagaggagcagggcacgtggaatcctgcccaaaggactctcgatagagacgtgatcctcgagaaccatcgagatctcgtgagttgggacttggctaccgccgtggggaagaaagattccacttctaaacagcgcatctttgacgaggagccggcaaatggcgtcaagatcgagcgcttcactcgcgatgatccgtggctttcaagctgcgaagaggtggatgactgtaaggaccagctggagaaacagcaggaaaaacaagaaatcctgttgcaggaggtggcatttacgcagagaaaggctgtcatccatgagcgcgtctgtaaaagcgatgaaaccggggagaaatctgggctcaacagctcactctttagctcacccgttattccgatacgtaaccatttccataaacatgttagccacgccaagaagtggcatctcaacgccgctgttaacagccaccagaaaattaacgagaacgagacgctctacgagaataacgagtgcgggaagccaccgcagagtatccatctcatccagttcacccgaacccaaaccaaggacaagtgttacggcttcagtgacagaatccagagcttctgccatggtacccccctgcatatacacgaaaaaatccacggtggtggcaagacctttgatttcaaagagtgtggccaggtgctgaacccaaagataagccacaatgaacagcagagaatccccttcgaggagtcacagtataaatgttcagaaacttctcatagttcctcactgacacagaatatgcgcaataattccgaagaaaagcccttcgaatgcaatcagtgtggcaagtcttttagctggtccagccatctcgtggctcaccaacgaacgcatactggcgagaaaccatatgagtgctccgaatgcggtaagtctttcagccggagctcgcacctggtatctcaccagagaacccatacgggagaaaaaccgtaccgctgcaatcaatgtggcaaatctttctcccagagttatgtcttagtggtccaccagcgcacacacacaggtgaaaaaccttacgaatgcaaccagtgcggtaagagctttcggcaatcctacaaactcatagcccaccaaaggactcacacaggggaaaaaccttacgagtgcaatcaatgcgggaagagtttcatacagagctataaacttattgcacaccagagaattcacacaggagagaagccctatgaatgtaaccaatgtggcaaatccttctctcaaagctacaagctagtggcccaccagcgaacccacaccggcgaaaagccatttgaatgcaatcagtgtggcaaatctttctcctggagctcacagttagtggctcatcagcgcacccatacaggagagaaaccatacgagtgttctgaatgcgggaagtcattcaacagaagctcccacctcgtaatgcaccagcggatacacacgggcgagaagccgtacgagtgtaaccagtgtgggaagagcttctcgcagtcatatgtgcttgtggtgcaccagagaacacacactggggagaaaccctatgaatgttctcagtgcggtaaatccttcaggcaatcaagctgcttgacgcagcaccagagaacccacaccggtgagaagcctttcgaatgcaaccaatgcggtaagactttttctctctccgcacgtctcattgtgcaccaaaggacccacaccggggagaagcccttcacatgcatacaatgcgggaaagcctttatcaatagctacaagcttataaggcaccaggctacacatactgaggaaaagctttatgaatgcaactag

SEQ ID NO: 10204 - DNA, 942 bp, Artificial Sequence
  Description of Artificial Sequence: Synthetic coding sequence
atggacaataaaaaaaggctagcctacgccatcatccaattcttgcacgatcagctcaggcatggaggtctctcctccgatgcccaagagagcctcgaagtggccatccagtgtctcgagactgccttcggagtcacggttgaagatagcgaccttgcattgcctcagacactgccagaaattttcgaagcagctgccacaggcaaggaaatgccacaagacttgaggagtcctgcacggacacccccatcggaggaagacagcgcagaagccgaaaggttgaaaaccgagggcaacgagcagatgaaagtggaaaattttgaagctgctgtgcacttttatggcaaggcaatcgaattaaaccctgcaaatgcggtgtacttttgcaaccgggctgcagcatactcaaaactgggcaattatgctggcgctgtacaggattgcgagcgcgctatttgtatcgatccagcctattcaaaggcctatggccgaatgggcttagctctctccagtctgaacaagcacgtggaagcggtggcctactacaagaaggcccttgagttggatccagataacgagacatataagagcaacctgaaaatcgccgaactcaaattaagggaggcgccaagtccaaccggcggagtgggctctttcgacattgcaggcttattgaataaccctggattcatgtccatggcctccaatttaatgaataatcctcagattcagcagcttatgtccggtatgatatctggcggaaacaatccactaggcaccccaggcacctctcccagtcagaatgatctggcaagcctgatacaagccggacagcagttcgcccagcagatgcaacagcagaacccagagttgatcgaacagctgcgcagccaaattcgcagcagaacaccatccgcctccaatgatgaccaacaagagtag

SEQ ID NO: 10205 - DNA, 1584 bp, Artificial Sequence
  Description of Artificial Sequence: Synthetic coding sequence
atgtaccagcctgaagacgataataactccgacgtgacaagcgacgatgatatgaccaggaaccgtcgtgaaagttctccccctcatagcgtccattcctttagcggggaccgtgactgggaccggagaggtaggtcaagggatatggagcctagagaccgctggagccatacccggaatccacgttcacgcatgccaccaagggacctctctttacctgttgttgccaagaccagcttcgagatggatagagaagacgatagagattccagagcttatgagtcacgctcccaggatgccgagagctaccagaatgtggttgaccttgcggaagatagaaagccccataacacaatacaggacaacatggagaattaccgcaaactgctatctttgggctttctcgcacaggatagcgttcccgctgagaagaggaataccgagatgttagacaacctacccagcgcaggatcccagtttcctgactttaaacatttaggcacgttcctcgtcttcgaagagctggtcacctttgaagacgtactggtggactttagtcccgaggagctttctagcttaagtgctgcacagcggaacctgtacagagaggttatgctggaaaactaccgcaacctagtgtctctggggcatcagttctctaaacctgatattatctcaagactcgaagaggaggagtcttacgctatggagactgattcacgtcataccgtgatctgccagggcgagtctcacgatgatcctctggagccccaccaggggaaccaggagaaattgcttaccccgattaccatgaacgatcctaaaactctgacccctgagagatcatacggttccgatgagttcgaacgtagctccaacctcagtaaacagtccaaggaccccctggggaaggatcctcaagagggcacggctccgggtatctgcacctccccgcagagtgccagccaggagaataaacataatcggtgcgaattttgtaagcggacattctctacgcaggtggccttgagacggcacgagcgtatccacaccggtaaaaaaccctatgagtgtaagcagtgcgccgaagccttttacttaatgccccacctcaatcgacatcagaagactcactccggcaggaagaccagcggatgcaacgaaggcaggaaaccttctgtccagtgtgcaaacctctgtgaacgggtgaggattcattcacaggaggactactttgagtgcttccaatgtggcaaggccttcctccagaacgtgcatctgcttcaacacctgaaagcccacgaagccgctcgggtgctcccccctggtctctctcactctaagacctaccttatccggtatcagcggaaacacgactacgttggtgaaagggcctgccagtgttgcgactgtggccgagtttttagtagaaattcctacttgattcagcactaccgtacccacactcaagagagaccttatcagtgccagctgtgcggaaagtgctttgggagacccagctacctgacacagcactaccagctgcattcacaggagaagacagttgaatgcgatcactgttag

SEQ ID NO: 10206 - DNA, 444 bp, Artificial Sequence
  Description of Artificial Sequence: Synthetic coding sequence
atggccctgaagcgtatccagaaggagcttaccgaccttcaacgagatccccctgcacagtgcagcgcaggacctgttggggacgacttgttccactggcaagctacaattatgggacccaatgactccccctaccaggggggagtgtttttcttgactattcactttcccacagactatccttttaagcctcccaaggttgcgtttaccaccaaaatttaccacccaaatattaactccaacggctctatctgcctcgatatcttgagatctcagtggtcacctgcattgaccgtgtcaaaagtgctgttgtctatctgtagtctcttatgtgaccccaatcccgacgatccactcgtgcccgagattgctcacacctataaggctgaccgggagaaatacaatcggctggctcgcgaatggacgcaaaagtatgctatgtag

SEQ ID NO: 10207 - DNA, 3072 bp, Artificial Sequence
  Description of Artificial Sequence: Synthetic coding sequence
atgttccacctgcgcacttgtgccgcaaagctgcgcccattgacagcctcccagaccgttaagacgttctcccaaaaccggccagcggctgccaggacatttcaacagatccgttgttacagtgctcctgtagccgctgaaccgttcctatccggaacttcatccaattacgtggaggaaatgtactgtgcctggcttgagaacccaaagtccgtgcacaagagctgggatattttctttcgcaataccaacgccggagcgccacccggaactgcttaccagagcccgctgccactgagtcgaggatctcttgccgcagtagcccacgcccagagcttagttgaggcccaacctaacgtggacaagcttgtagaagatcacctcgccgtacagtcattgatccgagcctaccagattcgaggccatcacgtggcccagcttgatccactcggcatactggacgccgacctcgattcttccgttcccgcagatatcatctcgtcaactgataaactggggttctatggactggacgaaagtgatctcgataaagtttttcatctgccgaccacaacattcataggaggccaagaatcagcccttcctctcagagagattataaggagactggagatggcctattgccaacacattggggtagagttcatgtttattaacgaccttgaacaatgccaatggattcgtcagaagttcgagacacccggaatcatgcagttcacaaacgaggagaagcgtacgttattagctagactcgtgcgcagtacccgatttgaggagtttttgcagcgcaaatggtcttctgaaaagagattcggactggaggggtgcgaggtcctgatccctgcactcaaaacaataatagacaaatcatcagaaaatggcgtcgactacgtcattatgggtatgccgcatcgcggaagactaaacgtgctcgcaaacgtgatcaggaaggagctggagcagatattttgtcagttcgattcaaaattggaggccgcagatgagggatctggcgatgtaaagtaccacttagggatgtaccaccggaggattaacagagtcaccgataggaatattacactcagtttagtcgccaacccttctcacctcgaggcggcagatcctgtagtcatggggaagacaaaagcggaacagttttactgcggagacaccgagggaaagaaggtgatgtccatcttgctgcatggcgacgcagccttcgctggccaggggattgtctacgagactttccacctgtcagacttgccctcatatacaacacacggcacagtgcacgtggttgtgaacaatcaaattggatttacaacagaccctcgaatggcacggtcatcaccttacccgaccgacgtagcaagagttgtcaacgctcctatattccatgttaatagcgacgacccggaggccgtcatgtatgtctgcaaagtggcagccgagtggcgctctacctttcacaaagacgtcgtggtagacctggtctgttatcgacgcaatgggcacaatgagatggatgagccaatgttcacccagcccttgatgtataaacagattcgcaagcagaaacccgtcttgcaaaagtacgcagaactgctggtcagtcagggggtcgttaatcagcctgagtatgaagaagaaatttccaaatatgataagatatgcgaagaagcatttgctagaagcaaagatgaaaaaatcctgcacatcaaacactggctagactctccttggcccggtttctttacactggacgggcaaccccgatccatgagctgcccctccacagggctgaccgaggatatcctgacccatatcggtaatgtcgcatcaagcgtgccggtggagaatttcaccatccacggcggactgtcacgaatactgaaaactagaggagagatggtcaaaaaccggactgtcgattgggctttagccgagtatatggccttcggttctctgctgaaagaggggatccatatcaggttgagcggccaagatgtcgagcggggtacattttcccacaggcaccacgtgttgcacgatcaaaacgtggataaacgcacgtgcattcccatgaaccacctctggcctaaccaggccccttatactgtttgcaattccagcctgtctgagtatggtgtgctagggttcgagcttggatttgccatggcctcccctaatgctctagtcctctgggaggcgcagtttggagattttcacaatactgcccagtgtatcattgaccagttcatctgcccaggccaggctaagtgggtcaggcagaacggcattgtgctccttctaccccacggcatggaaggaatgggacccgaacacagtagcgccaggccagaacggtttcttcaaatgtgcaatgatgatcccgacgtcctgcccgacctcaaggaggcaaacttcgatataaatcaactgtatgattgtaactgggtggtagttaattgtagcaccccaggtaacttttttcatgtgctgcggagacagatcttgctgccatttcgcaaacccttaattattttcactccaaaaagcctgctcaggcacccagaggctagatcctcattcgatgaaatgcttcccggaactcattttcagcgcgtgatcccagaggatgggccagcagcccagaatcctgaaaatgtgaaacggcttctcttttgcactggaaaagtgtattatgacctaactagggagagaaaggccagagacatggtggggcaagtcgcaatcacgaggattgagcagttgagccccttcccattcgaccttctgcttaaagaggtgcagaagtaccccaatgcagaattggcctggtgccaggaagagcataagaaccaagggtactatgactatgtgaagcccagactgcgaactacaatctcacgggctaaacctgtgtggtatgcaggtagggaccccgctgccgcacctgctacaggcaataaaaagactcacctcacagaattacagcgactgctagatacagctttcgaccttgatgtgtttaagaacttctcttag

SEQ ID NO: 10208 - DNA, 2667 bp, Artificial Sequence
  Description of Artificial Sequence: Synthetic coding sequence
atggagggagatgattgcgagttccgctacggggacggtaccaacgaagcccaggacaacgactttcccacagtggagaggagccggctccaggaaatgctgtcgctgctaggcctggaaacataccaggttcagaaactgtccctgcaggatagtcttcagattagctttgattctatgaagaattgggcgccacaggttccaaaagatcttccatggaatttcctacgcaagctgcaagctctgaacgccgacgcccgtaacaccactatggtcctggacgtgctgcccgatgccagaccagttgagaaggagtctcagatggaagaggaaataatctattgggatcccgcagatgaccttgcagcagacatttatagttttagcgaactcccaacccccgatacccctgtcaaccctctggacctgctctgtgcactgttgctttcgtctgatagtttccttcaacaggagattgcgctgaagatggccctttgtcagttcgccctgcctctggtgctgcctgatagcgaaaatcactaccatacttttttactttgggcaatgagagggattgtccgcacatggtggtcccagcccccacgcggtatgggatcctttcgggaggactctgtagttctgagtcgagccccagcctttgcctttgtgcggatggacgtaagctccaactcgaagtctcagttattgaacgccgtactcagccccggtcaccggcagtgggactgcttttggcatcgcgatctgaatttaggtactaatgctcgagagatctccgacgggttggtggaaatttcatggtttttcccctcaggtagggaagacctggatatcttcccagagcctgttgcgtttttaaacctacgcggtgatatcggctcgcactggctccagtttaaactcctcaccgagattagctccgctgtctttatcctgacagacaacatctctaagaaagaatacaagcttttatacagcatgaaagaaagcactacaaagtactacttcattctcagtccataccgcggaaagcgtaacaccaacttgaggtttctgaacaagctcattcccgttctgaagattgaccacagccacgtactggttaaggtctcctcaacagactccgattccttcgttaagaggataagggcaattgtgggaaacgtgctgagggcaccctgtagacgagtcagtgtggaagatatggcccatgctgctaggaagctggggctgaaagttgacgaagattgcgaggaatgtcaaaaagcaaaagatagaatggagcgcatcactcgcaaaatcaaggacagtgacgcctacagaagggatgagctacgcctgcaaggggatccttggagaaaggccgctcaagtggaaaaagaattttgtcagctgcagtgggcagtcgatcctcctgagaagcacagggctgagttgagacgccgactgctggagctgagaatgcagcaaaacgggcacgatccatcaagcggggtacaggagtttatcagcggaatttcatcaccctcactgtcagaaaaacaatactttctgcgatggatggagtggggacttgctagggttgcacagcctcggctacgccagcccccagaaaccctcctcacactgagacccaaacatggtggcacaaccgacgtcggtgagcccttatggcctgaacctctgggggtggagcatttcctccgggagatgggtcaattttatgaggctgaaagttgcctcgtggaggccggacggctccctgccggacagcgtcgattcgcacacttcccgggtctggcgagtgagttattgctaacaggattaccacttgagctgattgatggctcaactctgtcaatgcctgttcgctgggtcacgggcctcctcaaggagctccatgtgcggctggagcgacgctcacggttggtggtgctgtccaccgttggggtgcccggaaccggtaaatctaccttgctgaatacaatgttcggcctccggttcgcgactggcaaatcatgcgggccacggggagcttttatgcagctgatcaccgtcgcagagggattttctcaggatctgggctgcgatcatatcctggtgatagacagcggcggactaattggcggagccctcacttcagcaggggatagattcgaactagaggcctcattggcaacacttctgatgggtctctccaacgtcaccgtcatctcccttgccgagacgaaagatattcccgctgccatcctgcacgcgtttctgcgcctggagaagaccggccacatgccaaattatcagttcgtgtatcagaatctgcacgacgtttcagttcccggtccacgaccacgggataagcgccaattactcgatccacccggtgatctgagcagagcggcagcccaaatggagaaacaaggcgacggcttcagagctctggctggactggccttctgcgatccagagaaacagcatatttggcacatcccaggtctctggcacggcgcacctcccatggccgcagtaagcttggcctactctgaggctatattcgaacttaagcggtgcctgttggaaaacatccgtaatggactgtctaatcagaacaaaaatatacaacagctgatagagctggttagaagactgtag

SEQ ID NO: 10209 - DNA, 3744 bp, Artificial Sequence
  Description of Artificial Sequence: Synthetic coding sequence
atgatgcgcgagtgggtgctgttgatgagcgtcttgctatgcggactggctggcccaacccaccttttccagccgagtttagtgttggatatggccaaagtgctgctcgataattactgctttcccgagaacttactaggaatgcaagaagcgattcaacaggctatcaagtcccacgagatcttatccatctccgatccacagacgcttgcatcagtgctcacggcaggagtgcaatcttctttgaacgacccgcgtctcgtgatatcttatgaaccgtcaactcccgagccaccaccccaggtgccagcacttacaagcttatctgaggaagagctcttggcctggctgcagcgcggtctccggcacgaggtcctggaagggaatgtagggtacctgcgtgtggactctgtcccaggacaggaggtattaagcatgatgggtgagttcctggtggcccacgtctgggggaatctcatgggtaccagcgcattagtccttgacctgcgccattgtaccggtggacaggtgtccggaatcccctatatcatcagctacctgcatccgggaaacaccatactccatgtcgacacaatatacaacagaccatccaatacaactactgaaatatggactcttccacaggtcctgggcgagagatacggcgctgataaagacgttgtggtgctgaccagtagtcagacacgcggagtggccgaggacatcgcccatatcttgaagcagatgagaagagccatcgtggtgggcgagcggacagggggaggtgcgttagacctacgcaagttacgcattggcgagtcagatttcttcttcactgtccctgtgtcccgttctctgggcccattagggggagggagccagacttgggagggaagcggcgttctgccctgcgtgggcacaccagctgaacaggccctggagaaagcgctcgctattctgaccctaagatccgccttgcccggtgtggtgcactgcctgcaggaggttctgaaggactattacaccctcgttgatagagtccccacattactacagcacctggcgagtatggacttcagcactgtggtcagcgaggaggacctggtgactaaactaaatgccggattacaggctgcctccgaagatcctcggctgctggtacgcgctattggcccaaccgagacaccctcgtggccagctccggatgccgcagcggaagattcaccgggtgtcgcccctgagctgcccgaggatgaggcgatcaggcaagccctggtggattcagtgtttcaggtgagtgttttacccggtaatgtgggctacctccgttttgactcattcgcagatgcttctgtactcggcgtattggccccttacgtcttacgacaagtgtgggaacctctccaggacactgagcaccttatcatggatctaagacataatccaggcggtccaagttctgccgtgccgcttctactgtcctatttccagggtcctgaagcagggcctgtacatctgtttaccacatatgacagaagaacaaacatcactcaggagcatttcagccatatggaactaccagggcctcgctatagcactcagcgtggcgtgtacctcctaacctctcatcgtaccgccactgctgctgaagagtttgcatttcttatgcagagtctcggatgggctacgctcgtgggcgagataactgctgggaatctgctacatacgaggactgtgcccctgctcgatactcctgagggttcgttggccttgaccgttccagtcctgactttcatcgacaatcacggcgaggcctggctggggggtggagtagttccagacgctattgttctcgctgaagaggccttggataaagcacaagaggtgctggaatttcaccagagccttggcgctcttgtggaaggcacaggccatcttctggaggctcattatgctcggcctgaggtggtgggacagacttccgcgctactgcgggctaagctcgcccagggagcctataggactgccgtcgatctggaaagcctggcctcgcaactgactgccgacttgcaagaggtaagtggagatcatcgattactcgtgttccactctccaggtgaactagtggtggaggaagctccacccccacctccagccgtgcctagccctgaagaactcacttacctgatcgaggccctgtttaaaacggaggtgctgcctggccagttgggttatctgaggtttgacgcaatggctgagctggaaaccgtgaaggctgtgggccctcagctggttcggttggtctggcagcagctggtggatactgctgccttggtgatagaccttaggtacaatcccggatcctatagcacagcgattccattactttgctcctacttttttgaagcagagccacgccagcacctgtattccgtctttgatcgagcaactagcaaagtcaccgaggtatggactctacctcaggtggcgggacaacggtatggctcccataaagacctgtacatattgatgagccacacttccggtagtgccgctgaggcgtttgctcacaccatgcaggacctgcagagagccactgtgattggcgaaccgacagctggaggtgccctcagcgtcggcatttatcaggttggatcatcccccctctatgcttccatgcccactcagatggctatgtccgccaccactggaaaagcatgggatctggccggtgtggaacccgacatcaccgtgcccatgagcgaggccttgagcatagcccaggacattgtggcattgcgcgctaaagtacccacagtgctacagacggcgggaaagttagtagccgacaactatgcgagtgctgaactaggtgcgaagatggccaccaagctgtctggactccagtcccgttactcaagagtaacttcagaggttgccctcgccgaaatcctgggagctgacttgcaaatgcttagcggtgacccacaccttaaggctgctcacattcctgaaaatgcgaaggatcgtattcccggaatcgtgcccatgcaaattccaagtcccgaggttttcgaggaactgataaaatttagcttccacactaacgtcctcgaggacaatatcggctatttacgattcgacatgtttggagatggggaactcctaacacaagtaagtaggttgcttgtggagcatatatggaaaaaaattatgcacacggatgcaatgatcatagatatgaggttcaatattgggggtcctacctcatctattcctattctgtgcagctacttctttgatgaagggcctccagtgctgcttgacaaaatctactccaggccagatgatagtgtgtctgaactatggactcatgcccaggtggtgggagagagatatggcagtaaaaaatcaatggtgatcctcacctcatctgtaacagccggaaccgccgaggagtttacatacattatgaagcgcctcggcagagccctagtcatcggagaggtaacctctggcggatgtcaacctccacagacatatcatgtagacgacacaaacctgtaccttacgattcctaccgccagaagcgtcggggcttcagacggatcttcatgggaaggggtgggcgtaacgccgcatgtggtcgtgcctgcagaagaggctttagccagagctaaggagatgttgcagcataatcagctgcgagtcaaaagatctcccggactccaggaccacttatag

SEQ ID NO: 10210 - DNA, 885 bp, Artificial Sequence
  Description of Artificial Sequence: Synthetic coding sequence
atgaattccgaactggactactatgaaaaattcgaggaggttcatggtatcctcatgtacaaggatttcgtcaagtattgggataacgtagaagctttccaggcaagacccgacgacttggtgattgccacctatcccaagagcggtactacctgggtgagtgagattgtttacatgatttacaaggagggagatgtcgaaaaatgcaaagaggatgtgatttttaatcgcattcctttcctggagtgccgcaaggagaatctcatgaacggcgtcaagcaactggatgaaatgaattctcctcgaattgtgaagactcatctgcccccagaactgttgccagcttctttttgggagaaggattgtaaaatcatctatttatgtaggaacgccaaggatgtggcagtctccttttattatttctttctgatggtggccggtcatcctaaccccggatccttccctgagttcgtggagaaatttatgcagggacaggtgccatacgggtcttggtacaaacacgtgaaaagctggtgggagaaagggaagtctccccgagtccttttccttttctatgaagatctgaaggaggacattcgcaaagaagtgattaagttgatccactttctcgaacgaaagcctagtgaagaactcgtcgacaggatcattcatcatacgtcgtttcaagagatgaaaaataaccccagtacaaattacaccacgctcccagatgagataatgaatcagaagttgagtccattcatgcggaagggaataactggagattggaagaatcactttacagtagcccttaacgagaagtttgataagcactacgagcagcagatgaaggaatccacacttaagtttcgcacggaaatatag

SEQ ID NO: 10211 - DNA, 1446 bp, Artificial Sequence
  Description of Artificial Sequence: Synthetic coding sequence
atggcgtataacgataccgatcgcaaccaaacagaaaaactgctgaagcgcgtgcgtgaattagagcaagaagtccagcgacttaaaaaggagcaggcaaagaataaagaggattcaaacatcagggagaactcagcaggcgctgggaaaaccaaaagagcctttgacttctcggctcacggcagaagacacgttgcgctgcggattgcatatatgggctggggatatcagggattcgcctctcaggagaacaccaacaacaccattgaagagaagctgttcgaggctttaaccaagacacggctggtagagagccggcagacctccaactaccataggtgtgggaggacggataagggcgtgtctgcctttggccaggtcataagtctcgatctgcgaagtcagttcccccgtgggagggattccgaggattttaatgtgaaagaggaggctaacgctgcagctgaggagataagatacacacacattcttaatcgcgtcttaccccctgatattcggatcttggcctgggctccagtggagcctagctttagcgccagattttcttgcctggagagaacctaccgctatttctttccgagggctgatctggatatagtcacaatggattatgccgctcagaaatacgtgggtactcacgatttcaggaatctgtgcaaaatggatgtcgctaacggagtgattaacttccaacggaccatcctgagtgcacaggttcagcttgtgggacagagtcctggagaaggcaggtggcaggagcctttccagttgtgccagttcgaggtgaccggccaggcgtttctgtatcatcaggtaagatgtatgatggccattctgtttctcatcggccagggcatggagaaacccgagattatcgacgagcttttgaacattgaaaagaatccccagaagccgcaatacagcatggccgtggagttccccctggttctgtatgactgcaagtttgagaatgtgaaatggatatacgaccaggaagcccaggaattcaatataacgcatctccagcagttatgggctaaccacgccgtgaagactcacatgttgtacagcatgctgcagggacttgatacagtgccagtgccctgtgggatcggacccaaaatggatggaatgaccgaatggggtaatgtcaagccatctgtcattaagcaaacctccgcctttgttgagggcgttaaaatgaggacgtataagcctttgatggatcgacccaaatgccaggggctcgagtcccgcatccagcattttgttcgccgtggcaggatagaacatccccatcttttccatgaagaagagacaaaagcaaagcgggattgtaatgatacgctggaggaagaaaatactaatctggaaactcccacaaaaagagtctgcgtggatacggaaattaagtccattatttag

SEQ ID NO: 10212 - DNA, 618 bp, Artificial Sequence
  Description of Artificial Sequence: Synthetic coding sequence
atgtcgaacttcctacatctaaagtataatgagaaatccgtatccgtcaccaaagccctgaccgttcggttcctcactaaacgttttatcggggagtacgcctccaatttcgagtctatatacaagaagcatctgtgcctagaacgcaagcaactgaacttggaaatctatgatccatgctcacaaacgcagaaggctaaattttcgctgacgtctgagctgcactgggccgatggatttgtaatcgtgtatgatatcagtgataggtcttcattcgccttcgccaaggcactgatttaccgaattcgggaacctcaaacaagtcactgtaagagggccgtggaatccgctgttttcctcgtgggaaataagagagacctttgccacgttagggaggtaggttgggaggaaggtcaaaagctggcactggaaaatagatgtcaattctgtgagctatctgcagcagagcagagcctggaggtggagatgatgttcattcgcatcataaaggacatcttaataaacttcaagttaaaagaaaagcgcagaccatctggcagcaagtctatggcaaaattaattaacaatgtctttggaaagcgccgtaagagtgtgtag

SEQ ID NO: 10213 - DNA, 1008 bp, Artificial Sequence
  Description of Artificial Sequence: Synthetic coding sequence
atgggcaaggtgaaagtgggcgtgaacggatttggaaggatcggcaggctggtgacaagagccgcttttaattcaggtaaggtggatattgtggccattaacgatcctttcatagatctgaattatatggtttatatgttccagtacgactccacacatggaaagtttcatggcacagtgaaggccgaaaacggcaagctggtgattaatggtaatcctatcactattttccaggaaagagatccaagcaaaatcaagtggggggacgccggtgctgagtacgtcgtcgagtctacaggtgtgtttactacaatggagaaggctggggctcatctacagggtggcgcaaagagggtcattatcagtgctccctcagcggacgcccctatgttcgtaatgggtgtgaatcacgagaagtatgacaactctctgaagataatttcaaatgcgagctgcacgactaactgcctcgctcctcttgctaaggttatccacgataattttggcattgtcgagggacttatgaccaccgtacatgcaataaccgctactcaaaaaacagtcgatggaccaagcggaaagctgtggcgcgatggccgtggtgctttgcagaatatcatcccagcctcaaccggtgccgcaaaggccgtaggcaaggtgatccctgagttgaatggcaagctcaccggcatggccttccgggttcctactgccaatgttagcgtggttgaccttacgtgtcggctggagaagcccgctaagtatgatgacattaaaaaggtggtaaagcaggctagcgagggccctctcaaaggtatcttaggttacactgagcatcaggtcgtgtcctctgacttcaattcagacacacactctagtacctttgatgctggtgcgggtatcgcgctcaatgatcacttcgttaagctcataagttggtacgacaacgagtttggttatagcaaccgcgtggtagaccttatggcacacatggcttcaaaggagtag

SEQ ID NO: 10214 - DNA, 597 bp, Artificial Sequence
  Description of Artificial Sequence: Synthetic coding sequence
atggactccctcctcatgaatcgcagaaagttcctctaccagttcaagaacgtacgctgggccaagggcaggagggagacctacctctgctatgtggtgaagcgacgagatagtgcaacctcattttcactggactttggctacctccgcaacaaaaacggctgccatgttgaactcctctttctgcggtacatcagtgactgggatctggaccctgggcgttgctacagggttacctggttcaccagctggtctccatgttatgattgtgccaggcatgttgccgattttttaagaggaaatccaaatctcagcttaaggatcttcactgcccgactgtatttctgtgaggacaggaaggctgaaccggagggcctgaggaggctacaccgtgctggcgtccagatcgccattatgacctttaaagattacttctactgttggaatacattcgtcgagaaccatgagagaactttcaaagcatgggagggcctgcacgagaactccgtcagattaagcagacagctgcgcagaattcttcttcccttgtacgaagtagacgacttgcgggacgccttccgcaccctaggattgtag

SEQ ID NO: 10215 - DNA, 5472 bp, Artificial Sequence
  Description of Artificial Sequence: Synthetic coding sequence
atggccttatccagtgcatggaggtccgttctgcctctgtggttgctctggtccgctgcttgctctcgggctgcatctggcgacgataatgcatttccttttgacatagaggggagcagtgcagtcggtcgacaggatccaccggaaacgagcgaacccagagtggctctaggaagactccctcccgcagctgagaaatgtaacgctggcttctttcatacactctcaggcgaatgcgtcccctgcgattgtaacggaaattccaacgaatgtctggatgggagtggatactgcgtgcattgtcagaggaataccaccggcgagcactgcgagaagtgtctggacggatacatcggtgatagcatccggggtgccccacagttctgtcagccctgtccctgcccactgccgcacttggcaaacttcgccgaatcctgttacagaaaaaatggagccgtccggtgtatctgcaacgagaattacgccggaccaaattgcgagcggtgtgctcctggttactacgggaacccattactgataggatctacttgcaaaaagtgcgactgctccggaaactcagatcccaacctgatcttcgaggactgtgacgaagtgaccggccagtgtaggaattgcctccgcaacacaacgggttttaaatgcgaacgctgcgccccaggatactacggcgatgccagaatcgcaaagaattgcgccgtgtgtaactgcggagggggaccctgcgactccgtgacgggggagtgccttgaggaaggctttgagcctcctaccgggatggactgccccactatcagctgtgataagtgcgtctgggacttaactgatgccctgcggctagccgctttaagcatagaagaggggaagagtggagttctgtccgtttcatccggagcagcagctcatcgccacgttaatgagataaatgccacaatttaccttctgaaaaccaagctgtctgaacgcgaaaaccagtacgccttacgaaagatccagatcaataatgctgaaaacactatgaagtcgcttttatccgacgtggaggagctggtagaaaaagagaaccaggcgtctagaaagggtcagttggtgcagaaagagagcatggacacgatcaaccacgccagtcaacttgtggaacaggcacacgacatgagggacaagatacaggagattaacaataagatgttatactatggagaagaacatgagctttctccaaaagaaatatcagagaagctggtgcttgcccagaaaatgctggaagaaatccggtcacgccagcctttttttacgcagagagaacttgtggacgaggaggcggacgaggcttacgaactcctctcccaggcagagtcttggcagcgcctgcacaacgagacacggaccctcttccctgtagttctagaacagctggacgactacaacgccaagcttagcgatctacaggaggcgttggaccaggcactgaactacgtaagggacgctgaagacatgaatagagcaacagccgctcgtcagcgcgatcatgaaaaacagcaggaacgcgtgcgggaacagatggaagtagttaacatgtcactcagcacttcagctgattctttgacaacacccaggttgacactgtccgaattggatgacataataaagaacgcaagtggcatatatgccgaaattgacggcgctaagtctgagctgcaggtaaaactcagcaacctgagcaacctgtctcacgaccttgtccaggaggcaattgaccacgcccaagacctgcagcaagaagccaacgagttgagccgcaaactgcacagctcagacatgaacggccttgtccagaaagccctggacgcaagcaatgtttatgagaatatcgtgaattacgtgtctgaggccaacgagaccgctgaatttgccttgaacaccacagacaggatatatgatgccgtttctgggattgatactcagatcatctatcataaggacgaatcagagaatctcctgaaccaggccagagaactgcaagccaaggcagagtcgtcgtctgatgaggctgttgccgatacctcacggagagtggggggtgcattagcaaggaagtccgccctaaagacgagactttctgacgccgtgaaacaactgcaggccgctgaaagaggagacgcacagcagaggcttggtcagagtcgcctcataacagaagaggcaaatcgaaccacaatggaagtacagcaggctactgctcccatggctaataacctgacaaattggagtcaaaatctacagcatttcgactcatccgcctataatacggccgtgaattccgcgagagacgctgttagaaatttaacagaggtggtccctcagctgctcgatcagctgagaaccgtggagcagaaacgccctgctagcaatgtgtccgcctcgatacagagaatccgcgagctgatcgcacagacccggagcgtcgcatccaagatccaggtctccatgatgtttgacggtcaaagcgccgtcgaggttcactctcggacctcgatggacgaccttaaagctttcacctctctgtctctgtacatgaagcctccggtaaaacggcctgagctgacagaaacagcggaccaattcatcctgtacctgggtagcaaaaacgcaaagaaagagtacatgggcctcgcgattaaaaacgacaatctggtgtacgtctataacctaggaacgaaagatgtagagatcccgctggatagcaaacccgtctcctcatggcctgcctatttctccattgtgaaaatcgagagggtgggcaagcacggcaaagtatttcttaccgtgccctctctctcttccaccgccgaagagaaattcatcaagaagggagagttttcgggcgatgactccctcctagacctggatcccgaagatactgtcttttacgtcgggggtgttccctcaaatttcaaattacctacgtcgttaaacttacctggcttcgtgggctgcctggaactagcaacactgaataacgatgtgatcagcctgtacaactttaagcatatatataatatggaccccagtactagcgtgccttgtgcgcgagataagctggctttcacccagagtagggccgcaagttactttttcgacggcagcggctacgccgtggtgcgcgacataacgaggagaggcaagttcggacaggtgactcgctttgatattgaagtgagaactcctgcagacaacggcctcatactactgatggttaacgggtctatgtttttccgccttgagatgagaaacggatatttgcatgtgttctacgacttcggatttagtgggggtcccgtccacctggaagatactctgaagaaagctcaaattaacgatgcgaagtatcacgagatcagcattatctaccacaatgacaaaaagatgattctggtggtcgaccgaagacatgtcaaaagcatggataatgaaaagatgaaaattccatttacagatatctatattggtggtgcccctcccgaaatcttgcagtcccgggctttacgggcacacttaccgctcgacattaattttcgaggttgtatgaagggtttccagttccagaaaaaagatttcaacctgctggaacagaccgagactctaggagttggatacggttgccccgaagactctctcatttcccggcgagcctatttcaacggccaatccttcattgctagcatacagaagataagcttcttcgacggctttgagggaggcttcaattttcggacactgcagccgaatggtttgctcttttactatgcttcagggtctgacgttttcagtatctccttagacaacggaacggtgattatggatgtcaagggcattaaggtgcagagtgtcgacaaacagtacaacgacggtctgtctcacttcgtgatcagcagcgttagtccaacgaggtacgagctaatcgtggataagtcccgagtcggatccaaaaacccaacaaagggcaaaatcgaacagacccaggcttcagagaagaaattttactttgggggatctcctatctccgcacagtacgcaaatttcacaggttgcatctcgaatgcttactttaccagagtagatcgtgacgtggaggtggaggacttccagagatatacggagaaagtccataccagtctgtacgaatgtccaattgagtcttctcccctttttttgctgcacaaaaaggggaagaacctcagtaaacctaaggcttcccagaacaagaagggcggaaagagcaaggacgccccatcttgggaccccgtcgccttgaagctgcctgaaaggaacacgccgcgaaattctcattgtcacctgagtaattctcctagagcgatagagcacgcttaccagtacggaggcacagctaactcccgacaggaatttgaacacctgaagggcgactttggggctaaatcccaattttccataagattgcggaccaggagctcacacgggatgatcttctacgtctccgaccaggaggagaatgattttatgaccttgtttttagcacatgggcgactcgtgtatatgttcaacgtaggtcacaaaaagctgaaaatcaggagtcaggaaaaatataacgatggcctttggcatgacgtaatttttataagggaaaggagcagcggaaggctcgtgatcgacggcctgcgggtgcttgaggaatccctgcctccaacagaagcaacatggaagataaaggggcctatatatcttgggggtgtggccccaggtaaggccgtgaagaatgtacagatcaattccatctacagttttagcggctgtctgtctaatcttcagctcaacggggcatctataacatccgcttcacagactttcagcgtgaccccatgttttgagggcccaatggagacaggtacgtatttttccaccgagggcggttacgttgtgttggacgagtcctttaatataggactaaaattcgagattgcttttgaagtccggcctagaagcagcagtggaacccttgtccacggccactccgtgaacggcgagtacctgaatgttcatatgaaaaatggccaagtcatagttaaagtcaacaatggaatccgggacttctctacttcagttactccaaaacaatcactgtgcgacggaaggtggcacaggattaccgtgattagggattcaaacgtagtgcaactggatgtggattcagaggtcaaccatgtggtcgggccacttaatcccaagccaattgaccatagagagcccgtgttcgtaggtggcgtgcccgaatccctcctgactccgagactggcaccatcaaagcctttcacgggatgtattcgacactttgtcatagatgggcaccctgtgtctttctccaaagcagccttggtctcaggagctgtgtctattaatagttgccccgcagcctac

SEQ ID NO: 10216 - DNA, 1434 bp, Artificial Sequence
  Description of Artificial Sequence: Synthetic coding sequence
atgacttccaagtttctgctcgtctcctttatcctagcagcgctgagtctctctacaactttttccttacagcctgaccaacagaaagtgttactcgtgtcttttgacggttttaggtgggactacctctataaagtacccacaccccactttcactatattatgaagtatggggtgcacgtaaagcaagtaaccaacgtgttcattactaaaacttaccccaatcactacaccctagtcactggtcttttcgccgaaaatcatggtattgtggcgaatgatatgttcgacccaatccgaaataaatccttctctttagatcacatgaatatttatgattctaagttctgggaggaagcaacccccatctggataactaatcagcgtgccggacatactagtggggcagccatgtggccaggaacagacgtgaaaattcataaacgatttcccacccattacatgccttacaatgagagcgtcagtttcgaagaccgcgtggccaagatcattgagtggtttacttccaaggagcctattaatttaggcttgctttattgggaggaccccgatgacatgggacaccacctcggtcctgactcaccactcatgggaccagtgattagcgacatcgacaagaaactgggttacttaattcagatgctcaagaaggcaaagctttggaacacccttaacctaataattacatccgaccatggtatgacccaatgtagcgaagaacgactgatcgaacttgatcagtacctggacaaggaccactacacacttattgaccagtccccagtggccgcaattctgcctaaagaagggaagttcgacgaagtatacgaggccttaacccatgcccacccaaatttaaccgtgtacaaaaaggaagacgtacccgagcgctggcactacaagtacaatagcagaatccagcccatcattgccgttgcagatgaaggatggcatatcctgcaaaataaatcggacgattttctgttgggaaatcacgggtatgacaacgccctggccgacatgcaccccattttcctcgcacatggtccagcgtttcgaaaaaactttagtaaggaagcaatgaactccacagatctgtacccactgctgtgtcacttgctcaatatcacagccatgccacacaatgggagcttttggaacgtccaggacctgctcaacagcgccatgcctagggtggtgccctatacccagtcaacaatcctgctgcccggaagcgttaagccagccgaatacgaccaggaaggctcttacccttacttcatcggcgtgtcccttggttctattattgtcatcgtgttctttgtgattttcattaagcacctgatccactctcagatccccgcactacaggacatgcatgctgaaattgctcagccattacttcaagcctag

SEQ ID NO: 10217 - DNA, 1254 bp, Artificial Sequence
  Description of Artificial Sequence: Synthetic coding sequence
atgcgattcgcctggacagtgctgttattgggaccgctgcagctgtgcgcgctggttcactgcgctccccctgcggcaggccagcagcagccgcctagagaacctccggctgcccctggggcttggaggcagcagatccagtgggagaataatggccaagtgttctctctgttgagtctagggtctcaataccagcctcagcggaggcgggatcccggtgcagcggtgcctggagccgcaaatgctagtgctcaacagcctaggacgccaatcctgttaattcgagacaaccgtacagcagccgctcgtactcgcactgcaggaagtagtggagttactgctgggaggccccgacctacagccagacactggtttcaagccggttacagcacctcccgcgcaagagaggctggtgcatcccgtgctgaaaaccagacagctccgggagaggtacccgctctgtccaacctcagacccccttcccgggtcgatggaatggttggcgacgacccctataatccctacaaatattctgacgacaacccatactacaactattacgacacctacgagagaccgaggccaggtgggcgataccgacccggttacggtaccggctactttcagtacggcctgccggatctggtggccgatccatactatatccaggcaagtacatacgtccagaaaatgagcatgtacaacctacgctgcgctgccgaggaaaactgcctggcgagcaccgcataccgagctgacgtgcgcgactacgaccatcgcgtgcttctacggtttccccaaagggttaagaaccaaggtacctccgatttcttaccatcacggccaagatatagctgggagtggcacagttgccatcagcattatcattcaatggacgagttttcgcactacgaccttcttgatgccaacactcagcgcagagtggctgagggccataaggcctccttttgtttggaagacacctcttgtgattatgggtaccatcgacggtttgcctgtaccgcccatacacagggcctcagtcccggttgttatgatacgtatggggcagatattgactgccagtggattgacatcacggacgttaagccaggcaactatattctgaaagtcagcgtgaatccttcatatctggtccccgagtcggattatactaacaacgtggttcggtgcgatatccgctacacgggccaccatgcatacgcctcgggctgcacaattagcccatactag

SEQ ID NO: 10218 - DNA, 879 bp, Artificial Sequence
  Description of Artificial Sequence: Synthetic coding sequence
atgggtgagaaatctgaaaactgcggcgtgcccgaggacctcctgaacggcctcaaggtgaccgatactcaagaggcagaatgcgcgggacctcccgtccctgaccctaagaaccagcactcacagtccaaactccttcgcgacgacgaggcgcatttacaggaggatcagggggaggaggagtgtttccatgactgcagtgcttccttcgaggaggaaccaggggctgacaaagtggagaacaagagcaatgaagatgttaattcaagcgaactcgatgaggaatacttaatcgagctagagaaaaacatgtccgatgaagagaaacagaaaaggcgagaagaaagcacaagactcaaggaggagggcaatgaacagtttaagaagggggactacatcgaggcagagtctagctatagcagggcccttgagatgtgcccctcttgttttcagaaggagcgctcaatcttgttctctaatcgggcagctgccaggatgaagcaagataagaaggaaatggccattaacgattgtagcaaagcgatccagcttaacccctcttacatccgggcaatcctgagacgggctgagctgtacgaaaagaccgacaaattagacgaggcgctagaggactacaagagtattctcgagaaagacccaagcattcaccaggctcgcgaggcgtgcatgcgactgcctaagcaaattgaggaaagaaacgagagactgaaggaggagatgctggggaagttgaaggatttagggaaccttgtgctgagaccttttggtctcagtactgagaatttccagattaagcaggactcgagcaccggttcatacagtatcaatttcgttcagaaccccaataacaaccgatag

SEQ ID NO: 10219 - DNA, 2316 bp, Artificial Sequence
  Description of Artificial Sequence: Synthetic coding sequence
atgtcaggcttctttacaagcttagaccctcgcagggtccagtggggggctgcttggtatgcaatgcacagccggattctgcggactaagccagttgagagcatgctcgagggaactggcacaacgacagcacatggtacaaagttagcccaggttctgactacagttgacctgattagtctgggagtcggatcttgtgtgggcaccggcatgtatgttgtgtcaggtctggtggcgaaggaaatggctggtcctggtgtgattgtctcctttattatcgcggctgtggcctccatcctgtctggcgtgtgctatgccgaattcggtgtccgcgtccccaagaccaccgggtctgcctatacctacagctacgtcacagtgggcgagttcgtcgcttttttcattgggtggaaccttatcctggaatacctgataggtacagcagctggcgcatctgccctcagcagtatgtttgactcactggcaaaccatactatctctagatggatggccgacagcgtagggactttgaatggcctgggtaaaggagaggaatcctaccccgacctccttgcactcctaatcgctgtcatcgtgacgatcatcgtggcattaggggttaagaactccatcggttttaacaatgtgttaaatgtcctgaatctggcagtgtgggtgtttataatgattgcagggctgttctttataaatggtaagtactgggcagaggggcagtttcttccgcatggttggtcaggggtgctccagggagcagcaacttgcttctacgcgttcatcgggttcgatattattgccacgaccggggaggaggccaaaaacccaaacacctccatcccctacgcaatcaccgcaagtctggtgatttgcctaactgcctacgtttcagtgtccgttatacttactctcatggttccctattacaccattgacactgaatcccctctgatggagatgtttgttgctcacggtttctatgcggctaaattcgtggtcgctatcgggagcgtagctggccttacggtcagcctgttgggtagcttgttcccaatgccgagggtgatatacgctatggctggagatggcctgctcttcagatttctagctcacgtgtcttcctacactgaaacacccgtcgtggcttgcatcgtttccggcttcctggctgctctgctggccttgcttgtgtctttgcgcgatctgattgagatgatgtccatcggaactctccttgcatacaccctggtgtccgtgtgcgtgctcctattgaggtaccagcctgagtccgacatagacggctttgtgaagtttttatcggaggagcacaccaagaaaaaggagggtatactggctgattgcgagaaggaagcatgttctcctgtgtctgaaggcgatgaattctctgggcctgctactaacacctgcggggcaaagaatctgccaagcctgggggacaacgaaatgctcatcggcaaatctgataagagtacctataatgtgaaccacccgaactatggtaccgttgatatgactactggaatcgaagccgacgaatctgaaaatatatacctgataaaactgaagaaactgatcggccctcactattataccatgagaattcggctgggcctgccaggcaaaatggatcgcccaaccgcagccacagggcacaccgtgaccatctgcgtgttgctgctgttcatcttaatgttcatcttctgttccttcataatattcggatccgactacatcagcgagcagtcctggtgggccattctgttggtcgtgctgatggtgctgcttattagcactctagtgttcgtgatactgcagcagcctgagaatcctaagaaacttccatacatggcaccgtgtttgccctttgtccctgcctttgctatgctagtgaatatatatctcatgcttaaactctcaactataacatggatcagatttgctgtctggtgctttgtcggcctcctgatctactttgggtacgggatctggaactcgactctggaaatcagcgcacgcgaggaagccctgcatcagtctacctaccagcgctatgacgtcgatgatccatttagcgtggaggagggtttttcgtacgccaccgaaggtgaatcccaggaagattggggcggacctaccgaagataaaggattctactaccaacagatgtctgacgcaaaagccaacggacggacttcttctaaggcaaaaagtaagagcaaacataagcaaaacagcgaggcgctcattgccaatgatgagctggactattcgcccgagtag

SEQ ID NO: 10220 - DNA, 513 bp, Artificial Sequence
  Description of Artificial Sequence: Synthetic coding sequence
atgggcaacgaggcttcctatcctttggaaatgtgctctcactttgatgctgacgaaatcaaacggctgggcaaaaggttcaagaagctagatctggataattcaggatccctctcggtagaagagttcatgagtcttccggaactacagcagaaccctcttgttcaacgggtgattgacattttcgacaccgatggtaacggtgaagtagatttcaaggaattcatcgagggcgtgtctcagttcagtgtaaaaggggacaaagagcagaagcttcgatttgcattcaggatttacgatatggacaaggacggctatatctccaacggggagctgttccaggtgctgaaaatgatggtgggaaataacctgaaggatacacagctacagcagatagtcgacaaaaccattatcaacgccgacaaggacggcgacggaagaatatcttttgaagaattttgcgccgtggtgggcggtttagacattcataagaagatggtcgtcgatgtctag

SEQ ID NO: 10221 - DNA, 1218 bp, Artificial Sequence
  Description of Artificial Sequence: Synthetic coding sequence
atgagtagctccgtgaaaacgcccgctttggaagagttggtgcctgggagcgaggagaagcccaaaggacgtagcccactgtcttggggatcactgttcggccacaggagtgaaaaaatcgtatttgccaaatccgatggcggtacagatgaaaacgtgctcacagtcaccattacagaaacgaccgtgatcgaatcggatcttggggtttggagctcccgtgccttgctgtatttgactctatggttctttttctctttctgcaccctgttcctgaataaatatattctgtccctcctcggtggcgagcctagcatgctgggggctgtacaaatgctcagcaccacagttatcggctgtgtcaagaccctagttccatgctgtctttaccaacataaagccagactttcttatccccctaacttcctcatgaccatgttattcgttgggcttatgcgcttcgccaccgtggtgcttggcctcgtctcgctgaaaaatgtggcagtaagctttgccgagacggttaagtcttcagcacccatttttacagtgatcatgtcacggatgattctcggggaatacaccggacttctggttaacctttctctgatccctgtgatggggggactggcgctctgtaccgctactgaaatatccttcaacgtgctggggttcagcgccgctctgtccaccaatattatggactgccttcagaacgtgttctcaaagaagcttctgagcggtgacaagtacaggttttccgcccctgaactgcagttttatacgagcgcggcagcagtggccatgttggttcctgccagggtttttttcactgacgtgccagtgattggccgaagcggaaaatcattctcatacaatcaggatgtggtcctgcttctgctgactgacggcgtcctctttcacctccagagcgtgacagcatacgcactgatgggtaagatttcaccggtgacctttagcgtggcctcgacggtcaaacatgctctcagtatttggctgtcggtgatcgtgttcggaaacaaaatcacatcactgtcagcagtgggaactgccctggtaactgtcggggtgctgttgtataacaaagctcggcaacaccaacaggaagctctccagagcctggctgctgccactggccgtgctcctgacgatactgtggaaccattgctcccccaggatcctcggcagcatccttag

SEQ ID NO: 10222 - DNA, 1131 bp, Artificial Sequence
  Description of Artificial Sequence: Synthetic coding sequence
atgctgaagaaaatatccgtgggcgtcgcaggcgacctgaacacagtgacaatgaagcttgggtgcgtgcttatggcctgggccctctacctttccctcggcgtcctgtgggtggctcagatgcttctcgcagcgagttttgagacactccaatgcgagggccctgtgtgtaccgaggagtcaagctgccacacagaggacgatctgactgacgccagagaggccggttttcaggtcaaagcctacactttctctgagccctttcacttaattgttagctacgactggcttatccttcagggtccagccaaacccgtcttcgagggagaccttctggtgctgagatgccaggcgtggcaggattggcctctgacccaagttacattctacagagacggttctgccctaggtcctcctggccctaatagggagttctctatcaccgttgtacagaaggccgactctggacattaccactgttcaggaattttccagtctccagggccaggcatccctgagactgcatccgttgtagccattacagtccaagaactttttcccgcacctattctaagggcagtccccagcgctgaacctcaggccggatcaccgatgacgttgagctgtcagaccaaacttcctctacagcggagtgctgctcgactactgtttagcttctacaaggatggccgaattgttcagagcagggggttaagctccgagttccaaattccaacggcatcagaggatcactcaggatcctattggtgcgaagccgcaaccgaggataaccaggtttggaagcaaagcccacagttggaaattcgggtgcagggtgctagcagtagtgccgcaccccctacacttaatccagccccacagaaaagtgcagcgcctggaactgcccctgaggaggccccaggcccactgcctcccccaccaacacccagttccgaggaccccggattttctagcccccttgggatgccggatcctcacctataccaccaaatggggctcttactcaaacacatgcaagacgtgcgggtgctgctggggcacctgctgatggaacttcgggagctgtctggacacaggaagcccggtaccacaaaagcaactgctgagtag

SEQ ID NO: 10223 - DNA, 1572 bp, Artificial Sequence
  Description of Artificial Sequence: Synthetic coding sequence
atggctcgtaaagcactgaagttggcgtcttggacctctatggctctggcagcgtccggcatatacttctattctaataagtacctcgatcccaatgacttcggcgctgttcgggtggggcgagcggtcgccacgacagctgtcatcagctacgattacctaacttctctcaagagcgtgccctatggctcagaggaatatctacagctgcgcagtaaagttcacctgaggagtgcaagaaggctgtgtgagctgtgttgtgcgaacaggggcacgttcatcaaagtggggcagcatctgggcgcactcgactacctcctccccgaggagtacacctccacactcaaggtactgcactcccaagcccctcagtcctctatgcaagaaattaggcaggtgattagagaagatctcggaaaggagattcatgatctctttcagtcttttgatgatacaccactgggaaccgcttctttagcccaggtgcacaaggcggttctccatgacgggaggactgtggccgtaaaggtgcagcaccctaaggtccgggcacagagctctaaagacatcctcttgatggaggttctggtcctggcagtgaagcaattatttcccgaattcgaatttatgtggctcgtagacgaggctaagaagaatctcccactagagcttgatttcctgaacgaaggccgaaacgcagagaaagtgagtcagatgctgagacacttcgactttctgaaggtccctaggatacattgggacctgtctacggagagggtgctactgatggagttcgtggacgggggacaggtgaatgaccgagactacatggagagaaataagatcgatgtgaacgaaatatcccgccatttagggaaaatgtacagtgagatgatatttgtcaacggattcgtccactgtgaccctcatcctgggaacgtgctggtgcggaagcaccccggaacaggcaaggctgaaattgtactgctagaccacggcctgtatcagatgctaaccgaggagttcagattaaactactgccacctctggcagagcttgatttggacagatatgaagcgtgtgaaggagtattctcaaagactcggggcaggagacctctaccccctcttcgcctgcatgctgacagccagatcctgggatagcgtgaaccgaggcatcagccaggctcccgtgaccgctacggaggacttggagatccgaaacaatgctgccaactatctgccgcaaatcagccacctgctgaatcatgttccacgccaaatgctcctgatccttaagaccaacgatctcttgcgagggatcgaggcagccttggggacccgcgctagcgccagtagctttctcaatatgtcacgctgctgtatccgcgcactggctgagcacaaaaagaagaatacatgcagtttctttaggagaacccagattagcttctccgaagcattcaatctctggcagatcaatctgcacgaactaatcctaagggttaagggacttaaactggctgaccgtgtcctcgcactgatttgctggctgttccccgctccattatag

SEQ ID NO: 10224 - DNA, 1197 bp, Artificial Sequence
  Description of Artificial Sequence: Synthetic coding sequence
atgtggcttctcctgacaatggcctctctcattagcgtgctagggacaacacatggcctgttcggtaaactgcatcccggatcccctgaagtgaccatgaatatcagccaaatgataacctattgggggtaccctaacgaggagtacgaggtggttaccgaggatgggtacatccttgaagtgaacaggatcccctacggcaaaaagaacagcgggaacacaggccaaaggcccgtggtcttcctgcaacacgggttgttagcgagcgctacaaactggataagcaacctgcctaacaatagtctcgcattcattctggccgacgcaggatatgacgtgtggcttggaaatagtaggggcaatacgtgggccagaaggaacctgtactactctccagactccgtcgagttctgggcattcagttttgatgagatggctaagtacgatctgccagccaccatcgacttcatcgtgaaaaagactggacagaagcagctgcactatgtgggtcattcccagggaactaccatcggattcatcgctttctctacgaacccgagcttggctaaacgcatcaagaccttctatgccttggcacccgtggccacagtgaagtacaccaaatcgctcatcaacaaattgaggttcgtgccgcaaagcctgtttaagtttatctttggcgataagatattttatcctcataatttcttcgaccaattcctggccactgaagtgtgctcgcgcgagatgcttaacctcctttgcagcaatgcactgttcattatctgcggctttgattctaagaactttaacacaagccggctggatgtttacctgtcacacaatcctgccggtacaagtgtccagaatatgtttcactggactcaggccgttaagtccggcaaattccaggcttacgattggggatctcccgtgcagaatcggatgcactacgatcaaagtcaacccccttattataatgtcaccgccatgaacgttcccattgcagtgtggaatggcggaaaagatctgctggccgacccgcaggatgtaggtctgctgctgcccaagctccccaacttgatttatcacaaggaaatcccattctataatcacctggacttcatctgggccatggacgccccacaggaggtctataacgatattgttagtatgatttctgaggacaagaaatag

SEQ ID NO: 10225 - DNA, 555 bp, Artificial Sequence
  Description of Artificial Sequence: Synthetic coding sequence
atgaggggacaggggaggaaggaatccctttccgattcgcgggacctagatggctcctatgatcagcttactgattcagttgacgatgagtttgagcttagcacagtgtgtcaccggcctgaaggtctggagcagttacaagagcagaccaagttcacccgaaaagaactgcaggtactctatcgaggatttaaaaatgagtgtccctccggcatcgtgaacgaagagaactttaagcagatctatagccagttctttccacagggggatagttccacctatgccacattcctcttcaatgcatttgacaccaatcacgacggctccgtgagctttgaggaaatgctggacatcatgaaaagtatctacgatatgatgggtaagtatacctacccggcactgcgcgaggaggctcccagagagcatgtagaatcttttttccagaagatggatagaaacaaggatggtgtggtgacgatagaggagttcatcgagtcctgtcagaaggtccagctccctgcgttgtacatcactttaacctggactcaggcttag

SEQ ID NO: 10226 - DNA, 3900 bp, Artificial Sequence
  Description of Artificial Sequence: Synthetic coding sequence
atgtccttacaagaaatgtttcgtttcccaatgggcctgctcctggggtccgttctgctggtggcaagcgcgccagccacgctggagcccccaggctgttccaacaaggagcagcaggtaaccgtatctcatacttacaaaatcgatgttccaaaatccgccctcgtgcaagttgatgcagatcctcagcctttgtctgacgacggcgcttccctccttgcactcggcgaggcgcgagaggagcagaacatcattttccgacataatatacgcttgcagacaccacagaaagattgcgagctagcaggctccgtgcaggatctattagctagagtgaaaaagttggaggaagaaatggtggagatgaaagaacaatgttctgctcagcgctgctgccagggggtgactgatctctcgaggcactgtagtggccacggcaccttttctctggagacttgcagctgtcactgcgaagaaggcagagagggccctgcgtgtgaaagacttgcatgtccaggtgcttgctctggacacggaaggtgtgtcgatgggaggtgcctgtgtcatgagccctatgtgggagctgattgtgggtatcctgcatgcccagagaattgctcaggacatggtgagtgtgttaggggagtgtgtcagtgtcatgaagatttcatgagcgaagactgtagtgagaagaggtgtccaggcgactgttcagggcacgggttttgcgacacaggcgaatgctactgtgaagagggcttcactggcttggactgtgcacaggtggtcacaccacaagggctgcagcttcttaaaaacactgaggattccctcctggtgagctgggaaccaagctcacaagtggaccactatctcctcagctattatcccctgggcaaggagctcagcggcaagcagattcaggtgcctaaagagcaacacagctacgagatcctaggtctgcttccaggcaccaaatatatagtgaccttacggaacgtgaagaacgaggtctcaagcagcccccaacatcttttagctaccacagatcttgcggtgctggggactgcttgggtgacagacgaaactgagaactctctggacgttgagtgggagaacccgtccacagaggtggattactacaaactgagatatgggcctatgaccgggcaagaggtagctgaagtaaccgtcccgaagtcctctgatccaaagtccagatatgatatcaccggcctgcatccaggaaccgagtataaaattacggtggtgcctatgaggggggagttggaaggaaaacccatcctgctcaacgggagaactgaaatcgacagtcccaccaatgtggtgaccgatcgcgtgactgaggataccgcaacagtaagttgggacccggttcaggctgtgatagacaaatacgtagttcggtatacgtccgccgacggggataccaaagagatggccgtgcacaaggatgaatccagcaccgtgctgaccggtttgaagcctggggaggcttacaaagtgtacgtctgggcagaaagaggaaatcagggctctaagaaagcagataccaacgctctcaccgagatcgattccccggcaaacttggtgactgaccgtgtgacagaaaataccgccacgataagctgggacccggtacaggcaaccattgacaaatacgtggtccgctacacttcggctgatgaccaggagacaagggaggtgcttgtgggaaaggagcaaagctctacagtgcttacaggcctgagaccaggcgttgagtacacagtgcatgtgtgggcacaaaagggcgacagagaatcaaagaaggccgatacgaacgctcccacggatatcgattccccaaaaaatctagttacagatcgcgtcacggaaaacatggcaactgtgagctgggatccagtccaggctgcgatcgacaaatacgtggtgcggtacaccagcgcaggcggagagactagagaggtgcccgtggggaaagaacaatccagtaccgtcctcacgggacttaggccaggcatggagtacatggtccacgtttgggcccaaaaaggagaccaggagagtaagaaagctgacacaaaagcacagaccgatattgatagccctcagaatcttgtgactgatagggtaacggaaaatatggccacagtgtcctgggatcctgtgcgcgcaacgatcgatagatatgtcgtccgatatacctcggcgaaagacggcgagacacgtgaggttcccgttggaaaggagcagtcatccaccgttctgaccgggctccggccaggggtagaatacacggtccatgtgtgggcgcagaaaggagctcaggaaagcaagaaagcggatacaaaggcccagaccgatattgactctccccagaaccttgtgacagactgggtcacagagaacactgccacagtgtcttgggatcctgtgcaggctaccattgatcgttacgtggtgcactatacatcggctaacggcgagactcgagaggtgcctgtgggaaaggaacaatcttcgaccgttcttaccggactgcgccctgggatggagtataccgtgcatgtatgggcccagaaaggaaaccaggagagcaagaaagccgataccaaagcacagaccgaaatcgatgggcctaagaacctcgttactgactgggtaacagaaaatatggccaccgtgtcttgggatccagtccaagcgactatcgataagtatatggtccgctatactagcgcggatggagaaacacgggaagtgccggtcggcaaggagcacagtagtactgtgctgactggcctgcgtcccggaatggagtatatggtgcacgtttgggctcagaagggtgcccaggaaagtaagaaggccgacacaaaagcccagaccgaattggatcccccacgaaatctcaggccatcagcggttactcagagcggtggaattttgacctggaccccaccaagtgcccagatccacggatacatccttacgtaccagttcccggacggcacagtcaaagagatgcagcttgggcgtgaagaccagcgattcgccctacagggtctagagcaaggcgcaacctacccagttagtttagtcgctttcaaaggtggcaggaggagtagaaatgtctcaaccactctgtctactgtgggcgctcgattccctcacccttccgactgtagccaagttcagcaaaatagcaatgccgcttctggactgtacaccatatacctgcacggcgatgcgtccaggccattacaagtttactgtgacatggaaactgacggagggggttggatcgtctttcagcggaggaacaccggccagctcgacttctttaaaagatggagaagttatgtggagggattcggtgacccaatgaaggagttctggctggggctggataagcttcataaccttaccactggaacacctgcacgatacgaagtaagagttgacctgcagactgcaaatgaatccgcttatgcaatctacgacttcttccaggtggcctccagcaaagagagatataagctcactgtcggcaaatacagaggaacggctggagacgcactgacctaccataatggctggaagttcaccacatttgaccgtgataatgatattgctctcagtaactgtgccctcacccatcacggtggttggtggtacaaaaactgtcacttggctaatccaaacggcaggtacggggaaactaagcactcagagggggtgaactgggagccctggaagggacacgaattcagtatcccttatgtagagctcaaaattagaccccatgggtatagccgggaacctgtcctgggccgaaagaagagaactctgagggggcgattgagaaccttctag

SEQ ID NO: 10227 - DNA, 1662 bp, Artificial Sequence
  Description of Artificial Sequence: Synthetic coding sequence
atgacgcggggtgggcctggaggacggcctgggcttcctcaacctccacctctgctcctattactcctgttacttcccctgctgcttgtcaccgccgagccccctaagccagccggtgtctactacgctacggcgtactggatgccggctgagaagacagtgcaagtcaagaacgtaatggataaaaacggggatgcctatggcttctataacaatagcgttaaaacgacgggctggggaatcttggaaatccgggctggttatggaagtcagacattgagcaacgagatcatcatgtttgttgcagggtttctggagggctatttaacagcccctcacatgaacgaccactacacaaacttgtatccccagctcatcacaaaaccctccatcatggacaaggttcaagattttatggagaaacaagacaaatggacaaggaagaatataaaggagtataagacagatagcttttggagacatactggttacgtgatggcccagatagatggactctatgtcggagcgaagaaaagggccatccttgagggtactaaaccaatgaccttattccagattcagtttcttaacagcgtgggagatcttctggatctcatccccagcctgagtcccaccaaaaatgggagcctgaaggtgtttaagcgttgggacatgggtcattgcagcgctctgatcaaggtactccccggattcgaaaacatcttgtttgcgcacagtagctggtatacctatgcagccatgctccgcatttacaagcactgggattttaatgtcattgataaagacacttcctccagccgtctgtccttctccagctaccctggtttcctggagagcctggacgacttttacatcctgtctagcggactgatcctgctgcagactactaattccgtgttcaacaagacactgctcaaacaggtcatccctgagacgctgcttagttggcagcgagttcgagtcgcaaatatgatggccgactccggaaaacggtgggccgatatcttcagcaagtataactcaggaacctacaataatcagtacatggtactggacctgaagaaggtcaaacttaatcactcactggacaaaggcactttgtacattgtcgaacagatcccaacttatgtggaatattcggaacagaccgatgtgctcaggaagggatattggcctagctacaatgtgcccttccacgaaaagatttacaactggtctggctatcccctcctggtgcaaaagctgggccttgactactcgtatgatctagcacccagagccaagatatttaggagggatcagggcaaagtgacagatacggctagcatgaaatacattatgcggtataacaattacaagaaggacccttacagccggggagatccttgtaacaccatctgctgccgggaggatctgaatagtccgaatccctctcccggaggctgctacgacacaaaggtcgccgatatttatctggccagccagtacacaagctacgcaataagcgggcctactgtgcaggggggattgcccgtattccggtgggacaggtttaataagactctgcaccaggggatgcccgaggtatacaacttcgacttcattacaatgaaaccaattctgaaacttgatatcaaatag

SEQ ID NO: 10228 - DNA, 2271 bp, Artificial Sequence
  Description of Artificial Sequence: Synthetic coding sequence
atgtcacgccctggcacggctactccagctctggccctcgtgctgttggcggttacactggcgggagtaggcgcacagggagctgctctagaggatcccgattattacgggcaggaaatctggtcgagggagccgtattacgccagacccgagccagagctggagaccttctccccccctctccccgctggcccaggcgaagagtgggagagacggccacaggagccccgtcctcctaaacgagcaaccaaacctaaaaaagcccctaaacgggagaaatcagcccctgagcctcctcctcctggtaaacacagtaacaaaaaggtgatgcgtacaaaatcaagcgagaaagccgcaaatgacgaccacagcgtgcgcgttgctcgtgaggacgttcgagaatcttgtcctcctctgggtctagagactctgaaaattacagattttcagctccacgcgagcaccgtgaagcgttatggtctgggcgcacatcgtggaaggctgaacatacaagccggaataaatgaaaacgatttttacgatggagcatggtgtgccggaaggaatgatctccaacaatggatcgaggtggacgcaaggcgattaaccagatttacaggtgtaattacacaaggaagaaactcactgtggctgtccgactgggtaaccagctacaaggtgatggtatctaacgactcacacacttgggtcacagtaaagaatggaagtggcgatatgatttttgaggggaacagcgaaaaagagatccccgtcttgaatgagcttcccgtgcctatggtggcgcgatatatccgcataaatcctcaaagttggtttgacaacggttctatttgcatgcgaatggagatcctagggtgcccactcccagatcctaacaattattatcaccgacggaatgagatgacgaccacagatgatctggacttcaagcaccacaactataaagagatgcgccagttgatgaaagtcgtaaatgaaatgtgtccaaacatcacgcgcatctataatatcggcaaatcccaccagggcctaaagctgtacgctgtagaaatctccgaccatccgggtgagcacgaggtgggcgaacccgagtttcattacatagccggagctcacggcaatgaggttttgggacgggaattactgctgctgctggtacagtttgtgtgtcaggagtacctcgccagaaacgcaagaatcgttcacctggtggaagaaactcggatccatgtgctcccttcactgaatcctgacggatatgaaaaagcctacgaaggaggatctgaactggggggttggtcgttggggaggtggactcacgatggcatagatataaataacaatttccccgatctgaatacccttctgtgggaagctgaggaccgacagaacgtgccacggaaagtccccaatcattatatcgccatacccgagtggtttttgagtgagaacgcaaccgtagcagccgagactagagccgtaattgcttggatggaaaagatcccgtttgttctagggggaaacctgcaggggggagagcttgtagtcgcctacccgtacgaccttgtacggtcgccctggaagacccaggaacatacgcccaccccagacgaccatgtgttccggtggttagcatattcttacgcctctacccaccgtctgatgacggacgcgaggagacgggtttgccataccgaagacttccagaaagaagagggaacagtgaacggagcctcttggcacactgtggcaggatccctgaacgacttttcataccttcacactaattgcttcgagctgtcaatctacgttggctgcgataagtacccacacgagtctcagcttcctgaggagtgggagaacaacagagaatcactgatagttttcatggagcaagtgcatagaggtataaaaggtctcgtccgggattcccatggcaagggcatcccaaatgcgattataagcgttgaaggtattaaccatgatattaggactgccaacgatggtgactattggcgattgttgaatcctggcgagtacgttgttaccgctaaggctgaagggttcactgctagcaccaaaaactgcatggtcgggtacgacatgggggctacaaggtgcgacttcaccctgtctaagacaaacatggctcgcatccgggagataatggaaaagttcggcaaacagcctgtcagtttgcctgccagacgcctgaagctgcggggtcagaagaggcgtcagagagggtag

SEQ ID NO: 10229 - DNA, 702 bp, Artificial Sequence
  Description of Artificial Sequence: Synthetic coding sequence
atggctaccccaccctttaggcttatcaggaaaatgttctcattcaaggtctctagatggatgggactggcatgtttccggtccctcgccgcttcatcaccttctattcgacagaagaaactgatgcacaaactacaggaagaaaaagctttccgtgaagagatgaagattttccgggagaagatcgaggattttagggaagagatgtggacgttccgtgggaaaatacatgcattcagaggacagatccttggcttttgggaagaagagcgccctttctgggaagaggaaaaaactttttggaaggaggagaagtccttttgggagatggaaaagtcttttagggaggaggaaaaaactttttggaaaaaatacaggacattctggaaagaggataaagccttctggaaagaagacaatgctctgtgggagagggacaggaacctcctccaggaggacaaggcactatgggaggaggaaaaggcactgtgggttgaggaacgcgcactcctggaaggagagaaggccctgtgggaggacaagacatctctgtgggaagaggaaaatgctttgtgggaggaggagcgcgctttctggatggaaaacaacggccacattgccggtgagcagatgctagaagatggccctcacaacgcaaataggggccagagactgctcgctttttcccggggtcgagcttag

SEQ ID NO: 10230 - DNA, 696 bp, Artificial Sequence
  Description of Artificial Sequence: Synthetic coding sequence
atgatgctgtcatgcctattcttgcttaaagcgctgcttgcactcggctctctcgagagttggattacggctggcgagcacgcaaaagagggggagtgtcctcctcataagaacccatgcaaagagttatgccagggggacgagctgtgccccgctgagcagaaatgctgcactacaggttgtggcagaatttgtagagatattcctaaaggaagaaagcgagactgcccgagagtcattcgcaaacagagctgtcttaagcggtgcattaccgatgagacttgcccgggagtgaagaagtgctgcacgttagggtgtaataaatcttgcgtggtgcccatctcgaaacagaagctagcagagttcggtggagagtgccctgccgacccccttccttgcgaagagctgtgtgatggcgatgccagctgtcctcaaggacacaagtgctgcagtaccggatgtggtcgaacctgcctcggcgatatcgagggcggtcgcggaggggactgtcctaaagttttggttggactgtgcattgttggctgcgtgatggatgagaactgtcaagccggagagaaatgctgcaagagtggctgcggacggttttgcgtgcccccagtgctgccccctaagttaacgatgaatccgaattggactgttcgctctgactctgaactagagatccctgtcccatag

SEQ ID NO: 10231 - DNA, 1050 bp, Artificial Sequence
  Description of Artificial Sequence: Synthetic coding sequence
atgggacccatctccgcacccagttgtcgatggaggattccgtggcaagggctgctgcttacggcatcattgttcacgttttggaatccacctacaactgcacagctcaccatagaagctgtcccatctaacgcagctgaaggcaaggaagtgttgttgctggtccacaacctgccacaagacccaagaggctacaactggtataagggtgagacggttgatgccaatagacgaatcattgggtatgtgatttccaaccagcagatcactcccggacccgcatactccaaccgggaaaccatttacccgaatgcctccttgctgatgaggaatgtcactaggaatgatactgggagctacaccctccaagtaatcaagctgaatttgatgtctgaggaggtcacgggtcaattcagtgtgcaccctgagacccctaaaccaagcatttcatccaataattcaaaccccgtggaagacaaggatgctgtggcgtttacctgtgaacccgagacccagaataccacatacctctggtgggtgaacggccaatctcttcctgtatcacccagattgcagttatccaacggtaaccgcactctgaccctgctgtctgttactagaaacgacgtgggcccatacgaatgcgaaatccagaatccagcatctgcaaacttctctgatcccgtgaccctgaacgtgctctatgggccagatgcacctaccatcagcccctcagacacatactaccatgcaggagtgaaccttaatcttagctgccatgcagcttctaaccctccctctcagtacagttggtccgtgaacgggacttttcaacaatacacccagaagttgtttattcctaatataactaccaagaacagcggctcatatgcttgtcacactacgaactcagccaccgggcgaaataggacaactgttagaatgattacagttagtgacgcactagtgcagggctctagccctgggctatccgccagggcgactgtgagcattatgatcggggtcctcgctcgtgtagctcttatttag

SEQ ID NO: 10232 - DNA, 510 bp, Artificial Sequence
  Description of Artificial Sequence: Synthetic coding sequence
atgaccgcaggcaggcgcatggagatgttgtgcgctggtagggttcctgcactgctcctttgtctgggttttcatttgctgcaggccgtcctttctacaaccgtgatcccaagctgcatccctggcgaatccagcgataactgcaccgctcttgtgcagactgaagacaaccccagggttgctcaagtgagtataacgaaatgctcttccgatatgaatggatactgcctgcatgggcagtgtatatacctggtcgatatgtcacagaactactgtcggtgtgaggtgggctacaccggggttagatgtgagcattttttcctgactgtgcatcagccgctgtcaaaagagtacgttgccctgactgttatcctgatcattcttttcctgattaccgtagtgggctccacatactatttttgcagatggtatcgcaatcgcaagtcaaaggagcctaagaaggagtacgagcgcgtcacgagcggggatcccgagctcccgcaggtatag

SEQ ID NO: 10233 - DNA, 273 bp, Artificial Sequence
  Description of Artificial Sequence: Synthetic coding sequence
atgaagctgtccgtatgtttgcttctggtaacgctcgcactttgttgctatcaggctaatgccgaattctgcccagctctggtttccgaactcctcgatttctttttcattagcgagccgctgtttaagctgtctctggctaagttcgacgctccgcctgaagcggtggctgccaagctgggcgtgaagcgctgtactgaccagatgagcctgcagaaaagatcactgattgcggaggtgctggtcaagatcctgaagaagtgttctgtgtag

SEQ ID NO: 10234 - DNA, 429 bp, Artificial Sequence
  Description of Artificial Sequence: Synthetic coding sequence
atgccaagatgcagatggttgagtttaatcctccttacaatccctctggccttggtcgccagaaaggatcccaagaagaatgagaccggcgtgttgagaaagctcaaacctgtgaacgcctctaacgctaacgtgaagcagtgcctgtggttcgctatgcaggaatacaataaagaatctgaagacaagtatgtatttcttgtagtgaagaccctccaggcccaactgcaggtgacaaacctgctggaatacctgatagacgtcgaaatagccagaagcgattgcagaaaacccctgtcaactaacgagatatgtgccatccaggagaatagcaagctgaaacgaaaattgagctgttccttcttagtgggtgcactcccctggaatggcgagtttactgtcatggagaaaaagtgcgaagacgcttag

SEQ ID NO: 10235 - DNA, 438 bp, Artificial Sequence
  Description of Artificial Sequence: Synthetic coding sequence
atgggtatcggatgctggcgtaacccactgctactgctgatcgcactagtcctcagcgccaagcttggccattttcagagatgggaaggattccagcaaaaactaatgtccaagaagaacatgaattctaccctgaattttttcatccaatcttataataacgcatccaacgacacgtatctctaccgcgtccagcggctgattaggtcacagatgcagctgacaacaggcgtcgaatatatcgtgaccgtgaagattggctggactaaatgcaaacgcaatgacacttctaactctagctgcccactgcagtctaaaaaattgcggaagtctctgatctgtgagtcactgatctacaccatgccttggatcaactattttcaactgtggaataactcctgcctggaggccgaacatgttgggagaaacctgaggtag

SEQ ID NO: 10236 - DNA, 552 bp, Artificial Sequence
  Description of Artificial Sequence: Synthetic coding sequence
atgaaattactgttcccaatctttgcatccctgatgctgcagtatcaggtgaacaccgaattcatcggactgcgccgatgccttatgggattgggcaggtgccgcgatcattgtaatgtcgatgagaaggagatccaaaaatgcaagatgaagaaatgttgcgtaggtcccaaggtcgttaagctaatcaaaaactatttacagtacggtacaccaaacgtcctgaatgaggatgtccaggagatgctgaaaccagcgaagaattctagtgccgtgatacagaggaagcacatcctctcagtactccctcaaatcaagtccacatcgtttttcgccaacacaaattttgtcatcataccaaacgctacaccaatgaattccgccactatttccactatgacccctgggcagattacctataccgccacttccactaagtcaaatactaaagagtcaagagactccgccactgcctcaccaccccctgcaccaccaccaccaaatattctgcccacacccagtctcgaactcgaagaggccgaggagcaatag

SEQ ID NO: 10237 - DNA, 609 bp, Artificial Sequence
  Description of Artificial Sequence: Synthetic coding sequence
atgagagggcacccctccctcctgctactttacatggccttgacaacatgtctcgacacaagtccaagcgaggaaacagatcaggaggtgttcttaggacccccagaagcacagagcttcctctcatcacacaccagaattccacgcgctaaccactgggatctcgagctgcttacaccaggaaatcttgagcgcgagtgtctggaggaacgttgctcctgggaagaggcgcgagaatactttgaagataatacattaacagagcgcttctgggagtcatacatatataacgggaaaggcggtaggggaagagttgatgtagccagtttagccgttggcctgaccgggggaatactgttaatcgtgctggccggtctcggcgcattttggtacctcagatggaggcagcacagagggcagcagccgtgcccccaggaggctgggctaataagtcctttgagccctctgaacccccttggcccaccaacacctctcccgccaccacccccacccccacccggactcccaacctacgaacaggccctggcagcctctggggtgcacgacgcccctcctcctccttacacatctctgcggagaccgcactag

SEQ ID NO: 10238 - DNA, 558 bp, Artificial Sequence
  Description of Artificial Sequence: Synthetic coding sequence
atgagactcctgatcctgacgtgtctggtcgccgtggccttagcgaggccaaagctcccgttgaggtaccccgagcggctacagaatccaagcgaaagtagcgagccaattccccttgaatctagagaggaatatatgaatggcatgaaccgacagcggaatattttgagggagaaacaaaccgacgaaatcaaggatacgcgcaacgagtcaacccagaattgcgtagtagctgaacccgagaaaatggagtcttcgatctcgtcatccagcgaggagatgtccttgagcaaatgcgccgaacagttttgtcgcctcaatgaatacaatcagctgcaactccaagccgcacatgctcaggagcaaatacgcagaatgaatgaaaactcgcacgtccaggtccctttccaacaactcaaccagctcgccgcttacccatacgctgtttggtactatcctcagattatgcaatacgttcccttccctccattttccgatatttctaatcccactgcccacgagaattatgagaagaacaatgtgatgttacagtggtag

SEQ ID NO: 10239 - DNA, 1410 bp, Artificial Sequence
  Description of Artificial Sequence: Synthetic coding sequence
atgattacagaaggcgctcaggctccacgactcctattacctcctttgctgttgctgttaaccttacccgcaaccggctcagacccggtcctgtgcttcacacagtacgaagaatcttccggaaagtgtaagggcttattgggcggaggagtgagtgttgaagactgttgtctaaatactgctttcgcataccagaagcgatctggcggactgtgccagccatgtcggagcccacggtggagcttatggtcaacttgggccccatgctccgttacgtgttctgagggtagccagctgcgatataggaggtgtgtgggctggaatggccaatgttcagggaaagtcgccccagggaccctcgaatggcagctccaggcttgtgaggatcaacaatgttgccctgagatggggggttggagcggttggggcccatgggagccctgcagcgtcacttgttccaagggcacgaggactagaagacgtgcatgcaatcacccagctcccaagtgtggagggcactgtccagggcaagcccaagagtcagaagcatgcgatacccaacaggtctgccccacacatggagcatgggctacctggggtccttggactccatgtagtgcttcttgccacggaggcccacatgaacctaaagagaccagatcccggaagtgctcagctccagaaccatcccagaagccacccggtaaaccatgtcccggacttgcgtacgagcagagacggtgtacgggactgcccccttgtccagtggcaggagggtggggaccatggggtcctgtaagtccatgcccagtgacgtgtggccttggtcaaacaatggagcagcggacatgcaaccacccagtgccccagcatgggggtccgttttgcgccggagacgcaaccagaactcatatttgcaatacagccgtgccctgcccggtagacggggagtgggatagctggggcgagtggagcccttgtatacgcagaaacatgaagagtatctcttgccaagagatccctgggcaacaatcccggggaagaacatgccgcggacggaagtttgatggacataggtgtgcaggccaacagcaggacattcgccattgttatagcatccagcattgtccactcaagggctcttggagtgagtggtcaacatggggactgtgcatgcccccatgcggccctaacccaacacgcgctaggcaaaggttgtgtacccccctgctccccaaataccccccaaccgtgtcaatggtggagggccaaggagagaaaaacgtaactttctggggcagacccttgcccagatgtgaggagctgcagggccaaaagcttgttgtcgaggagaagcgtccctgtctccacgtaccagcatgtaaggatccagaggaggaagagctgtag

SEQ ID NO: 10240 - DNA, 453 bp, Artificial Sequence
  Description of Artificial Sequence: Synthetic coding sequence
atgcttatcgccacctcattcttcctgtttttctcctctgtggtcgccgctccaacacactcatccttttggcaatttcagcgaagagtgaaacacataacaggacgctcagccttcttcagttattatgggtacggctgctactgtggccttggcgacaaaggaatccctgtagacgataccgatagcccatcatccccgagcccatacgaaaaattgaaagagttcagctgccagccagtgcttaactcataccagttccatattgtgaatggcgcagtcgtgtgcggatgtaccctgggccctggcgctagttgtcattgcaggctcaaggcctgcgagtgcgataagcagagtgtgcattgctttaaggagtcattgccaacatacgagaaaaacttcaaacagttcagttctcagccacgctgcgggagacacaaaccatggtgctag

SEQ ID NO: 10241 - DNA, 1347 bp, Artificial Sequence
  Description of Artificial Sequence: Synthetic coding sequence
atgagagagtgcatctcagtgcacgttggacaggctggggtgcagatgggcaatgcctgttgggagctgtactgccttgagcatggtattcagcctgatggccaaatgccaagtgacaagaccatcgggggaggagacgactctttcactacatttttctgcgaaactggggcaggtaagcacgtgccaagggccgtgttcgttgatctagagcctacagtgatagacgaaattcgaaacggaccatataggcagttgttccatcccgagcagctcattacgggaaaggaagatgcagcaaataattacgccaggggccactacaccattggaaaagagatcatagatcctgtactcgacagaatacgcaagctgtcagaccaatgcacaggtttacagggcttcttggtgttccactccttcgggggaggtacagggagtggatttacgagcttgctgatggaacgtctgtctgtcgactacgggaaaaaaagcaagctagaattctcaatttatcccgctccccaagtctctacggcagtggttgaaccttataattccatcctcacaacccacacaactctggaacactctgactgtgcttttatggtggacaacgaggcaatctatgacatctgtagaaggaacctggatatcgagaggccaacatataccaatctgaacagacttatctctcagatcgtaagcagtataaccgcctcgttgcgcttcgatggtgcattaaatgtggaccttacagaatttcagacaaacctggttccataccctaggatccactttcctttggctacctacgcacccgttatctcagccgagaaggcataccacgaacagctgagcgtggccgagatcactaacgcttgcttcgaacctgccaaccagatggttaaatgtgaccctcgccacgggaagtatatggcctgttgtctgctctatagaggagacgtcgtgcctaaagatgtgaacgcggctatagccgcaatcaaaacaaagcggtctatacaatttgttgattggtgtcccactggctttaaagtcggaatcaactaccagccgccaacggtcgtccccggtggcgatctggccaaggtccaacgggctgtctgtatgctcagcaacactactgccatcgcggaagcctgggcccgtttagaccacaagtttgacctgatgtatgctaaacgcgcttttgttcactggtacgtgggcgagggcatggaagaaggagagtttagtgaagctagagaggatatggcagctttggaaaaggattacgaggaggtcggaatcgacagttacgaagatgaagacgaaggcgaagagtag

SEQ ID NO: 10242 - DNA, 942 bp, Artificial Sequence
  Description of Artificial Sequence: Synthetic coding sequence
atgcgggtggttactattgtgattctgttgtgcttctgtaaagcggctgagctgaggaaggctagccccggtagcgtgcgctctagagtgaaccatggacgggcaggaggcggtcgccgtggttccaatccagtgaagagatacgcccctgggctgccctgtgatgtttacacatatctgcacgagaagtatctggactgccaggaaagaaaactggtgtacgtactaccgggatggccccaggatctcttacatatgctgctggctcgtaacaagatcaggaccctcaagaacaatatgttttccaagtttaagaagttgaagtctttagatttgcagcagaatgaaattagtaaaatcgagagtgaggcattctttggattaaataaactcaccacactcctgttacagcataaccagatcaaggtcttgacggaagaggttttcatctacacgccactgttatcttacctccgcctatatgacaatccttggcattgcacatgcgagatcgagacgctcatctccatgttgcagatccctaggaatagaaatttgggaaattatgctaaatgtgagtcccctcaggaacagaagaataagaagctccggcagattaagtcggagcagctgtgtaacgaagaagagaaggaacaactcgaccccaagccgcaggtttctggtaggccccctgtgattaagcctgaagtggacagcaccttttgccataattatgtttttccaattcagaccctcgattgcaaacggaaggagctgaagaaagtacccaacaatatcccgcctgacatcgtaaaactcgatctcagttacaataagattaaccaactcaggccgaaagagttcgaagacgtccatgagctaaagaaactgaatctgtcctctaacggaatcgaattcatcgatccaggctcactaagatag

SEQ ID NO: 10243 - DNA, 972 bp, Artificial Sequence
  Description of Artificial Sequence: Synthetic coding sequence
atgcaagcagcttggctcttaggagctctagtggtgcctcaacttttgggcttcggccatggcgcacgaggtgccgaacgggagtgggaagggggatggggtggagctcaggaagaggagcgggaaagggaggccctgatgctcaagcacctgcaggaggcactcggactgccggctggccgaggtgatgaaaatccagccggtacagtggagggcaaggaagactgggagatggaggaggatcagggtgaagaagaggaggaagaggccacccccaccccgagcagtggaccatcaccttcacctactccagaggatattgtcacctacatcctgggcaggctcgcgggtctggacgctgggctgcaccagctgcacgtccgactccatgccctggacaccagagtagtggagctaacccagggactgaggcaactgagaaatgctgccggagacaccagggatgccgtccaggccttgcaggaggcccaaggtcgagcagagcgagaacatggtagactggaaggttgtttgaaaggcttacgtttggggcataaatgcttcctgctctctcgcgacttcgaagctcaggctgcagcacaggccaggtgtactgccagaggtgggagcctggcacagcccgcagatcggcagcaaatggaggctctgactcgatatctgagggctgctctcgctccgtataattggccagtgtggcttggtgtacacgatcgacgtgctgaaggcctttatctctttgagaacggccaacgggtatccttcttcgcatggcaccgaagcccacggccagaactcggggctcagccttctgcaagcccccaccccctgtcaccagatcagcccaacggcggaacacttgagaactgcgtggcccaggcaagtgacgacgggagctggtgggatcacgactgccaaagaagactctactatgtatgtgagttcccattctag

SEQ ID NO: 10244 - DNA, 1086 bp, Artificial Sequence
  Description of Artificial Sequence: Synthetic coding sequence
atgaacggcctgtcactctccgagctgtgctgcctgttctgttgtcctccctgccccggacgaattgccgctaaactggcattcctcccacctgaagccacttactctctggtgcctgagcccgaaccaggacccggaggcgctggtgccgcaccccttggtaccctacgagccagcagtggagcgcctggacgctggaagctacatctgacagagagagccgacttccagtacagccagcgggaactcgacactatcgaggtattccctacgaagtctgctcggggaaaccgcgtgtcttgtatgtatgttcgctgtgtacctggcgcacggcagggccatcaggctcagggcggacatccccagctcgcttgggttggtcggctgggggacagcaacaaccccgcacccggagggtgtctgctcggaaagtcctgggggacgggtgccgctttggcatgcggatatatacaccttcttgcacgctataccgtgttattcagccacggcaacgctgtagatctgggccagatgagctcattttacatcggcctaggcagccgcctgcactgcaatattttttcttacgactactccggctatggcgctagcagcggccgtcctagtgagaggaacttatacgccgatatcgatgctgcatggcaggcactgcggacccggtatggcattagtcccgatagtattattctctatgggcagtctatcgggaccgtccctaccgtcgaccttgcatccagatacgagtgtgctgcggtagtgctacacagtccacttacaagcggcatgcgtgtcgcatttcccgacacaaaaaaaacatattgttttgacgcgttccccaacatagagaaggtcagtaagatcactagtccggttctgatcattcacggcacggaggatgaagtaattgacttttcacacggcctcgctttatatgagagatgccctaaggctgtcgaaccgttgtgggtcgaaggggctggtcacaatgatatagagttgtactcccagtatctggagcgcctgcgaaggtttatctctcaggaattgcccagtcaaagggcgtag

SEQ ID NO: 10245 - DNA, 1404 bp, Artificial Sequence
  Description of Artificial Sequence: Synthetic coding sequence
atgaggacagccccatcattgaggcggtgtgtctgtctcctgctagcagcaatactggacctggcgagaggctacctcactgttaacatcgagcctctcccacccgtagtagccggtgatgctgttaccctgaagtgcaacttcaaaaccgacggtcgaatgcgggaaatcgtctggtaccgggtcactgatggtggaactatcaagcagaaaatcttcacctttgacgccatgttcagcacaaattattcacacatggaaaactaccgtaagcgagaagacctggtgtaccagagtaccgtgagattgccagaggttaggataagtgacaatggaccttatgaatgtcacgtcggaatctacgatcgcgctacacgggaaaaggtggtccttgccagcgggaacatctttctgaatgtgatggcccctcctacctccatcgaggtcgtcgccgctgacactcccgctcctttttcccgctatcaagcccagaactttactcttgtgtgtatcgtcagcggtgggaagcccgcacctatggtttacttcaagcgcgacggtgagcccattgacgccgtccctttgagtgagccacctgccgcatcatctggcccacttcaggacagtaggccttttagatccctgctgcatcgggacttagatgataccaagatgcagaagtcattgtcgctgttggacgccgagaatagaggaggccgtccctatacagagcggccttcccggggattaacgcccgatcctaatatcttgctccaacctacaaccgaaaatatacctgagaccgttgtaagtcgtgagttccccaggtgggtgcattccgccgagcccacttactttctacggcactcccggactccttcatcagacggtacagtagaggtcagggctctgctcacgtggactttaaatccacaaattgacaacgaggccctgttttcatgcgaggtcaagcacccagctctgagtatgcctatgcaggcagaggtgactctggtcgccccaaaagggccaaagattgtcatgacaccgtctagagccagagttggagatacagtgcggatcctggtgcacggatttcagaacgaggtgttccccgagcccatgtttacctggacacgggtgggctctagactgctcgacggctccgccgaattcgatgggaaggagcttgtgctggagcgagtacctgccgaattgaacgggtcaatgtacaggtgcacagcacaaaatcctcttggctcgacagacacccatacacggttgatagtctttgaaaatcctaacattcccagggggaccgaagacagcaatggctcaattggaccaacaggtgctaggctcactctcgtgctcgccttgactgtgattcttgaactcacatag

SEQ ID NO: 10246 - DNA, 783 bp, Artificial Sequence
  Description of Artificial Sequence: Synthetic coding sequence
atggcccgaccaggcatggagcgttggcgcgatcggctggccctggttacaggtgcctctggagggattggggcagcagtcgccagggcactggtacagcagggcctcaaggtggtgggttgtgcacgcaccgttgggaacatagaggagctggccgcagaatgtaagtccgccggataccctgggacactgataccctaccgctgcgatctgagcaacgaagaagacatcttgtccatgttctcggcaattagatcccagcattccggcgtggatatttgcatcaataatgctggtctcgccagaccagacaccctgctctccgggagcacttctggctggaaagacatgttcaatgtaaatgtgctagcgctttcaatctgtactagagaggcatatcagagcatgaaagaacggaacgtggatgatggccacattattaacatcaactccatgtccggccaccgtgtgttgcccctatccgttacgcacttttattccgctactaagtacgcggttacagccctaactgagggtctgaggcaggaactgcgggaggcgcagacccacatcagggctacatgtatatcacctggagtcgttgagactcagtttgcctttaagcttcacgacaaggaccctgaaaaggccgcagcaacatacgagcagatgaaatgcctgaaaccggaagacgtcgccgaggcggtgatctacgtgctgagtacccctgcccacatccagataggagatatccagatgcggcctaccgaacaggttacctag

SEQ ID NO: 10247 - DNA, 1218 bp, Artificial Sequence
  Description of Artificial Sequence: Synthetic coding sequence
atgagcagccctgcgctaaccgccggtgcctcgggcaaagtcatggacttcaataacggaacatacctcgtcagcttcaccctattttgggagggacaagtctccctgagtctattgttaattcacccatctgagggagcctcagctctgtggcgagccaggaaccaaggctatgataaaatcattttcaaggggaagttcgtcaatggcacctctcacgtgtttaccgagtgtgggttaactttgaatagcaacgcagaactctgcgaatacttggatgacagagatcaggaagctttttactgcatgaaaccacagcatatgccctgcgaagcactgacgtatatgaccactcggaaccgcgaggtgagctacctaacggacaaggagaacagtctgttccataggtctaaagtgggagtcgaaatgatgaaagacagaaagcatattgatgtgacgaattgcaataagcgcgagaagatagaagagacctgccaagtggggatgaaaccacctgtcccaggaggctacacccttcaggggaagtggataacaaccttctgtaatcaagtccagcttgacactatcaagataaacgggtgccttaaggggaagctgatatatctgctgggggactccaccctcagacagtggatatattactttcccaaagtggtgaaaacactgaagttctttgacctgcacgagactgggatttttaagaagcacctgctgctggatgccgaacgtcatacgcagattcagtggaagaagcactcctaccctttcgtgacctttcagctgtacagcctgattgaccatgactacatccccagggaaattgataggctttccggtgacaaaaacacagccattgttattacctttggccagcattttaggccatttccaatcgatatctttattagacgcgcaataggggttcagaaagcaattgaaaggctgtttctgcgcagcccagccacgaaagtgattatcaaaactgaaaacattcgtgagatgcacatagagactgagcgctttggcgatttccacgggtacatacattacctcataatgaaagatatcttcaaagacctcaacgttggcattattgacgcttgggacatgacaattgcctacgggactgatactatccacccacctgatcacgtcataggcaatcagatcaacatgtttctcaactatatatgttag

SEQ ID NO: 10248 - DNA, 597 bp, Artificial Sequence
  Description of Artificial Sequence: Synthetic coding sequence
atgcctgtgcccgcactgtgtctgctgtgggcactggctatggtcaccagaccggcatctgccgctccgatgggaggccctgaattggctcaacatgaggagttaacactcttgttccacggaactttacagctgggccaggctttgaatggtgtctaccgcaccactgagggacgactgacgaaggctcggaattccctcggcctgtacggccgaactatcgagctgctgggccaggaggtgtctaggggccgagatgccgctcaggagctcagggctagccttcttgaaacacagatggaagaagatatactgcaactacaggccgaggccactgccgaggtgctgggtgaggtggctcaggcacaaaaggtcctccgcgattcggtacagcgccttgaggtccagcttcgatcagcctggctgggccctgcgtacagggaatttgaggtgttaaaggcccacgccgacaaacaatctcacattctttgggccctgaccggccatgtccagaggcagcgccgagagatggtcgcacaacaacatcgcctcagacagattcaggaacgtctccataccgcggcattgccggcttag

SEQ ID NO: 10249 - DNA, 1455 bp, Artificial Sequence
  Description of Artificial Sequence: Synthetic coding sequence
atggcaggcccttggacctttacactgctgtgtggactgctcgccgctacgctgattcaggcgacactgtcccctacagcggtgctcatcttgggtccgaaggttataaaggagaagctcacgcaggaactaaaagaccataacgctacgagtattcttcagcagctgccccttctgagtgccatgcgagagaaacccgctgggggtataccagtcttgggatccctggtgaatactgttcttaagcatattatttggcttaaagttatcactgccaatattttgcagcttcaggtcaagccctccgcaaatgaccaggagctactggttaaaattccgctcgacatggttgccggatttaacacaccactagtgaaaactatcgtcgaatttcacatgactaccgaagcccaggcaacaatccgaatggacacctcagcatccgggccaacccgtctggtcctgtcagattgtgcaacctcccacgggtccctgagaatacagttgctgcataagttgagctttctggtcaacgctctcgctaagcaggtgatgaacctgttggtgccatccctgccaaatctagtgaagaaccaactttgtcctgtgatagaagcttccttcaacggtatgtacgccgatctgctccagttagtgaaggttcccattagcctaagcatcgaccgactcgagttcgatctgctttaccccgcaatcaagggcgatacaatacagctctatctgggcgctaagttgctggattctcagggtaaagtgactaaatggttcaataatagcgcggctagcctcaccatgcctacactcgacaacattcccttctcattgatcgttagccaagacgtcgttaaggcagctgttgccgctgtgctgtccccggaagagtttatggtgctgctggattctgtcctacccgagtccgcacataggttgaagagctccatcggtctgataaacgagaaagctgccgataagcttggctccactcagatcgtgaaaattctgacgcaggatacccccgagtttttcatcgatcagggacacgccaaagtagcacaactgatcgtcttggaggtgtttccatcctcagaggcgctgcgcccactgttcactcttggaatcgaggcctctagcgaggcacagttttacacaaagggagatcagctgattttaaacctcaacaacatctccagtgatcgcatccagctgatgaacagcggcatcgggtggttccagccagacgttctgaagaatataattaccgagattattcacagcatactgctccctaaccaaaatggtaagctcaggtctggggtgcccgtgtctctcgtgaaagctctgggcttcgaggcagcagagagctctctcaccaaagacgccctagtgctcacacctgcttctctgtggaaaccatcaagccccgtctcgcagtag

SEQ ID NO: 10250 - DNA, 750 bp, Artificial Sequence
  Description of Artificial Sequence: Synthetic coding sequence
atgcttcagctgtggaagctagtcttgctgtgcggcgtactcacgggaacctccgagtcgctcctagacaatcttggtaatgatctatctaatgtggtggataagctagagcctgtgctccatgaggggttagaaacagtcgacaataccctgaaaggtatactggagaagttaaaggttgacctgggggtcttgcaaaaaagctcagcctggcaattggccaaacaaaaggcacaggaggctgagaaactcctcaataatgtgatctcaaagctgttgcctacgaataccgacatctttggtctaaagatcagtaatagtctcattctggacgtgaaggcagagcctatcgacgacggcaagggcctgaatctgtcatttcctgtcacggccaatgtcacagtggccggacccattattggacagatcattaacttgaaggcctcactggatctgctcacagccgtaactatcgagacagatccccagacccaccagcctgtagctgtgctgggtgagtgcgcgtcggatcccactagtataagtctgtcgctgttggataaacatagccaaatcattaacaaatttgtaaactctgtcattaacacactcaaaagcactgtcagttccctgctgcagaaagaaatatgcccgctgattcgtattttcatacactcattagacgttaacgtaatccaacaggtcgtggacaacccgcagcataaaactcaacttcagacgttgatttag

SEQ ID NO: 10251 - DNA, 1959 bp, Artificial Sequence
  Description of Artificial Sequence: Synthetic coding sequence
atgcaaggccctctactcctgcctgggctgtgtttccttctttccctgttcggagccgtcacacagaaaaccaagacctcctgtgccaaatgtcctcccaatgcgtcatgcgtgaataacacacattgcacctgcaatcatggctacaccagtggatctggtcagaaactctttactttccctctggaaacatgtaacgatatcaatgagtgtacccctccatattcggtgtattgcgggtttaacgctgtgtgctacaacgtcgaagggagcttctactgccagtgcgtgccgggatatcgactgcattccggtaacgagcaattttccaatagcaacgagaacacgtgccaagacactactagtagtaaaacgaccgagggacggaaagagttgcagaagattgtcgacaaatttgaaagtctcttgaccaaccaaaccctttggcgaaccgagggtcggcaggagatttccagtaccgctacgaccatcctgcgagatgtcgaaagcaaagtcctggagaccgctctcaaagatcccgagcaaaaagtccttaagatccagaatgattcggttgcgattgagacacaggccattaccgataattgcagcgaggaacggaagacgttcaacctcaatgtgcagatgaactcaatggatatcagatgctcagatatcatccagggtgacacacagggaccctctgcgattgcgttcatcagctatagctcactgggcaatatcatcaacgccaccttttttgaagagatggacaagaaggatcaggtctacttgaacagtcaagtggtttctgcagcaattgggccaaaaaggaatgtgagtctgagtaagtctgtcactctcacattccaacacgtcaaaatgacaccgagtactaaaaaagtcttctgtgtgtattggaaatcgacaggacaggggtcgcaatggagccgcgatggctgcttcctgatccatgtgaacaagagtcataccatgtgcaattgctcccatctaagctcctttgctgtgctgatggctctcacatcccaagaggaagacccagtgctaaccgtcattacgtatgtgggtctgagcgtcagcctgctttgcctgctgcttgcggcactgacattcttgctgtgcaaggctattaggaacacgagcacaagcctccacctgcagctgtctctctgtctgttcttggcgcatctgctgtttctggtggggatagaccgaaccgaacctaaagtgctgtgctccataatagctggggctctccactatctgtatctcgctgcattcacatggatgcttctggagggcgttcatctgtttctcacagcacgtaatttaaccgttgttaactattctagtatcaaccgcctaatgaagtggatcatgtttcccgtgggctacggagtgccagccgtgacagtggcaatcagtgccgctagctggccccacttgtacggtacggctgataggtgttggctacatttggatcagggatttatgtggagcttccttggccctgtatgcgcaattttctcagcgaacctcgtgttgtttatcttagtattttggatactgaagagaaaactatcctctctgaattccgaagtgagcaccatccagaatactaggatgctggcattcaaagccacagcccagctgttcatccttggctgcacatggtgtcttggacttctccaggtcggcccagccgctcaggtgatggcttaccttttcactatcatcaactctctgcagggtttctttatatttctagtctactgtctgctgtctcagcaagtccaaaagcagtatcagaaatggtttagggaaattgtgaagtcaaagtccgaaagcgagacgtacaccctcagctccaagatgggacctgattctaaaccatccgaaggcgacgtctttccaggacaggtcaagaggaagtattag

SEQ ID NO: 10252 - DNA, 1263 bp, Artificial Sequence
  Description of Artificial Sequence: Synthetic coding sequence
atgtctcctcctcccctgctgcagccgttactgctcctgttgcctctgctgaacgtcgagcccagtggagccaccctgattcgtattcctctgcatcgagtgcagcctggcagacggattttgaacctgttaagaggctggagagagcctgctgagcttcccaaactgggggctcccagcccaggcgacaagcctatctttgtccccctcagtaactatagggatgtgcagtattttggtgaaattggactcggcacgcctccccaaaattttaccgtggcgtttgacaccggctccagcaatctgtgggtgccttcacggaggtgccactttttctccgtcccatgttggctccaccataggttcgacccaaaggcgagctcttctttccaggccaacgggaccaaattcgcaatccagtacgggaccggccgagtcgatggcatcctgtctgaggataaactgacaattggtggcatcaagggtgcttccgtgatctttggagaagccctttgggagccctcgttggtcttcgcctttgcccatttcgatgggatcctgggactgggtttccccattttatccgtcgagggtgtgaggcctccaatggacgtgctcgtcgaacaaggactgctcgacaagccagtattctccttctatcttaaccgcgacccagaagaacccgacggaggagaactcgtgctgggtggaagcgatcctgctcattacataccgcctctgacctttgttcctgtgaccgtgccggcttactggcagattcatatggaaagggtgaaagtagggcctggtttaaccctgtgcgcgaaagggtgtgccgctatcttggacactggtacaagcctgatcacaggtcctactgaggagatcagggcactacacgccgctatcggcggtatcccactgctggccggagagtatatcattttatgttccgaaattccaaaactgcccgctgtatcgtttcttttgggcggtgtgtggttcaaccttaccgcccacgactacgtcattcagaccacacgcaacggtgtgcggctttgcctctcagggtttcaggcccttgatgtgcctccaccggctgggcctttttggattctgggcgacgtcttcctcggaacatatgtggccgtctttgacagaggggatatgaaatcctctgctagggtcgggcttgcgcgtgccagaaccaggggcgctgacctggggtggggcgagacggcccaggctcaatttcctggctag

SEQ ID NO: 10253 - DNA, 1293 bp, Artificial Sequence
  Description of Artificial Sequence: Synthetic coding sequence
atggcctggacttttgaatgcagccgaacaacctctcccgagccgctatccacttccccgtgcagaactacaagcagcagaaactcacctactatgtcttgccccgcatccgttgcgtgtgagccatcaaccagtactactactagttcccctcctaagctaagtgtggcgcctcaatttttaccccgatccctccgtgtggcagacttggccgctaatcaggtaatggaaattttccccctgaccttcggcgagaagccggcattgcgctccgtctatcttcataataaccagctgtcaaatgctgggttgccacctgacgcatttagaggatccgaggccattgccacactttcgttgtccaataaccagctctcctatctccctccaagcctgcccccaagcctggaacgcttgcaccttcaaaacaacctgatttccaaggtccctaggggggcacttagccggcagacacaacttcgagaactttatcttcaacacaatcaattgacagacagcgggctcgacgccaccacattctctaaactccacagcttggaatacttggacttgagtcacaatcagctcaccaccgtgcccgctggtttgccaagaacgttagccatactgcatctgggccgaaaccgcattagacaggtcgaggcggcaagacttcatggggcaaggggcctgaggtatctgttgcttcagcacaaccaactcggcagcagcgggctacccgcaggggcacttaggcccctacgcggtctccacactctccacctttacgggaatggactggaccgggtgcccccagccctgccgagacgcctgagggcactggtgcttccacacaatcatgtagcagctctgggcgctagagacctcgtggcaacacccggactgaccgaactgaatcttgcttacaaccggttggcttccgcacgggtgcaccaccgggcttttaggcggctgcgcgcacttagatcactggaccttgccggtaaccaactaaccaggttacctatgggcctccccactggcttgcggacactgcagctgcagagaaaccagctccggatgctggaaccagagcctctggcaggcctggaccagctgcgagaactctccctggcacataacaggcttagagttggagacattggccctggcacatggcacgaattacaggctctccaagtgaggcatcgtctggtttcccacaccgtccctagggctccaccatcaccatgcctgccgtgccatgtcccaaacatcctggtgagttggtag

SEQ ID NO: 10254 - DNA, 3162 bp, Artificial Sequence
  Description of Artificial Sequence: Synthetic coding sequence
atgtggcagcccagacgaccatggccaagggtaccttggaggtgggccctcgccttgctggccttggtgggagccggactgtgccacgccggtccccagccgggatatcctgctcggccttccgctcgaaacaagaattggtgtgcgtatattgtgaacaagaatgtatcatgcagcgtactggagggctccgagtctttcattcaagcccaatataactgtgcatggaaccagatgccctgcccgagtgctctcgtgtatcgggttaatttccgccctcggtatgtcacacggtataagacagtgactcagctggagtggcgatgttgcccaggcttccggggtggcgactgccaagagggccctaaggatccggtcaagactctccggccaacacccgctaggccccgtaacagtttgaagaaagctactgataatgagccctctcagttctcagaaccacgcaagaccctgagccccaccgggacggctcagccctcctggggcgtggatccaaaggaagggcctcaggaacttcaggagaagaaaatacaagtcctggaggaaaaagtcttacggctgactaggacagtgctagacctgcagtccagcctggccggtgtgtcagaaaatttgaagcacgcaacccaggacgatgcgagcaggacacgggcaccgggactatcatcccagcatcctaagccggatacaactgttagtggagacaccgagaccggccaatcacctggcgtctttaacacaaaagaaagcggaatgaaggacattaaatcagagctggcagaagtgaaggataccctgaagaacaagtctgataagctggaggagctggatggtaaagttaagggatacgagggacagttaaggcagcttcaggaagccgctcaagggccaacagtgaccatgacaacgaacgagttatatcaagcgtacgtcgacagcaaaattgatgccctgcgggaagagctgatggaaggaatggatagaaagctcgctgacctgaaaaatagttgcgagtataagctgaccgggctgcaacaacagtgcgacgattatggatctagctacctgggagtgattgaactcattggcgagaaagagacctccctccgcaaggaaatcaacaatttgagggctcgtctgcaggagccctccgcacaggctaattgttgcgacagcgaaaaaaacggagatatcggacagcagatcaagaccctcgaccagaagattgaaagagtggcagaggctacgcgcatgctgaatgggaggctggacaatgaattcgatcgactgatcgtgcccgagccggacgtggacttcgacgctaagtggaatgagttggatgctaggataaacgttacggagaagaacgcagaggagcactgtttctatatcgaagaaaccttgcggggagcgatcaacggggaggtaggcgacctgaagcagctggtcgatcaaaagatccagagtctggaggacaggctcggatctgtcctgctccaaatgaccaacaacactggggctgagctgagtccgcctggagcggctgcactccctggagtgagtggttcaggagatgagcgcgtaatgatggagctgaatcacctgaaagacaaagtgcaagtagtggaggacatctgtctgttaaacattcagggtaagccacacgggatggaaggcgcacttcccaatcgggaggaccgagcagtcagagactccctacacctcctgaagtccttgaacgataccatgcacaggaaatttcaggaaaccgaacaaacaatacagaagctgcaacaagatttctccttcctttacagccaacttaaccacaccgaaaacgatgttacgcacctgcagaaggagatgagcaactgccgggctggagagaacgctggcatggggcgtttcaccaaagtcggagaacaagagcgcacagttgataccctgccctctccacagcatccggtggctcactgctgcagccagttggaagaacgttggcagaggctgcagagtcaggtgatttccgaactggatgcgtgtaaagagtgcacacagggggtgcagagggaggtcagtatggtagaggggcgagtcagccatatggagaagacttgtagcaagctggacagcatttctggcaacctgcaacgaatcaaggaggggctgaacaagcacgtcagctccctgtggaactgcgtgaggcagatgaacggaactttgagaagccactcacgcgacatatccggcctaaaaaattccgttcagcagttttattcccacgtgttccagatctctaccgacctgcaggatctggtaaaatttcagccatctgctaaagccccaagtcctcctccaccagccgaggccccaaaggaacccctccagcccgaaccggcaccacccaggcccagcggcccagccaccgccgaagaccctggtagacggccagtgctgcctcagcgaccgcctgaagagagacctccgcagccccctggctctactggcgtcatcgcagagacgggccaggcaggcccaccagccggtgccggagtcagcggcagaggacttccaaggggcgttgacggtcagactggctcgggcacagtcccaggtgctgagggatttgccggagctcctggatatcctaagtcccctcctgtggctagtccgggagcccctgtgcccagtctcgtgtcattcagtgccggtctgacccagaaaccttttccaagcgacggcggagtcgtgttgttcaataaggtcctcgttaatgatggagacgtgtataacccgtccacgggcgtcttcacggccccttatgacggcagatacctgattactgctactctcacacctgagcgggatgcttacgtcgaagccgtgttgtccgtaagtaacgcatcagtagctcagctccatactgccggatatcggagagagtttcttgaatatcacagaccacctggcgctctccatacttgtggaggaccaggtgcttttcacttgatcgttcacttaaaagcgggagacgctgtaaacgtggttgtgaccggaggtaagctggcgcacaccgatttcgatgagatgtatagcacttttagtggcgtgttcctctatccattcctgtcccatctctag

SEQ ID NO: 10255 - DNA, 1548 bp, Artificial Sequence
  Description of Artificial Sequence: Synthetic coding sequence
atggcgcagctcttcttacccctgcttgccgctctggtgctggcacaggctccagccgcactcgccgacgtcctggaaggggatagtagcgaagatcgcgcttttagagtaagaatcgctggcgatgcgcctttacagggggtgctcggaggcgcactcaccatcccatgtcatgtgcactatctcaggccacctccctccaggagagccgtgttggggtccccaagggtgaaatggacctttctctcacgcggacgggaggccgaagtgctggtagcccgaggggtacgagtaaaggttaacgaggcctatcgcttccgggtcgccctacccgcttaccccgcttccctgactgacgtgagtctcgcactgtctgagctacgccctaatgattccggtatttacaggtgcgaggtccaacacggaatagacgatagttccgatgcagtagaagattcccagctgtaccctatacagacaccacgcgaagcctgctatggggatatggacgggtttcccggtgtaaggaactacggcgtcgtggatccagacgatctctacgatgtgtactgttacgctgaggacttaaacggggaactctttttgggcgaccccccagaaaaactgacactcgaggaagcacgcgcatactgccaggagcgtggtgcagaaatcgccaccacaggccaactctacgccgcttgggatggcggactcgatcattgttcacctgggtggctggctgacggaagcgtgagatacccaatcgttactcctagccaaaggtgtggtggtggactcccgggagttaaaacactgttcctttttccaaatcagacaggttttccaaataaacacagtcgctttaacgtctactgttttagggggagtacctgccttcttcccagcttacgtcccccaacccagccgcctacacaggatggcctcgaggccattgtaactgtgaccgagactctggaggaactacaactcccacaggaggccacagagtccgagtctcgcggtgccatttactccatcccaatcatggaggacggcggaggcggatcttctacgcctgaggacccagctgaagccccaagaacactgctagaatttgagacccagtctatggtcccccctacagggttttctgaagaagaggggaaggctttggaagaggaagagaagtacgaggatgaggaggagaaggaagaagaggaagaggaagaagaggtggaagatgaggcactgtgggcttggccgtctgaactgtcttcgcccggacctgaagccagcttacccactgaacccgcagcccaagaggagtcactgagccaggcccctgctagggccgtgcttcaacctggtgcaagtccactgcctgatggtgaaagtgaggcctccagacctccccgtgtccatggaccccctactgaaacgctccccaccccgagggagcgaaatttagcgtctccaagccccagtaccttggtcgaagcacgggaagtgggtgaagctaccggtggtccagagcttagtggttag

SEQ ID NO: 10256 - DNA, 1023 bp, Artificial Sequence
  Description of Artificial Sequence: Synthetic coding sequence
atgcctggctggctaacgcttccaacactctgccggttcctgctctgggctttcactatttttcacaaggcacagggcgaccccgcttctcacccaggccctcattacctacttcctccgatccacgaggtgattcactctcatcggggagctaccgcaacgttgccttgcgtgttaggcaccactccgcctagctataaagttcgatggagcaaagtggagccaggggagcttagagaaactctgattcttatcacaaacggcctgcatgcaagaggttatgggcctttggggggtagggccaggatgcggagagggcatagacttgacgctagccttgttattgcaggcgtgaggctggaagatgagggaagatatcgctgtgaacttataaacggtatcgaggatgaatctgtggctctcacgctttcacttgaaggcgtggtctttccctaccagccctctaggggcaggtatcagttcaactactacgaggcaaaacaggcctgcgaggaacaggacggaagacttgcaacttatagtcaactgtaccaggcctggaccgaaggactcgactggtgtaacgctgggtggctactggagggatctgtcaggtatcctgttctcactgcgagggccccttgtggtggtcgaggcaggcctggaataaggtcttacgggcctcgagatcggatgagagaccgatatgacgcgttttgcttcactagtgcccttgctggccaggtgttttttgttccgggacgcctcacgttgtcggaggcccatgccgcttgtaggcgacgaggggctgtggtggcgaaggtgggtcacctctacgccgcatggaagttctcaggtctggaccaatgcgacgggggttggctggccgacggttcggtgagatttcctattaccaccccacgacctcgatgcggcggactcccagaccctggggtaaggtctttcgggttccccaggccacaacaggcagcttacgggacctactgttacgctgaaaactag

SEQ ID NO: 10257 - DNA, 690 bp, Artificial Sequence
  Description of Artificial Sequence: Synthetic coding sequence
atggatctcctccaatttctggcatttctgtttgtgctcctgctttccggaatgggagcaaccggaactctgagaacatcgcttgacccatctttggagatctacaagaagatgttcgaagtcaagcggcgagaacaacttctggccttaaaaaatctggctcagcttaacgatatccaccagcaatacaaaatcctggatgttatgttaaaaggcctgttcaaggtcttagaagacagccgaactgttctaaccgcagcagacgtgctgccagacggcccattcccacaggatgagaagttgaaagatgccttctcccacgtggttgagaacaccgctttcttcggagatgttgtgctaagattcccacgaatcgtgcactactatttcgaccataactccaactggaacctcctgatccgctgggggatttctttttgtaaccagacaggtgtttttaatcaggggcctcattcaccaatcctttcacttatggcacaggaactcggtatttccgaaaaggacagtaacttccagaacccttttaagatcgatcgcaccgaatttatcccctcaaccgaccccttccaaaaagctttacgggaggaagaaaagagacgcaagaaagaggaaaagcggaaggaaattcgtaaggggccacggatcagccgctcccagtcagaactgtag

SEQ ID NO: 10258 - DNA, 465 bp, Artificial Sequence
  Description of Artificial Sequence: Synthetic coding sequence
atgtctgtcggaacaagtctggagcaggctcagatgtcaaccctcacatgcccactattcattcctacagttggccgaaagacggcactgcacagtggggaagactttcaaacgctactcttcgagcgggtgttcgtcaacttggatggatgctttgatatggccaccggccagtttgctgcccctttgcggggtatttatttcttcagtctgaacgttcacagttggaattacaaagaaacctacgtgcatatcatgcacaaccaaaaggaggcagtgattctgtacgcacagccatccgaacgcagcatcatgcagtctcaatccgtgatgttggatctcgcctacggtgacagagtgtgggtgaggttattcaagcgacagagggagaacgccatatactccaatgactttgacacctatatcacattttccggccatttgattaaagcggaagacgactag

SEQ ID NO: 10259 - DNA, 900 bp, Artificial Sequence
  Description of Artificial Sequence: Synthetic coding sequence
atgcggtccgtgggcgagggggcacgggaatggattagggagtgccagcatcaattcagacatcacagatggaattgcacaaccctggaccgcgatcacaccgtcttcggtagagtgatgttgcgaagttcacgggaggccgcattcgtttacgcaatatcctcggcaggcgttgtgcacgcaattacacgcgcatgtagccaaggcgaactgtcagtgtgttcctgtgatccatacaccaggggacgtcatcatgatcaacggggagatttcgattggggcggatgctctgataacatccactatggggtcaggtttgcgaaggccttcgtcgacgctaaggagaagcgcctgaaggacgctagggcattgatgaacctgcataacaatagatgcggccgtacagcggtaagacggttcctcaaactggagtgtaaatgccacggcgtgtccgggtcatgtaccctgcgtacatgttggcgggctttgtcagattttcggaggacaggtgattacctccgaaggagatacgatggtgcggtgcaagtgatggcaactcaggacggagcaaactttacagcagccagacagggctataggcgggcaactcgtacagatttagtgtacttcgataactcccctgattactgtgtgctggataaagctgcgggatcgctggggacagctggcagggtgtgcagcaagaccagcaagggcacagatggatgcgagatcatgtgctgcggaagaggttatgacaccacgagggttacacgggttacccaatgcgaatgcaagttccactggtgttgtgccgttaggtgtaaggaatgcagaaacactgtggacgtgcacacctgcaaggcgccaaagaaagcggagtggctcgaccagacatag

SEQ ID NO: 10260 - DNA, 1710 bp, Artificial Sequence
  Description of Artificial Sequence: Synthetic coding sequence
atgctgctgctttttagtgttattttgatatcctgggtcagtacagtcggtggggaagggaccctttgcgatttccctaagatccatcacggcttcctgtatgacgaggaggattacaaccccttcagccaggttccaaccggcgaggtcttctattactcttgcgaatataactttgtctctccaagcaagtctttctggacgagaattacctgcacagaagaaggctggtctcctactccaaaatgcctgcggatgtgttcttttccatttgttaaaaacgggcattcagaaagctccggcctgatccacctggaaggtgacactgtgcagatcatctgcaacacgggatactcacttcaaaacaacgagaagaacatttcgtgtgtagaaagagggtggtctacaccccctatctgctcctttaccaaaggcgagtgccacgtgcccattctggaagccaacgtggacgcgcagcccaagaaagagagttacaaggtgggcgatgtcctgaaatttagttgcagaaagaacctcattagagttggatcagacagcgttcagtgctatcaatttggctggagtcctaatttcccaacatgcaagggacaggttagatcatgcgggcctccccctcagcttagcaacggggaagtgaaggagatccggaaggaagaatacggacacaatgaagtcgtggaatacgactgcaacccaaatttcatcatcaatggtcccaaaaaaatccagtgtgtggatggcgagtggacgacattaccaacctgtgtcgaacaagttaagacctgcgggtatatcccggaactggaatacgggtacgtacagccatcggttcctccgtatcagcatggcgtgtcagtggaggttaactgtcggaatgagtatgccatgattggaaacaacatgatcacctgtattaatggcatctggacggagctccccatgtgcgtggctacgcaccaactcaagcggtgcaagattgccggagtgaatatcaaaacactgttaaaactttccggaaaggagtttaaccataatagcagaattcgatacagatgtagcgatatattccggtatcgtcacagcgtgtgcataaatggcaagtggaatcctgaagtggattgcacggagaagagggagcagttttgcccccctccaccacaaatcccaaacgcccaaaatatgacaacaactgttaactaccaggacggagaaaaggttgccgttctgtgcaaggagaactaccttctgcctgaagcgaaggagattgtctgtaaggacggcaggtggcaatcactgcctaggtgtgtcgaatcaacagcctattgtgggccaccaccctcaatcaataacggagacaccacttcttttcctctgtccgtctatcctcccggatctacagtgacctaccggtgtcaatctttttacaagcttcaaggttcagtgacagttacatgcaggaataaacagtggagtgagccaccacgctgcctagatccctgtgttgtgtctgaggaaaacatgaataaaaataatatacaactgaagtggcggaatgatggcaaactctacgccaaaacgggggacgctgtggagttccagtgcaaatttccacacaaggcaatgatctcaagccccccattccgagccatttgccaagaaggtaaattcgagtaccctatctgtgaatag

SEQ ID NO: 10261 - DNA, 351 bp, Artificial Sequence
  Description of Artificial Sequence: Synthetic coding sequence
atgaaaggtctccggtctctcgccgctacaaccctggcattattcctggtattcgtctttcttgggaattctagttgcgcccctcagcgcctgctggaacgcagaaactggacgcctcaggcgatgctttatctcaaaggggctcaggggcgtcgctttatttctgaccaatctcggaggaaggacctgagcgaccgacccttaccagagagacgctcacccaacccccagctgttgaccatcccagaggcggcaacgattcttcttgcctccctgcagaaaagcccagaggatgaagaaaagaacttcgatcagacaaggtttctagaagactccctgttaaattggtag

SEQ ID NO: 10262 - DNA, 192 bp, Artificial Sequence
  Description of Artificial Sequence: Synthetic coding sequence
atgaagcacgtcctcaatctatatctgctaggagtggtccttacccttcttagcatctttgtgcgggtcatggagtctctagaggggcttcttgaaagtccatcacctgggaccagctggacaaccaggtcgcagttagccaacactgagcctacaaagggccttcccgatcacccttctagaagtatgtag

SEQ ID NO: 10263 - DNA, 567 bp, Artificial Sequence
  Description of Artificial Sequence: Synthetic coding sequence
atggtacctggcgctgccggatggtgttgtctcgtgctgtggttgccagcctgtgtagcagcccatggctttcggatccatgattacctgtattttcaagtcctatccccaggcgacatacggtacatcttcacagcaacgcctgccaaggatttcggcggtatttttcatacccggtacgagcaaatccatctggttcctgctgagcctcccgaagcctgcggagagctgagcaacggattcttcatccaggaccagattgcactggtagagcggggtggctgtagctttctatcaaaaaccagggttgtccaggagcacggaggcagagcagtgatcatttctgacaacgctgtagacaatgattccttctatgtggaaatgattcaggacagcacacagcgaacggctgatattccagccttgtttctcctcgggagagacggatatatgattcggagatcccttgagcaacatggcttgccatgggcaattatctcaattccagtcaatgtgaccagtatacccacttttgaacttcttcagcccccttggacattctggtag

SEQ ID NO: 10264 - DNA, 2559 bp, Artificial Sequence
  Description of Artificial Sequence: Synthetic coding sequence
atgaagcccatgttgaaggatttctcaaatctgctgctggtggtgctatgcgactacgtcttgggcgaggccgagtacttgcttcttagggaacccggtcatgtcgcccttagtaatgacacagtttatgtggatttccagtacttcgatggagcgaatggaacgttgagaaacgtctctgtcctactgcttgaagctaataccaatcaaacagtgacgacaaagtacttgcttactaaccagtcacagggcacactcaagttcgagtgcttctacttcaaggaggcaggcgattactggtttacgatgacaccagaagcgactgataattctacaccgttcccttggtgggaaaagtcagcctttttaaaggttgaatggcccgtcttccacgtcgacctgaatagaagcgctaaagcagctgaaggtaccttccaagtgggactgttcactagccaacctctgtgcccattcccggtggacaaaccaaacattgtggtggatgtgatctttaccaactcattaccagaagccagacgaaacagtaggcagccactggagatacgtacctctaaaaggaccgagcttgcacaaggacagtgggtagaattcgggtgtgccccactcgggcctgaagcgtatgtgacagtggtcttgaaattactggggagggatagtgtcattacctccacaggacctattgacttggcccagaagtttggttacaaattggtgatggtgcccgaactgacctgcgagtctggagtagaggtgacagtgttaccacctccgtgcactttcgtgcaaggggtcgtgaccgtgttcaaggaggccccacgctacccaggaaagcgcacaattcatctggctgaaaattctctccccctgggggaacgcagaacgatttttaactgcacactatttgacatgggcaaaaacaaatactgctttgacttcggcattagtagccggtctcatttcagtgcgaaggaggaatgtatgttgatccaacgcaacacagaaacttggggtctctggcagccttggtctcaatgcagtgctacttgtggggatggcgtgcgcgagagaaggcgagtgtgcttaaccagctttccctcttcacccgtctgcccaggcatgtccctggaagcatccctttgcagtctcgaggagtgcgccgctttccagccatcatccccgtccccactgcagccgcaggggccagtgaaaagcaacaacatcgtgacagttactggaatcagcctgtgtctgtttataatcattgccacggttttaattacattgtggcggcgtttcggtcggccagcaaaatgtagtacccccgcaaggcataactcgatccacagtccgtcattccggaaaaatagtgacgaggagaacatttgtgaactgtctgagcaacggggaagtttctcggatggtggcgacgggcctactggcagccccggagacaccggcatacccctcacttacaggcgaagcggaccagtgccacccgaggatgacgctagcggttctgagtccttccaatcgaatgcccagaaaatcatccctcccctttttagttacaggctagcccagcagcagctgaaagagatgaagaagaagggcctcacagagaccactaaggtttaccacgttagccagagcccactgaccgatacagcaattgacgcagctcccagcgcccctctcgacctcgaaagccctgaggaggcggctgccaataagtttcggataaagtcaccctttccagagcagcctgcggtgagtgccggtgaaagacccccttcgcggcttgacttaaatgtgactcaggcatcatgcgcgatctcccccagccaaacgttaattaggaagagtcaagcccgacatgtcgggtcccgcggagggccttccgaacgctcccacgctaggaatgctcacttcaggcgaactgcttctttccatgaagccaggcaggctcgccctttccgcgagagatccatgtccactctgactcctcggcaggcacctgcatattcttcaaggactcggacctgtgagcaggccgaggatcgctttagaccccaatcccgaggtgcccatttgtttcccgagaagctcgagcatttccaggaagcatcaggaacacgcggaccactgaaccccctgccaaagtcttacacactggggcagccactcaggaagccggatctgggggaccaccaagccggtttggtggccggaatcgagcggactgagccacacagggcgcgtcgtggcccttctccctcccacaaatctgtaagcagaaagcagtccagcccaatttcaccaaaggataattaccaaagagtgtcctccctttccccttcccaatgtagaaaagacaagtgccagtcatttcccacccatcccgagttcgcattttatgataatacaagttttggcttaaccgaggccgagcaacggatgctagacttgcccggttatttcgggtccaacgaggaggacgaaacgacctctaccctgtctgtagagaagttggtcatttag

SEQ ID NO: 10265 - DNA, 369 bp, Artificial Sequence
  Description of Artificial Sequence: Synthetic coding sequence
atgggattccacttctgcatctggattatctttctgcttccacccccatgtaaaaagtgtctgtccccccctactatgaaccttcgacctccaaaatcgtgtgggaacgtcttttactgggtcctggtcctgaattcgggcctgttgtataagttctgtcagacaattaagtgccgcgctaactggcgtccagccagggcccctagagggtggaatgaggctaccgagagacaccaggagcgccgaacccaaatggagaccgaaatgggtggtatatcaactacctactggcaccgactgtgcacttgcaccgaccggcgagccgagaagttggtaatggacggcaacaattgctggtttcataagtag

SEQ ID NO: 10266 - DNA, 978 bp, Artificial Sequence
  Description of Artificial Sequence: Synthetic coding sequence
atgcagggtagagtggcgggtagctgcgcccctctcggcctgctgttggtgtgtcttcatctgcctggattattcgctcgctccattggggtcgttgaagaaaaggttagccagaatctggggacaaacctgccacaactggggcagcctagctcgaccggtcccagtaattctgaacatccacagcctgccctggatcccagaagcaatgatctggctagagtgcctctgaaactgtcggtcccagcatctgacggctttccccctgcaggaggatccgcagttcagaggtggcccccatcctggggcttgcctgccatggactcctggccacccgaggacccctggcaaatgatggctgcagcggcagaggacagactcggcgaggccttacctgaggaactttcatatctttcaagcgccgctgccctggctcctggatccgggccactgcctggggagtcttcgccagacgcaactggtttatcaccgaaggcttctctgcttcaccaggattctgaaagccggagattgccacgctcaaactccctgggggcagggggaaagattctctcccagcgtcctccctggagccttattcacagggtgcttccggaccacccttgggggaccctaaatcccagcgtgagttggggcggtggaggccctgggaccgggtggggcacaagacccatgccacatccggaaggcatctggggcatcaacaaccagcctccaggcacctcgtggggcaacatcaacaggtatcccggaggaagttggggcaacatcaacaggtatccagggggaagctggggaaatattaatcgctatccaggtggatcatggggaaatatccacttgtaccccggaattaacaaccccttccctccgggagtactgcggccacccggatcttcgtggaatattccggctggcttcccaaaccccccatctcccagactgcaatggggctag

SEQ ID NO: 10267 - DNA, 2631 bp, Artificial Sequence
  Description of Artificial Sequence: Synthetic coding sequence
atgggaccagaagccctgtctagcctcttgcttctgctcttggttgcatcaggcgacgccgatatgaaggggcatttcgatccagctaaatgcaggtatgctttggggatgcaggatcgcactatacctgattccgacatctctgccagtagtagctggagcgatagtaccgccgctcgccattcacgactagagtctagcgacggcgatggagcttggtgtcctgccggatccgtgtttccaaaggaggaagagtatctccaggtcgatctccagcggttacatcttgtggctctggtgggcacacagggtaggcacgcgggaggcctgggaaaggagttcagccgaagttaccggctgcgatacagtagagatgggaggcgctggatggggtggaaggaccgctggggccaggaagtaatcagcggaaacgaagatcctgagggcgtcgtcctgaaagaccttggtccccctatggttgcccgtctcgtccgcttttaccccagggcagatagggtcatgtccgtatgcctgcgcgtcgagctgtatggatgcctctggagggatggtttgctgtcttataccgcgccagttgggcagaccatgtacctgtccgaagctgtttacttaaatgacagcacttatgatggacacaccgtgggcggtcttcagtatggcggtctgggccagctagccgacggtgtagtgggccttgatgacttccggaaaagtcaggagctaagggtttggcccggttacgattatgttggatggtccaatcactccttcagcagtgggtatgttgagatggagttcgaattcgaccgcctgagggcctttcaggccatgcaggttcactgcaataatatgcataccctcggtgcgaggcttccaggcggtgttgagtgccggttcagaaggggtcctgccatggcttgggaaggcgaaccaatgaggcataatttgggcggtaatctcggggaccccagagcccgtgccgtgagtgttcctctgggagggagagtggccagatttctgcagtgtcgctttttattcgcgggtccatggcttctcttctctgaaatttcgttcatttctgatgttgtgaataactcttcccccgcattaggaggcacatttccgcctgccccatggtggcccccaggaccccctcccacgaacttttcctcactggaattagagcccagagggcagcagccagtggccaaggcggagggctcacccaccgcaattcttattggatgtctagttgcaatcatcctcctccttcttctcattatcgcactaatgctgtggcgcttacattggaggcgcctcctttcgaaagctgaaagaagggttttagaagaagaactgacagtccacttgtccgtccccggagacactattctgattaacaaccgcccaggcccacgagaacccccaccttaccaggagccaagaccaaggggtaatcctccccattccgctccctgcgttcctaacggcagtgcctacagcggagattacatggaacccgaaaagccaggagcacccctgctgcctccccctcctcaaaacagcgtaccccattacgctgaagccgatattgttacacttcagggcgtcacggggggaaatacatacgccgtccccgctcttccacctggagcggtcggtgatggaccgccacgcgtggacttccccagatccagactcaggttcaaggaaaaattgggagaagggcagtttggagaggtgcacctctgcgaggtcgattctcctcaggatttggtgtctctggatttccccttgaatgtgcggaaaggccaccccttgctggtggcagtgaagattttgcgtcctgacgctacaaagaatgctagaaacgacttcctcaaagaagttaagattatgtcccgacttaaggatccgaatatcataaggctgctcggcgtgtgcgtgcaagacgatccgctgtgtatgattaccgattacatggaaaatggagacttgaaccaattcctctcagctcatcagctggaagacaaggccgcagagggcgcaccgggtgacgggcaggccgctcagggcccaactatttcttatccgatgcttctgcatgttgcagcccagatcgcttcaggcatgaggtaccttgcaactttgaactttgttcaccgagatctggccaccaggaactgtttggtaggtgaaaacttcaccatcaagattgccgattttggaatgtcaaggaatttatatgccggagactattaccgggttcaaggcagggccgtgcttccaatccgatggatggcatgggagtgtattctcatgggaaagttcactactgcctctgacgtgtgggcctttggtgttacgctgtgggaggttctgatgctgtgcagagcacagcctttcggacagctgactgatgagcaagtgattgagaatgccggagagttctttagggatcagggaagacaggtgtatctgagtaggcccccagcatgtccacaagggttgtacgagctgatgctccggtgctggagtcgagagagtgagcagaggcccccattcagccagctgcataggttcctggccgaagacgccctgaacacagtttag

SEQ ID NO: 10268 - DNA, 672 bp, Artificial Sequence
  Description of Artificial Sequence: Synthetic coding sequence
atgaaattcgtcccctgtctgttactggtgacccttagttgtctggggaccttaggccaagcccctcgtcagaagcagggaagtacaggcgaggagttccatttccaaacaggcggacgcgattcgtgtaccatgagaccatcctcgttagggcagggcgctggggaggtgtggttgagagtcgactgccggaataccgaccaaacttactggtgcgaataccgcggacagccgtccatgtgccaggccttcgctgcagatccaaagccctattggaatcaggctctccaagagctgagacgactgcaccacgcctgccagggcgcaccagtgctccgtccgtcggtgtgcagggaagccggaccacaggcacatatgcagcaggtgacaagctccctcaaaggttctcccgagccaaatcagcaacctgaggccggtaccccatctctgaggcctaaagctaccgtcaagttgaccgaggcaacccagttaggtaaggactccatggaagagctcggtaaagctaagcccacaaccaggccaactgctaagcctacccaacctgggccacgcccaggaggcaacgaggaggccaaaaagaaggcatgggaacactgctggaagcccttccaggcattatgcgcgtttctgatctcgttcttcagaggttag

SEQ ID NO: 10269 - DNA, 585 bp, Artificial Sequence
  Description of Artificial Sequence: Synthetic coding sequence
atgaccatgaggcataattggacacccgaccttagtcctctctgggtgttattgctttgcgcacacgtggtgacgcttctcgtccgggctaccccagtgtcccagacaaccaccgcagctacagcaagtgtgcgatctacaaaggatccttgtccgtcacagccccctgtattcccggctgccaaacagtgccctgccttagaggtcacttggcctgaggtagaagtacccctcaacgggaccttgtcactgtcatgtgtggcctgctctcgcttccccaatttttctatcctttactggttaggtaatggctcattcatcgagcatctccctggaaggctctgggagggatcgacttcccgcgaacggggtagcacaggcacgcagctgtgtaaggctctggtcctggagcagctgacaccagccctgcattccactaatttctcctgcgtactggtcgacccagagcaagttgtgcagcgccacgtcgtcctggctcagctatgggccggtttgcgagccactctgcctcctactcaggaagcactgcctagctcacattcatctcctcagcagcaaggttag

SEQ ID NO: 10270 - DNA, 777 bp, Artificial Sequence
  Description of Artificial Sequence: Synthetic coding sequence
atgattgccatctccgccgtctcatcagccctcctcttctcactgctgtgtgaggcatctaccgttgttctcctaaacagtacagattctagccccccaacaaacaacttcaccgacatagaagcagctcttaaggctcagctggattccgctgatattccaaaggcgcgtaggaagagatacatcagccagaacgacatgattgccattttggattaccacaatcaggttaggggaaaagtgttcccacctgcggctaacatggaatatatggtgtgggacgagaacctcgctaagtccgctgaggcctgggctgcgacgtgcatctgggaccatggcccttcatacctgctccggttcttgggccagaatttaagcgtgcgcacgggtcgttaccgtagtatcctgcaactcgtcaaaccctggtacgatgaggtgaaggactacgccttcccctatccccaggactgtaacccgaggtgtcccatgcgatgtttcgggccaatgtgcacacattatacccagatggtgtgggcgactagcaataggattggttgcgccattcatacttgccagaacatgaatgtctggggtagtgtgtggcgaagagctgtctatctcgtgtgtaattacgccccaaagggcaactggattggtgaagccccatacaaagtcggtgtgccttgcagttcctgcccgcctagttacgggggtagctgtacagataatttatgttttccaggggtcacctcgaattacctgtactggttcaagtag

SEQ ID NO: 10271 - DNA, 906 bp, Artificial Sequence
  Description of Artificial Sequence: Synthetic coding sequence
atgctccctcttacaatgactgtcctgattctcttacttctccccaccggacaagccgcacccaaagatggcgtgacccggcctgattctgaggtgcagcaccaacttctgcccaacccattccagcccggtcaggagcaacttggcctactccagtcatacctgaagggcttaggcagaacagaggtccagttagaacatctatcgagagaacaggtgctcctgtatctcttcgccctccacgactatgatcaatccggtcagttggacgggctggagctgctgtctatgcttacggccgctctggcacccggtgccgctaacagccctaccaccaatcctgttatcctgatcgtggacaaggtgcttgagactcaggacttaaatggcgacggccttatgacgcctgccgagcttattaactttcctggcgttgccctgcgccacgtggaacctggagaacccctagccccttctcctcaagaacctcaggccgtgggacgtcagtccctgctggcaaaaagccctctgagacaggaaactcaggaggcccctgggccacgggaggaagctaagggtcaggtggaggcccgtagagagagcctcgatccagtccaggagccgggtgggcaggcagaggccgatggggatgtcccaggtcccagaggtgaagctgagggccaggccgaggcaaaaggggatgccccaggtcctcggggagaggctgggggacaggcggaggctgagggcgatgctccaggtcctcgcggtgaagcgggaggacaagccgaggcacgcgaaaatggtgaagaggcgaaagagctgcccggtgaaacccttgagtcaaaaaacacccagaatgactttgaggtacatattgttcaggtggaaaacgatgagatctag

SEQ ID NO: 10272 - DNA, 969 bp, Artificial Sequence
  Description of Artificial Sequence: Synthetic coding sequence
atgaaaaccctggcaggcctggtgctcggcctcgtgatctttgacgccgcagtaaccgcacctacattggaaagcattaactacgattccgagacatacgacgccaccctcgaagacctcgacaatctgtacaattacgagaacatcccagtcgacaaggtagagatcgagatcgctactgtgatgccatctggcaatagagagttgctcaccccaccaccccagcctgaaaaggctcaagaggaagaggaagaagaggagtcaacaccacgcctgatcgacgggagcagcccccaagaacccgaatttacaggcgtgcttggcccacacacgaatgaagatttcccaacctgcctgctctgcacatgtatttctaccaccgtttattgcgacgaccacgaattggatgctatccctccattgcccaagaataccgcatacttttactcccgcttcaaccgtattaaaaaaatcaataaaaatgatttcgcttcactatccgaccttaagcgtattgatctgacctctaatctgattagtgaaatcgatgaggatgccttcagaaagctgcctcaactgagggagctggtcctccgcgacaataaaatcaggcagctgcctgaattgccgacaactctgacatttattgatatcagcaacaaccggcttgggcgtaagggcatcaagcaggaagccttcaaggatatgtacgacctccaccacctgtaccttaccgacaacaatctggaccatattcctttacccctgccggagaacctacgggctctccatctgcaaaacaacaatatcttggagatgcacgaagataccttctgtaatgtgaaaaatctaacgtacatccggaaggctctcgaggatatccgactggatggcaacccaataaacttgtcaaagacaccccaggcgtacatgtgcctgcctcggctcccagtgggctccttggtgtag

SEQ ID NO: 10273 - DNA, 618 bp, Artificial Sequence
  Description of Artificial Sequence: Synthetic coding sequence
atggtgaatctcgccgctatggtttggcgaaggttattgcgcaaacgatgggtgctggcattggtcttcggtctgagccttgtttattttctgtcctccaccttcaagcaagaagagcgcgcagtccgggaccgcaacttactgcaggtccacgaccataaccagcctatcccctggaaagtgcagtttaacctgggcaattcttcacggccttctaaccaatgccgaaacagtattcagggcaagcacctgatcactgatgaactggggtatgtctgcgagcgcaaagatctgctggtgaacgggtgttgcaatgtgaatgtgccctccactaagcagtattgctgtgatggctgctggcctaatggttgctgtagcgcctacgaatattgtgtgtcctgttgtctgcaaccaaataaacagctgctgctggaaaggttcctcaacagagccgcagtggctttccagaacctgttcatggccgtggaagatcattttgagctctgcctggccaagtgtagaaccagctctcagagcgtccagcacgaaaatacgtatagggatcctattgccaaatactgctatggagagtctcccccagaactctttccggcttag

SEQ ID NO: 10274 - DNA, 3057 bp, Artificial Sequence
  Description of Artificial Sequence: Synthetic coding sequence
atggtgagccattttatggggtccctgagcgttctgtgctttttgttacttcttggatttcagtttgtgtgccctcaaccaagcacacagcatcgaaaggtgccccagcgcatggccgctgagggcgcaccagaggacgacggaggcggtggggctcccggtgtctggggagcgtggggtccgtggtctgcctgctctcgaagctgctcagggggagtcatggaacaaacccgaccatgtctccctcggtcctaccgccttcgcggaggtcagcggcctggcgctcccgctagggcgttcgccgaccacgtcgtcagcgcagtccggactagcgttccattgcataggagtcgggatgagaccccggcacttgctggcactgatgccagcagacaggggcctaccgtcctgcggggtagtcggcacccccagcctcaggggctggaagttaccggtgacaggcgttctcggacaagaggaacaattggaccagggaaatatggctacggaaaagccccttatatcttgcctttgcaaacagataccgctcacactccacaaagacttaggcggcagaagctcagctccaggcactccagatcccagggcgcttcatcagctagacatggctacagcagtccggctcatcaagtgccgcaacacggtcccctataccagagcgactctggaccacggagcgggcttcaggcggcagaggccccaatttaccagttacctctcactcacgaccaaggctatccagcggcaagcagtctgttccactcgccggagacctccaacaaccatggggtaggaacgcatggtgccactcagagcttctctcagccagcacggagtacagctattagttgtatcggggcataccgccagtacaagctatgtaatacaaatgtctgtcccgagtccagtcgctcaattcgggaggtccagtgtgcttcctacaataacaaaccattcatgggtaggttttatgagtgggaaccatttgccgaagtaaaagggaacaggaagtgcgaacttaactgccaggccatggggtaccgattctacgtcaggcaggcagagaaggttattgacggtacaccctgcgaccagaatggcactgctatctgcgttagcggtcagtgcaagagcattggatgcgacgattatctgggcagcgacaaggtggtggacaaatgtggggtgtgcgggggagacaatacagggtgccaggtggtttccggagtgtttaaacacgccctgaccagtctcggttaccaccgcgtcgtcgaaattccagagggagctacaaaaattaatattactgaaatgtataaatctaacaactaccttgcacttagatcacggtcaggccgttctataattaacgggaattgggcaatcgatcgacctggcaagtatgaagggggtggtacaatgttcacgtataagagacccaacgagatctcaagcacagcgggtgagagctttctggcggagggtcctactaatgaaattctggatgtctatatgattcatcagcaaccgaatcctggggtccactatgaatacgtgattatggggacaaatgccattagcccgcaagtccctccccatcgcagacctggcgagcccttcaacggtcagatggtgacagaaggccgttcccaggaagagggagagcagaagggaaggaatgaggaaaaggaagatctgagaggggaggcccctgaaatgttcactagtgagagcgcccagacatttcccgtacgccatccggatcggttcagtccccaccggccagataatctggtgcctccagcgccacagccaccaagaaggtcccgcgaccacaattggaaacagcttggtacgacagagtgctccaccacttgcggtaaaggctcacagtatccaattttccgctgtgtccatcgaagtactcacgaagaggctccagaaagttactgcgattcatctatgaagccaactccggaggaagagccctgcaatatcttcccatgtcccgcattctgggatattggtgaatggagcgaatgcagcaaaacgtgcggactgggtatgcagcacaggcaggtgttgtgtagacaagtgtacgccaaccgctccctcactgtgcaaccgtatagatgtcagcacctggaaaaaccagagacaaccagtacctgtcagctcaaaatttgcagcgagtggcagattcgtacagattggacttcctgcagcgtgccctgtggcgtcggacaacgaaccagggacgtgaagtgcgttagtaacatcggggatgtggtggacgatgaggaatgcaatatgaaactacgccctaatgatattgagaactgtgacatgggcccatgcgccaagagctggtttctgaccgagtggtcagaacgatgctctgccgaatgcggcgcaggagtgcgcacgaggtccgtagtttgcatgactaatcatgtctcttctcttccactggagggctgcggcaacaatcgtcccgcagaagccacaccatgcgacaacgggccttgtactgggaaggtcgaatggtttgccggatcatggtctcagtgctctatcgagtgtggctctgggacacagcagcgggaagtcatctgtgtgagaaaaaacgctgacacgtttgaggtgctggatccctcagagtgtagcttcctcgagaagccgccttcccagcagtcttgtcacctcaaaccatgtggggctaaatggttctcaactgagtggtccatgtgttctaaatcttgccaggggggattcagagtgcgagaggtgagatgcctgagtgatgatatgaccctcagcaacctgtgcgatccacaactgaagcccgaggagcgggagtcctgcaatccacaggattgtgtccctgaggtagatgaaaattgcaaggacaaatactataattgtaacgtggtcgtgcaggcccgtctttgtgtgtacaactactacaaaactgcatgttgcgcaagctgcaccagggttgctaacaggcaaacaggcttcttagggagccgctag

SEQ ID NO: 10275 - DNA, 1503 bp, Artificial Sequence
  Description of Artificial Sequence: Synthetic coding sequence
atgaagtgtaccgctagagaatggctgcgggttacaacggtgctgtttatggccagggcaatcccagccatggtcgtccccaacgcaacactcctggagaaattgctggaaaaatatatggatgaagatggtgagtggtggattgcgaaacagcggggtaagcgagctattactgataatgatatgcagtcaatcttagacctccataacaagctccgatctcaagtgtatcccaccgcctccaacatggagtacatgacttgggatgtggagctagaacgctcagccgaatcttgggccgagagctgtctgtgggagcatggccctgcctcccttctgccttcaattggacagaatctgggggctcattggggtagatacaggccaccaacgttccatgtgcagtcctggtacgacgaagtgaaagattttagctatccctatgaacacgagtgtaacccgtactgtccatttcggtgcagcggcccagtgtgtacccattacacccaagtggtgtgggctacaagcaaccggatcggatgtgccataaacctttgtcacaacatgaacatttggggccagatttggccaaaggctgtttacctcgtgtgcaactactcccccaagggtaactggtggggacacgccccatataaacacggaaggccatgctccgcttgcccacccagctttggtggagggtgtagagagaatctttgctacaaggagggctctgaccgttattaccctccaagggaagaggagaccaatgagattgagcgccaacagtcccaggtccatgatacccacgtgaggaccagaagcgatgacagcagcagaaacgaggttattagtgcacaacagatgagccaaatcgtttcttgcgaggtccgactgcgtgaccagtgcaaagggacaacatgtaataggtacgagtgccctgcaggttgtttggacagtaaggccaaagtgatagggagcgtgcactacgagatgcagagtagcatctgtagagcagcaatccactacggaataatagacaacgatggcggatgggtcgacatcacccgccaaggcaggaaacattactttatcaagtccaaccgcaatgggatccagaccatcggaaaataccaaagcgccaatagcttcaccgtgtcaaaggttacagtgcaggcggtgacgtgtgagactaccgtggaacaactttgcccgtttcacaaacccgcttcccattgcccacgagtgtattgcccaaggaactgtatgcaagctaatccccactacgctcgtgtgattggtaccagagtctattcagacctatcctccatctgccgggcagctgtacacgcaggggtggtccgcaaccacggaggatacgtggacgttatgccagtcgacaagaggaaaacatacatagcgtccttccagaatggcatcttctctgagtctctacagaaccctccaggaggaaaggcgtttcgagtgtttgccgttgtgtag

SEQ ID NO: 10276 - DNA, 2070 bp, Artificial Sequence
  Description of Artificial Sequence: Synthetic coding sequence
atgaagtttggggcagtaacacggatcggaggacctcccttggggaatcagagcccaagtagttgttctctcctgcacgaaaaggatcccccaaccaccagcggtccccagacagaccagccaaagaaacatctcacaaatttcaagtcagcaacgcgcagggttgctagaacgcagtggctgaccgcagaccgccagacgtgggcaagtatcagcagcgtcccatgggctcaaactatttccgaaaaaaagccagggggttccctgtgggaaacaaggtctagccccccaacgaccgcgggtacagaggaggccatgaatacaaccagtttgctggcccctgcagccgaaatcatggcgacaccgggaagcccatcccaggccagtccgactcttggtgcatttactcatggtacccagactccctcccccactaaggccacagctccgcgatacccccaaacgggcgatctctcggctgagtggccctttaccgccggtgaggaaccagtgctggtgccaagaccccatcaggttagcagagtccgcagctcatgctgcctcagtccaattttgtgcagtcctgctatgattgcatttctgctgacctccgtcctcatgattccacacgccggaggtcatcctttggatacaccacacctaccacaggagttacctcccggattacccaacaatattaacattacgtttttcagcggtatgttcaagaatgttgaatcagtagctgagatctttgattgcctgggtccccacttcacttggcttcaggccgttttcacaaactttccagtgctcatccagttcgtcaacgggatgaaatgtgttgctggcctgtgcccacgcgactttgaggactatggctgcacctgccggtttgaaatggagggcctgcccgtggacgaaagcgattcctgttgctttcagcacagaagatgctatgaggaggctgctgagatggattgcctgcaggatcctgccaagcttagcacagaggttaattgtgtatctaagaaaataatttgcgagtccaaggataattgtgaacatctgctgtgtacttgtgataaggccgctatcgaatgcctggccagaagttccctcaactcgagtttgaacttgctcgatacgtccttctgtctggcgcaaacacctgagacgaccattaaagaggacctgacgactctgctgcctcgagtggtacctgtcgaacctacagacacttctcttacagccctgtccggagaagtagcggctgaaactgaagcggaccggctgatcacacttagcaagaaaaaggccggtcatgaccaggaaggagtgggggcagccagagcgacatcaccccctgggagcgccgagatcgttgccacccgcgttaccgctaagatcgtgacattggtaccggcaggcatcaaatccctggggctcgccgtaagcagtgtggagaacgaccctgaggaaacaactgagaaggcatgcgaccgctttaccttcctacacctcggaagcggggataacatgcaggtgatgccacagctgggtgaaatgctcttttgtctaaccagtaggtgccccgaggaattcgaatcctacggctgctattgcgggcaggagggcagaggggagccccgagacgatttggatcggtgttgtctgagccatcattgctgtctggaacaggtgcgcagattgggttgccttctggaacgacttccttggtcccctgtggtatgtgtcgatcacacaccaaagtgtggtgggcagtctctatgtgagaaactgctctgtgcctgcgaccaaacagctgcagagtgtatgacgagcgcatcttttaaccagtccctgaagtccccgagtcgattgggatgccccggacaacccgctgcgtgcgaggacagcctccaccccgttcccgctgcacctacacttggcagttccagtgaggaagattcagaagaggacccgccacaggaagacctgggtagagcaaagcgcttcctccggaagagtctcggacccttgggcatcggcccactgcatggacgttag

SEQ ID NO: 10277 - DNA, 1359 bp, Artificial Sequence
  Description of Artificial Sequence: Synthetic coding sequence
atggaactagctctgagacggtccccagtgcctcgatggctgctcctcctgcccctgctgctcggcctcaatgcgggagcggtgattgattggcccactgaggaggggaaagaggtgtgggattacgtcactgtaagaaaggatgcctacatgttttggtggctgtactacgcaaccaattcttgtaagaatttttctgaacttcctctggtgatgtggttgcaggggggacccggagggagtagcacaggttttgggaattttgaagaaataggtcctctcgactcagatttgaaacctcggaaaacaacttggttacaagctgccagcctactgttcgtcgataaccccgtcgggacaggttttagctacgttaacgggtctggagcctacgcaaaagacctggctatggttgctagcgacatgatggtgctcttgaaaaccttcttctcttgtcataaagaattccagaccgtcccattttacatcttcagcgaaagttacggagggaagatggctgccggaattgggcttgagctctacaaggccatccagcggggaacgatcaaatgtaacttcgccggagtcgcactgggtgactcgtggatttctccggtagattccgtgctgagttggggcccttacttatacagcatgtccctgctcgaggataaagggctggctgaagtgagcaaggttgccgagcaagtgctgaatgccgtcaataaaggtctgtatcgagaggccaccgaactatggggaaaagctgagatgatcatcgagcagaacacagacggtgtcaacttctataatattctgacgaagagcacacccacatctactatggaatcatccctcgagttcacccaatcccatcttgtgtgtctttgtcagaggcacgtcagacacttgcaacgggatgctttgagccagttaatgaatggcccaatccgaaaaaaactaaaaattattcctgaggatcagtcgtggggcggacaggccaccaacgtgttcgtgaacatggaagaagactttatgaagcctgtgattagtattgtggacgagttgctagaagctgggatcaacgtgacagtgtacaacggtcagcttgacctgatcgtggatacgatgggtcaggaggcctgggtgagaaagctgaaatggcccgagctgcccaagtttagccagttgaagtggaaggccttatactctgatccgaagtccctggaaactagtgcctttgtgaagtcatacaaaaatctggctttctattggatcctgaaggctggtcatatggtgccttccgatcagggcgacatggcccttaagatgatgaggctagtcacacagcaggagtag

SEQ ID NO: 10278 - DNA, 1395 bp, Artificial Sequence
  Description of Artificial Sequence: Synthetic coding sequence
atggtgaggctggccgctgaactcttacttctgctgggacttctattacttaccctgcacatcaccgtactcagaggcagtggcgctgcggatggcccagacgctgcggctggaaatgcatcccaggcccagttgcagaacaacctgaatgtggggtccgataccacctctgaaacatcatttagcctctcaaaggaggcccctagggaacacttggatcatcaggctgcacaccagcccttccccaggccacgatttcggcaggagaccgggcatcccagtttacagcgggacttcccacgctctttcctgctggacctacctaatttccccgacttgtccaaggccgatatcaatgggcagaaccctaatatacaagtgactatagaagtagtcgatggccctgacagtgaggccgacaaggatcagcatcctgaaaataaaccatcttggagcgtgcctagccccgactggcgagcctggtggcagagatcactgtccctcgccagagctaattctggtgatcaagactataagtatgattcaactagcgacgacagtaattttctgaaccctccacggggttgggatcataccgctcccggacaccgtaccttcgagacgaaagatcaaccagaatatgacagtacggatggagagggcgattggagcctgtggtctgtgtgcagcgtgacatgtggtaatggcaaccagaagaggacacggtcatgcggatacgcgtgcaccgctacggaaagccgcacatgtgatcggccaaattgccctggcatcgaggacacattccgaacagccgctacagaggtatcattgctggccggatctgaagaattcaacgctacaaaattgtttgaagtggacactgattcatgcgaaagatggatgtcatgcaagtcagagttcctcaagaagtacatgcataaggttatgaacgacctcccttcatgcccctgttcctaccccaccgaagtagcctacagtaccgcagatatcttcgacagaatcaaacggaaagatttcagatggaaggacgcctcaggcccaaaggagaaactggagatctataaacctaccgccaggtactgtattaggagcatgctatcgctggagagtaccacgcttgccgctcaacattgctgttatggcgacaacatgcagttgataacccgcggtaagggggcaggtacccccaacttaatttcaaccgagttttccgcggagctgcattacaaagttgacgtgctgccttggattatttgtaaaggcgactggtctagatacaatgaggcacgcccaccaaataatggccagaagtgcaccgagtccccaagtgacgaggactatataaaacaattccaggaggctagagagtattag

SEQ ID NO: 10279 - DNA, 1536 bp, Artificial Sequence
  Description of Artificial Sequence: Synthetic coding sequence
atgctggttgatggaccatctgagaggcctgcactgtgctttttattattggcggtggcaatgtctttttttggcagcgccttatccatcgacgagacccgggcacacctccttttgaaggaaaagatgatgagactcggcggacgtctggttttgaataccaaagaagagctggcaaatgaacgtttgatgacactgaaaattgcagaaatgaaggaggccatgagaacgctcatatttccaccttcaatgcacttcttccaggctaagcatctgatcgaacggagccaagtgttcaacatactgaggatgatgcccaagggagcagcactccaccttcacgatatcggaatcgtgaccatggactggctcgtgcgtaacgtgacctaccgaccccattgccatatctgctttacgcctcgagggattatgcagtttagattcgcccatcccaccccaagaccgagcgaaaagtgcagtaagtggatcctcctcgaggactataggaagcgagtgcagaatgtgacagaattcgacgatagcctcctgcgcaacttcactctggtgacacagcatcctgaagtcatctacactaaccagaatgttgtgtggtcaaagttcgagacaattttcttcactatcagtggcctcatccactatgccccagtgtttcgcgactatgtgttcagatccatgcaggaattctatgaggacaatgtgttgtacatggaaattagagctcgcctgctgcctgtctatgaattgtcaggagagcaccacgatgaggagtggtcagtcaagacgtatcaggaagtggcccagaagtttgtggaaacccacccagaatttattggaattaagattatttactcagatcatagatctaaggacgttgctgtaatagccgagtccattaggatggccatgggcctgaggattaagttccctaccgtagtggcgggtttcgacttggtcggtcacgaagacacaggccactctctgcatgactacaaggaagcccttatgatccccgctaaagacggcgtaaaacttccttatttctttcacgccggagaaacagactggcaggggacatcaatcgacaggaatatattagatgctctgatgctcaatactactcggattgggcatggcttcgctctctctaaacatcctgctgtgcggacttattcctggaaaaaggatattcccatagaggtttgcccgataagcaaccaggttctcaaacttgtgtcagatctgagaaaccatcctgtggcaactttgatggccaccggccatcccatggtgatcagtagtgacgaccccgctatgtttggcgctaaaggactatcttatgatttttacgaagtgtttatgggaataggtggaatgaaggcagatctgcggacactaaagcagctggcaatgaactcgattaagtactctactttacttgagtccgagaagaatacttttatggaaatctggaaaaaacgatgggataaatttatagcagatgtagctaccaagtag

SEQ ID NO: 10280 - DNA, 777 bp, Artificial Sequence
  Description of Artificial Sequence: Synthetic coding sequence
atgaagcagattctgcatcccgctcttgagaccactgctatgacactgtttcccgtgctactcttcctggtcgcaggcctgctcccgagcttccccgcaaatgaagacaaggaccctgccttcactgcgctgctcactacccaaacacaggtgcagagggagattgttaataaacacaacgaactcagaagagctgtttctccacccgcacggaatatgctcaagatggaatggaacaaagaggcagcagcgaacgcccagaagtgggcgaaccaatgtaattatcgtcactcaaaccccaaagacaggatgaccagcctaaagtgtggggaaaatttgtacatgtcttccgcatcgtccagttggtcacaggctattcagtcgtggttcgacgagtataacgattttgattttggcgtagggcctaagacacctaacgctgtggtcgggcactacacgcaggttgtgtggtacagttcttatctggttggatgcggcaacgcctactgtccaaaccagaaagtgctgaaatactattatgtgtgccagtactgcccagcaggaaactgggcgaacaggctatatgttccatatgagcagggcgcaccttgtgcgtcctgcccagacaactgcgacgacggcctgtgtacgaacggctgcaagtacgaagacctctacagtaactgtaagtccctgaagttaacattgacttgtaaacatcagctggttagggactcctgcaaggcatcctgtaactgcagtaacagcatctactag

SEQ ID NO: 10281 - DNA, 714 bp, Artificial Sequence
  Description of Artificial Sequence: Synthetic coding sequence
atggtgactcctcccccaccaccagtgttctctctgcttaagatcagccagcggattgtgtgcctcgtcttagataagtccggcagcatgggagggaaggacaggcttaacaggatgaatcaggctgccaaacatttcttactgcagactgtcgagaacggaagttgggtgggcatggtacatttcgactcaacagccacaattgtgaacaagctgatccagattaagtcatccgacgagcgcaatacactcatggcaggactgcccacatatccactggggggtacttccatatgcagcggaattaagtacgccttccaagtgatcggagagctccattcccagttagacgggtctgaagtccttctcctgaccgacggcgaggacaatacggcctcctcgtgcatagacgaggttaagcagtcaggcgcaatcgttcattttatcgcactgggcagggctgccgacgaagcagttatcgaaatgtccaaaatcactgggggaagtcatttctacgtgagcgacgaggcccagaacaatggccttattgatgctttcggggctctcacctctggaaacactgacttgagccagaagtcgctccaggtgcgtgtgctgattccatgggtgtttatgtttacctttgctactaggaaaaaccatcttgtcgtgattagcttcgaatttcatatattcctgaaggtgaatttctag

SEQ ID NO: 10282 - DNA, 459 bp, Artificial Sequence
  Description of Artificial Sequence: Synthetic coding sequence
atggacaacgtgcagcctaaaataaagcaccgaccattttgtttctccgtgaagggccatgtcaaaatgctgaggctcgccctgaccgtcacaagcatgacgttctttatcattgcccaagctcccgagccctacattgtgatcaccggatttgaagtgaccgtgattttgtttttcatattactctacgtgctcaggctggatcgtttaatgaaatggttgttttggccccttcttgacatcattaactcacttgtaactacagtgtttatgttgattgtgtcagtgctagctcttattcccgagaccaccacattaaccgttggtggcggtgtgtttgctctcgtgacggccgtgtgctgcctggcagacggtgctctgatttatcgtaagctgctgttcaacccatctgggccttatcagaagaaacccgtccacgagaagaaagaggttctttag

SEQ ID NO: 10283 - DNA, 3744 bp, Artificial Sequence
  Description of Artificial Sequence: Synthetic coding sequence
atgttggctagtagcagcagaattagagccgcttggacacgagcactgctcttgccattgctcttggctgggcctgtcggatgtctgtctcgccaggagctgttcccttttggcccaggacaaggagaccttgagctggaagatggagatgatttcgtgtctcccgctctcgaactatcaggagctctccgcttttacgacaggagtgacattgacgcggtctacgtgacaaccaacggtattatagccaccagtgagcctccggctaaggagtcgcatccagggctcttcccccctacgtttggcgctgtcgccccttttctggccgatctggataccacggacggcttgggtaaggtgtattatcgggaggaccttagtcctagtattacacagcgcgcagcagagtgcgttcatcgtggcttcccagagatctcctttcaaccttcgagtgccgttgtggtcacctgggaaagcgttgctccataccagggacccagccgggatcctgatcagaagggcaagcggaacacctttcaggcagtgctggcctcctctgactcaagctcatacgcaatctttttgtaccctgaggatgggttgcagttccacactaccttctctaaaaaagagaataatcaggttccagctgttgtcgcttttagtcagggcagtgtggggttcctgtggaaaagcaacggggcttacaacatattcgccaacgatagggagtccgttgaaaacctggcaaaatccagcaacagtgggcagcaaggcgtgtgggtgtttgaaatcggcagtcctgccaccaccaacggcgtggtccccgctgatgtgatattaggcactgaagacggcgctgagtacgacgatgaggatgaagattacgacttggcaacaacccgtttagggttagaagatgtaggtaccacgcccttttcttataaggccctgcggcgaggcggagccgacacttacagcgtaccctcagtgctctctccaaggcgcgcagccacagagcgcccactgggccctccaaccgagcgcactagatcttttcaactggccgtcgaaacttttcaccagcagcacccccaagtgatcgacgtcgatgaggtcgaggagacaggtgttgtattttcctacaatactgattcaagacagacttgcgcgaacaatagacaccagtgcagtgttcatgcggagtgccgcgattacgcaaccgggttctgctgttcctgcgtagcgggttacacaggcaatggaagacagtgtgtcgccgaaggttctccccagcgcgtgaatggcaaagtgaaagggcgaatcttcgtggggtcaagccaagtgccgatagtatttgaaaacacagaccttcatagctacgtcgttatgaatcacggcagatcttacacggcgatctcaaccatcccggaaactgtggggtactccctactgcccctggcgcctgtgggaggcatcatcgggtggatgtttgccgtggagcaagatggcttcaagaacgggtttagcattacagggggtgagttcacccggcaggccgaagtcacttttgtaggccaccctgggaatctcgtgattaaacagcggttctctggcattgatgagcatggccatctcaccatagacactgagttggaaggccgagtacctcagattcctttcggaagctctgtccacatcgagccatatacggaactgtatcattactctacgagcgtgataacctctagctctacaagagagtatactgtgacagagcctgagagggacggagctagtcctagccgaatttacacatatcagtggcgacaaaccattactttccaggagtgcgtgcacgacgacagtaggccagcactgcccagcacacagcagctctctgttgactctgtgtttgtcctttataaccaggaagagaaaatattgagatatgcgctatccaactccattggccctgtgcgcgagggaagccctgacgcccttcagaatccctgctacatcgggacacacgggtgtgacacaaatgctgcttgcagaccaggcccaaggacacaattcacttgcgaatgttctatcggcttcagaggagatggcagaacctgctacgacattgacgaatgctccgagcagccatccgtgtgtgggagccataccatctgcaataaccaccctgggacctttcgctgtgaatgcgtggagggctaccagtttagcgatgagggtacatgcgttgctgtggtggatcagcgtcccatcaactactgtgaaacaggactgcataattgcgatatcccacagcgagcacagtgcatctatacaggaggatcatcatatacttgcagttgccttccaggattcagcggcgacgggcaagcctgccaggatgtggacgaatgtcagcccagccggtgtcaccctgatgcgttctgttacaatacccctggaagtttcacctgccaatgcaaaccaggctaccagggcgacggcttcagatgtgtgccaggggaagtggaaaaaactcgctgccagcatgagagggagcacatcctgggggctgccggtgcgaccgacccccagagacccatccccccagggctattcgttcccgagtgcgatgctcatggtcactacgcccctacacagtgtcacggcagcacggggtactgttggtgcgtggaccgagatggaagggaagtggagggtacaaggacacgacccggtatgacccctccatgcctatcaaccgtggccccacctatccaccagggacctgccgtccccaccgccgtgatcccactcccccctggaactcacttactcttcgcccagacaggcaagatcgagcgactgcccctcgagggcaatacgatgcgtaagacagaagccaaggcctttcttcatgtgcctgctaaggtgatcattgggctggcttttgattgtgtggacaaaatggtgtattggactgatataactgagccaagtatcggacgtgcaagtcttcacggcggtgaaccaacgaccatcatccgccaggatcttggcagtcccgagggcattgcggtggaccatctgggcagaaacatcttctggaccgatagcaacctcgacagaatcgaggtggctaaacttgatgggactcaaagaagggtcctgtttgaaaccgatttagttaaccccaggggtatcgtcacagactcagttaggggcaatttgtactggactgattggaatcgcgacaatcccaagatcgagacaagctacatggacgggacaaacaggcgaattctggtccaagacgacttgggccttcccaacgggctgacctttgatgcctttagttcccaactctgctgggtggacgcgggaacaaatcgggcagagtgcctgaacccttctcagccgtcccggaggaaggctctagaaggactccagtacccgttcgccgtgacaagttacgggaagaatttgtatttcaccgattggaagatgaactccgttgttgcgcttgatctggctatatcaaaggagaccgacgcctttcagccccataaacaaacccggctgtacgggatcactactgctctgagtcagtgcccacaagggcacaactactgttctgtgaacaatggtggatgcacccacctctgcttggctaccccaggaagccgaacctgccgctgtccagacaacactctcggtgtagattgcatcgaacagaaatag

SEQ ID NO: 10284 - DNA, 525 bp, Artificial Sequence
  Description of Artificial Sequence: Synthetic coding sequence
atgctgagaaccgaatcatgcagaccaagatcacctgcaggccaagtcgccgcagcctctcccctactgctgctcctgctacttttggcatggtgcgctggggcttgtcgcggagcacctatcctgccccagggcttacagccagaacagcagctacagctctggaatgagattgacgatacctgttcctcattcctcagcattgactcacagcctcaggcctccaacgcactggaagagctgtgtttcatgatcatgggaatgctccctaagccccaagagcaggatgaaaaggataatactaagagatttctcttccactattctaagacacagaagctgggtaagagcaacgtagtcagtagtgtggtgcacccattgctgcaacttgtccctcacctgcatgagaggcggatgaagcgcttccgcgttgatgaagagttccaatcccctttcgctagtcagagccgtggttactttttgttcaggcctcgcaacgggaggcgttcagccggatttatttag

SEQ ID NO: 10285 - DNA, 1218 bp, Artificial Sequence
  Description of Artificial Sequence: Synthetic coding sequence
atggacactatatttctctggtccttgttattacttttcttcgggtcacaggcctctagatgttccgcccagaagaacacagagttcgcggtggatctctatcaagaggtaagtttgagtcacaaagataacatcatcttctccccactaggcatcacacttgtgctggagatggtgcagctcggggcaaaaggaaaagcacaacagcaaatccgacagactcttaaacagcaggagactagcgcaggtgaggagtttttcgtcctcaagtccttcttttccgctatatctgaaaaaaagcaagagtttaccttcaacctggctaatgcactctatctgcaagaaggattcactgtcaaagaacagtatttacacgggaacaaggagtttttccagtccgctattaagctggttgactttcaagatgcaaaggcctgcgccgagatgatctctacctgggtcgaaagaaagacagatggcaaaattaaggatatgttctcgggagaagagtttggtccacttacgagactagttctcgtcaacgccatttacttcaagggggactggaaacaaaagttccgaaaggaagacacgcaacttatcaattttactaagaaaaatgggagcaccgttaaaattccaatgatgaaagcccttttacgaaccaaatatgggtacttcagcgaaagcagcctcaactaccaggtactcgagctttcatataagggagacgagttctcacttataatcattcttccagccgaggggatggatattgaggaagtcgagaaactcatcaccgcgcagcaaatactcaaatggctttccgaaatgcaagaggaagaggtcgagatatcactccctaggtttaaagttgagcagaaagtggacttcaaagatgtgctgtattcactcaatatcacagagatcttttcagggggttgtgatctgagtggtattacagactcctctgaagtatatgtgtctcaggtgactcagaaggtcttctttgaaataaatgaagacggctccgaagccgctacatccacagggattcacatccctgtcatcatgagcttagcccagtctcagtttatcgctaaccatcccttcttgttcattatgaagcataatccaacagagagcatcctcttcatggggagggtgacaaaccccgatacacaggagatcaagggcagggatttagactccttgtag

SEQ ID NO: 10286 - DNA, 3687 bp, Artificial Sequence
  Description of Artificial Sequence: Synthetic coding sequence
atgaagggagcaagattgttcgtcttgctgtcctcattgtggagcggtgggataggtttgaacaattcaaaacacagttggacaatccctgaggatgggaacagccagaagactatgccttcagcatccgtcccacccaacaagatccagtccctacagatcctgcccacaacccgtgtgatgtcggcagaaattgcgaccacaccagaggccaggactagtgaggactcactgctgaagtccacattgccgcctagcgagacaagtgccccagccgaaggcgtgcgtaaccagactctcacttctaccgagaaggccgagggcgtggtgaaattacagaacttaacacttccaacgaacgcatctattaagtttaatcctggcgcagagtcggtggttctttcaaattcaaccctgaagttcctgcagtcttttgctagaaaaagcaatgagcaggctacatcactgaacacagttggcggaacagggggaattggcggtgttggaggcaccgggggagtcggcaatcgtgctcccagagagacgtatctgtctcgaggcgattcatccagttcccaacgcacagattaccagaagagtaatttcgagacaacccgtggcaaaaactggtgcgcatacgtgcatacgaggctaagtcctacagtgatccttgacaatcaggtgacctacgtacccggtgggaagggcccttgtggatggaccggcggttcttgtccccaacgctcgcagaaaatcagcaatccagtttaccgcatgcagcacaaaattgtcacaagtctggattggaggtgctgcccaggatactccgggcctaagtgccagctgagggcccaggagcaacagtcattgatacacaccaatcaggctgaatcccataccgctgtaggccgtggcgtcgcagagcagcagcagcagcaaggatgcggcgatcctgaagtgatgcagaagatgactgaccaggttaactatcaggctatgaaattaaccctcctgcagaaaaaaatcgataacatctcacttacagtcaacgacgtgcgtaacacttacagtagtctggagggaaaggtcagcgaggataagtccagggagttccagagcttactgaagggcctgaaaagcaaaagcataaacgtgctcattcgggacatagtgagagagcagtttaagatcttccagaacgacatgcaggagaccgtggcacagttgttcaaaacagtgtcaagtttgtccgaggatttggaatctaccagacagattatccaaaaggtgaacgaatccgtggtatctatcgctgcgcagcagaagtttgtattggtgcaagaaaaccggcctactttgacagatatcgtggagctgcgcaaccacattgttaatgtgcgccaagagatgacattgacatgcgagaaacccatcaaggagctggaggtgaagcagacccacctcgaaggcgctcttgagcaggaacatagccggagtatcctgtattatgagtctcttaacaagactttatccaagctgaaggaggtccatgagcaattactgtcaaccgagcaagtgagcgaccagaagaacgcaccagcagctgagagtgtgagcaataacgtgaccgaatacatgtcaaccttgcacgaaaacattaaaaagcagagcctcatgatgctgcaaatgtttgaggatttgcacattcaagagtctaaaatcaataacttaacggtctccctcgaaatggaaaaagagtcacttcgtggcgaatgcgaagacatgctgtcaaaatgccgcaacgattttaagtttcagcttaaggatacggaagaaaatcttcacgtactcaatcagacactcgcggaggttctgttccccatggacaataagatggacaagatgagtgagcagttgaatgacctcacctacgacatggaaatcctccaacctttattggagcagggagcctccctgcgtcagacaatgacctatgaacagccaaaggaggccatcgtcatccgcaaaaaaatcgagaacctgacctccgccgtcaactcgctgaactttatcataaaagagctgactaaacgccacaacttgctccggaacgaagtgcagggcagagatgatgccctggaacgacggataaacgagtatgctctcgagatggaagacggactgaataagactatgaccattatcaacaacgccattgatttcatccaagataactatgcactcaaagaaacactgtccacaattaaggataactcagaaattcaccataagtgtaccagcgatatggagaccattctcactttcatccctcagttccatcgactaaacgatagcattcagacactagtcaacgacaaccaaagatataatttcgtactgcaggtagccaagaccctagctggaatacccagggacgagaaactgaatcaatccaactttcagaagatgtaccagatgtttaatgagactacttctcaggtgagaaaataccagcagaacatgtctcacctggaagagaagttgctgcttacgaccaagatatcaaaaaatttcgaaacaagactgcaggacatagagagtaaggtgacccaaacactgataccttattatatctctgtaaaaaaagggagtgtggtcaccaacgaacgtgaccaggccctgcagttgcaggttctaaacagtaggtttaaagccctggaggcaaagagtattcacttgtccattaattttttctctttaaataagaccctgcatgaggtgctcactatgtgtcacaacgccagcacaagcgtcagtgaactcaacgccacaatccccaagtggatcaaacactccctacctgatattcagcttctccagaaaggattaacagaatttgttgaaccaatcatccaaattaagacacaggctgctcttagtaacctgacgtgctgtatagacaggagtctgcccggttccctggccaatgtcgtgaaatctcagaagcaggtgaagagcctgcctaagaaaattaacgccttgaaaaagccgaccgtcaatctcaccacagtgctgattggacgcacacagcgaaacacagataacattatttatcctgaagagtacagcagttgttcaaggcatccgtgtcaaaacgggggaacctgtattaacggcaggacctcgttcacttgcgcctgtaggcatcccttcacaggagacaattgcactattaaactggtggaggaaaacgcgttagcaccagactttagcaaggggagctacaggtatgcacccatggttgcgttctttgcttctcacacttatgggatgacgatcccagggccaatcctgtttaacaatctggacgtgaactatggcgcttcctatacccctaggacaggcaagtttaggatcccctacctgggggtgtatgttttcaagtataccatagagtcatttagcgcacatatcagcggatttttggtggtcgatggcatcgataaactagcatttgagagcgagaacatcaacagtgaaattcactgtgacagggtgctgaccggcgatgccctgctggagcttaactacggacaggaggtgtggctccggctggccaagggaactatacccgcaaaattcccacccgtgactacattttctggttacctgctctaccggacctag

SEQ ID NO: 10287 - DNA, 1365 bp, Artificial Sequence
  Description of Artificial Sequence: Synthetic coding sequence
atgtggcccctcactgtgccacctccgcttctacttttgctttgtagcgggctggcaggccagacgctgtttcagaaccctgaggaaggctggcaactgtatacttcggcccaggctccagacgggaaatgtatttgcactgcggtgatccccgctcagtctacttgtagcagggacgggcgatcgcgagagttgagacaacttatggaaaaggttcagaatgtatcccagtctatggaagtgctggagctgagaacatatcgggatttacagtatgtaagaggaatggagacccttatgaggtctctggatgcgaggttgagagctgctgacggcagcttgtcggcgaaatcatttcaggaactgaaagatcgcatgacggagttactccccctctcttcagttcttgagcagtacaaagcggacactcgcactattgtccgcctcagggaagaagtccgtaacctgtccggttcattggctgcgatccaagaggagatgggggcatacgggtacgaagacctccagcagcgcgtcatggccctggaagcacgtctgcacgcctgtgctcaaaagctggggtgcggcaagctcaccggagtcagtaaccctataacggtgagagccatggggagtcggttcggttcctggatgaccgataccatggccccttccgccgacagccgggtgtggtatatggacgggtactacaagggcaggcgcgtcttagagttcaggactctgggtgactttatcaaggggcaaaattttatccaacatttattgccacagccctgggcaggcacaggccatgtggtgtataatgggtccctcttttataataagtaccagtctaacgtggtcgtgaagtaccactttcggagtcgaagtgtccttgtacaaagatctctccctggcgctggatacaacaacacctttccctatagctgggggggtttttctgatatggatttcatggtagacgagtctgggctttgggctgtttacacaaccaatcaaaacgccggaaatatagtggtcagcagattagatccccacactttagaagtcatgagatcttgggataccggttatccgaagcgctctgccggtgaggcattcatgatctgtggggtgctctacgtgactaactcacacctggcaggggctaaggtttacttcgcttattttacaaacacctcctcatacgagtataccgacgtgccctttcataaccagtacagccacatctccatgctggattataatcctcgtgaaagggccctctacacatggaataacgggcatcaagtattatacaatgtcacactattccacgtgatctctaccagcggcgatccctag

SEQ ID NO: 10288 - DNA, 909 bp, Artificial Sequence
  Description of Artificial Sequence: Synthetic coding sequence
atgtgcgccgagagactgggtcagttcatgacactggctctggtccttgccacttttgatccagcacgaggtactgacgcgacaaaccctccagaaggaccccaggaccgtagctcacagcagaaaggacgactgtctctgcaaaacactgcagagatccagcattgtcttgttaacgccggtgacgtgggatgtggagtgtttgaatgctttgagaataatagctgtgaaattcgcggactacacggtatttgcatgaccttcctgcacaatgccggaaaattcgatgctcagggcaagagtttcatcaaggatgctttgaagtgcaaggcccatgcactacgacaccgattcggctgcatctctcgaaaatgtcccgctataagagaaatggtatcacagctgcagcgggagtgttacctgaagcacgatttgtgtgccgctgcacaggaaaacacaagagtcatagtggaaatgatccactttaaagatctccttctccatgagccatacgtggatttggttaatctcctgctgacatgtggcgaggaggtgaaggaagccatcacccactccgtccaggtccaatgcgaacagaattggggaagtctgtgcagcattttgtcgttttgtacttcggctatccagaaacccccaacggcccctcctgagaggcagcctcaggtcgataggaccaaactctcaagagcccaccacggggaggcgggtcatcacctccccgagccaagctcacgtgagaccgggagaggtgctaaaggggagagggggagcaaatcccaccctaatgcgcacgcacgcggacgtgtgggaggcctaggagctcagggaccaagcgggtcgagcgaatgggaggatgagcagtctgaatactccgatatacgcagatag

SEQ ID NO: 10289 - DNA, 2529 bp, Artificial Sequence
  Description of Artificial Sequence: Synthetic coding sequence
atgaaacccggtgggttttggctccacctgacactgttaggggcatctcttcctgccgcactcggttggatggatccgggaacatctaggggcccagatgtgggtgtgggagagagccaggctgaggaaccacggagtttcgaagtgaccagaagagaggggctgtcgtctcacaacgagctgttagcaagctgcgggaagaaattttgttctagaggaagtcggtgtgtcctgtcgcgtaaaaccggagaacctgagtgtcaatgcctcgaggcttgtcgcccaagctacgtccctgtgtgtgggtccgacggacgcttctacgagaaccactgcaaacttcaccgtgctgcgtgtttgcttggtaagagaataaccgtgatccattcaaaagactgctttctgaagggggatacttgtactatggccggatacgcccgtctgaagaatgtgctgctggccctccagaccagactgcagcccttgcaggaaggggattctagacaggatcctgcctcacaaaagcgcctcttggtggaatccctcttccgtgatctagacgccgatggaaacgggcaccttagctctagcgagctcgcgcagcacgtgctgaagaaacaggacctggacgaggacttactagggtgtagccctggggacctactccggttcgacgattataattctgattccagcctcaccctgagagagttctatatggcctttcaggtcgtgcagttaagcctggccccagaagatcgcgtctctgtcaccaccgtcaccgtcggactgagtacagtcctgacttgcgccgtccatggggatcttagacctcccatcatttggaagcgaaacggcctaaccctgaatttcctggacctggaagacattaatgattttggggaggacgattcactctatattacaaaggtcactacaatccacatgggcaactacacctgccacgcatctggccatgaacagctgttccagactcatgtgctccaggtgaatgtgcccccagtgatccgtgtgtaccccgaatctcaggcgcaggaacccggagtcgcagcgtccttacggtgccatgcagagggcattcctatgcctagaatcacatggctgaaaaacggtgtggatgtctctacccagatgagcaaacagctgtccctcctggcgaacggctccgagttgcacattagtagcgtacgttatgaagacactggagcgtatacatgtattgcaaaaaacgaggtcggggtcgacgaggacatctcatccctcttcatcgaagacagcgcgcgaaaaacactagccaatatcctctggcgagaagaaggtctaagcgtgggcaacatgttttacgtgttttccgacgatggcatcattgtgattcatcctgttgactgcgaaattcaaagacatctgaagcctaccgagaaaatcttcatgtcatatgaggaaatctgcccgcagagggagaagaatgctacccagccatgtcagtgggtctccgccgtcaacgttcgaaatcgctacatctacgtggcacagcccgcactctccagggttcttgttgtagatattcaggcgcagaaggtcctacagagcataggggttgaccctcttcccgctaagttgtcatacgataaatcacatgaccaagtgtgggtactaagctggggcgacgtccataagagtaggcccagcttgcaggtaatcaccgaagcttctacgggccaaagccaacacttgatcagaacacctttcgccggagtggacgattttttcatcccacctactaatctgatcataaatcacatccggttcggttttatttttaacaagagcgacccggcagtccataaggtggatctagaaaccatgatgccactcaagacaatcggcctgcatcaccacggatgcgtacctcaggcaatggctcatacccacttagggggttatttttttatccagtgtcggcaggactcacccgcttccgcagcaagacagctgcttgtggattctgtcaccgactctgttctgggacccaatggggacgtgaccggcacccctcatacttccccagacgggcgttttatagtgtcggctgctgctgattcgccgtggcttcatgttcaagagataacagtaagaggggaaattcagaccctctatgatctgcagattaatagcggcatatctgatcttgcttttcagagatctttcacagagtcaaaccagtacaatatatacgctgccctacacaccgagcctgatctactgttcttggaactgtccacgggaaaggtgggaatgctcaaaaatcttaaagagcctcccgcaggaccagcacagccctggggcggaactcatagaattatgcgcgatagtggcctgttcggacaatacttactgacccccgcacgtgagagcttgtttttaataaacggccgtcaaaatacgttaagatgcgaagtgtccgggattaaaggtggaacaacggttgtttgggtcggcgaggtgtag

SEQ ID NO: 10290 - DNA, 2256 bp, Artificial Sequence
  Description of Artificial Sequence: Synthetic coding sequence
atggctttccgcactatctgtgtccttgtgggggttttcatatgttccatctgtgtgaaagggtcaagtcagccccaggctagggtatacctgacttttgatgagctcagggaaactaaaacttcagaatattttagcctatcacaccaccccctagattatcggatcctgctcatggatgaggatcaggatcgcatatacgttgggtccaaggaccacattttgtccctcaacatcaacaatatcagccaggaagctctctcggtgttttggcctgcctctaccattaaagtggaggaatgtaagatggccggtaaggatcccactcatggatgtggcaacttcgtccgcgttattcaaaccttcaacaggacacacctctacgtgtgtggctctggggcattcagccccgtgtgtacatacctaaaccgcggtaggcgaagtgaggatcaggtatttatgatcgactccaagtgtgagtctgggaagggtcggtgctcctttaaccccaatgttaataccgtgtcagttatgatcaacgaagagctgttctccgggatgtacattgactttatgggtacagatgccgctatttttcggagtctgactaaacgtaatgcagtgcggactgaccagcacaattccaaatggctatctgagccaatgttcgtcgatgcgcacgtgatccccgacggtactgacccaaatgatgctaaggtgtacttctttttcaaggaaaagttaaccgacaataaccggagcactaagcaaatccatagtatgatcgctaggatctgccccaacgacaccgggggtctccggagtttggtgaataaatggacgacctttctgaaagccaggctcgtctgttcagtcacagacgaagacggcccagagactcacttcgacgaactggaagatgtgtttctcctggaaacggacaaccctagaaccaccctcgtctacggtatatttacaacttccagctctgtgttcaagggcagcgcagtgtgtgtgtaccacctgtcagacatacagacagtgttcaatggaccgtttgctcacaaagagggtcctaatcaccagctgatttcctaccagggacgtatcccctatcctcgtcctgggacatgccctggtggggcttttactccgaatatgagaacaaccaaagagttccctgatgacgttgttacattcattaggaatcacccgctcatgtacaacagcatctaccctatccacaaacgccctctaattgtccggataggtaccgactataaatacactaagattgccgtggatagggtcaacgcagctgacggtagataccatgtcctgtttctgggtactgaccgtggcactgttcaaaaggtggtggtgctccctactaacaatagcgtaagcggggagctaattctcgaagagctggaagtgttcaagaatcatgctcccatcacaactatgaaaatcagctcaaagaaacagcagctttacgtctcttcaaacgaaggagtgtcacaggttagtctccatcggtgtcatatctacggcacagcctgcgctgactgttgtctggccagagacccatactgtgcatgggatggacactcatgctcgcggttttatcccacaggcaaacgcagatccaggcgccaggatgtccgacacgggaaccctctgacccaatgtcgcggattcaacctgaaagcttaccggaacgccgcagagattgtacagtatggagtgaaaaataatacgactttcctagaatgtgcgcctaagtccccccaggccagtatcaagtggctgttgcagaaagataaggacagacggaaggaggtgaagctgaacgaacggatcattgcaacatcacaggggcttttgataaggtcggtccagggatccgaccaaggactgtatcactgcatcgccacagagaactcattcaaacaaaccatagctaaaatcaatttcaaagtcttagactctgaaatggtggccgtagtaaccgataagtggtccccatggacctgggcgagcagcgtgcgggctctgcccttccaccccaaagatattatgggggcattttcccacagtgagatgcagatgatcaatcaatactgcaaggataccaggcaacagcaccagcagggtgacgagtcgcaaaaaatgaggggagattatggaaagcttaaagcactgatcaactcgcggaagtcccggaaccgacggaatcaacttcccgagtcatag

SEQ ID NO: 10291 - DNA, 2316 bp, Artificial Sequence
  Description of Artificial Sequence: Synthetic coding sequence
atgggatggttaacacgcatagtctgcctcttctggggcgtcctgctcaccgctcgggcaaactatcagaatgggaagaacaacgttccacgccttaaattgagttataaagaaatgttggagtcaaataatgttatcacgtttaacggtctggctaattcctcaagctatcacacgttcttactggatgaggagcgctcgagattgtacgttggcgcaaaggaccatatcttctcatttgatttagtgaacatcaaagacttccaaaagattgtgtggcccgtatcgtacaccagacgggatgagtgtaaatgggccggtaaggacatcctaaaggaatgcgccaactttatcaaagtactgaaggcatacaaccagactcatttgtacgcctgcggaaccggggcattccatcccatttgcacatatatcgaaatcgggcaccacccggaagacaacatctttaaactcgagaattcccattttgagaacggaagaggtaagtccccgtacgaccctaagctattgacagcttctcttctgattgatggggaactgtattccgggacagccgctgatttcatgggacgagattttgcgatttttagaactttggggcatcaccatcccattagaacggagcagcacgactctaggtggcttaatgaccccaagtttatcagcgcacacttgatctcagagagtgacaaccccgaggacgataaggtgtacttcttctttagagaaaacgcgatcgacggagagcatagtggaaaggccacccacgcacggattggtcagatttgtaagaatgatttcggtgggcacagaagtctagtgaataagtggactacgtttttaaaagctcgattaatctgttcagttcccggacctaatgggatcgatacccatttcgatgaacttcaggatgtgtttctgatgaatttcaaagacccaaagaaccctgtggtctacggggtattcactacgtcctcaaatatctttaagggctccgcggtgtgcatgtactcaatgagtgacgtcaggcgcgtttttctgggtccatatgcacaccgcgacggtccaaattatcagtgggtgccctatcaaggtagggtcccttatccgaggcccggtacgtgtcccagtaagacattcggaggcttcgattccacgaaagatctcccagacgacgtcattacctttgctaggtcccaccccgctatgtataatccggtctttcccatgaacaaccgaccaatcgtaatcaagacagacgtgaattatcaatttactcaaatagtcgttgaccgggtggatgctgaagacggtcagtacgacgttatgtttattggcacagacgtcggaaccgtgctaaaagttgtgtctattcctaaagagacctggtacgacctcgaagaggtcctgttagaggaaatgactgttttccgcgagcctacagccatttccgccatggaactctcaacaaaacaacagcagctgtacatcgggtccactgctggcgttgcccagctccccctacacagatgcgatatctatggcaaagcttgcgccgagtgctgtctggccagagatccctattgcgcgtgggatggcagcgcttgcagtcgatacttccccacagcgaagcgtagaactcgacgacaagatattcggaacggtgatcctctgacccactgcagcgatctccaccatgacaaccaccatggccactcacccgaagagagaattatatacggcgtggagaactcttctacttttctggaatgctcaccgaagtcacaacgggcactggtgtactggcagttccagagaagaaacgaggagcgaaaagaggagattagagtggacgaccacatcatccgaaccgaccaaggactgcttctgcgctcactccagcagaaagattctggtaattacctctgccatgcagttgagcacggttttatacaaactctgctcaaagtgactctggaagtgattgacaccgagcacttagaggagttgcttcacaaagatgacgacggtgacggcagtaaaaccaaagagatgtcaaattctatgaccccctcccagaaggtgtggtacagggattttatgcaactcatcaaccacccaaacttgaataccatggacgagttttgtgagcaggtgtggaagagagacagaaagcagcggaggcagaggccaggccatacacccggtaatagtaacaaatggaaacacctgcaagaaaataagaaaggcaggaatagacgaactcacgagttcgagcgggcacccagatctgtttag

SEQ ID NO: 10292 - DNA, 4605 bp, Artificial Sequence
  Description of Artificial Sequence: Synthetic coding sequence
atggccctgacacctggctggggctccagtgcaggtcccgtgaggcctgagctatggttactcctttgggcagccgcatggcgacttggtgccagcgcctgtcccgcactttgtacctgtaccggcactactgtcgactgtcatggcacaggccttcaagctatccctaagaatattcccaggaataccgaacgcttggagctcaatggtaataacattacaaggatccacaaaaatgacttcgctggcctgaaacagctgcgggtgctccagttgatggagaaccagatcggagccgtcgagaggggtgcttttgatgatatgaaagagcttgagcggctgcggcttaatagaaatcaactgcacatgcttcctgagttgctcttccagaataatcaggcactgtcacgactggatcttagtgagaacgccatacaggccattccccgaaaagcttttaggggcgcaaccgatttgaaaaatctgcagctggataaaaaccagatttcctgtatcgaggaaggtgcatttcgcgctctgagaggcctggaggtgctgactctgaacaacaataatatcaccaccatccctgttagttccttcaaccacatgccaaaattgcgtacattccgattgcattccaaccatcttttttgcgactgtcacctcgcctggctgtcccagtggctgagacaacggcctaccatcggtctctttacacagtgctctggtcctgcctctctgcgtggtctgaacgtcgctgaggtgcagaagagcgagttctcgtgctcaggtcagggggaagcagggagggtgcccacatgcaccctgtctagtggatcttgtcctgccatgtgtacgtgctcgaatggtattgttgactgtagaggcaaagggctgacagcaattcctgcaaacctcccagaaactatgactgaaatccgcctggagctaaatggaatcaagagcatacctccgggagcattctctccatataggaaactccgcagaatagacttgtcgaataatcagatagcagaaatcgcccctgacgcatttcagggcctgcggagtctgaacagcttagttctatacggtaacaaaataacagacctgcctcgcggagtttttgggggactgtacactctgcagctgctgctacttaacgcaaacaagattaactgtattcggccagatgcgttccaggatctgcagaacctctccctgctgtcgttatatgataacaagatccaatctctggctaaggggactttcactagtctgagagccattcagacactgcatttagcccagaatccttttatctgcgattgtaatttgaagtggttagcagactttttacgcaccaaccccattgaaacatcaggggcacgttgcgccagtcctcgacgtcttgccaacaagaggattggccagattaagtccaagaaatttcggtgctcagccaaagaacagtattttatccctgggacagaggattatcaactgaattccgaatgcaactctgacgttgtgtgtccccacaaatgccgctgcgaggctaacgtagtggagtgttcttccttaaagctgacaaagatcccagagcgcatacctcagtcgacagccgaactgcgactgaacaataatgagatttcgattctggaggcaactggaatgttcaaaaagctgacacacctgaaaaagattaatcttagtaataataaagtgtcagaaatcgaggacggtgctttcgaaggcgctgcctcggtcagtgagctccatttaaccgctaaccaactggagtccatcagatccggcatgttcagaggcctggatgggcttagaacactgatgctcaggaacaatagaatctcttgtatccacaacgactcgttcacggggttgcgcaatgtccgtcttctctccttatacgataatcaaataaccacggtgagccccggtgcatttgacacgctacagagtctgagcaccctgaatctgctagcaaatccctttaactgtaactgtcagttagcctggttgggcggttggttgagaaaacgcaaaatcgttaccggaaaccccagatgccagaacccggattttttgcgccagattccactgcaggatgtggcctttcctgacttcagatgcgaagaaggtcaggaagagggcggatgtctgccacggcctcaatgtccacaggagtgcgcctgtcttgatacagtcgtccgatgctctaacaaacacctccgcgcactcccaaagggtattccaaagaatgtgacagaactgtacctggacggaaaccagtttactttagttccaggacagctgtccacattcaagtatctgcagctagtggatctgtccaacaataagatctcctcactgagtaatagcagttttaccaatatgagtcaactgaccaccctgattctctcatataacgcgctacagtgtatacctcctttggccttccaaggactacgttcgctcaggctcttatccctgcacggcaatgatatctctactctgcaggaagggatctttgcagatgttactagcttgtcgcatctggccatcggagccaacccactgtactgtgattgtcacctgagatggctgtcttcatgggttaaaaccggttataaagaaccagggatcgcgagatgcgcaggaccccaggatatggagggtaagctgctactgactaccccagctaaaaagtttgaatgccagggccctcctactttggccgtgcaagccaagtgcgacctctgcctgtcctccccatgccagaaccagggcacctgccacaacgatcccctcgaggtgtatcgttgtgcctgccccagcgggtacaaaggcagagattgcgaagtatctttggattcctgcagttccggcccatgcgaaaacggtggcacctgtcatgcccaggagggggaggacgctccattcacgtgtagttgccccaccggatttgaaggcccaacatgcggtgtcaatacagacgactgcgtggatcatgcttgcgccaacgggggagtctgcgttgacggagtgggaaattacacatgtcagtgccccctgcagtacgagggcaaggcgtgcgaacagttagtggatctatgcagtcccgacctgaatccttgccagcatgaagcccaatgtgttggaaccccggacggccctcggtgtgagtgtatgcctggctatgccggagataactgttccgaaaaccaggatgactgccgggatcaccgctgtcagaacggagctcagtgtatggacgaagtgaacagctactcctgtctctgcgccgaagggtactctgggcaactgtgtgaaatacctcctcacttaccagctccgaagagcccctgcgagggcacagagtgccaaaacggcgctaactgtgtggatcaagggaaccggccagtctgccagtgtctaccaggcttcggtggtcccgagtgcgaaaagctgctatcagtaaactttgtcgaccgcgatacttatctgcagttcaccgatctgcagaattggccacgcgctaatatcaccctgcaggtgtctacggctgaagataacggaattctcctgtataacggcgataatgaccacatcgccgtcgagctgtaccagggacatgtgagggtgagctacgatccgggaagctatccaagtagtgctatatattctgccgaaaccatcaatgatggacagtttcacacagtcgaattggtggccttcgaccagatggttaacctcagcatcgacggcggtagtccaatgactatggacaattttggtaagcattacactttaaactcagaagccccactctatgtggggggtatgccagtggatgtcaacagcgctgcattccgattatggcaaatcctcaacggcacaggcttccatggctgcatccgcaatctctatattaacaacgagctgcaggatttcaccaaaacgcaaatgaagcctggtgtagtgcctggttgtgaaccctgtcgaaagctgtactgtctgcacggaatctgtcaacccaatgccacccccggacccatgtgccactgtgaggctggatgggtgggactacactgcgatcagccggcagacggcccttgtcacggccataagtgcgtgcacgggcagtgcgtgcccctcgacgcattgagttactcctgtcagtgtcaggatggctattcgggggcactgtgtaaccaggctggagctctggccgagccttgccgtggcctgcagtgcctgcacggacattgtcaagcttcggggaccaaaggggcacattgtgtatgcgacccaggattttctggcgagctgtgtgagcaagaaagcgagtgcagaggggaccccgtgcgtgattttcaccaggtgcaacgcggatatgccatttgccagacaacccgccctttatcctgggtggagtgcagagggagttgtcctggtcagggatgctgccagggacttaggctgaagcgtaggaaatttacattcgagtgttccgacggcacgagctttgccgaagaagtggaaaagcccactaaatgcggctgcgccttgtgcgcatag

SEQ ID NO: 10293 - DNA, 342 bp, Artificial Sequence
  Description of Artificial Sequence: Synthetic coding sequence
atggacagccgacaagctgctgcgctgctggtgctccttttactgattgatgggggatgcgcagaaggcccaggaggacagcaagaggaccagctaagcgccgaagaagattcagagcctcttccaccacaagatgcccagacatctggttccctgctgcattatttacttcaggccatggagcgccctgggaggtctcaagctttcctgtttcaaccccagcggtttgggagaaatactcagggctcatggcgcaacgagtggttgagcccaagggctggggaaggtctgaattcccagttttggtccttggctgccccacaaaggtttggaaagaagtag

SEQ ID NO: 10294 - DNA, 2568 bp, Artificial Sequence
  Description of Artificial Sequence: Synthetic coding sequence
atggctcgccaccttctgctcccactggtgatgctggtgataagcccgattcccggagctttccaggatagcgctttgagccctacacaagaagagcctgaggatcttgactgcgggaggcccgagcctagcgcaaggattgtgggtggcagcaatgcccagcccggaacatggccatggcaggtgtctctccaccacggtgggggtcatatctgcggcggttctctaatagcaccatcttgggtgctgtcagccgctcactgtttcatgaccaatggtactcttgaacccgctgccgaatggtcagtgctcctcggggtacacagtcaggacggtccccttgatggggcacacacgcgcgctgtggcagcgattgttgtaccagccaattacagtcaagtcgagctcggcgcagacctggctctcttgcggcttgcgtccccggcttcgctgggtcctgccgtttggccggtctgtctgcctagggctagccatcgctttgtacatggaacagcttgttgggccactggttggggagatgtgcaggaagccgacccactccctttgccgtgggtcttgcaggaggtggagttgagacttctgggggaggccacatgtcagtgcctgtactctcagcctggcccttttaatcttacacttcagattttgccaggcatgctgtgtgccggatacccagagggcagacgggacacatgccagggggacagcggaggccctctcgtctgtgaggagggagggcgttggtttcaggctggaattacaagcttcggtttcggttgcggcaggcgaaacagacccggagtgttcacagcagtggccacttacgaagcgtggatccgggaacaggtgatgggatcggagcctggacctgcatttccaacccaaccccaaaagacccagtctgatccacaggagcctcgggaggagaattgtactatcgcccttcccgagtgcggaaaagcacctaggcctggtgcgtggccatgggaagcccaggtgatggtgccgggtagtaggccatgtcacggcgcattggtgtcggaaagctgggtgctggctcctgcatcatgcttcctcgaccctaactcatccgattcacccccaagggatctagacgcctggagagtgttgctccctagccggccaagggctgagagagttgctagactggtacagcacgagaatgcctcttgggataacgcctccgacttagccctgctgcagctgcgcactccggtcaacctcagcgccgcttctagacccgtgtgcctccctcatccggagcactactttctgcccggaagcaggtgcagactcgctcggtgggggaggggcgagccggctttaggccctggggcactactcgaggctgaattactggggggttggtggtgccactgtctgtacgggcgacagggagcagccgtgccgttgcccggtgatcctcctcatgcattgtgtcccgcataccaggaaaaagaggaggttgggagctgttggaatgatagtagatggtctctactatgccaggaagaaggcacttggttcctggctgggattcgcgattttccctcgggctgtctgaggcccagggccttctttccccttcagacacacgggccttggattagtcatgtcacccggggagcatacctggaagatcagctggcatgggactggggtcctgatggcgaggagactgagacccagacttgcccacctcataccgagcatggagcatgtggcctgaggctcgaggctgccccagtgggtgttttgtggccttggttggccgaagttcacgtcgccggagaccgggtgtgcacagggattcttttggcacctggatgggttctagccgctactcactgtgttttgaggcccggttctactaccgtcccctacatcgaagtctacttggggagggccggagcatcctcgctgccacaaggacatcaggtgagtcgcctcgtaatcagcatccggttaccccagcacctgggactgagaccacctctcgcactcctagaactctcaagccgggtcgaacccagccccagtgcactgcccatctgtcttcacccagccggtattcctcctggtgctagctgctgggtcttaggctggaaagagccacaggatcgagtgcctgtcgccgcagctgtgagtatcctcactcagcggatctgtgactgtttgtaccagggaattttacctcccggtacattgtgtgtcctttatgccgagggccaggagaaccggtgcgaaatgaccagcgcccctcctcttctgtgccagatgacggaggggtcctggattctggttggcatggcggtacagggatccagggagctgtttgctgccatcgggcctgaagaggcgtggatctcacagactgttggggaagccaattttttacccccttcaggcagcccgcactggcccaccgggggatccaacctgtgtccccctgagctcgccaaagccagcggaagtccccacgccgtctattttttactgctgctgacacttctgatccagagttag

SEQ ID NO: 10295 - DNA, 912 bp, Artificial Sequence
  Description of Artificial Sequence: Synthetic coding sequence
atgctgcaccccgaaactagtccagggagaggtcacctgctcgctgtgttacttgccctgctgggaaccacttgggctgaggtatggcccccacaactgcaagaacaggccccaatggctggagcgctgaacagaaaggaatctttcctcctcctgtctctgcataatcgattgcgctcttgggttcagccgcctgcggcagatatgcggagattggattggtccgattctctggcccaactcgcacaagccagggcagcactgtgcggcatccccacgccatctttggccagtggtctttggaggaccttgcaagtggggtggaatatgcagctgctgcctgctgggttagccagtttcgtggaggttgtttccctctggttcgctgagggtcaaagatatagccatgccgcaggcgagtgtgccaggaatgcgacatgtactcactacacccaacttgtatgggcaacttctagccaattgggttgtggcagacatttgtgtagtgccggacagaccgctatcgaggccttcgtctgtgcttacagcccaaggggaaattgggaggttaatggcaaaaccatcattccctataagaagggcgcttggtgttctctctgtactgcatctgttagtggctgcttcaaggcgtgggaccatgcaggtggtctctgtgaggtgcctaggaatccctgccggatgtcctgtcagaatcacggaaggctgaatatcagcacctgccattgccattgtcccccaggctacaccggaaggtattgccaggtgagatgcagtcttcagtgcgtgcacggacgctttcgggaagaggagtgctcctgcgtatgcgatatcgggtatggggagccgtccgttccacccagatgcattttcccatctacaccagtgacatag

SEQ ID NO: 10296 - DNA, 1158 bp, Artificial Sequence
  Description of Artificial Sequence: Synthetic coding sequence
atgaaaatgctgcctggcgtgggcgtgttcggcacaggctcaagtgccagagtgcttgtgcctctgctgagggctgagggctttaccgttgaagctttgtgggggaagaccgaagaagaggcgaagcagctggccgaagagatgaacattgcattttacacgagtcggaccgacgacattttgttgcatcaagatgtagatctggtctgcatctccatccccccaccattgaccaggcaaatatctgtaaaagctcttgggataggtaagaacgtggtctgcgaaaaagccgctactagtgtcgacgcttttcgcatggttactgcaagcaggtactatccccagttaatgtcgttggtgggaaacgtactgaggttcctgccagccttcgtgcgcatgaagcagctgatctccgagcattatgttggggctgttatgatttgtgacgcacgcatatactcaggaagcctgttgtccccctcctacggctggatttgcgatgagttgatggggggtggcggactccataccatgggaacatacattgttgatctcttaacacacctcactgggaggcgggctgaaaaggtccacggactgttgaagacgttcgtgaggcagaacgccgcaatacgcggtatacgacatgtgaccagcgatgacttttgctttttccagatgttgatgggagggggtgtatgttccaccgtgactctgaactttaacatgcccggagcattcgttcatgaagtgatggtggtgggatccgctggcagactcgtggccagaggggctgatctgtacggtcagaagaattccgcgactcaggaggagcttcttctgagggacagcctggccgtgggcgctggattacccgagcagggaccgcaggatgtgcccctgttgtacctgaaaggcatggtttacatggtccaggccttacgacagtccttccaaggccagggcgatagacgcacctgggatcggacacctgtctccatggctgcttctttcgaagatggcctctacatgcaatccgtggtagatgccatcaaacgttcttcacgatctggagagtgggaggcagtggaagtcttaacagaggagcctgacactaaccagaatctgtgcgaggctctccagcgcaataatctttag

SEQ ID NO: 10297 - DNA, 1470 bp, Artificial Sequence
  Description of Artificial Sequence: Synthetic coding sequence
atgcctgtgacttttgccctattacttctgctcggccaggcaaccgcagacccctgctacgacccacagggacggccacagttttgcctgcccccagtaacccagttggcggcagtggctgcatcttgtccccaggcttgcgcactttctcccggaaaccacttaggtgcccgagagacctgcaacggatctctgacactagccttggggggacctttcctcttgacgagcgtgtctctgaggttttgtactccaggccctcctgccttgatactgagtgcagcctgggcctctgggggaccttggcgtctcttatggcatagaccagcttggccgggtgcactcggcggaccagagcgtgtgacatttcatagtacaccaggccctaaggcgacagtggcggctagccaccttcgcgtcgagttcggaggtcaggcaggactggcggctgcaggcctacggggtagatgccagtgccatggacacgccgcacggtgtgcagcaagggcacggcctccgaggtgtcactgccgacaccacacaaccgggccaggatgcgagtcttgcaggcccagccaccgggactggccttggcgccctgccacacctaggcaccctcacccctgtctgccgtgctcgtgcaatcagcatgcacgaagatgccgctttaactcagaactgttcaggttgtccggcggtagatccggaggtgtctgcgagagatgtagacaccacaccgcgggtcggcactgtcattactgccagcccggattctggagagacccttcccagccgatcttctcccgccgagcttgcagggcttgtcagtgccaccctataggagccaccggcggaacgtgtaaccaaacttcaggacaatgcacgtgcaagctgggggtgactggccttacctgtaatagatgtggcccagggtaccagcagagccgcagtcctcggatgccgtgccagaggattccagaggcaactactactctggccaccacaccgggagcctactcctcggacccgcagtgtcagaactactgtaatatgtctgatacacgtgtgcatatgtccctcaggcgatactgtcagcaggatcacgtcctcagggcccaggtcctggcctcggaagccgcagggcctgcctggcagcgactggccgtgagagtcctggccgtgtacaaacagcgtgcacaaccagttcgcagaggcgaccaggacgcctgggttccacgcgctgatctcacttgcggttgtctaagactccagcccggtacagactatctgctgctgggaagcgcagtgggtgatcccgatcccacaagactgatattggacaggcacggcctcgctttgccatggcggcctcggtgggccagacctctgaaaaggcttcagcaggaagaaagagcaggtggatgcagaggcgtaagagccccaaccccaagtccccgtccagagcattag

SEQ ID NO: 10298 - DNA, 8429 bp, Artificial Sequence
  Description of Artificial Sequence: Synthetic coding sequence
atgaccttggagggcctttatctggccagagggccactggcaagactgctgctggcttggtctgctctgttgtgtatggccggaggtcagggcagatgggatggtgccctggaagcggctgggcctggcagagtgcgtcgaaggggcagcccaggtattttacagggccctaacgtctgtgggtcaaggtttcatgcttattgctgcccaggctggcgtactttccctgggagaagtcagtgcgtcgtaccaatatgccgcagagcttgcggggaaggcttttgtagtcagccaaatttgtgcacctgcgcagatgggaccctcgccccaagttgtggcgtgagtagaggttccggatgctctgtctcatgcatgaacggaggcacttgccgtggcgctagctgtctgtgtcagaaaggctatactgggactgtgtgtggccaacccatttgcgacagagggtgtcacaatggaggaaggtgcattggtccaaatcgctgcgcatgcgtgtacggattcatgggcccacaatgcgagagagattataggacagggccttgttttggtcaagtgggccctgaaggctgtcagcaccagctcactgggttggtgtgtacgaaggctctgtgctgtgcaacggtaggtagagcgtggggcttgccttgtgagctgtgtccagcgcagcctcacccttgtcggagaggattcattccgaacattcatactggcgcatgccaagatgttgacgagtgtcaggccgtgccgggactttgccagggaggttcctgcgtcaacatggtcggcagctttcactgtcgttgcccagttggacatagactaagcgactcaagtgccgcttgcgaggactatcgggctggggcatgcttcagcgtgctgtttggaggcagatgtgccggagacctcgctggtcactacacgcgacgccaatgctgctgtgacagagggcgatgctgggctgctggccctgtgcctgaactgtgtcctcccagaggttcgaatgagtttcagcaattgtgtgcccaaaggctgcccctgctgcccggacacccgggactcttccccggactgctgggtttcggatccaatggcatgggacctccccttgggcctgccagacttaatccccatggctccgatgccaggggaattccttccctggggcctggcaatagtaatattgggactgctacattaaaccagaccatcgacatttgcagacatttcacgaacctgtgcctgaatggtagatgcttacctacgccaagttcctacaggtgcgaatgcaacgtgggctacacccaagacgtccgtggcgagtgtatcgacgttgacgaatgcacaagttccccgtgtcaccatggggattgtgtcaatatccccggaacgtaccattgccgctgttacccgggtttccaggctacgccgacgcgacaggcctgcgtcgatgtcgacgagtgtatcgtgtcaggtggactctgccatctgggtcgctgcgtaaacaccgagggcagcttccagtgcgtgtgtaatgcgggattcgagttgtctccagacggtaagaactgtgtggaccataacgaatgcgcaacatctaccatgtgtgtgaacggggtatgtcttaacgaagacggaagttttagttgcctgtgtaaacccggatttttattggcccctggaggccattattgtatggatattgatgaatgccagacacctggaatatgtgtcaatggccattgcactaacacagagggaagttttaggtgtcagtgtctcggtggcttggccgttggtaccgacgggcgagtgtgtgtagatacccacgtccgcagcacttgctacggcgctatcgagaagggttcctgtgctcgcccatttccaggaaccgtcaccaaaagcgaatgctgttgtgctaaccccgaccatggttttggcgaaccttgccagttgtgtcctgccaaggacagcgcagagttccaggctctgtgctccagtggactcggaataacaactgatggaagagacatcaacgagtgcgcgctggatccagaggtgtgcgcaaatggagtgtgcgagaacctgcgcggaagctatcgctgcgtctgcaatctgggctacgaagccggagcttctggcaaggactgcacggacgtcgatgagtgtgccctcaactctcttctatgtgataatggctggtgtcaaaatagccctggctcctacagctgtagttgtccacccggattccatttctggcaggacaccgaaatctgtaaagacgtcgatgagtgtttatcttcaccatgtgtatctggtgtgtgtcgcaatctggctgggagctatacctgtaagtgtggtccaggctctagacttgacccatcgggcacattctgtctggactccactaaagggacctgttggctgaaaatacaggagtctcggtgcgaagtcaatctccagggggcttccctgcgatcagagtgctgcgcgaccttgggcgctgcctggggctctccttgcgaacgctgtgagatcgatcccgcttgtgccaggggattcgcgaggatgacgggcgttacctgtgatgacgtcaacgaatgcgagagttttcccggagtgtgtcctaatggccgatgcgtcaatacagctggtagtttccggtgtgagtgccctgagggcctgatgctcgatgcgtctggcagattatgtgtggacgtgaggctggagccctgtttcctgagatgggatgaggacgaatgcggcgtgacgctgccagggaagtacaggatggatgtttgttgctgtagcattggagcagtttggggggttgagtgtgaggcttgcccggacccggaaagcctggagttcgcttctttgtgccctaggggattgggatttgcatctagagattttctgtcagggagaccattctacaaggacgttaatgaatgtaaagtgttccctggtctctgtacccatggaacatgccgcaacacagtcggatcctttcattgtgcctgcgccggagggttcgctttggacgcgcaagaacgaaactgtactgacatagacgaatgcagaatctcacctgacctctgtgggcaagggacatgcgtaaatacgcctggctcattcgaatgcgagtgcttccccggatacgagagtgggtttatgctcatgaagaactgcatggatgtggacgaatgtgctcgtgaccctctactctgcaggggcggtacctgcacaaatacagacgggagttataaatgtcagtgtcctccaggccacgagctgacggcgaagggtaccgcatgcgaggacattgatgaatgcagcctctccgacggattgtgtccacacgggcaatgtgtgaatgttatcggggcatttcagtgttcctgccacgcaggctttcaatccacccctgatcggcaaggttgcgtggacattaacgaatgtcgagtacagaacggcggatgtgacgtccactgtattaacacagagggatcataccggtgttcctgcggccagggttactctctgatgcctgacggacgcgcatgtgcagacgtggacgagtgcgaagaaaacccccgagtctgtgatcagggtcactgcacaaatatgcctgggggacaccggtgtctgtgttacgatggcttcatggcaacacccgatatgcggacttgtgtggatgttgatgaatgtgacctcaatccacacatttgccttcacggggactgcgagaacactaagggatcttttgtatgccactgtcaacttgggtatatggtaagaaagggcgcaacaggttgcagtgatgttgacgaatgcgaggtcgggggacataattgtgacagccacgctagctgtctgaacatccccggaagtttctcatgccgatgtctaccgggatgggtcggagatggatttgagtgccacgatttagacgaatgtgtgagtcaggaacataggtgtagtccaaggggagattgcttaaatgtgccagggtcctaccgatgtacatgtcgtcagggttttgcaggtgatgggttcttctgtgaagaccgagatgagtgtgccgaaaacgtcgacttgtgtgacaacggccagtgtctaaacgccccagggggttaccgctgtgaatgcgagatgggattcgatcctacagaggaccacagggcctgtcaggacgtcgacgaatgcgctcaggggaatctgtgcgcgttcggctcttgtgaaaatttaccaggcatgttcagatgcatctgtaacggaggctatgagctcgaccggggagggggtaactgtaccgatattaacgaatgcgctgacccagtcaattgcattaatggcgtgtgcattaacacacccggatcttatctgtgcagttgtccccaggactttgagttaaacccctcgggcgtcggatgcgtcgacacccgggcagggaactgttttttagagacccatgaccgaggtgactccggaatatcctgttcggctgagataggtgtgggcgtgactagagcatcctgctgctgctccctgggtcgagcctggggaaacccttgtgagctgtgtcctatggctaatacaaccgagtacaggactctgtgtcctgggggagagggatttcagccgaatcgcatcaccgttattctggaggatatcgacgagtgtcaggaactgcctggactctgtcagggcggagattgcgtgaacaccttcgggtcattccagtgtgagtgccctcccggttatcatctttctgagcacactagaatatgtgaggacatcgatgagtgctctacacattccgggatttgcggcccaggcacgtgctataatactcttggtaactacacttgtgtctgccccgctgaatacctccaggtgaatgggggaaacaactgtatggacatgaggaagtctgtatgttttagacactacaatgggacgtgtcagaatgaacttgcttttaacgtgaccaggaagatgtgttgctgcagttacaatattgggcaggcatggaaccggccatgcgaagcctgtcctactcctatatcgcctgactatcagatcctctgtggtaaccaagcacctggattcctgactgatattcacaccgggaagcccttggatatcgacgagtgtggtgagattcctgccatatgtgctaacggcatttgtatcaaccagatcggtagtttccggtgcgagtgtcctgcgggtttcaattataactctatcctgctcgcctgcgaggatgtggatgaatgcggaagcagagaatccccttgccagcaaaacgccgactgcattaacatacccggaagttataggtgtaagtgcactaggggctataagctctcacctggaggagcatgtgtcggacgcaatgaatgtagagagattccaaacgtttgctcccatggcgactgcatggatactgaaggctcctacatgtgcctttgccaccgcggtttccaggcaagtgcagatcagactctgtgcatggacatcgacgaatgtgaccggcagccttgcgggaatggcacctgtaagaatatcattgggtcctacaattgtctctgtttccccggatttgttgtaacacacaacggcgattgcgtggactttgacgaatgtacaaccctcgttgggcaggtgtgtagattcggccattgcctgaacaccgccggttcctttcattgtctatgccaggacggttttgaactgactgccgacggtaagaactgtgtcgacacaaacgagtgcttgtcgctagccggtacttgccttcccggaacatgccagaatctagagggctctttccgctgcatctgccctcctggatttcaggtccagagtgaccactgcatcgatattgacgaatgcagcgaagagccaaacctgtgccttttcgggacatgcaccaacagccctgggtcctttcagtgcctctgcccacccggttttgtgctgtctgataacggccaccgttgttttgacacacgccaaagtttctgcttcaccagatttgaggccggtaaatgcagtgttccgaaagcctttaatacaacaaaaacacggtgttgctgtagtaagcgaccgggagagggttggggtgatccttgtgagttatgcccacaggaggggagtgcagcatttcaggagctttgtcctttcggccacggtgccgtaccaggacccgacgattcgcgcgaagatgtcaatgagtgcgcagagaaccccggagtgtgtacaaatggcgtatgtgtcaacacggacgggtcatttagatgtgagtgtcccttcgggtattccctcgatttcactgggatcaactgtgtagatacggatgaatgcagcgtcggtcacccctgtggccagggaacttgcactaatgtgataggcggattcgaatgcgcctgtgcagatgggttcgagcctggattaatgatgacctgcgaagatatcgatgagtgttccttgaacccgttactgtgcgcttttaggtgccataacaccgaagggtcttacttatgtacctgcccagctggttacactctgcgcgaagacggagctatgtgtagggacgtggatgagtgcgcagacgggcagcaggactgtcatgcacgcggaatggagtgtaaaaatctgatcggcacttttgcttgcgtctgccctccaggcatgaggccacttcccggaagtggggagggctgcactgatgacaacgaatgccacgcacagccagatctgtgtgtaaacgggaggtgtgtgaacaccgcaggatcgttccgttgcgattgtgacgaaggttttcagcccagtcctactttgaccgaatgccacgatattcgtcagggaccctgctttgctgaggtgctccagaccatgtgccgatccctgagctccagcagcgaggccgtgacccgggctgagtgctgttgtggcggtggcagagggtggggtccgaggtgcgaactctgcccactcccaggtacgagcgcctacaggaaattatgcccccacgggtcagggtacaccgcagagggccgtgatgtggacgagtgtagaatgctggcgcatctgtgcgcccacggggaatgcatcaactcattggggtccttccggtgtcactgtcaagccggatatacgccagatgcaaccgctaccacctgcctggacatggacgaatgttcccaggtcccgaaaccttgtacctttctgtgcaagaacacaaaggggtccttcttatgcagctgcccgaggggctatttactggaagaagatggtcgcacctgcaaggacctggacgaatgcaccagccggcaacataactgccaattcctctgtgtgaatactgtgggagcctttacctgcaggtgtccacctggattcacccagcatcaccaggcctgcttcgataacgacgagtgctctgcacagccaggcccttgtggcgcacatggacactgtcataacacccccggtagtttccgctgcgagtgtcaccagggcttcacgttagtttcaagcggacatggctgcgaggacgttaacgagtgtgacgggcctcatcggtgccagcatggttgccagaaccagctggggggatatagatgctcatgccctcaggggttcactcagcactcacagtgggcccagtgtgttgatgaaaatgagtgcgctctcagtccccctacctgcggcagcgcttcatgtcggaacaccctggggggatttagatgtgtatgtccgtctgggtttgatttcgaccaagccctcggcggatgccaagaggtggatgagtgtgcaggccgtcggggaccctgttcctactcctgcgcgaacactcccggaggattcctgtgtggctgtccacagggatatttccgtgctggccaaggccactgtgtgagcggattgggcttcagccccggtccacaggacaccccagataaagaagagctcctcagttccgaagcttgctacgagtgtaaaatcaacggactaagtcccagggatagaccccgtagatccgctcatcgagatcaccaggtaaatctggccacacttgactcagaggctctcctgacattgggattgaacctgagccaccttggcagagctgagcggatattggaactgcgcccagccttggaagggctcgagggtcggatcaggtacgttattgtgaggggtaatgagcagggtttcttcagaatgcatcacctgcgcggtgtcagctccttgcagctgggtaggcgacgacctggaccaggcacctatcggcttgaggtcgtatcacatatggcgggtccttggggtgtccagccagagggacagccaggaccctggggtcaggcacttcgcttgaaagtgcagctacagctcctcta

SEQ ID NO: 10299 - DNA, 303 bp, Artificial Sequence
  Description of Artificial Sequence: Synthetic coding sequence
atggagaccaggcaggtctcacggtctccgagggtccgactgttactgctgctactacttttactggtggtcccatggggcgtgagaaccgcgtctggggtagccctcccgccagttggcgttctgtcactccgtccaccagggagagcctgggcagaccctgctaccccaaggcctcgccgatcattggctctggcggatgatgcagcttttcgcgagcgagccaggctattggccgctctggaaaggcggcattggctgaacagctatatgcacaaactcctggttctagatgcgccttag

SEQ ID NO: 10300 - DNA, 1404 bp, Artificial Sequence
  Description of Artificial Sequence: Synthetic coding sequence
atgtggaggtgcccccttgggctgcttctccttctgccccttgccggtcatctggcgttgggagcccagcaaggccgaggcaggcgggagctcgcaccagggctgcacctccgcggaataagggatgccggtggtcgatattgtcaagagcaggacctttgctgtcgcggacgcgctgatgattgtgctctcccctacttgggcgcaatatgctattgcgatctattctgtaataggactgtttccgactgttgcccagacttctgggacttctgtctgggggtacctccaccattcccccctattcagggatgcatgcatgggggtaggatctaccctgtgctggggacgtactgggataattgtaacaggtgcacatgccaggaaaacaggcaatggcagtgcgatcaggagccctgtctggtagaccctgatatgatcaaagccattaaccaaggcaattacgggtggcaggcaggcaatcacagcgccttttggggaatgacgctggacgagggcattcggtaccgactggggaccatccgcccatcatcaagcgtgatgaacatgcacgaaatctacactgtgctcaaccccggagaggtgttacccacagcctttgaagcttctgaaaagtggccgaacctgatacacgaaccactggatcagggcaactgtgccggtagctgggcgttttccacagcagccgtcgccagtgaccgagtgtcaatccactcattgggccacatgactcccgtcttaagcccacaaaatctactcagttgtgacactcatcagcaacaaggctgccgtgggggtaggttagacggcgcatggtggtttctgagacgccgtggagtcgtcagcgaccattgctacccattttccggcagggagagggacgaggccggtccggctcctccatgtatgatgcatagccgagcaatgggcagaggcaagagacaggccaccgctcattgtccaaactcctacgtcaacaacaacgatatctatcaggttactcccgtgtatcgcctgggctctaatgacaaggagatcatgaaagagctgatggagaacggaccggtccaggccttaatggaagtccacgaggatttctttctctacaagggcggaatctactctcacaccccagtaagcttggggaggcctgagcgataccgcaggcacggcacgcattctgtcaaaattactggctggggagaggaaactcttcctgatggaaggacccttaagtattggacggctgcaaactcttggggccctgcctggggcgagcgaggccactttcggattgtgcggggtgtgaacgaatgtgacatcgaatcatttgtcctgggagtgtggggacgcgtaggcatggaggacatgggtcaccactag

SEQ ID NO: 10301 - DNA, 2205 bp, Artificial Sequence
  Description of Artificial Sequence: Synthetic coding sequence
atgttctacgtctgttcttcttgcgtgttcttatgtggttcgaatttcccaaactttcctttccaggtcgcctccgcaaagagcgctcctgagattccaactattgaccaagcatactcaaagctgtctaattcgatcacggtggagtgggcgacggtgcccggagccacgtcgtacctccttacagccgaggatggtgataccgtcatcgagacaacagtggccaacagccctgggacggtaactggcctgaaggccgcaacttggtatgaaattaccatccggagcatctcagccgcaggaagatcccaggccagtccaccaaagcaggccaaaacagtgctggctgccccaatcctcgaggtttccagccccagctctgatagtattctggtgcaatgggaagccgtgtatatggcaatagccttcagcgtgtccataatgagagccaatggcctgggttccatttggaaagaaaatactacgaacacttctctcacttttaccagtctcgaggcaggcacgctgtacacaataaaggcctatgcttggaacgcaaatcgaattcccggagacgacagtacctgcaaccagagaacatccccacgggctcccgctaatatacaagtgtcgttcgattctggggctctcaaggcctccttttcctgggccagggcggaaggcgcattcaattacaccgtcatggcactctcagactcaagtgaattgacatgcagtaccacattttcatcctgcaccatcagctccctccagtgtggtaccgaatacctgatttctgtgctcgccagcaacgacgccggatcatctaaatcttcgagcgctatgaccttgaagaccgtggcctgcgcccctggccgagtgactattcaagaagatcctcctggacacctctcggtggcatggtcctctgtggacctgggggattattatgtggtgtttgtcaagtccgacgacggcctcgaggtgcattgcaacacttctctcacccaatgcaactttctgtcagagtgtggatttacctactttataagcgtgtttgtgtacaacaaagcaggccagagtccccttggtgatatcttcaattacactaccgctccgtgttgccccagcgacattaaccccgtcctggtgtcttctgacagggtcgagatcgtttggagccccgtgcgaggagccgaactctacgagacgaaagctgttgacggatataacatggttgaatgcaatgatacaacaccagcatgtaccctgtctgcactcgaatgcgatacaaagtacaacattaccgtgtattcctttaacgaagtgagaggctccaacatgtcctgcacaccccagttcattacgaccgccccatgtagtcccgagattaagaatgtgagtagggacgccttcagcatgatcaatgtgcactggcgcagtaccaacgacgacgcgacatacacagtcactgcccagggggagaaaggtctgtatcaatgctcttcaacaggcgaatcctgtacaatgaggggcctcccatgtggatctgtgttctccgtgacggcggtggccgagacccaggctggcagatctttgcctagttattccgtgcctctcgagacggtgccctgctgtcccacaggcctaaccgtgacccaaattacccagagcgtcataaacgtgagttggactattggtcgagttgcacagacgcacgtggctgtgctggaaagtcacacaggccagtcaaagtgtcacactcaccagaaccactgtcttcttgggtgcatcacttgcggcatcaattacactgtaacactgaaagctattagcgctacaggacttacagctgactgcagctaccagagctatttcagcggggcatgctgtcccctgggagtgaagctctataggttgggcccaaatggcattcggatctactggcaggccagccgaggatccgccaactacagcactgacctttatgggtccaagggcattttcacgtgcacgccctccgctggcctctctttttgtgatgtcacagagatcccatgcggggatgtctatactgtaatggtctcccctgtagccaagacagggctgaaacttaccttttgccctaaaaagatctactcagtaacatgctcgggcagcacactggggatggtcatttataggggcaagcgtaatgaggaatag

SEQ ID NO: 10302 - DNA, 1098 bp, Artificial Sequence
  Description of Artificial Sequence: Synthetic coding sequence
atgctggatgggagccccttagcaagatggttggctgctgcgtttggcctcaccctgctgctggcagcccttagaccttcagccgcatattttggactcaccgggagtgaacctctgacaatcttgcctctaacacttgagcccgaagctgctgcccaagcacactacaaggcttgtgacaggctgaagcttgaaaggaagcagagacgcatgtgtcggagagacccaggggtggccgaaacccttgtggaggcagtctcaatgagtgcccttgaatgccagttccagttccgtttcgagaggtggaattgcacattggaaggcaggtatagagcatcacttctgaagaggggctttaaagagacagcattcctatacgcaattagcagtgcaggcttgacccatgcactggctaaagcatgctcagctgggagaatggagcgatgcacctgtgacgaggcccctgacctggagaatcgagaagcctggcaatggggagggtgcggcgacaacctcaaatactccagtaagtttgttaaagaatttctcgggaggagatcaagcaaggacctgcgagcgcgtgtcgattttcacaacaacctggtcggcgtgaaagtcatcaaagccggagttgagactacttgcaaatgccacggcgtgtcaggttcatgtaccgtgcgcacctgctggcgccagcttgcccctttccacgaggtggggaaacatctcaaacacaagtatgagactgctttaaaagttgggagtaccaccaacgaggctgcaggcgaagcaggtgccattagcccgcctcgcggaagggcctcgggcgctggcggatcagaccccctgcccaggaccccagagctagtccacctagatgactccccatccttctgcctcgcagggaggttttcaccgggaactgctgggaggagatgtcaccgcgaaaagaattgcgaaagcatttgttgcggcaggggccacaatactcagtcacgggtcgtgactcggccttgtcagtgccaggtgcgttggtgttgttatgtggagtgccggcagtgcacccaaagagaagaggtgtacacttgcaagggctag

SEQ ID NO: 10303 - DNA, 795 bp, Artificial Sequence
  Description of Artificial Sequence: Synthetic coding sequence
atgaggctgaggcctcttccgctggtggttgttcccggactcctgcagctgctattttgcgacagtaaggaagtggtgcacgcaaccgaaggcctcgactgggaagacaaggatgccccagggacattggtcggaaatgtggtccatagtcgaataattagtcccctgcgcctgtttgttaaacagagtccagtgcccaaacccggacccatggcctatgcggacagtatggaaaacttctgggattggcttgccaacataaccgagatccaagagcccttggctcgaactaaaaggaggcctattgtcaaaacagggaaatttaagaagatgtttggatggggtgatttccactcaaatataaaaactgtgaagctgaacttgctgatcacggggaaaatcgtggaccatgggaacggaacattcagcgtctactttaggcacaacagcactggactcgggaacgtctcagtgtcgcttgtgcctcctagtaaggtggtggaattcgaagtgagtccccaatcaactcttgagacaaaggaaagcaaatcatttaattgtcgtattgaatacgaaaagaccgatagagcaaagaaaacggccctctgcaatttcgatcccagcaagatctgctaccaggaacagacccagtcgcacgtctcctggctatgtagtaagcctttcaaggttatttgtatttacatagctttctatagtgttgactataagctcgttcagaaggtgtgccccgattataattatcactcagaaaccccctatctaagcagcggttag

SEQ ID NO: 10304 - DNA, 1125 bp, Artificial Sequence
  Description of Artificial Sequence: Synthetic coding sequence
atgaaacccttgctggaaacattatacctgctcggcatgcttgtgcctggcggattaggctatgatcggtcattggcacagcaccgtcaggagatcgttgataaaagcgtatcgccttggagcctggaaacctactcttataacatctaccaccctatgggggaaatatatgagtggatgcgtgaaatcagtgaaaagtacaaggaagtggtcacccagcacttcctgggcgtgacttacgagacacaccctatgtattacctaaaaataagccaacctagcggcaatccaaaaaaaatcatttggatggattgtgggatccacgcaagagaatggatcgcacccgcattctgccagtggtttgtcaaggagatcctgcaaaaccacaaggataattcctccatacgcaagctcctgaggaatctcgatttttacgttcttcccgttctcaacattgacgggtacatctacacgtggaccaccgaccgactgtggagaaaatctcgtagtccacacaacaacggcacatgtttcgggaccgacctgaaccggaattttaatgctagctggtgttccataggggcttctcgcaactgtcaagaccagaccttctgcggcacgggtccagtttcagagcctgaaacaaaggccgtggcctcatttatagaatccaagaaagatgatatcctgtgcttccttaccatgcacagttacggacagctgatactcaccccctatggctacactaaaaacaaatctagcaatcaccccgagatgatccaagtcggacagaaggcggcaaacgctcttaaggcaaaatacggtaccaattatagagtcggaagctcagctgacatcctgtacgcttccagcgggagttctcgagactgggctcgggacatcgggatccccttttcttatacctttgaacttcgggatagcggcacctacggctttgtactcccagaggcccaaatacagcctacgtgtgaggagaccatggaggcagtgcttagcgtgctggacgacgtgtacgccaagcactggcattcagattctgctggcagggtcacaagcgcgacgatgttgcttggtctcctggtttcctgtatgtccctgctgtag

SEQ ID NO: 10305 - DNA, 1728 bp, Artificial Sequence
  Description of Artificial Sequence: Synthetic coding sequence
atggccagctggttgcgcaggaagttgagggggaaacgaaggcccgtcatcgccttttgcctgctgatgatcttgtctgctatggctgtgacccggttccctcctcagaggccatccgctggccctgaccccggaccaatggagccccagggtgtcactggagcccctgctacccatatacggcaggctctgagttcgtctcgcagacagcgggcacgcaacatgggcttttggcggtcacgtgctctcccacggaattctatcctggtttgtgccgaggaacagggtcacagggccagggttgacagatctcgggaaagccctggcggagaccttcgacacccaggacgggtacgaagggacatcaccctaagtgggcaccctcgcctgagcacacagcatgtcgttcttctgcgcgaagacgaggtgggtgacccagggacaaaagacttggggcatccacaacatggttctcctatccaggaaactcaatctgaggtggtgactctggtgagccccctcccgggatcagacatggctgccctgcccgcatggcgagccacaagcgggctgacgttatggcctcatactgccgagggcagggacctcttgggcgctgagaatcgagcactaacaggaggacaacaggcggaagacccaaccctggcctcgggtgcacatcaatggccaggctcagtcgaaaagctgcaagggtctgtatggtgtgatgccgagacactcttgtcatcttccagaactggtgggcaggcaccaccatggctgaccgatcatgacgtgcaaatgctccgtctgttagcacagggagaggtggtcgataaggccagagtgccggctcacggacaggttctccaggtcggtttttcgaccgaagccgctctgcaggacctgtcttctcctaggctcagccagctttgctcacaaggcctgtgcgggctgatcaaaaggcctggcgatctacctgaggttctcagctttcatgttgaccgagttttagggctgagaaggagcttgccggcagtggcaaggcgctttcatagccctcttctcccctatcgctacaccgatgggggtgccaggcccgttatctggtgggcccctgacgtgcagcacctgtcggatcctgacgaagatcagaatagcctggccctaggctggctgcagtaccaagccttactggcccactcctgcaactggcccggacaagcaccctgtcccggtatccaccatacagagtgggccagattggccctgttcgacttcctgctccaagtgcatgacaggctggataggtactgttgtggcttcgaaccagagccttccgacccctgtgtagaggaaagactcagagaaaaatgtcagaatccggcagaactacgcctggtacatattcttgtgagaagctctgacccgagtcatctagtctatatcgataacgccggaaacctccaacaccccgaggacaagctgaatttccgcttgctcgagggcatagatggtttcccggagtctgctgtgaaagtcttggcaagtggctgtctccaaaatatgttgctgaaaagccttcagatggatccagtgttctgggagtcccaaggtggcgctcagggtctgaagcaggtgctgcagaccttggaacagagggggcaggtgctcttaggacacattcaaaagcacaatctgaccctctttcgagacgaggacccttag

SEQ ID NO: 10306 - DNA, 1680 bp, Artificial Sequence
  Description of Artificial Sequence: Synthetic coding sequence
atgtggaccaacttcttcaaactgaggttgttctgctgcctcctagctgttttgatggtggtggttctagtcataaatgtaacccaggtcgagtacctcgaccacgaaacagtgagcgcaactttcatcgactctagcggccagttcgtgtcatcccaggtgaccggcataagcagaaacccgtactgtgggtacgaccagcagacattgtcctcacaggaaagaatggaagaggactcacttctcgcagccctgcatagacaggtccccgacgtgggacccgtgccttttgtgaagtctaccgatccatccagctcatacttcgtgattctcaactctgccgctttcttcaaagtggggtctcagctggaagtgctggtgcacgtccaagacttccagcgaaaacccaagaagtatggaggagactacctccaggcgagaatccactcactgaaactgcaggctggtgccgtgggaagggttgttgactaccagaacggcttctacaaggttttcttcaccctactgtggcccggaaaggtcaaggtatctgtaagtctggttcacccgagcgagggcatcagggtgctccagcgtctgcaagaggacaagccagaccgagtgtactttaagtcactttttagatccgggagaatttccgaaacgacggaatgcaacgtgtgtttgcccggaaacttgccactttgtaactttaccgacctttataccggagaaccttggttttgtttcaagccaaagaaactgccctgttctagccgtatcactcactttaaaggcggatacctgaaggggctgctaactgcagccgagtctgcgttctttcagagtggggtcaatatcaaaatgcctgtcaacagttcaggccctgattgggttaccgtgattccgaggagaattaaagagacgaatagcctggagctctcccagggttccgggaccttccccagtgggtattattacaaggaccagtggcgcccaaggaaattcaaaatgaggcagttcaacgatccagataatattacagagtgtttgcagcgtaaagttgtgcatttgttcggcgattccactattagacaatggtttgaatacctgaccacctttgtgccagatctggttgagttcaatttaggctccccaaaaaacgtggggccattcctggcggtcgatcagaagcacaatattctcctgaaatacaggtgccatggaccacccatccggtttaccactgtttttagcaatgagctacattacgtagcgaatgaactcaacggtattgtgggcggtaagaacaccgtggttgctatcgccgtatggtcccacttcagcacgtttccgttggaggtgtatatccggaggctgcgtaatatacgccgtgctgtggtgagactcctggataggagtcccaagacagttgtcgtgattcggactgccaacgcccaggagctcggccctgaagtgtctctcttcaactcagattggtacaactttcagctggacaccattcttcgtaggatgttttccggcgtgggcgtgtatctggtcgacgcttgggagatgacacttgctcattatctgccgcataagcttcacccagatgaggtaatagtcaagaaccaactggatatgtttctttcctttgtatgtccactggaaacctag

SEQ ID NO: 10307 - DNA, 3624 bp, Artificial Sequence
  Description of Artificial Sequence: Synthetic coding sequence
atgcgcttgacccatatctgttgctgctgtttgctttaccagctgggctttttgagcaacggcatagtctctgagctgcagttcgcccctgaccgtgaagagtgggaggttgtgttcccagcactgtggaggagagagcccgtggaccccgcaggcggatccggaggcagcgcagatccaggctgggtgaggggggttggaggtgggggaagtgccagagcccaggccgcaggaagcagtcgtgaggtccgaagtgtggccccagtaccattggaagaaccagtcgagggtcggagcgagtctcgccttagaccaccacctccctctgaaggagaggaagacgaggaacttgaatcccaggagcttcccaggggatctagcggcgcagcagcgttgtcacctggcgcaccagcgagttggcagcctccccctccacctcagccccctccttcacctccccctgcacaacatgctgaacccgatggcgatgaagtgctgctgcgaattcctgcattcagtagggacctttacctacttctgagacgggatggaagatttctggcaccccgttttgccgtggagcagaggcctaatcccggacctggtcctacaggggctgctagtgccccacaaccacctgccccacccgatgcaggctgtttttacaccggcgctgtgctgagacaccctggaagcttagcttctttcagcacttgtggtggcggactgatgggattcatacagcttaatgaagactttattttcatcgagcctctcaatgacacgatggctattactgggcacccccatagagtctaccgtcagaaaaggagtatggaggagaaagttacagagaaaagcgcactgcattcacattactgtggcataatcagtgacaaaggcagacctagatctcgcaagatagctgagtccggaaggggcaagcgctacagttataagctgccccaggagtacaacattgagacggtcgtggtggctgatcccgctatggtctcatatcacggagcagacgccgcacggagattcattctaacgatcctcaacatggtgttcaaccttttccagcacaagtccctgtctgtccaggtcaatctgagagtgataaagctgattttgctgcacgagaccccccctgagttatatattggacaccatggcgaaaagatgctagaaagtttctgtaagtggcaacacgaagagtttggaaagaagaatgacatccaccttgaaatgtcaacaaattggggcgaagacatgacaagtgttgatgccgcaattctgatcacccgcaaggatttttgcgtgcacaaggatgagccctgcgatactgtgggtatcgcttatctctcaggaatgtgttccgaaaaaaggaagtgtattattgcggaggacaacggacttaacctggctttcaccattgctcacgaaatgggccacaatatggggataaaccatgacaatgaccatccgagctgtgccgatgggttacatatcatgtctggggaatggattaaagggcagaacctgggggatgtgtcgtggtctcgatgctctaaggaagatctggagcggttcctcagatctaaggctagcaactgtctgttgcagacaaacccccaatcagttaactccgttatggtgccttcaaagcttccagggatgacatacaccgcagacgagcagtgtcaaattttattcggaccactcgcaagcttttgccaagaaatgcagcacgtgatctgcacaggactttggtgcaaagtggaaggagagaaggagtgccggacaaaattggatccacccatggacgggacggattgcgacctgggcaaatggtgtaaagccggtgagtgcaccagccgcacctcggcacctgaacatctggcgggtgaatggagcctgtggagtccgtgctcacgtacctgctctgctgggatcagttccagggaacgaaaatgcccaggcctggacagtgaggcacgagattgcaatggaccgcgaaaacagtacagaatctgtgaaaaccccccttgtcctgccggactccccggttttcgcgactggcagtgtcaggcgtacagtgttcgtactagttcccctaaacatatccttcagtggcaggcagtgctcgacgaggaaaagccctgtgcactgttctgctcccccgtgggcaaggaacagcccattcttctgtccgagaaagtaatggacggtaccagctgcggatatcaaggcctggatatatgtgctaacggtcgctgccagaaagttggatgtgacgggctactgggctcccttgcacgggaagaccactgtggcgtctgtaacgggaatggaaaaagctgtaaaattattaagggtgatttcaaccacacacgaggcgcaggctacgtcgaagttcttgtgatccccgcaggcgcacgaaggatcaaagtggtggaagaaaagccggcacactcttacctggccttgcgagacgccggaaagcagagcattaacagtgactggaagattgaacactcaggcgcatttaatctggcgggtaccaccgtgcattatgtccgcagaggtctctgggagaagataagcgctaaaggcccaactaccgcacctctgcatctcctggtactgctcttccaggatcagaattacggtctccactacgagtacaccattccttctgatcctctgcctgaaaaccagtcatccaaggcacccgagccactgtttatgtggacccacacctcatgggaggactgcgatgctacctgcgggggaggcgagcgcaagactacagtgagttgtacaaaaatcatgtccaaaaatatcagcattgtggataacgagaagtgtaagtacctcacaaaaccagagcctcagatcaggaagtgcaacgagcaaccatgccaaacacgctggatgatgacagaatggaccccgtgtagcaggacctgcggtaaggggatgcagagtagacaagtcgcctgcactcaacagttgtccaacggcacactgatcagggcaagagaacgggactgcatcggacccaagccagcttctgcccagaggtgtgaagggcaggattgcatgactgtgtgggaggccggagtctggagtgaatgctcagtcaaatgcggcaagggcatccgacacagaaccgtgcggtgtactaatcccaggaagaagtgtgttctgtccacgcggcctagggaggcagaagactgcgaggattattcaaaatgctatgtgtggcggatgggtgattggtctaaatgcagtatcacctgcggaaagggcatgcaaagcagagtaattcaatgtatgcataaaattaccggtcgtcacggcaatgagtgcttttccagcgagaagcccgctgcgtaccgcccttgccacttgcagccttgtaacgagaaaatcaacgtgaacacaattacttctcccagactagcagcgcttaccttcaagtgcctgggtgatcagtggcctgtctattgtcgagtcattcgagaaaaaaatctgtgccaggatatgaggtggtaccagagatgttgcgaaacctgccgtgacttctacgcccagaaactccagcagaaatcctag

SEQ ID NO: 10308 - DNA, 258 bp, Artificial Sequence
  Description of Artificial Sequence: Synthetic coding sequence
atgaaaatcaccggcggtctgctgctgctgtgcacagtcgtatacttttgtagctcctccgaggctgcttccttatctccaaagaaggtggattgctccatctacaagaaatatcccgtggttgcgattccttgtcctatcacatacttgcctgtgtgcggcagcgactacattacgtatggtaacgaatgtcatctttgtactgaatctctcaaaagtaatgggcgagtgcagttcctgcatgacggctcttgttag

SEQ ID NO: 10309 - DNA, 2982 bp, Artificial Sequence
  Description of Artificial Sequence: Synthetic coding sequence
atgggatcaggcagagtccctgggctgtgtctgttagtgctactggtccacgccagggcagctcagtattctaaagctgctcaggacgttgacgaatgtgtggaaggaactgataactgccacatcgacgccatctgccagaacaccccgagatcttacaaatgtatttgcaagagtggttacaccggcgatggaaagcactgcaaggatgtggatgaatgtgagagggaggacaatgctggctgcgtgcacgattgcgtcaacatccccggaaactacaggtgcacctgttacgatggttttcatcttgctcacgacggacacaactgtttggacgtggacgagtgcgccgaaggtaatggcggttgccagcagtcttgcgtgaatatgatgggaagttatgaatgccattgccgtgaaggattttttctgtccgacaatcagcacacttgtatccaaaggcctgaggagggcatgaactgtatgaacaaaaaccatggttgtgcacatatttgtcgggagactcctaagggtggcatagcttgcgagtgccgccctggatttgaactgaccaagaatcagagagactgcaagcttacttgtaactacggcaatgggggatgccagcacacctgtgatgatactgaacaaggccctcgttgtggatgtcatattaaattcgtgcttcacactgatgggaagacttgcatcgaaacctgcgccgttaacaatggaggatgcgattcgaaatgccatgacgccgctaccggcgttcactgcacatgtcccgtcgggttcatgctccaacctgatcgtaagacctgcaaagacattgatgagtgccgcctcaacaacggaggttgcgatcacatatgccggaatactgtgggatcattcgagtgttcctgtaagaaggggtacaagctgttgataaatgaacggaattgccaggatatcgacgagtgctcctttgacaggacatgtgaccatatttgcgtgaatacacccggatcatttcagtgtctctgtcacaggggttatttgctgtatgggatcacgcactgtggagacgtcgatgaatgtagcataaataggggcggatgtcgatttgggtgcatcaacacccctggcagctaccaatgtacctgtcccgctggccaggggagactgcattggaatggtaaggactgtaccgagccgctgaaatgtcaaggcagtccaggtgccagtaaagccatgctgagctgcaatcggtccgggaaaaaggacacatgtgccttgacctgtccgtcgcgcgctcgattcctgcccgaatccgaaaatggttttaccgtgtcttgcggtactccgagcccaagggctgcacccgcacgagccggtcacaatggcaatagtaccaatagcaaccattgccacgaggctgcagtgctgagtataaaacagcgagcaagcttcaagattaaagatgctaaatgtcggctgcaccttagaaataaaggcaagaccgaggaggccggacgcataacaggtcccggaggcgctccttgctctgaatgccaagtgactttcatccacctcaagtgcgattcatctagaaaaggaaaaggtcggagggctcgaacccctccaggaaaggaagtcacgcgtctgaccttggagcttgaggcagaggtgagagccgaggaaacgacagcaagctgcggccttccatgtctgagacagagaatggaacggagactcaagggtagcctcaagatgttgcgaaagtctattaaccaagaccgcttcctgctacggctggctggtctggattatgaactcgcgcacaaacctggcctggttgcaggggagagggccgaacccatggagagctgccgcccaggccagcaccgggctggcacgaagtgcgtgtcttgcccacagggcacctattaccacggccagacagaacagtgtgtgccttgcccggctggcaccttccaggagagggagggccagctgtcatgtgatctgtgcccaggcagcgacgcacacgggcctctaggcgctactaatgttaccacatgtgctggtcagtgtccaccagggcaacattctgtggatggcttcaaaccctgtcagccatgccctaggggtacttaccaacccgaagccggtcgcacgctatgcttcccttgcggcggagggttgactactaaacatgagggagccatttcttttcaggactgcgacactaaggtacaatgctcacccggacattattataatacttcaatccaccgctgtattaggtgcgctatgggaagctatcaaccagatttcagacagaacttttgttcacggtgtcctggcaacaccagtaccgacttcgacggaagcacgagcgtcgcacagtgcaaaaacagacaatgcggcggagagctcggagagttcaccggttatattgaaagccccaactatccaggcaactaccctgctggagtagaatgtatttggaacatcaatccgcctcccaaaagaaagatcctgatcgtcgttccagagatcttcctgcccagcgaagacgagtgcggagatgtgctcgtaatgcggaagaacagctccccttccagcatcacaacatacgagacctgtcagacctatgagcgccctatcgcctttactgctagatcacgcaagctgtggatcaattttaaaaccagcgaagctaattccgccagggggtttcagataccatacgttacgtatgatgaggactacgagcaattggtcgaagacattgtccgagatggtcggctctacgccagcgaaaatcaccaggagattttgaaggacaaaaagctgattaaggccttctttgaagtgctggcccatccacagaactactttaaatacactgagaaacacaaggagatgctcccgaagtcattcattaaacttttaaggtccaaagtatccagtttcctgcgaccgtacaaatag

SEQ ID NO: 10310 - DNA, 4773 bp, Artificial Sequence
  Description of Artificial Sequence: Synthetic coding sequence
atgccaggcggagcatgcgtgctagtcatcgccttgatgtttttagcttggggggaggctcaggaatgctcgccaggaggccaccagtttttaagaagcccctaccgtagcgttcgcttcgacagctggcatctacagcaatccgccgtgcaggatttaatctgcgaccactctctgtctcccggttggtatcgcttcttgattttggaccgccctgccgaaatgcctactaaatgcgtggagatgaatcattgcggtacacaggccccaatatggctgagtctccgggatagcgagacacttcctagtccgggtgaaataaagcagttgacagcatgcgccacatggcaatttttgttctccaccacgaaagactgctgcttatttcagattcccgtgagcgtgcgaaactgtggtaacttctcagtatacctgcttcagcccacgcaggggtgcatgggctactgcgccgaggctatctcagacgccaggctgcatccttgcggcagcgatgaaactgagactgggggagactgtgtacggcagcttgccgctagcctccctccgccacccgcagggaggcccgaggtactggttgaactcattgaaagtcgccttttttgtcgctgtagttttgacgtgcctgcaacgaaaaattcggtgggttttcatattgcatggtcccggctcagctctcaagaagtaaaggaggaattgacacaagagaccacagtccaagccttctctttgctcgaacttgacggcataaacttacgactgggagacagaatcttctgctctgcctccgtattcttcctcgaaaacccccatgtgcagtccgttgccatcgaaagccaggagttttttgcgggttttaagctgcagccggagctcagcacaatttctgaagacggaaaggaatactacctgcgaatagagtcgactgtaccaatcatatgttccgaattttcggagctcgatcaggagtgcaagatctcacttaaactcaagacaattgggcagggacgcgaacacctgggactcaacttagcactgtcttcatgtcacgtggatctgcttcagacatcctcttgtgccaacggcacatgttcccacaccttcgtgtattatacagccgtcaccgatttttctcgcgatggggaccgagtgagtaatatagtcgtgcagccaatcgtcaatgaggattttttgtggaataattatattccagatagtattcagattaaggtgaaagatgttccaaccgcatactgttacactttcaccgacccacacattattacctttgatgggagggtgtatgataattttaagacgggaaccttcgtgctctacaagagcatgtcacgcgattttgaggtacacgtcaggcagtgggactgtcgctctctgcactatccagtcagttgcaactgtggctttgtagcacaggaagggggagatatagttacctttgatatgtgcaacggacagctgcgcgaatctcagccctacctatttatcaagtcccaggacgtcactcggaatattaaaatctccgagtcttacctggggagaaaagtcaccatctggttcagttccggggctttcattagagctgatttgggtgagtggggaatgtctctaacaatacgggcacccagcgtagactatcgcaacaccctggggttgtgcggaacattcgatgaaaatcccgaaaatgactttcacgacaagaacggaatgcaaatcgaccaaaactttaataattacgtcgcattcatcaacgagtggcggatacttcccggaaaatccatgagcgatacccttcccgtatcaatgacttctccaggcaaaccatcctactgttcctgctcactcgatactgccgcttatccttcttccgaagacctcgatagcgtgtccaggagtgagatcgctcttgggtgtaaggatctcaaccatgtatcactgtcctcccttattcctgagctggacgtgacgagtgagtatatcaactctgataccctcgtgcgagagataaacaaacatacttctccagaagaatataatttgaaccttttcctccaggagaaaaagcacatcaatttgactaaattgggcctgaatgtgcagaaacatccaggaaatgagaaggaggattctctgcagtaccttgcaaataagaagtacacacaagggagggggtcacacagccaggagatgcgatataacagacaaaaccgctggaaacggcagaactttcatgagttccccccactgtttgctttccctagcctgtcacaaaccgacctggaagagctcacctacttcttccctgaagatcacgccgaagacgtccaacaggagttttttcccagttggcccaccccctccggcctcacagagtacagcaccctgacactttgtcaggagacccttgccaattcctccattggccgactatgcttggcgttcttgggaaagcgcttggactctgttatcgagatgtgcgtcaaggacgtcttactgaaagatgacttatcctgggccgaggcgggtgtggctctcctggaaaatgaatgcgagaagcgaattgtggaagagggcaagtataacaccgaagaatatggcacttcgatcgaggatatcttatctgtactgaagtgccctaacctttgcagcggaaacgggcagtgcatggagtggggctgcgcttgctctcctagcttttcaagctatgactgttccgattcatacgacaaagctccggaaataaccgagctgggcaatgccggtttttgtgatgttcagaagtacaactgcatgatggttcgggtgttcggcaaaggctttaaagaactgcccagtatcaaatgtgaggttaccaagctgcagtacaattcttctgagtggatgcccggagaaccgatctacacccagaccgtattccataactcccgggctgtggattgccagctccctactgatgtccagcagttcgataccatggatctggtgggaggcaagcccaccgggaagtggcagcttaaagtgtccaatgacggttacaagttctccaatcctaaaatcaccgtgatctatgacggggcatgtcaggtatgcggactatacaagaacgattcatgtactattaaggagaacgtttgtattattgacggtttgtgctacgtggagggagataaaaatcctacaagtccatgcctaatatgtcggcctaagattagcagattcacatggagctttttagaaaataatcagccaccagtcattcaagcgttacaggataagctacagactttttatggagagaactttgaatatcaattcgtggctttcgaccccgagggatccgatatccactttacgctcgacagcgggccagaaggagccagcgtatcctctgccggtcttttcatgtggaaaactgacctactaacaacgcagcagatcactgttagattgaatgacgactgcgacgcagagacccgtgtgacgatcgaggttacagtgaagtcatgcgattgtctgaacggtggctcgtgtgtctctgaccgaaatttttcgcctggctcaggggtgtacctgtgtgtttgcctgcctggctttcacggttccttgtgcgaagtggacatatccggttgccaaagcaatccttgtggcctgggctcttacatcagtggttttcattcctactcgtgcgattgtccccctgagttgaaggttgagacgcaatttgtaaaccagttcaccactcagacagtggttctcacgagatcagataaaagcgtaaacaaagaagaagacgataagaatgcccagggtcggaagaggcacgtgaaaccgacgagtgggaatgcgtttaccatctgtaaatacccgtgcgggaaatctcgcgagtgcgttgcgcctaatatctgtaaatgtaagcctggttatattgggagtaactgtcaaaccgcattatgcgaccctgattgtaagaaccatggcaagtgtattaaacctaatatctgccagtgtctccccggacatggcggtgctacttgtgacgaagagcattgcaatccgccttgtcagcatgggggaacatgcttggcaggtaacctatgcacatgtccttatggtttcgtcgggccacgctgcgaaacaatggtgtgtaaccgccactgtgagaatggaggccagtgtttgacccccgatatttgtcaatgcaagcctggatggtacggacctacttgttcgaccgccttatgcgaccctgtctgcctgaacggcggaagctgtaacaagccaaatacctgcctgtgccccaacggtttttttggggagcattgccagaatgctttctgtcaccccccttgcaaaaacgggggacactgcatgcgcaataacgtctgtgtttgcagggaaggctataccggtcggcgtttccagaaaagtatttgcgaccctacctgcatgaacgggggaaagtgcgtcggaccgtcgacatgtagctgccctagtggctggtctggtaagagatgcaacacccctatatgtcttcagaaatgcaagaacggcggagagtgtatagctccctccatctgtcattgcccctcgtcctgggagggcgtcaggtgtcagatcccaatctgtaatcctaagtgtctatacggcggaagatgtatctttcccaacgtatgctcttgcaggaccgaatattctggagtcaagtgcgaaaagaaaatccagatacgacggcattag

SEQ ID NO: 10311 - DNA, 624 bp, Artificial Sequence
  Description of Artificial Sequence: Synthetic coding sequence
atgagcaccaagcccgacatgatacagaagtgcctgtggctagagatcctgatgggaatcttcatcgcaggcacccttagtttagattgcaacctgttaaatgttcatcttcggcgagtcacttggcagaacctgcgtcacctatcttctatgtccaatagttttcctgtcgaatgtctacgcgaaaacatcgcctttgagctgccccaagagtttctgcagtatactcagccaatgaaacgagacattaaaaaagccttctatgaaatgtctctgcaagcctttaatattttctcgcagcatacctttaagtattggaaagagcgacacctgaagcagattcagataggcctggaccaacaagccgagtacctcaaccaatgtctggaggaagacaaaaacgaaaacgaggatatgaaggaaatgaaggagaatgagatgaaaccatccgaggcgagggtacctcaactcagtagtctggagcttcggagatattttcatcgaatcgataattttcttaaggagaagaagtacagcgactgtgcgtgggagatcgtgcgtgtagaaatcagaaggtgcctgtattacttttacaagttcaccgctctattccgcagaaagtag

SEQ ID NO: 10312 - DNA, 939 bp, Artificial Sequence
  Description of Artificial Sequence: Synthetic coding sequence
atggaaagcgcattaccggcagcaggtttcttgtattgggtcggagcaggcacggtggcctacctggctttgaggatttcttacagcttattcacagccctgagagtctggggcgtggggaacgaggccggagtgggtcctggtttgggcgagtgggccgtcgttactgggtccacagacggcattggcaaaagttatgctgaggaattggctaaacacgggatgaaggtggtgctcattagtagatccaaggataagctggatcaggtgagttctgaaatcaaggaaaaatttaaggtggagactaggacgattgccgtcgacttcgccagtgaagacatctacgataagattaagaccggcctggccggactggaaatcggcattcttgtaaacaatgttggcatgtcctatgagtaccctgagtacttcctggatgtgcccgacttagataatgtcatcaaaaagatgatcaacatcaatatcctgtcagtatgcaaaatgactcagcttgtcctaccaggcatggtggaacggagtaagggcgctatcctgaacatttcctccggctctggtatgctacctgttccacttttgactatttactcggccacaaaaaccttcgtggacttcttctcgcagtgcctgcatgaggagtacaggtccaagggcgtgttcgtacaatcggtgctgccctacttcgtggctaccaaattggctaagattcggaaacccacactggacaaaccatctcctgagacattcgtgaagtcagcaataaagaccgtcggcttacagagtaggactaacggttacctcattcatgccctgatggggtccatcatctccaatctgcctagctggatctatctgaaaatcgtaatgaatatgaacaagagtacacgggcacattacctgaagaagaccaagaagaattag

SEQ ID NO: 10313 - DNA, 2214 bp, Artificial Sequence
  Description of Artificial Sequence: Synthetic coding sequence
atggagctggggtgctggactcagctggggctgaccttcctgcagttgctgctgattagtagtctgccacgggaatatacagtgatcaacgaggcttgtccaggggctgaatggaacatcatgtgcagggagtgttgtgaatatgatcagatcgaatgcgtctgtcccggaaaaagggaagtagtcggatatacaattccatgttgcagaaatgaagagaatgagtgcgatagttgtctaatccacccagggtgcaccattttcgagaattgcaagtcatgtaggaacggatcttggggagggacattggatgacttttatgtcaaagggttctactgcgctgagtgcagagctggttggtatggaggcgactgcatgcgctgcggccaggtgcttagagcccctaaaggacagatattgttggagtcctatcctctgaacgcacactgtgagtggacgatccatgcaaagcccggatttgttatacagctccggttcgttatgctgtcgctggaattcgattatatgtgccagtatgactacgtggaggtccgcgatggagacaatcgcgacggccaaatcatcaaacgggtttgtggcaacgagagacctgcgcctatacagtccataggctcctctctccacgtgttatttcattctgacggttccaaaaactttgatggcttccacgcgatttacgaggagatcactgcttgctccagtagcccttgcttccacgacggaacctgcgtactggataaagccggatcctataagtgcgcctgcctggcaggctacactggccaaagatgcgagaacctgttagaagcaggaaagtccaaaatcaaggcatccgaagattccctgtcagtcctggaggaacgaaattgctcagaccctgggggacctgtcaatggctaccagaagattacaggtggacctggattaattaacgggagacacgccaaaataggtacagtggtatccttcttctgcaacaacagctatgtccttagcggcaacgagaaaagaacatgccagcagaatggcgagtggagtggcaagcaacctatttgcataaaggcgtgtagggaacccaagatctctgaccttgtgcggaggcgtgtgttgcctatgcaagtgcagtcacgtgaaacgcccctccaccagctatattccgcagcgttttccaaacagaagctgcaatctgcacctacaaagaaacctgccctgccctttggagatctgcccatgggataccagcacctgcacactcagcttcaatacgagtgcattagcccattttaccgccgactgggcagttctaggagaacctgcctccgaactggaaaatggtctggtagggccccttcatgcatccccatctgcgggaaaatagagaacatcaccgctcctaaaacacagggcctacggtggccctggcaggcagccatttaccggcgaaccagcggggtgcatgatggttccttgcataagggggcttggttcctggtgtgctccggggctcttgtgaacgagagaactgtcgttgtcgctgctcactgtgttacagaccttggaaaagtgactatgattaagactgcagatctgaaagtggtcctagggaagttctatagggatgatgatcgagatgagaaaacaatacagtccctgcagatttccgccatcatcttgcatcccaactacgaccccatcctcctggatgcagatattgccatcctcaagctgctggataaagccaggatttctactagagttcagccgatttgcctggccgcttccagagatctcagcacgtcctttcaagagtctcacataaccgtagctggttggaacgtcctggccgacgtgcgttcccccggtttcaaaaatgacaccctgcgcagcggcgtcgtcagcgtggtggactcgttactgtgcgaagaacagcatgaagaccatggaattcccgtgtctgtaacagataacatgttctgtgcctcttgggagccaactgcaccaagtgatatttgcaccgccgaaacaggtggcatcgccgcagtgtccttcccaggaagagcaagcccagagccccgatggcatctgatgggcttggtgtcgtggagttatgacaagacctgtagccatcgcttatcaacagcctttacgaaggtgctgcctttcaaggattggattgagcggaatatgaagtag

SEQ ID NO: 10314 - DNA, 1503 bp, Artificial Sequence
  Description of Artificial Sequence: Synthetic coding sequence
atggggaccgctagatggctggcccttgggtcactgtttgctcttgccggtttattggagggccgattagtgggcgaagaggaggctggcttcggcgagtgcgataaatttttttacgctggcactccaccagcaggcctggctgctgattcacatgtgaaaatctgtcagcgggctgaaggcgcagaacgattcgctaccttatacagcacacgagaccgtatccccgtatattcagccttcagagctccaaggcccgcacccggaggagcggaacagaggtggcttgtcgagccccagattgacgaccctaactccaatttggaagaagcaattaacgaggcagaggccataacatcagttaatagccttgggagcaaacaggcactgaatacagattacctggactcagactaccagcggggtcagttgtaccccttctcgttaagttcagacgtacaagtcgctacgtttaccctgactaattcagcacccatgactcagagctttcaagagagatggtacgttaacctccattccctgatggaccgagctctcacacctcagtgcggctctggggaggacctgtacatcttgactgggactgtgccctcagattatagagtcaaagacaaggtcgctgtgcctgagtttgtgtggctcgctgcttgttgtgccgtcccgggagggggatgggctatggggtttgtaaagcacactcgggatagcgacataattgaggacgtgatggtgaaggatctccagaagctcttgccttttaatccgcaacttttccaaaacaattgtggggaaacagaacaagataccgaaaagatgaagaaaattctggaggtggtgaaccagattcaggatgaggagcggatggttcagagtcagaaatcgtcgtctcctttgagctccacacggtcgaaacgttcaacactgctccctccggaggccagtgaagggtcatccagcttccttgggaaattaatgggcttcatcgccaccccttttataaaactctttcagctgatttactacctggtggtcgctatcctcaagaatattgtgtacttcttgtggtgcgttaccaagcaagtaatcaatggaattgaaagctgtctctacaggctcgggagcgctactattagctacttcatggcgatcggggaggaactggtctccatcccctggaaagtactgaaggttgtagcaaaagtcattagggccctgctgcgcatcctctgctgcctcctgaaagccatctgccgtgtcttgtccataccagttcgagtgctggtggacgtggctacattccctgtctacaccatgggtgcaattccgattgtgtgtaaggatattgccctaggtctggggggaacggtgagtctgctttttgataccgcttttgggactctgggcggtttgttccaagtggtctttagcgtttgcaagcgaatcggatacaaggtcaccttcgacaatagcggtgagctgtag

SEQ ID NO: 10315 - DNA, 300 bp, Artificial Sequence
  Description of Artificial Sequence: Synthetic coding sequence
atgaagtcggcaaagctggggtttctccttagatttttcattttctgtagcctcaatacgctgctacttggaggcgttaataagatagccgaaaaaatctgcggggacttaaaagatccctgcaaactggacatgaacttcggttcttgctatgaagtacatttcagatatttctacaataggaccagtaagcgatgcgagacctttgtgttttctggctgcaatggaaacctgaacaactttaagctgaaaatcgaaagagaggtggcttgtgtagcaaagtataaacctcctaggtag

SEQ ID NO: 10316 - DNA, 390 bp, Artificial Sequence
  Description of Artificial Sequence: Synthetic coding sequence
atgcccatggcttctcctcagacccttgttctgtacctgcttgtgctggctgtcaccgaggcctggggtcaggaggctgtgatcccgggttgtcacctacatccctttaatgtcacggttaggagcgaccgacaggggacctgccaggggtcacacgtagctcaggcttgcgttggtcactgtgagagcagtgccttcccttccagatacagcgtcctagtggcctcaggctaccgacacaacatcacctccgtgtcccagtgctgcactatctctggcctcaagaaggtgaaggtgcaattgcagtgcgtggggtccagaagggaagaactggaaattttcacagccagggcctgtcagtgcgacatgtgcaggctctctcgctactag

SEQ ID NO: 10317 - DNA, 1965 bp, Artificial Sequence
  Description of Artificial Sequence: Synthetic coding sequence
atggctaaatttggcgtgcacagaatcttacttttggccatctcccttacaaagtgcctggaatcaacgaaattactcgccgacctcaagaagtgcggggacctcgaatgcgaggcactgattaatcgcgtgtccgccatgcgcgactaccggggacctgattgtcggtaccttaatttcaccaaaggtgaggaaatttcggtctacgtgaagctggcgggagagcgcgaggacctgtgggcaggatcaaaaggcaaggagtttggatactttcctagagacgccgtgcaaatcgaggaggttttcatcagcgaggagatacagatgagcaccaaggagtcagactttttatgtttgctaggagtatcttatacattcgacaacgaagactccgagctgaacggagactacggcgagaacatatacccttacgaggaagacaaggacgagaagagttctatctatgaatctgattttcaaatcgaacctggtttttatgcgacttacgagtccactttatttgaagatcaggtccctgctttggaagctcctgaggacataggcagcaccagcgagtcaaaagattgggaggaggtggttgtagagtctatggaacaggaccgtattccagaggtgcatgttcccccttcatctgctgttagtggggtgaaggagtggtttgggctcggcggagaacaagcagaagaaaaggcctttgaatcggtcattgaaccggtgcaggaatcatcatttagatctcgaaaaattgccgtcgaggacgaaaatgatctggaggaattaaataatggggaacctcagactgaacaccagcaagaatcagaaagcgaaatagacagcgtgcccaagacccagtctgaactagcatcagagagcgagcacattcccaaaccgcagagcactggctggttcggcggaggcttcactagttatttgggattcggggatgaggacaccggactcgaactgatcgctgaggagtctaacccccctctgcaggattttccgaacagtatcagttccgataaagaagctacggtgccatgtaccgaaatcctcaccgagaaaaaagatactatcaccaatgattccttgtcgctgaagccaagttggttcgacttcggcttcgctatactagggttcgcttatgctaaagaagataaaatcatgctggatgaccgaaaaaatgaggaggacggcggtgcagatgagcacgagcacccactcacatctgagttggacccagagaaggaacaggagatcgagaccataaagatcatcgagacagaagaccagattgacaagaaaccagtgagtgaaaagaccgacgaaagcgatacaatcccctacctgaagaaattcctatataacttcgataatccttggaattttcagaatattcctaaggaaaccgagctcccatttccaaaacagatcctggaccaaaacaatgtgatcgaaaatgaagaaacaggggaattcagcattgataactaccctacagataacactaaagtaatgatcttcaaatcctcctatagccttagtgacatggtgagcaacatcgaactgccaactcgaattcacgaggaggtgtatttcgaaccatcttcctctaaggactctgatgagaacagcaaaccctcggtggacaccgagggtcctgctcttgttgaaatcgatcgaagcgtggagaatactttattgaattcacagatggtgtccacggataactcgctctcatctcagaactacattagtcaaaaggaggatgcttctgaattccaaatcctgaagtacctatttcagattgatgtctacgattttatgaactcggccttctccccgattgttatcctcactgaaagggtgagtttgcctttcaagccgttcgccattatcctgccaattttactaaatattcgcgttgctacaaagtatgtgtag

SEQ ID NO: 10318 - DNA, 1152 bp, Artificial Sequence
  Description of Artificial Sequence: Synthetic coding sequence
atggccggtataccaggattgctgttcctactattcttcctgttatgtgctgttggacaagtaagcccatatagcgccccttggaagccaacttggcctgcataccgccttcctgtagtgcttccccaatcaacgttaaatctagctaagcccgattttggggcagaagccaagctcgaagtgagtagttcatgtggcccacagtgccacaagggaacacccctgcccacatatgaagaggcgaagcagtatttaagctatgaaactctgtatgccaatggcagtagaactgaaacacaggtgggcatttatatcctttcctcatcaggggatggggctcagcatcgagactccgggtcctctgggaagagcagacggaaaagacagatctatggctacgactcaaggttttcaatattcggtaaagactttctgctcaattacccattctcaaccagcgttaagctcagtaccggctgcactggcacactcgtcgccgaaaaacacgtcctgaccgctgcccactgcatccacgacggaaagacttacgtaaagggaacacaaaagctccgggtaggttttctgaaacctaagtttaaagacggaggacgaggggcaaatgattctacgtctgcaatgcctgagcagatgaaattccagtggattcgggttaagaggacgcatgtgccaaaaggctggatcaaggggaatgctaacgatattggaatggattacgactacgcgctgcttgaactgaaaaagccccacaaacgtaagttcatgaagatcggagtctctcctcccgcaaaacagctccctggtggcaggatccatttttccgggtatgacaatgatcgcccaggaaatctcgtgtacagattttgtgacgtgaaagacgagacgtacgacctcctctaccagcagtgtgatgctcagcccggagcctctggtagtggagtttacgtaaggatgtggaaacgtcagcagcaaaagtgggagaggaaaatcattgggatcttttctggccaccagtgggtggatatgaatggctccccacaggatttcaacgtcgccgtacgcattacaccactcaagtacgcccaaatttgttattggattaaggggaattaccttgattgtcgcgaggggtag

SEQ ID NO: 10319 - DNA, 1662 bp, Artificial Sequence
  Description of Artificial Sequence: Synthetic coding sequence
atgaagtggtgctgggggccagtcctgcttattgccggtgcaacagtcctcatggaaggcctccaagcggctcagagagcatgcggacagaggggcccaggaccgcctaagcctcaggagggcaacaccgtacccggagagtggccttggcaggccagcgttcggaggcagggggctcacatctgctctgggtccctggtggccgacacctgggtgttgactgccgcacattgtttcgagaaggcggcagccacagagttgaatagttggtccgtagtacttggctccctgcagcgggagggactgtccccgggagcggaagaagtgggagttgccgcacttcagctgcctagggcctacaatcactactcccaggggagcgacttggccttgttacagcttgcgcacccaaccacgcatactcccttatgtttgccacagccagcacatcggttcccattcggcgcttcctgctgggccacgggatgggatcaggacacgtcggatgctcctggcacattgcggaacctcagactgcggctgatctctagaccaacgtgcaattgcatctataatcaactccatcagcgtcacttgtctaatccggcacgaccaggtatgctgtgcgggggtccacaaccaggggtccaaggaccctgccagggggactcagggggtcctgtgctatgcctggagccggatggccactgggtacaagcgggaataataagtttcgctagtagttgtgctcaggaggatgcccctgtgctgctgacaaatacagcagctcatagttcttggctacaggcccgagtccaaggtgcagccttcctcgcgcagagcccagaaacaccagagatgagtgatgaggactcttgtgtggcatgcgggtctttgcgaaccgcgggaccgcaggctggcgctccgtcaccatggccctgggaggctcgcctgatgcaccagggacaattagcctgcggcggagcactggtctccgaagaagctgtgctgactgctgctcactgtttcattgggcgtcaggccccagaggagtggtctgttgggttaggaacacgtccagaggaatgggggttgaagcagctgattctgcacggcgcttacacacatccagagggaggctacgatatggcccttctgcttctcgcgcagcctgtcacgctgggggcaagtttgcgccctctctgtctgccctatccagaccatcacctgcccgatggagagcgcggatgggtgctcggcagagcacgcccaggcgcagggatatcctccttgcagaccgtcccagttaccctgctgggaccacgtgcctgcagccgcctgcacgccgctccagggggagatggtagtcccattctcccgggtatggtgtgtacttccgccgtgggcgagctaccctcttgcgaggggctaagtggggctcccctggttcacgaggtcaggggcacttggttcctggcaggccttcacagttttggagacgcatgtcaaggtccggcacgacctgcagttttcaccgccctccctgcatacgaagactgggtctcaagcctggactggcaagtgtattttgctgaggagcctgagcctgaggcagaaccagggtcctgcttagctaacatcagccagccaacctcgtgctag

SEQ ID NO: 10320 - DNA, 936 bp, Artificial Sequence
  Description of Artificial Sequence: Synthetic coding sequence
atgggcataattcagtctattttagcaacctccagagactgttactcgtttaaaaagaaaccaatccccaagaaacccaccatgctggcccttgctaagattctgctcatatctactctgttctattctctactcagtggatcccatggcaaagaaaatcaggatatcaataccactcagaacatcgcggaggtgtttaagacaatggaaaacaagcctatttctctagaatctgaggctaacttgaacagcgataaagagaatattacaaccagtaacctgaaggctagtcacagcccacccctaaatcttccaaataactcccatggaatcacagatttcagctctaattcctcggccgaacatagtcttgggagtctcaagccaaccagcactatctcaacatcccctccacttatccacagcttcgtcagtaaagtgccctggaatgctcccatcgcggacgaagacctgctgcctatttctgcccaccctaatgctaccccagcattgtcctcagaaaattttacctggtcactggttaatgatactgtgaaaactcctgacaattcaagcatcactgtttccatcctatcctcagaacctacgtctccatccgtcaccccacttatagtggagccatctggctggctgactaccaactcagatagcttcaccggtttcacaccttaccaagagaaaacgaccttacagcctactttgaaattcaccaacaactccaagttgtttccaaacacatccgacccacagaaggtgctgaggctcgacaacgcccctgaaccttacgatgtttcattcggcaattcgtcttattacaacccaaccctcaatgactccgctatgcccgagtcagaggagaatgccagagatggcatcccaatggacgatatcccacccctgcgcaccagtgtgtag

SEQ ID NO: 10321 - DNA, 3120 bp, Artificial Sequence
  Description of Artificial Sequence: Synthetic coding sequence
atgcagtcacgcttactgctgcttggcgctcctggcggacacggaggtccagcctctcgtagaatgagactattgttgcgccaggtggttcagcgcagacctgggggagatagacagcgcccagaagttcggctgctccatgctggcagtggggcagacacgggcgataccgtgaatataggtgatgtgtcttataagttaaagattcccaaaaaccccgaattggtaccccagaactacatcagcgatagtttggcacagagcgtcgtgcagcacttgcggtggatcatgcagaaagacctgctcggacaggacgtgttcctgattgggccacccggacccttgcggaggagcatcgctatgcaatacctcgagcttaccaaaagggaggtcgaatatattgccctgtctagggatacgaccgagacagaccttaagcagagacgggagattcgcgctggtactgctttctatattgaccagtgtgctgtacgggctgccaccgaagggagaacactcattctcgagggcttagagaaggccgagcgcaatgtgcttcctgttcttaataatctccttgaaaatcgagaaatgcaactggaagacggacggttcctcatgtccgccgaacgctatgataaacttctcagagaccacactaagaaagaactggattcctggaaaatagtgagagtctccgaaaacttcagggtgattgccctgggtttgcccgtgccaaggtattccggtaacccattggaccctcctctgcgtagtcgcttccaggctcgagacatctactatctaccttttaaggatcagttaaagctgttgtacagtatcggcgcaaacgttagtgccgaaaaagtaagtcagcttctctccttcgctaccacattgtgcagccaggagtcatccacattaggattgccggatttcccactggattcactggcggctgctgtgcagatcctggactcgttccctatgatgccaattaagcatgcgatccagtggctgtacccctattcgattctgttgggccacgaaggcaaaatggcagtggaaggggtgttgaagagattcgaattgcaggactccggcagcagcctgttacccaaggagatcgtcaaagttgagaaaatgatggaaaaccacgtgagccaagcgagtgtgactattcggatcgctgataaagaggttaccataaaggtcccagctggcacccgcttgttgtcccaaccatgcgccagcgaccggttcattcagaccctgtcccacaaacaactacaggccgagatgatgcagtcgcatatggtaaaggatatttgcctgatcggcggaaagggttgcggcaagaccgtgatcgctaaaaattttgccgataccctcgggtacaatatagaaccgatcatgctgtatcaggacatgaccgccagggatttgctacaacaaaggtataccctacccaatggggataccgcatggcggtccagcccgttggtgaacgcggcattagaaggaaagcttgtgttgctcgacggcatacatagggtgaacgccggtactttggccgttctgcagcgattgatccacgatcgcgaactttctttatacgatggatctagattgctcagagaggatcgctacatgcgcctgaaggaagaactgcagttgtctgatgagcagttgcagaagagatctatctttcccatacatccctcctttcgcatcattgcactcgccgagccaccagtgattgggtcgacagcccaccagtggcttgggcctgagttcctcactatgtttttctttcattatatgaaaccacttgtaaaatccgaggagattcaggtaataaaggaaaaggtgcccaacgtcccccaggaagctctcgacaagcttctgagctttacccacaaactacgagaaactcaggacccaaccgcccagtctctggctgcatcgttatcaaccagacagttgcttagaatatccagaaggctaagtcagtaccccaacgaaaacctgcacagtgccgtcacaaaagcctgcctgtccagatttttgccatctctcgcaaggtcggctctggaaaaaaacctggctgacgctaccatcgaaattaatacagacgacaatctggaaccagagttaaaagattacaagtgcgaggttacctcgggtactctgagaataggggcagtgtcggcccctatttacaatgcccacgagaagatgaaggtgccagacgtgcttttttacgataacattcagcacgtcatcgtaatggaagacatgttaaaagacttcctcctgggggaacacctgctcctagtgggaaaccagggggtgggaaaaaacaaaatagttgaccgctttctgcacctcctgaaccggccacgcgaatacatccagctgcaccgcgacaccacagtgcagaccctcaccttacaacctagtgtgaaggacggcctcatagtgtatgaagactcccctcttgtgaaggcagtcaaattgggtcacattctcgtggttgacgaagcagacaaggcccctacaaatgtaacttgcattctgaagactctggtcgagaacggcgaaatgatcctggctgatggacgacggattgttgcgaattccgcgaatgtcaacggtcgagagaatgtggttgtaatccatcctgacttccgtatgatcgttttagcaaaccgtcctggtttccccttcctcgggaacgacttcttcgggaccttgggggatatcttttcctgccatgccgtggataatcctaagccccacagcgagctagagatgctgcgacagtacggtcccaatgtgcccgaaccaatccttcaaaaactggtcgccgcttttggcgagttacggtcactggctgaccaggggatcatcaactatccctactccacacgggaggtcgtaaatatagtcaaacatcttcagaaattcccaacagagggattgtcctcagtggtccgcaacgtgttcgattttgacagttataataatgacatgcgtgaaatcctgatcaataccctgcataaatacggaatccctattggagccaagcccacttctgttcagctcgccaaggaatag

SEQ ID NO: 10322 - DNA, 801 bp, Artificial Sequence
  Description of Artificial Sequence: Synthetic coding sequence
atgaggctgctcttcctggcggtactacgccctcatacaggcaatgccgtgaccgcccagcgcgtgcgggctcacctagaagctgcagggcatgtgtgcgtcttgaaagatgctttcgatttcgagagtaggtcagagatcgctaacttaatcctcgctgagaattgcgaggctgccctcgccttacatctatacagggggggtcgtctgctccaaggacaccgcatcccttttggcgtgattttcggcggaacggacgtaaacgaggacgcaaatcaggccgagaaaaacaccgtgatgggaagggtgctggaggaggcaagattcgccgtcgcctttacggagtctatgaaggaaatggcccaggcccagtgggtcgacccagtcttcactagggaagtgaaagcgaaagtgaagcgggcagcaggagttaggctgatcggagagatgccccaggaggacctccatgccgtggtcaagaattgtttcgcggtagtaaactccagcgtctcagagggtatgagtgcagccatcctagaggccatggacctggaggtcccggtactggcgcgaaatatccctggtaatgcggcagtcgtcaaacacgaggtgaccgggctcctgttcagcaatccccaagagttcgtgcacctggccaaaaggctggtgtccgatcccgctctcgaaaaggagatagtcgtgaacggcagagagtacgtccgaatgtaccacagttggcaggtggagagggacacctatcagcaactgatccggaaactagaaggttccacggaggactag

SEQ ID NO: 10323 - DNA, 2478 bp, Artificial Sequence
  Description of Artificial Sequence: Synthetic coding sequence
atgttcagtggattcaacgtgtttcgagtaggaatctcatttgtgatcatgtgcattttttacatgccgacagtgaattctttgccagaactaagcccccagaagtacttcagcacacttcagcccggaaaggcatccctggcttacttttgtcaggccgattctccaagaacaagtgtattcctggaagaattgaacgaagcagtacgtccactgcaggactacggtatttctgtcgctaaggttaattgcgtaaaagaggaaatatctcgttactgcgggaaggagaaggatctcatgaaggcttacctattcaagggcaacatcctgctgagggagtttcccaccgacaccctgttcgacgtcaacgccatagtcgcacatgtcctgttcgcactgctgtttagtgaagtgaaatacatcacaaaccttgaagatctccagaatattgagaacgcactcaagggtaaggcaaatattattttcagctacgtccgagccattggcattcctgagcatagagccgtcatggaggccgcttttgtgtatggcacgacttaccagtttgtcttaacaactgagatcgcccttctcgaatctattgggtcagaagatgtggagtatgcccacctgtactttttccattgcaaactggtgctggatcttacccaacagtgcaggcgcactctgatggagcaaccgctaaccactttgaacatacatctattcataaagaccatgaaagcccctctgctgactgaggttgcggaggatccccagcaggtgtctaccgttcatcttcagctgggtctgccgttagttttcattgttagccagcaagccacttacgaagcggaccgccgaactgctgaatgggtcgcttggcggctcctggggaaggccggtgtgctgctcctccttcgggattcacttgaagtgaatattccccaggacgccaatgtggtgttcaaacgcgcagaggagggagttcccgtggaattcctggtcctccatgatgttgacttaattatttctcacgttgagaataatatgcatatagaagagatccaggaggacgaagataatgacatggaaggacctgatattgatgtccaggacgatgaagtcgccgaaacggtgttcagggacagaaagcggaagctgcctctggagctgaccgtggaattgacagaggagacatttaacgctactgtgatggcatcagacagcatagttctcttttatgctgggtggcaagctgtgtccatggccttcctgcagtcctatattgatgttgctgtgaagctgaaggggacatccacaatgctgctcactaggatcaattgcgcagattggagcgacgtctgtactaaacagaacgtgacagaattccccataatcaaaatgtataaaaaaggagaaaacccagtgagctacgcaggcatgctggggacagaggaccttctgaaatttatccaattaaacaggatctcctatccagtgaacataacaagtatacaggaagctgaggagtacctgtccggagagctctacaaagatttaattttgtacagtagcgtgagcgtcttgggcttgttttcccctacgatgaaaaccgctaaagaagacttctctgaagccggaaactatctgaaggggtacgtcatcacaggcatctattccgaagaggatgtattactgttgagcacaaagtacgcagcaagtctgccagccctgctgctcgcccgtcacaccgaaggcaagatcgagagtattcccctagcttccacccatgcgcaagatatagtgcagattattacggacgcactgctggagatgtttcccgaaatcaccgttgaaaatttgcctagctattttaggctgcagaaaccgctgctgatcctcttttctgacggcaccgtgaatcctcagtacaagaaagcaatccttacactggtcaagcagaaatacctggacagcttcaccccttgctggctgaacctcaagaacacccctgtggggagaggcatcctgagagcatactttgaccctctgccaccgctgccactgttggtgctagtcaatctccacagtggcggacaggtcttcgccttccccagtgaccaggccataatcgaggagaatttggtactctggctaaaaaagctggaagcaggattggagaaccacataacgatcttgcctgcccaggagtggaagcccccactcccagcttacgacttcttgagtatgattgatgcagccacatcgcagagagggacgcggaaagtacccaagtgtatgaaagaaacagatgtgcaggagaatgacaaggaacagcacgaagataaatccgccgtcagaaaggaacccatcgaaaccctgagaatcaagcattggaacagaagcaactggtttaaagaggctgagaagagtttccgcagagacaaggaactgggatgcagtaaggtgaactag

SEQ ID NO: 10324 - DNA, 672 bp, Artificial Sequence
  Description of Artificial Sequence: Synthetic coding sequence
atgacatggagacatcacgtccggcttctgttcacagtctccctcgccctccagattattaatcttggcaactcctatcagagggaaaaacacaacggtgggagggaagaagtgaccaaggtggccacccagaaacatagacaatcgccattgaattggacatcaagccactttggggaggtgacaggctcagccgaaggttggggccctgaagaacccttgccctatagctgggcttttggcgaaggtgcatctgctaggccacggtgttgccggaatggaggaacttgtgtgttaggatcattttgtgtgtgtccagctcactttaccggccgatattgtgagcacgatcagcggaggagcgagtgcggggcattagagcacggcgcttggaccttgagggcatgccacctctgtaggtgcattttcggagccctgcactgcctgccactccaaacacctgatcgatgtgaccccaaagactttctagcgtcccacgcccatggcccttcagccggaggagctcccagccttctcctgctgcttccctgtgctctgctgcatagactactccgtccagacgcaccggctcacccgagatctctggtgcccagcgtactgcagagagagaggaggccctgtgggcgacccggtctgggacaccgactgtag

SEQ ID NO: 10325 - DNA, 1320 bp, Artificial Sequence
  Description of Artificial Sequence: Synthetic coding sequence
atgcctgcaatagccgtcctggccgcagccgcagcggcttggtgcttcctccaggtggaaagccggcatctggacgcgctagccggtggcgcaggacccaatcatggtaactttttggataacgaccagtggttgtcaaccgtctcacagtacgacagggataagtactggaaccgctttagagatgatgattacttccggaactggaatcccaacaaaccgtttgaccaggctctagatcccagcaaagatccctgtctgaaggtgaaatgttctccgcacaaggtgtgtgtgacgcaggattatcaaacagccttgtgtgtgagcaggaaacatctgctgccaagacagaagaagggcaatgtagctcaaaagcattgggtggggccttctaacctggtgaaatgcaagccgtgtcctgtcgctcagtccgccatggtgtgcggaagcgatggacatagctatacgtccaagtgtaagctggagttccacgcctgtagtacgggaaagtcgctggcgacactgtgtgacggtccctgtccttgcctgcccgaacctgaaccccctaagcataaagcagagaggtctgcatgcaccgataaggagctgaggaatctggcttcgcggctgaaggattggttcggagccctgcatgaggacgccaaccgagttatcaaacccacatcctctaatacagcccagggaagatttgatacgagtatcctcccaatctgtaaggactccctcggatggatgttcaataagttagatatgaattacgatttactcctggatcccagtgagatcaacgctatttatttggacaagtacgagccttgcattaagccgctatttaactcctgtgacagctttaaggatggtaagctgagcaataacgaatggtgttactgcttccaaaaacccggtggcctgccatgccagaacgagatgaaccgcatccaaaaattaagtaaaggcaagtccttgctgggggcattcattccgagatgcaacgaagaggggtattacaaagcaactcagtgccatggctcaactggccagtgttggtgtgtggacaaatatgggaatgaactcgcgggaagcagaaagcaaggagctgtgtcttgcgaggaggaacaagagacgtcaggggatttcggttctggcggttccgtggtgctcctcgacgatctggaatatgagcgcgagctggggcctaaggacaaggagggcaagctcagagttcatacacgcgcagtcacagaagacgatgaggacgaggatgacgacaaagaggacgaagttgggtacatctggtag

SEQ ID NO: 10326 - DNA, 7871 bp, Artificial Sequence
  Description of Artificial Sequence: Synthetic coding sequence
atgaaagtaaagggccgagggattacgtgccttctcgtctcttttgccgtgatttgcctggtggcgactcccggaggaaaggcttgcccaaggcggtgcgcttgctatatgcctaccgaggtccactgcactttccgatatttgacatcgatcccagatagcatacccccaaacgtggaaagaataaacctgggctacaatagcctcgtgaggctgatggagactgatttcagcggcctgaccaagctggagctgttgatgctccattctaatggcatacacacaattccggacaaaaccttctcagaccttcaagctctgcaggtgctgaagatgagctacaataaagttcgtaagctccagaaagacaccttttacggactgcgcagccttactcgcctgcacatggatcacaacaatattgaattcattaacccagaggtgttctatggactcaactttttgaggctcgtgcacctcgaaggcaatcagctaaccaaacttcacccagatacatttgtcagcctgagttatttgcagatattcaaaattagtttcattaagtttctgtatctctcagataacttcctgacatctctaccccaggaaatggtgtcctacatgcccgatctcgacagcctctacctgcacgggaacccgtggacctgcgactgccatctgaagtggctgagcgactggattcaggaaaaacccgacgtgataaagtgtaaaaaggatagaagcccttcaagtgcacagcaatgtcctctgtgtatgaaccctcgtacgagtaaagggaagcctcttgctatggtgagcgcggcagccttccagtgtgctaaaccaactatagactcttcattgaaatctaaatcattgaccattctcgaggatagtagttcagcattcatttcacctcagggcttcatggcaccgttcgggtcgctgacactgaatatgacagaccagagtgggaacgaagccaacatggtatgctctatacagaagccttcaaggacaagtcctatagccttcactgaggaaaatgactacatcgtcctcaacacctccttttcgaccttccttgtctgcaatatcgactatgggcacatccagcctgtctggcagatcttggccttgtattcagatagcccactgatcctggaaaggtctcacctcctgagcgagacaccacagttgtattataagtacaagcaagtggccccaaagcctgaagatatctttaccaacatcgaggctgacctacgagcagacccaagctggctgatgcaggaccaaatttcactgcagctgaatcgtactgcaaccaccttctctacgcttcaaattcagtattccagcgatgcccagataaccctgccaagagccgaaatgagaccagtgaaacacaaatggacgatgatcagcagggacaacaacacgaaattggagcacaccgtgctcgtcggcggaaccgtgggcttgaattgcccaggacagggagatcccacaccgcacgtagactggctgcttgctgatgggtcgaaggtcagagccccatacgtttctgaagacggcaggattctgatcgataaaagtggcaagctggaactgcagatggcagactcctttgacaccggcgtctaccactgcatctctagcaattatgacgatgccgatatactgacctaccgtatcaccgtggtcgaacccttagttgaggcctaccaggagaacggaatccatcacactgtgttcattggagagacacttgacttgccttgtcactcaaccggaatcccagatgcgagtattagttgggtgatcccaggcaataacgttctctaccagagctctagagacaagaaagtgttgaacaatgggactctaagaatcctccaggttaccccaaaggatcaaggatactaccgatgcgttgccgcaaatccatcaggggtggacttcttgattttccaagtgagtgtgaaaatgaagggtcagcgcccactggaacacgacggggaaacagagggctcaggattggacgagtctaaccccatagctcacttaaaggaaccccctggagcccaactgcggacttccgctctgatggaggcagaggtgggcaagcacacctcctccactagcaagcgccacaactaccgcgaactaacgttacagcgaaggggggattctactcaccgcagatttcgagaaaatcgccgacacttccctcccagcgccagacgaattgatccacagcactgggcagccttattggagaaggcaaaaaaaaacgccatgcccgacaaaagagaaaacaccactgtgtcaccgccacctgtggtaacccagttgccaaacatcccaggcgaggaagacgacagctccgggatgctggccttacacgaggagttcatggtgcctgcaacaaaagccttaaacctcccggctagaactgtcaccgccgatagtaggaccatatcagattctcctatgaccaacattaattatgggactgaattctctcccgtggtcaatagtcaaatcctgccgcctgaagagccaacagactttaagctctcgacggcaattaaaactaccgccatgtcaaaaaacatcaaccctacgatgtcctcacagattcagggtaccacaaatcagcactcatctacagttttcccactgctgctcggggctactgagttccaagacagcgatcagatggggagagggcgagaacatttccaaagtagaccacctatcacagttaggactatgattaaggatgtcaacgtcaagatgttgtcatctaccaccaacaagctactcctcgaaagcgtgaatacaaccaactctcaccaaactagtgttcgggaagtgtccgagccaagacacaatcatttttattcccacacgacgcagattctctccaccagcactttccccagcgatcctcacacagcagctcacagtcaatttccaatacctcgaaactcaaccgtgaatatccccctcttccggaggttcgggaggcagcgtaaaattggaggtcgtggaaggatcattagcccctaccgaacccctgtgcttaggcgacataggtattctatcttcaggagcactactcgaggctcttccgagaaatccactactgccttctcagcgaccgtccttaacgtgacctgcctaagctgtttgccacgggagcggctgacgactgccaccgccgctctgagctttccctccgcagcaccgataaccttccccaaggccgatattgccagagttccaagtgaggaatcaacaaccctggtgcagaaccccctcctgttgttggagaataagccttcagttgagaagaccacgccaactataaagtacttccgcaccgagatcagccaggtgaccccgaccggcgcagtgatgacttacgccccaacttcgatcccaatggaaaagacccataaggtgaatgctagttacccacgggtgagtagcactaatgaggccaaacgagatagtgtaattacctcctccctctccggcgctattaccaagccccctatgacaataattgctattacaaggtttagccggcgaaaaattccttggcagcagaatttcgtcaacaaccacaaccccaagggcaggcttcgaaatcaacacaaggtttccctgcagaagtcaacagccgttatgttgcccaaaacctcaccggctttgcccagggacaaggttagtccctttcacttcacaaccctctccacgtcagtgatgcaaattccatccaacacccttacaacagcccatcataccacaaccaagacgcataatccagggagtttaccgacaaagaaagaactgccctttccacccctcaaccccatgctgcccagcattatttccaaagactcctctaccaaatcaataataagtactcagaccgcaatccctgcaacaacgcctacatttcctgcctccgtgattacatacgagacgcagacagaaagatcacgagcacagacaatccaaagggaacaggagccacagaagaagaaccggacagatcctaatatttctccagatcagtcatctggtttcaccacaccaacagcaatgaccccaccagtcctgaccaccgctgaaacaagcgttaaaccaagtgtctctgcattcacacacagtcccccagaaaatacaacagggataagctccactatatcattccatagccgcaccctgaatctgacagacgtgatcgaggagctggcacaggccagcacccagactctgaagtccactatcgccagtgagaccacccttagcagcaaatctcaccagtccacaacaaccagaaaggccataattcggcacagcactatccctccctttctctcctcgtcagccacattgatgcccgtccccattagccccccattcacccagagagccgtgacggataacgtggctacccccatatcaggcttgatgaccaataccgttgtcaagttgcacgaatcgagccggcataacgctaagccccagcagctcgttgctgaggtagccaccagtccgaaagtgcacccaaacgctaaattcaccatcggcactacccactttatttactcgaacttgcttcactctacacctatgcccgcactgaccactgtgaagagtcagaactctaagctgacccccagcccatgggccgagaaccagttctggcacaagccgtactcggaaattgctgaaaaaggaaaaaagcctgaagtcagtatgctagccactacaggactgagcgaagcgaccacccttgtgtccgattgggacggacagaagaatacaaagaaatcagacttcgacaagaagcctgtccaagaagcaaccacatcgaagctcctacctttcgattccctgtccagatacatattcgaaaaacccagaatagtgggtgggaaggcagctagtttcacaatcccagctaatagcgacgcattcctgccgtgcgaagccgtggggaatccgttgccaactattcactggactcgtgtccctagtggcctggacctttctaagagaaagcaaaactctcgggtgcaagttctccccaacggtaccctgagtatccagagggtggagatacaagatagagggcagtacttatgtagtgctagtaatttattcggcaccgatcacttacacgtcacactgagtgtggtctcctatcctccaaggatcttggagagaaggacaaaagagattactgtgcatagcggttccacagtcgagcttaaatgcagagccgagggtagaccatcacccactgtgacctggattttagcgaaccagactgtggtgtccgagagcagccaaggaagcagacaggctgtagtcaccgtcgacggaaccctggttcttcataatctgtcaatttatgatcgcggtttttataaatgcgtggcctctaacccgggagggcaggattctttactggtcaagattcaggtcattgctgcccctcccgttatcctggagcagcgcagacaagtgatcgttggcacctggggcgaatcccttaagttgccttgcactgccaaaggcacccctcagccatcagtctattgggtcctcagcgatggcaccgaggtgaaacctctgcaattcaccaactccaagctcttcctcttcagcaacggtaccttgtacatccgcaacctggcaagtagcgaccggggtacttacgaatgtatcgccaccagttccacaggctcggagcggagggtggtgatgctcacaatggaggaacgggtgacctcaccccgtatcgaggccgcatcccagaaacgtaccgaggtcaacttcggggacaagctacttctcaattgcagcgccacaggggaacctaaacctcaaatcatgtggcggttgccctccaaagcagttgtggaccagcaacatcgcgttggcagctggatacatgtttatccaaacgggagtctcttcataggctcggttacagagaaagacagcggagtgtacctatgcgttgctcgcaacaagatgggagacgatctgatcttgatgcatgtctcactgagactgaagcccgctaagattgaccacaagcagtatttccggaagcaagtcctccacggtaaagacttccaggtcgattgcaaggctagtggatctcctgtgccggagattagctggtcattgcctgatggcacaatgattaataatgcaatgcaggcagatgacagtggacaccggacccgtcggtacaccttgttcaataacggaacactgtactttaacaaagtcggggtggctgaggagggcgactacacctgttatgcgcagaatacattgggcaaagacgagatgaaggtacacctcaccgtaatcacggccgcaccccgtatccggcagagcaacaagacaaataaacgcataaaggccggagacactgccgtccttgattgtgaagtcactggagaccctaaaccaaagatcttttggctgcttccctcaaacgacatgatttccttctctatcgacagatacactttccacgccaacggatcacttactatcaacaaggtaaagttgctggattccggcgaatatgtgtgcgtcgcgaggaatccaagtggagatgacaccaaaatgtacaaattagacgtggtgtcaaaacctcccctcatcaatggtctttacacgaatagaactgtcataaaagctactgcagttaggcattcaaaaaaacacttcgactgtcgcgctgagggcaccccctcaccagaggttatgtggattatgccagataatatctttttgacagccccatactacgggagtagaatcaccgtccataaaaatgggactcttgagattcgaaatgtcagactgagtgattctgccgatttcatttgcgtcgccagaaatgagggaggcgagagcgtacttgtcgtgcagctggaggttctggaaatgcttcgcaggccaacatttaggaacccctttaacgagaaaatcgttgcacagcttgggaaatcgactgccctgaactgctccgtcgacggcaatccaccacccgagatcatctggatcctgcctaatgggaccagattctcaaatggtccgcagtcttatcaatacctgatcgccagcaatggttccttcatcattagtaaaactacgagagaggacgccggaaaatataggtgcgctgctcggaacaaggtggggtatatagaaaagctcgttatcctcgagatcgggcagaaacctgtgatccttacctatgccccaggtactgtgaaggggatctcaggtgagagcctcagcttgcactgtgtgtccgatggaatccccaagccaaatatcaaatggacaatgccgtcaggctacgtggttgaccgccctcagatcaatgggaagtacatcctgcatgataatggcaccctggtgatcaaagaagcgaccgcgtacgaccgcggaaattatatatgcaaggcccagaattctgtcggccacaccctgattacagtgcctgtgatgattgtggcttaccccccacggattaccaacagacccccaaggagcattgtgaccagaacaggcgctgcctttcaactccattgtgtggccctgggcgtgccaaaaccggagataacatgggaaatgccagaccactcgctgctgagcacagcaagcaaagaacgtactcacggtagtgagcagctccatctgcagggaaccctcgtcattcagaaccctcagacgtccgattccgggatctacaagtgtacagccaagaatccattgggtagcgactacgcggcaacttacatccaggtcattta

SEQ ID NO: 10327 - DNA, 1995 bp, Artificial Sequence
  Description of Artificial Sequence: Synthetic coding sequence
atgaaaactgggttattttttctgtgtttactcgggacagcagcggcaattccaaccaatgcaagattactaagcgatcatagtaaacctactgctgaaaccgttgcccctgacaatacagcaattccttcactacgggctgaagctgaagagaacgagaaggagacagccgtgtctactgaagacgactcacaccacaaggctgagaaatcaagcgtcctgaaatccaaggaggaaagccatgaacagagcgcggagcagggcaagagtagctcacaagagctggggttaaaggatcaggaggatagcgatggtcatctttctgtaaacctggagtacgcgcctactgagggcacccttgatattaaagaggatatgtctgaaccccaggagaagaagctcagtgaaaatacagattttctcgctcctggcgttagttctttcaccgattctaaccagcaggagagcatcacgaagcgcgaagaaaaccaggagcaaccccgtaactatagtcatcaccagttgaaccggagctctaagcattcacaggggcttagggaccagggtaatcaagagcaagatcccaacatctcaaacggggaggaggaagaggaaaaggaacccggtgaggttggcacgcataacgacaatcaagagagaaagaccgaactcccgcgagagcacgctaattctaaacaggaggaggataatacccaaagtgatgatatcctggaagagagcgaccaaccgactcaagttagtaagatgcaggaagatgagttcgatcaggggaaccaggaacaggaggacaattctaacgctgaaatggaggaagagaatgcgagtaacgttaacaaacacatacaagaaacggaatggcagagccaggagggcaagaccggactcgaagcaatctccaaccacaaggagacggaagagaagaccgtgtcggaggccctgctaatggaaccaactgatgacggtaatacaacccccaggaaccacggcgttgacgatgacggagacgatgacggagatgatggcggtaccgacggcccaagacattcagcttctgatgactactttatcccatcccaggcattcttggaagctgagagggcccagtcaattgcctaccatctgaagatcgaagagcagcgcgagaaagtgcatgaaaacgagaatattggcacaaccgagccaggcgagcaccaggaagccaaaaaagccgaaaattccagtaatgaggaagaaacgtcgagtgagggcaacatgcgcgtgcatgcagtggactcttgcatgagcttccagtgtaagaggggccatatctgcaaggcggaccagcagggtaagccacattgcgtatgtcaggacccagtcacttgccccccaactaagcccctcgaccaggtttgcggtaccgataatcagacctacgccagcagttgtcacctctttgcgaccaagtgcaggttggagggcactaaaaaaggccatcaactccaactcgactactttggggcatgcaaatctatccctacgtgtacagatttcgaggtcattcagttcccattgaggatgagagactggcttaagaatatcctcatgcaactttacgaggctaattccgagcatgccggatatttgaatgagaagcagagaaataaggtgaagaaaatctatctcgacgagaagcgactgctcgccggagaccacccaatcgacctgcttttgcgcgattttaaaaaaaactatcacatgtacgtgtatcccgtacattggcagttctccgagttggaccagcaccccatggatcgggtgctcacccactcagaactcgccccactccgtgcatcgctggtccctatggaacactgtatcacccggttttttgaggaatgtgacccaaacaaggataagcatatcaccctgaaggaatgggggcactgtttcgggatcaaggaggaggacatagatgagaatttgctgttctag

SEQ ID NO: 10328 - DNA, 1254 bp, Artificial Sequence
  Description of Artificial Sequence: Synthetic coding sequence
atgcttgccctgttagtgctcgtcacagttgcgctggcctcagcacaccatgggggagagcactttgaaggcgagaaagtgttcagagttaacgtggaagacgaaaatcacattaatattattagagaactcgcctccaccacacagatcgatttttggaaacctgactcagtgacacagataaagcctcattccacggtggatttcagggtgaaagctgaagacacagtcacagtggagaatgtcttaaagcaaaacgaactgcagtataaggtgctaatcagtaacctgaggaatgtggtcgaggctcaattcgatagtagagtgagggcaacaggccattcctacgagaaatataacaagtgggagaccatcgaggcgtggacccagcaggttgctacggaaaatcccgctcttatcagcaggagcgtgattggaacaacattcgaggggcgagctatttatctgctgaaggttggcaaagccggtcagaataagccagctatctttatggactgtggctttcacgctagggagtggattagccctgctttctgccagtggtttgtccgcgaagccgtgcgaacctacggtagggaaatccaggtgaccgagctcctggacaagctcgatttttacgtactgcctgtcctcaacatagatggatacatatatacatggaccaaatccagattttggcgtaagacccggagcacccataccgggagtagctgtattgggacggacccgaacagaaacttcgacgctggatggtgtgagattggcgcttcgcggaacccatgtgatgagacttactgcgggcctgccgcagaatccgaaaaagagaccaaggcgcttgcggactttatccggaacaagttgagctctatcaaggcttatctgacaatacactcctacagtcagatgatgatatatccttattcatatgcctataagctcggagaaaacaatgcagaattaaatgcattggcaaaggcgacagtcaaggaactggcaagccttcacggaaccaaatatacatatggtcctggagctactactatataccccgcagcaggagggagtgacgactgggcttacgaccaggggattcggtattcttttacatttgagctgcgggacacaggtaggtacggatttctgctcccagagtcccagatccgagctacatgtgaggaaacctttttggccattaagtatgtcgcttcctacgtgctggagcacctctactag

SEQ ID NO: 10329 - DNA, 588 bp, Artificial Sequence
  Description of Artificial Sequence: Synthetic coding sequence
atggccgtcagccaaggtgacgggactctgtgctttgtgctgctcttgtgttgctggcaggagactgaactccgaccaaggacagtaataccaggcagccccaccgaaatccccttctcctccaaacaggaagatatgtccgaactgcttgatgagatcctggtgcaagagatcttagatcttaataaaacgaccccatctgagatgccttccacggccagcactctgagtacaccactccacgccggtattgacgagaactatcaggccggtggcagtgaaaattatcatgagcttctcgaaaacctccagtttagtccaggcatagaggtgaagatatctaatgacgaagccaacgccaacgctaatctgcacggagatccctccgaaaattatagaggcccacaggtgtcccctggcagcgagaaatctgtatcttctaaggagaaaaactccaagaacacacagtacgaaaatctgtcgattttggatcagatactccagaatattgggaggagttcggggaatatcttccataaagaacagcaacgaacgagcgcccagcgccgtagccaaggcagccagtag

SEQ ID NO: 10330 - DNA, 2334 bp, Artificial Sequence
  Description of Artificial Sequence: Synthetic coding sequence
atgaacgcgaataaagacgaacgtttgaaagccaggagtcaagactttcacctattcccggcactgatgatgctgtctatgaccatgctctttttgcccgttactggcactctgaagcaaaatatccccaggctgaagttgacttataaggacttgctgttatccaacagctgcattccttttcttgggtcctccgagggcctggatttccagacgctgctgctggacgaagaacggggaagattgctgctaggcgctaaagatcacatcttcctccttagcctggttgatctcaacaagaatttcaagaaaatctactggcctgcagctaaagagcgcgtcgaactgtgtaagttggccggtaaggatgccaacaccgaatgtgccaacttcatccgtgtacttcaaccttacaacaaaacgcatatatacgtgtgtgggacaggagcgttccaccccatctgcgggtatatagacctgggggtgtacaaggaagacattatctttaagctcgacactcataatttggagtccggccgtctaaaatgcccgtttgacccccaacagccatttgcatcagttatgacagatgaatacttgtacagcggtacggcatctgacttcctgggcaaggacacagcttttacacgtagcttgggacccacgcacgaccaccattatatccgcaccgacatcagcgagcactattggttgaatggggcaaagtttatagggacattctttatacctgacacctacaacccagatgacgataaaatctattttttctttagggagtcaagtcaggaggggagtacaagcgataaaaccattctctcacgggtggggcgagtatgcaaaaatgacgtgggtggccagaggtcacttattaataaatggaccactttccttaaggctcggctgatctgctctatccccggttcagacggggctgacacctactttgacgagttacaagacatctacctgctgcctacccgtgacgagcgaaaccctgttgtttatggcgtgtttacaactacctcaagcatcttcaaagggtctgccgtgtgcgtttattcgatggccgatatccgcgcagtgtttaacgggccatacgcacataaagagagcgcagaccatagatgggtacagtacgacggacgtatcccttacccacgaccaggcacctgtccatccaagacatacgacccactcatcaagtcaacgagggatttccctgacgacgtgatcagtttcatcaaaagacactccgtgatgtataaatcggtctaccccgtcgctggcggtccaacctttaaaagaataaatgttgattatagattgacccaaatcgtggtggatcatgtcatcgctgaagatggccagtatgatgtcatgtttctcggaacagatatcggcactgttctgaaagtggtgagcatatcaaaagagaaatggaatatggaagaagtggtactcgaagagctgcagatattcaagcattccagcatcatcctgaatatggaactcagcttaaaacagcaacagctttatatcggatctcgagacgggcttgtgcaactgtccttacaccgatgcgacacatatggcaaggcttgcgcggactgctgtttagcccgagatccatactgcgcatgggacggtaatgcctgttctaggtatgccccaacttctaagcgacgggcaagaagacaggatgttaaatacggtgatccaatcacccagtgctgggatattgaggactctatcagtcacgagactgccgatgagaaggtcatcttcgggattgagtttaatagcacctttttggagtgtatacccaagtcacagcaggctacgataaaatggtacatccagaggtctggagatgaacaccgcgaggagctaaaacccgacgagaggatcattaaaactgaatatggcctattgattcggagtctacagaaaaaggatagtggcatgtactattgcaaggcccaggagcatacgtttatacacacgatcgtgaagctcacattaaatgtcattgagaatgaacagatggaaaacacccaaagagcagaacacgaggagggcaaggtaaaggatctgctggccgaaagccggcttcgctataaagattacatacagattttgtctagccctaacttttctcttgatcagtactgcgaacaaatgtggcaccgtgagaagcgaagacaacgcaacaaaggaggccctaaatggaaacatatgcaggaaatgaaaaaaaagaggaaccggagacaccaccgcgatttggacgagctgccgagagccgtggctacttag

SEQ ID NO: 10331 - DNA, 1332 bp, Artificial Sequence
  Description of Artificial Sequence: Synthetic coding sequence
atgcagcccagcgagatggtgatgaatcccaagcaagtgtttctgtctgtactcattttcggtgtagccggattgctgctctttatgtacctgcaggtttggatcgaagaacagcacacagggagagttgagaagagaagggaacagaaggtcaccagcggctggggacctgtcaagtacttgcgacctgtgccccgaatcatgtcaactgagaagatccaagagcacattaccaaccaaaaccccaagttccatatgccagaggatgtgagagaaaaaaaagaaaatctgctgttgaattccgagcgctctacgcggttactaaccaaaacatcccatagtcagggaggggatcaggcgctgtctaagtctaccggcagtcccaccgaaaagctgattgaaaaaagacaaggagccaagactgtatttaacaaattttctaacatgaactggccagtggacatccatcccctgaataagtctctggtcaaagacaacaagtggaaaaagaccgaggaaacacaagaaaagcgacggtccttcctgcaagagttctgtaagaaatatggcggagtaagtcatcaccagtcacacctgtttcacaccgtatccaggatttacgttgaggacaagcacaagattctgtactgtgaggtgcccaaggcaggttgctcaaattggaagaggatcttgatggtgctgaacggtctggcaagctccgcgtataacatcagtcacaacgcagtccactatggtaagcacctgaagaagctggatagctttgatctgaaagggatatacaccagacttaacacatatactaaagcagtttttgttagggacccgatggagcgactcgtgtccgccttccgggacaaattcgagcatccgaactcatattaccacccagtctttggtaaagccattatcaagaagtaccgccctaacgcctgtgaagaggctctgattaacggcagcggagtgaaattcaaggaattcatccattacctgctggatagccaccggccagtcggcatggatatccactgggaaaaggttagtaagctttgttatccctgccttataaattacgactttgtcggcaagtttgagaccttggaggaagatgcaaactatttccttcagatgattggcgctcccaaggaattgaagttccccaactttaaggacaggcacagctctgacgaaagaaccaatgctcaagttgtccgccagtacctgaaggacctgacaaggacggagcgtcagctgatttacgatttttactatttggactacctgatgttcaattacactactccctttctgtag

SEQ ID NO: 10332 - DNA, 3228 bp, Artificial Sequence
  Description of Artificial Sequence: Synthetic coding sequence
atgcggggtgggaagtgcaatatgttgagctcactggggtgcctgctgctgtgtgggagtattacgctcgctttggggaatgcacagaaactccccaagggaaaaagaccaaatctgaaagtacatattaatacaacctccgactccattctgctgaagtttctgagaccttctcccaatgttaagctggaaggcctgttattaggatacggatcgaatgtgtcccccaaccagtacttccctctccccgcagaaggcaagttcactgaagcgatcgtggacgctgagccaaagtatctgattgtagtgcgccctgcaccaccccctagccagaagaagagctgcagcggtaagacgcgctctcggaagcccctgcagctggtggtcggaactttgactccaagcagcgttttcttgtcatggggctttcttattaaccctcaccacgattggacactaccctcccattgccctaacgatcgattctacaccattcggtaccgcgagaaagacaaggagaagaaatggatctttcagatctgccccgcaactgagactatcgtggagaacctgaagcccaatacagtgtacgagttcggggttaaggataatgtggaggggggaatttggtctaagatattcaatcacaaaacagtggtgggatcaaagaaagtgaatggaaaaatacagtcaacctatgatcaggaccataccgtacccgcatacgttcccaggaaactgatcccgatcaccattatcaagcaggtgattcagaacgtgactcacaaggattcagctaaaagcccagagaaggccccactggggggtgtgattctggtgcatcttatcataccgggattaaatgaaactaccgtcaagttgccggcatctctgatgtttgagataagcgacgcgctcaagacgcaactcgctaaaaacgagactctcgctttgcccgctgagtccaaaactccagaagtggagaagatatccgccagacctacaaccgttactcctgagaccgtgcctcggagcactaagccaaccaccagtagtgccctggatgtgtcggagacaactttagccagctcagaaaaaccgtggattgtccccaccgctaagattagcgaagattccaaagtgctgcaacctcaaaccgccacttatgatgtgttcagtagcccaaccacttctgacgagcccgagatctccgattcctacacggctacgtccgacagaatccttgattctatcccccctaagacaagtcgcactttggagcagcctcgggcaaccctcgcaccctctgaaacaccctttgtgcctcagaagctggagatattcaccagtcccgagatgcagccaacgactccagccccacagcagacgacctcaattcccagcactccaaagcggagaccccgtccaaagccgcctagaactaaacccgaaaggaccacaagcgccggaacaatcacccctaagatctcaaagtctccagagcctacttggactactccagcacccggtaaaacacagttcattagtttgaaaccaaaaatcccattatcccctgaagtgacccatacgaaaccagctccgaaacagactcccagagcacccccaaagccgaaaacgagtcccagaccccgtatacctcagactcagcccgtccccaaagtgccacagcgtgttacagctaaacccaaaaccagcccaagccctgaggtgagctacacaacgccggcacccaaggacgtcctcttgcctcacaaaccctatccagaggttagccaatccgagcctgctcctctggagacgcgtggcatccccttcattcctatgatcagcccgtcgccatcccaagaggagctacagacgaccctggaagaaaccgaccaatcaacacaggagcctttcaccactaagatcccccgtaccactgagcttgccaaaaccactcaagctccccaccgattttataccaccgtccggccaagaacaagcgacaagcctcatatcaggccaggagtcaagcaagcccctcggccatccggggcagacagaaacgtttccgtcgacagcacacatcctactaagaaaccaggcacccgcagacctccgcttcctcctaggccgacgcaccctcgcagaaagccactgcctcctaacaatgttaccgggaaacccggatccgcagggattatcagtagtggtcccattaccacacctccgctgcgtagtacacctaggcctacaggtacccctctcgaacgtattgagaccgacattaagcagcctacagtgcctgcatcaggtgaggaactggagaacattaccgacttttcctccagcccaacccgcgaaacggatcccctgggtaagcctcggtttaaaggcccacacgtgcgctacatacagaagccggacaattccccctgcagcatcactgactctgtgaagagatttccgaaagaggaagccacggaaggcaacgctacttccccaccacagaatccccctaccaaccttactgtcgttaccgtcgaggggtgtccctcctttgtgatacttgactgggaaaagccactgaatgataccgtaaccgagtacgaggtgattagcagggagaacggttcgttcagtgggaaaaataagagcatccagatgactaatcagacctttagcaccgttgagaatctcaagcctaataccagctacgagttccaggtcaagccaaagaatccactgggagaaggccctgtctctaatacagtggccttcagcaccgaatctgccgatcctcgggtctccgagcctgtcagtgccggaagagatgcaatttggacagaaagaccatttaatagcgactcatactcagaatgcaaggggaaacaatatgtcaagcgaacctggtataagaaattcgttggggtgcaactctgtaactctctgcgctataagatttatttgagtgattctctgaccggtaagttctacaatatcggcgaccagagagggcatggcgaagaccattgccagtttgtagacagtttccttgacggccgaactggacagcaactcacaagcgatcagctccccatcaaagagggttattttcgcgcagttcgtcaggagcccgtgcagtttggggaaattggaggccatacacaaatcaattatgtgcagtggtacgaatgtgggactactatcccagggaagtggtag

SEQ ID NO: 10333 - DNA, 483 bp, Artificial Sequence
  Description of Artificial Sequence: Synthetic coding sequence
atgctccctttcctttttttctccactctgtttagtagcatcttcaccgaagcccagaagcagtactgggtgtgcaactcaagcgatgcctcaatttcttacacctattgcgataagatgcaataccccatctctattaacgtcaacccctgcattgaactcaaaagaagcaaaggtttgctgcacatcttctacatccctaggagggacctaaagcaattgtacttcaacctttacattaccgtaaatactatgaatttacctaagagaaaggaagttatttgtcgcggtagcgacgatgattacagcttctgtcgagccttgaagggcgagacagtaaatacaacaatctcgttctcgttcaagggtattaagttttctaaagggaagtacaagtgtgtggtcgaagccataagcggttccccagaggagatgctcttttgccttgagttcgttatactacaccagccaaattccaactag

SEQ ID NO: 10334 - DNA, 780 bp, Artificial Sequence
  Description of Artificial Sequence: Synthetic coding sequence
atggctgccctcatgcgaagcaaagattcatcctgttgcctgttgctgctggccgctgttcttatggtggagagtagccagattggtagcagcagagctaaactcaactccattaagtcatccttgggcggagagaccccagggcaggccgcaaaccgcagtgccggtatgtatcagggcctagcattcggcggtagtaagaaggggaaaaaccttgggcaggcttatccgtgttcatcagataaggagtgtgaggtgggcagatactgccatagtccacaccaggggagcagcgcttgcatggtttgcaggcgtaaaaagaagagatgccacagagacgggatgtgctgcccatccacacggtgcaacaacggaatttgtatacccgtcacagagagtattctgaccccacacatccccgctctcgacggaactcgtcaccgtgacaggaaccacgggcactactcaaatcacgatctcggctggcagaacctcggccgacctcatacaaaaatgagccacataaagggacatgagggcgacccctgtctccgctcatcggactgcatcgaaggattctgctgcgcacggcacttttggaccaagatttgcaagcctgtgctgcaccagggagaagtgtgcactaagcagcgcaaaaaaggttcacacggccttgagatattccagcgctgcgactgcgctaagggactgagttgtaaggtctggaaagatgctacatatagtagcaaagccaggttgcacgtctgccagaaaatatag

SEQ ID NO: 10335 - DNA, 3030 bp, Artificial Sequence
  Description of Artificial Sequence: Synthetic coding sequence
atgggccagctttgttggctgccactcttggccccacttctgttgctaaggcctcccggtgtgcagtctgctgggccaattagggctttcgtcgtccctcatagtcacatggacgtgggatgggtatacacagtccaggaatctatgcgggcttacgcagctaatgtatacacttctgtagttgaagagctagctcgaggacagcagcgtcgcttcatagccgtcgagcaggagtttttccggctgtggtgggatggcgtggcttccgatcaacaaaaatatcaagtgcgccagcttttggaggaaggccgactggagttcgtcattggcggacaagtgatgcatgatgaggcagtcacccacctcgacgatcaaatcttgcaactaactgaggggcatggctttctctacgagactttcggaatcagaccgcagttcagctggcatgtggaccctttcggggcttcagctacgaccccaactctgtttgctctggctggctttaatgctcacttaggctctcgcatcgattacgacctgaaagcagccatgcaggaggcccgaggcctgcagttcgtatggcgtggttccccctcgctgtcagagagacaagaaatttttacacatattatggaccaatattcatattgcacaccttcacacatccccttcagcaaccgaagtggcttctactggaacggcgtagccgtcttccccaagccacctcaggacggcgtttatcccaacatgtctgagccagtgaccccggctaacataaacctctatgctgaagcactggtcgctaacgtaaagcaacgcgcagcctggttcagaacccctcatgtcctgtggccttggggttgcgacaaacagttcttcaacgcgagcgtccagttcgccaacatggaccctctgcttgatcacataaatagccacgccgctgagctgggagtgtccgtgcagtacgcaaccctgggggactattttagggcacttcacgctcttaacgtcacttggcgcgtcagggaccaccacgacttcctcccctactctacagagcccttccaggcttggaccgggttttacacttccaggtcatccttaaagggtctggcacgacgggcatcggctctgctgtacgccggagagagcatgttcacacggtacctgtggccagccccaaggggacacctggatccaacgtgggccctgcagcagcttcagcagctgagatgggctgtgtcagaggtgcagcaccacgacgctatcaccggcacggagagtccgaaagtaagggatatgtacgcgacacatctggcttctggtatgcttggcatgaggaagcttatggccagcattgtcctggatgaactccagcctcaggcccctatggctgcctcctctgacgctggtcccgctggccacttcgcgtcagtttataatcccttagcctggaccgtcacaacaatcgtaacgctgacagtgggcttccctggcgtgcgggtgaccgatgaggccggacaccccgtgccatctcagatacagaacagtacagaaacaccaagcgcctatgacctccttatcctcaccactatacctggcctgtcttatagacactataacatccgcccaacggctggtgcccaagagggcacacaggagcccgctgccactgttgcgagcactctacaatttggtcgcaggcttaggcggaggacatcacacgctggtcgttatctagtgcctgtggctaacgattgctacatcgttcttctagaccaggatacaaacctgatgcattccatttgggagcggcagtctaatagaactgtgcgcgtgacacaggagttccttgaataccatgtgaacggcgacgtgaagcagggccctatcagtgacaattatctgtttacacccggtaaagccgcagtccccgcatgggaagccgtagaaatggagattgtggctggccagttggttaccgaaattaggcaatacttctacaggaacatgaccgctcaaaattacacttacgctattaggagccggctgacccacgttccacagggtcatgacggcgaactactgtgccataggattgagcaggagtatcaggctgggcctctagagctgaaccgggaggcggtcctgcggactagtactaatctgaacagtcaacaagtcatttactctgataacaacggctatcagatgcaaaggcgcccttacgtgagctacgtgaataacagcattgcccgaaactactaccctatggttcagtccgcattcatggaggacgggaagtctcggttagtccttctgtcagagagggcccatggaatttcctcacaggggaacggccaggtcgaagtgatgctccaccgtaggctatggaataattttgattgggatctaggctacaacctcaccctgaacgatactagcgttgtgcatcctgtgctgtggttgctgctggggagctggtccctcaccacagcgctcagacagagatcagccctggctctccagcaccgaccagtggttctgtttggtgacctggcagggaccgctcctaagctaccagggccacagcagcaagaagctgtgacacttcccccaaatctgcacctgcagatccttagcattccaggttggcgctacagttccaatcacaccgagcacagccagaatttgaggaaaggccatcggggagaggctcaggccgacctgaggcgcgtgctcctcagattgtatcacctatacgaggtgggagaggacccggttctgtcccagcccgttaccgtgaatcttgaggcagtgctgcaggcgctaggatcagtcgtggccgttgaagaaaggtcgcttacgggtacttgggatctcagcatgctccacagatggtcctggcggaccggcccaggaagacataggggggacaccacatcgcccagcagacctccaggaggaccgattataactgtgcaccctaaggagataaggacctttttcatacactttcagcagcagtag

SEQ ID NO: 10336 - DNA, 1443 bp, Artificial Sequence
  Description of Artificial Sequence: Synthetic coding sequence
atgttatttagaaataggttcctgttgctcctagccctcgcagccctgctagcgtttgtatccttatctctgcagttttttcatctgattcctgtatctactcccaagaacggaatgtcaagtaagagcagaaagagaattatgcctgaccccgtcaccgaacctccagtgactgacccggtgtatgaggcactgctatattgtaatatcccaagcgtggccgaacggagtatggagggacacgcaccacaccattttaaactagtttccgtacacgtatttattaggcatggagatagatatcccttgtatgtcatccccaaaacaaagcggcctgagatcgattgtaccctggtggccaaccgcaagccctaccatcccaagctggaggcatttatctcccatatgtctaaaggctcgggagcctcgtttgaaagccctctgaacagcctcccattgtaccctaaccatccactgtgtgaaatgggcgaactcacacaaaccggcgtggttcaacacctgcagaatgggcagttgctgagggacatctacctgaaaaaacacaaactgctgcccaatgattggtcagcagaccaattgtatctggagacaacaggcaagtctcggactctacaatctggactcgcactgctatatggctttctccccgattttgattggaagaaaatctacttccgtcaccagccatccgctctattctgctctggaagctgctactgccctgtgaggaaccagtatcttgaaaaagagcaaaggcggcagtatcttctgcgccttaagaatagccaactcgagaagacatacggcgagatggcgaagatcgtggacgttcccaccaagcaattacgggctgcaaacccaatagacagcatgctttgtcacttctgccataatgtttccttcccttgcacaagaaacggctgcgtggacatggagcactttaaggtgatcaaaactcaccagattgaggatgaacgagagcggcgtgaaaagaaattgtatttcggatattctctgctgggcgcacaccccattttgaaccagactattggaaggatgcagagagctacagaaggaaggaaagaggagcttttcgcgttgtatagtgcccatgatgtgaccctaagccctgtcctgtccgccctgggcctcagcgaagcaaggttcccgagattcgctgctcggctcatcttcgagctctggcaggatcgcgagaaaccttctgagcactctgtgcgcatcctttataacggtgtggacgtcacctttcataccagcttttgccaggatcaccataagagatcccctaagcccatgtgtcctctggagaacctggttcgtttcgttaagcgcgacatgttcgtcgccctgggtggctccggaaccaactactatgacgcctgccaccgagagggattctag

SEQ ID NO: 10337 - DNA, 1341 bp, Artificial Sequence
  Description of Artificial Sequence: Synthetic coding sequence
atgctgcacccggaaactagtccgggtcggggacaccttctggctgtcttactggccctccttggaacagcctgggccgaggtgtggcctcctcagctacaagagcaggccccaatggctggcgctctgaatagaaaagagtcgttccttttgctgtcactgcataatcgtttaaggtcttgggttcagcccccagcagccgacatgagacgactggactggagcgactctctggctcaactggcccaggccagggccgcattgtgtggtactccaactccctcgctggcctcaggtctttggcggacactgcaagtcggctggaacatgcagctcctcccagcaggccttgtctcctttgtggaagtcgtttcattatggttcgcggagggccagagatactctcatgctgctggcgagtgcgctcggaatgcaacatgtactcactacacccagctggtgtgggccacctccagccaactggggtgtggacgacacttgtgctccgccggtcaggctgccatcgaagccttcgtgtgcgcatacagtccaagagggaattgggaagtgaatggtaaaactatcgtaccatacaaaaagggggcatggtgtagcctgtgtacagcctctgtgtctgggtgtttcaaggcgtgggaccacgcaggtgggctgtgtgaggttcctcgaaacccctgccgaatgtcgtgccagaaccatggccgactgaatatctcaacctgccactgccattgtccgcctggatataccggcagatactgccaggttagatgttcactgcagtgcgtccatggacgttttcgggaggaagagtgcagttgtgtctgcgatattggctatggcggagctcaatgtgcgacaaaggtccactttccttttcacacatgcgacctgaggatagatggagattgctttatggtgagctctgaagcggacacatattaccgagccaggatgaagtgccagcgaaagggcggtgtcttagctcagataaaatctcagaaggtgcaggacatcttagccttttatttgggccgtctcgaaacgaccaatgaggttatagatagtgatttcgagacgcgaaacttctggattggcttgacctataagaccgcgaaggattccttcaggtgggcaactggtgagcatcaagccttcacctcttttgcttttgggcaaccagacaaccacggattcggaaactgcgtcgaactgcaagctagtgcagctttcaattggaacgaccaacgctgcaagacgcggaatagatacatttgccagttcgctcaggaacatatcagtagatgggggccaggaagctag

SEQ ID NO: 10338 - DNA, 2313 bp, Artificial Sequence
  Description of Artificial Sequence: Synthetic coding sequence
atggtggagagcgcaggcagagccggacaaaagcgacctggattcttggaggggggtttgctgctgttgctactgctggtgaccgcagctctggtcgccctgggtgtgctgtacgctgatcgacggggaaaacaactcccaagattggcctcacgactctgcttccttcaggaggaaagaacttttgtcaagagaaagcccagaggtatccccgaggcccaggaagtgtccgaggtatgcacaacacccggttgcgtaattgctgccgcacgcatcctccagaacatggacccgacaaccgaaccttgtgatgacttctatcagtttgcgtgcggcggatggctgcggcgacatgtgatccccgagacaaattctcgctatagtattttcgacgtcctgcgggacgagctagaggtgatcctcaaggccgtgttggagaactctaccgcaaaggacagacctgccgtggagaaggcaagaaccctgtatcggagttgtatgaatcagtctgtgattgagaagcggggatcccagcctctgctggacatcctagaagtagtcggcggatggcccgttgccatggaccgatggaacgagaccgtcggcctcgagtgggagctcgaacggcaattggctttaatgaactctcaatttaataggcgcgtgctgatcgatcttttcatctggaacgatgatcagaatagttcacgccatatcatctacattgaccaaccgacccttggaatgccttccagggaatattactttaatggaggatccaatcgaaaggtgcgtgaggcataccttcagttcatggtgtccgttgcgacgttgttgcgagaagacgctaacttgccaagagattcttgtttggttcaggaagatatggttcaggtgcttgagcttgaaacacagctggccaaagcaaccgtaccacaagaagagcggcacgatgtgatcgcactctaccatcgtatgggtctcgaggaattacagtctcagtttgggctgaaaggctttaactggacactctttatacaaactgtgctgagtagcgttaagattaaattgctccctgatgaggaagtggtcgtgtacggaattccctatctgcagaacctcgagaatattatcgatacatactccgccagaaccatccagaattacctggtgtggaggctggtattagataggatcggatccttatcacagcgcttcaaggacactcgggtgaactaccgaaaggcattattcggcacaatggtggaagaggtccgctggcgcgagtgcgttggatatgtgaactccaacatggaaaatgcggtgggaagcttgtacgttagagaagctttcccaggcgactccaagtctatggtgagagaattaattgacaaagttagaactgtgtttgttgaaaccctggatgagcttggctggatggacgaagagagcaagaaaaaggcccaggagaaggccatgtcaattcgcgagcagatcgggcacccagactatatacttgaggagatgaaccgcaggctcgacgaagagtactctaaccttaatttctctgaggacctatactttgagaatagcctccaaaacctgaaggtcggggcacagaggagtctgagaaaacttagggaaaaggtggaccctaatttatggatcataggggcagcagtggtgaatgcattttactcacccaacaggaaccagattgtgttccccgctggtattctgcagccaccattcttcagcaaagagcagccgcaggccttaaactttggcggtattggcatggtgatcggccatgagattacacatggcttcgatgacaacggtcgaaatttcgataaaaatggtaacatgatggactggtggtccaactttagtacgcagcacttccgcgagcagtccgaatgtatgatctaccagtacggtaattattcttgggatttggccgatgagcagaacgtaaacggttttaataccctgggcgaaaacatagccgataatggcggtgttcgccaggcttacaaggcttatctaaagtggatggccgaggggggaaaagaccaacagcttccgggattagatctgacccatgaacagctgttttttattaactatgcccaagtgtggtgcggtagctaccgacctgagtttgccatacaaagcatcaagacagacgtccactccccgctcaagtacagggtcttgggatctctgcagaatctcgccgcatttgccgatactttccactgtgctcgcggtactccaatgcatccaaaggagaggtgccgagtctggtag

SEQ ID NO: 10339 - DNA, 1317 bp, Artificial Sequence
  Description of Artificial Sequence: Synthetic coding sequence
atgtctaagagagataaagcgggaaaagacacagctagagggaaaggcaaggatattagcaagtacgggtccgtacagaagagttttgcagatcgcggactgcccaagcctcctaaggaaaaactgctgcaggtggagaagttaaggaaagagtccggaaaaggaagttttcttcagcccactgcgaagccgcgagctcttgctcagcaacaggcagtgatcagaggtttcacctattataaagctggtaaacaggaagtgaccgaagccgtagccgacaacacacttcagggaacatcctggctcgaacagcttccacctaaggtggagggaaggtccaactcggcagagcctaacagcgcagaacaagatgaagctgagcctaggtcatccgaacgcgtggacttggccagcggaacgccaacatctattcctgctacaacgactaccgcaacaacaacacccacccccaccaccagtcttctacccactgagccaccgtccggcccagaagtttcttctcagggcagggaggccagctgtgaggggactctacgcgctgtggatccccctgtccgtcatcacagctacggcagacacgaaggcgcttggatgaaagacccagctgcgcgagatgaccgcatctacgtgactaactattattatggaaattcactggttgagttccggaatttggaaaatttcaagcagggaaggtggtctaacatgtataagctgccctacaactggattggcacagggcacgtggtgtaccagggtgcattttactataatagggccttcaccaaaaacataatcaagtatgatcttcgccagaggtttgtagcctcctgggcactgttaccagacgtggtctatgaggacaccactccatggaagtggagaggccattccgacatagatttcgccgtggacgaaagcggcctttgggtgatttatccagcagtagatgatcgggatgaggcccaaccagaggtcattgtccttagccgcctagatcccggtgacctctcagtacatcgagaaaccacgtggaagaccaggctcaggagaaattcgtatggaaactgttttcttgtctgcggtatcttgtacgccgtggatacttacaatcagcaagagggccaagtggcctacgcatttgatactcataccgggacggacgccaggccacagctgcccttcctaaacgagcacgcctacactactcagatcgactataaccctaaagagcgcgtgctgtacgcctgggacaatggccaccagttgacctacactcttcactttgtggtttag

SEQ ID NO: 10340 - DNA, 3570 bp, Artificial Sequence
  Description of Artificial Sequence: Synthetic coding sequence
atgcctggcctgttaaactggattaccggggcagccttgccactgaccgcctccgacgtcacatcttgcgtctctggatacgcactgggactgactgctagcctgacttatggcaatttagaagcccagccttttcagggtttatttgtatatcccctcgatgagtgcacaactgtaatcggctttgaggcagtgatcgccgacagggtggtgaccgtccaaatcaaggacaaagccaagctggagagcggccatttcgacgcttctcatgtaaggtctcctactgtgacgggtaatattcttcaggacggtgttagcatcgcaccgcacagctgtacacctggaaaggtaacactcgatgaggatcttgaacgtatactgtttgtggccaacctcggcacgatagccccaatggagaacgtaactatcttcatctcaaccagctccgagctccccactttgcctagcggcgcagttcgggtactccttccggctgtgtgcgcccctaccgtgccgcagttctgtactaaaagtacggggacctccaatcagcaggcccagggcaaggaccgtcattgcttcggggcttgggctcctgggtcatggaataagctttgccttgctacgctgctgaacactgaggtgtctaaccctatggaatatgagtttaacttccaattggagattaggggcccatgtctgttggccggagtggaaagcccaacacatgagatccgagctgacgcggctccaagcgccaggagcgccaaatcaatcatcatcactctagcaaacaaacatacttttgaccgcccagtcgaaatcctgattcatccctctgagccgcatatgccacacgtgctcattgaaaaaggcgatatgaccttgggagagtttgaccagcatctgaaaggcagaactgacttcataaaaggaatgaaaaagaagagtcgagccgagaggaagaccgaaattatacgaaagcggttgcataaggacataccacatcactccgttattatgctgaatttctgcccagaccttcaaagcgtacagccctgcctccggaaagcacatggagagtttatcttcctgatcgataggtcttccagcatgtccggcataagcatgcaccgtgtcaaagacgctatgttggtggcgctcaaatcgcttatgccagcctgcttatttaacattattggatttggtagcaccttcaaaagccttttcccctcctcccagacctacagtgaggattccctggcaatggcttgcgacgacattcagagaatgaaagcagacatggggggaaccaatatcctctcacccctgaagtgggtgataaggcagcccgtgcaccggggtcatcccagactgctctttgtcattactgatggcgcagtcaataatacaggcaaggtgcttgaactggtgcgaaaccatgcgttcagcactcgctgctacagctttggcatcggacctaacgtctgtcaccgattagtcaagggcctagccagcgtctcagaaggctcagctgaactcttgatggaaggagagaggttgcaacctaaaatggttaagtctctgaaaaaggctatggcaccagtcctgagcgacgtgactgtcgagtggattttcccagaaacaacagaagtcttggtcagtcccgtgagtgcttccagtctgtttccaggagagcgcttagtcgggtatggtatcgtgtgtgatgcttccctgcacatctctaacccacggagcgataagcgtcgtaggtactcaatgctgcatagccaagagagtggcagctctgtcttttatcacagtcaggatgacggacccggtctggaaggaggtgattgcgctaaaaacagtggcgctcctttcattttgggccaggctaaaaatgcaagactcgctagcggagacagtactactaaacacgacctgaatctgtctcaaaggcgaagagcgtactccacaaatcagattaccaatcacaagccactacctcgcgctaccatggccagtgatccaatgcctgctgctaaacggtaccctctgcgtaaagcccgacttcaagatctgaccaatcagacatctctggacgttcagcgctggcaaatcgacttgcagccgctcctgaactccggccaggacctgaatcaaggacctaaactgagagggcctggcgctcggaggccttcgctcttgccccaaggttgtcaacccttcctcccttggggccaagaaacacaagcatggagtcctgtcagagaacgaaccagtgactcccggagccccggagacctggagccaagtcaccaccctagtgcgtttgaaacagagacatcttcagattgggacccgccagccgagtcccaagagcgcgctagtccatcccggccagcaactcctgccccagtccttggcaaggctctcgtgaagggcctacacgactcacagcggctgcaatgggaagtttcctttgaactcggaacacctggaccggagcgaggaggcgctcaggacgccgatttatggtctgagacatttcaccaccttgccgctcgggcaatcattcgggacttcgagcaactggctgaacgagagggcgaaatcgaacagggctccaatcggagatatcaggtgtctgccctccacacctcaaaagcctgcaacataatttccaagtatacagcattcgtgccagtcgacgtttccaagagtaggtatctcccaaccgttgttgaatatccgaatagcgcagctctccggatgcttgggagtcgggctctggcacagcagtggcgtggcactagctcaggcttcggcaggcctcagactatgcttggtgaggactcggcaccgggtaatgggcctcagcgatccttagctactaataccctgtctagtatgaaagcttccgaaaacctgttcggtagctggctcaacctgaacaagtcccggctgctgacccgcgcagccaaaggcttcttgagcaagccccttatcaaggccgtggaaagcacctctggaaatcagtctttcgattacatcccccttgtatcgctgcaactagcgtcgggggcattcctgctcaatgaggccttttgcgaggccacgcacattccgatggaaaagctgaagtggacctcaccttttacttgccacagagtcagcctgaccacacggcctagtgagtctaagactccctctccacagctctgcacgtctagtcctccacgtcatcctagctgcgatagcttttcccttgagcccttggctaaagggaagctggggctggagcccagagccgtagtcgaacataccggcaaactgtgggcaactgtcgtcggcttggcctggctcgagcattctagtgcaagttatttcaccgaatgggaactggtggcagctaaagcaaactcgtggctagagcagcaggaggtgcctgaaggcaggactcaagggacactaaaggcggcagctcgccaactattcgtgctgctccgacactgggacgaaaatcttgagtttaatatgttatgttacaaccccaactacgtgtag

SEQ ID NO: 10341 - DNA, 1344 bp, Artificial Sequence
  Description of Artificial Sequence: Synthetic coding sequence
atgccccacgtacttattgagaaaggagacatgacgctcggtgagttcgatcagcacctgaagggccgaacagacttcatcaagggaatgaaaaaaaaatctcgcgctgaaagaaaaaccgaaattatcaggaagaggttacacaaggacattccccaccattctgtaattatgctgaatttctgcccagacctgcagagcgtgcagccctgcctccggaaggctcacggagaattcattttcctaatagaccgatctagcagcatgtctggaatatctatgcatagagtgaaggatgccatgcttgtcgcactcaagtcccttatgccagcctgtctgtttaatattatcgggttcggatccacctttaagtctctgtttcctagctctcagacatacagtgaggactcgttagctatggcttgcgacgacatccagcggatgaaggcagatatgggagggaccaacatcctgagccctctgaagtgggtcatccggcagcccgtgcatcgtgggcacccacgcctgttatttgtcattaccgacggcgcagtgaacaacacaggaaaagtcttggagctggtgcgcaaccacgcattttccacccgatgttacagctttggaattgggccaaacgtctgtcacaggttggtgaaggggctggctagtgtttctgaaggctcagcagaactgctgatggagggcgaacggctccaaccgaagatggtgaagagccttaagaaagcgatggcccctgtgctctcagacgttacagtggagtggatttttcccgaaacaactgaggtgcttgtgagtccagtctctgcctcgagtctgttcccgggagagcggctggtagggtacgggatcgtgtgcgacgcttccctgcatatctcaaatccacggtcggataaaaggaggagatacagcatgctgcacagtcaagagagtggcagtagtgtgttctatcactcccaggatgatggccctggattggaggggggagactgtgctaagaatagcggggcacccttcatcctcggccaggcaaagaatgccaggctggcttccggcgacagcacaactaaacacgatctgaacttgtctcagcgcagacgtgcgtacagcactaatcagattactaaccataaacctctccccagagcgacaatggcatcagaccccatgcccgctgccaagagatatcctctgcggaaggccaggctgcaggatctgaccaaccagacctcgctagatgtgcagcggtggcagatcgatcttcaagccttcatctgcctgacttcagaggataccttccagatccgtactccaactggtcagtag

SEQ ID NO: 10342 - DNA, 726 bp, Artificial Sequence
  Description of Artificial Sequence: Synthetic coding sequence
atgtggacggtcaggactgagggaggacacttcccattacactctccaaccttctcctggcgtaacgtggcctttttgctcctgctctcgctggccttggagtggacatccgcaatgcttaccaaaaaaatcaaacataagcctggcctgtgtccaaaggagagactaacatgtacgactgagttaccagattcttgcaatactgacttcgactgtaaggaatatcaaaaatgctgcttctttgcctgccagaagaagtgcatggatccatttcaggagccgtgtatgctcccggtgagacacgggaattgcaaccacgaagcacagcggtggcattttgacttcaagaactatagatgcacccccttcaaatatcgtggatgcgaaggaaacgcgaacaatttcctgaacgaagatgcctgccggaccgcgtgcatgctcattgtgaaggatggccagtgccccctttttcctttcaccgagcgcaaagagtgcccacctagttgtcactctgatattgactgtcctcaaactgacaaatgttgtgagagccgctgcgggttcgtctgcgcacgggcatggactgttaaaaaggggttttgtccacgcaaacccctactgtgcactaaaattgataaaccgaagtgcttgcaggatgaggaatgccctctcgtggagaagtgttgttctcactgtggcctgaagtgtatggacccacgcagatag

SEQ ID NO: 10343 - DNA, 1074 bp, Artificial Sequence
  Description of Artificial Sequence: Synthetic coding sequence
atgagaccaccgccagctctcgccttggcaggcctgtgcctgcttgccttgccagccgctgccgcttcgtacttcgggctgactggaagggaggttttgactccatttcctggattaggaacggcagccgcacccgcacagggtggcgctcacctgaagcagtgcgacctgctcaagttgtcccgacgccagaagcagttgtgtaggagagagccgggactggcagagacccttcgtgacgctgcccacctcgggctcctggagtgtcagttccaattcaggcatgagaggtggaattgctcactcgaagggagaatgggactgctcaagcggggtttcaaggaaaccgcatttttatacgcagtatctagtgccgcacttactcacaccttggccagggcctgttccgccggacggatggagaggtgcacctgcgatgacagtccgggtctggagagccggcaggcgtggcaatggggcgtctgcggggacaacctgaagtacagtacgaaatttctttctaacttcctgggcagtaagaggggtaataaggatcttcgggctagggctgatgctcataacactcacgtaggcattaaggccgtaaaaagcggactgcggaccacttgcaaatgtcacggagtgtcgggatcttgcgcggttcgaacgtgctggaaacagctgtccccgtttagggagactgggcaggttctcaaactcagatacgatagcgcggtgaaagtctcctcagccaccaacgaagccctgggtcgcctggaactttgggcgccagcccgacagggcagcctgacaaaaggattagccccacggtctggcgacctggtctacatggaagacagtccatccttttgtcggccttctaagtattcgccaggtactgcaggacgtgtatgctctcgcgaagcctcttgcagctccttatgctgcggacgtggttacgacactcaaagcaggctcgtcgccttttcctgccactgtcaggtgcaatggtgctgttacgtcgaatgtcagcaatgtgtgcaagaggaattagtttacacctgcaagcattag

SEQ ID NO: 10344 - DNA, 810 bp, Artificial Sequence
  Description of Artificial Sequence: Synthetic coding sequence
atggtgcgttgcctggggcctgcccttctgcttctgctcctgctgggctccgccagctcagttgggggtaaccgttgtgttgatgctgccgaagcctgcaccgctgacgccagatgtcagcgattaaggtccgaatacgtagcacaatgtctggggagagccgcacagggcggttgtcctcgcgcaagatgccggagagcacttaggcgatttttcgcaagaggaccacccgcacttacacacgcattgctcttttgtccttgcgccggtccagcatgcgcggagcgtagaagacaaaccttcgtgccatcttgtgcattctccggaccgggtcccgctccaccaagttgtcttgagccccttaacttctgtgagcgcagccgagtgtgccgccctaggctgcttgcctttcaggtgagttgcacaccagcaccctctgcccctgacggctgcctgctggaccaaggtgctaggtgtcttagagcctacgcaggattggtaggaacagctgtaaccccaaactatgtggacaacgtctcagctcgcgtagctccctggtgcgactgtggtgccagcgggaataggagagaggattgtgaggccttccggggtctgtttactcggaataggtgtcttgatggcgctatacaggccttcgcgagtgggtggccgcctgtgctgctggaccagctcaatccacagggtgaccccgaacacagcttattgcaggtgtcttctaccggtagggccctcgagcggaggagcctcctgagtattcttccggtgttggcgctacctgctcttctgtag

SEQ ID NO: 10345 - DNA, 1728 bp, Artificial Sequence
  Description of Artificial Sequence: Synthetic coding sequence
atgagcggcaattgggtgcacccgggtcagattctcatctgggcaatctgggttctcgcagcccctaccaaaggtccttctgccgaaggcccacagcggaacacaagattggggtggattcagggcaagcaggttacagtgctcggctcccccgtaccagtgaatgtttttcttggtgtcccctttgccgctccccctctcgggagcctgaggttcaccaatccacagccagcctctccgtgggacaatctacgcgaggcgacttcctaccctaacttgtgtctgcagaatagtgaatggcttttgctggatcaacacatgctgaaagtgcattatcctaagttcggtgtatccgaggattgtttgtacctaaacatttatgccccagctcatgcagacaccgggagtaaactcccggtgctggtttggtttcccggtggcgcatttaagactggtagtgcatcgatcttcgatgggtccgctctcgcagcatacgaggacgtcttagtagtggtggtgcagtaccgcctggggatttttggattctttacaacatgggatcaacatgcaccaggaaattgggcctttaaggatcaggtggccgctctgtcctgggtgcagaagaatatagagtttttcggaggagatcccagttctgtgaccattttcggggagagcgcaggcgctatatccgtctcttcactgatcctgtctccgatggccaaggggctgtttcacaaggccattatggagtccggtgtggcaataattccctaccttgaggcccacgactacgaaaaatccgaagacctgcaggtagttgctcatttctgcgggaacaacgcttctgactcagaagctcttctgcggtgtctgagaacaaagccttcaaaggagctccttacactgagtcagaaaactaaatcattcactcgcgtggtcgacggcgcttttttcccaaatgaaccccttgatctactgagccagaaagccttcaaagccatccctagtattattggcgtcaataatcacgagtgtggcttccttctgcctatgaaggaagccccagagatcctgtccggctccaacaagagcttggctctacatctgattcagaacatcctccatatcccacctcagtacctccacctggtcgccaacgagtatttccacgacaaacactccctgactgaaattcgggattcgctgctggaccttctgggggatgtgttcttcgtcgtgcccgctttaattacagccagataccacagggacgcgggagcccctgtatacttttacgaattccgacaccgacctcagtgtttcgaagataccaagccagccttcgtcaaagctgatcacgccgacgaggtcagattcgtttttggtggcgcatttttgaaaggcgacatcgtcatgtttgagggagctactgaggaagaaaagctcctctctcgcaagatgatgaaatactgggcaaccttcgctcggaccggaaaccccaacgggaatgacctctcactatggcctgcctataatctgactgaacaatacctgcagctcgacctgaatatgagtctcggtcagagactgaaagaacctagggtggatttctggactagcacgattcctctgatcctctctgcatctgacatgctccatagccctctgtcaagtctaacgtttctgtccctcctacaacctttcttcttcttttgcgcaccctag

SEQ ID NO: 10346 - DNA, 1026 bp, Artificial Sequence
  Description of Artificial Sequence: Synthetic coding sequence
atgggcacactgccctggctgctagctttcttcatattaggcttgcaagcctgggacacgcctacaatcgtgtcaagaaaggaatggggagcaaggcctttggcctgtcgagccttactgactttacccgtcgcctacatcataaccgatcagctgccagggatgcagtgtcagcagcagtcggtctgtagtcagatgctgcggggtttgcagagccactccgtttacaccatcggctggtgtgacgtggcttataactttcttgtgggagacgatgggcgtgtctatgaaggcgtcggctggaacatccaaggtctccatacacaggggtataacaacatttctctcggtattgcattttttggcaacaagatcggctcttccccttctccagctgcgcttagcgctgcagaaggcctgatctcatacgcaatacaaaaaggacatctcagcccacgctacatacaacctctcctgctgaaggaagagacctgcctcgatccccagcaccctgtgatgcctcgaaaggtctgccctaacattattaagcggtccgcatgggaggcccgagagactcattgtcctaaaatgaatctgcctgcaaagtacgtgataatcatccacacggcaggtacatcctgcaccgtgtctactgattgccagaccgtcgtaaggaatatccagtcattccacatggatacaagaaatttctgcgacatcggttatcatttcttggtgggccaggacgggggagtgtacgaaggcgtcggatggcacattcagggcagccacacatatggttttaatgatatcgcactcggtatagcgtttatcggctacttcgttgaaaagccacccaatgccgctgccttggaagcggcacaggacctgattcagtgcgccgtcgtggaaggatatcttacaccaaattacctgctcatgggtcattccgatgttgtgaatattctgtccccaggccaggcactgtacaacatcattagtacttggcctcacttcaagcattag

SEQ ID NO: 10347 - DNA, 897 bp, Artificial Sequence
  Description of Artificial Sequence: Synthetic coding sequence
atgggcatcgtgtgcgcacaatgttctttcatcctgctgctttccatcattagagctcggccaccaccattcctgttttgtcctttatcctcccagcggactgaatcgccttataaaccagtgcacttgggcctgggaccaaccgataaggttgccgctatagcgatggccaggattatcgacctggttccctgggatgatgggtcaactcacgtatatgccagcccagccattctgctgccgatggaaagacaaaggaatcagctcgctggggtaaaacagcagctgtatcatccagcactccccacactgaggcacatggatcgggataccgtgaaagcgtgtttgcctgacgaacactgtcaatcaacaacgtactgtcggaaagatgaatttgacaatgcccattttacattgttaggagttcccaacaagcccctgcagtgtctggacatcactgcgacgggtcagaagcttcggaatcgatatcatgagggcaaattagcaccaattgccccaggtatcaaccgggtagattggccttgcttcacccgagccatagaggactggagtcatttcgtgtcttcggccggagaatttaagttgccctgcctgagaaaacgggctgagggcctgagtggctatgccgtgaggtaccttaagccagatgtgactcagacgtggaggcaggaagccctgtgtggggcatgggctggacgcccatgttccccagatagcccacggccttatccctgttgccccccacagtactgtctaagtcagaacccctccttagataggtatgggcagaagccgctgccatttgacagtctcaacaccttcaggtctttcggatcctcttatagtcgcgttaactatctgacaccatggcattag

SEQ ID NO: 10348 - DNA, 5798 bp, Artificial Sequence
  Description of Artificial Sequence: Synthetic coding sequence
atggcccctggggctctacgcggagggtgtgaacagcgggctccgggtggtggagccaggactgcagccctgggcccatggccatggccatcacctggtccagccccatcccctggcgctgcgcctcctcggtcgcggaagatgtctggcgctcttttgtggcccctgctgccacttctgttgttgcttctctcggcacgcgacggtgtgcgggcagcacagcctcaagcccctggctatctgattgcagccccatctgttttcagagcaggcgttgaggaggttatcagcgtaacaatttttaactcaccaagagaggtcacagttcaagctcagctggtggcccaaggagagccagtggtgcagtcacagggtgctatcctagataagggcaccattaaacttaaagttccgactggactacgtggccaagccttactcaaagtgtgggggaggggttggcaagccgaggagggtccactattccacaatcagacatcagtcacggtcgatggaaggggcgcttctgtgttcatccagactgataaacctgtgtatcgtccacagcatagagtgctaatctccatatttaccgtgagtcctaacctgcgccctgtcaatgaaaaattggaagcctatatcctggatccacgcggatcccggatgattgaatggcggcacctgaagcctttctgttgtgggatcacgaatatgtcctttccactatccgatcaacccgtgctgggcgaatggtttattttcgtggagatgcaggggcatgcctacaacaagtcgtttgaagtccaaaagtacgtcctgccaaagttcgaactcctaattgatccgcctagatacatccaggatctggatgcatgcgagacgggaacagtcagggcccgatatacatttggtaagcccgtagccggagctctgatgatcaacatgacagtgaatggggttggctattacagccacgaagttggacgtcccgtgctacgtaccacaaagatcctcgggagccgcgactttgacatatgcgtccgagatatgattccagcagacgtcccagaacacttcaggggaagagtctctatctgggcaatggtaacatccgtggatggatcccagcaggtcgcttttgatgatagcactcctgtacagaggcagctcgtcgacatcagatattccaaagacactaggaagcagttcaagcccggtctcgcatatgtgggtaaggtcgagctgtcataccctgatggctctcctgctgaaggagttaccgtccagataaaggcggagctcacccccaaggataatatttatacaagtgaagtggtctcgcagagaggtttggtcggattcgagatcccgtccatcccaacatctgcacaacacgtctggctggagactaaggtcatggctcttaacggcaaaccagtgggcgctcagtacctgccatcatacctctctctggggagttggtacagtcccagccaatgctatctccagttgcagccccctagccatcccttgcaagtgggtgaagaggcttacttctccgtgaagtctacttgcccatgcaactttaccctgtattacgaggtggccgcacgaggcaacatcgtattgtcaggccaacagcctgcccataccacacagcagcgatccaagagggccgctcccgctctggagaaacccattcgcctgacacacttatccgagaccgagcctccgcctgcccctgaagccgaggtcgatgtgtgcgtcacgtctctgcacctcgctgtcacgccatctatggtaccactaggaaggctgctggttttttacgtgagagagaatggggaaggagtggctgatagtctgcaattcgccgtggagacgttcttcgaaaaccaagtgtccgtcacctacagcgccaatgagacgcagccaggcgaggtcgttgacctacggatcagggccgctagagggtcatgtgtatgtgtggctgccgtggataagagcgtctatctgttgaggtcgggtttcaggctgacaccggctcaggtattccaggaactagaagattacgatgtgagcgattcattcggagtgtcacgtgaggacggtccgttttggtgggcgggactaaccgcccaacggaggaggaggagtagcgtgtttccctggccctggggaatcactaaagactccggctttgcctttaccgagaccggcttggtcgttatgacggatcgagtgagtttgaatcatcgtcaggacggagggctgtataccgatgaagctgtgcctgctttccagcctcacaccggctcacttgtggctgtagcacctagtcgacacccgccacgaacagaaaagcggaagcggacctttttccctgagacatggatctggcactgtttgaatataagtgaccccagtggtgagggcaccctctcagtgaaagtgcccgattccataacgtcttgggtgggagaggcagtggcgctgtctacttcgcaaggactcggcatcgctgaacctagtctactgaagacttttaaacccttttttgtcgacttcatgctgccggctctaataattcgaggagagcaggtcaagatcccactctccgtgtacaactacatggggacttgcgccgaggtatacatgaagctctcagttcccaagggcattcagtttgtaggtcacccaggcaaacggcatgtcaccaaaaagatgtgcgtggcccctggagaggccgaacctatctgggtagtgctaagtttcagcgacctgggattgaacaatataacggcaaaggccttagcctatggggacacaaattgctgtagggatggacgctctagcaaacaccctgaggagaatcacgccgacagaagggtccccattggcgtggaccacgtacgcagaagtgtcatggtagaggcggagggcgtgcctcgagcatacacctattcagcttttttttgtccttctgaaagagtccacatcagtaccccgaacaagtacgaattccagtacgtccagcgccctttgaggctcacccgattcgacgtcgccgtgagagcccacaacgatgcacgcgtcgctctctccagcggtccacaggacaccgctggtatgatcgagatcgtactcggtggacaccagaatacccgatcctggattagtacatctaagatgggggagcctgtggccagcgcgcacacagctaagatcctgtcctgggacgaattccgcaccttttggatttcctggagaggaggactcatccaggtcggccatggacccgagccgtctaatgagtccgttatcgtggcctggaccctaccacgtcccccagaggtccagtttatcgggttttcaacagggtggggaagtatgggtgaatttcgtatttggaggaaaatggaggtggacgagtcatacagcgaggcatttactctgggcgtcccacacggcgctatccctggctctgagagagccaccgctagcataattggggacgttatggggccaacccttaaccacttgaataacttgctacggctgcctttcggctgtggcgaacagaatatgatccactttgcccctaacgtcttcgtgctgaagtacctgcagaagacccagcagctaagcccagaggtagagagggagacaaccgattacctggttcagggctatcagaggcagctaacctacaagagacaggatggaagttacagtgcttttggagaacgggacgctagtggtagcatgtggctgaccgccttcgtgcttaaatcgtttgcacaggccagatcttttatcttcgtcgatccaagagagctcgcggcagctaaatcttggattatccagcaacagcaggctgatgggtccttcctcgcagtcggtagggtactgaacaaagacatccaaggtggaatacacggtaccgtgcctctgaccgcctacgtcgtcgtggcattgctggagaccggtaccgcctccgaggaagaacgcggaagtaccgacaaggcaagacacttccttgagtcagccgctccactggccatggatccctactcttgcgccctcaccacgtacgctctaacgttgctcagatctcccgctgcccctgaggctctgaggaaactgcggtcactggctataatgcgggacggtgttacacattggtcactttcaaattcatgggacgtggacaaggggacctttctaagtttttctgaccgggtctctcaatctgttgtgtctgcagaggtggagatgacagcttacgcactcctgacctacacgctcctcggcgacgtcgccgcagctcttcccgtggtgaaatggctgagccagcagcgtaacgccttgggcggtttctcatccacccaggatacctgcgtagctctgcaggcattggcagaatacgccattctttcgtatgcgggtgggatcaatttaaccgtcagtcttgcaagcaccaatctcgactaccaagaaactttcgaacttcatcgcaccaatcagaaagtgctacagacggctgccattccatcactgccgaccggtctgttcgtttccgcaaagggggacggctgctgcctgatgcagatcgatgtaacgtataacgtcccagaccccgtcgctaagccagctttccagctgctggtctccctccaagaaccagaagcacaggggaggcctccgcctatgcccgcaagtgctgccgagggatcacggggtgactggccaccagccgacgatgatgatcctgccgcagaccagcaccaccaggagtacaaggtgatgctggaagtgtgcacaagatggctccacgctggatcctctaatatggcagtcctcgaggtgcctttactctctggttttagggccgacatcgaatccctggagcaacttctgctcgataagcatatgggcatgaagcggtacgaagtcgctgggaggcgcgtcctgttctactttgacgaaatccccagtagatgtctgacctgcgtcaggttccgtgccctgcgggaatgtgttgtgggtcgcacgagcgctctgcctgtcagcgtttacgattattatgaacctgcctttgaagccactaggttctataatgtgtccacccattccccactggcacgcgagctctgtgccggtccagcgtgtaatgaggttgagcgtgccccagcgagaggaccagggtggttccccggagagagcggcccagcggtagctccggaggagggtgccgctatcgcgagatgtggttgtgatcatgattgtggcgctcagggtaatcccgtgtgcggcagcgatggcgtggtgtatgcatccgcttgcagattgcgagaagctgcgtgccgccaggccgctcctctggagcctgctcctccctcttgttgtgccctggagcagagacttccagcatcctcgtcatctacttacggagatgatctcgcttcagtggctccagggcctctacagcaagatgttaaactcaacggcgcaggactcgaggtggaagactccgaccccgaacccgaaggggaggccgaggacagagtgacggccggtcctcgccctcccgtgagctccggaaacctagaatcttccactcagtcagctagcccatttcacaggtgggggcagacaccagccccacagaggcattccggccgtgtagtgggcgcacacaggcccggactgcttagtcccgtgtttgtatactcgccggcattccaaagcggaggtgaagagggcctctggatgagtaatacgtgcaccctgagata

SEQ ID NO: 10349 - DNA, 1209 bp, Artificial Sequence
  Description of Artificial Sequence: Synthetic coding sequence
atggtttgcgccagagctgccctggggccaggagcgctttgggctgcggcatggggcgtgctgctgcttactgcccctgcgggtgcccaaagaggcagaaagaaggtcgtgcatgtgctggaaggtgaaagcggctccgtcgtcgtgcaaactgcaccgggtcaagtggtgagccaccggggtggtacaattgtgcttccctgccggtatcactacgaagcggcagcgcacgggcacgatggcgtgcgcttaaaatggacgaaagtcgtggatccactggcattcactgacgttttcgtggctctcggtccacaacaccgcgcttttggtagttaccggggacgcgcagaactgcagggagacggcccaggtgatgctagcctggttctccgtaatgttaccctccaggattacggacgttatgagtgtgaagttacaaatgagctcgaggacgatgcgggtatggtgaaactggatttggagggtgtggtttttccttaccatccccgaggcggacggtataaactcactttcgcggaggcccaacgcgcttgcgctgagcaagatgggattctcgcatcagctgagcaactccacgctgcttggagggatggtttggactggtgcaacgccggttggttgcgggacggttctgtgcagtacccggtgaatcgccctcgggagccctgcggcggacttgggggtaccgggtccgctggtggaggtggagacgccaatgggggactccgaaattacgggtatcggcacaatgcggaggaaaggtatgacgcattctgttttacgtctaacctaccgggaagagtgttttttcttaagcctctcaggcctgttcctttctccggggcagctcgcgcttgcgccgctcgcggagctgccgtggccaaagtcggccaattgttcgccgcatggaaacttcaactgctggaccgctgcacagcaggttggctcgctgacggaagcgcacggtaccccattgtgaatcctcgggctaggtgcggtgggcgtagacccggagtccgctcactgggatttccagacgccacacggcgtttgttcggagtttactgttaccgagccccaggcgcaccggacccagccccaggtgggtggggatgggggtgggctggaggcggagggtgggccggtggcgctagagatccagctgcatggacccccctacacgtatag

SEQ ID NO: 10350 - DNA, 1740 bp, Artificial Sequence
  Description of Artificial Sequence: Synthetic coding sequence
atgtccgctttgcggcctctgctgctgcttctgttgccactttgtccaggcccaggccctggacctgggagcgaggctaaagtgacgaggtcttgtgctgaaacccgccaggtcttaggcgcaagaggatattccttgaatctgatccctcccgctctcatctccggagagcatctaagggtgtgtcctcaggagtatacatgctgtagcagtgaaacagaacagaggctgatccgagaaactgaggccacctttagggggttggtggaggacagtggttctttcttagttcatactctcgccgcacgccataggaaattcgacgaattctttttagaaatgctgtccgtcgctcagcattcgcttactcagcttttttctcactcatacggtagactgtatgcccaacacgcactgatcttcaatggactattcagtcggctgagagatttctacggggagtctggggaaggcctggacgacaccctggctgacttctgggcccagctcctcgaaagagtctttccactcctgcacccccagtactctttcccccctgactacttgctgtgtctgtcacgcttagctagtagtacggacggaagcctgcagcctttcggagatagtccacgcaggctgagactgcaaatcaccagaaccctcgtggctgctcgcgcatttgttcagggcttggagactgggaggaacgttgtgtctgaagcccttaaagtgccggtctctgagggttgttctcaagccctgatgcgacttattggatgccctctgtgtcgcggagtcccctctctcatgccttgccaaggcttctgcctgaacgtggtgaggggttgtctgtcatctcggggactggagccagattggggcaactaccttgatggccttctcatcttagccgataaactgcagggacccttctcattcgaactcacagccgagagcatcggagttaaaatctcagagggcctgatgtatctgcaggagaactccgccaaagtgagtgcccaggtctttcaggagtgtggccctcctgatcccgtgcccgcaaggaaccggcgagccccaccacccagagaagaagccggaaggctgtggtctatggtgacagaagaggagcgccctacaaccgccgctggcacaaatctgcaccggctggtctgggagctgcgggagagactggctcggatgcgaggtttctgggcgagactgtctttgacggtctgcggggattctcgaatggctgcggacgcctcactagaggccgcaccttgttggaccggagccggtagaggacgttacctgccacccgtggtcggcggtagtccggctgaacaagtgaataatcctgagctaaaagtggatgcttccggcccagatgttcctacccggaggagacggctgcagctcagagccgcaacggcgagaatgaagacagccgcactcggtcatgatctggacggtcaggatgcagatgaggacgcaagcggctctgggggtgggcagcagtatgcagacgactggatggcaggcgctgtggccccacctgcaagaccccctagaccaccgtaccccccaaggagagacggctccgggggtaagggaggcggaggttctgccagatataaccaaggccgttcccggtccggtggggcttctatcgggtttcacacacagaccatcctgatccttagcctcagcgcgctggccttgctgggcccacgttag

SEQ ID NO: 10351 - DNA, 498 bp, Artificial Sequence
  Description of Artificial Sequence: Synthetic coding sequence
atggccctgctggccctgcttttggtcgtagccctcccgagagtgtggacagatgctaatctcaccgcgaggcagcgcgatccagaagactctcagaggaccgacgaaggtgataatcgggtatggtgtcatgtgtgcgaacgggaaaataccttcgagtgtcagaatccgaggcgatgtaaatggacggaaccttactgtgttatcgccgctgttaagatttttccgaggttttttatggtcgccaagcaatgctccgccggatgtgcagccatggaacgacctaagcctgaggagaaacggtttttactggaggaaccgatgccttttttctacctcaagtgttgtaagatccgttactgtaacttggaagggccacccatcaattcctcggtcttcaaggagtacgctggaagcatgggagaatcatgtggcggactgtggcttgccattctactgttgctggcttccattgcggctggcctcagcttgagctag

SEQ ID NO: 10352 - DNA, 933 bp, Artificial Sequence
  Description of Artificial Sequence: Synthetic coding sequence
atgaatggactgtctctgagcgaactctgctgcttgttttgctgccctccatgccctggcagaatcgctgctaaactggcttttttgccaccagaggctacctacagcctggtcccagagcccgaacctggcccaggcggagctggtgcagcccctctcggcacgcttcgagcatcttccggggcacccggtcggtggaaactgcacctgaccgagcgagcagactttcaatattctcagcgtgaactggacacaattgaggtgttcccaacaaagagtgccagaggcaatagagtgtcttgcatgtacgttaggtgcgttccaggcgctcgttacacagtactctttagtcatggtaacgctgtggatctgggccaaatgtccagtttctacataggcttaggctcaaggctacactgcaatattttctcctacgattattctggatatggcgctagtagtggcagacctagcgaacggaatctctacgcggatatcgatgccgcttggcaggcgctgcgcacacggtacggaatctcccctgatagcatcattctgtacggacaaagtattggcaccgttcccacagtggaccttgcgtcccgctatgagtgcgccgctgtggttctgcacagccctttaacctccggcatgcgggtggcgttccccgacaccaagaagacatactgctttgacgctttcccaaatattgaaaaggtcagcaagataacctctcccgtactgattattcatgggactgaggatgaggttatagacttttcccacggcctggcactatatgagaggtgcccgaaagccgtggagcccctgtgggtagagggagccggtcacaacgatatcgagttgtatagtcagtatctggaacggctgcgccgattcattagtcaggagctgccttctcagagagcctag

SEQ ID NO: 10353 - DNA, 1905 bp, Artificial Sequence
  Description of Artificial Sequence: Synthetic coding sequence
atggcgcaaggcgtgttatggatactgctgggtctgttgctgtggtcagatcctggtaccgcaagcttgcctctcttaatggacagtgtcatccaagctttggcagaactggaacagaaggtgccggcagccaaaacacggcacaccgcctcagcatggctgatgagcgccccaaattcaggaccacacaataggctatatcacttcttgctcggagcttggagcctgaacgctacggagctcgacccctgccccctgagccctgaactcctggggttgacaaaagaagttgcgagacatgacgtccgcgaggggaaagagtacggggtagtgctggcgccagatggctcgacggtcgcagtggagccgctgttggccggtttggaggcaggccttcaaggtaggcgagtgattaatttgcccctggactctatggcagccccatgggaaacgggggacacttttcctgacgtggtagcaattgcaccagatgtgagggccacgagctcccccggtctgagggatgggagccctgatgtgacaactgcggacataggagcaaacacccctgatgccacaaagggatgtcctgatgttcaagctagtctgcctgatgcaaaggcaaagtctccccctacaatggtggatagcctgctggcggtgactcttgctggcaacctggggctgacctttctgagaggctcacagactcagtcgcatcccgacctggggaccgagggatgctgggaccagctgtctgctccaaggaccttcacgcttctcgatcccaaagcaagcctcctgaccatggcattcctgaatggagccctggacggtgtgatactgggcgattacctgtcccggaccccagagccccgacctagcctgtcacacctgctgagccagtactatggagccggagttgcacgggatccgggattccgatccaatttcagaaggcagaacggtgctgcactcacttcagccagcattctggcccagcaggtatggggcacactggttctcctgcaacgtctggaaccggtgcatctccagctccagtgtatgtcccaggaacagctcgcacaggtggccgctaacgctacgaaggagtttaccgaagcgttcctagggtgcccagctatccaccccaggtgtagatggggcgcagccccataccggggacggccaaagctcctgcaactgccgctgggattcctgtacgtccaccatacttacgttcctgctccaccctgcactgacttcactaggtgtgcggctaatatgagatccatgcagaggtatcatcaagatacccaaggatggggggatattggatactcctttgtggtggggagcgatggctacgtgtacgagggcagaggctggcattgggtgggggctcacactctcggacacaacagcagggggtttggcgtggccatagttggtaattacaccgcggctttgcctacagaggccgcactcaggaccgtcagggatactctgccgtcatgtgccgtcagagctggcctgctccgtcctgactacgctttactcgggcatcgccagctagtgcgcactgactgccccggtgacgctttgttcgatctgctccgcacatggcctcacttcacagcggtgtcgctgaggtcgctgcactacacagcccgacgaccgagtgtgtacacgtcatccacgcgcccactcccgcctgcttgcaatagctgcgccaggacagcctccgccagaccaccaacttcccggagacatgtatacagtggaaacctggggcctgcattcgccggacattccgcgggaaacatacccgatccagtaacatcggcctacgctgcctcggcccagcctcagacccaaccagcttgcccattcccttcctcatag

SEQ ID NO: 10354 - DNA, 777 bp, Artificial Sequence
  Description of Artificial Sequence: Synthetic coding sequence
atgctggtgttgtacggacatagtacacaggacctgcccgagaccaatgcccgtgtggttggcggtacagaggcaggacgcaactcttggcctagccagataagtttgcagtaccgatccgggggatctcggtaccacacatgtgggggaactctcatccggcagaactgggtcatgacggctgcccactgtgtggactatcagaagacttttagagtcgttgccggagaccacaacctgtcccaaaatgacggcacagaacagtatgtgtctgtccagaagatcgtcgtccatccctactggaacagcgataatgttgctgcgggttacgatattgccctcttgcggcttgcgcagtctgtaacgcttaattcatacgtgcaactgggtgtcttgccacaagaaggagctatactggccaataatagtccttgttatatcacgggctggggcaagaccaaaacaaatggtcagctggcacagactctgcagcaggcttacctacccagcgtcgactatgccatctgctctagtagtagctactggggatccacagttaagaatacgatggtgtgcgccggaggcgatggtgtcagatcgggctgccagggcgactccggtgggcctctccattgtctggtgaacggcaaatacagcgtgcacggggtgacgagcttcgtttcctcaagaggttgcaatgtgagtcgcaagcccacagtcttcacccaggtgagcgcatatatctcctggattaataacgtcatagcatcgaattag

SEQ ID NO: 10355 - DNA, 993 bp, Artificial Sequence
  Description of Artificial Sequence: Synthetic coding sequence
atggctgctcggaggtctcagcgcagacgcggtcgtcgcggagagccagggacagcactgttggtcccccttgctctcggactcggactagctctggcctgcctcggattgttgctggctgtcgtctctcttggttccagggcatccctctcagcgcaggagcctgcacaggaggagttagtggctgaagaggaccaggacccctctgaacttaatcctcagaccgaggagtcacaggatccggcacccttcttgaatagactggtgcgccctagacggtccgccccaaagggccgaaaaacccgggctaggagagctattgcagcccactatgaggtccacccccgtcctggacaagatggagcacaagctggagtcgacgggacagtgtccggttgggaagaggctagaataaattcatcatcacctctgcggtataacagacagataggagaattcatcgttacccgagccggattgtactatctatactgtcagtctagtgatgccttagaggcctgggagaacggcgagaggtcccgaaagcggagagccgttttaacgcagaagcagaaaaagcagcattctgtactgcatcttgtgcctatcaatgcgacctcgaaggacgacagcgacgttaccgaagtcatgtggcagccagcccttagaaggggtagaggtctgcaagcccagggctacggcgtgcgtattcaggacgcaggcgtgtacctcttgtactcccaagtactcttccaggatgtgaccttcactatggggcaggtggttagcagggaaggtcagggccgacaggaaaccctgtttcgttgtatacgctccatgccaagccaccccgatagggcctacaattcttgctatagcgctggggtctttcacctacatcagggcgacatcctcagtgtcattattccacgggctcgggctaaattgaacttgtccccccacggaacattcctggggttcgtgaaattgtag

SEQ ID NO: 10356 - DNA, 2253 bp, Artificial Sequence
  Description of Artificial Sequence: Synthetic coding sequence
atggcgaagcctaggctgctcgtgctttatttcgctctcatagtggtgccggcttgggtgtcaagcatagtcctgaccggcacctctgagccaccagacgcccaaacagtagcaccagctgaagatgagacgctgcaaaacgaagctgacaaccaagagaacgtgttgtcccaactactcggagattacgacaaggtgaaagctatgtcggagggttccgactgccaatgcaagtgtgttgtgaggcccctgggcagagatgcgtgccaacgaatcaacgctggagcatctcgcaaggaggatttttataccgtggaaactataaccagcggcagttcttgcaaatgtgcatgtgtggccccaccaagcgcccttaatccctgtgaaggtgatttcaggctgcagaagctgagagaggctgacagccaggaccttaagttgagcaccatcattgatatgctggagggcgcattctatggcctggacttgctcaagttgcactctgttacaaccaagttagtcgggagggtcgacaaattagaagaggaagtcagcaaaaacctcaccaaggagaatgagcaaatcaaggaggatatggaggagatccgcactgaaatgaataagcggggaaaggaaaattgctctgagaatatactcgattctatgccagatatccgctcagctttgcagcgggatgctgcagccgcttacgcacatcctgagtatgaggagcgcttcctgcaggaagaaacggtgagccagcaaatcaattctattgagctgctccagacaagacctctggccctaccagaggtcgtgaagtctcagcgaccacttcagcggcaggtgcacctgcggggtagaccagcctctcagccgacagttatccggggaatcacctactacaaggccaaggtgtctgaggaggaaaacgacatcgaggagcagcaggacgagttcttcagtggcgataatggagtagatcttctcatcgaagatcaattgcttaggcataacggtctcatgacatctgttacgcgccgtcccgcagccacgaggcaaggccatagtaccgcggtcacctctgacctaaacgctcgcacagctccatggtcctcagcactgccccagccttcgacctctgacccctccattgccaatcacgctagcgttggtcccactttgcaaaccaccagtgtgagcccagatcccacccgtgaatccgtcttacagccatctccacaggttccagccactacagtggcccatacagctacccaacagcctgctgcccctgccccaccagccgtgagcccaagggaggccctaatggaagcaatgcacacagtgccagtccccccaaccaccgtgagaaccgattcacttggaaaagatgctcctgcgggatggggcacaacccctgcaagtccaaccttgagtcctgaggaagaagacgacatcaggaacgtgattggcaggtgcaaagatacactctccacaattacaggccctacaacgcagaacacttacggacgtaatgagggcgcatggatgaaagatcctctggctaaagacgagcggatctacgtgaccaactattactacggaaatacactcgttgaatttagaaacttagaaaatttcaagcaaggcagatggagtaactcttataagctgccttatagctggatcggcacaggtcatgtggtttataatggagcattctattacaatagagcctttactcgcaatatcatcaagtatgatctcaagcagcggtatgttgcagcatgggccatgctccacgacgtggcatacgaggaagccacaccttggcggtggcagggtcactctgatgttgatttcgccgtggacgagaacggcctgtggctcatatacccggcactcgacgacgagggcttctctcaggaggtcatcgtactgtccaaattaaacgcggctgacctgagcacacaaaaggaaactacttggagaacaggcctgcgtcgcaacttttatggaaattgtttcgtcatctgcggggtcctttacgctgtggatagctacaaccagcgtaacgctaatatctcctatgcttttgatacacataccaatactcagattgttcctaggctgcttttcgagaatgagtactcctacactactcaaatcgactataacccaaaagaccgacttctgtatgcatgggacaatggacatcaggttacctaccacgtgatcttcgcatattag

SEQ ID NO: 10357 - DNA, 678 bp, Artificial Sequence
  Description of Artificial Sequence: Synthetic coding sequence
atgaagctgggctgcgtgctgatggcatgggcgttgtacctgtctctcggtgtgctgtgggtagcccaaatgttgctcgccgctggctgtcatgctgagctgttccccgcacccatactccgggcagtgccctcagccgaacctcaagcagggtcacccatgacactctcatgtcagaccaaacttccgttgcagcgaagcgccgctcgtctgctgttcagtttctataaggacgggaggattgtccagtcacgcggactgagctctgaattccagattcctacagcctccgaagaccattctggctcttactggtgcgaagcggctacagaagacaatcaggtctggaaacagagtccccaattggaaatcagagttcaaggagcaagctccagtgctgctcccccaaccctgaatccggcaccccaaaaatctgcggcaccaggtacagcacccgaggaagcaccaggacctttaccaccaccccctacccccagctctgaggaccctggtttcagctcaccactcggcatgccggacccgcacttgtaccaccagatgggtctactcctgaagcacatgcaggacgtgcgggtgctcctggggcacttactgatggaactgcgagagctttccggtcataggaagcccggtactacaaaggctaccgccgaatag

SEQ ID NO: 10358 - DNA, 891 bp, Artificial Sequence
  Description of Artificial Sequence: Synthetic coding sequence
atgagccgtcaggagccaaagatgttcgtgctcctctatgtgacatctttcgcaatctgcgcttccggacaaccaagaggcaatcagctgaaaggcgagaattacagtcccagatatatttgtagcatacccggtctccctggccctccagggccacccggagctaatggatcacctgggccacatgggcgaattggcttgcccggaagggacggaagggacggcaggaagggcgagaagggcgagaaaggaacagcgggtttaaggggtaagaccggacccttaggactagccggagagaaaggagaccagggagagactggaaaaaagggaccaatcggccctgagggggaaaagggcgaagtgggccctattggacctccgggacctaagggtgacaggggagagcagggggaccctggcctgcccggtgtctgccggtgcggctccatcgtccttaaaagcgccttcagcgtcgggatcacaacatcatatccagaggaacggctcccaattatttttaataaggttctctttaatgagggcgaacactacaaccccgctacgggaaagttcatctgtgcctttccagggatctattatttttcttatgatattacgctggcaaacaagcaccttgccattggactggtgcataatggtcagtaccggatcaaaaccttcgacgccaatacgggcaatcacgacgtggccagcgggagcacagtgatatatctgcagccagaggatgaggtgtggttagaaatcttctttactgaccagaacggtctattttcggatcctggttgggctgactctctgttcagtggcttcctgctttatgtcgacacggactatttagactccattagcgaggatgatgaactgtag

SEQ ID NO: 10359 - DNA, 1275 bp, Artificial Sequence
  Description of Artificial Sequence: Synthetic coding sequence
atgggcagcctcgtcctcactctttgtgctcttttctgcctggccgcatacctcgtgagtggctcccctatcatgaacctcgagcaaagcccattggaggaagatatgtctctctttggggatgtgttttcagagcaagatggggtcgacttcaacactctgctccaaagcatgaaggacgaatttctgaagactctgaacctgtctgatattcccacccaggattcagccaaagtggatcccccagaatatatgttagagttgtataacaagttcgctactgacagaactagcatgccaagtgcgaatatcattcgaagcttcaagaacgaggacctgttttctcagcctgtaagctttaatggactgagaaagtaccccctgctgtttaatgtcagcatccctcaccacgaagaagtcattatggcggaactgcgactctacacactggtccaaagagataggatgatctacgatggagtcgacaggaaaattacgatctttgaggtgctagaatccaagggggacaacgaaggagagcgcaacatgctggtgttggtgagcggtgagatatacggcaccaacagtgaatgggagacttttgatgttacagatgccatcaggcgctggcagaagtctgggtcctcgacccaccagttggaggtccacattgagagcaagcatgacgaggcggaagacgccagctccggccgtctcgaaatcgacaccagtgcgcagaataaacacaaccccctcttgattgtgtttagtgacgatcagtcctccgataaagaacgcaaagaggagctcaatgagatgatctcacacgagcagttgccggagctagataatttggggctcgattccttcagctcaggaccaggggaggaggccctgttgcagatgcggtcaaatataatttatgatagtacagccaggatacggcgtaatgccaagggaaattactgcaagcggacacccctctatatcgactttaaggagatcggatgggatagctggataatcgcccctcctggctacgaggcctacgagtgccgaggtgtctgcaactaccccctcgcagaacacctcactcctactaagcacgccattatccaggctcttgtgcacttaaaaaactcccagaaagcatcaaaagcctgttgcgtgccaaccaagcttgagcccatttcgattctctacctggataagggcgtggtcacctacaaatttaagtatgaaggaatggccgtgtctgaatgtggctgtcggtag

SEQ ID NO: 10360 - DNA, 381 bp, Artificial Sequence
  Description of Artificial Sequence: Synthetic coding sequence
atgcacctgtcacagttattggcctgtgccctgctcctgactctcctgtcgctgcggccaagcgaagccaaacctggagcccctcctaaagttcctaggacaccccctgccgaagagctggcggaaccacaggctgcgggagggggtcagaagaaaggggacaaggctcccggtggaggtggcgcaaacctgaaaggcgaccgatcacggctgcttcgcgacctgcgggtagacacgaaaagtcgcgcagcttgggccaggctgctgcaggagcaccctaacgcaaggaagtataaaggagctaataaaaagggcctgtcaaaggggtgtttcggcttgaagctggacagaatcggctctatgtcaggtttgggctgttag

SEQ ID NO: 10361 - DNA, 423 bp, Artificial Sequence
  Description of Artificial Sequence: Synthetic coding sequence
atgagatccccaagaatgagagtgtgcgccaagtctgtcctgctttctcattggctgtttctggcttatgtcctaatggtgtgctgcaagctgatgagtgcttcaagccagcatctgagagggcacgccggtcaccatcagatcaagcaagggacatgtgaagtggtggctgttcaccggtgctgtaataaaaatcggattgaggagaggtcccagacagtgaagtgtagctgcttccccggtcaagttgccggaaccacaagggcccaaccgtcctgtgtggaggcttctatcgtgattcaaaagtggtggtgccatatgaacccatgcctggagggcgaagattgtaaagttttgcccgactacagtggatggtcctgttcctccggaaataaggtgaagactactaaggtaacacggtag

SEQ ID NO: 10362 - DNA, 1332 bp, Artificial Sequence
  Description of Artificial Sequence: Synthetic coding sequence
atgcttatgctgtttgtttttggtgtgctgctgcacgaagtcagtctgagcggacaaaatgaggcgccacctaacacacactccatccccggagagccgctgtacaattacgcctccatacgcctgcctgaggagcatatccccttcttcctacacaataatcgccatatagcaacggtttgtaggaaagattccctgtgtccttacaaaaagcaccttgagaagctaaagtattgttggggctacgagaaaagttgtaagcccgaattcagatttggatatcccgtttgctcctatgtcgacatgggttggacagataccctcgagagtgctgaagacatattctggaagcaggctgatttcggctacgcccgagagcgtcttgaggagatgcatgtgctgtgccaacccaaggagactagcgactcaagtctcgtgtgctctcgctatctgcagtactgcagagcaactaatctctacctggatttgcgcaatatcaagaggaaccatgatagatttaaagaagacttttttcaatctggcgaaatcggaggccactgtaagctcgatatcaggaccctgacctctgaaggccagcgcaagtcacctctccagagctggttcgccgagttacaatcctacacccagcttaattttcggcctatcgaagatgccaagtgtgacattgtcattgaaaagcctacttacttcatgaagttggatgccggtgttaacatgtaccatcacttttgtgatttcataaatctctatattacgcaacatgtaaacaacagcttctcaactgatgtgtatattgtcatgtgggacaccgatggcaaaattagggtgacaatccttgctcgaagtactgaatatcgaaaaatccttaaccagaacgagctcgtgaacgcgctcaagactgtgtctactttcgaagtgcaaattgtggactacaagtatcgagagttgggttttctggaccaactgaggatcacgcataacactgatatcttcattggaatgcatggtgccggacttacccacctactgtttctgcccgattgggctgccgtttttgaactgtataattgcgaggacgagagatgctaccttgacctggcgcgactgcgtggtgttcactacataacttggcgcagacagaacaaagtattccctcaggataaaggccaccaccccacactgggagagcatcctaagtttacgaactactcattcgacgtggaggagttcatgtacttagtactgcaagctgccgatcacgtgctccagcacccaaaatggcccttcaagaagaaacatgacgagctgtag

SEQ ID NO: 10363 - DNA, 336 bp, Artificial Sequence
  Description of Artificial Sequence: Synthetic coding sequence
atggggccatcttcttgtctgctgctgattctgatcccactactgcagctcattaacccaggaagtacacaatgcagccttgacagtgtgatggacaaaaagattaaggatgtgttaaacagcctggagtatagccctagccctatttcaaaaaagctgtcctgtgctagcgtgaaaagtcaagggaggccatcttcttgtccagcgggaatggccgtaacaggatgtgcctgtggttatgggtgtggtagctgggatgtgcaactggagaccacctgtcattgccagtgctctgtggtggactggactacagccagatgttgccatctgacctag

SEQ ID NO: 10364 - DNA, 1965 bp, Artificial Sequence
  Description of Artificial Sequence: Synthetic coding sequence
atggccccaaagaagctgtcatgtttgagatctctgctactgccgctgagtctgaccctgcttctgcctcaagcagatacacgaagctttgtggttgaccgaggacatgacaggttcctattggacggcgcaccatttcggtatgtatcgggctctctccattattttagagtgccaagggttttgtgggctgatcgtctactcaagatgaggtggagtggcctgaacgccatccagttctacgtgccgtggaattaccatgagccacagccaggagtgtacaacttcaatggttcccgcgaccttatcgccttcctaaatgaggccgcactggccaatctcctcgtaatacttagacccggtccctatatatgtgccgagtgggaaatgggaggtctcccttcttggctgctgcgtaagcccgaaattcatctgcgaacctcagatccggatttcctcgctgctgtggattcctggtttaaagtgctcctgcccaagatctacccatggttgtaccacaatggcggaaatatcatcagtatccaggtggaaaatgagtacggctcctatcgcgcatgcgattttagctatatgcgccacctggcaggactgttccgcgcactgctgggcgaaaaaattctgctcttcactaccgacggtccagaaggtctgaaatgcggaagcctccgaggactgtacacaactgtcgacttcgggcctgcagacaatatgaccaaaatcttcactctgctcaggaaatatgagccacacggccctcttgtcaactccgagtactacaccggctggttagactactggggccagaatcacagcaccagaagcgtgtcagcggtgacaaaagggctggagaatatgcttaagctgggggcaagcgtgaacatgtatatgtttcacggcggtacaaatttcggatattggaacggtgcagacaagaaggggaggttccttcctataactacctcttacgattacgatgcccctatctccgaggccggagatcccacaccaaagctctttgcacttcgggacgttataagcaagtttcaggaggtgcctctcggcccactgcctccaccatcccccaagatgatgctaggaccggtgacccttcatctggtggggcacctgctcgcctttctcgatcttctttgtcctagaggtcccatccactccatcttgcccatgacgttcgaggctgtgaagcaagatcacggatttatgctatacaggacatatatgacgcacacaatttttgagcctacacccttctgggtgcctaacaatggggtgcatgatcgggcttatgttatggtagatggggtgtttcagggagttgtcgagcgcaacatgagggataagctcttcctaacaggaaaattgggttcaaaactggatatcttggtggaaaatatgggacgattatctttcggctcaaactcttctgactttaagggtctgctgaagccccctattctcggccagaccatcctgacgcagtggatgatgttcccccttaagattgacaatttagtgaaatggtggttccccctgcagctgcccaagtggccttatcctcaggccccttctggcccaacgttttatagcaaaacctttcctattctgggttcggtaggagacaccttcctgtacctgccgggatggaccaagggccaggtatggataaacgggttcaacctgggaaggtattggacaaaacaggggccacagcagacactctatgttccacggttccttttattccctcggggagccctgaacaaaatcactttgcttgagctggaggatgtaccgctacagcctcaggtacagttcctggataagcccatactgaacagcacaagcaccctgcatcggacgcacattaattctcttagcgccgacacactttctgctagcgagcctatggagctgtcaggccactag

SEQ ID NO: 10365 - DNA, 2502 bp, Artificial Sequence
  Description of Artificial Sequence: Synthetic coding sequence
atgaatatggaaatcggccacccccatgagggaaaagacgatcttggtgacaaaagagtgattatgggcaccaaatttccaatggagttaggaatccgagtaggcctgggaaaggaggactcacgttgtggggaaagtcctgtggtgagcaacaaatgcgagggaagaatggctcctccggaaacaaagttccccttatccaaaggtctggaaatgggcctcgagaggcagaatatctcccggacagtcatgcaaagaggatccctcggcgtggacagcgtcagcgcttcacagggtacaaagcccagtttgcttcctggacggatgggactcgaaaatgagtcactgctggcaggttacactcacgagcgaatcattcaaccccctctggggagggtctgtggaagttctcaggccgcagggagtagacgagccccacttgcaagcggtcccgaaggcgtggaagaactggtggggaagccagcttttgttatggagccaagacaagaaatggagaaagaaagcacctgtgtgctcatgaaaccaaacaccgagatcaaactgcctgtggaagtcgacattgggctgacccaggcagaagggcctgatgaaactaaaaatactgaaccacagatgggtctggttatcgagccacctcaatgccagtttgcacagcagcatgaacagaggaaggaagctggcaatattgagtcaggagttgagccgccagataggatccggccaatttatagtggaaaattcttcgaccggactccatgttggccctcagccggaaaagtgatccctgtgggttatagagtcgcaacgtgtttaacggaaaagctgccaaggctgatcacgccccctgaggccaaaaagtatttcaacttccggtacccaccggctggagtcgaaagggttttttatggcagagccaacgacccacagatcgcgccttacctcactcatgggatccgctccaaaatttccgtgctggccaacacgctgatcaaccctcagccaatcacaacttttcagcagaaaataaaggataagaaagagagtatttatctgagcaaccgcagggccccactaggtaagtctcacgaccaagcaccagggttgcccaagggtatggatactactaataccacgtttggcacggcagtgattaaggagtacagcgcaaaggatgtggttaacccgccaaagtcctacgaggaggtcttcaaggagggaaatgagggacacgatctgtatgtggtgtctcacaatgattattatgcaggagaggccaagaataggaaatacaatccatcctcattccaccgttgctctgtgtatggggtgcctacccctcattttaacgatggacgggctatggcaaagtctctttattggctgcatgagctgcaaatgaaaagaggagccaagtttgtaagcaagcgagcagacgatttcaaggagaagttccaacacaagctgggccgtgtgctggacccaatcgcagagactatgaatgtgccaccagactgcacattcggagcatgcttacgacctgaggagtacggagttggagatcttatccacaataggcttcccgatgagtatctgaggggcaaggaccgccagcgcgcactgatagccgcagtgcgccatcacctgaaaaaagtcaattaccagaagttcgacaccttactggctgcgtttaggcactacgacaagaagggcgacggaatgatagacaaggacgagctccaggaagcatgtgaccaggcgaatctgtccttagacgataaactgctggatcagctgttcgactactgtgatgttgacaacgatgggttcattaactatctggagtttgccaatttcttgaattggaaggacaagatgttacttaaagaatacgaggagagagtgatcataaaaggccgaaaaccagactgtgtgaacccaactgaagccaacgtggaagagccagagcaaactctgctgattaaaccagaggacatagtcctgaaggaggccggatcgacagaaaagactttgcgcacccttttacggccatctgataaggtcagtaattattataagaccacttcctcggaaattaacgcaattgtaggagccattccttcaacttgctatccaatctgcggggtccctacaatccggtcagatatccctgcccctcgcatcagaagaataagcgaccgtacgaactatggcgaagaagggagcgcatactctctcttgtacccaactatctttgcaaggaagggcgtgtttgaaagggactttttcaagacgagatcgaaggaagagattgccgaaattctgtgcaatatcggagttaaattatctgatgaggagttcgaaaacgtctggaatctggctagtaaaaagcatcatagaggggaagtgtgcgtcgaaaatattcgaaacgtcctcgacgaacttaggcacgcagatagaatcaaatgtaagaccctgatgtag

SEQ ID NO: 10366 - DNA, 2004 bp, Artificial Sequence
  Description of Artificial Sequence: Synthetic coding sequence
atgggatcctcccgtctggccgcactgctcttgcctctgctactgatcgtgatcgacttgagcgactctgcaggtatcgggtttagacacctcccgcattggaacacgaggtgcccactcgcttcccacactgatgactccttcacgggaagctctgcgtacatcccatgtcggacctggtgggccctcttttctaccaagccatggtgtgtccgcgtttggcattgcagccgctgtctatgccagcatctgctcagtggcggaagcgggcttcagagaggcctctttcatcttctggtccagaagtccaagaagtcttcgacctttaagttttaccggaggcataagatgcccgcaccggctcagcgcaaactgttacctcgccgtcatctcagcgagaagagccaccacatttctatccccagccccgatatctcgcataaaggcctgagatctaaacggacacagccctccgaccctgagacatgggaatctctccctcgactggattcccaacgccatggaggcccagagttctccttcgatcttctgcctgaggctcgcgcaatccgggtgaccatatcatctggcccagaagtcagtgtccgattgtgccatcagtgggcgctcgaatgcgaagagctcagctctccctacgatgtccagaaaatcgtctccggtggccatactgtggagctaccgtacgagttcctcctgccatgtctgtgtatcgaagccagttacttacaggaggacactgtacggcgtaagaagtgcccgttccagagctggccagaggcctatgggagtgacttttggaaaagcgttcattttaccgactatagtcaacatacccagatggtgatggccttaaccttacgttgtccgctgaagctggaggcagcactctgccaaaggcatgactggcacaccctatgtaaggacttgcctaatgctacagctagagagagcgatgggtggtacgtcttggaaaaggtggatctccatccccaactatgtttcaagttcagctttggcaactcctcccacgttgagtgtcctcaccagacgggatctctgactagctggaacgtgtccatggatacccaggctcagcagctgatcttgcacttcagtagcaggatgcatgccacattctccgccgcttggtccctgccaggcctcggacaggacaccctggtgcctccagtgtacactgtaagccaagctcgcggtagctcacctgtctcactggaccttatcattccgttcttgaggcctggatgctgcgtgctcgtttggcgatctgatgtgcagtttgcctggaagcatcttttgtgccctgatgtatcttaccggcacctgggactgctcattcttgctctgttagctctattgaccctcctgggtgtggtgttagctttgacttgccggaggcctcagtcagggccagggcctgctcggcctgtgcttctcttgcacgcagctgatagcgaagcccagcgcaggcttgtcggcgcactggctgagctattgagagctgccctcggcggtggccgtgatgtaattgtggacctctgggagggtcgccacgtagccagggtgggtcccctgccgtggttatgggctgctcgtacaagggtggccagagaacagggtacagtgttgctgctgtggtctggagccgatttaagaccggtgtcaggaccagaccctagggctgcgcctttgctggccctcttacacgccgctcctcgacctctgctgctcttggcctatttttccagactctgtgcgaagggagatatcccaccgccactgagggcgctgccgagataccgcctgctccgagatttaccacggttgttgagggcactggacgctagaccattcgcagaggcgacatcgtggggcaggctgggtgccagacaaagacggcagagccgactggagctgtgttcacggctggagagagaggctgcaagactagccgaccttggatag

SEQ ID NO: 10367 - DNA, 609 bp, Artificial Sequence
  Description of Artificial Sequence: Synthetic coding sequence
atggagctgtggggcgcttatttgttactgtgcctgttttccctgttgacacaggtgaccaccgagccccctactcaaaaacctaaaaaaatagtgaatgccaagaaggatgtggtgaataccaagatgtttgaggagctcaaaagtcggctagacaccctggcccaggaagtcgccctcctaaaagagcagcaggccctgcaaactgtgtgcctgaaaggtaccaaagtgcatatgaaatgctttctagcattcacccaaaccaaaacttttcacgaggcctctgaggactgcatctctaggggcggaacgctggggactccccagaccggaagcgagaacgatgctctgtacgagtatcttagacagtctgtggggaacgaagctgaaatttggctcggactaaacgatatggcagccgagggcacctgggttgatatgaccggagctcgaattgcttataagaactgggagacggagatcacagcacagcccgacgggggaaagaccgaaaattgcgcagtcttgtctggcgcagctaatggaaaatggtttgataagcgctgccgggatcagctgccgtatatttgccagtttggaatagtctag

SEQ ID NO: 10368 - DNA, 1839 bp, Artificial Sequence
  Description of Artificial Sequence: Synthetic coding sequence
atgctcgaaggtcttggatcgcccgcaagcccaagggccgcagcatcagcaagcgttgctggaagttccggccctgctgcctgctctcctccatcgtccagtgcacccaggagtccagagagtcctgccccaaggcgaggcggagtgcgcgcttcagtgccccaaaagctggcagaaatgttgagcagtcagtatggtctgatcgtctttgtggctggactgttgttactccttgcttgggctgtgcacgcggcaggagtctcgaaatcagatctcttgtgcttcctgaccgcgctgatgctcctgcaactactatggatgctgtggtacgtgggccgatcttccgcccaccggagactatttagattaaaagacactcacgccggagccggatggctgcgtggctccatcacccttttcgctgttattactgtgatactgggctgtcttaagatcggatactttatcggcttctccgagtgcttgtctgccactgagggggtgttccccgttacgcacagcgttcatactttacttcaggtatactttctgtggggccatgccaaagatattattcaaagcttcaaaactctggagcggtttggcgtgatccattcagtcttcaccaacctactgttgtgggctaacggggtacttaatgaatccaaacaccaacttaatgaacataaagagcgcctaatcacattgggattcggcaacatcactaccgttcttgacgatcacaccccccaatgcaactgcacccctcctactctttgtaccgcgatcagtcacggaatttactacctttatccctttaatatcgaatatcagattttggccagcactatgctctatgtgttatggaaaaatatcgggcgtaaagtggactcacatcagcaccaaaagatgcaatttaagagtgacggggtgatggtcggagctgtgctggggctcacggtcctggctgctaccattgcagtagttgtggtctatctgatccatatcggtagatctaagacgaagtctgagtccgctctgattatgttttatctgtacgctattactctgctgatgcttatgggcgctgccggattggcagggataagaatttatcgaattgatgagaagagcttagacgagtctaaaaatcccgctcgtaaactggactctgacctactggtcggaacagcatcaggctcctggttgatcagctgggggtcaatactagccattctttgcgccgagggccacccaaggtacacttggtacaatctcccgtactctattttggctatcgtggagaaatacattcagaatctgttcatctttgagtcaatccacagagagcctgagaaactttccgaagacattcaaactcttcgagtagtcactgtgtgcaatggaaacacaatgcctctcgcttccagttgtcccaagtctggcggagtcgccagagacgtcgcccctcaggggaaagacatgcccccagcggctaacgggaatgtgtgtatgcgtgaaagccacgacaaagaagaggaaaagcaggaagagagcagttggggcggatctccctcacccgtgagactgccccgttttttgcagggaaacgctaagagaaaagtgctgagaaatatcgccgctttcctgtttctttgcaatatatcactctggattcctccggcatttggatgccgaccagaatatgacaacggattggaagagattgtgtttggatttgagccttggattatcgtggtgaacctggccatgccattttccattttctatagaatgcatgccgctgcctctcttttcgaggtgtactgcaagatctag

SEQ ID NO: 10369 - DNA, 786 bp, Artificial Sequence
  Description of Artificial Sequence: Synthetic coding sequence
atggaattgctgcaggtcacaatcttatttttactgcctagcatttgtagctcaaattcaacaggtgtgctggaggcggcaaataatagcctggttgtgaccaccactaagcccagcatcacaacgcccaacaccgagtccctacagaagaacgtagtaacgccaacaactgggacaacccctaaaggcacaataacgaatgagctcctaaaaatgtctctcatgtctacggccacattcctgaccagcaaagatgaaggcctcaaggccaccacaacagatgttcgaaaaaacgactccattatttccaacgttacagtcacctctgtgactttacccaacgctgtttcaaccctccagtcttccaagccaaagaccgagacccagtcctctatcaaaaccacagagataccaggtagcgtcttacagccggacgcatcaccgtccaaaacgggcacactgacctcaattccagtgaccatccccgaaaatacctctcagtcacaggtaattgggaccgaaggtgggaagaatgcttccaccagcgccacatcccggtcttatagttccataatcctacccgtagtcatcgctttgatcgtgattaccctgagtgtgtttgtgctggtggggttgtatagaatgtgctggaaagccgaccctggcacccccgagaatggcaacgatcaaccgcagagcgataaggagtcggtgaaactgcttacagtgaaaaccataagccacgagtccggcgagcacagcgcccagggaaagacaaagaattag

SEQ ID NO: 10370 - DNA, 6408 bp, Artificial Sequence
  Description of Artificial Sequence: Synthetic coding sequence
atgcccgcactgggaccagccttacttcaagccttgtgggctggctgggttctgaccctgcaaccactcccccctacagcgttcactcccaacggcacatatctccagcaccttgccagagatcccacgtccggcaccctctaccttggcgcaaccaatttccttttccagctctcgccaggcctccagctggaggctactgtctctacgggcccagtcctcgatagtcgtgactgtctcccccctgtcatgccggacgaatgtccacaagctcagccgactaacaatcccaatcagctgctcctggtgtcacctggcgctttagtggtgtgcggatccgtgcaccagggagtctgtgaacagagacgcttaggacaactggaacagctcctgttgagaccggagcggccaggggatactcagtatgtggctgccaacgatccagctgtgagcactgtcggactcgtggctcaaggcctggctggcgaaccactattgtttgttggcagaggctacacctcccgaggagtggggggaggcattccaccgattactacccgggctctttggccgcctgatccccaggcggcatttagctatgaggagactgccaaactggccgtaggcaggctttcggagtactcccatcatttcgtcagtgcattcgcaagaggggcttcagcctattttctgttccttagaagagatctgcaggctcaatcccgcgctttcagagcatatgtgtcaagggtatgtctccgggatcagcattactactcctatgtcgagttgcccctggcctgtgaaggaggacgatatggtctcatccaagcagcagcagttgccacatctcgcgaggtagcacatggggaggtactgttcgcagccttctccagcgcagcacctccaacggttggcagacctcccagcgctgccgcaggcgcttcaggcgcaagtgccctgtgtgctttccctctcgatgaggtggaccgactcgctaacaggacgagggatgcctgttataccagggagggaagagcagaagatggaacagaagtagcatacatcgaatacgatgtgaactccgattgcgctcagctgcccgtggataccctagatgcatatccttgcggttcagaccataccccaagcccgatggcaagtagagtgccccttgaagccacgccaatcctggagtggccaggtattcaactgacagccgtggcagtgactatggaggacggacatacgatcgcattcttaggggactcccaagggcagcttcacagggtctacctcgggccaggcagcgacggccacccctactccacgcagtccattcagcagggatccgccgtgtctcgtgatctgactttcgatggtaccttcgaacacctgtatgtgatgacgcagagtacccttctgaaggttcctgtcgcttcttgtgcccagcacctggattgtgccagttgtttggctcacagggacccatactgcggatggtgcgtccttctcggcaggtgtagcaggagaagtgaatgttctaggggtcaggggcctgaacaatggctgtggtctttccagccggagctgggctgtctacaggttgccgctatgtctcctgccaacatttcccgcgaagaaacccgcgaggtgtttctctccgttcccgacttgcctcccctgtggcctggagagtcatatagttgccattttggtgagcaccagtcccccgcactgcttactggcagcggggtgatgtgcccatcgcccgatccatccgaggccccagtcctgcccaggggagctgattatgtgagcgtgagtgtggagctacgcttcggcgcagtggtcatcgctaaaactagtttgtccttctacgactgcgtcgcggtgactgagctccgtccctcggcacaatgccaggcttgtgtaagtagcagatggggatgtaattggtgcgtgtggcaacacctgtgtacccataaggccagttgtgatgccggaccaatggtggccagccaccagtcccccctggtgagtcccgacccgccagctagaggcggtccatcacccagtcctcctactgcccctaaagcccttgcgaccccagcacctgacaccctgcccgtggaacctggggctccaagtacggcaaccgcatcggacatcagtcctggagccagcccctcgctgttgagcccatggggtccctgggcgggttcaggttccatcagctctcctggttccacgggctctcctttacacgaagagccctcaccacctagcccccagaatggaccgggtaccgctgtgccagcaccaaccgattttcgccctagtgctactccagaggatctgctcgcgtctccactcagcccaagcgaggtcgctgccgtccccccagccgatccagggccagaggcactccacccaaccgtccccttggaccttcctccagcgacggtgcccgctaccactttccccggtgcaatgggatccgtgaaacccgcactcgactggctaactcgggaaggtggcgagctacctgaagccgatgaatggacgggaggcgatgcccctgctttttccacatccacactgctgtctggagacggcgactctgcggagctggaaggacctcctgctcctttaatcctgccaagttcccttgattatcagtatgacactcccggattgtgggaattggaggaagcgaccttgggcgcaagttcatgtccatgcgtggagagcgtgcaaggctcaactctaatgcccgtacacgtggagcgggaaatcagactcctaggcagaaacctacatctcttccaagacgggcctggtgacaatgaatgtgtgatggagctcgagggcttagaggttgtggttgaagctcgcgtcgagtgcgagcctccccctgacacacagtgccacgttacttgtcagcagcaccagctgagctatgaggctctgcagccagagctgagggtgggattatttcttaggagagccggacgactgcgcgtagattccgctgaagggctgcacgtggtgctgtacgattgctcggtcggacacggagattgcagccgctgccaaaccgccatgccgcagtacgggtgtgtgtggtgcgaaggggagcgacccaggtgtgtgacacgtgaggcgtgtggcgaagctgaagccgtggcaacgcagtgtccagcaccactcattcattctgtcgaacctctgaccggaccggtcgacgggggaacccgagtcaccattcgtggctctaaccttggtcagcacgttcaggacgtgcttggtatggtgactgtagctggtgtgccatgcgccgtcgacgcccaggagtacgaggtcagtagcagccttgtatgcattactggagccagcggggaagaagtagctggggcaactgctgtggaggttcccggacgcggacgcggtgtgagtgagcacgatttcgcctatcaagaccctaaggttcacagcatcttccctgctagaggcccacgggctggtggaacccgtctgacactcaatggatccaaactgcttactggtagacttgaggatattcgtgttgttgtgggcgatcagccctgccatctactgccagagcaacagtccgagcagcttcgttgtgagaccagcccacggcctacccccgcaacactcccagtggctgtgtggtttggagccaccgagcgccgtctgcagagggggcagttcaagtataccctggatccaaatattaccagcgcaggacctaccaagtcttttctgagcgggggacgcgaaatatgtgtccggggacaaaatctggatgtggtgcagacgcctaggatccgagttacagtggtgagcagaatgctgcaaccctctcagggcttgggcaggcggcgtcgggtggttccagaaactgcctgcagcttgggaccctcttgcagcagccaacagttcgaggaaccctgtcatgtgaactcttcgcaacttattacctgcaggactcccgcactcccagggctgcccgaggacccctgggttcgggtggagttcattctggacaacctagtattcgattttgcaacgttaaaccccacacctttcagttacgaagctgatcccacactccagcctttgaatcctgaagacccaacaatgcccttccggcacaagccagggagcgtgttttctgtggagggggagaacctcgacctggccatgagcaaagaagaggtcgtggccatgattggtgatggcccatgtgttgtgaaaactctcacacgccatcatttatattgtgagccacccgtcgagcagccacttccacgccaccatgctctgagagaagcacccgatagtctccccgagttcaccgtacaaatgggaaaccttaggttttcacttgggcacgttcagtatgacggggagagtcctggggctttcccagtggctgcccaggtgggactgggggtggggacaagcctcctggccttaggagttatcatcatcgttctgatgtaccgtaggaagtcgaagcaggctctgagagattacaaaaaggtgcagatccagctggaaaacctggagagctccgtacgtgaccggtgtaaaaaggagttcacagatctaatgacggagatgacagacctaacttcagaccttctcgggagtggcatcccctttcttgactacaaggtgtatgctgaacgtattttttttccaggtcaccgcgaaagtcccctgcaccgggacctgggcgtgcctgagtcacgccgtccgactgtggaacagggtctgggccagttgtccaatctcctgaacagtaaacttttcctgacaaagttcatccacaccctggaatcacagcgaacgttttcagctcgtgaccgagcatatgtagcgtctctgcttacagtggctctgcatggaaagttagagtattttactgatatcctcagaacacttctgagtgatctggtggcgcagtacgtggctaaaaaccccaagcttatgttacggagaacagagacagtcgtggagaagttgctcactaactggatgtctatttgtctgtacactttcgttcgggactctgttggcgaaccgctgtatatgctttttcggggtatcaaacatcaagtcgacaagggcccagttgattcagttaccggcaaagccaagtatacgctgaatgacaacagactgttgagagaggatgtcgaatacagacctctgactctgaacgcattgttggccgtgggcccaggcgctggcgaggcccagggcgttccagtgaaggtgctggactgtgataccatttctcaggcaaaagagaagatgctggatcagctgtacaaaggcgtgcctctcacgcagcgaccagatcccaggaccttggatgtggagtggcggtcaggagtggccggacatctgatcctatcggacgaggatgtaaccagcgaggtgcaggggctatggcggagattaaatactctacagcactacaaagtgcccgacggagccacggtggcactcgtcccatgcctaaccaaacacgtgctcagagaaaaccaagattatgtacctggagagcggacacccatgctggaagatgttgatgagggtggcattagaccctggcatcttgtcaaaccctccgacgaacccgagccaccccgtcccaggaggggcagccttagaggaggcgaaagagaaagagcgaaagcaataccagagatttatctgactcgattgctctctatgaagggcactctgcagaagttcgtggacgatctgttccaagtcatactatctactagtagacctgtgccactggcagttaagtacttttttgatctgcttgacgaacaagcccaacagcatggaatctccgatcaggacacaattcatatctggaaaaccaattctttacccctaaggttctggatcaatataatcaaaaatcctcaattcgtgttcgatgtccaaaccagtgacaatatggacgcagtcctgctggttatcgcccagacctttatggatgcctgtaccctggccgaccacaagctagggcgagatagtcccatcaacaagctgctgtatgctagggacattccaagatacaaacgaatggtggaacggtactatgccgacataagacagaccgtacctgctagcgaccaagaaatgaactcagttcttgccgagttatcatggaactattccggggacctcggagcacgggtggcattgcacgagctgtacaaatatattaataaatactacgaccagattatcacagcactcgaagaagatggtacggcgcagaaaatgcagctgggctatcgcctgcagcagattgcagccgcagtggaaaacaaggtgaccgacctttag

SEQ ID NO: 10371 - DNA, 297 bp, Artificial Sequence
  Description of Artificial Sequence: Synthetic coding sequence
atgaagctgatggtgctcgtgtttaccattggcctcaccctgcttttaggggttcaggcgatgccggctaacaggctgagctgttaccgcaaaattctcaaagaccacaattgtcacaacttacccgaaggcgtcgcagacctcactcagatagatgtgaacgttcaggaccatttctgggacggcaagggctgtgaaatgatctgctactgcaacttctccgaattgctgtgttgtccaaaggacgttttctttggccctaaaataagttttgtcattccctgcaacaaccagtag

SEQ ID NO: 10372 - DNA, 1443 bp, Artificial Sequence
  Description of Artificial Sequence: Synthetic coding sequence
atgaaaagaagtgtagctgtgtggctgctggtaggcctgtctctgggtgttccccagttcggcaaaggcgacatctgtgaccctaacccatgtgaaaatggtggaatctgcctgcccggactagccgacggctcatttagctgtgagtgccccgacggctttactgacccaaattgctcatcagtggtcgaagtggcctctgacgaggaggaacccactagcgctgggccttgtactcctaatccttgccataacggtggtacctgcgagatcagcgaagcgtacaggggggacacttttattggatacgtctgtaaatgtcctagagggttcaatggcatccactgccagcacaatatcaacgagtgtgaggtggagccctgtaagaatggcggaatctgcactgacctggttgctaattacagctgcgaatgccccggtgagtttatgggaaggaactgccaatacaagtgcagcggtcccctgggcatagaaggaggcatcatctccaatcagcagattaccgcctctagcacacaccgcgctctttttgggcttcaaaaatggtacccatattacgccaggctcaataaaaaagggctgattaatgcatggaccgcagctgaaaatgaccggtggccgtggatacagataaacctgcagcgtaagatgagggtgactggagtcatcactcagggcgctaagcgcatcgggtcacccgagtacatcaaatcctataaaatcgcctactccaacgatggcaaaacctgggccatgtacaaagtgaagggcaccaacgaagacatggtgttccgcggaaatattgacaacaataccccatacgctaacagtttcacaccccctatcaaggcacaatatgtgcggctgtatccacaggtgtgcaggagacactgcaccctaagaatggagctgctgggctgcgagctttcggggtgctccgagccattgggcatgaaatcagggcatatccaagactatcagatcaccgcttccagtatctttagaaccctgaacatggacatgttcacctgggaacccaggaaggccaggctggacaaacaaggaaaggtcaatgcctggacgagcggtcacaacgatcagagccaatggttacaggttgatctgctggtgcctactaaagtgactggcatcatcactcagggtgccaaggacttcggacacgttcaattcgtcgggtcttataagttggcttactccaacgatggggaacactggactgtgtaccaagacgaaaagcaaagaaaggataaggtgtttcaagggaacttcgacaatgatacacacagaaagaacgtaattgaccctcctatctacgccaggcacatcagaatactaccttggtcttggtatggacgaatcacactcaggtctgagctcctcgggtgcacagaagaggaatag

SEQ ID NO: 10373 - DNA, 1323 bp, Artificial Sequence
  Description of Artificial Sequence: Synthetic coding sequence
atggccgtgaagctggggactctgttgctggccctcgcacttggcctggcccaacctgccagcgcgcgtagaaagttgctggtatttctcctggatgggtttcgcagcgattacatatctgacgaggcactggaatcactgccgggtttcaaggagatcgtcagccgaggcgtgaaggtggattatctcactcctgacttcccctccctctcctatcctaattactacacactgatgacaggccgtcactgcgaggtgcatcagatgatcggaaactacatgtgggatcccaccactaacaaatcgttcgatataggtgttaacaaggacagcctcatgccactctggtggaacggcagcgagccattgtgggttaccctgaccaaagccaagaggaaagtgtatatgtactactggcctggttgtgaggtcgagatcctaggggtgcgccctacctactgtctggaatataagaacgttccaaccgatatcaatttcgccaacgctgtgagcgatgcccttgacagcttcaagagtggaagagccgaccttgccgctatttatcatgagcgcatagatgtggaaggacaccactacgggcctgctagcccccagcgaaaggatgctctgaaagcagtggatactgtcctcaagtacatgactaaatggatccaggaaaggggattgcaggaccggctgaatgtgattatcttctcggatcacggtatgaccgatatcttttggatggataaagtaattgaactcaataagtacatctctctcaatgatcttcagcaggtgaaggaccggggacccgtggtgagtttgtggccggcacctggaaaacatagcgagatctacaataagttatctacagtagagcatatgaccgtctatgagaaggaggctattccgtccagattttattacaagaagggcaaatttgtgtccccgctgactctcgtggccgacgaaggctggttcattactgagaatagggaaatgctgccattttggatgaacagcaccggcagaagagaggggtggcagcgtggatggcatggttacgacaatgagctgatggatatgagagggatcttcctggcgtttgggcctgatttcaagagcaattttcgcgcagcgcctatccgctctgtcgatgtgtacaatgttatgtgcaatgtagtcgggattactcccctcccaaataacggctcttggtccagggtgatgtgcatgcttaagggcagggcgtccaccgcaccgccagtgtggccctcacactgcgcactagcccttatactgctgttcctgttggcttag

SEQ ID NO: 10374 - DNA, 351 bp, Artificial Sequence
  Description of Artificial Sequence: Synthetic coding sequence
atggagagcagccgggtgaggctgttgccattgctcggggcagctttactccttatgctgccgctgctgggcactcgggctcaggaagacgctgaattgcagcctcgcgcactggatatctactcggctgtggatgatgcttcgcacgaaaaagagctcatcgaggcgcttcaggaggtgctcaagaagctaaagagtaagagagtgcctatctacgaaaagaagtatggacaggtgccgatgtgcgatgccggtgaacagtgtgcagtgagaaaaggtgccagaatcgggaagttatgtgattgcccgagaggcactagctgcaacagtttcttacttaaatgcctttag

SEQ ID NO: 10375 - DNA, 1365 bp, Artificial Sequence
  Description of Artificial Sequence: Synthetic coding sequence
atggccagacccaacaaatttctactatggttttgttgtttcgcctggctgtgtttccctatcagccttggatcccaagcctctggaggagaggcccagatcgccgctagtgccgaattagagtcaggtgcaatgccgtggtcattactgcaacacattgatgagcgagatagggccggactcttgccagctctgttcaaggtgctgtccgttggcagaggaggtagtcccaggcttcaaccggactccagggccctccactacatgaaaaaactgtataagacctacgccaccaaagaagggatcccaaagagtaatagatcgcacctgtacaataccgttcgactctttactccatgtacccggcataaacaagcccctggcgaccaggtcaccggcattttgccctctgtcgaactgctgtttaatttggatcgcattacaactgtcgaacacctgcttaaatccgtcctcctgtacaacatcaacaactctgtcagtttctccagcgccgtgaaatgcgtatgtaatctgatgatcaaagaaccaaaatcatcatctcgcaccctggggcgtgctccttattcattcacattcaacagccagttcgagttcggtaagaagcataagtggatccagatcgacgttaccagcctcctgcagcctctggtagcctccaataaaagatccattcacatgagcataaacttcacctgcatgaaagaccaactggagcatccatccgcccaaaacggcttatttaatatgacgctggtatctccaagcctgatactgtacctgaatgacacctccgcccaggcttatcattcttggtattccctgcactacaagaggagaccttcccaggggccagaccaagaacgcagtttaagtgcatatccagtcggggaggaagcagccgaagatgggagaagctcgcaccaccgccatcggaggggccaggaaaccgtcagctctgagttgaagaagcccctaggcccagctagcttcaatctaagtgagtatttcagacaatttctactgcctcagaatgaatgcgagctgcatgatttcagactcagctttagccagctgaagtgggacaattggattgtcgcaccccatcgatataatcctcggtattgcaagggggactgccctagagcggtgggccacagatatggctctcccgtgcataccatggtacaaaacatcatctacgagaaactggattccagcgttccccgaccatcctgcgtgccagccaaatattctcctctttctgtgttgaccatagaacccgatggtagtatagcctacaaggaatacgaagatatgatagctactaagtgcacttgcagatag

SEQ ID NO: 10376 - DNA, 234 bp, Artificial Sequence
  Description of Artificial Sequence: Synthetic coding sequence
atgtggcacttaaagctttgcgctgttctgatgatttttctcctgttgctgggccaaattgatggctctccaatacccgaggtatcatccgctaagcgacgaccccgtaggatgacccctttttggcgtggagtaagcttgcggcctattggtgccagttgccgcgacgattcggagtgtatcacccgtctctgtagaaaaaggcgctgctccctgagtgtggcccaggaatag

SEQ ID NO: 10377 - DNA, 912 bp, Artificial Sequence
  Description of Artificial Sequence: Synthetic coding sequence
atgtctgagccccaaccggatctggagcccccacagcatgggctatacatgttgtttctgttggtcctagtattcttccttatggggttggttggctttatgatctgccacgtgttaaaaaagaaaggctataggtgcagaaccagcagaggctccgagccagacgacgcacaacttcagcccccagaggacgatgatatgaatgaagatacagtagagcgaatagtccgatgcatcatccagaatgaggccaacgctgaggctctcaaagaaatgcttggggactcagaaggagaaggtacagtccagctaagctcagtcgacgccacctcctcgttgcaggatggggcaccatcgcaccatcacaccgtgcatttagggagtgccgctccctgccttcactgctcgcgaagtaagcggcctccgctggtgagacaggggaggagtaaagaggggaagtccaggcctcgtacgggggagactacggtgttctctgtggggaggttcagggttactcacatcgaaaaaaggtacggactgcacgagcatcgggacggttcaccgaccgatcggagctgggggagtgggggtggccaagacccaggtggtggccaaggaagcgggggaggacaacccaaagcaggtatgccagccatggaacggttgcccccagaaagaccccagccacaagttttggcttcaccccctgtccagaacggaggcctgcgggactcaagcctgacccctcgggctcttgagggcaaccctcgtgcatccgcagagcccacactgagagctggcggtaggggaccaagcccaggactcccaacccaagaagcaaatggacagccttctaaaccagatacatcagaccaccaggtgagcttaccccagggcgcaggttctatgtag

SEQ ID NO: 10378 - DNA, 795 bp, Artificial Sequence
  Description of Artificial Sequence: Synthetic coding sequence
atgagaaccctttggatggccctgtgtgcgctgtcacggctgtggcctggcgcacaggccggatgcgcggaggccggaaggtgctgccctggcagggacccagcttgtttcgccagaggctggcgtctggaccgcgtctacggtacctgcttttgtgatcaggcctgccgattcaccggcgattgctgctttgactatgatagggcttgcccggcacgaccatgctttgttggagagtggtctccatggtctgggtgtgccgaccagtgcaagcctacaacacgcgtaagacgtcgcagcgtacagcaggaaccccaaaacggtggtgcaccctgccctcctcttgaggagagggcgggatgcctggagtatagcacaccccaggggcaggactgtgggcacacatacgtgcctgcattcataaccactagcgcctttaacaaggagaggacccgtcaggcaacctccccccactggtcaacccacactgaggatgctggatattgcatggagttcaaaacagaatcgctcacccctcactgcgcactagagaactggcccctaacgagatggatgcagtacctccgcgaggggtatacggtttgcgtcgactgtcagccaccagccatgaattcggtcagcctgcgctgctccggggacggtctagattccgatggaaatcagaccctacactggcaagccatcggcaatcctcgctgtcagggtacctggaaaaaagtccgtagggttgatcaatgcagctgtcctgccgtccactcattcatcttcatatag

SEQ ID NO: 10379 - DNA, 312 bp, Artificial Sequence
  Description of Artificial Sequence: Synthetic coding sequence
atgcgacagcgcctactgccgtccgtgactagcctgctcctagtggccctgctatttcccggatcctctcaagctcgccacgtgaaccactccgcaacagaagctttgggcgaattgcgcgagagggcccctggtcagggtaccaatggcttccaactgctccggcatgctgtgaagagagacctcctgccacctcgcacccccccttaccaggtgcatatttctcaccgcgaggctcggggaccttcttttagaatctgcgtagacttcctgggacctaggtgggcccgaggctgcagcacgggaaattag

SEQ ID NO: 10380 - DNA, 3867 bp, Artificial Sequence
  Description of Artificial Sequence: Synthetic coding sequence
atggcctctgtggcatgggcggtgttgaaagttctgctgcttctccccacccagacctggagccctgtaggcgcaggcaacccacctgactgcgatgctccactcgcctccgctttgcctagatccagcttcagttcttcctccgagctatctagctcccacgggcctggcttctcgagattaaaccgcagagatggtgcaggtggttggacgcccttagtctccaataaatatcagtggctccagatagacctgggggaacgaatggaagtcactgcagtggctacgcagggagggtatggatctagcgactgggtcacttcttatctgttgatgtttagcgacggtgggcgaaattggaaacagtacaggcgcgaagaatcaatctgggggtttcctggaaacaccaacgccgattcagtggttcactacaggctacagcctcctttcgaggcccgattcctgcgtttcctgccccttgcctggaatcccagaggtcgaatcggaatgagaatcgaagtttacggatgcgcttataagtctgaggtcgtctatttcgatggtcagtcagcactgctgtaccgcctcgataaaaagcccctgaagccgatccgggatgtcattagcctcaagttcaaggccatgcaaagtaacggaatcctgctgcatagagaaggccagcacgggaaccacattacgctggagctgataaagggcaaactggtgttcttcctcaactctggaaacgccaaattgccttccacgatcgctcccgtgacactgacccttgggagcctgctagacgatcaacattggcacagcgtgctgattgaactgctcgatacacaggtgaactttacagtcgacaagcatacacaccacttccaagccaagggagattctagctatcttgatctgaatttcgagatcagtttcgggggaattccaactcccggaaggtctcgtgcttttaggagaaaaagtttccacggttgtctagaaaatttatactataacggggtggacgtgacggagcttgcgaagaagcacaagccccagatcctgatgatggggaatgtgtccttctcctgtcctcagccacagacagtgccagtgactttcctgagctctcggtcctatctggccctgcccggtaattccggtgaagataaggtatcagtaacctttcagttcagaacatggaatcgcgcagggcatctgctctttggtgagctcagacggggtagtgggagcttcgtcctatttctaaaggatggcaagctgaagcttagcctattccagccgggacaaagccctaggaacgtcaccgccggagcgggacttaacgacggacagtggcatagcgtgtcattctccgctaaatggtctcatatgaacgtggtcgtggatgatgataccgccgtacagcccctggtggccgtgctgatcgactcgggcgacacatactattttgggggatgcttggacaacagctctggaagcgggtgcaaatccccactaggaggatttcaggggtgcttgcgtcttatcacgattggcgataaggctgtagatccgattctagttcagcagggggcactgggctcattcagagacctccagatagattcttgtggcataacagacagatgccttccatcatactgcgagcatggaggcgagtgttctcagagctgggacaccttcagctgcgattgccttgggaccgggtacacgggcgaaacctgccactcttctctgtacgaacagtcctgcgaagcacacaagcaccgtggcaacccttccggtctctattatatcgacgcagacggttccggaccacttgggccattcctggtgtattgtaacatgactgctgatgccgcatggacagtggtgcagcacggagggcctgatgcagtgactctgcggggtgccccttctgggcaccccagaagcgctgtgagctttgcctatgcagcgggtgcaggccagctccggtcagcagtcaacctagcagagagatgcgagcagcggctggcgctgagatgtggaaccgctcgccgacctgacagccgtgatggtactcccctctcttggtgggtggggcgaacaaatgagactcacacgagctggggtgggtctttacccgatgctcagaaatgcacatgtgggctcgagggcaattgtatcgactcccagtactattgcaactgcgatgccggacggaatgaatggacgtctgacactatcgtgttaagccagaaagaacacttacccgtgactcagatcgttatgacagatgcgggacgcccacactccgaagctgcttacacccttgggcctcttctctgtagaggagatcagagtttttggaactcagcctcgtttaatacggaaacaagctatctccactttccggctttccacggagaattaaccgcggatgtgtgcttttttttcaaaacaacagtgtcttccggcgttttcatggaaaacctcggcattaccgatttcattaggattgagctacgggctcccaccgaggtcacgttttccttcgacgtgggcaatggtccctgtgaagttaccgtgcaatctccaactccatttaatgataatcaatggcaccacgtccgcgctgaacgaaacgtgaagggcgcatctctgcaggttgatcagctgccccagaagatgcagcctgcccctgcggacggacacgttcgccttcagctgaactcccaattattcatcggaggaaccgccaccagacagcggggattcctgggttgcattcggtcactgcaattgaacggtgtggctcttgacctcgaagaaagagcgaccgtgaccccaggagtggaaccgggatgtgctgggcactgctccacttatggccatttatgccggaacggaggtagatgcagagaaaagcgcagaggcgtcacctgtgactgtgcattttcggcctacgacgggccattctgctccaacgagatttcagcctactttgccaccggttcttccatgacttaccatttccaggaacactatacactttccgaaaactcctccagcctggtcagttcccttcaccgcgatgtcacactcactagggagatgatcaccctgtccttcaggaccactcgcacaccaagtctcctgctgtatgtgagcagtttctacgaagaatatctgtctgtgatcctggccaataacgggagcctgcagatccgctataagctggacagacaccagaacccagacgcattcaccttcgattttaaaaatatggccgatggacaactgcaccaagtgaaaattaatagggaagaggctgtcgttatggtagaggtgaatcagtcaactaaaaaacaggtaatcttgtcctcggggacagaattcaacgcagttaagagcctgatcttaggcaaggtgcttgaggccgcaggcgctgacccagatacgcggcgagctgctacatccggatttacgggttgtctgagcgcggtaagattcggtagagcagccccattgaaggccgcattgcgccctagtgggccttctcgcgtcaccgttagagggcacgtggcccctatggcgcgatgcgcggcaggtgctgccagcggatcaccagctcgagagctggcgccacggctcgccggtggtgcaggaagaagcggacccgcagatgagggagaacccctcgttaacgccgataggcgagactccgcggtaatcgggggtgtcatcgcagtggtcatctttattctgttgtgtatcaccgcaatcgccatccggatttaccagcagcgcaagcttaggaaagagaacgaaagtaaggtttccaagaaggaagaatgttag

SEQ ID NO: 10381 - DNA, 369 bp, Artificial Sequence
  Description of Artificial Sequence: Synthetic coding sequence
atggtacctggtccaccggaaagcgtggttcgattctttctgtggttctgtttcctactcccacctactagaaaggcatcctgtgaccccagagacctgaaaagctgcaaccggccatgtgtgtggagcaggcttttgaaaccaaattcatcccttagcaatctggagaccgcttatttccctcagatcctgcggtttctgcgcccttggtatttttcacggagccacctgaattaccaccagaaggcccctgccaggtgggaatggctgtattccatctacagaaagggcaccaaggcgcaaagaagaaatgtcctacggtccccatgcgccccaccgcagccgagttggccgtgctcggtcatctag

SEQ ID NO: 10382 - DNA, 1887 bp, Artificial Sequence
  Description of Artificial Sequence: Synthetic coding sequence
atggctccgagcgctgatcccggtatgagcaggatgttacccttccttctactgctgtggttcctgcccatcacagagggttcacagcgcgctgaacctatgttcaccgctgtcactaacagcgtgctacctcccgattacgatagcaaccccactcagctgaattatggagtcgctgtcacagatgttgatcatgacggcgactttgagattgttgtggctggctacaatggcccaaacctggtgcttaagtatgatcgtgcccagaaaagattggtgaatattgccgtggacgagaggtcgtccccttattacgctctgagggaccgacaaggtaatgctatcggggtcaccgcatgcgatatcgacggagatggtcgagaggaaatctattttttgaataccaacaacgccttcagtggtgtcgccacgtacacggacaaactgttcaaatttagaaacaataggtgggaggacatcctatccgatgaggtcaacgtggcccgaggtgtggcaagtctattcgctgggagatctgtggcatgcgtggatcgtaaaggaagtgggagatattcgatctatattgctaactatgcctatggcaacgtgggacccgatgccctgatcgaaatggaccccgaggcatcagatctctcccggggtatcctggctctccgcgacgtggcagccgaggccggagtcagcaaatacacaggtggccgaggcgtttcggtcggtccgatccttagctcctccgcatcggacatcttctgcgataacgagaacggccctaatttcttgtttcacaaccgtggtgacggaacctttgtggacgcagccgctagtgctggggttgatgacccacatcagcatggtcggggagttgctttggccgattttaaccgcgatgggaaggtggatatcgtctacggcaactggaacgggccacacagactttacctgcaaatgagtactcacggcaaagtgcgtttccgggatatagcatcacctaaattttcaatgccttctccagtcagaacagttatcacggctgactttgacaatgaccaagagctggagatcttcttcaacaatatcgcgtacagaagttcatccgccaaccgactttttcgggttattaggagagagcatggcgatccgctgatagaggagctcaaccctggtgacgcactggaacctgagggcagagggacgggcggtgtggtgaccgatttcgacggcgacgggatgctggatctgattttgagccacggagaatccatggctcaaccactttctgtgtttcggggtaatcagggtttcaacaacaactggctcagggttgtccctagaactaggtttggcgcttttgccagaggagctaaggtcgtactgtacaccaaaaagtcaggcgcacacctacgtattatcgacggtggtagtggctacctatgcgaaatggagcccgtggctcattttggcctaggtaaggacgaagcaagctccgtagaggtcacctggcctgatggcaagatggtttcgcgcaatgtcgcgtctggggagatgaactctgtgctcgagattctctacccaagggatgaggacacactgcaagatccagcccctctggagacacctatgaacgccagctcaagccactcatgcgcactggaaacgagcccgtacgttagcacacctatggaagccacaggcgcaggacccaccagatcagcggtgggcgctaccagtcctacgcgaatggcccagccggcatggggactgtcagcctctcatcgcgctccagcccctcctcctccacccctgttgctcccgcttcccctattactgccactcttggagcttcctctcttacatagatcttcgtag

SEQ ID NO: 10383 - DNA, 1008 bp, Artificial Sequence
  Description of Artificial Sequence: Synthetic coding sequence
atgcagggacaggggaggcgcaggggaacatgtaaagacattttctgtagcaaaatggcgtcctatctgtatggtgttctgttcgccgttggcctgtgcgcccctatttactgcgtcagcccagccaatgcaccctctgcctatccccgtccatctagcaccaaaagtacacccgcatctcaggtctacagccttaatacagattttgcattccggctgtaccgccgtttggtgctagaaaccccctcacagaacatcttcttcagccccgctcgcataaactctcatgtgaagaagaaaacgcagggaaaggttgtggatattattcaaggccttgatctgctgaccgcgatggtgttggtcaatcatatcttcttcaaagccaagtgggaaaagccgtttcatccagaatatacacgtaagaactttccttttttagtaggcgaacaggtgaccgtgcacgtgcctatgatgcatcagaaggagcagttcgctttcggtgtagatactgaactcaactgctttgtcttgcagatggattataaaggtgacgccgtcgccttcttcgtcctcccgagcaagggcaagatgcgccagctggaacaagctctttcggctcgcacattgaggaaatggtctcactcccttcagaagcggtggatcgaagttttcatacccaggttctccattagtgcatcttacaacctagaaacaatcctgccaaagatgggcatccagaacgttttcgacaagaatgctgatttttccggaatagctaagagggattcactacaggtgtctaaagcaacccacaaagccgtactggatgtgagcgaggaaggtacagaagccacagcggcaacaacaaccaagttcatcgtgaggtccaaggacggaccctcctattttacagtgtctttcaatagaactttcctgatgatgattacaaataaagctaccgatggcattttattcctcggcaaggtagagaatcccaccaaaagctag

SEQ ID NO: 10384 - DNA, 768 bp, Artificial Sequence
  Description of Artificial Sequence: Synthetic coding sequence
atggtgcttttgctcgtgatcttgattccagtcttggtgagcagcgcgggtacttctgcacattatgagatgctcggcacctgtcggatggtttgcgacccttacggaggaaccaaggcgccaagtaccgccgctacaccggacagaggtctgatgcagagcctgcctacatttatacagggccctaagggcgaagccggtcgcccagggaaagccggtcctcgcggtcctcctggagaacctggccctccagggcctatggggccacccggtgaaaagggtgaacctggcaggcagggcctccctggaccaccaggggcacccggactgaacgccgctggggcaatatctgcagccacgtattcaacagtgccaaaaattgccttttatgccggtctgaagaggcaacatgagggttatgaggtcctgaagttcgacgacgtagtaaccaacctggggaatcactacgacccaactactggtaaattcacgtgttcgatccctgggatctatttctttacctaccacgtgctgatgcggggtggtgatggtacaagcatgtgggcagacctgtgcaaaaacaaccaggtgcgtgccagtgccattgcccaggacgcggaccagaactacgattatgcgtccaacagcgtggtgcttcatcttgagccaggggacgaagtgtacatcaagcttgacggagggaaagctcacgggggaaacaacaataagtactcaaccttctcaggtttcataatatacgcagattag

SEQ ID NO: 10385 - DNA, 1617 bp, Artificial Sequence
  Description of Artificial Sequence: Synthetic coding sequence
atgtcattttctgctacaattctcttctcccctccctcggggagtgaagcacgctgttgttgctgtgcctgcaagtccgagacaaatggaggcaacacaggatctcagggcggaaatccccctccctccacacctataacagtcacgggccacggcctggcagttcagtccagcgagcagcttctgcacgtcatctaccagagagtcgacaaggctgttgggttagcggaggccgctctgggtctcgcaagagccaacaacgaattgctgaagaggctacaggaagaggtcggggatctgcgccagggtaaggtgagcatccccgacgaggatggtgagagcagggcccattctagtcctcctgaagaacctggccctcttaaggagagccccggagaggccttcaaagcgctcagcgctgttgaagaggagtgtgactctgtcggttctggagtccaggtcgtcatcgaggaattaaggcagctcggagcagcttcagtcgggcctggtcctctgggtttcccggctacacaacgggacatgaggctaccagggtgtacactcgcagccagtgaagcggcacctctgctcaaccccttagtggacgactatgtggcttctgaaggagctgtacagagggtcctcgtcccggcatacgcaaagcaacttagtcccgcaacgcaactggctattcagagagcaaccccagagaccggacccgagaatggcactaagcttccccctcctcgcccagaagatatgttgaatgccgctgcggctctagactccgctctcgaagaatccggcccaggctctacaggggaactgaggcatagccttggcctaaccgtttcaccttgtcgaacacggggatcaggacagaaaaatagtaggagaaagcgggatctggtactatcgaagctggtccataatgtccataaccacattaccaacgacaagcgatttaacgggtcagagtctatcaagtccagttggaacatctctgtagtcaagtttcttctagagaaactcaagcaggaacttgtgacatcaccccataattacacagataaggaattaaaaggagcctgtgtggcctattttctgacaaagcggagggagtatagaaactccctgaacccattcaaaggcctgaaggagaaggaggagaagaagctccgcagcaggcggtatagactgttcgctaatcgttcttcgattatgcgacatttcggacctgaagaccaacggctctggaacgacgtgactgaagagctcatgtctgatgaggaggattccctcaatgagcccggtgtctgggttgcgagaccacccaggtttcgggcacagcgacttactgagctctgttaccaccttgacgccaactccaaacacggcacaaaagcaaatcgggtctacggtcctcctagcgaccgtctcccctcggctgaagcacagctgctcccaccagaactctacaatccaaactttcaagaggaagaggatgagggcggagatgagaatgccccaggctcccctagctttgatcaacctcataagacttgttgccccgacctcaacagctttattgaaattaaggttgagaaagacgagtag

SEQ ID NO: 10386 - DNA, 2853 bp, Artificial Sequence
  Description of Artificial Sequence: Synthetic coding sequence
atgcttctgctgggtatcctgacccttgcttttgctggcagaaccgcgggaggttccgaacccgagagggaggtcgtcgtgccaatccgcctggatccagacataaacgggcgacgctattactggagaggccctgaggacagtggcgatcaggggctgatctttcagatcactgcatttcaggaggatttttaccttcatcttacccccgatgcccagttcctggctcctgcattctcaacagaacacttgggagtccccctccaggggctgactggaggttcaagcgacctgcggcgatgcttctattcaggggatgtgaacgctgagcccgactcatttgctgctgtttccctgtgcggaggcctacgtggagctttcgggtaccggggagccgaatacgtcatcagtcccctccccaacgcttcagctcccgcagctcagcggaacagccagggcgcacacctgctgcagaggcgtggcgtccctggagggccttcgggcgaccctacgtctagatgtggggtagcaagcggctggaatcccgctattctacgcgcattagacccttacaaacctagacgagctggcttcggggagtcgcgctcaaggcggagatccgggagggccaagaggttcgtgtccattccaaggtacgtcgagacgctagtggtggccgatgagagcatggttaagtttcacggcgctgacctggagcactatctgctgaccctgctggctacagccgcacgactctaccgccacccctctatccttaatcccataaacattgtcgtggtgaaggtgctgcttttgcgagacagagactcgggacctaaggtgaccggaaatgccgctttaaccctgcggaacttttgcgcatggcagaagaagctgaacaaggtttccgataagcacccagagtactgggatacggcaatactgtttacgcgccaagacctgtgcggagccaccacctgcgatacactgggcatggctgatgtcgggaccatgtgcgatccaaagcgcagctgttccgtgatagaggacgacggactcccaagtgcatttactaccgcccacgagctcggacatgtatttaacatgcctcacgacaatgtgaaagtctgcgaagaggtcttcggaaagcttagggcgaaccacatgatgtctccaacgctgattcaaattgatagggccaacccatggagtgcatgtagcgcagcaattatcactgactttctcgatagcggacacggggattgcctgctagatcaaccatctaagcctatttctctgccagaagatctgccgggtgcctcgtataccttgtctcaacaatgtgagctcgcttttggcgtgggcagcaaaccttgtccgtatatgcaatactgtacgaagctttggtgtacagggaaagccaaagggcagatggtctgccagacacggcatttcccctgggcagatggtacatcatgcggagagggcaagctttgtcttaagggcgcttgcgttgagagacataatctgaacaagcatagggtggatggatcctgggccaaatgggacccctacggcccatgttcacgtacctgcggcggtggagtgcagctggcccgacggcagtgtacgaatccgaccccagccaacggtggtaaatattgcgagggagtccgcgtgaagtatcgtagctgtaatttggaaccttgcccctcttcagcctcaggaaaaagctttcgtgaggagcaatgtgaggccttcaacggatacaatcacagtaccaatcgcctcaccctggcagtggcctgggtgcccaagtactcgggagtttcgccacgggacaagtgcaaattgatctgtagagccaacgggacgggttatttctacgtgttggccccaaaggtagttgacgggacactatgttctcctgacagcacttctgtctgcgtgcaaggaaagtgcataaaagcaggatgtgacgggaacttaggcagtaagaagagattcgacaagtgtggggtctgtggaggcgacaataaatcttgtaagaaagtaaccggcctgtttactaaacctatgcacgggtacaatttcgtagtggccattcctgccggagccagttctattgacatccggcagcgcggatataaggggttaattggagacgacaattacctggccttgaagaatagtcagggcaaatacctactgaatggccattttgtggtttctgctgtcgagcgcgatctcgttgtcaagggttccttactgcgttatagcggtacaggcaccgctgtcgagtctctccaagctagcagaccgattttagaaccactgacagtcgaagtcctgtccgttggaaagatgacacctcccagggtgcggtacagcttttatcttccaaaagaaccacgcgaagataagtccagtcacccgaaagatcctagaggaccctctgttttgcataattctgtgttgagtctttccaaccaagtggagcagcctgatgacagacctcctgccagatgggtggcagggtcgtggggcccatgctcagcttcctgcggatcaggcctgcagaaacgggcagtggactgcaggggatccgcaggtcagcgtacagtccctgcttgcgatgcggctcatagaccagtagagacccaggcttgcggcgaaccttgcccaacctgggaactcagcgcctggtccccgtgttcaaaaagctgcgggagaggctttcagcggagatctttaaagtgtgttgggcacggcggtcggctgctggcaagggatcagtgtaacctgcaccgcaaaccccaggagcttgatttctgcgtgctcaggccttgctag

SEQ ID NO: 10387 - DNA, 1521 bp, Artificial Sequence
  Description of Artificial Sequence: Synthetic coding sequence
atgacaagcaagccccattccgattggataccatacagtgtcctcgatgacgagggacggaacttaaggcagcagaagcttgaccggcagcgggctcttctggagcagaagcagaagaagaagcgccaggaacccctgatggtgcaggccaatgcagacggacgtcctaggagtcgaagagctcggcagtctgaggagcaggcacccctggtagagtcatacctttcttcatccggcagcacatcttatcaggtccaagaggcagactcactggcctccgtgcaactgggtgcaactaggccaactgcacccgctagcgcgaagcggacaaaggcagcagcaactgcgggtggacagggcggtgcggcaagaaaggagaaaaagggtaaacataaagggacttctggcccagccgctttagctgaggataagtctgaggcacagggtccagtacagattctgacagtgggtcaatcggatcatgcccaggatgcgggagagaccgccgcagggggtggagaacggccatctggccaagacctgagggccactatgcagcggaaaggaatctcctccagtatgtcgttcgacgaggatgaggaggacgaggaagagaatagctcatcctcttcacagttgaatagcaacaccaggccatctagcgccacgtcaagaaaatccgtacgcgaggctgcctcagcccctagtccaacagccccagaacagcccgtagacgtggaagtgcaggacctggaggagtttgcacttcgcccagccccacagggaatcaccatcaaatgccgaattacccgggataagaaaggtatggaccgtggtatgtatcccacttacttcctgcatctggatcgagaagacgggaaaaaagtgttcctgttagcgggaagaaaaagaaagaagagcaagacgtctaattacctgattagtgtcgacccgacggatctatcccgaggaggggacagttatattggcaagctgaggtccaatctgatgggtaccaagtttaccgtctatgacaacggcgtgaacccccagaaggcctcctcttccacccttgagtctgggactttgcgacaggagctcgccgctgtgtgttatgaaacaaatgtactcgggttcaaggggcctaggaagatgtctgtcattgtcccgggaatgaacatggtgcacgagcgggtgtcaatcaggcccaggaacgaacacgagacgcttcttgccaggtggcaaaataaaaacaccgaatctataatagagttgcagaacaaaactcccgtgtggaatgacgacacccaatcttacgtgctgaactttcacggcagggtgactcaggcctcagtgaaaaacttccagattatccacggcaatgatcctgactacattgtgatgcaattcggcagggtcgcggaggacgttttcactatggactataactacccactctgtgctctccaggcctttgcaattgcactttccagctttgactccaaacttgcttgcgagtag

SEQ ID NO: 10388 - DNA, 594 bp, Artificial Sequence
  Description of Artificial Sequence: Synthetic coding sequence
atggcaaaaaatggcctagtgatatgcattctggtaataaccctgctgctggaccaaactactagtcacacgtctcggctgaaggcacggaaacattctaaacggagggtccgcgacaaggacggggacctgaagacgcagatcgaaaagctctggacagaagtcaacgcactaaaagagattcaggcgctccagaccgtttgtctcagaggcactaaagtgcacaagaaatgctatctcgcttcagaaggtctgaaacattttcacgaagctaatgaagactgcatttctaagggcggaattctggtaattcctaggaattctgacgagatcaatgccctccaagactatggaaagagatccctgcccggagtcaatgacttctggctggggattaatgacatggtaacagaggggaagtttgttgacgtgaacggcattgctatttcattcttgaattgggaccgggcacagcctaatggcggtaaacgggagaattgtgtgttgttttcccagagtgctcagggaaagtggagcgatgaggcgtgtcgaagctctaagaggtatatctgtgagttcaccattccccagtag

SEQ ID NO: 10389 - DNA, 2424 bp, Artificial Sequence
  Description of Artificial Sequence: Synthetic coding sequence
aaaaagaaaaggaagatctcactgttgcctaagcctcctaaacacgacgctccactgactatcgaatttccaaacctggacaaaaccagcgccgagtggctgaaggtgaatggactcaaggctaaaaaactcagcctttatcaggtcctcgcccctaacgccttcagcccagtggaagaatttgtgcctattcttcaaaaaactgtatcttctactatccatgagaaagccatgattcagtttgagtggcatgatgggacagtgaagaatatccacgtagacccgccattcctatacaagtaccagcagcagcttagtagggccatgcggatgtacgaacgcaggattgagtggctctccctcgcaagtcgcaggatctgggggaccgtgtgtgagaagagagtggtagtgttactggatattagcgctacaaattctatgtatatcatccatatccagcacagcctccggctgcttctcgaggaacagctgtcaaataaggactgttttaacctcatcgccttcggaagtaccattgaatcatggcgacctgaaatggtgccagtctcccacaacaatctgcagtccgcctggcgctgggccctgaatctccggtgcagaggctctagaaacgtgctctctgccctgaggaaagctgttgaagtggacttcaaagataaggataaacatcagtcacaaggcatttacctgttcaccgggggaattccagatcaggacatgccaacactgtcagcctacatggccgaagcttgcggcggatgtgatctgcagctgaatgtctgtctgttctatgtcggtgagccaaaaatggatacaactcctccagccagatacgcaagccacactgatacagccgctgcctacaaggaggtcacacgagccgcaggaggccgttttcactggttcggggacacaggaatctacgagtccgacgacattaactctatcatgtccgagatggaaaaagccctgaattacagtcagaaatgtgccttcctgatggcgagcctcaaaaatcactctggtaaggtcctgggctccagtgctctgcccaaagaaaaacccaagacactgcagcttaggtctcagcctaaaaagctctgccctccgcgacccacagttcccctcggggcaaggatgtctatcaaggacgacccggatcgggaaaaatctccacccctgaagtcccttaagtggaggcccctgagctcgcgagtgggaatcagtcccgctgcggcacagccgactaaggaaggaatgatggagctccgcaggaagacaaaaagccgcgaagctgagacctccctgttgctgttctacactgagaagggcaacgatgtgggtagtgtctacaagaagtatcctcagggacggggtctcaggcgaacatcaagttctatagatctgccaagaaaggacaccgtttgcagttcacaggaatgggtagctaagtacggcttgaaaaaactgaagctggagattagtcggtgcatgggccctaattgtacacaccagaaaagtgggcagcggtctgcaagtgccaaacattgctccatttttcccagcgtggaaatccatggcgttgtccggcacatccagtggacgcctagggaaatggaagtttatatccggcacctagaaaaggtcctcagaagatacgtccagagactgcagtggcttctgagcggaagcagaaggttgtttggcaccgtactagaaagcaaagtgtgcattctgctcgatactagcggatccatgggcccttacctgcagcaggtgaaaacggaattagtacttctgatctgggaacagctgcgaaaatgctgcgattcttttaatttactgtccttcgctgagagcttccagagctggcaggatacgctggtggagacaacagatgcagcatgccacgaggcaatgcagtgggttacgcatttacaagcccagggctctacatctatcctccaagctctgctgaaggctttttcattccacgatctcgagggcctgtacctgttgacggatggcaagcctgacacctcatgctctctcgtgcttaatgaagttcagaagttgagagaaaaacgagacgtaaaagtgcacactatctccctgaactgttcagatcgcgcagccgtcgagtttctgagaaagctggcatctttcacgggtggccgttatcattgccctgtcggagaagatacactgtcgaagatccacagtctcctcactaagggttttattaacgaaaaggatcccacacttcctccttttgaaggtgatgaccttaggattctggcccaggagatcaccaaagccaggtcattcctgtggcaggcgcagtcgttcagaagtcagctgcagaagaagaacgacgctgagcctaaggtgacactcagttag

SEQ ID NO: 10390 - DNA, 639 bp, Artificial Sequence
  Description of Artificial Sequence: Synthetic coding sequence
atggtgagccgcatggtgagcacaatgctgtctggcctcctcttttggttggccagcggttggacgcccgcatttgcatattcccccagaacccctgatcgggttagcgaggcagacatccagagactgctgcacggagttatggaacagctgggaattgcaagaccacgggtggaataccctgcgcaccaggcaatgaatctcgtagggccacagtccattgaaggcggagcccacgaggggttacagcacctcggcccatttggaaacattcctaatatagtcgccgagctgacaggcgacaatatacctaaagacttttctgaagaccaagggtaccctgatcccccaaacccatgccccgtgggtaaaaccgccgacgatgggtgcttagaaaatacaccagacacggccgaattttcccgcgagttccagctacaccagcacctgttcgatcctgaacatgactacccgggactgggaaagtggaacaagaaactactgtacgagaaaatgaaaggaggtgaacgcagaaagaggaggagtgtgaacccttacctgcaggggcaaagactggacaatgtggtggccaaaaagtctgtgccccacttcagcgatgaagataaggaccccgagtag

SEQ ID NO: 10391 - DNA, 1524 bp, Artificial Sequence
  Description of Artificial Sequence: Synthetic coding sequence
atgtgcaccaagaccataccagtgctctggggatgtttcttgttgtggaatttatacgtttcctccagtcagaccatttacccagggataaaggctcgaattactcagagagcgcttgactacggcgtgcaagccggtatgaagatgatagagcagatgttaaaagagaagaagctgcccgatctatctgggtccgaatccctggagttcttgaaggtcgattacgtcaactataactttagtaatatcaagattagcgcgttctctttccctaacacctcactggccttcgtccccggagtggggataaaagccctgaccaaccacggcaccgccaatatcagtaccgactgggggtttgagtctcctctgtttcaggacacaggcggtgcggacctattcctgtcaggtgtttacttcactggtatcattatcctcacccggaacgattttggtcatcctaccctgaaactgcaggactgttacgcccagctgagccacgcccacgtttctttttctggcgaactgtcagttctttacaactccttcgcagaaccgatggagaagcctatacttaagaacctgaatgaaatgctatgccccatcatcgcatcagaggtaaaggccctcaacgccaacctgtctactcttgaagtcctcaccaagatcgataattacacactcctcgactattccttgatctccagccccgaaattaccgaaaattatctggaccttaatctgaaaggagtattctacccactggaaaacctgactgatcccccatttagccccgtgccatttgtgctgccggagaggagcaattctatgctctatattggaattgccgaatacttcttcaagtccgcaagcttcgctcacttcaccgctggggtctttaatgtgactctctccactgaggaaatctctaaccacttcgttcaaaattcgcagggtttgggcaacgtcctctcccgaattgccgagatttacatcctctcccagcccttcatggtgagaattatggccaccgaaccccctataattaatctgcagccagggaatttcaccctggatattccagccagcattatgatgctcactcaacccaagaactctacagtcgaaaccatcgtgtcgatggacttcgttgcctctacatcagttgggcttgtgattctcggccagcgtctggtttgttccctgagcttaaatcgatttcggctggccttgccagagtccaaccgtagcaatatcgaagttctgagattcgagaacatcctctcctctatactccattttggagtcctccctctggcgaatgcaaagttacagcaaggcttcccactttctaacccacacaaatttctcttcgtgaactccgatatcgaggttctggagggtttcttgctgatcagcaccgacctcaaatatgagactagttccaaacagcagccatcatttcacgtgtgggaggggctgaatctgataagtcgtcagtggagaggcaagagcgcaccgtag

SEQ ID NO: 10392 - DNA, 474 bp, Artificial Sequence
  Description of Artificial Sequence: Synthetic coding sequence
atgcatccctggttgggcagcgcccttggcttccctaaatgtcgagggatacatctgtgcgcctgtggaaatggctggactcccggagagaccctgtcccagaacaagactgagattaccaagaacaaagtgacctgctggagaccccacgggtgcgaaccaaacacgggcctggggtatcagggttcccacaccagcaagtataccctactgccttggaacctgttaaaaaccaagcccctcccccctagccatggcaaagaagggggaaaagaggccaaggttccatcgggtgataattcagggagaggcgaggtcccacgggctcaggagggccaggctgcatgtggccgagccgcttctggtgattcccaagaggggatgagacgaggatatgaggagcgtgccacggctcagcggcctgctgtccggtccgccgagacgacagcgcacggaacatggatctacccttag

SEQ ID NO: 10393 - DNA, 213 bp, Artificial Sequence
  Description of Artificial Sequence: Synthetic coding sequence
atgagcaacaacatggccaagatcgcggaggcccgtaaaacagtcgagcaactgaagctagaagtgaatatcgataggatgaaagtctctcaggctgccgctgagctgctggcattctgcgagacccatgctaaagatgaccctctcgtgacaccagtacctgccgctgaaaatccgtttagggacaaacgtctattctgcgttcttctctag

SEQ ID NO: 10394 - DNA, 645 bp, Artificial Sequence
  Description of Artificial Sequence: Synthetic coding sequence
atggcacttttattatgtctggtctgtctcactgcagccctcgcccatgggtgcctacattgccattcaaatttttccaagaaattctctttttaccgccatcatgtgaatttcaagagttggtgggtaggcgatatccctgtttcaggagccctcctgactgactggagtgatgatacaatgaaagagctgcatttggccatacccgctaagatcacaagagaaaagctcgaccaggtggcaacagcagtatatcaaatgatggaccagctctaccaaggcaaaatgtatttccctggctatttccccaacgaattgcgcaacatttttagggaacaagtgcacctgatccagaacgccattatcgaaagcagaatcgactgccagcaccggtgcggcatatttcagtatgaaaccattagctgtaataactgtacagactcccatgtagcatgtttcggctacaactgcgaatcatctgcccaatggaaatccgcagtgcagggcctgctgaactacatcaacaactggcacaaacaggacacaagcatgagtctcgtgagtccagcactgaggtgcttggaaccaccacaccttgctaacttgacgctggaggatgccgctgaatgcctgaagcaacattag

SEQ ID NO: 10395 - DNA, 459 bp, Artificial Sequence
  Description of Artificial Sequence: Synthetic coding sequence
atgagccctcacctgaccgcgttgctgggcttggtcctgtgcctggcccaaacaatccatacccaagaaggcgctctccccaggccatcgatctctgccgaacccggtacggtgattagccctggctctcatgtgactttcatgtgccggggacccgtgggagtgcagacgtttcggctggaaagagaggaccgtgcaaagtataaggatagctataacgtcttccgcctgggcccttctgaatcggaggccagattccacattgatagtgtttcagagggcaatgccggactgtaccggtgtctctactataagcctccgggttggagcgaacatagcgatttcttagagcttctcgtgaaagagtcctctggcggacctgacagccctgatactgagccaggatcaagcgcaggaacagtgccaggaaccgaagccagcgggttcgacgctccatag

SEQ ID NO: 10396 - DNA, 900 bp, Artificial Sequence
  Description of Artificial Sequence: Synthetic coding sequence
atggctccatggagccaccctagtgcccagttgcagccggtggggggagacgcagtatcgcccgcactcatggtgctgctttgccttggactatccctgggtccacgcactcatgtccaggctggtaatttgtcgaaagctactttatgggcagagcccggaagcgtcatctcccggggaaattccgtcactataagatgccagggaactctggaagcccaagaatacaggctagtgaaagagggcagccctgaaccatgggacacccagaaccccctggagcccaagaacaaagccagattttccattcctagtatgacagaacatcacgctggacgataccggtgctattattatagtcccgcaggctggtcagagccctcggaccccctcgaactggtagtgactggattttataataaacccacactctccgccttaccttctccggtggtcacttccggtgaaaacgtgacattgcaatgcggatccagacttcgctttgatagatttatcttaaccgaagaaggcgatcacaagttgtcttggaccctggacagccagcttactccctctggccagtttcaagcgttgttccccgtgggtccggttactccaagccaccgttggatgttgcgctgctatggttccagacgtcacatcctgcaagtttggagtgaaccgtccgatctgcttgagatcccagtctccggggcagccgacaacctcagcccaagtcagaacaaatcggacagcggaacagcctcacatctccaggactacgctgtcgaaaacttgatccggatggggatggccggactcatcctggtggtcctggggatactcatctttcaggactggcacagtcagcggagcccgcaggcagccgcaggcagatag

SEQ ID NO: 10397 - DNA, 618 bp, Artificial Sequence
  Description of Artificial Sequence: Synthetic coding sequence
atgaaagtcttattactcacaggcctcggcgcattgtttttcgcctactactgggacgacaactttgatccaggtgggctcgattacctggtgttgaaccacattgggggtgccccagccggtacacgtgcacgctcccctcaggcgacaagatggcttatgcaggtcaatttcgtgtcctatgtccagctgacttcccgcgcactgccgtccctgacagactcaaaggggagtctcgttgtggtgagctcactgttgggtagggtgcccaccagtttctctactccttatagcgccgctaagttcgcactggatggctttttcggatcgctgcgacgcgagctggacgtccaggacgtgaacgtggcgatcacaatgtgcgtgcttggactgcgagacagggctagtgcagcagaggcagtgcgcggagttacaagagtgaaggctgccccaggcccaaaggctgcactggccgtcatacggggaggtgccacacgcgctgcaggcgttttctacccgtggcgctttcggttactgtgtctgctccggagatggctccccaggccgcgagcttggttcattcgccaagagctgaacgtgaccgccgctgccgcatag

SEQ ID NO: 10398 - DNA, 795 bp, Artificial Sequence
  Description of Artificial Sequence: Synthetic coding sequence
atgttgaggtgtggcggacggggacttctgttgggactggcagtggcagcagctgcggtaatggccgctcggctgatgggatggtgggggccacgcgcaggtttccggctttttattccggaagagctgtcccgctacagaggcggtcctggtgacccgggtctgtatttggcgctcctgggcagggtgtacgacgtaagttcaggtcggagacactatgaacccggatcccactattctgggtttgctgggcgagacgcgtctcgggctttcgtgaccggggactgttcggaggcagggcttgtagacgatgtctctgatctctctgccgctgagatgctcacgcttcacaactggttgagcttttatgaaaaaaactacgtatgcgtgggcagggtgaccggacgtttctacggggaggatggccttccaacccccgcattgacccaggtcgaagccgctattaccagggggctggaggcaaataagctacagttgcaagaaaagcagacatttcccccttgcaacgcagagtggagcagcgcgagagggtctcgcctatggtgctctcagaaaagtgggggagtgagccgggattggataggtgtacccagaaaactatacaaacctggcgcaaaggagccgagatgcgtctgtgtgaggactaccggccctccaagcggccagatgcccgataacccccctcacagaaaccgtggcgaccttgaccaccctaacctcgccgagtatactggatgtccacccctcgctataacttgttcgtttcccttatag

SEQ ID NO: 10399 - DNA, 468 bp, Artificial Sequence
  Description of Artificial Sequence: Synthetic coding sequence
atgtcaaagcgcctgctgctgctgttgttactgtccatgggaggcacgtgggctagcaaagaaccactacgccctcgctgccggccaattaatgcgaccctggcagtggagaaggagggatgccccgtgtgcatcactgtgaatactacaatctgtgcaggttactgtccaaccatgacccgcgtcttgcagggcgttctgccagcgcttccccaagtggtctgtaattatagagacgtgcgattcgagagtatccgtcttccgggttgccctcgcggagtcaatccagttgtcagctacgctgtggctctcagctgccagtgtgccctctgccgtcggtccaccaccgactgcgggggtcccaaggaccatcctcttacatgcgatgaccccagatttcaggactctagcagtagcaaagctccacctccctccctgccaagtccaagtcggctcccaggcccatag

SEQ ID NO: 10400 - DNA, 498 bp, Artificial Sequence
  Description of Artificial Sequence: Synthetic coding sequence
atggagatgtttcagggcctgcttctacttctgctgctgagcatgggcggaacgtgggcttctaaggagcccctaagaccacgctgtagacccataaatgctaccctcgccgtagaaaaagagggctgtccagtctgtatcactgttaacacaacgatttgcgcaggatactgtccaactatgacgcgcgtgttgcaaggcgtactcccagcgcttcctcaagtagtctgcaactacagggatgtgagatttgagagtatccgcttacccggatgccccagaggtgtaaacccagtggtctcatatgcagtggccctgtcctgccagtgcgcactgtgccggagatccacgaccgactgtggcggtccgaaggaccatccactcacttgcgacgatcctcggtttcaggacagcagctccagtaaagccccacccccaagcttgccatctccatcgagactgcccggaccaagcgacacgcctatcctcccacagtag

SEQ ID NO: 10401 - DNA, 990 bp, Artificial Sequence
  Description of Artificial Sequence: Synthetic coding sequence
atgctaccgctgctactaggcctgctggggccagccgcatgttgggcactagggccaacccctggtcctggatccagcgaactaaggtcagccttctcagctgcacgtaccacaccccttgaggggactagtgagatggctgtgactttcgataaagtgtatgtaaacattggaggagatttcgatgtggccaccggccagtttaggtgtagagttccaggggcttacttcttcagcttcacagctggaaaggcccctcacaagtccctctccgtgatgttggtgcgtaatcgcgatgaagtgcaagctttagcatttgacgagcagagacgtccaggggctcgacgggctgcctcgcagtcagctatgctgcagctggattacggcgacacagtctggttgcggctgcatggggctcctcagtatgctcttggtgctcccggtgctaccttctccggatacctggtatacgctgacgccgacgccgacgcacctgcccgaggacccccagcgcctcccgaacccaggtccgccttttccgcggctcgcaccagaagtctcgtggggagcgacgccggtccaggtccaagacaccagccactggccttcgacactgaattcgtcaacataggcggtgattttgacgctgcagccggagttttcagatgccgactccctggggcttacttcttttcattcacacttggtaagttgccaaggaagacgctgtccgttaaactgatgaagaacagggacgaagtccaggctatgatctatgatgacggagcatctcgacgccgtgagatgcagagccaatcagtgatgctcgctttgagacggggtgacgccgtgtggctgctgagccatgaccacgacgggtacggcgcatactccaatcacggaaaatatattacgttcagtggatttctcgtgtaccctgatctggctccagccgctcccccaggccttggggcatctgagttattgtag

SEQ ID NO: 10402 - DNA, 873 bp, Artificial Sequence
  Description of Artificial Sequence: Synthetic coding sequence
atgcggcgtccggcagcagtgcctctattgctgttgttatgtttcggatcacagcgggctaaggcagccacagcatgtgggaggccacggatgctgaatcggatggtcggcggacaggatacccaagaaggtgaatggccttggcaggtctcgattcagcgcaacggctcccacttttgcggcggttcactaatcgcggagcaatgggtcttaacagccgctcactgcttcagaaatacctctgaaacaagtttataccaagtgctcttgggagcgcgtcagctcgtgcagcccggacctcacgctatgtatgcccgagtgaggcaggtggagtctaaccctctgtatcaaggcaccgccagttccgcggacgtcgctctggtggagctcgaggccccagtcccatttaccaactatattctgcccgtgtgcttgccggacccaagcgtcattttcgagacaggcatgaactgctgggttacagggtgggggagcccttctgaagaggacttactccctgaaccacggatcttgcagaagctggccgtcccgataatcgataccccaaagtgcaatctcctgtattccaaagatacggagttcggatatcaacccaagaccattaaaaacgacatgctgtgcgccggattcgaggagggcaagaaagatgcttgcaagggggatagcggcggacctctggtgtgtttggttggtcaatcctggttacaggcaggcgtcatctcatggggcgaaggttgtgcccgtcaaaaccgccctggagtatatatcagagttacagctcatcataactggattcatcgcatcatccccaagttgcaatttcaacctgccaggcttgggggtcaaaaatag

SEQ ID NO: 10403 - DNA, 792 bp, Artificial Sequence
  Description of Artificial Sequence: Synthetic coding sequence
atggcttttctttggctgctgagctgctgggcattactcggcactactttcggctgtggtgtgcctgctatccatcctgtactatccggcctgtcccgaatcgtgaatggcgaggacgccgtgccaggttcctggccctggcaggtgtctcttcaagacaagactggatttcatttttgtgggggatccttgatcagcgaggactgggttgtgacagccgcacattgcggcgtgaggacaagcgatgtcgtggtagccggagagtttgaccagggttcagacgaggagaacattcaggtcctgaagatcgccaaagtctttaagaacccaaaatttagcattctgacagtcaacaatgacattaccctgttgaaacttgctacacccgctcgattctctcagaccgtatcagctgtttgtctgccgtctgcagatgacgacttccctgctgggactctgtgcgccacaactgggtggggtaaaaccaagtacaacgctaacaagacccctgataaattgcaacaggcggctctgccccttctgtcaaacgcggaatgcaagaaatcctggggaaggaggattacagatgtgatgatttgtgcgggtgcgtccggcgtttccagttgcatgggagattctgggggtcccctcgtttgccagaaggacggcgcttggacattagttggtatcgtgagctggggttcccgcacatgctccaccactacccctgccgtgtatgcccgagttgccaagcttattccttgggtgcagaaaatactcgccgcaaactag

SEQ ID NO: 10404 - DNA, 228 bp, Artificial Sequence
  Description of Artificial Sequence: Synthetic coding sequence
atgggcgctgctattagtcaaggcgcactgattgcgatcgtatgcaatggactcgtgggtttcctgcttcttctcttgtgggtgatactgtgctgggcatgccacagccgcagcgcagacgtggatagtttgtcagaaagccggactcaggagtctgcttgcctggagctggaccccgctgcgcaatcactagcatctctcgccccaattggagctcagtggccctag

SEQ ID NO: 10405 - DNA, 762 bp, Artificial Sequence
  Description of Artificial Sequence: Synthetic coding sequence
atggctcggagcctgctcctccctctgcagattctgcttctatctttagcgttagagaccgccggagaagaggcgcaaggagacaaaatcattgatggcgcaccgtgcgctagaggctcacatccctggcaggtagctctgctctccggcaatcagcttcactgtggcggagtgctcgtcaacgagagatgggtgcttaccgctgcccactgtaagatgaacgaatacacagttcacctgggttcagacacactgggcgaccggcgtgcccagcgtatcaaggcttccaaatcttttcggcaccctggatatagcacccagacccacgtcaacgatttgatgctggtaaaactaaacagccaagcccgactctcctccatggtaaagaaagtccgcctgccttctaggtgcgaaccccctggcacgacttgcactgtgagtggctgggggaccacaacctccccggacgtgactttccctagcgatttgatgtgcgtggacgttaaactgatctctccccaagactgtacaaaagtatacaaagatttgctggagaattccatgctgtgcgccggaatcccagactccaagaagaatgcctgcaatggcgattccggcggacctctggtttgtcggggtactctccagggtctcgtctcttgggggacctttccttgtggccaaccaaatgatccaggagtctacacgcaagtgtgcaaatttacgaaatggatcaacgataccatgaagaagcatagatag

SEQ ID NO: 10406 - DNA, 480 bp, Artificial Sequence
  Description of Artificial Sequence: Synthetic coding sequence
atgaaggcgtggggtaccgtggtcgttactctcgccacgctgatggtggtgaccgttgacgccaaaatatatgagagatgcgaactggcagcaaggctcgaacgggctggattgaacgggtataagggctacggagtgggggactggctttgcatggcacactacgagagcgggtttgatactgcattcgtggaccacaatccagacgggtcttcagagtatggtatttttcaactcaatagtgcttggtggtgtgataatggcattacccccaccaaaaacctctgtcacatggactgtcacgacctgcttaacaggcatatcctggacgatatccgatgtgcgaaacagattgtgtcttctcagaatggcctgtccgcatggacttcttggagacttcactgtagcgggcatgatctgagcgaatggctgaagggatgtgatatgcacgtaaaaattgatcctaagatacatccatag

SEQ ID NO: 10407 - DNA, 501 bp, Artificial Sequence
  Description of Artificial Sequence: Synthetic coding sequence
atggctcagacaaactcgttcttcatgcttatctcctcccttatgtttctgtctctgagccaggggcaggaaagccagactgagctacccaacccaagaatctcgtgccccgaagggaccaacgcttacagatcctactgctattatttcaacgaggaccctgagacctgggttgatgccgatctctactgtcagaatatgaatagtggcaacctcgttagcgtgttaacacaggccgaaggagcctttgtcgctagcctcattaaagagagttcaacggacgactccaacgtctggatcggcctgcacgatcccaaaaagaatcgccgatggcactggtcaagcgggtccctagtctcttataagtcctgggatactggttctccttccagtgctaatgccggatattgtgcgagtttgacgtcatgttcggggtttaaaaaatggaaggatgagtcatgcgaaaaaaaattttcatttgtttgtaagttcaaaaattag

SEQ ID NO: 10408 - DNA, 528 bp, Artificial Sequence
  Description of Artificial Sequence: Synthetic coding sequence
atgctccctccaatggcccttccttccgtcagttggatgctcctgagttgtctgatgctgctgagccaagtccaaggagaggaaccacagcgagaattaccgtcggcaaggatccgatgccctaaaggctctaaggcttacggttcccattgttatgccctgttcctcagccccaaatcttggaccgacgcagacttagcctgccagaaaaggcccagtggaaatttggtctctgtgctatcaggagcagaaggatcttttgtttcatccctggtaaaatctattggaaatagttacagctacgtctggataggactgcacgaccctactcaaggaaccgagccgaatggggaagggtgggaatggagctccagcgatgtcatgaattattttgcatgggaacgaaatcctagcacgattagctcccctggacactgcgccagcttgagccggtccactgctttcctccggtggaaggactacaactgtaacgtgagattgccctatgtctgcaagttcactgattag

SEQ ID NO: 10409 - DNA, 1686 bp, Artificial Sequence
  Description of Artificial Sequence: Synthetic coding sequence
atgggggctcggacacccctcccaagtttctgggtttctttctttgctgaaacaggaattctttttccagggggaacaccctggcccatgggatcgcagcactccaagcaacacaggaaacccggtcctcttaagaggggacatcgtagagatagacggaccaccaggaggaaatactggaaggaggggagagaaatcgctagagtgctggacgacgagggacgtaacctcaggcagcagaaactggacaggcagcgagctctgctggaacagaagcagaaaaagaagcggcaggaacccctgatggttcaggccaatgctgatggaaggcctcgctccaggcgcgctcgccaaagtgaggagcaggcaccccttgtggaatcctacttgagctcgtcgggctccacctcttatcaagtgcaagaggcagattcactcgctagtgtgcagcttggcgctaccagacccacagctccggctagcgctaagaggaccaaggcagctgctacagctggagggcagggaggcgctgcccgaaaagaaaagaaaggaaaacataaaggcacttcagggccagctgctctggccgaggataaatctgaagctcaaggacctgtacaaatacttactgttggccagtccgaccatgcccaggatgccggagagacagcggctgggggaggagagcgacccagcgggcaggatttgagggccaccatgcagcgcaagggcatctctagttctatgtcattcgatgaagacgaagaggatgaggaggagaattctagtagctcctctcaacttaacagtaataccaggcccagttccgctacctctagaaagtcggttcgcgaagccgcaagcgctccatcccccacagcgcctgagcagccagtcgatgttgaggttcaggacctagaggaattcgccttacggcctgcaccgcagggtattaccataaagtgccgtatcactcgtgataagaagggcatggacagggggatgtatcctacctacttcctacatctggatcgtgaagatgggaagaaggtgtttttgctggccggacggaagcggaagaagtccaaaacgtctaattacctgatcagcgtggaccctaccgacctcagcaggggcggagactcttacattggcaaactacgttcgaatctcatggggactaaattcactgtgtacgacaacggtgtgaacccgcagaaagcttcatcaagtactctggagtctggaacgctccgccaagagctcgccgcagtgtgttacgagacaaatgtgctgggctttaagggccctcggaagatgtcggtaattgtgccaggaatgaatatggtgcacgaacgagtctctatccgcccacggaatgagcacgagacattgctcgcaaggtggcagaataagaataccgaaagcatcattgaactccaaaacaaaactccagtgtggaacgatgacacgcagtcctatgtcttgaattttcacggccgtgtgacacaggcctcggtgaaaaattttcaaattatccacggcaatgatcctgattatatcgtgatgcagttcggtcgtgttgctgaagacgtctttaccatggattataattacccgctgtgtgctctccaggctttcgccatcgctctgtcaagctttgactcaaaattggcctgcgagtag

SEQ ID NO: 10410 - DNA, 1272 bp, Artificial Sequence
  Description of Artificial Sequence: Synthetic coding sequence
atgatgtaccgaccggatgtggtgcgggcacgcaaacgcgtatgctgggaaccttgggtcattggcctggtaatttttattagcctaattgtcctggctgtgtgtatcggacttacagttcactacgttcgctacaaccaaaaaaagacttacaattactacagtaccctcagctttacaactgataagttatacgctgagttcgggcgagaggcatcgaacaatttcacagaaatgtcccagaggcttgagtccatggtcaagaatgcattttacaaaagccctttgcgcgaggagttcgttaagagtcaggttatcaaattttctcagcagaagcatggggtcctcgcccacatgctgttgatatgtagatttcactccactgaggatcccgagaccgtagataagatagtgcaactggtccttcatgagaaattgcaggatgccgtgggaccgcctaaggtcgaccctcacagcgtcaagataaagaaaataaataaaactgagaccgattcatacctgaatcattgctgcggcacaagaagatccaagacattgggacagtcacttagaatagtggggggaaccgaagtggaagagggagagtggccctggcaagcatctctgcagtgggatggatcccatcgctgcggtgctaccctaataaatgcaacttggctggtgagcgctgcacactgtttcactacctacaagaacccagccaggtggacagcctcattcggagtcaccatcaaaccctccaaaatgaagcggggtttgagaagaatcattgtgcacgagaaatacaaacaccctagccacgactatgacatctctctagctgaattatcgtctcccgtgccctacaccaacgcggtccatcgggtgtgcctacctgacgcttcatacgagttccaaccaggtgatgtaatgtttgtcacaggctttggggctcttaagaatgatggatactcacagaatcacctacggcaggctcaggtgaccctgatcgacgccacgacgtgcaatgaacctcaggcgtataacgacgccataaccccccgaatgctgtgcgcaggaagccttgagggcaaaactgacgcatgtcagggagactcagggggaccacttgttagcagtgatgcccgtgacatatggtacctagctgggattgtgtcatggggggacgagtgtgccaaaccgaataagcccggtgtctatactcgtgtaactgcattaagagactggattactagcaagacaggtatttag

SEQ ID NO: 10411 - DNA, 282 bp, Artificial Sequence
  Description of Artificial Sequence: Synthetic coding sequence
atgaagcccgtgctaccccttcagttcctggtggtgttttgtctggcactgcagctggtgccaggctccccaaaacagcgtgtgctgaaatacatcctggaacccccaccttgcatttcagcccctgaaaactgtacacacctctgcaccatgcaagaggactgcgagaagggattccagtgttgctcttccttctgtggaattgtgtgttcttcagaaactttccagaaaaggaaccgcatcaagcataagggcagtgaggtcatcatgccagctaattag

SEQ ID NO: 10412 - DNA, 1530 bp, Artificial Sequence
  Description of Artificial Sequence: Synthetic coding sequence
atggattttcttctggctctggtgctcgtttcctctctgtatctgcaggccgcagctgagtttgacgggaggtggcccaggcagatagttagctctatcgggttgtgtcgctacggcggtcgcattgattgctgttggggctgggccaggcagtcctggggtcagtgccagcctgtctgtcagccacgctgtaaacacggggagtgcatcggaccaaacaaatgtaaatgccatcctggttatgcgggtaaaacttgcaatcaggacctgaatgagtgcgggctgaagccgaggccttgcaagcataggtgcatgaatacttacggttcctataagtgctattgtctgaatggatacatgctgatgcccgacggatcatgctcctcggccctgacgtgcagcatggctaactgccagtatggctgtgacgtcgttaaaggtcagatacgttgtcaatgtcccagtcccggtcttcagctggcaccagacggtagaacttgtgtggatgttgacgagtgtgccaccggaagagcatcttgcccccgattccgccagtgtgtgaacacctttggttcatatatctgcaagtgtcataaggggtttgatcttatgtacataggtggtaagtatcagtgtcacgacattgatgagtgctcacttggacagtatcaatgtagttcctttgcccgttgctacaacataaggggatcctacaagtgcaagtgcaaggagggatatcaaggagatggtctgacctgcgtgtacataccgaaggtcatgattgaaccgagtggccctattcacgtcccgaagggaaacggtactattttaaaaggtgacaccggcaataataactggattcccgacgttgggagcacctggtggcctccaaagactccctatattcctcctatcatcacgaataggcccaccagcaagccaaccactcgccctacaccaaagcccactccaatacctacgccaccaccccctcctccactgcctaccgagttgcggactccgctaccaccgacaacgcccgagcgcccaaccacgggtctgaccacgatcgcccctgccgcttctaccccacccggtgggatcacagtggacaatcgcgtgcaaacagacccccagaaacctcgcggtgatgtgttcagtgtcctagtgcactcctgcaattttgatcacggactgtgcggatggatcagggaaaaggataacgacctccactgggagcccatcagagatccggctgggggacagtacttgacagtctctgcagcgaaggctcccggagggaaagccgcaagactggttctgcccttaggacggctcatgcactcaggagatttatgccttagcttcagacataaggtcacgggcttacatagcggcactctacaggtgtttgtgcgaaagcatggcgctcacggggctgccttgtggggcaggaatggtggacacggctggcgacagacacagatcacgctgaggggcgctgatatcaagtcggaatcccagaggtag

SEQ ID NO: 10413 - DNA, 381 bp, Artificial Sequence
  Description of Artificial Sequence: Synthetic coding sequence
atggataaatcactgctgcttgagctgccgattctcctttgttgctttagggcgctttccgggtcgctgagcatgaggaatgacgccgtgaatgaaatcgtcgctgttaaaaataacttccccgtgatcgaaatcgtacagtgtagaatgtgccacctgcagtttcctggtgaaaagtgttctcgtggccgaggcatatgcaccgccaccacagaggaagcttgcatggtcgggaggatgtttaagagggatgggaacccatggttgactttcatgggatgtttgaagaactgtgcagatgtgaagggcatcaggtggagcgtttatctcgtgaacttccggtgttgccgatctcatgacctgtgcaacgaagatctctag

SEQ ID NO: 10414 - DNA, 537 bp, Artificial Sequence
  Description of Artificial Sequence: Synthetic coding sequence
atggaattgctccaggtgacaattctgttcctgctgccctcaatctgttcgtctaactcaaccggagtgctggaagcagcgaataatagtttggttgtcactacaaccaagccgtcgatcacgacacctaatacggaatcactgcaaaaaaatgtggtcacccctactaccggtacgacacccaagggcacgattacaaatgagctgcttaagatgtccctgatgtcaactgccacgtttcttacatccaaggacgaggggcttaaagccaccactactgatgtccgaaagaacgattcaataataagcaacgtaaccgttacttccgttacattaccgaacgccgtctccactctccagagcagtaagcccaagactgagacgcagtccagcatcaagactaccgaaattccgggtacaccagagaacggcaatgatcagccccagagcgataaagaatctgttaagttgttgaccgtgaagactatctcacacgagtctggtgaacactcagcacagggcaagactaaaaattag

SEQ ID NO: 10415 - DNA, 2544 bp, Artificial Sequence
  Description of Artificial Sequence: Synthetic coding sequence
atgtttaaatgttggagtgttgtcctcgtgttgggatttattttcctggagagcgaaggcagacccactaaagagggcggttatggattgaagtcttaccagccccttatgcgcctgcggcacaaacaggagaagaaccaggaaagttcccgggttaaaggttttatgatccaagatggaccattcggttcttgtgaaaacaaatattgtggtctcgggcgacactgtgtgacttctagagaaaccggtcaggccgagtgcgcttgcatggacctgtgcaaacggcactataaacctgtgtgtggaagcgacggagaattttatgagaaccactgcgaggttcatcgggctgcctgtttaaagaagcagaaaattactatcgtacacaatgaggattgtttcttcaaaggcgacaagtgcaagacaaccgagtactcaaagatgaagaacatgcttctggatctgcagaaccagaagtatatcatgcaagaaaacgagaacccgaacggagatgacattagtagaaaaaaactgttagtggatcagatgttcaaatactttgatgccgattccaatggcctcgtcgacatcaacgaactcacccaagtgatcaagcaggaagaactgggcaaagatctcttcgattgtacactgtacgtgctgctcaagtatgacgacttcaacgcggataagcacttagcccttgaagagttctaccgtgctttccaagtcatacagttgagcctcccagaagatcagaagctgagtatcacggcagccactgtgggccaaagtgcagtgctctcatgcgccattcaggggacattgaggcctccgatcatctggaaacgcaataatattatcctaaataatttggatttggaagacattaatgactttggggatgatggctccttgtatataacaaaagtgacaacaactcacgtcgggaattacacatgctatgctgacgggtacgagcaggtttatcagactcacattttccaggtcaatgtgccccctgtcatccgcgtctacccagaaagtcaggccagggaaccaggcgtcactgcctccctgcgctgtcacgctgaaggaattcccaaaccgcagttagggtggctcaagaatggaatcgacattacccccaagctgtcaaagcagctgacactacaggcgaatgggtcagaggtacacatctccaacgtgaggtacgaagataccggggcttacacttgtatagcaaagaatgaggcaggcgtggatgaggacatttcatccttgtttgttgaggattccgctcgaaagacacttgcaaatattttgtggcgtgaggagggactcggcattgggaacatgttttacgtattttatgaggacgggattaaagtgatacagcctatcgaatgcgagtttcaaagacacatcaagccctctgagaagttactcggatttcaggacgaggtatgccccaaagcagagggagatgaggtgcagcgatgcgtgtgggcatcggccgtgaatgtgaaggacaagttcatctacgtggcgcagcctacactcgaccgggttctgatagtcgacgtgcagtctcagaaggtggttcaggcggtttctacagacccagtcccagtaaaactccactatgataaatcccatgatcaagtgtgggtactctcctggggcaccctcgagaaaaccagccccacccttcaggtcattacattagcatctggaaacgtgcctcatcatactatacatacccagcccgtggggaagcagttcgatcgagtggacgatttctttattcccaccaccaccctaattatcacgcacatgagatttggatttattctccacaaggacgaagccgctctgcagaaaattgacttagaaacaatgagctatatcaaaacaatcaacttgaaggactataaatgcgtaccccagagtctggcctacacccacctcggtgggtattacttcatcgggtgcaagcctgattctacaggcgctgtcagtcctcaggtgatggtggatggagtcactgattcggtgattggcttcaatagtgatgtaactggaacaccctacgtgagcccagacggccattacttggtgtccatcaacgacgtaaaaggattggtaagggtgcaatatattaccataaggggcgaaattcaggaagcctttgacatatatacgaacttgcacatttcggacctggccttccaacccagcttcactgaagctcaccaatacaacatctacggaagctccagcacccaaaccgacgtgctgtttgtggagctgtcatcaggaaaagttaagatgattaagagtctgaaggagccgcttaaagcagaggaatggccatggaacagaaaaaacagacaaatccaggattccggcctgtttggccagtacctcatgaccccaagcaaagactcacttttcattttagacggacggcttaacaaactgaattgtgagattactgaggtggagaaggggaacaccgtcatctgggtgggtgacgcttag

SEQ ID NO: 10416 - DNA, 273 bp, Artificial Sequence
  Description of Artificial Sequence: Synthetic coding sequence
atgagactcagcgtctgtttactcctgctgacactggcactatgctgttatcgggctaacgctgtggtttgtcaggccctcgggtcagaaattacaggcttcctgttggccggtaagcctgtgttcaaattccagctcgccaagtttaaggcaccactggaagccgtggctgccaagatggaagtgaaaaagtgtgtggacactatggcctacgagaaacgagttcttatcaccaagaccttggggaaaattgcagagaagtgcgaccgctag

SEQ ID NO: 10417 - DNA, 1044 bp, Artificial Sequence
  Description of Artificial Sequence: Synthetic coding sequence
atgtccagttggtctcgacaaagaccaaaatcacctgggggaatccaacctcatgtttccagaacactgttcctgttgctgctgcttgccgcatccgcgtggggagtgactctcagccctaaggactgccaggtcttccgaagcgaccacggatcaagcatcagttgccagccgccagctgagataccagggtatctgccggcagacacagtgcatcttgctgttgagttctttaatctcacccatctgccagcaaatctccttcaaggagccagtaagctccaggaactgcacttgtcatctaatggtctagaatcattgtctcccgagtttttgcgtcctgtgccacagttgcgagtccttgacctaactaggaacgccctgaccggacttcccccaggactcttccaggcttccgcaactctggacacactggtgctcaaagagaatcagctggaagttctagaggtgagttggctgcatgggctcaaggctttgggtcacctcgatttatccggcaacaggttgaggaaattacctccaggcttactggccaatttcaccttactacgaacattggacctgggcgagaaccagttggagactctcccgcctgacctgctccgaggccctctccagctcgagaggctccacctggaaggaaacaaactgcaagtactgggaaaagacctgctgctccctcaaccagatctgaggtatctattccttaatggcaataagctagcccgtgtggccgcaggggcattccaaggacttaggcagctcgatatgctagacctgagtaataattcattagccagcgtgcccgaggggctgtgggcttctctggggcagcccaactgggatatgagagacgggtttgacatttctggaaacccttggatttgcgatcagaatctgagcgatctgtatagatggctccaggcgcagaaagacaagatgttttctcaaaatgacacccggtgcgccggtcctgaagccgtgaaagggcagaccctccttgcagtcgccaagtcccagtag

SEQ ID NO: 10418 - DNA, 1407 bp, Artificial Sequence
  Description of Artificial Sequence: Synthetic coding sequence
atgccgccttggggagccgcactggccttgattctggcggtcctcgctctcttagggcttttgggtccccgtctgcggggtccttggggcagagccgtgggcgagcggaccttgcctggtgcacaagacagggacgatggtgaagaagctgatggcggaggtcccgctgatcagttttcagatgggagagaacccttgccaggaggatgttcgttggtgtgcaaacctagcgccctggcccagtgcctcctgagagctctacggcgatccgaggcactcgaggcgggaccacgctcgtggttttccggcccacacttgcagactctatgccacttcgtacttcctgtcgcaccaggacctgagctggcccgagaataccttcagctggccgacgatggactcgttgccctggactgggtagtcggtccttgcgtacgaggcaggagaatcaccagtgctgggggacttcctgcagtgttgctcgtaatccccaatgcttggggacgattaacgagaaatgtgctcgggctttgcctgcttgcactggagaggggctactatcctgtgatcttccatagaaggggtcatcatggttgcccattggtttctcctcgcctgcaaccattcggcgatccttcagatctgaaagaagcagtaacctacattcgctttagacaccctgcggctccactttttgcagtctctgaggggagcgggtcagccctgttgttatcatatttgggggagtgcgggagcagtagctatgtgaccggcgcagcttgcatctccccggtgctgaggtgtcgcgaatggtttgaggccggactgccctggccttacgaaagagggtttctgctgcatcagaagattgctcttagtaggtatgccacagctctagaagataccgtggacacctctcgcctgttccgctcacggagcttgagggagttcgaagaggctctcttttgtcatactaaaagttttccaatttcatgggatacatactgggacaggaatgacccactccgcgatgttgatgaagcagccgtcccggtgctgtgtatttgctctgccgatgacccggtctgcgggccacctgatcacaccctgaccactgagctatttcactcaaatccctactttttcctactactctctagacatggaggccattgcggctttctccgccaagaacccctgcctgcctggtcccatgaggttatccttgaaagctttcgcgcactgaccgaattttttcggactgaggaacgaattaagggtctatcgcgacacagagctagcttccttgggggaaggaggcgagggggagccttacagagacgcgaggtgtcaagcagctcaaacttggaggagatcttcaactggaagcgttcctacacccggtag

SEQ ID NO: 10419 - DNA, 423 bp, Artificial Sequence
  Description of Artificial Sequence: Synthetic coding sequence
atgttttttactatctcaagaaagaacatgagtcaaaagctctcactgcttctccttgtgttcggtctcatttggggtctgatgctgttgcattacaccttccagcagccacgtcaccagtcctctgtaaaattgcgagagcaaatcctcgatctctccaagaggtacgtgaaagctttggccgaggaaaacaagaacacagtcgacgttgagaatggcgcttcaatggccggttatgctgaccttaagcggacgatcgcagtgctcttggacgacattctccagagactggtgaaacttgaaaataaggtcgactatatcgtggtgaacggatcagctgccaacaccactaacggcacttccgggaacctggtaccagtcacaaccaataaacgcactaacgtgtccggatccatccggtag

SEQ ID NO: 10420 - DNA, 993 bp, Artificial Sequence
  Description of Artificial Sequence: Synthetic coding sequence
cgaggagctctcgtgggagcacctagaagtgcacgggcaagctgcctgcgtggcaggaggcccggaagacggcagccctgcggcagatgccccgatccgcctagatctggccctggccaagccggtagggcaagatgcgccagagatgttgcagctcagacagctctggcaccacgtgccctggctctgggtgctggcgcagccggaccaggatggagaggggctgtgccccgacgacccgcagcgcgagtgtctagagccgcacaaagacaggagcaagaactggtgcgcctgcacagagagcaggaatgcgagcttcagcccgagcccgctccacccaggccctccgggccagcgaccgcagaggacccgggtaggcgccctgtgctgccacagagaccccctgaggaaagacctccgcagccacctgggagcacaggcgtgatcgccgaaacaggccaggccggaccacctgccggtgccggagtcagcggctaccctaagtcaccccctgttgcttcacccggagcacccgtcccatcccttgtgagcttttcagctggcctcacacaaaagccttttcctagtgacggcggagtggttttgttcaacaaagtgctagtgaacgacggggatgtgtacaatccctcgactggcgttttcactgcaccgtatgatgggagataccttatcacagccacactaacccccgagcgtgatgcatacgtggaggccgtgctttccgtcagcaacgctagtgtcgctcagctgcacaccgctggatacagacgggagtttctcgagtaccatcgcccaccaggagccctccatacgtgtggcggtcctggcgcattccatcttattgtccatctgaaggctggcgatgctgtgaatgtcgttgttactggagggaagctagcccataccgattttgatgagatgtactccactttctcaggcgtgtttctgtatccttttctgtctcatttgtag

SEQ ID NO: 10421 - DNA, 585 bp, Artificial Sequence
  Description of Artificial Sequence: Synthetic coding sequence
atgtctgccctgtggctcctcttagggctgctcgcccttatggatctttcagagagttctaattgggggtgctatggcaacattcagagtctggacacgcccggtgcttcgtgtgggattggtcgccgtcacgggctgaactactgcggcgtaagggcatctgaaaggttggcggaaatcgacatgccctacttactgaaatatcaacccatgatgcagacaataggccagaagtattgcatggatcccgctgtgatcgccggagtcttaagcagaaaatcacctggagataagattttagtgaacatgggggatagaacatccatggtccaggatcccggttcccaggctccaaccagctggatctcagagtctcaggtttctcagaccacggaggtgctgacaacccggataaaggagatacagcggagattccctacgtggacaccagaccaatatctgagaggaggcctctgcgcgtactccggaggcgctggatacgtgcgaagctcacaagaccttagctgtgatttctgcaacgatgtgctggcacgggctaagtacttgaagcgccatggcttctag

SEQ ID NO: 10422 - DNA, 273 bp, Artificial Sequence
  Description of Artificial Sequence: Synthetic coding sequence
atgaagtttctggccgtgctcgttcttttgggggtgagtattttcctggtatccgcccagaatcccacaacggctgccccagctgatacctaccccgctaccgggccagccgacgacgaagcgccagatgcagagactacagccgctgccaccaccgcgactaccgccgcaccaactacggccaccacggccgcttcaacaaccgctcggaaggatatcccagtactcccgaaatgggttggagatctaccgaatggtagggtctgtccttag

SEQ ID NO: 10423 - DNA, 1914 bp, Artificial Sequence
  Description of Artificial Sequence: Synthetic coding sequence
atgtctaggatgctgccctttttactcttactgtggttcctgcccattacagaaggttcacagagagccgagccaatgttcaccgccgtgacaaattcagttctcccccctgattatgatagcaaccccactcagctaaactacggcgtagccgtgaccgacgtagaccatgacggggatttcgaaattgtggtggcaggctacaatgggccaaatctcgtgctcaagtatgatagggctcagaagcgcctggttaacatcgccgtcgatgaacgatcttccccctactacgccctgagagatagacaggggaacgccattggagtcaccgcctgcgatatcgacggagacggcagggaagagatctattttctcaacaccaataacgcttttagcggcgtcgctacctacaccgataagctcttcaaattcaggaacaatcggtgggaggacatcctgtctgacgaggttaacgtggctaggggtgtggccagtttgttcgcgggtcgaagcgtagcatgtgtcgaccgcaagggaagcggaaggtacagcatctatatagcgaactatgcctatggtaacgtgggccctgatgccctgatcgagatggacccagaagccagcgacctgagccggggaatcctagccctaagggatgttgctgctgaagccggtgtgtccaaatacaccgggggacggggtgtgtccgttgggccaatcttgagctcctctgccagcgatatcttctgtgataacgagaacggacctaactttttatttcacaacaggggagacggcacgtttgtggacgctgctgcgagcgcaggcgtcgacgaccctcatcaacatgggcgtggggtggcactcgccgatttcaacagggatggcaaagtagacatcgtgtacgggaattggaacgggcctcaccgattatacctacagatgtccacccatggaaaggttaggtttcgggacattgcgagcccaaaattttctatgccatcccccgtgcgtacggttattacagcagacttcgataacgatcaggaactcgagatcttttttaataacattgcctataggtcttcctccgccaatcgcctttttagggtgattaggcgagagcatggtgacccattgattgaggagctcaatcccggtgatgcgttggaacccgaggggcgaggaacagggggagtagtcactgactttgatggcgatggcatgttggacctgatcctttctcacggggagagcatggcacagcccctgagcgtgttccggggaaatcaggggttcaacaataactggctgcgagtcgtgccccgaactaggtttggcgcattcgccaggggagccaaggtggtcctatacactaagaagtcaggtgcccatctgcgcataatcgacgggggttcgggatacttgtgtgagatggagcccgtggcgcatttcggacttggaaaagatgaagcctctagcgtggaggtaacgtggccggatgggaaaatggtgagtagaaacgttgcaagcggtgaaatgaatagtgtcttggagatactatacccgcgtgacgaagatacactgcaagatccggcacctctcgaatgcgggcaaggatttagccaacaagagaatggccattgcatggacacaaatgagtgcattcagttcccctttgtctgccccagagataagcccgtgtgcgttaatacttacggctcctacaggtgcagaaccaataagaagtgctctcggggatacgagcccaatgaagatgggactgcctgtgtagcgcaggtggccttcttgggcggatatagttccgcggcaagccggatatcagagccacttagtcgggcttcttatctcagccttgggcttggactgtgcttacagttgtacgctctatag

SEQ ID NO: 10424 - DNA, 600 bp, Artificial Sequence
  Description of Artificial Sequence: Synthetic coding sequence
atggctcttaatggcgcagaggttgacgacttctcctgggaaccccctacagaagctgagacaaaggtactccaggcccgacgggagcgccaggacaggatctcaagactgatgggtgattatcttctgaggggataccgcatgctgggcgagacctgcgccgattgcggaacgatactcttgcaggacaaacaaagaaagatatattgcgtggcatgtcaggagctggattcagatgttgataaggacaaccccgcactgaatgcccaagctgccctttcacaagccagagagcaccagctggccagcgcttccgaacttcccctgggaagtaggccagcccctcagcctccggtgcctaggccagagcactgcgagggtgctgccgctggtcttaaggctgcccagggtccacctgccccagcagtccctcctaatactgacgtcatggcctgcactcagacggcactactgcagaagttaacctgggcctccgctgaactgggtagtagtacctctctggagaccagcatacagctgtgtggtctgatccgagcctgcgctgaagcgttaaggtctttacaacaactgcagcattag

SEQ ID NO: 10425 - DNA, 813 bp, Artificial Sequence
  Description of Artificial Sequence: Synthetic coding sequence
atgaagctgggctgcgttctaatggcctgggctctgtatttgtccttaggagtgctatgggtcgcccagatgcttctggccgcttcattcgagactctgcagtgtgaggggcctgtgtgtactgaagagtcctcatgccatacagaggacgaccttactgatgccagagaagctggattccaggttaaagcctacacgttttctgagccgttccacctgattgtttcttacgaactcttccccgcacctattctgcgcgcagttccttccgctgaaccacaagccggtagtcccatgaccttgagctgtcagaccaaacttcccctccagcggagcgccgcaagactgctgttcagcttctacaaagacggcaggattgtgcagagtagggggctgagcagcgaatttcaaatacccaccgctagcgaggatcactccgggagctattggtgtgaagctgccaccgaggacaaccaggtatggaagcagagtcctcagctggagattcgggtgcagggggcttcttcatccgcggcacctcccaccctcaaccctgctccccagaagtccgcagctccaggcactgcgcctgaagaggcgcctggccctttaccaccccctcctaccccctcctccgaggacccaggcttctcctctccgttaggcatgcctgacccgcacctttaccaccagatgggattactgctgaagcacatgcaggatgtgcgggtcctactcggacacctgcttatggagcttcgggaattgagcggtcacagaaagcccggtacaactaaggctacagctgagtag

SEQ ID NO: 10426 - DNA, 2421 bp, Artificial Sequence
  Description of Artificial Sequence: Synthetic coding sequence
atgcgtctgtctccagcacctctgaaattaagccggacgcctgcactacttgccctggcactgccactggccgctgctcttgctttctcggacgagaccttggacaaggtcccgaagtctgaagggtattgctcccggatcttacgagcccaggggacccgcagggaggggtacactgagttctctctccgggtcgagggggaccccgatttttataaacccggaacgtcttaccgagtgactctctctgccgcacccccttcttactttcgcggttttactctgatagctctccgagagaatagggagggtgataaggaggaagaccatgccggtactttccagattatcgatgaggaggagactcagtttatgagcaattgtcccgtcgccgtcactgagagtaccccaagacgacgcacaagaatccaagtcttttggatcgcacccccagccggaacaggttgcgtcattttaaaggcctcgatagttcagaagaggattatctactttcaggacgaggggtctttgacaaaaaagctgtgcgagcaagatagcacatttgacggcgtcaccgacaagccaatcctggattgttgctgcggaactgccaagtatagactgacattttacggcaactggtccgaaaagactcatccaaaagattaccccagacgggctaaccactggagtgctatcataggcggaagccacagtaaaaattacgtgctgtgggaatacggtggttacgccagcgagggcgtgaagcaagtagctgaactgggttcccctgtgaaaatggaagaagagatccgccagcagagtgatgaggtcctcaccgttataaaggccaaagcgcaatggcctgcctggcagcccttgaatgtgcgcgcagcaccttccgccgaattctccgtggataggacccggcacctgatgtcattcctgaccatgatggggccaagtcccgattggaacgtaggtctgtccgctgaggacctgtgcacgaaggagtgcggatgggtccagaaggtagtccaggacctgattccatgggacgccggaactgattctggcgtcacttacgaatctccaaataaaccgactattcctcaggagaaaattcggccactgacaagtctcgatcatccacagtccccgttttatgaccctgagggaggttctataactcaggtggcaagggtggtgatcgaacgaatcgcccgaaaaggggaacaatgcaatatcgtaccagacaacgtcgacgatattgtcgccgacctcgctcctgaagaaaaggacgaagatgacactcctgagacctgtatctactcgaattggtcaccttggtcagcatgctccagttctacttgtgacaaggggaagcgcatgcggcagcgaatgctgaaagcgcagctggacttgtcagtgccatgtccagacacccaggattttcagccatgtatggggcctgggtgctctgacgaggatggaagtacttgtaccatgtcagaatggatcacatggtccccctgcagtattagttgcggaatgggcatgaggtcaagggagcggtatgtcaaacagttccccgaagatggctctgtgtgcactctgcccactgaggagactgagaagtgtactgtcaatgaggagtgtagtccctcctcttgcttgatgaccgaatggggtgaatgggatgaatgttccgcaacttgtgggatgggcatgaagaaacgacacaggatgattaaaatgaaccctgcagacgggagcatgtgtaaggctgaaacatcgcaggccgaaaaatgtatgatgcccgaatgtcacaccatcccctgcctgctgtccccttggagtgaatggtcagactgttcggtaacttgtggcaagggaatgaggacccggcagagaatgcttaagtctcttgccgagctgggggattgtaacgaggacctggagcaggttgagaagtgcatgcttcccgagtgtccgatagactgcgagctgacagagtggtcccagtggtcagagtgcaacaagagttgcggaaaaggccacgtgatcaggacccgcatgattcagatggagccccagttcggaggcgctccgtgtcctgaaaccgtccagagaaagaagtgtcggattagaaaatgtttacgtaatccttctattcagaaactgagatggagggaagcccgagaaagcaggcgatcggaacaactgaaagaggagagcgaaggcgaacagtttccaggatgtcgcatgcggccatggactgcttggtccgagtgtacaaagctgtgcgggggaggtatccaggaacgctatatgaccgtgaagaagagatttaagtcctctcagttcacctcatgtaaggacaagaaagagatccgggcatgtaatgttcatccatgttag

SEQ ID NO: 10427 - DNA, 4242 bp, Artificial Sequence
  Description of Artificial Sequence: Synthetic coding sequence
atgagacacggtgttgcgtgggcactgctcgtggcggcagcactgggacttggggcaaggggtgttcgcggagcagtggcgcttgcggatttctaccccttcggagccgagcggggagacgccgtcactccaaagcaggacgatggcggatctgggctgagaccactgtccgtgccgtttccgttctttggcgcagagcactctgggttgtatgtaaataacaacggaatcattagcttcctgaaggaagtctcccagttcacccccgtggctttccccattgccaaagaccggtgcgtggtggcggcattctgggctgacgttgacaacagacgagcaggagatgtgtactatcgcgaggctacagatcccgcaatgctgagacgggctaccgaagacgtcagacactattttcctgagctgctcgactttaacgcaacctgggtattcgtggcaacatggtaccgggtcacgttcttcggtggctcatccagctcgcccgttaataccttccagacagttctgattactgatggaaagttgtccttcacaattttcaattacgagtccattgtgtggacaactggaactcatgcttcttcaggcggaaatgctaccgggctgggcggtatagccgctcaagctggctttaatgctggggacggacaacgttacttctccatccctggttcacgaactgctgatatggctgaagtggaaacaacgaccaatgtgggcgtcccaggtcggtgggcttttcgtatagacgatgctcaggtgagagtgggtggatgtggccacacgacaagcgtgtgcctggcactgcgcccttgccttaacgggggtaagtgtatcgatgactgtgtgacaggcaatcctagctatacctgtagctgtttgagcggcttcacagggcgtagatgtcatcttgacgtaaacgaatgcgcctcgcagccttgccagaacggtgggacatgcacacacgggattaatagttttcggtgccagtgccctgcaggtttcggcggacccacatgcgagaccgcgcagtccccatgcgacactaaggaatgccagcatgggggacagtgccaggtggaaaatggctcggcagtctgcgtatgccaggcaggctacacaggagctgcgtgtgagatggacgtggatgactgttccccagacccgtgcctcaacgggggtagctgtgttgatctggtggggaactacacttgtctatgcgctgaacctttcaaggggttacggtgcgagaccggagatcatcctgtccctgatgcctgtctgagcgcaccatgtcataacggtggaacttgcgttgacgcggatcagggctatgtgtgtgagtgccccgagggcttcatgggtctcgattgccgtgagcgcgtgccagacgactgtgagtgtcgcaatggcggtcgatgtctgggggctaacacgacactgtgccaatgtccgctcggcttttttggactattgtgcgagttcgagattaccgccatgccatgcaacatgaatacccagtgtcctgacggcggttactgcatggagcatggtggaagctacctttgtgtgtgccataccgatcacaatgccagccactcgctgccctctccttgtgacagtgacccctgctttaacggtggcagctgcgacgcccatgatgactcctacacctgtgaatgcccacgcggtttccacggtaagcactgtgagaaagctcgcccacacttgtgttcatcaggtccctgtcggaacgggggaacttgtaaagaagctggtggcgaataccattgcagctgtccctaccgatttacaggccgtcattgtgagattgggaaaccagattcctgcgccagtggcccttgccacaacgggggaacatgttttcactatatcggaaaatacaagtgtgactgtcctccgggattcagtggtcggcattgcgagatcgcgccatctccatgttttcgcagcccatgcgtgaacggcggtacctgtgaggatagggacaccgactttttttgccattgccaggccggttacatgggtcgcagatgtcaggccgaggtggattgtggtccacccgaagaagtcaagcacgccactttgcgatttaatgggacccggctgggcgctgtcgcgttatatgcatgtgatagaggatattctttatctgccccaagtagaatccgggtctgccagccacatggggtgtggagtgaacctcctcaatgcctcgaaattgatgagtgtcgctcccagccttgcctgcacggcggttcttgtcaagacagagtggccggatatctttgtctgtgtagtaccggctatgaaggcgctcattgtgagctggaaagagacgagtgccgagcccacccttgcaggaacggcggatcatgccgaaacctgcctggtgcttacgtctgcaggtgccccgctgggttcgtcggtgtgcactgcgagaccgaggtcgatgcctgtgactcatcaccctgtcagcatgggggtagatgcgagagcggcggaggagcctacctttgtgtgtgtcctgagtcgttctttggttaccattgcgaaacagtatcggatccttgcttctctagcccttgtggcggacggggatactgtctggccagtaatggttctcatagctgcacctgcaaggttgggtatactggcgaggactgcgcaaaagaactatttcccccaactgcactgaaaatggagagagtggaagagtcgggggtgagcatcagctggaaccccccaaatggtcccgctgctagacagatgctagatggctacgccgtaacttacgttagttctgacggcagctacagaagaactgatttcgttgaccgaaccaggtcttctcatcagctgcaggccctggccgcaggccgagcttacaatatttctgtcttttcagtcaaaaggaacagcaataacaagaacgacatctcaagaccggctgtcctgctggccaggacgcgccctagacccgtcgaggggttcgaagtgaccaatgtcaccgctagtaccatcagcgtgcagtgggcactacacagaattcgccacgctacagtcagcggtgttagggtgtcaataaggcatccagaggccctaagagaccaggcgacggacgttgatcgttctgtggataggttcacattccgcgcactgttaccagggaaacgctacacaattcagctgaccaccctaagtggactgcgcggagaggaacaccctactgaatcgctggccacagcacctactcatgtgtggacgcgccctttgccccctgccaacctaacagctgcacgggtgacagctacaagcgcacacgtggtgtgggacgccccaacacccggatcgctcctggaggcctatgtgattaatgtcaccacttctcaatccaccaagtccagatacgtgccgaacggaaagctcgcttcatacacagtgagggatctgctccctggtcgcagataccagctcagcgtcatagctgtccaatccaccgagctaggcccacaacattccgagcctgcacacctgtacatcatcacgtcacccagggacggggctgatcgcaggtggcaccaggggggtcaccacccacgtgtactcaaaaaccgacctccaccagccaggctcccagagttgagactgctgaatgaccactctgcccctgaaaccccaacccagccaccacggtttagtgagttggtggacggaaggggccgagtctccgccaggtttggtggcagcccctcaaaagccgcaaccgtgcggtcgcaaccaacagcctccgctcagttagagaatatggaggaggccccaaaacgtgtcagccttgctctccaattgccggagcatggcagcaaggatattggaaatgttccaggaaactgcagtgaaaacccatgccaaaatggaggaacttgtgtccccggagcggacgctcattcttgcgactgtggccctggctttaaggggaggagatgtgagctggcttgcattaaggtgagcagaccatgcacccggcttttctctgagaccaaagccttccccgtgtgggaggggggagtctgccatcatgtgtacaaaagggtgtatagggtccatcaggacatctgctttaaagagtcctgtgagagtaccagtttgaagaaaacaccgaaccggaagcaaagtaagagtcagaccctcgagaagtcgtag

SEQ ID NO: 10428 - DNA, 1008 bp, Artificial Sequence
  Description of Artificial Sequence: Synthetic coding sequence
atgtttctggctacattatctttccttcttccttttgcacacccttttggcaccgtcagctgtgagtatatgctgggaagccctcttagttctctggcccaagttaacctgagccctttcagtcaccctaaagtgcacatggatcccaattattgtcacccatcgacatctctgcatctttgctctctggcgtggagttttactcggctgctgcaccccccactcagcccaggaattagtcaagtcgtaaaggatcacgtgacaaaacccacagccatggcccagggtagggtggcacatttgattgaatggaagggctggtcaaaacctagtgattcccccgctgcactggagtctgcgttctcctcatattccgacctgagcgaaggagagcaggaggcgaggttcgccgcaggcgtagccgagcagtttgctatagccgaagcaaagctccgggcttggagtagcgtggacggggaggatagcaccgacgactcatacgatgaagacttcgccggaggtatggacactgatatggccggacaactcccactggggccacatttgcaggatcttttcacaggccaccgcttcagtaggccggtcaggcagggaagcgtcgaaccagaaagcgattgcagccaaactgtctcgcccgatacgttatgcagttccctttgctccctcgaggacggcctgctggggtcacctgccagattggcatctcaattactgggtgatgagctgttactggcaaaactaccccctagcagagaatctgcttttagaagtctgggaccccttgaggctcaagactcattgtataatagcccgcttaccgagtcatgtctctcccctgctgaagaggagccggctccatgtaaggactgccagcccctctgtccacctctgaccggctcctgggagagacaacgacaggcatctgacctggcatcttccggcgtggtcagcctggatgaggacgaagcagaacctgaggaacagtag

SEQ ID NO: 10429 - DNA, 828 bp, Artificial Sequence
  Description of Artificial Sequence: Synthetic coding sequence
atgcagccaccaggtccaagggaccctcttataagactctgcttcttccgcgaagagggaacgaatgtagtgcagaaaatctgcttctcgacgcaaatcataaggcactttgagagcaaactctcagatacaattgaagtgtaccaagagagaattcagtggctcacagagaactctaaaaaggccttcggtctgataaagggagccagggtgagcatattgatcgacgtgtccgctatctcctcaggcccacagaaggaagagttccagaaggacttgatgtctttgatcgacgaacagctctcccacaaagagaaattattcgtgctgtcatttggcacgaacgccggaagtctgtggcctgaccctatggaggtctccgccagcaccttacaagaattgaaactttgggtgaagactctgcagcccgacgggggaagcaacctcttgcaggccctcaagaagatattcactctgaagggcctcgattctttagtggctattatgcgctcatgcccggatcagccttctgagatactgtctgattacatccaacagtctacaatggggagggacctcatcatccacttcatcacctatagatgtgacgaccagatgccacctgcagtgttgaagaacctcgctgaagccgtgagaggctattatcactgctattctccaaagatggaacactacacctccagggacatggatgaactgcttgctgagattcagaaggcgcagtctctgctgtcacacgttcaggccctgcagcacagcagcccttgtgaagcactgacctgcaccatggaggaacccagaaattag

SEQ ID NO: 10430 - DNA, 438 bp, Artificial Sequence
  Description of Artificial Sequence: Synthetic coding sequence
atgttgactaggctggttttaagtgcccatctctccagcactacgtcccccccatggactcacgctgcaatctcctgggaacttgataatgtgctgatgccatcacctaggatctggcctcaggtcacacccaccggtcgctctgcttctgttcggtctgaaggcaacacttctagcctgtggaacttttcagctggacaggacgttcatgccatcgtgactaggacatgcgagagcgtactgtctagcgcagtttacactcacggttgcggctgtgtgaggtcagccaccaacatcacttgccagtcaagcggacagcaaaggcaggcggctcggcaggaagaagagaactccatatgtaaagcccacgattcaagagagggtcgactgggataccccttgagcgcccaccagcccggtagtggaggcccaaattag

SEQ ID NO: 10431 - DNA, 777 bp, Artificial Sequence
  Description of Artificial Sequence: Synthetic coding sequence
atgacgccacccaagctgagagcgagtctgtcaccttcattactgttacttctgtctgggtgcctgttggctgctgctcgccgagagaagggagctgccagtaatgttgcagagcccgtcccaggtccgaccgggggatcaagtggtcgatttctatcccccgagcaacacgcatgcagctggcagttgcttctcccagctcctgaggccgctgcaggctctgaacttgccctgcggtgccagtcgcctgacggcgcacgacatcaatgcgcctaccgagggcatcctgaaaggtgcgcggcttatgcagccagaagagcccatttctggaagcaggtgttgggaggcctgcggaaaaagcggcgtccctgtcatgatccagcaccccttcaggcacgattgtgtgccggaaaaaagggacatggagccgaacttcgactggtcccacgcgcaagccctccagcccgacccaccgtcgcaggcttcgccggagagagtaaaccacgggctagaaacaggggaagaacccgagagcgtgcctccggtcctgccgcaggtacccccccacctcagagcgcacccccaaaagaaaacccgtcggagaggaagaccaatgaaggcaaacggaaagccgcacttgttccaaatgaggagagacccatgggaactggtccagatcctgatggcttggacggaaacgctgagttgaccgaaacgtattgcgctgagaaatggcacagtctgtgcaattttttcgtgaacttctggaacggatag

SEQ ID NO: 10432 - DNA, 393 bp, Artificial Sequence
  Description of Artificial Sequence: Synthetic coding sequence
atggcgaggaggcattgcttctcctactggctgctggtctgctggttagttgtaacagtggccgagggtcaagaagaggtttttacgcctcctggcgattcgcaaaacaacgccgacgccaccgactgtcagatctttactctaacaccaccacctgcacctaggtcccccgtgacgcgcgctcagcctataacaaaaaccccacgctgtccttttcacttcttccccaggagaccgagaatacactttaggttcccaaaccggccttttgtcccttccaggtgcaatcacagattcccttttcagcccttctattggccccacagatatctaacctaccgttattttccaagacggagactccagagaggtagttcttctgaagagagttag

SEQ ID NO: 10433 - DNA, 600 bp, Artificial Sequence
  Description of Artificial Sequence: Synthetic coding sequence
atgtatccagctacagccgtgccacagatcaacattaccatactcaagggagaaaagggtgaccgtggtgatcgcggtttacagggtaaatatggtaagactggatcagccggagcacgcggacacactggacctaagggtcagaagggttctatgggtgcaccaggcgagcgctgtaagagtcattacgccgctttttctgtagggcgtaagaagcctatgcattctaatcactactatcagactgtcatcttcgacacagaattcgtgaatttatacgaccactttaacatgttcacaggcaagttctactgttacgttccaggcttatacttcttttcactgaacgtgcacacctggaaccagaaggaaacatatctgcatataatgaagaatgaggaggaggtggtcattctgtttgctcaagtgggtgatagatccatcatgcagtctcagtccttgatgctagagctgagggaacaagatcaggtctgggtgcggctgtataagggggaaagagagaacgcaatcttttcagaggagctggatacatatattaccttctcgggttatctggtcaaacacgccacagagccctag

SEQ ID NO: 10434 - DNA, 702 bp, Artificial Sequence
  Description of Artificial Sequence: Synthetic coding sequence
atggcccttaagaataaattctcttgtttatggatacttggcctctgcctcgtggcgacaactagcagcaaaattccctctatcacagacccacatttcatcgataattgcatcgaggcccataacgagtggcgagggaaggtgaacccccctgccgcagacatgaagtatatgatctgggacaagggattagctaagatggctaaagcatgggccaaccaatgtaagtttgagcacaatgactgtctggataagtcctacaagtgttacgccgcattcgaatacgtaggggaaaacatttggcttggaggtatcaagtccttcactcccagacatgccatcaccgcttggtacaatgaaacccagttttacgatttcgattctctatcttgttccagagtgtgtggccattatactcagctggtctgggcgaattctttctacgtggggtgcgctgttgccatgtgtcctaatctgggtggcgcatcaaccgctatttttgtttgcaattacggaccagcaggcaacttcgctaatatgcccccttatgtgcgcggtgaaagctgctcgctttgtagtaaagaggaaaaatgtgtgaagaacctgtgcaaaaatcctttcctgaagcctactggcagggcccctcagcagactgcatttaaccctttcagcctgggttttttgcttttgcgcatcttttag

SEQ ID NO: 10435 - DNA, 669 bp, Artificial Sequence
  Description of Artificial Sequence: Synthetic coding sequence
atggcactccatattcatgaggcatgcattttgctgctggttattcctggtctggtaacatccgctgcaatctcccatgaggattatccagcggatgaaggtgaccagatcagctccaacgataacttgattttcgatgactaccgcggtaagggatgcgtggacgatagcggcttcgtttataaactcggggaacgattttttcccggacactccaattgcccttgtgtctgtgcattagatggcccagtctgcgatcagccggagtgccccaaaatccaccccaaatgtacaaaggtggagcacaacggatgttgtccagagtgtaaagaagtgaaaaatttttgtgagtatcacgggaaaaattacaaaatccttgaggaatttaaacccagcccttgtgagtggtgccggtgtgaaccatcaaacgaagtgcattgtgtggtagctgattgcgcggttccagagtgtgttaatccggtctacgagcctgagcagtgttgcccagtgtgtaaaaatggacccaactgtttcgctggcacaacaatcatcccagcaggtatcgaggtgaaggttgatgaatgcaacatttgccactgtcataacggcgactggtggaagcctgctcagtgtagcaaaagagaatgccaggggaagcagaccgtctag

SEQ ID NO: 10436 - DNA, 957 bp, Artificial Sequence
  Description of Artificial Sequence: Synthetic coding sequence
atgctcccattgactatgacggtattgatcctcctactcttgcctaccgggcaggccgcacccaaggatggcgtgacacggccagattccgaagtccagcaccagcttttaccaaaccccttccagcccggtcaggagcagctcggcttactccagagctacctgaagggtctgggaaggacagaagtgcaactagaacacttgtctagagagcaagtgctgctctatctcttcgcgcttcacgattatgatcagtctgggcagctggacggcctagaactacttagcatgctgaccgccgcattggccccaggagctgctaattcgcccactacaaaccccgtgattctgattgttgacaaagttctagagacacaggatcttaatggcgatggactgatgacaccagccgagctgatcaattttcctggcgtcgccttaaggcatgtggaaccaggggaacctcttgcaccgtcaccccaagaaccacaggctgtgggtagacagagcctcctggcaaaaagcccgctgcgacaggagactcaggaggcaccaggacccagagaggaggccaagggtcaagtggaagccaggcgggaaagcctggacccagtccaggagcccggaggccaggcagaagcagatggtgatgtacctggacctcggggtgaagcagagggccaagcagaagctaaaggggatgcccctgggcctcgcggagaagctggaggacaagcagaggccgaaggagacgcacctggccctaggggtgaagccggtggccaagccgaggccgagggagatgctccaggacctcgtggggaggctggcggtcaggctgaggccagggagaatggagaggaagccaaagagctgcctggggaaacactggagtccaagaatactcagaatgatttcgaagtgcacattgtgcaggtggagaacgacgaaatctag

SEQ ID NO: 10437 - DNA, 393 bp, Artificial Sequence
  Description of Artificial Sequence: Synthetic coding sequence
atgctggccccacttttcctatgctgtctccgcaatctgttccgaaagctaatatccttccagcctcctcagcttgggagaacaaatatgcattattcaaagcttcctcgtacggccatagaaacagagtttaagcagaatgtgggtccaccccctaaggacctgaccgcggaagtctattttccctctattaagagcagaagtcatcttcccgctgtcttctataaccagtacttcaagcatccaaagtgcgtaggcgagtatgggccaaagaacggagcagaacgccaaatagaagagaggaaggtgcttccgactactatgatgttctcgatgcttgctgattgtgtcctgaagtccacaccgattccaatactgggtgttgctatgtag

SEQ ID NO: 10438 - DNA, 4362 bp, Artificial Sequence
  Description of Artificial Sequence: Synthetic coding sequence
atgatgctccctcaaaactcatggcacattgacttcggacgctgctgttgtcatcaaaatctctttagtgcagtagtgacgtgcattctgctcctgaattcctgcttcctcatctcgtcgttcaacggcacggatctcgaactgagattggtgaatggcgacggaccatgttcaggcacagtcgaggtcaagtttcaagggcaatggggtaccgtgtgtgacgatggttggaatactactgcttctacagtggtgtgcaagcagctcggatgtcccttctcgtttgctatgttccgtttcggccaagcagttactcgccacggcaaaatctggctagacgacgtgagctgctatggaaatgagagcgccctctgggaatgccaacaccgggaatgggggagtcacaactgctaccatggagaggatgtaggggtcaactgctatggagaagctaatctaggcttgcgactcgtggatggaaataattcctgttctgggagggtggaagtgaaattccaggagcggtggggcactatttgtgatgatggctggaacttgaacaccgcggcagttgtctgcagacagctcggctgtcccagcagttttatttcctctggtgtcgttaactcaccggcagtccttcgcccaatatggctggatgacattctctgtcagggcaatgagttggctctgtggaactgccgccaccggggttggggtaaccacgattgctcacacaatgaggacgtgactcttacgtgttacgactccagtgacttggaactgaggctcgtcggaggaacaaaccgctgtatggggagagtggaattgaaaattcaagggaggtggggcaccgtttgccatcataagtggaacaacgctgcagccgatgtggtatgcaagcagctgggctgtggaacagctctgcacttcgccggactcccacatctccagtccggttctgatgttgtctggctggacggtgtatcatgttcaggaaacgaatctttcctctgggattgcaggcactctggcaccgtcaacttcgactgcctgcatcagaacgacgtgagtgttatatgcagcgacggcgcagacttagagcttagattagctgatggctctaataattgcagcggccgagtagaggtaaggattcacgagcagtggtggaccatctgtgatcagaattggaagaacgaacaggccctggtggtttgtaagcagctgggctgcccgttctccgtgttcggaagcaggcgcgctaagcccagtaacgaagctagggatatctggatcaacagcatcagttgcacagggaacgagagcgccttgtgggactgcacctatgacgggaaagctaaaagaacttgctttcgtcggtctgacgccggagtgatttgcagtgataaagcagacctggatctacgcctcgtgggagcccactccccctgttacggcagacttgaagtgaagtaccagggagagtggggcaccgtgtgccacgaccgatggtctacacgcaatgctgcagtggtgtgtaagcagctcggctgcgggaagccactgcacgtctttggcatgacttattttaaggaggctagtggccctatttggctagacgacgtgtcttgtatcgggaatgagagcaacatatgggactgtgagcactccggttggggcaaacacaactgcgtacatcgggaggacgtcatcgtgacctgttctggcgatgcgacctggggcttacggctcgttggtggttccaatcggtgcagtgggagactcgaggtgtattttcaggggagatggggtaccgtgtgtgatgacggctggaatagcaaagccgcagccgttgtttgttcccagctggattgcccaagctcaattatcggaatgggcctcggtaacgctagcacaggctacggcaagatctggctggatgatgtctcctgtgatggagatgagagcgatctgtggtcttgtcgaaactccggctggggcaataatgactgtagccactccgaagacgtcggcgtgatctgttccgacgcttccgacatggaactgcggctcgtgggtgggagcagccgctgcgccggaaaggtcgaggtcaatgttcaaggcgctgttggcatattgtgcgccaacggttggggcatgaacatcgccgaagtggtatgcagacagttggagtgtggctccgcaattagggtctcacgagagccacatttcacggaaagaactttacacatcctgatgtccaactctggctgtaccgggggagaagctagtttatgggactgtatcaggtgggaatggaagcagaccgcttgccatctcaacatggaggctagtctaatttgtagcgctcatcggcagcctagactggtcggcgctgacatgccctgttccggaagagtcgaggtcaagcacgccgatacctggaggagcgtctgcgattctgacttttctctccacgcggctaatgtgttatgtagggagctgaattgcggcgacgctatctccctatcagtgggcgatcactttggcaagggtaacgggctgacttgggctgagaaattccagtgcgaaggatctgaaacacatctcgctctctgtcccatcgtccagcatcctgaggacacctgtatccacagccgcgaggtgggagtggtgtgctctaggtacacagacgtcagacttgtgaatggcaagagtcaatgcgacggccaggtcgaaatcaatgtcctaggacattggggtagcctctgcgatacacactgggatccagaagacgcgagggtcctgtgtagacagctcagctgcgggacagccctctctacgactgggggtaaatatataggggagagatcagtccgcgtttgggggcatagattccactgtcttgggaacgaatctctgctggacaattgccagatgacagtattgggtgctccaccctgcattcacggaaatactgttagcgtgatctgtaccggaagcttgacccagcccctcttcccctgcctcgctaatgtctccgatccctatttaagtgcagtcccagaaggctccgcccttatctgcctggaagataaaaggctaaggctggtggacggagatagtcgctgtgccggacgggtcgaaatctaccatgacggcttttgggggaccatctgtgacgacggttgggatctgtcagacgcccacgtggtgtgtcagaagctgggatgcggtgtggccttcaacgcaaccgtgagcgctcattttggcgaagggagtgggccaatttggttagacgatctgaactgcacaggaatggagagtcatctgtggcagtgccccagcagagggtggggacagcatgactgcagacacaaagaagatgcgggagtgatttgttccgagttcactgcgctgcggctttatagcgagacagaaacggaatcttgcgcagggagattagaggttttttacaatggcacttggggttcagttggaagacgcaacatcactacagctatagccggtattgtgtgcagacagctggggtgcggagagaacggcgtcgtatccctcgccccactctctaagacagggagtggcttcatgtgggtggacgatatccagtgccctaagactcacatctctatctggcagtgtctgtccgcgccttgggagcgaaggataagctcgcccgctgaagagacatggattacctgcgaggacaggatcagggtgaggggcggagacacagagtgctcagggcgtgtagagatctggcacgcaggcagctggggaaccgtttgcgacgactcgtgggatctagcagaggcagaagtggtgtgtcagcagcttgggtgtggatcggccctggccgcattgagagatgcatcattcggccaggggaccggaaccatttggctggacgacatgcgatgcaagggaaacgaaagctttctctgggattgccacgctaagccttggggccagtccgattgcgggcacaaagaagatgctggcgttcgatgtagcggccaatcccttaaaagtctcaatgcctcgtccgggcatctggcactgatcctgtcaagcattttcgggctcctcttgctcgttctgtttatactgtttctcacttggtgtagggtacagaagcaaaagcatcttccattaagggtgagcacccgccgacggggatcacttgaggaaaatctcttccatgagatggaaacttgcttgaagagggaagatccacacgggacccggacctccgacgacaccccgaaccacggttgcgaggatgcttcagacacaagtctgctcggggttttacccgcttctgaggctactaaatag

SEQ ID NO: 10439 - DNA, 759 bp, Artificial Sequence
  Description of Artificial Sequence: Synthetic coding sequence
atgctccctccgcctagaccagcagctgcgctggccttgccggtgctgctcctccttcttgtagtattaacgccgcctccaaccggtgctcgacctagccctggacccgactacctcagacggggttggatgaggctgctggccgagggcgaggggtgtgctccctgcaggccagaggaatgcgctgctccgagaggctgcctggctggccgtgtgagggatgcgtgcggctgttgctgggagtgcgccaaccttgaaggccagctgtgtgatctggatccgagcgctcatttctacggacattgtggcgaacagcttgaatgtcggctggatacggggggagatctttcgaggggtgaggtccccgagccattgtgtgcttgccgtagtcaatcccctctgtgcggcagcgatggacatacatactcccaaatctgcagactacaggaggctgcccgtgcccgacccgatgctaatcttacagtcgcccaccctggcccatgtgagtcagggcctcagatcgtgagtcatccctatgacacttggaggggtccacggctgcaaaccctgggcacagaggatacccttacgacgttggtgggtgcgggtggaatggctagggccgtggcctgcggtgaagcgcctggcgagcatctggccctccaggtcctctgtttaagtggcaagagaagacacctttggcaggtggggtccactggcagctctgagggagtccctagcggtggctcattctggtag

SEQ ID NO: 10440 - DNA, 1323 bp, Artificial Sequence
  Description of Artificial Sequence: Synthetic coding sequence
atgaaactggccctcctgttgccctgggcctgttgctgtctgtgtggatccgccctcgccaccggctttctatatccattctccgccgctgcgctgcagcaacacggatatcccgagccaggagcgggttcgcctgggtcaggctacgcatctcgacgtcactggtgccatcataccgtaacacgcactgtatcgtgccaagtgcagaacggctccgaaaccgtcgtacagcgagtctatcagtcttgcagatggcccggaccttgcgctaacttagtgtcatatcggactctgattaggccaacttacagggtgtcttaccggactgtgacagttcttgagtggcgttgttgccccggatttacgggatcaaattgtgacgaggaatgtatgaactgcacacgcctgtctgacatgtctgagaggcttaccacactcgaggctaaggtgctactcttagaagccgcagagcgaccaagctcgcccgataacgacttaccagctcctgaaagtacccctcctacttggaatgaggattttctccctgatgccattccacttgcccatcctgtgcctcggcagcgaagacccaccggacccgctggtccccctggccagaccgggcctcctggaccagccggtcctccgggaagcaagggagataggggccagactggggagaaaggtccagccggtccaccaggactcctgggtcctcccggacctcgtggccttccaggcgagatggggcgacctggtcctcctgggcctcccggtccagcagggaatccaggaccttccccaaattcaccccagggcgctctgtattccctgcagcctccgacggataaggataacggtgacagtagacttgccagtgccatagttgacaccgtactggccggtgtgcccggtccgagaggacccccaggaccccctggcccacctgggcctagggggcctcccggacctccgggaacacccggttctcagggacttgccggtgagcgaggaaccgtggggccaagcggggagcctggtgtgaagggcgaggaaggagagaaggctgccaccgccgagggtgagggagtccaacagctaagagaggctttgaagatcctagctgagcgcgtactgatcctggaacacatgattggaattcacgatcctctggcctcccccgagggaagcggccaggatgcagcgttgcgagctaacctgaagatgaagagagggggtgcacagcccgacggcgttctggccgctctgttaggacccgatcccggtcaaaagagtgtcgaccaggccagtagcagaaaatag

SEQ ID NO: 10441 - DNA, 1341 bp, Artificial Sequence
  Description of Artificial Sequence: Synthetic coding sequence
atgcttcatcctgagaccagtcctgggaggggccacctgctggccgtgctactggctcttttagggaccgcatgggctgaagtgtggcctcctcagttgcaggaacaggcccctatggctggcgctctcaatagaaaggagtcgtttctgctgttgagcctgcacaacagactgcgcagctgggtccagcccccagcagcagacatgcgcagactggactggagtgatagtctcgcgcaacttgcccaggcaagggcggcactgtgtggaatccccacacctagccttgccagcggtctttggagaaccctccaggtcggctggaacatgcaactcctgcctgcagggctggcctctttcgtcgaagtggtgtcactgtggtttgccgaaggccagcggtacagccatgccgcaggggagtgtgcaaggaatgcaacctgtacccactacacacagctggtctgggccacctccagccaacttggctgcggcaggcacttatgttccgctggacaggccgcaatagaggccttcgtctgcgcttactccccacgaggcaattgggaagtaaacggaaaaaccattgtgccatacaagaagggcgcatggtgttccctgtgtacagcctctgtctcaggctgttttaaagcctgggaccatgcagggggactgtgcgaagtgcctcggaatccctgccggatgtcctgccagaaccacggacggcttaacatctctacttgccactgccactgtcccccaggttatacgggcaggtactgtcaggttcgatgttcattgcagtgtgtgcatggaagattcagagaagaggaatgtagctgcgtatgcgatatcgggtatggaggcgcacagtgtgccacaaaagtgcattttccattccacacttgtgaccttcgtattgatggagattgctttatggtgtcttcagaggcagatacgtattaccgagcaagaatgaaatgccaaaggaagggaggcgtgctcgcccagataaagagccaaaaggtccaggatatcctggccttttatctgggacgactcgagaccaccaacgaagtgattgattctgatttcgaaactaggaatttctggattggcttaacttataaaacggccaaagattcattccgatgggctacgggtgaacatcaggcatttacctcctttgctttcggacagcctgataaccatggtttcgggaattgcgtggagctgcaggcctccgcggcattcaattggaacaaccaacgctgtaaaacgcgcaacagatacatctgccagttcgcgcaggagcacatctcgaggtggggtccaggctcatag

SEQ ID NO: 10442 - DNA, 219 bp, Artificial Sequence
  Description of Artificial Sequence: Synthetic coding sequence
atgcagcgcctggtgctgctgctcgccatatcattgctgctgtatcaggacctcccagttcgcagcgagttcgaactcgatcggatatgtggctacggaaccgcccgatgccgcaagaagtgcaggtctcaggagtaccgcataggaaggtgccctaacacttatgcatgttgtctgcgcaaatgggacgagagcttgttgaatcgtaccaagccctag

SEQ ID NO: 10443 - DNA, 2349 bp, Artificial Sequence
  Description of Artificial Sequence: Synthetic coding sequence
ctgtggctgctgctgtgggccgcagcgtggagactgggggcaagcgcctgccctgccctgtgtacttgcaccggcacaactgtggactgtcacgggactggactccaggcaattccaaagaacatcccccgaaacactgagcggctggaactgaacgggaacaacatcacaagaattcacaagaacgatttcgctggcctgaaacaactacgggtactgcagcttatggaaaatcagatcggagctgtagagaggggcgcattcgatgacatgaaggaactcgaacggcttaggcttaatcgaaaccagctccacatgctgccagagttgttgttccagaataatcaggctctctctaggctggatctgtctgaaaacgcgatccaggcaattcccaggaaagcatttaggggtgctactgaccttaaaaatttgcaactggacaaaaatcagatttcctgcatcgaggaaggtgcattccgcgctctccgagggctggaagtgctgactcttaataataataatataacgacaatcccggtcagctcttttaaccacatgcccaaactgaggaccttccggcttcattcaaaccatctgttctgcgattgccacctcgcctggcttagtcagtggttaagacagcgacctaccatcggactcttcacccagtgttctggcccagcatccctgagagggttgaatgtggccgaagtgcaaaaaagtgagtttagttgctcagggcagggggaggctggacgagtccctacctgcactctgagttcaggcagttgcccagcaatgtgtacgtgttctaacggtatagttgattgtcgagggaaagggctgaccgccattcctgccaacctgcctgagactatgaccgagatccgtctcgaactcaacggaattaaatctataccaccgggagccttcagcccatacagaaaattgagacggatttgtcctctgtcgttttgctccccatgcagagatctgagcaacaatcagatcgccgagatcgcacctgacgcatttcaagggctccgatccctgaatagccttgtgctgtacgggaataaaatcacagaccttcccagaggcgtgtttggtggcttatacactttgcagttgttgttgcttaacgcgaataaaatcaattgcattagacccgacgctttccaggatctgcagaatctgtccctactgtcactttatgacaataagattcagtcgctggccaaggggacatttacctccttacgggcaatccagactctacatctggctcaaaatccctttatctgcgattgcaatctaaaatggctagctgacttcttgcgcaccaatccaattgaaacctcaggagcacgctgtgcctcccccaggcgcctggctaacaagcgaattggccaaatcaagtctaagaagtttcggtgctccgccaaggaacagtatttcattcccggaactgaagactatcaattgaactccgaatgtaactctgatgtggtttgcccacataagtgtagatgtgaggctaatgttgtcgagtgcagctcacttaaactaactaaaatcccagagcgaatcccacagtccaccgcggagttgaggttaaataacaacgaaatctcaatcctggaggctacaggaatgtttaaaaaactaactcacctgaagaagatcaacttatctaacaataaagtgagtgaaatcgaggatggggcttttgaaggagccgcatcggtgtctgagctccacctaacggctaatcagctggaaagtataaggagcggcatgttccgaggtttggacggtcttcgaactctaatgctgcgcaacaaccgcatatcatgcatacataacgatagcttcaccgggcttagaaacgtgcggctcctgagcctctacgacaatcagataacaacggtttcccccggtgccttcgacaccctccagtcactctcaactcttaatctccttgcgaatccttttaattgtaactgtcagctggcgtggctggggggttggctgcggaagaggaagattgtcacgggcaacccaagatgccaaaacccagatttcctgcggcagattccactgcaagacgttgcctttcctgactttcgttgtgaagagggacaggaggaagggggttgcctcccaagaccccagtgcccacaagaatgtgcctgcctggacaccgttgtgcggtgttcgaataagcacctgagggcactccccaaagggatccctaaaaacgtgaccgaactgtacctggatgggaaccaatttacactggtccccggtcagctcagcacttttaagtatctgcagctggtatag

SEQ ID NO: 10444 - DNA, 411 bp, Artificial Sequence
  Description of Artificial Sequence: Synthetic coding sequence
atgtcaaacgtcccacacaagtcctccctacctgagggaattaggcccggaactgtcctccgcatcaggggcctcgttccaccaaacgcatcccgatttcacgtcaatctattgtgtggtgaagagcagggatccgatgcagccttacactttaatcccaggctggataccagcgaggtggtctttaattctaaagagcagggctcttgggggcgagaggaacgagggcctggagtgcccttccagcgaggtcagccttttgaggtcctaatcatcgcctcagatgacggcttcaaagccgtggtgggcgatgctcagtatcaccattttcgacatcgcctaccgttggcccgagtccgactggtggaggtgggcggtgacgttcaactcgacagcgtccgcattttctag

SEQ ID NO: 10445 - DNA, 1926 bp, Artificial Sequence
  Description of Artificial Sequence: Synthetic coding sequence
atgccacctcccctgccactcctgttgttaactgtgcttgtggtggcggctgcacgacccggatgtgagtttgagcgaaacccagccgctacttgtgtcgacctacaactaaggacatgcagcgatgccgcatacaatcacactacatttcccaatctgctacaacaccgctcgtgggaggttgtggaggcaagctcagagtacattctgttatcggtgctacatcaattgctggaaggccagtgtaatcccgacctgagactgcttggctgtgcagtcctggcccctaggtgtgagggcggatgggttagacgaccctgccggcacatttgcgagggacttagggaggtctgccagcctgcttttgatgcgattgatatggcatggccatactttctggattgtcaccggtatttcacacgggaagatgaggggtgctacgatcccttagagaaactgcgcggaggccttgaggctgacgaggctttgcccagcggactgccacccacattcattaggttttctcatcatagctacgctcagatggtgcgtgtgctgaggcggaccgcttcccggtgcgcccatgttgccagaacgtactctatcggtcggtcgtttgatggcagagagctccttgtgatcgagttttcctctcgacctggacagcacgagctcatggagccagaggtaaagcttatcggcaacatccacggtaatgaagttgcgggaagggaaatgctcatctacctcgctcagtatctctgcagtgaatacctgctggggaaccccaggattcagcgtttgctgaacactactagaattcacctgttgccttcgatgaacccagacggctacgaggtagccgctgccgagggggctggatacaatggctggacaagtgggagacagaatgctcagaacctggatttgaataggaacttcccagacttgacttccgagtattacaggcttgccgagaccaggggggctaggagtgatcatattccaatcccacagcattattggtggggtaaggtagctccggagacaaaggcaatcatgaaatggatgcagacaattcctttcgtgctgtcagcaagcttgcatggaggggatctcgtggtgagttacccctttgactttagtaaacatccgcaggaagaaaagatgttcagccccacgccggatgaaaagatgtttaaactcctcagtcgcgcttacgcagacgtccatcccatgatgatggacagatctgagaaccggtgcggcggtaactttctcaagaggggttcaattatcaatggggctgactggtactcttttaccggaggcatgtctgattttaattacctgcacacaaactgtttcgagatcacggtggagcttggatgcgtcaagttccctcccgaggaggctctgtatattttgtggcagcacaataaggaatcactgcttaattttgtggagacggttcatcgaggtatcaaaggagttgtaacagacaagttcggcaaacccgttaagaacgccagaattagcgtaaaggggattaggcacgatattacgaccgcccctgatggagactactggagattattacccccaggaatccatattgtgattgctcaggccccaggatacgccaaggtgattaaaaaggtgatcatccccgcacggatgaaaagggctggaagagtggacttcattctccagcctttgggtatgggtcctaaaaacttcatccacggcctcagaagaaccggccctcacgaccccctgggaggggcttcttctctgggtgaggctactgagccggacccactccgtgcccgacggcagcctagtgctgacgggtctaagccttggtggtggtcttatttcacgtctctgagcacacataggccaagatggttacttaaatattag

SEQ ID NO: 10446 - DNA, 1305 bp, Artificial Sequence
  Description of Artificial Sequence: Synthetic coding sequence
atggcttcactgggactcttgctgctgttgctgctgactgcactcccgccactgtggagcagttccttgcccggacttgatacagctgagagcaaggcaaccattgccgacttaatcctctcggcactggaacgcgctaccgtgtttttagagcagaggctcccagagattaatctagacggcatggtcggggtgcgggtgctggaggagcaactgaagtctgtgcgagagaaatgggcgcaggagcctctgttgcagcccctgtccctgcgcgtcggcatgcttggagagaagttggaagcagcaattcagaggagcctgcattaccttaagctgagcgatcctaagtacctccgcgagtttcagttaaccctccagcctggcttctggaaactgccccatgcctggatccacaccgatgcaagtcttgtctatcccacctttggcccacaagatagcttttcagaggaaaggtcagacgtgtgcctggtgcaactgctggggactggaacggattcaagcgagccttgcggactgtccgatctatgtaggagcctcatgacaaagcccggatgctccggctattgtctgtcccaccagctgctgttcttcctgtgggcacgaatgaggggctgtacccagggaccactgcagcagtcccaggattacatcaatttattctgcgcaaatatgatggatctaaaccgccgagccgaggctattgggtacgcctacccaactcgcgacatttttatggagaataatgtgactgggcatcctgtcttctacctgcctctttgtgattcttttctcccacctaaggcagccccagtgactgagctatacaccgatggaccagtcatgttttgcgggatgggaggcttttccgacttttataaattacggtggctagaggccatcctttcctggcaaaaacagcaggaaggctgtttcggtgaacctgatgcagaagacgaagagctcagcaaggctattcagtatcagcaacacttttcgaggcgagttaagaggcgggagaagcagttccctgactcccgttctgtggcccaagccggtgtgcagtggcgcaatctgggctcactccaacctcttcctccgggatttaagcagtttagctgcttgatcctgcctagctcttgggactaccggagtgtgccgccatacctcgctaacttttatatttttcttgtcgagaccggttttcaccacgtagctcacgccggactcgaactactgatttctcgagaccccccaacatctgggtcacagtccgtaggtctctag

SEQ ID NO: 10447 - DNA, 555 bp, Artificial Sequence
  Description of Artificial Sequence: Synthetic coding sequence
atgatgtcatttcttcttggagcgatactgacactgctgtgggcgccaaccgctcaagcagaggttctgttgcagccagattttaatgctgagaagttcagcggtctctggtatgtcgtgtcaatggcctctgactgtcgagtgtttctgggaaagaaggatcatctctccatgtctacccgggctattcgtccaaccgaagaggggggattacatgtgcacatggagttccctggggctgatggttgtaatcaagtcgatgccgaatatctgaaagttggatccgaagggcactttagggtccccgctttagggtacctggacgtgagaatcgttgatactgactatagttctttcgctgtgctttacatctacaaagagctggagggagccctgtccacgatggtgcagctctattcacggacccaggatgtcagtccccaggcactgaaatccttccaagatttctatcctacactgggcctgccaaaggatatgatggtaatgctcccacagtcagatgcttgcaaccccgagagcaaggaggctccctag

SEQ ID NO: 10448 - DNA, 219 bp, Artificial Sequence
  Description of Artificial Sequence: Synthetic coding sequence
atgcagcgcctcgtccttctactcgctatctctctcctgttgtatcaggatcttccagtgcggagtgaatttgagctggatcgaatctgcggatatggaactgccaggtgtcgtaaaaagtgcagatcccaagagtaccgcatcggcagatgccccaatacctatgcttgctgcctgcgcaagtgggacgagtctctcctcaaccggactaaaccatag

SEQ ID NO: 10449 - DNA, 2247 bp, Artificial Sequence
  Description of Artificial Sequence: Synthetic coding sequence
atggggagggcaggagcggctgctgttattcccggtttggcactgctgtgggccgtagggctgggatctgctgccccaccgcctagattgagactctcattccaagagctgcaggcatggcatggccttcaaaccttctctttagagcgcacctgctgctatcaagccctgctggtcgacgaagagcgcggtcgcctgttcgtcggggctgaaaaccacgtcgccagcctaaacctggacaatatcagtaaaagagcaaaaaagctggcgtggccagcacctgtagagtggcgggaggagtgcaattgggcgggaaaagacattggcacagaatgcatgaactttgttaagctgcttcacgcatacaatcggactcacctgttagcttgtggcacgggcgctttccatccaacctgtgcttttgtggaggtgggccacagagcagaggaaccagtgctcaggcttgatcccggtaggattgaagatggtaaaggcaaatccccttacgacccacgccacagagccgcatctgtcctggtgggcgaagaactatactcaggggtggctgcagacctgatgggcagagacttcaccatcttcaggagtctaggccagaggccatcgctaaggaccgagccgcacgactctcgatggctcaacgagccaaagttcgtcaaggtgttctggatccccgagagcgaaaaccctgatgacgataagatatactttttctttcgagagaccgcagtcgaggccgctcctgcccttgggaggctgtctgtgtctagggtgggacagatttgccggaatgacgttggcggacagagatcactggtgaataagtggacaacattcttgaaagccagactggtttgtagtgtgcctggggtggagggggacacccactttgatcagttgcaagatgtctttcttctaagcagtagggaccataggacccctctgctgtacgccgtgttctccacttctagctcaatctttcaggggtcagccgtttgcgtgtactccatgaatgatgtgcgcagggccttcttgggccctttcgcacacaaagagggaccaatgcaccagtgggtgagctaccaggggcgagtgccatatccaaggcctgggatgtgcccttctaagaccttcggtacattctcctcaaccaaagatttccccgatgatgtaattcagtttgctcgtaaccacccactgatgtacaacagcgtgctgcccactggaggtaggccactgtttctacaggtgggtgccaattacacatttacccaaatcgcggctgacagggtcgccgcagccgatggacattacgatgtcctgttcattggaaccgacgtaggcaccgtgctgaaggtgatttccgttcccaagggctccagacccagcgctgaaggactcctgctagaagagcttcacgtgttcgaagactccgccgcagtcactagcatgcaaatcagctcaaagcgccatcagttatatgtggctagtcggtcagctgtcgcccagattgccctacatcggtgtgccgctcacggtcgtgtgtgcacagaatgctgcctcgcacgcgacccttactgtgcctgggatggggtagcttgtacgagattccagcccagcgccaagagaaggttccggagacaagacgtgaggaatggtgatcccagcaccctgtgcagcggagatagttcccggcctgcattgctagagcataaggtgttcggggtggagggctcttccgccttcttggaatgtgagcctaggtctctccaggccagggttgagtggacttttcagcgcgcaggagtcaccgcacacacccaggtcctggcagaagagcggacggaacggaccgcgagaggcctgttgcttcgccgactccgacggcgtgacagtggcgtttacctgtgcgcggcagtcgaacagggattcacccaaccactccgtaggctttccctgcacgtgttgagtgctacccaggccgaaaggctggccagggccgaagaagccgctccagctgcgcctcctggcccaaaactgtggtacagggactttttgcaattggtggagccaggtggagggggatcagcaaactcactccggatgtgccgccctcagccagcattgcaatccctccccctggaatctcggaggaagggacgaaacagacgcactcacgcacccgaacctcgggcagaacgcggtcctagatcagcgacgcattggtag

SEQ ID NO: 10450 - DNA, 369 bp, Artificial Sequence
  Description of Artificial Sequence: Synthetic coding sequence
atggtgctgctgtgtctgtttctggctagtctagccgctaccccccgagccggagtgaccggcgcatggccaacatctggcttgtcaatcttggcacagcttcagccgtcttgcgagctgaggtggacccagcttagccgctcttcatggagagacctggtgatgaccacttcattatggagcctggcttattttcagcatttcagccaggagactacaacccaggagcagctggatgagatggaggagattccgagagaatcccagtgtggccgacaggacttccatgccctgagttgtcctactgcatctcctcgcgaccgtgtcctcctgtgctgcccaggctggcgtgccatggtaccttcctag

SEQ ID NO: 10451 - DNA, 570 bp, Artificial Sequence
  Description of Artificial Sequence: Synthetic coding sequence
atgttgcttggacagctcagcaccctcctctgcttgctcagcggggctctcccgacaggctctggcagaccagagccacagtctcccaggccccagtcctgggccgctgcaaatcaaacatgggccctgggccctggggcactgccacctctagtgccagcctcagcattaggcagctggaaagccttcctgggcttgcagaaagccaggcaattaggcatgggacgtctccagcgcggacaagacgaggtggcagcagtaaccctgccacttaatccccaggaggtaattcagggcatgtgtaaagccgtgccttttgtgcaggtgttttcaaggcccggatgtagtgccattaggctaagaaaccacttatgttttggacattgctccagcctttacatacccggttccgacccaaccccactcgtgctttgcaacagctgcatgccagcccgtaaacgctgggcacccgtggtgctctggtgcctgaccggaagctctgctagccggcgtcgagtgaaaatctcaactatgttaatcgagggctgtcattgctctccaaaagcctag

SEQ ID NO: 10452 - DNA, 2505 bp, Artificial Sequence
  Description of Artificial Sequence: Synthetic coding sequence
atgaagcacacactagccttgctggctccactgttgggcctgggtttaggtcttgcgctctctcagctagcagcgggagctacggactgtaagttcttagggcctgccgagcatctaacattcacacctgcggcacgggctagatggttggctcctagagtgagagctcccggattgctagattccctgtacgggaccgttaggcgatttctatctgtggttcagctgaaccctttcccttctgagctggtgaaggccttactgaatgagctcgcatcggtcaaggtgaacgaggtcgtgcggtacgaggccggatacgtggtgtgcgctgtgattgccggactttacctgctgctggtgccaactgccggactctgcttctgctgttgtaggtgccatagaaggtgcgggggacgcgtaaagaccgaacacaaggccctggcctgcgaacgcgcagctcttatggtgttcctgctactaacaacactcctcttgctgatcggtgtcgtctgcgcatttgtgacaaaccagagaacacatgaacaaatgggaccctccatcgaggccatgcctgagaccttgctctccctatgggggctcgtcagcgatgtcccccaggagcttcaggctgtggcccaacaattctcgctccctcaggaacaagtgtcggaggaactcgatggagtcggcgtgtccatcgggtccgccattcacactcagctgagatcatcggtgtaccctctgcttgccgctgttgggagcctgggacaggtgctgcaggtgtctgtccaccatctgcagacactcaacgctaccgtggtggaacttcaggccggtcagcaggacctggagcccgctatacgggagcaccgcgacaggctgttagaactcctgcaggaggccagatgccagggcgattgcgcaggcgcactgtcatgggctcgaaccctggaactgggagctgatttcagccaggttccctccgtagaccacgttctgcaccagctgaagggtgtgcccgaagccaacttcagtagcatggtgcaagaagagaacagcacctttaatgcccttcctgcgttagcagctatgcagacaagcagtgtcgtccaggaactgaagaaggctgttgctcagcagccggagggcgtacgaaccctggccgaagggtttcctgggctagaggctgcttctcggtgggctcaagccttgcaggaggtggaggagtcaagtcgcccatatcttcaggaggtgcaaaggtatgagacctataggtggattgtgggctgcgtcctgtgcagtgtcgttctgttcgttgtcttatgtaaccttctcggcctcaacctggggatctggggtctcagtgccagggacgatcctagccaccctgaggccaagggcgaagcaggagccaggttcttaatggcaggggtggggctgtcatttcttttcgcagcccctttgattctgctggtctttgctaccttcctggtgggcggaaacgtccagacactggtttgccaatcttgggaaaatggcgaactgtttgagttcgccgacacaccagggaatctccccccatccatgaacttaagccagctcctgggactccggaagaatatcagtatccatcaggcttatcaacagtgcaaggaaggggcagcgctttggactgtcctgcagttaaacgattcttatgatctggaggagcacttggatatcaaccaatacaccaacaagctcaggcaggagctccagtcactgaaggttgacacacaaagtttggatctacttagtagtgcggcacgcagagatctggaggcattgcagagcagtgggctgcagaggatccactaccctgattttctggttcagatccaaagacccgtagtgaagacaagcatggagcagctggcccaggaattacaaggcctggcccaggcccaggacaatagcgtcctggggcaaaggcttcaagaagaagcacagggacttcgcaatttgcatcaggagaaggtagtgccccagcaatctcttgtggccaaactcaacctttccgttcgcgctcttgagagcagtgccccaaacctgcagctggagacatcagacgtccttgccaacgtaacatacctgaagggcgaactgcccgcatgggctgctaggattctgcggaatgtgagcgagtgttttctcgctcgcgagatgggctatttctcccagtatgtcgcatgggtcagggaggaagtcacccagaggatcgccacctgtcagccactatccggggctctggataactcacgtgtgatactgtgtgacatgatggctgacccctggaatgccttctggttctgcctggcctggtgtaccttttttctcataccatccattatattcgctgtgaagacatctaagtatttcagacctattcgcaaacgcttaagctctacctcatccgaggaaacacagctgttccatatccccagggtaaccagtttaaaattatag

SEQ ID NO: 10453 - DNA, 2505 bp, Artificial Sequence
  Description of Artificial Sequence: Synthetic coding sequence
atgaagcacacactggccttactcgctcccttactgggcttaggcctggggttggccctgtctcaactagcagcgggagcaacagattgcaaatttctggggccagctgagcacctaaccttcaccccggctgccagggcccgatggctggcccctagagtgagggctccaggactgctggattcgctgtacgggaccgtgcgcagatttctctcggtggtgcagcttaatcccttcccctccgagctggtgaaagctctgctgaatgagctcgccagcgtgaaggtgaacgaggtagtaagatacgaagccggatatgtggtgtgtgctgttattgctggcctgtacctcctcctggttcccaccgcaggattgtgtttctgctgctgcaggtgtcacagaagatgcggtgggagggtcaaaactgagcacaaagccctcgcttgtgagcgggcagcactgatggtgtttctcctcctgactacattgctgctcctcattggcgtcgtgtgtgcttttgtcactaatcagagaacgcacgagcagatgggaccgtccatagaagctatgcccgaaacattgttatccctttgggggctcgtatcagatgtgccacaagagcttcaagccgtggcccaacagttctctctgccccaggagcaagtaagcgaagaactagatggggtgggcgtgtccattggtagcgctattcatacacagctgcggtcttccgtctaccccctactcgccgcagtggggagtctggggcaggttctacaagtctccgtacatcacctgcagaccttaaacgccaccgtcgtggagctgcaggccggtcaacaggatctggaaccggctatcagagagcatagggatcgattactggagctcctgcaggaggccaggtgtcaaggggattgtgcgggagctttgagctgggccaggaccctggaactgggtgccgatttcagccaagttccctctgttgaccatgtgctgcaccagctgaagggggtgcccgaagctaacttctccagcatggtccaagaggaaaattctacctttaatgcgctcccagccttggcagccatgcagacatcgtctgtggtacaagagctgaaaaaggccgtggcccaacagccagagggtgtgcggacactcgcggagggcttccctggtcttgaggccgcaagccggtgggcccaggcactccaggaggtcgaggagagtagccggccatatctgcaggaggttcagaggtatgaaacatacaggtggattgttgggtgtgtgttatgttcagtagtcctctttgtggtgctctgcaatttgctggggctcaatctgggcatttgggggctgtccgcaagagatgatccttctcacccagaagcaaagggggaggccggtgctcgcttcctgatggccggagtcgggctctccttcctcttcgcagctccgcttatactcctggtctttgccacctttctcgtgggcggtaatgtgcagacgctggtgtgccagagctgggaaaatggggagctctttgaattcgcggatactcctggaaacttacccccttcaatgaacctgtcacagctcctgggacttcgcaaaaatatcagcatccatcaggcctaccagcagtgtaaagaaggcgcagcgttatggaccgtgcttcagcttaatgatagttacgatctggaggagcaccttgacataaaccaatacactaacaagctgcggcaggaactacagagtttgaaggttgatactcagagcctggatctcctgagctctgccgctcgccgagacctggaggcactgcaaagctcagggctgcagcgcatccactatcccgacttcctggtacagatccagcgaccagtcgtgaaaaccagtatggaacagctggcacaggagttgcagggcctggctcaagcccaggataactctgtacttggccagagactgcaagaagaagcccagggcctaagaaatttgcatcaggagaaagtggtgcctcagcagtccctggtagcaaaacttaatctatccgtccgggctctagagtccagcgccccaaaccttcaattggagactagcgatgtcctcgcaaacgtcacctatcttaagggagagcttcctgcttgggcagctagaatcctgaggaatgtctccgaatgtttcctggcccgagaaatgggttacttctctcagtatgtggcctgggtcagggaggaagtgacccagcgcatcgctacttgccaaccattgtccggggctctggacaactcacgggtcatcctgtgcgatatgatggccgatccttggaacgcgttctggttttgcctagcttggtgcacgtttttcctgatcccttccatcatctttgccgtaaaaactagtaagtacttcagacccatcaggaagagactgtcttcaacctccagtgaagaaacccagctgttccacatcccgagggtaacaagtctcaaattgtag

SEQ ID NO: 10454 - DNA, 216 bp, Artificial Sequence
  Description of Artificial Sequence: Synthetic coding sequence
atgacccagctgttgctgttcctggtagccctgctggtgcttggccacgtcccttcgggaaggagcgaatttaagcggtgctggaagggccaaggcgcatgccagacgtactgtaccagacaggagacttatatgcacctgtgtcctgacgccagtctatgttgtctgagctatgctctcaagccccctcccgtgcctaagcatgaatatgagtag

SEQ ID NO: 10455 - DNA, 1377 bp, Artificial Sequence
  Description of Artificial Sequence: Synthetic coding sequence
atggaggcaaccggcaccgatgaggtcgacaagctcaaaaccaaatttatcagtgcctggaacaatatgaagtattcttgggtgcttaagaccaagacttacttttcgagaaattccccggtcctgctgctgggcaagtgttatcattttaagtacgaggatgaggataagactctgccagcagagagtggctgcaccatcgaggatcatgtgatcgcaggcaacgtggaagaatttaggaaggatttcatttctcgcatctggctcacctacagagaggagttcccacaaatagaaggttcagcgctgacgacggactgcggctgggggtgcactctcaggactggccagatgctgttggcccaagggctcatactccatttcttaggacgtgcttggacctggcccgatgccctgaacatcgagaacagtgactccgagtcctggacttcacacactgttaagaagtttaccgcctccttcgaggcctcgctttcgggagaaagggaattcaagacaccaaccattagccttaaagaaacgattggaaaatatagcgatgatcacgagatgcgcaacgaggtctaccacagaaagatcatttcatggttcggagacagccctcttgctttattcgggctccatcagcttatcgagtatggcaaaaagtctggcaaaaaagccggagactggtatgggccagctgtggtggcgcacatcttaaggaaagccgtggaggaggctaggcatcccgacctgcaggggatcacaatctacgtggctcaggattgcacagtgtacaacagtgacgtaattgacaagcagtctgcctctatgacctccgacaatgccgatgataaggcggtcatcatactagtgcctgtccggctggggggagagaggacaaacaccgattatctggaattcgttaagggaattttgagcctcgaatactgtgtggggatcatcggcggaaaacccaagcagagctactacttcgcgggattccaagacgactcgctgatctatatggatcctcactactgtcaaagttttgtggatgtgagtattaaagatttccccctcgagactttccactgtcctagcccaaaaaagatgtcgttcaggaagatggatccgtcatgcacaattgggttttactgtagaaatgtccaagatttcaaaagggcgtcagaggaaattactaaaatgctaaaattctcatccaaagagaagtatcccttgtttacatttgtcaacggccactcgcgggattatgatttcacgtccactactaccaatgaggaagatctgttttctgaggacgaaaagaaacagctgaagagattctcgaccgaagagttcgtcctgctgtag

SEQ ID NO: 10456 - DNA, 342 bp, Artificial Sequence
  Description of Artificial Sequence: Synthetic coding sequence
atgagacagagactgttgcctagtgtgacatctctgttgctcgtggcacttctgttccctggatcgtcccaggcacgacacgttaaccatagtgccacagaagcactgggcgagctgcgcgagagagcaccaggacagggcaccaatgggttccagctgctacgacatgccgttaaacgcgacctgctgccccctagaacgcctccatatcaggaacccgcatccgatttgaaggtggtcgattgtcgcaggtccgaaggtttctgccaggaatactgtaattatatggagacgcaggtgggctactgttcaaaaaaaaaagatgcatgttgcttacactag

SEQ ID NO: 10457 - DNA, 258 bp, Artificial Sequence
  Description of Artificial Sequence: Synthetic coding sequence
atgaaaaaggttttgttgctgattaccgccattttagcagtagctgtgggatttcccgtatcacaggatcaagaacgagaaaaacggtcaatatccgacagcgacgaattggcctcaggattcttcgtctttccatacccatacccctttcgacctctccctccgataccttttccgaggttcccttggttcagacggaattttcccatccccattcccgaaagcgcaccaacaactcctttgccttcagaaaagtag

SEQ ID NO: 10458 - DNA, 264 bp, Artificial Sequence
  Description of Artificial Sequence: Synthetic coding sequence
atggccgtttcagtgctgcggttaaccgttgtgctggggctccttgtgttgttcctcacatgttatgcagatgacaagcccgataagcccgatgacaagccagatgattccggcaaggatccgaagcccgacttcccgaaattcctttccctccttggaactgagatcattgaaaatgcagtggagttcattttgagatcaatgagccgctcaacgggtttcatggagttcgacgataatgaaggtaagcactctagtaaatag

SEQ ID NO: 10459 - DNA, 945 bp, Artificial Sequence
  Description of Artificial Sequence: Synthetic coding sequence
atgtcgtcagaagctgagacacagcagccacctgccgctcccccagctgcaccagccctatcagcagctgatactaagccaggcacaaccggcgcacagggtgccgtcgcgagggcccacataggaggggcagggggagacaagaaggtgattgcaaccaaggttctcggtacagtaaagtggtttaacgtcagaaacggctacggcttcatcaaccggaacgacactaaggaagacgtgttcgtgcatcaaacagccattaaaaagaacaatccacggaagtacctcagatccgtcggggacggagagactgtggaatttgacgttgtcgaaggagaaaaaggagccgaagctgccaatgtgacgggtccgggtggagtgcccgtgcagggcagcaagtatgccgctgacaggaatcactacagacgctacccccgtcgtcgcggtcctccaagaaactaccagcaaaattaccagaactccgagtctggtgagaagaacgaggggagtgaaagcgcacccgagcggccaaataatgctgggccacaagccaaagtcccaacactgttacacgcggagtacggtaggagacctcagtacagcaatccccctgtgcagggcgaggtgatggaaggagctgacaaccaaggtgccggagaacaaggccgtccagtgcgacagtgtattggggacattgatcatgattcagcgggagctctgctcgctcggcagccaagggaagatggtaatgaagaggacaaagagaatcagggcgatgagacacagggccagcagcctccccagcggagatacaggagaaacttcaactaccgtcgtcggagacctgagaatcccaaaccccaagatggaaaggaaacaaaagctgctgatcctcccgcagagaacagctccgctcccgaggcagagcagggcggagccgaatag

SEQ ID NO: 10460 - DNA, 636 bp, Artificial Sequence
  Description of Artificial Sequence: Synthetic coding sequence
atggtcttcctgaagttcttctgcatgtcattcttttgccacctttgtcagggctatttcgatggcccactatacccagagatgtctaacgggactctgcaccactatttcgtgccagacggagattacgaggaaaatgatgatccagagaaatgccagctgctgtttcgggtctcggatcatagaagatgtagtcagggggagggctcacaggtggggtctctgctgagcctcacactgcgagaggaattcacagtgttaggaaggcaggtggaggatgcaggcagagtgctggaaggaatctcgaagtccatcagttatgacttagatggcgaggagtcctacggcaaatatttgagaagagaaagccaccagatcggcgatgcctattccaattccgataagtcgctgaccgagctggaatcaaagtttaaacagggccaagagcaggactcaagacaggagtcaagactcaatgaagatttcctgggcatgctcgtccataccagaagcctactgaaggagacccttgatatctcagttggtctcagggataagtacgagctcctggccctgactattcggtcccatggaactcgcttgggccgtttgaagaacgactatctgaaggtatag

SEQ ID NO: 10461 - DNA, 1566 bp, Artificial Sequence
  Description of Artificial Sequence: Synthetic coding sequence
atgctgtgtgcactgctactgctcccgtccctcctcggagctacaagagcctcgcctacaagcggcccacaggaatgcgctaaggggtcaaccgtttggtgccaggacttgcagacagccgcacggtgcggggctgtcggatactgccagggtgccgtgtggaacaaacccacagctaagtctttgccttgcgatgtgtgccaagatattgccgcagcggcagggaacgggctgaatcctgacgccactgagtctgatatccttgccctggtcatgaagacgtgcgagtggctaccttcacaggagtcaagtgccggatgcaaatggatggttgacgcgcatagttccgcaattctgtccatgctgcgaggtgcccctgattccgcccctgcgcaagtttgcacagccctgagcttgtgcgaacctctgcagaggcacctagccacgctgaggccactgtctaaggaagacacttttgaggccgtggccccattcatggccaacgggccactaacattccaccctaggcaggcacccgagggggctttgtgtcaagattgtgtgcgccaggtcagccgccttcaggaggccgtgcgcagcaaccttaccttggctgaccttaatatccaagaacaatgcgagagcttgggtcccggtctggcggtgctatgtaaaaattacttgtttcaattttttgtgcctgccgaccaggccctgagactcctgccaccccaggaattgtgcagaaaggggggtttctgcgaggagctaggtgcccctgccagattaacacaggtcgtcgccatggatggagtcccctcactggagctcgggctgcccagaaaacagtcagagatgcaaatgaaagccggagtcacctgtgaggtctgcatgaacgtggtacagaaactcgatcattggttgatgagtaatagctccgagcttatgattacccacgccctagaaagagtttgtagtgtaatgcctgcatccattacgaaggagtgtattattctggtcgatacctatagcccttccttggtacagctcgtggctaaaatcacgccagagaaggtgtgcaagttcatcaggctctgcgggaacagacgtcgggctcgtgccgtccacgacgcctatgctatcgtcccctcgccagaatgggacgctgaaaatcagggaagcttttgcaatgggtgtaagcggctgttgaccgtctcatctcataacctggagagcaaatctactaaacgagacattctggtggcttttaaaggtggatgtagcattcttccactcccgtacatgattcagtgtaagcatttcgtcacacaatatgagcctgtcctgatagaaagcctgaaggacatgatggaccccgtagccgtgtgtaagaaagtgggagcctgccatggcccaaggactccactgttgggaaccgatcagtgcgcccttggcccatcattctggtgtaggtcacaggaggctgctaaactctgcaacgccgtgcagcactgccaaaagcatgtgtggaaagaaatgcatctgcacgctggggaacacgcgtag

SEQ ID NO: 10462 - DNA, 2127 bp, Artificial Sequence
  Description of Artificial Sequence: Synthetic coding sequence
atggccgcagctgcagttgccgctgctgccgctgcagccgcagcagcatctctccaggtgctcgaaatggagagcatggagacggccgcagctggcagtgctgggcttgccgcagaggtgcgaggatcaggaacagtggattttggacctggcccaggcatcagcgcaatggaagcttccggcggagaccccggtccagaggctgaggactttgagtgctcttcccactgttctgagctgtcttggaggcagaatgagcagaggagacagggcctcttttgtgacattacgctctgtttcggcggtgccggaggacgtgagtttcgggcacatcggtccgtcttggctgccgctacagaatatttcaccccactcttgagtggccagtttagcgaaagtagatcagggagagtcgaaatgcgcaaatggagttctgagcccggaccggagccggatactgtggaggcagtcatagagtacatgtacactggtaggattagagtcagcacagggagtgtccacgaagtgctcgaactggctgatagatttctgttaatcaggctgaaagaattctgcggagaattcttaaaaaagaagctgcacctgtctaattgtgtggcaattcatagtctcgcgcacatgtacaccctcagtcagctggctctgaaggccgctgacatgattcggagaaatttccacaaggttatccaggacgaggagttttacacactacctttccatttgatcagagattggctctcagacctagagattacagtcgactctgaagaggtgctctttgaaactgtgttaaaatgggtacagcgcaatgcggaggagcgcgaaaggtattttgaggaattgttcaagctactcagactcagccagatgaagccaacctacttgacccgtcatgtgaaacccgagcgcctagtggccaacaacgaggtgtgcgtgaagctggtggctgacgccgtggagcgtcacgccttgcgggctgagaacatacagtcaggaacctgtcaacaccccactagccacgttagcctgctgcctcgatacggccagaacatggatgtgatcatggttatcgggggtgtttccgagggcggtgattacctgagtgagtgcgtggggtattttgtagacgaggatagatgggtaaacctgccccacattcacaatcatctggatggccatgccgttgccgtgactgaatcttatgtgtacgtggcgggaagtatggagcccggatttgcaaagacagtggagagatacaacccaaacctgaacacatgggaacatgtatgttcgctcatgaccagaaaacattcttttggacttacagaagttaagggcaaactgtatagtatcggtggacatggaaatttttctccaggcttcaaagatgtgacagtatataacccagagctcgacaagtggcataatcttgagtccgccccaaaaattttaagagatgtcaaggccctagccattgaagacaggttcgtgtacatcgccgctaggactccagtggaccgggacacggaggacgggttaaaggcagttattacatgttacgatactgaaactcgccagtggcaggacgtggaaagtctcccgctgattgacaactattgcttttttcaaatgagcgtcgtaaactccaatttttaccaaaccgctagttgctgtccaaagtcatactgcctggaaaacgaggaggccgttagaaagatagcctcacaggtgtctgacgagatactggagtctttacctccggaagttctttccatcgaaggtgctgctatttgctactataaggatgatgtttttattatcggaggatggaagaactctgatgacattgataagcaatataggaaagaagcgtaccggtattgcgcagaaagaaaaagatggatgctgcttccgccaatgcctcagccacggtgtcgtgctaccgcatgccatgtgagaatcccatatcgctacttacatggtacccaacgctacccaatgcctcagaacctgatgtggcagaaggaccgcataaggcagatgcaagagattcaccgccacgccctgaatatgcgcagggttccctcgagccagatcgagtgttag

SEQ ID NO: 10463 - DNA, 1578 bp, Artificial Sequence
  Description of Artificial Sequence: Synthetic coding sequence
atgtccggcaattgggtgcaccctggccagatcctgatatgggccatttgggtgcttgcagcaccaacaaaaggcccttctgcagagggaccacagaggaatactcgactagggtggatacaggggaaacaggtcacggtgcttgggagtccagtccctgtaaacgtgttcttaggagtcccctttgccgcacctccccttggcagcctcaggtttactaatccacagcctgccagcccatgggataacctgagagaagcaacatcctacccaaatttatgcctacaaaatagcgagtggttgctgctcgaccagcatatgctcaaggtccattatccaaaatttggcgtgtccgaggactgcctgtacctcaacatttacgcgccagcccacgccgacaccgggtcgaaactgccagtgctggtatggtttcccggtggcgcattcaagactgggtctgcttccatatttgacgggtctgcactggctgcctacgaggacgtgctggtggttgttgtccaatatagactgggcatcttcggattcttcacgacatgggaccagcacgctccagggaattgggctttcaaggaccaggtggccgctctgtcatgggtccagaagaatatcgagttcttcgggggagaccctagctcggtgaccattttcggcgaaagtgctggcgctatcagcgtgagtagcctgatactatccccaatggctaagggtctttttcacaaggccatcatggagagcggcgtggccattattccatacctcgaagcccatgactacgagaagtcagaagacctgcaagtcgttgctcacttttgcggaaataacgcttcagactcggaggccctgctaaggtgcttgaggacgaaaccatctaaagaactgcttactctcagtcaaaaaacaaagagctttactagggtggtcgacggggcatttttccctaacgagcctctcgaccttctctctcaaaaggctttcaaggccataccaagtatcatcggtgtgaacaatcacgagtgcggctttctactccctatgaaagaggcaccggagatcttgtccggctccaacaaatctctggccttgcacttaatccaaaatatccttcacatccccccacagtatctgcacctggtggctaatgagtactttcacgataaacactcccttacagaaattagagattccctgttggacctgcttggagatgtcttttttgtcgtgccagccctcatcacagcacgatatcatagagaaggcgcaacagaagaagaaaaactgctgtccaggaagatgatgaagtactgggctaccttcgccagaaccgggaatcccaacggaaacgatctgtcactctggccagcctataacctgacggagcagtatctgcagctcgatttaaatatgagtctgggacagcgattgaaggagcccagggtggatttctggacctccaccatcccgttaattctaagcgcttcggatatgctacatagtccactgtctagcctgacatttttatcactgttacagccctttttcttcttctgtgcgccatag

SEQ ID NO: 10464 - DNA, 900 bp, Artificial Sequence
  Description of Artificial Sequence: Synthetic coding sequence
atggtgcggtgcctcggccctgccctgctgttgctcctactgctgggtagcgccagtagtgtgggtgggaaccgctgcgtggatgccgctgaggcttgtacagcagacgccaggtgccagagactacggagcgaatacgtggcccagtgtctgggccgagcagctcaaggcggatgccccagggctcgttgccggcgtgctttacgccgtttctttgcgcgagggcctcccgcactgactcacgcccttttgttctgtccgtgcgctggcccagcatgcgcggaacgcaggcgacaaacatttgtgccgtcttgcgctttctccggcccaggacctgctcctccatcttgcctcgaaccgcttaacttttgcgaacgatcacgcgtttgtcgttgcgcgagagctgctgcaggaccttggcgcggatggggccgagggttaagccccgcacatcgccctcctgcggctcaggccagcccacccggactgagtggtctggtacatccaagcgcgcagaggcctcgccgactgcccgcagggcctggcaggcctcttcccgcaagactgcggggaccccgaggggtgcccgcagggaccgccgtcacgccaaattatgtggataatgtgtcagccagagtcgctccatggtgcgattgcggggctagtggcaacagacgggaagactgcgaagcgtttcgtggcctcttcacacgaaatcggtgtttagacggggctatacaagcgtttgcctcgggctggcctcccgtccttcttgaccagctgaacccacaaggcgaccctgagcatagcctgctgcaagttagcagcactggtcgtgccctcgaaaggaggtcactgctgagcatcctgcctgttctggccttgcctgcactgttgtag

SEQ ID NO: 10465 - DNA, 270 bp, Artificial Sequence
  Description of Artificial Sequence: Synthetic coding sequence
atgcaggcatgcatggtccccggtctggctctttgtctgttgttggggccactggcgggtgctaagcccgtgcaagaggagggcgatccatacgcagagctgcctgctatgccttattggccctttagcaccagcgatttctggaactatgtacagcacttccaagccctcggtgcctacccccagatcgaagacatggcgagaaccttctttgcccacttccccctgggaagcacgctgggattccacgttccgtatcaggaagactag

SEQ ID NO: 10466 - DNA, 663 bp, Artificial Sequence
  Description of Artificial Sequence: Synthetic coding sequence
atggcgagcgagcggctcccaaatagacccgcatgtctgctggtcgcctctggggcagctgaaggcgtgtccgcacagtcttttttgcactgttttactatggcatctacagcattcaaccttcaggtggccacccccggtggtaaggcaatggaatttgtagacgtgactgaatcgaatgcacggtgggtgcaggacttcagactgaaggcctacgccagccccgctaaactggaatcaatcgacggggcacggtatcacgcgctattaatcccatcctgtccgggagccttaaccgatctggctagtagcggctcactggcccgaattctgcagcactttcactcagagagtaaacctatttgcgccgtgggacacggggtagctgctttatgttgcgcgaccaacgaggataggtcctgggttttcgactcctacagcctcacagggccttcagtgtgtgaactggtgcgggcacctggcttcgcccgactgcccttggtcgttgaggatttcgtgaaagacagtggggcttgcttttctgccagcgagcccgacgctgtccatgtagtgctggaccgacatctcgtcacaggccagaatgcgtcttcaactgttccagccgtgcagaatctgcttttcctctgcggtagccgtaagtag

SEQ ID NO: 10467 - DNA, 1158 bp, Artificial Sequence
  Description of Artificial Sequence: Synthetic coding sequence
atgtgggggttccgccttctgaggtctcctccactcctcttactgctgccacaactggggatcggtaacgcctctagttgcagccaggctcgtaccatgaatcccggtggcagtggtggagctcggtgctctctctctgccgaagtaaggcggcgtcaatgcctccaattgagtaccgtcccgggagccgatccacagcgttccaacgagttgctgctgctagcggcagccggagaagggttagagcgacaggatctgccaggggatcctgctaaggaagaaccacagccaccaccccagcaccatgtcctgtacttcccaggagacgttcagaattaccatgagatcatgactaggcatcctgagaactaccagtgggaaaactggtctctggaaaatgtcgctacgattctggcccatcgctttcccaatagctacatctgggtgattaagtgcagccgcatgcatctacataagtttagttgctatgacaatttcgttaaatccaacatgttcggggcacccgaacacaacacagattttggagcctttaagcacctgtacatgttactggtgaatgcgtttaatctgtcccagaactccctctcgaaaaaatcactgaatgtgtggaacaaagactctatagcttcaaactgtagatcatcaccctcccatacaacaaatgggtgccaaggtgagaaggtgcggacctgtgaaaagtctgacgagtccgctatgtccttttatccacccagcttaaatgacgcatcctttacgttaattggattctccaaggggtgcgtggtgctgaaccagttgttgtttgagctaaaggaagccaaaaaggataagaacattgatgcctttatcaagagcatccgcaccatgtactggctcgatggcggtcattccggcggttccaacacctgggttacttacccagaggtccttaaagaattcgcccagactggcataatcgtacacacacacgtgacaccataccaggtccgggaccctatgcggagctggatcgggaaagaacataagaaattcgtgcagatactgggagacctcggtatgcaagtgacctcacagatccactttactaaggaggctccttccatcgagaaccacttccgggtgcacgaggtcttctag

SEQ ID NO: 10468 - DNA, 936 bp, Artificial Sequence
  Description of Artificial Sequence: Synthetic coding sequence
atgaggggggctgcccgagccgcatggggccgagcaggacagccatggccacgccctccagctcccggaccaccccctccacctcttcctcttcttctactgctgctggctggcctgctgggtggtgcgggagcccaatactctagtgatcgctgtagttggaaaggatctggtctcacacacgaagcccataggaaggaagtcgaacaagtttatttgcgttgtgcagccggagctgtggagtggatgtacccaacaggagctctgatcgtgaacttgcgcccaaacaccttttctcccgcacggcacctgaccgtatgtatccggtcattcacagactcttccggggcaaacatttacttggaaaagactggggagctccgcctactcgtccccgacggagatggtcgccctggacgcgtgcagtgctttggtctcgaacaggggggtctgttcgttgaggccacaccacagcaggatattgggcgtagaaccaccggctttcagtacgaactggttaggcgccaccgggcaagcgatctgcacgaactctcagccccttgccgaccttgctctgatactgaagtgctactggctgtgtgcacatccgatttcgcggtgcggggatcaattcagcaggtcacccatgagccagagagacaagactcagcaattcatttaagagtctcacgactttataggcaaaagtcaagagtgtttgagcctgtacctgagggggacggccattggcaagggcgtgtccgaaccctactggagtgtggggtgcgccctggacatggggactttctgtttacggggcatatgcacttcggagaggctcgactgggatgtgctcccagattcaaagactttcagcgtatgtaccgggacgcccaagagcggggattaaacccttgcgaagtgggcactgactag

SEQ ID NO: 10469 - DNA, 1221 bp, Artificial Sequence
  Description of Artificial Sequence: Synthetic coding sequence
atggggccaagtactcccctgcttattttgttcctcctgtcttggagcggacccctgcaggggcagcaacaccacctggtggagtatatggaaagacgcctagctgccctggaagagaggttggcccagtgtcaggatcaatcgagtcggcacgccgctgaactcagggatttcaagaataagatgctgccgctgcttgaggtcgcagaaaaggagcgtgaggctttacggacggaggctgacaccattagtggacgtgtggaccgcttagagcgggaggttgactacctggaaactcagaaccctgcccttccctgcgtggagttcgatgagaaggtgaccggaggccctggcacaaaaggcaagggcaggagaaacgaaaagtacgatatggtaactgactgtggctatacaatttcccaggtgcgatctatgaaaattttaaagcgcttcggcggtccggcagggctgtggacaaaggacccccttggccagaccgagaagatatatgtgctagacgggacacaaaacgacacggcctttgtttttcctagactgcgcgactttaccctggctatggcagctcggaaggcatccagggtgagagtacctttcccttgggtcgggacaggacagctggtgtacggtggctttctgtactttgccaggaggccacccggtcgtcccggtggcggtggtgaaatggaaaacaccctgcaactcatcaagttccaccttgcgaatcgtaccgtagtggacagctccgtattcccagctgagggcctgattcccccatatgggctcactgccgacacctatattgacttggctgcggacgaggaaggactctgggcggtctatgccacgcgcgaagatgataggcatctatgcctggccaagctggacccccagactcttgacactgaacagcagtgggacactccatgccctcgtgaaaacgccgaggctgcttttgtgatttgcggaaccttgtacgtggtgtacaatacccgccctgcttcacgggctagaatccagtgtagcttcgatgcctccggtaccttgaccccggagagagccgcactgccatattttccacgccgatatggagcccatgcatcattgagatacaaccccagggaacggcaactctacgcctgggatgacggctaccagattgtctataaactcgaaatgcgcaaaaaggaagaggaagtgtag

SEQ ID NO: 10470 - DNA, 900 bp, Artificial Sequence
  Description of Artificial Sequence: Synthetic coding sequence
atgggtgggccaagagctcttcttgccgcattgtgggcactggaggctgctggaaccgcggcactgcgcataggagctttcaacattcagagctttggagacagcaaggtgtcagatccagcatgtggctctatcatcgcaaagatcctggccggatacgacctcgcgctggtccaggaggtgcgcgacccagacttatctgctgtttcagctctgatggagcagatcaacagtgtgtctgaacatgagtattctttcgtttccagccagcctctaggtcgagaccagtacaaggagatgtatctgtttgtataccgcaaagatgcagtgagtgtggttgacacttatctctacccagatcctgaagacgtgttttctcgggagccttttgtggtgaagttctccgctccgggaacaggtgagcgggcaccaccacttccctccaggagggcattgacgccgcctccactgcctgcagctgctcagaatctggtattaatacccttacacgcagccccacaccaggctgtcgctgaaattgatgctctctatgacgtgtatctcgatgtgattgacaagtgggggacagatgatatgctgttccttggcgatttcaatgctgattgttcatatgttcgggcacaggactgggcggcaatcagactgagatcaagtgaggtctttaagtggctcattccagactctgctgacactactgtcggaaactccgattgcgcatacgatcgcatcgttgcttgcggagctaggctcagacggtccctgaaaccacagagtgccactgtgcacgatttccaggaagagttcgggctggatcagacgcaggcacttgccatctcagaccatttcccggttgaggtgaccctgaaatttcacaggtag

SEQ ID NO: 10471 - DNA, 1617 bp, Artificial Sequence
  Description of Artificial Sequence: Synthetic coding sequence
atggggtgtctgtggggtcttgcacttccattgtttttcttttgttgggaggtgggtgtgagcggatcttctgctggcccttccacacgccgagccgataccgccatgactaccgatgacacagaagtgccggcaatgacactggccccaggtcatgccgctctggagacccagaccttatccgccgaaacctcctctcgggcttcaaccccggcaggccctatccccgaggccgagacacggggagccaagcgaatcagccccgcaagggagaccaggtcgttcactaagaccagtccgaatttcatggtgttaatcgctacatccgtggagactagcgcagcctccggctctcccgaaggtgctggaatgaccaccgtgcagacgattactggatccgacccacgggaagccatctttgatacgctgtgcactgatgattcatctgaagaagctaaaactcttaccatggacatactcacactagcacatacctctacagaggccaaaggcctttccagcgagagctccgcttctagtgactccccccacccagtaatcactccaagccgagcttccgaaagctctgcaagctctgacggcccacaccctgttatcactccaagtagggcaagcgagtccagcgccagttcagacggccctcaccccgtgattactccatcttggtccccaggatcagacgttactctacttgctgaggcactggttacagtcacaaacatagaggttattaactgctccatcactgagatagagactactacctctagcatccccggagcatcagacaccgatttgatccctactgaaggcgtcaaggcctcctctaccagcgatccgcctgctctccccgattcaactgaggccaagcctcatatcaccgaagtgacagcttcagcagaaacactgagcacagctggaactactgaatccgcagctccagatgctacagttgggacccccctgcccacgaactcagctactgaacgtgaagtgacagctcccggtgctactaccctttctggggcacttgtcacagtttcccgcaacccgctcgaggagaccagtgccctgtctgtggagactcccagttacgtgaaggtgtccggcgcagccccagtctctatcgaagctggatccgcagttggaaagaccacctccttcgcgggttcgagcgcttctagctacagccccagcgaggcagctttgaagaattttacgcctagcgagacacccaccatggatatcgccactaaaggccctttcccaaccagcagggatccgttaccttctgtgcctccgacaaccactaactcgtcccggggtaccaactctactctcgccaaaattacaacctctgccaaaaccacaatgaagcctccgaccgctactcctacaacagcccgaacaagaccaactaccgacgtgagcgcaggagagaacgggggatttcttcttctgcgcctgtcagtagcatcacccgaggacctcactgatcctcgggttgcagaaaggctaatgcagcagttgcaccgcgagcttcatgcccatgcaccacacttccaggtgtctctgctccgcgtccgcagggggtag

SEQ ID NO: 10472 - DNA, 975 bp, Artificial Sequence
  Description of Artificial Sequence: Synthetic coding sequence
atgagttccgaagcggagactcaacaacccccagctgctccccctgctgccccagcgttgtccgccgctgacactaagccgggaaccaccgggtccggggctggctctggaggcccaggagggttgacatcagcagctccagccggaggagataagaaggtgatcgctacaaaagtattgggcacggtgaagtggttcaatgttagaaatggctatggatttattaacaggaacgatacgaaagaagatgtgttcgtccaccaaaccgccattaaaaaaaacaaccccaggaaatacctaagatcagtgggagatggtgagacggtggagttcgatgtggtcgaaggagaaaagggagccgaggctgctaacgttacagggcctggtggagttccggtgcagggtagtaagtacgcagccgatcggaaccactatcggaggtacccgcgaaggcggggacccccaaggaattaccagcagaattatcaaaacagtgaatccggcgaaaaaaacgaaggatccgaatccgctcccgaaggccaagcacagcagcggagaccttataggcggagacgcttcccaccttactacatgcgccgtccctacggccgacggcctcagtattctaatcccccagtccaaggagaggtaatggagggcgctgataaccaaggtgccggtgaacaagggagaccagttagacagaacatgtatcgaggatatcgaccaaggttcaggagaggcccaccgcgtcaacgacagcctcgcgaagatggtaacgaagaggataaggagaaccaaggcgacgaaacacaggggcagcagcctccacagagacgataccggcgaaacttcaactaccgcaggaggagacccgagaaccctaaacctcaagatggcaaagaaaccaaggcggctgatcccccagccgaaaatagcagcgcccctgaagctgagcagggtggggctgaatag

SEQ ID NO: 10473 - DNA, 210 bp, Artificial Sequence
  Description of Artificial Sequence: Synthetic coding sequence
atgaggatcttttactatttacattttctttgttacgtgacctttattttaccggcaacctgcacactggtcaacgcggataggtgtactaaaagatacggaaggtgtaaaagggactgcttggagtctgaaaagcaaatcgacatttgttctctacctcgtaagatttgctgtactgagaagctgtatgaggaggatgacatgttctag

SEQ ID NO: 10474 - DNA, 342 bp, Artificial Sequence
  Description of Artificial Sequence: Synthetic coding sequence
atgaagctcttgaccaccatttgcaggctgaagctggaaaagatgtatagcaaaacgaacacatcatctacgatcttcgaaaaggctaggcatgggaccgagaagatttccaccgcccgatccgaggggcaccatattaccttcagccgttggaaatcctgcaccgcgatcgggggtcgctgcaaaaatcaatgtgatgactcagagttccgtattagctactgcgcgcgtcccacgacacactgctgtgtaaccgagtgtgatcctaccgacccaaacaattggatcccaaaagacagtgttggcacccaggaatggtaccctaaggacagcaggcactag

SEQ ID NO: 10475 - DNA, 3030 bp, Artificial Sequence
  Description of Artificial Sequence: Synthetic coding sequence
atggatttaatccgcggagttttactccgtcttctgctcctggcgtccagcctagggcctggggctgtgagcctccgcgctgctatccgcaagccagggaaagtgggacccccattggacattaagctgggcgctctgaactgcactgcattctcgatacagtggaagatgcccaggcatccgggaagccccattctgggttacacggtcttctattcggaagtcggggctgacaaatctctgcaagagcagttacactctgtgcctttatccagagatatacccaccactgaggaagtgattggcgatctcaagccaggtaccgaataccgagtgagcatcgcagcctactcacaagccggtaaaggcagactttcttccccccgtcatgtaactaccctgagccaggactcatgcctgcccccagccgctcctcagcagccgcatgtcattgttgtttctgactctgaggtggcactttcctggaagccgggagcctctgaaggcagtgctcctatccagtactactcagttgagtttatccggccagacttcgacaaaaagtggacaagtatccacgagcgaatacagatggactctatggtaatcaagggattagaccctgacacaaactaccagtttgcagtcagagctatgaactctcatggaccctcacccaggagctggccctccgacattatccggaccctgtgccccgaggaggctggttctggacgctacgggccacgctatattactgacatgggcgcaggggaggatgacgaaggatttgaggacgacttagacctggatataagcttcgaggaggtgaagcctctccctgccacaaaaggcggtaataaaaagtttttggttgagtccaagaaaatgtccatctccaaccccaagaccatttcgcgtctgattccacccacctccgctagtctgccagtgaccaccgtggctcctcaaccaattccaatccaaagaaaaggcaagaacggtgtggccattatgtcccgcttatttgacatgccgtgcgatgaaacactgtgctcagccgatagcttctgtgtgaacgattacacatggggcggttctaggtgccagtgcacactcggaaaggggggagaatcatgcagtgaagacattgtgatacagtatccgcaattttttggccattcgtacgtgaccttcgagccactcaagaatagctaccaagcttttcagattacccttgaattccgcgcagaggccgaggacggattacttctgtactgcggagagaatgagcatgggcgtggtgattttatgtccttagccatcatcagaaggtcattacagtttcggttcaactgtgggaccggcgtggcaatcattgtcagtgaaaccaaaattaagctggggggatggcacactgtgatgttgtatagggacggtctgaacggactactgcagctcaataacggtacaccagtaacaggacagagtcagggtcagtatagtaaaatcacctttagaactcccttgtacctgggtggcgctccatccgcctattggctagtcagagctactggcaccaacaggggctttcagggctgtgtgcagtcactcgccgtgaacggacgaagaattgacatgaggccttggcctctcggcaaggccttgagcggggcagacgtgggagagtgctcttctggcatttgcgatgaggccagctgtattcatgggggtacatgcacagccatcaaagctgactcgtatatttgtctgtgtccgctcggattcaaggggagacactgtgaggatgcatttacgctgactatcccccagttcagagaatccttgcggagctatgccgctacaccgtggccactggaacctcagcactacctcagctttatggagttcgaaatcacatttcggccagacagtggggatggggtcctactttattcttatgacacaggctcgaaggattttctgagtataaacttggctggaggtcacgtcgaatttcggtttgactgtggttccggaacgggcgtgctgaggtcagaagaccctctgacacttggcaattggcacgaactccgagtatcacgtacagcgaagaatgggatccttcaggtggataagcagaagatagtggaaggtatggccgaaggtggctttacacagatcaagtgtaatactgatattttcatcgggggtgtgcccaattatgacgacgtaaagaagaacagcggtgtgctgaaaccattcagcggatctatccagaaaatcatcctgaatgatagaaccattcatgtcaagcacgatttcacctccggagtaaacgttgagaacgcagcccatccttgcgtgagagcgccatgcgctcacggcggatcttgtaggcccagaaaagagggctacgactgcgattgtcctttaggctttgagggtttacactgccagaaggcaattatcgaggccattgaaatcccgcaatttatcggcagatcttacctcacatacgataatcccgacattctcaaacgggtttccggcagccggagcaatgtttttatgcgttttaagaccaccgctaaggatggcttactgctgtggaggggggacagccccatgagaccaaacagtgactttatttcgctcgggctacgcgatggggcactagtgttttcctataaccttggctccggggtcgcaagcattatggttaatgggtcgtttaatgacggcaggtggcaccgggtcaaagctgttcgcgatgggcagtcaggtaaaataacagtggacgattatggggctagaactggaaaatcacctggcatgatgaggcaacttaatattaacggcgctctctatgtgggcggaatgaaggaaatcgccctgcacactaacaggcagtatatgcgagggctggttggatgcatcagccacttcaccttatccactgactatcatatcagtctggtcgaggacgccgtcgatggaaagaacatcaacacttgtggggcaaaatag

SEQ ID NO: 10476 - DNA, 1272 bp, Artificial Sequence
  Description of Artificial Sequence: Synthetic coding sequence
atgtctgtgagaggaatcctgcggttgggcactcaggagtacccaagccctctggatcccgaagtgggcccttactgcgacaccccgaccatgcgaacgctgttcaatcttctgtggctcgccctggcgtgtagtcccgttcatacgacactctccaagtcagatgctaagaaggcggcaagtaagaccctgctggaaaagtcccagttcagcgacaagcctgtccaggatagggggttggtggttaccgacttaaaggctgagagtgtggtcttggaacacagatcatactgctcagccaaagctcgggaccgccacttcgctggcgacgtgcttggctacgtcaccccatggaattcccatggctacgatgtgacaaaagtttttggatccaaatttactcagatctcccctgtgtggttacaactgaaacgccgaggcagagagatgttcgaagtcaccggtctccatgacgtcgatcagggttggatgagggcagttcgtaagcacgccaaaggtctgcacattgtgccccgactgctcttcgaggactggacgtatgatgacttcaggaacgtgctcgactctgaagacgaaattgaagagctgtccaaaactgttgtgcaagtggccaagaatcagcattttgatggattcgtggtggaagtatggaatcagctgctctctcagaaaagagtcggcctgatccatatgcttacacacctcgccgaggcgctacaccaggcaaggctgctggcactgttggtaatccccccagccatcaccccgggtacggaccagctgggaatgttcactcacaaggaatttgagcagctcgcaccagtcctcgacggcttcagccttatgacatacgactattcgaccgctcaccagccagggcctaacgccccactgtcatgggttcgcgcttgtgtgcaggtcttggaccccaaaagcaagtggcggagcaaaatcctgctcggtcttaatttttacgggatggactatgccacaagcaaggacgcccgagagcccgttgtgggagccaggtatatccagaccctgaaggaccaccgcccacggatggtgtgggatagccaggcctccgagcacttctttgagtacaagaagagccggagcgggaggcatgtagtcttctacccaactctgaagtccttacaagtgcgactggagctcgccagagaactgggggtgggagtcagcatctgggagctcgggcagggactcgactatttctatgatctcctttag

SEQ ID NO: 10477 - DNA, 1182 bp, Artificial Sequence
  Description of Artificial Sequence: Synthetic coding sequence
atgagaactctgtttaacctcctgtggttggcgttggcttgttcacctgtccatactacactgtcaaagtcagacgccaagaaggctgccagcaaaacacttctagagaagagccagttctccgataaacctgtgcaggatcgcggtctcgttgtaacggatctcaaggctgaaagcgttgtgctcgagcatcggagctattgttctgccaaggccagggaccgccacttcgcaggagacgtgctggggtatgtcaccccatggaacagccatggatatgacgtcaccaaggtttttggctccaaattcactcagatcagcccagtctggctccaactcaagcgcaggggcagagaaatgttcgaggtgactggcctgcatgacgtagaccagggctggatgagagcagtgcgcaaacacgcaaaggggctgcatatcgtccctcggctcctgtttgaggattggacctacgacgattttcgtaacgtcctggattcagaggacgagattgaggagttgagtaaaacagtggtccaagtggccaaaaaccagcacttcgatggcttcgttgtggaagtctggaatcaactgctaagtcagaaacgggtggggctcatccacatgctgactcaccttgcagaagcgttgcatcaagccagactcctggccctcttagtcataccgccagcaatcacaccaggcacggaccaactaggcatgttcacccacaaagagtttgagcagcttgcaccggtcctcgacgggttctccctgatgacatatgactatagcaccgcacatcagcccggtcctaacgctcctctatcttgggtgagggcctgtgttcaagtcctggatcccaaaagcaagtggaggtcgaagattttactgggcctcaatttctacggtatggactacgcaacctcgaaagacgctagagaaccggtggtaggggcacggtacatacagaccctaaaggatcatcgcccaagaatggtttgggactcccaggctagcgaacatttttttgaatacaagaaatcaagatctgggagacatgttgtgttctatcccacgttgaagtccttgcaggtgagactggaacttgcacgagagctgggtgtgggtgtatccatttgggaactgggccagggactcgattatttttatgacctcctctag

SEQ ID NO: 10478 - DNA, 1959 bp, Artificial Sequence
  Description of Artificial Sequence: Synthetic coding sequence
atggcatcagtggcatgggccgtactgaaggttcttctcctccttccaacgcagacttggagccctgtgggggctggtaatccccctgactgcgacgcacccctagccagcgcactgcccagatcgagcttttcgagctcaagtgagctcagcagctcccacggcccagggttcagtagactaaaccgaagggatggcgctgggggatggacgccgctggtatctaataaatatcaatggttgcagatagacttaggggagcgcatggaggtgactgccgtggctacgcaaggcggatacgggtcgagcgattgggtgaccagctatctcctgatgttttcagacggcggacgcaattggaagcagtacagacgggaagaatccatttgggggttccccggaaataccaatgccgattcggtggtgcactacagactgcagccaccgttcgaggcccgtttcctgcgctttctccccctggcctggaatcccagaggacggataggtatgcgtattgaagtctacggatgcgcctacaagtcagaggtggtgtacttcgacggccagagcgccctgctctacaggcttgataaaaaaccactcaagcctatcagggacgtaatttctctgaaattcaaagcgatgcaaagcaatggaatcctgttgcaccgagagggccagcacggaaatcatatcaccctggagctgataaaagggaagctggtctttttccttaactcagggaatgccaagctcccctcaactatcgcccctgtgaccttgacgttggggagcctgctggatgatcaacactggcactccgtgctgatcgaactcctcgacactcaggttaattttactgtagacaaacatacccaccattttcaggcaaagggcgactcctcttacctggatctaaatttcgaaatttcatttgggggaatccctacaccgggtcgaagccgggcttttaggagaaagtcatttcacggctgcctggaaaatctgtattataacggcgtcgacgtgaccgaactggctaaaaagcacaagcctcaaatacttatgatgggcaacgtttccttctcatgccctcagccccagaccgtgcctgtgaccttcctctctagcaggtcttatttggccctgcctgggaacagtggcgaggataaagtgtctgttacttttcagttccgaacttggaaccgggctggacatttactatttggagagctgcgcagggggtccggtagcttcgtgctgttcctgaaagacggaaagctgaaactctcactcttccagcccggacagagtcctagaaatgtgaccgcaggcgctgggctgaacgatggacagtggcattcggtgtcattttctgccaaatggagccacatgaatgtcgtagttgacgatgatacagcggtgcagccccttgtggcagtacttatagacagcggtgacacctattacttcggcgctctgtacgagcaatcctgtgaggcacataagcacagggggaacccctcaggcctgtactacattgacgcagacgggagcggcccactcggcccattcctggtgtactgcaatatgaccgatgcagcctggaccgttgtccaacacggaggacccgatgccgttactctgaggggggctccatctggccacccccgtagtgcagtgtcattcgcttatgctgcgggagccggtcagctgagatccgccgtgaatctcgctgagaggtgcgaacagcggctggcactccggtgtggcacggcccgaaggccagattctcgggacggtacacccctgtcatggtgggtgggcagaacaaatgagacacacacgtcgtggggtggatctctgcccgacgcccagaagtgcacttgtggtctagagggaaattgcatagactcccagtattactgcaattgcgatgccggaaggaatgagtggtag

SEQ ID NO: 10479 - DNA, 1455 bp, Artificial Sequence
  Description of Artificial Sequence: Synthetic coding sequence
atgtggtatgtcagtacccggggagtggccccacgcgtgaatttcgaaggagccctgttctccggctacgcacccgatggagggctgttcatgccagaggaactgcctcagttagacaggggaaccttgtgccagtggagtaccctctcctatcccggtctggtgaaagaactctgtgcgctgtttatcggttcagaactgcttcctaaagatgagctgaacgacctgatagatagggctttttcacgcttccgccacagggaagtggttcacctgtcccgtctgagaaatggcctgaacgttctcgagctctggcatggagtcacctatgccttcaaagacctctcactgtcatgtactacacaatttctccaatactttctggagaaaagagagaaacacgtgactgtggtggtaggaacctctggcgacacgggatccgctgccatcgaaagcgtgcagggtgccaaaaatatggacataattgtactactgccaaaaggtcactgtaccaaaattcaggaactccagatgaccaccgttctcaagcagaatgtgcacgtgttcggagttgagggaaactctgacgagctggacgagcccattaagactgtctttgctgatgttgctttcgtgaagaagcataacctcatgtcgctgaatagtattaattggagcagagttctggtgcaaatggcccatcattttttcgcctacttccagtgcaccccatcgttggatactcaccccctgcctttggttgaggtggtggtaccgacaggagctgcaggaaatcttgctgctgggtacatcgcccaaaaaattggcttaccaattcgtttggtggtggcggtcaaccgaaacgacattatccacagaaccgtgcaacagggcgatttttcgctgtcagaagctgttaagagtacactggccagtgccatggatatacaggtgccctacaatatggagcgagtgttttggttattgagtggaagcgattcacaagtgacacgtgcgctcatggagcaattcgaaagaacccagagcgttaacctgccaaaggaactgcactcaaaactgtctgaggcagtgacttcagtctcggtctcggacgaggcgattacgcaaaccatgggcagatgctgggacgaaaatcagtacctgctctgtccacattccgcagtggccgtcaactatcattatcagcaaatagatcggcaacagcccagcactcccaggtgctgcttggccccagcaagcgccgcaaaatttcccgaagccgtgctcgccgctgggttgactcctgaaactccggctgaaatcgtcgccctcgagcacaaggaaacccgctgcaccctgatgaggcggggagacaattggatgctcatgctccgcgatacgatagaagacttatctcgccagtggcggtctcacgcgctgaacacaagccagtag

SEQ ID NO: 10480 - DNA, 264 bp, Artificial Sequence
  Description of Artificial Sequence: Synthetic coding sequence
atggtgtctttaatgaaactctggatccccatgctgatgacatttttctgtactgtgctgctctctgttttgggggaaatgaggaaaaagaggtacgatagaaaggagctgctcctggaagagtgttgggggaagccaaacgtaaaggagtgcacaaataagtgttcgaaagccttcaggtgcaaggataagaactacacatgttgttggacctactgtggaaacatatgttggattaatgtggaaacttcaggagactattag

SEQ ID NO: 10481 - DNA, 453 bp, Artificial Sequence
  Description of Artificial Sequence: Synthetic coding sequence
atgaggttcatggccggtcccgctgggagccagtcactcggccctttgtgctttcactcctcaccacaggcactttataccgtactcttgattgtccttgttatgatgtccttggtgttcggaaagtttgtgccagtgaattgggagccaccccagccattgccatttcccaagtacctccgctgctatagatgtttactggagacgaaagagctgggctgcttactgggctccgatatttgtttaacaccagcagggtcaagctgcattacgctccacaagaagaatagctcgggctccgacgtaatggtgagtgattgccgcagcaaggagcaaatgagcgactgctctaacactagaactagtccagtgagcgggttttggatttttagccagtactgcttcctcgatttctgcaacgatccccagaaccggggactttatactccatag

SEQ ID NO: 10482 - DNA, 873 bp, Artificial Sequence
  Description of Artificial Sequence: Synthetic coding sequence
atgagcgtgcggcgaggacggagacccgcacgcccaggaacaagattgtcatggctgctttgctgttccgcactgcttagtcctgcagcgggttatgtgatagtgagttcagtgtcatgggctgttacgaatgaggtagatgaggagctggacagcgccagcactgaggaagccatgcccgcactccttgaagacagcggctctatatggcagcagtcattcccagcctctgctcataaggaggacgcacacctcagaccacgagctggggcagccagagcccgaccaccgcctgcgcctcccggtatgttctcctaccggcgtgaaggaggccagactgcatcggctccacctggacccaggttgagagcggctaccgctcgaagccttgcccacgcgtcagtgtggggttgtctagcgactgtcagtacacacaagaaaattcagggcctgccatttggaaactgtttgccagtgtctgacgggcctttcaataactctactgggatcccctttttctatatgactgcaaaagacccagtcgttgcggatctgatgaagaaccctatggcatctctgatgctgcctgagagcgaaggggaattttgcagaaaaaacattgtggatcccgaggaccctcggtgcgtccaactgaccctcaccggccagatgatcgctgtgtcgcctgaggaagtggagtttgctaagcaggccatgttcagccgtcatcctggaatgaggaagtggcccagacaatacgagtggttttttatgaagatgcgcatagagcatatctggttgcagaagtggtatggaggagcgtcctctatcagccgtgaagagtactttaaggccgtcccaaggaaagcatag

SEQ ID NO: 10483 - DNA, 2742 bp, Artificial Sequence
  Description of Artificial Sequence: Synthetic coding sequence
atgggcccagaggccctgtcttccctcttactgctgctgctcgtggcctcaggtgacgctgacatgaaagggcacttcgaccctgccaaatgtcggtatgcactcgggatgcaggatcgcaccatcccagatagcgacatcagtgcgtcgtcatcatggtccgattccacggctgctcgtcatagtaggctggagagctctgacggggatggagcgtggtgccccgcaggaagtgtctttcccaaggaggaagaatatctccaggtggacctacagagactccatcttgtggctttggtcggtacgcagggcaggcacgccggtgggctgggcaaagagttcagcaggagttatagactgcgctacagtcgcgatggacggcgatggatggggtggaaggacagatggggacaggaggttattagcggaaacgaggatcccgaaggcgtggtgctgaaagacctgggccctccaatggtggctaggctggtccgtttttacccacgggctgaccgtgtgatgagcgtgtgcttacgggtcgagctttatgggtgcctgtggcgggacgggcttctgtcttatacagctccggtcggccagacaatgtacctatcggaggctgtgtatttgaacgactccacatatgacggtcacacggtcggaggcttgcagtacggcggacttggtcaattggccgacggggtcgtggggttggacgacttccgcaaaagccaggaactgcgggtttggccagggtacgactacgtgggatggagtaaccactcttttagttctggctacgtggaaatggagtttgagtttgatagactgagagcatttcaggcgatgcaggtccattgtaacaacatgcatacattgggggcacgcttacctggtggagtggagtgcagattccgcagaggccctgccatggcttgggagggcgaaccaatgcgtcacaacttaggcggaaatctgggtgaccccagagcgcgagccgtgagtgtgcccctgggaggccgagtggccagatttttgcagtgccgctttctcttcgctggaccttggcttctcttctctgagataagttttatttcggacgtcgttaacaactcctccccagcactaggcggtactttcccccctgccccttggtggccacccggtcccccaccaacaaattttagctctttggagctcgagcccagaggtcagcagccagtggccaaagctgagggctcccctaccgcaattcttatcggatgcctggtggcgattatcctgctcctgcttctgatcatcgctttgatgttatggcgcctgcactggagacgcctattaagcaaggcagagaggagggtgctggaagaggagctgacagtccacctaagcgtacccggagataccattctgatcaataatcggccagggccacgcgaaccgccaccatatcaggagcccaggccgagaggcaaccctccccatagtgccccttgtgtacctaacgggtccgctttgctgttgtccaacccagcctacagactcctgttggcaacctatgctcgtccaccccgaggcccaggccctccaacaccagcctgggctaaacccaccaatacacaagcttacagtggggattatatggaacctgaaaaacctggagccccactgttgcccccacctccccagaactccgtgccacactacgctgaagccgatatcgtaactctgcaaggagttacgggtggaaacacttatgccgtgccggctctccccccaggggctgttggagacggcccacctagggtagattttccccgttccaggttaaggttcaaggaaaaattaggcgagggtcagtttggggaggttcatttatgcgaggtggatagcccacaggacctcgtcagccttgattttcctcttaacgttagaaaaggacacccattgttagtggccgtgaagatactgaggccagatgccaccaagaatgcacggaacgactttctcaaggaagtcaagatcatgtccaggctcaaagatcctaatatcattagactgcttggagtgtgtgtccaggatgaccccctctgcatgattaccgactacatggaaaatggcgacctgaaccagtttctgtccgcacaccagctggaggacaaagcagcagaaggcgcaccgggagatggacaagctgcacagggcccaacaatctcctatccaatgttgcttcacgtggccgcacagatagcatcaggaatgcggtatctggccaccctgaactttgtgcaccgagatcttgctacacgaaactgcctggtcggagagaatttcaccatcaaaatcgcggactttgggatgtccaggaacttatatgccggagactactatagggtgcaggggagggccgtgctgcctattcgctggatggcttgggagtgtatcctcatgggcaaatttacaaccgcctctgacgtctgggcgttcggcgtaactttatgggaagtcctgatgctttgtagggcccagcctttcggccaactgacagacgagcaggtcatcgaaaacgcaggcgagttctttagagaccaaggaagacaagtttacttatcacggccacctgcttgcccacagggactgtacgagctcatgctccgctgctggagccgggagtcggaacagcggcctcccttttctcagctccatcgattcctggcggaagacgctctgaatacagtgtag

SEQ ID NO: 10484 - DNA, 243 bp, Artificial Sequence
  Description of Artificial Sequence: Synthetic coding sequence
atgaaactgagtggaatgttcctgctgctctcccttgcccttttttgttttctgaccggtgtcttttcgcagggaggacaggttgattgtggagagtttcaggacccaaaagtttactgcacacgtgagagtaacccacattgtggaagcgatgggcagacttatgggaacaaatgcgctttttgcaaggccatcgtcaaaagcggaggcaagatctccctcaaacaccccggaaaatgctag

SEQ ID NO: 10485 - DNA, 270 bp, Artificial Sequence
  Description of Artificial Sequence: Synthetic coding sequence
atgaaaccctggatccttttactggttatgtttatatccggagtcgtcatgctgctccccgttctgggcagcttctggaacaaagacccattcctagacatgattagagagacagaacaatgctgggtccagccgccatacaaatattgtgaaaagagatgcaccaagatcatgacttgtgtgagaccgaaccacacatgttgttggacctattgcgggaatatctgcctggataacgaggagccgttgaagagtatgctgaatccttag

SEQ ID NO: 10486 - DNA, 264 bp, Artificial Sequence
  Description of Artificial Sequence: Synthetic coding sequence
atgttaccatgtctggcccttctgctgttgatggagctgtccgtgtgtaccgtggcaggtgatggtggcgaggagcagaccttatcaactgaagctgagacctgggagggcgctggcccatccatccagctgcaactacaggaagtgaagacaggtaaggccagccagttttttggactcatgggaaagagagtgggcggtagaccgttgattcagcccagaaggaagaagggcagagaagacgaggcccaggggtccgagtag

SEQ ID NO: 10487 - DNA, 285 bp, Artificial Sequence
  Description of Artificial Sequence: Synthetic coding sequence
atgcagcacagtcttgtatttttcttcgctgtgatcctacatctgtcccacctgctgcacctggacgccagcatccatcccttcagactgccctttagtagtaagcccttccttctcatacccatgtcgaacaccaccctcccccatacagcatggcctctgtcctttcttcaccaaactgtgtccactcttaaagctgtggccgtcactcatagcctctggcatttgcagattccagtagactgccaggcttgtaataggaaaagcaagaagatatattgctag

SEQ ID NO: 10488 - DNA, 327 bp, Artificial Sequence
  Description of Artificial Sequence: Synthetic coding sequence
atgagacaaaggctactgccttctgtgacctctctcctcctggtggccctgctgtttcccggaagttctcaggcccgtcacgttaatcatagtgcaaccgaagccctgggagaattacgggagagggctcctggacaggggaccaacggcttccagctgctcaggcatgccgtgaaacgagatttactaccgccacgtacccccccttaccagggtgacgtccccctcggcatccggaacacaatttgcagaatgcagcaaggtatctgccgcctctttttctgccattctggcaccggccaacagcatcgccagcggtgcggttag

SEQ ID NO: 10489 - DNA, 807 bp, Artificial Sequence
  Description of Artificial Sequence: Synthetic coding sequence
atgcttcttctggcagcagctttcttggtggcttttgtgctccttttatatatggtctctcctcttatcagccctaaacccttggcgctaccaggtgcccacgtcgtagtcaccggtgggtcctcaggcataggaaagtgcatcgcaatagaatgctataagcagggggctttcataacccttgtggctcgtaacgaggacaaactgctgcaggccaagaaggagatagagatgcactccattaacgacaaacaggttgtgctgtgtatctccgttgacgtgagccaggattataaccaggttgaaaacgttataaagcaggcccaggaaaagttggggccagtggacatgctagtaaactgcgccggaatggctgttagtggaaagtttgaggatctggaggtgtctaccttcgaggtcaaaccttacaacgtttatatcactgtcgcctacccgcctgacactgacacaccgggatttgccgaggaaaatcgaaccaaaccgttggagacccgcctgattagcgagactaccagcgtgtgtaaacccgaacaagtggcaaagcagattgttaaggacgcaattcaggggaacttcaattcatccctgggctctgacgggtatatgcttagtgccctgacttgtgggatggccccagtgacatcaatcaccgaagggctgcaacaggttgtcactatgggactatttagaaccatcgctcttttctatttgggttcttttgatagcattgtacgtaggtgcatgatgcagcgcgaaaaaagtgaaaacgccgataagacggcatag

SEQ ID NO: 10490 - DNA, 1686 bp, Artificial Sequence
  Description of Artificial Sequence: Synthetic coding sequence
atgcgctggatactctgttggtccctgactctctgtctgatggcacagacagcactgggagccctgcacacaaagaggcctcaggtggtgactaagtacggtactctgcagggcaagcagatgcatgtaggcaagactcccattcaagtctttttgggtgtcccattctctagaccccctctaggtatccttagattcgcgcctcctgagcctcctgaaccttggaagggtatacgagacgcaacaacctatccaccagggtgtctgcaagaaagttggggacaactggccagtatgtatgttagcactagagaacggtacaaatggctgcgctttagcgaggattgcctgtatcttaatgtgtacgcgccagctagggctcctggcgacccccaactgcctgttatggtctggttcccaggtggtgcgttcatcgtgggtgctgccagctcgtacgagggctctgacctcgccgcacgcgaaaaggtcgtgcttgtttttcttcagcaccgtctgggcatctttggcttccttagcactgatgatagccacgcccgaggaaactggggcctgcttgaccagatggctgcactcagatgggttcaggagaacatagccgcattcgggggagaccctggaaacgttacactcttcggccagtccgctggcgctatgtcaatctctggactaatgatgtcaccgctagcgtccggactgtttcaccgcgctatttctcagagcgggaccgccctgtttagactgtttataacaagtaatccattgaaggtagccaagaaagtggcacacctagccggatgcaaccataactccacacagatcttggttaattgtctccgagcgctctcgggcaccaaggtgatgagagttagcaacaaaatgcgcttcctccagctgaactttcagcgcgatcctgaagaaattatctggagcatgtctcccgtggtggacggagtagttattccagatgatcctttggtattgctcacacaggggaaagtgtccagcgtgccttacttgctcggagtaaataatctggaattcaactggttgcttccatacatcatgaaatttccactcaatagacaggccatgcgcaaggagacaattactaagatgctttggagcactcggacccttcttaacatcaccaaggagcaagttcctttagtcgtagaagagtatctagataacgtgaatgagcacgattggaagatgctccgcaaccgtatgatggacatcgttcaggacgctacattcgtttacgcaacactgcagaccgctcattaccatagggacgcaggcctccccgtctacctgtatgagttcgagcatcacgccaggggaatcatcgtcaaacccaggacggatggagccgaccacggagacgagatgtacttcctgtttggaggccctttcgccactgggctttcaatggggaaagaaaaggccctgtccctacagatgatgaaatactgggcaaatttcgccagaactggaaatcccaacgatgggaatctgccatgttggccccgatacaataaagatgaaaagtatctgcagctggacttcactacacgcgtcgggatgaagctgaaagagaagaagatggccttctggatgagcctctatcaatctcagagacctgaaaaacaaagacagttttag

SEQ ID NO: 10491 - DNA, 444 bp, Artificial Sequence
  Description of Artificial Sequence: Synthetic coding sequence
atggccagctcactaaaaatatggggaacattgctcgcgctcctctgcattctttgcacgctcctggtccagtccaaggaagtgagttggcgtgagttcatgaagcagcattacctctctccttcgcgggagtttcgtgaatacaagtgcgatgtcctgatgcgagagaacgaagcactgaaggacaagtcatctcacatgttcatttacattagctggtataaaatagaacatatctgcacatcggacaactggatggatcggtttcggaatgcgtacgtctgggtgcagaaccccctcaaagtcctcaaatgccaccaggagaatagcaaaaacagttacactgagtcgaggagtttcaactacatcgaattccactgttctatggatggttacgtggatagtatcgaagatctgaaaatggttgaacctattgggaactag

SEQ ID NO: 10492 - DNA, 444 bp, Artificial Sequence
  Description of Artificial Sequence: Synthetic coding sequence
atgaccagcagtctgaaaatctggggaatcctattggctttgctgtgcatattgtgcagactgtgtgtgtacagcaacaatatctactggagagagttcattaagctgcattacctgtcccccagtagagagtttaaggaatataagtgcgacgtgctgatgcgggagaaagaagcattaaaagggaaaagctttcacatgtttatttattctctatggtttaagatccagcgagcgtgcatcaatgaaaagggttctgaccggtacagaaacgcctacgtttgggctcccggagccctgaaggttctggaatgtcactgggagaaatataataaccggtacaccgagtcgcgttccttttcctacatcgagtttcattgcggagtggacgggtacgtcgacaacatagaagacttgcgcatcatagaaccaataagcaattag

SEQ ID NO: 10493 - DNA, 1248 bp, Artificial Sequence
  Description of Artificial Sequence: Synthetic coding sequence
atgtcaccatttttgtatttagttttgctggtattaggcctccacgctactatccactgtgccagccctgaaggcaaagtcacagcttgccacagctcccagcctaacgccacgctctacaagatgagctctattaacgcagatttcgccttcaatctataccgccgattcacggtcgagactcccgacaaaaatatcttcttctcacctgtatcgatctctgccgcactagtgatgctgtccttcggcgcttgctgcagtacgcaaactgagatcgtggaaacccttgggttcaatctcaccgacacgcccatggttgaaatccagcacggctttcagcatctgatctgtagtctcaactttccaaaaaaggaattggaacttcaaatcgggaatgctctcttcatcgggaaacaccttaagcccctggccaaattcctgaacgacgttaagacactatatgaaacagaggtcttcagcaccgatttttcgaacatctctgctgcaaagcaggagatcaactcccatgtggaaatgcaaactaaaggtaaagtggtgggcctgatacaggatctgaaaccgaacactatcatggtgctcgtcaattatattcatttcaaggcccagtgggccaacccgttcgatcctagcaagaccgaggacagctccagttttctgatcgataaaaccactacagtgcaggtccccatgatgcaccagatggaacagtactatcacctggtggatatggagcttaattgtacggtcctgcaaatggactacagtaagaacgcgctggctcttttcgttctcccaaaagagggccagatggaatcagtagaggcggcaatgtcgtcaaaaaccctgaaaaagtggaatcgactcctgcagaaaggatgggtcgatctttttgtgcctaaattctctatctccgctacgtacgatcttggtgctactttgttgaaaatggggatccaacatgcctattccgaaaatgcagacttttctgggctgaccgaagacaatggcctcaaactctctaacgcggctcataaagccgtcctgcatattggcgaaaaaggcaccgaagctgcagccgtgccagaggtggaactctccgatcagcccgaaaacacgttcctgcatccgatcatccagatagataggtccttcatgctgctgatcttggaaaggagcacacgctccattctgtttttagggaaggtggtgaaccccaccgaggcttag

SEQ ID NO: 10494 - DNA, 285 bp, Artificial Sequence
  Description of Artificial Sequence: Synthetic coding sequence
atgaggactctggctatcctggctgcaatcctgcttgtggctcttcaggctcaagccgagcccctacaagctcgggctgatgaggtcgcagccgctcctgagcagattgcagcggatattcctgaggtggtggtttctctggcgtgggacgagtcactggcacccaagcaccccggaagtaggaaaaacatggattgctactgcaggatccctgcgtgcatcgccggtgaacgccgttacgggacttgtatttatcagggtcgcctgtgggccttctgctgctag

SEQ ID NO: 10495 - DNA, 1062 bp, Artificial Sequence
  Description of Artificial Sequence: Synthetic coding sequence
atgcgcctccccagaagagccgcattaggtctgcttcctctgctgttactgttgccaccagccccagaggccgctaagaaacccacaccttgccatagatgcaggggattggttgacaaatttaatcagggcatggtggataccgctaaaaagaatttcgggggaggaaacacagcctgggaggagaaaacccttagcaaatacgaaagcagcgagatcagactgctcgaaatcttggagggcttgtgtgaaagttccgatttcgagtgcaatcagatgctcgaggcacaggaggaacatctcgaggcctggtggcttcaactgaagagcgagtaccctgatcttttcgaatggttttgtgtgaagactctcaaggtttgttgttcaccagggacctacggccctgactgtcttgcctgccaaggcggatcacagaggccttgtagcggaaatggacactgtagtggcgatggctcacgtcaaggcgatggttcctgtcggtgtcacatggggtaccaggggcctctctgtacggactgtatggatggatatttctcaagtctacggaatgagacgcacagcatatgtaccgcttgtgacgagagctgtaagacctgctccggactcaccaacagggactgtggggagtgcgaggtgggatgggtgctggatgagggcgcttgtgttgatgtcgatgaatgcgccgcagagcctcctccctgcagcgcggctcagttctgtaaaaacgctaatggatcgtacacctgcgaagagtgtgacagttcatgtgtggggtgcacgggagagggtccaggcaattgtaaagagtgcatcagcggatatgcacgggagcacggccagtgcgctgacgtggatgaatgtagcctggccgagaagacttgtgtgaggaagaatgagaattgctacaataccccaggttcttacgtatgtgtttgccccgacggatttgaggagacggaagacgcatgcgttccacctgcagaggctgaggctaccgagggcgagtcaccgacgcaattaccctcaagggaggatctgtag

SEQ ID NO: 10496 - DNA, 651 bp, Artificial Sequence
  Description of Artificial Sequence: Synthetic coding sequence
atgaaattgaatttggtgcagatcttttttatgctgctgatgttactcctcggtctgggcatgggcctgggattaggcttgcatatggcgaccgcggtgctagaggaaagcgaccaacccctgaacgaattctggtcatcagacagtcaggacaaagctgaggcgaccgaagaaggggatggcactcagaccactgagactctcgtactgtccaataaagaagttgtgcagcctggctggccagaggatcctatccttggcgaagacgaagttgggggtaacaaaatgttgagagcaagcgctctcttccaatccaataaagactacctccgtctggaccaaacagacagggagtgtaacgatatgatggcccataagatgaaagaacctagtcagagctgcatcgcacagtatgccttcatccacgaggacctgaatactgtaaaggccgtgtgcaattcccctgtgatcgcctgtgaactcaagggcggtaaatgtcacaagtccagccgtcctttcgatctcacattgtgtgagctgtcacagcccgaccaggtcacgcccaattgcaactatctcacctccgttataaaaaaacacatcataattacgtgcaacgacatgaagagacagcttcccaccggccagtag

SEQ ID NO: 10497 - DNA, 222 bp, Artificial Sequence
  Description of Artificial Sequence: Synthetic coding sequence
atgagaatagctgtcttgttgttcgcgatcttttttttcatgtcacaggttttacctgcgaggggaaaatttaaggaaatctgcgaacggcctaacggatcctgtagggatttctgcctggaaactgagattcacgtcggaaggtgccttaattctcagccctgttgcctgccgcttggacatcagccaaggattgaaagtacgaccccaaagaaggattag

SEQ ID NO: 10498 - DNA, 609 bp, Artificial Sequence
  Description of Artificial Sequence: Synthetic coding sequence
atggagcggggtgcaggcgcaaaacttctgcccctcctcttgctgctgagggctaccggctttacttgtgcccaaactgatggtcgaaatggctacacggccgtcatcgaagtaacttctggcggaccttggggagattgggcttggccagagatgtgcccagacgggtttttcgcatcaggatttagtctcaaggtcgagccccctcagggcatacctggggatgacaccgctctgaatggtattaggcttcactgtgcaagaggtaacgtgctggggaacactcatgtcgtagaaagccaatcaggatcttggggggaatggtccgaacctctctggtgcagagggggtgcttacctagttgccttttctttgagggtggaagcaccaaccactctcggcgataacactgccgctaacaacgtgcgctttagatgctctgacggagaagaactccagggccctggactttcatggggggatttcggcgactggagcgatcactgccccaaaggcgcttgcggccttcagacgaaaatccagggtccgagaggcctgggcgatgatacggccctgaacgatgctcggcttttctgctgccggtcttag

SEQ ID NO: 10499 - DNA, 759 bp, Artificial Sequence
  Description of Artificial Sequence: Synthetic coding sequence
atgcagctgactcgttgctgcttcgtgttcctagtgcagggcagtctttacctagtgatttgtggacaggacgatggcccacctggttcagaggacccagagcgagatgatcacgagggccagccaagaccgagagttcccaggaagcggggacatatttcccccaagtctcgtcccatggcaaattcgacccttctgggtctcctggcccctcccggagaggcatggggcattcttggccaaccacctaatcgcccaaaccattcaccccctccctcagccaaagtcaaaaaaatcttcggatggggagacttctatagcaatattaagacagtcgccttgaatctgcttgtgaccgggaagatcgtggaccacggtaacggcacattctctgtgcactttcaacataacgcgacaggacaggggaacatatccatttctctcgtcccaccctctaaggcggtggagtttcaccaggagcaacagatcttcattgaagcaaaggctagcaaaatcttcaattgtagaatggaatgggagaaggtcgagaggggacggaggacctccctatgtacccacgaccccgcaaaaatctgctctagggatcacgcacagtccagtgccacttggagttgtagccaaccgtttaaagtcgtctgtgtgtatattgccttctattcaacagactacagattagtgcagaaagtgtgccctgattacaactatcacagcgacaccccatactacccctccggctag

SEQ ID NO: 10500 - DNA, 555 bp, Artificial Sequence
  Description of Artificial Sequence: Synthetic coding sequence
atgaagattctggttgcctttctggtggtgctgacaatttttggcatccagagtcacggatatgaagtatttaacataattagcccttctaataatggcggtaacgtccaggaaacggtgaccatcgataatgagaaaaatactgcgatcattaacatccatgccggatcttgctcctctacgaccatctttgattacaaacacggctatatcgcctctcgggtgctttcccgcagggcttgcttcattctgaagatggatcaccagaacattccgcctctcaacaatcttcaatggtacatttacgaaaagcaggctctggacaacatgttttcctctaaatatacttgggtgaagtacaatcctctcgagagcctcattaaagatgtcgactggtttctcctgggctctcccattgagaaactatgtaagcatatacctctgtataaaggagaagtcgttgagaacacccacaacgtaggcgcagggggatgcgcaaaggcgggactgctaggtatactcggtatatctatttgcgccgatattcacgtctag

SEQ ID NO: 10501 - DNA, 651 bp, Artificial Sequence
  Description of Artificial Sequence: Synthetic coding sequence
atgggcgcagtcatgggtacctttagctctctgcaaacaaaacagagaaggcctagtaaagataagattgaggacgagttggaaatgacaatggtgtgtcataggcctgagggtctggagcaactggaggctcagacgaactttactaagcgggaactccaggtgctctacagaggctttaaaaatgagtgtccttccggggtggttaacgaggacacatttaagcagatctatgcccagttctttcctcacggagacgccagtacgtatgcacactatctgtttaatgcttttgatactacccagactgggtccgtcaagttcgaggattttgttacagccttatctatcctcctgcgaggcacggtgcacgagaagctgagatggactttcaacctatatgatatcaacaaagatggatacatcaacaaagaagagatgatggatatcgttaaggcgatatatgacatgatgggcaaatacacttacccagtcctcaaggaggacactccaaggcaacatgtggatgtgttcttccagaaaatggataagaacaaagatggcattgtgacactagatgaatttctggaaagctgccaggaagacgataatatcatgaggagcctgcagctgtttcaaaacgtcatgtag

SEQ ID NO: 10502 - DNA, 2736 bp, Artificial Sequence
  Description of Artificial Sequence: Synthetic coding sequence
atggcgcagttgtttcttccactcctggctgcgctcgttctggctcaggcaccagcagccctggctgacgtactggagggcgactcttcagaggaccgggcattcagagtaagaatcgcaggggatgccccattgcagggggtcctgggcggtgcactcactattccatgtcacgtccactatctgcgccctcctccaagtaggagggccgtgttaggatcccccagagtgaagtggaccttcctgtcaagaggaagagaggccgaggtactggttgcgagaggagttagggttaaggtgaacgaggcatacaggttccgggtggccctgccagcataccctgcttccttgactgatgtgtcccttgccctgtctgaactgcgcccaaatgacagcggtatctaccggtgcgaagttcagcacggtatcgacgactcatctgatgccgtagaggtgaaggtcaagggtgtcgtatttctgtacagagagggcagcgccaggtatgccttcagtttctccggcgctcaggaagcctgcgccagaataggcgcacatatagctacacccgagcaactgtatgctgcttacctcggcggatacgagcaatgtgacgcgggttggctgagcgatcagactgtgcgatatcccattcagactcctcgggaagcttgctatggtgatatggatggattccccggtgtaaggaactacggcgtagtcgatcctgatgacctttacgatgtgtattgttatgcagaagatctcaatggggagctgtttcttggtgatcccccagagaagctgacgctggaggaggccagggcctattgtcaagaaaggggcgctgagatcgcaaccactggacagttgtatgccgcttgggacggcggactcgatcactgtagccctggctggctagccgatgggagcgtaaggtacccaatcgtaacgccttctcagaggtgtggcggtggactgccaggagtcaaaactctgttcttgttcccgaaccaaactggattccctaacaagcattcacgctttaacgtgtactgttttcgggacagcgctcagcccagcgctatccctgaggcctcaaacccagccagcaatccggcaagcgatggcctggaagccattgtgacagtcacggaaacattagaggaattacagctcccacaggaagcaaccgagtctgaatcaagaggtgccatatattcgattccaatcatggaggatggaggcggaggatcctcaactcctgaggatcctgctgaggcacctcgaacgcttctagagtttgagacgcagtccatggtgccccctacgggtttctctgaggaagaagggaaggctctggaggaggaagagaagtacgaagacgaggaggaaaaagaggaggaagaggaagaggaagaggttgaagacgaggcgctgtgggcatggccctccgagctcagcagccccggaccagaggcctctctgcccactgagcctgctgcacaagaagagtccctctctcaagctccagccagggcagtgttgcaacccggagcctcaccacttcctgacggagaatccgaagcctcccgcccacccagggttcatggccctcccaccgagacccttccaacccccagagagaggaatctggcgtcaccttctcctagcacgttggtcgaagcgagagaagtgggcgaagccactgggggacccgaattgtctggtgtgccgagaggtgaaagcgaggaaaccgggtcgtccgagggagccccatccttactccctgcgacccgagcacctgaaggcactcgcgagctagaagccccaagcgaggataactccggaaggacagcccctgctggaacctcggtgcaggcacagcccgtgctgcccacggactcggctagtagaggtggagtcgcagttgtccccgcttcaggtgattgcgtaccctccccttgccacaacggcggaacgtgcttagaggaagaggagggagtgaggtgtctctgcctgcctggatacgggggagacctgtgtgatgttgggctgcggttctgcaatcctggctgggatgcctttcaaggcgcttgttacaagcatttcagtacccgccgtagttgggaggaggctgagacgcagtgccgaatgtatggagcgcacttagcttcaatctctacacccgaggaacaggactttatcaacaacaggtatcgcgagtatcagtggatcggactgaacgataggacaatcgaaggcgactttctctggtcagacggcgtgcccctgctgtacgagaattggaaccccggacagcccgattcctacttcctatcaggggagaactgcgtcgtcatggtgtggcatgaccagggccagtggtcagacgtcccttgtaattaccacctgtcctatacttgcaaaatggggcttgtgtcctgtggacccccaccagaactgccactggctcaggtattcggacgtcctcgcctgcgttatgaggtggacactgtcctgcgttatagatgccgggaaggactggcccagcgaaatcttccgctcattagatgccaggaaaatggcagatgggaagctcctcaaattagttgcgttcccaggcggccagcgcgtgctcttcaccccgaggaggatcctgagggccgacagggcagactactgggacggtggaaggccctgctcattcctccctcctctcccatgccgggaccatag

SEQ ID NO: 10503 - DNA, 852 bp, Artificial Sequence
  Description of Artificial Sequence: Synthetic coding sequence
atgggccttggcctgcgcggttggggacggcctctgctcactgtggctaccgcactgatgctcccagttaaacctcccgctggcagctggggagctcagattatcggaggacatgaggtgacacctcattcacgcccttatatggctagcgtgcgcttcggcggtcagcatcactgtggagggttcttgcttcgagcacgttgggttgtctccgcagcccattgcttcagccatagagacctacgcacgggattggtggttctgggagcccacgttttgtccacagcagaaccaactcaacaggttttcggtatcgatgcgttgacaacacatcccgattaccaccctatgacccacgcgaacgatatctgcctcctgaggttaaatggcagcgcagtgctcggccctgcagtgggcctcctccggccacccggtaggcgggcaaggccgccaacagctggcaccagatgccgtgtcgcaggttggggctttgtgagtgactttgaagaacttcctcctgggcttatggaggcaaaagtgagagttctggacccagacgtttgtaactcatcctggaaaggacatttgactctgaccatgctatgcaccagatcaggcgattcccataggcgcggtttctgtagcgcagactccgggggtcccctagtgtgccggaatagagcccacgggctggtgagtttttcaggattgtggtgcggagaccccaaaacccctgacgtttacactcaggtcagcgccttcgtcgcgtggatatgggacgtcgtacgtagatcctcaccacagccaggtccgcttcctgggaccacacggcctccaggggaggctgcttag

SEQ ID NO: 10504 - DNA, 1209 bp, Artificial Sequence
  Description of Artificial Sequence: Synthetic coding sequence
atgatggtggccctgaggggcgcatctgccctcttggtcttgttcctcgccgcattcctcccaccccctcagtgcacccaggacccagctatggtccattacatataccagcgttttcgcgtgctcgaacagggcctcgagaagtgtactcaggccacccgtgcatacatacaagaattccaggagttttcaaaaaatattagcgtgatgctgggccgatgccagacctatacttccgagtacaaaagcgccgtggggaacctggcgctccgcgtggagcgcgctcagagggagatcgactacattcagtacttacgcgaggcagacgaatgcattgaaagcgaggataagactctggccgagatgctgctccaggaggccgaagaggaaaagaagattcggacactgttgaacgcgagctgcgataacatgttgatgggcatcaagagtctgaaaattgtcaagaagatgatggatacgcatggatcctggatgaaagacgccgtgtacaactcccccaaagtttacctgctcatcggtagcaggaataacaccgtttgggaattcgctaacatccgggcttttatggaagataataccaagccagctccccgtaagcagattcttaccctgagctggcagggtacagggcaggtgatctacaaggggttcttgtttttccacaatcaggcaacgagcaatgagattattaagtataatctccaaaagaggacggtagaagaccgaatgctgcttccaggcggtgttggtcgggcactggtgtatcagcatagcccttccacatatatcgatttggcagtcgatgaacatggactttgggctattcacagcggaccgggtacacatagtcacctggtgctcacaaagatcgagcctggaaccctcggggtagaacactcttgggatacgccctgccgttctcaggatgccgaggcgagtttcctgctctgtggtgttttgtatgtggtgtattctacagggggacaaggtccccatagaatcacctgtatctacgaccctctgggcacaataagcgaggaagatcttcctaacctctttttcccaaaacggcctcggtcacatagcatgattcattacaacccccgagacaagcagctgtatgcctggaacgaggggaaccagatcatctataagctccagaccaagagaaaactgccgttaaaatag

SEQ ID NO: 10505 - DNA, 1221 bp, Artificial Sequence
  Description of Artificial Sequence: Synthetic coding sequence
atgcagctctttctccttctgtgcctcgtcttactctccccccaaggcgcttctctccatcggcaccaccccagagaaatgaaaaagagggtggaggatctgcatgtgggcgctactgtagcgccttcctcgaggcgagattttacctttgacttatacagagcacttgcatctgcggcacccagccagagtatcttcttcagcccagtgtcaatctcaatgagtttggctatgctcagcctgggagccggttcaagtaccaagatgcagattctggaagggttgggccttaacctgcagaagagtagtgaaaaggaacttcatcggggtttccagcagctgttacaagagctcaaccagcccagggacggctttcagttgtccctggggaacgccctctttacggatttggttgtggatctccaggataccttcgtctcggccatgaaaactctctatctggcagatacattccctaccaacttccgggattctgctggagcaatgaagcagataaatgattatgtggccaagcagaccaaaggcaagatcgtagatctccttaagaatctggacagtaatgccgtagtgatcatggtgaactacattttctttaaagccaagtgggaaacgtcttttaaccataagggcactcaagagcaggatttttacgttacatctgaaaccgtcgtccgggtccctatgatgtctcgcgaagaccagtaccactatctgctcgacaggaacctgagctgcagagtcgtcggggtgccttaccaaggtaacgccaccgctctctttatcctgccaagtgaggggaagatgcaacaggttgaaaacggtctgagtgaaaagactcttcggaaatggcttaaaatgtttaagaagcgtcaactggagttatacctgccaaagtttagtattgagggttcttatcagctcgagaaagtactgcccagcctgggaatatccaacgtgttcacttcccatgcagacctgtcaggaatatccaatcacagcaacatccaggtctctgaaatggtccacaaggcagtagtggaagtggatgagagcggaacccgcgcagccgctgccacaggtacgattttcacgtttcgatccgcgaggctgaacagccagcgactcgtgtttaacaggcctttcctgatgtttattgtggataacaatattctgttcctggggaaagttaacaggccctag

SEQ ID NO: 10506 - DNA, 1626 bp, Artificial Sequence
  Description of Artificial Sequence: Synthetic coding sequence
atgcggctgtcgccgtttcatctgcagcttgaattccacatgaaggaaaagagggaggaccttcaaattagctggagcttcatcagcgttcctgagatggcagtcaacatccagcctaaagctctgggcgaggatcaggtggccgagactagcgctatgagtgacgtgctcaaggacattctgaagcatctggccggaagcgctagcccgtcagtggtgcttatcacgaagcccactacagtcaaggaagcccagaatctccaatgcgccgctagcacagctcaggaaagctgtccacctaaaccgcctcgagcacatgaactgaagctactcgtgcgcaatatacatgtgctgctgctcagcgagcctggggctagcggacatatcaatgccgtgtgcgtcgtacagttgaatgatcccgttcaaaggtttagctccacccttaccaagaacacgcccgacctgatgtgggaggaggaatttactttcgagttgaacgccaaaagtaaggaactgcatctgcagatttctgaagcaggacgatcatcagagggtttgctggccaccgcgacggtacccctggacctgttcaaaaaacagccatccgggcctcagtcctttaccctaacgtcaggcagtgcttgtggtagtagcgtactagggtctgtgactgccgagttctcatatatggaaccaggagagctgaaatcctggcccattcccccaccggttcctgccgcaaaaattgaaaaagacagaactgtcatgccctgtggcaccgtagttacaaccgtgactgcagtcaaaaccaaacctcgcgttgacgtgggaagggccagccccctgtcgtcagatagccctgtgaaaacccccatcaaagtgaaagtgattgaaaaggatatctccgtacaggcgatcgcatgccggtcggccccagtaagtaaaacgctcagcagctccgacaccgagctcttggtccttaacgggtccgatccagtggcagaggttgcaatccgtcagcttagcgagtcaagtaagctgaaattaaagtcacctcgcaaaaaatcaactattataatctcaggcatttccaagacttccctgtcccaggaccatgacgctgccctgatgcagggatatacagccagcgtagactctacacatcaagaagacgctcctagtcaccccgagagggccgctgcgagcgccccacctgaggaagctgaatcagcccaggcttcgctcgcccctaagccacaggaggacgaacttgacagctgggatttagaaaaggagcctcaggccgctgcttggtcttcccaagtgctgcttgatccagatggcgatgaactgtctgaatctagcatgtcggttctggaaccaggcacggctaagaagcataaaggcggaatcttgcggaaaggcgctaaactgttctttcgaagaagacatcaacagaaagacccgggtatgtcgcagagtcacaatgacctagtgtttctagagcagcctgaagggtcacgtcgaaagggaattactctcacccggatcctgaataagaagcttctatcccgacatcgtaataagaatactatgaacggcgctcctgtagaaccctgcacttag

SEQ ID NO: 10507 - DNA, 993 bp, Artificial Sequence
  Description of Artificial Sequence: Synthetic coding sequence
atggcttttctcccgagttgggtttgtgttttagtgggaagcttcagtgcctctttggcgggaactagcaacctgagcgaaactgaaccacccctttggaaagaatctcccggtcaactttctgactaccgagttgaaaatagcatgtatatcatcaatccttgggtctatctcgaaagaatgggaatgtacaagatcattttgaatcagacagcacgctatttcgcaaagtttgcaccagacaatgagcagaacatcttgtggggtctgccactgcagtatggatggcagtataggactgggagactagcggaccccacccggcgaaccaactgcggatatgaatccggggaccatatgtgcatatccgtagacagttggtgggccgacctcaattattttttgagttccttaccatttctggcggcagtggatagcggcgtgatggggatatccagtgaccaggtgcgcctactgccccctccaaagaatgagcgaaagttttgctacgacgtgtcgagctgcaggtcgtcctttcccgaaacaatgaataagtggaatacattctaccagtatcttcagtctcccttttccaagttcgacgatctactgaagtatctgtgggcggctcatacttcgactctcgctgataatataaagagcttcgaagatagatatgattattacagcaaggcagaagcacacttcgagcggtcttgggtgttggcagtcgatcacctggcagccgttctgtttcccaccaccttaattagaagctataagttccagaagggcatgccgccacgcatcttactgaacaccgatgtcgcacccttcatttccgatttcactgcctttcagaacgtcgtactggtgctgctgaatatgcttgataacgtggacaagtctataggatatctatgcactgagaagagtaatgtgtaccgagatcatagcgaatcttcatccagaagctatgggaacaactcctag

SEQ ID NO: 10508 - DNA, 813 bp, Artificial Sequence
  Description of Artificial Sequence: Synthetic coding sequence
atggatagcctggagtggaattgggccctcgtgtacgagctatcaggtgaacaccatgatgaggagtggagcgtgaaaacataccaggaggtggctcagaagttcgtagaaacccaccctgagttcattggtatcaagatcatctactcggaccatagatcaaaggacgtagctgttattgccgagtcaattagaatggctatgggcctccgtataaagttccccacagtggtcgccggttttgatcttgtaggccatgaagacaccggacattctctgcacgattataaggaagcattaatgattccagctaaggacggagtgaagctgccttacttcttccacgcaggggaaacagattggcagggcacaagtatcgatcggaacatcctcgacgctctgatgctgaataccaccagaattggtcatgggtttgcgctgagcaaacatcccgctgttcgcacctactcctggaaaaaggatatcccaatcgaagtgtgcccaatatccaaccaggtgttaaagctggtctcagaccttagaaaccacccagtggccactctgatggcaacagggcacccaatggtgatctcctctgatgacccagctatgttcggcgctaaaggccttagctacgacttctacgaggtgttcatgggcatcggaggaatgaaggcagacctccgcaccctcaagcagcttgccatgaactccatcaagtatagcacactgctcgagagcgaaaaaaatacatttatggagatatggaagaagaggtgggataaattcatcgctgatgtagctaccaaatag

SEQ ID NO: 10509 - DNA, 939 bp, Artificial Sequence
  Description of Artificial Sequence: Synthetic coding sequence
atgggtgtcatggcgatgctgatgctgccacttttattactgggaatctccggcctactttttatttatcaggaggtgtctcggctgtggtccaaatccgctgttcagaataaagtggtggttatcacagacgccatttcaggtttgggcaaagagtgtgccagggtgttccatacaggaggagccaggctggttttgtgtggaaagaattgggaacggctcgaaaatctgtacgacgcgcttatctccgttgctgacccatcaaaacagaccttcacacctaagttagttctgttggatttaagcgacatcagctgcgtgcctgatgtagccaaggaagtgctcgactgttatgggtgtgttgacatactgatcaataacgcttccgtgaaggtcaaagggccagctcacaagattagcctggagctggacaagaaaattatggatgccaactatttcggacctatcactctgacaaaggccttgttacctaacatgatctctaggagaaccggccagatcgtgttggtcaataatatccaaggcaagttcggcatcccatttaggaccacctacgcagccagtaaacatgcagctctgggctttttcgattgcctccgcgcagaggtggaggagtatgatgtagtgatctctacagtgtctccaaccttcattcgatcttaccacgtctatccagagcaggggaattgggaggcttcaatctggaagtttttctttagaaagctaacttacggagtgcaccccgtagaggttgccgaggaggtgatgagaacggtgcggcgtaagaaacaggaagtgttcatggcgaatccgatcccgaaagccgctgtttacgtgaggacatttttccctgagttcttttttgccgtggtggcttgtggagtcaaagaaaagctcaatgtgcctgaagagggctag

SEQ ID NO: 10510 - DNA, 738 bp, Artificial Sequence
  Description of Artificial Sequence: Synthetic coding sequence
atggcatcaacagcccttctcgccttgtgcagcactggagcttttagcgggctagcagtggaagctggagctggggtctgtcatgccacgcccatttatgccggtcatagctggcaccaggcaacattcaggctgaacgtcgccggaagtacactttcccgatacctgcgggatctcttggttgctgctaatcccgacttactgcaacaggctctgccaaggaaggctattacacatctcaagaaacggtcctgctatgtctccctagatttcgaaggagatctgagagaccccgcacggcaccatccagcttcattctcagtcgggaatggatgctgcgtatgcttaagctccgagaggtttcggtgccccgaaccgatcttccagccagggctgttgggtcaggccgaacagggcctgcctgccctcgcgttccgtgccctgcagaagatgcccaagaccctacgaacaagactggctgatactgtggtcctagctggaggttccaccctgtttcctggctttgctgaaagactcgataaagagctggaagcgcagtgcaggcgtcatggttacgccgctcttcgcccacaccttgttgccaaacacggaagagggatggcagtgtggaccggtggctccatggtggcgtccttacactcattccagcgtcggtggattactagagctatgtaccaagagtgcggcagcaggctattgtatgatgtgtttaattag

SEQ ID NO: 10511 - DNA, 909 bp, Artificial Sequence
  Description of Artificial Sequence: Synthetic coding sequence
atgcggagatgggcatgggccgcagtggtggtcctcctggggccacagctcgtcttgctgggaggagtgggagcacgcagagaggcccagaggacccagcagccaggtcagcgagccgaccctccaaatgccaccgcctctgcaagctctcgcgagggtctaccggaggcacccaaaccctctcaggcctccggccctgagtttagtgacgcgcacatgacatggctgaatttcgtgaggcgtcccgatgatggagcattgcgaaagagatgcggctcacgcgataagaagcctcgggatttattcggcccaccaggtccgcctggcgcagaagtcaccgccgagaccttgctccatgaatttcaagagctgctgaaagaagcaactgaaagacgctttagcgggctgttggaccctcttctccctcaaggggcaggcctccgcctagtgggcgaagccttccactgccgcttgcaggggcctagaagagttgataagcgcaccctggtcgagctgcacggatttcaggctcccgcagcacagggggcatttctgcggggatcaggactctctttggcatccggccgtttcaccgcccctgttagcggaattttccagttcagcgcctccctccatgtggatcactcggaactccagggcaaagctagactgcgggctagagacgtcgtgtgcgtcctaatctgcatcgagtctctgtgtcagcgccacacatgtttggaggctgtctccgggctcgagtccaactctagagtgtttactctccaagtccagggactgctgcaattgcaggcgggacaatatgcaagtgttttcgtagacaacggcagtggcgcagtgttaacaattcaagccggttctagttttagcgggctgctgctgggaacatag

SEQ ID NO: 10512 - DNA, 1416 bp, Artificial Sequence
  Description of Artificial Sequence: Synthetic coding sequence
atggattctgcccctctgttcccgaggccccatctgttccaaaacttattattgttcctgtgggccctgctgaactgcggcctcggcgtatccgcccagggccctggagagtggaccccttgggtgagctggacaagatgttcatctagttgtgggagaggcgtgagtgtgagatcacgtcgctgcttaagactgccgggagaagagccctgttggggcgattcacacgagtatcgcttgtgtcagctgcccgattgcccaccaggcgctgtcccatttagagacctccagtgtgccctctacaacggaagacccgtgctcggaactcagaaaacataccagtgggttccctttcatggcgctcccaatcagtgtgatctgaactgcctggcagagggacatgccttttaccattcttttggtcgggtgctggacggaaccgcatgctcaccgggtgcccaaggtgtgtgtgtcgcagggaggtgcctcagtgcagggtgcgacgggctcttagggagtggggctcttgaggatcgatgcggaaggtgcgggggagccaatgatagctgtttgtttgtccagcgggtgttcagagacgctggtgctttcgccggttattggaacgtgacactgatccctgagggcgcaagacatattcgggtggaacaccgttctcgaaatcacttggcactcatgggaggggatggcagatacgtgctgaacggccattgggtcgtctccccaccaggcacatacgaggctgctggcacccatgttgtgtatacacgggatactgggccacaggaaaccctccaggccgctggtcccacttcccacgacctcctgctgcaggtgctgctgcaggaacccaatccaggcatcgagttcgaattctggttgcccagagagagatattcaccttttcaggcaagggtgcaggccctgggctggccccttcgacagccccagcccagaggcgtggagccacagccgccagccgcacctgccgtgactccagcacagacacccacactagcccctgacccatgccctccctgcccggacacccgcggtcgcgcacaccggcttttacactattgcgggtccgactttgtctttcaggcacgcgtcctagggcatcatcatcaggctcaggagacacggtacgaagtccgcatacagctcgtttacaaaaaccgaagtccattgcgagctagagagtatgtgtgggctccaggccactgtccctgtcccatgctggctccccaccgtgattatctcatggcagtgcagaggctcgtgtctcctgacgggacacaggaccaattgctgctcccccatgccggatatgcccgtccttggtcccccgctgaagattcacgcatacgtcttacagccagacgctgccccggttag

SEQ ID NO: 10513 - DNA, 222 bp, Artificial Sequence
  Description of Artificial Sequence: Synthetic coding sequence
atggctccacagaccctgcttctcgtgctggtcctgtgcgtcctactgctccaggctcagggcggatatagggacaaaatgcggatgcagaggatcaaagtctgcgagaagaggccaagtatagatctatgtatccaccactgcagttacttccaaaaatgcgagactaacaaaatttgttgttctgctttctgtggcaatatctgtatgtcaattctatag

SEQ ID NO: 10514 - DNA, 2349 bp, Artificial Sequence
  Description of Artificial Sequence: Synthetic coding sequence
atggcgagagcccgtgccggagccctgctagccttatgggtgctaggcgctgccgctcaccctcagtgtctggactttcggcctcccttcagacccacccagcctcttcggctttgtgcacaatacagcgatttcggatgttgcgatgagggcagggacgccgagctgacccgcaggttttgggctctggcttctcgggtggatgccgctgagtgggccgcttgcgccggatacgcccgagatctcctctgtcaggaatgtagcccttacgcagcccatctttatgacgctgaggacccatttacgcctcttcgaacagtaccaggcctttgccaggattactgtctcgatatgtggcacaagtgcagaggcctgttccggcacttgagtactgatcaagaactgtgggccctcgaaggtaatctggccagattctgtaggtacttatctcttgatgacacagattactgcttcccttatctgctagtcaacaaaaatttgaactccaacctgggacatgtggtcgccgatgctaagggctgcctgcagctctgcctggaagaagtggctaacgggttgcgcaatccagttgccatggtccacgcacgcgatggaacacacagattctttgttgcggaacaggttggtctggtgtgggcttacctgcctgaccggtctcgcctgggaaaaccattccttaatatctccagagtagtgctgacctcaccgtgggagggcgatgagcgaggcttcctgggcatagccttccacccttccttccaacacaatcggagattatatgtgtactactcagtcgggattcgttcatccgaatggatccggatcagtgaatttcgagtctctgaggacgacgaaaacgccgttgaccattccagtgaacggatcatcctggaggtgaaggagcccgcatccaatcacaacggaggccagctgctcttcggagatgatggttacttgtatattttcacgggcgatgggggtatggccggtgatcctttcggtacatttgggaatgcccagaacaagagtgccttgctcgggaaagttctgcgaattgacgtggacaggaaggagcgaggattaccttacgggattccaccggacaatccatttgtgggggatccagccgcacagcctgaagtctatgccctgggcgtaaggaacatgtggcgctgctcattcgatcgtggggacccttcgtcggggactggacggggacggcttttctgtggagatgttgggcaaaacaaattcgaggaggttgacgttgtcgagcgaggcggtaactacggatggagggctagggagggatttgaatgttacgataggagtctatgtgctaacacaagcctcaacgatctcctgcccattttcgcctatccccacacggtaggaaagagcgttaccgggggttatgtctacagggggtgtgagtaccccaatctgaatggactgtacatctttggggatttcatgagcggaaggctcatgagtctgcaggaaaatcctggaaccggacaatggcagtactcggagatctgtatgggacacggacagacctgcgaatttccaggtctcattaataactactacccttatataatttctttcggtgaagacgaagctggcgaactctattttatgtccaccggcgaacccagtgcaaccgcacccaggggagtggtctacaaaattatcgatgctagcagacgcgcacctccagggaagtgtcaaattcagcccgctcaggtgaaaattcgatccagactaattccttttgtgccaaaagagaagtttattcctaagaccagatctacgcctcgacccactgccagggcccctactagggcgcctcggagaggtcgcccaacggctgctcccccagcccctacgcctcggccagcccgtcccacccagcagcccggttccaggcggggaggcggtagacgcaggggaagactgaattccgcctcacgcgcttttagggatggggaagtgagactggtgaggccagccggactctccagtggctctggcagagtcgaggtattcgtgggtgggcgatggggaaccgtgtgcgacgacagctggaatattagtggagctgccgttgtatgcagacaacttggcttcgcctatgcggtgagggctgtgaaacgggctgagttcggtcagggcggtagtctgcccatcttacttgacgacgtgcgatgtgccggatgggagagaaacttgctggagtgtcagcacaacggtgttggcacacacaactgtgaacatgatgaggatgcgggagtggtgtgctcacatcagaatccggacttgtag

SEQ ID NO: 10515 - DNA, 1317 bp, Artificial Sequence
  Description of Artificial Sequence: Synthetic coding sequence
atgcacccattacccggttattggtcttgctactgcctcctgttactgtttagcttgggcgtgcagggcagcctgggagccccaagtgccgcacccgagcaggtccacctttcttaccctggagagccaggttctatgacggttacatggacgacctgggtgccgacgcgatctgaagtgcagttcggtcttcaacctagcggtccactgccacttcgggcacaaggcacctttgttccttttgtggacggcggtattctacgtcgcaaactctacattcacagggtaacccttcggaaacttttgcctggagtacagtatgtgtaccggtgtggatcagcccaaggatggtctcgcagatttcggtttagggctctgaagaatggcgcacattggtcccctcgcctagctgtcttcggggacctgggagccgacaacccaaaagccgtgcctcgcttaaggcgagacacacagcagggtatgtacgatgccgtcttacatgttggcgattttgcctataacctcgaccaagacaacgccagagtcggtgaccggttcatgcgcttgattgagcccgtcgccgcaagtctcccctacatgacctgtccgggtaaccacgaagaacgttacaatttttccaactataaagccaggttttctatgcccggagataatgagggtttgtggtactcttgggatttaggacctgcccacatcatttcattttccacagaggtctatttcttcctacactacgggaggcatctggttcaaaggcagttcaggtggttggaatcagacctgcaaaaggccaataagaatagagcagccagaccatggattattactatggggcaccgtcccatgtattgcagtaatgctgatctggatgactgcactcggcacgagagcaaagtgcgaaaaggcctccagggaaagctatacggtctggaagatttattctataaatatggagtggatctgcagctttgggcccacgaacattcttatgagagactgtggcctatttacaattaccaggtttttaacggaagccgcgagatgccctataccaatccgagaggcccagttcatattattacggggagtgccggatgtgaagagcggctgactccatttgctgtcttcccacgcccatggagtgcagtgcgggttaaagaatatggctatactcggctccacatccttaacggaactcacatacacattcagcaggtatctgacgatcaggatggcaaaatcgtcgacgacgtctgggtggtgagacccctgtttgggaggcggatgtacctgtag

SEQ ID NO: 10516 - DNA, 411 bp, Artificial Sequence
  Description of Artificial Sequence: Synthetic coding sequence
atggctcgcacaaaacagacagcgagaaagtccaccgggggaaaggctcctcggaaacaactggcgaccaaggcagcacggaaatccgccccagctacaggaggcgtcaagaagcctcaccgctaccgccctgggaccgtggcgctgcgcgaaatcagacggtatcaaaaatcaacagaactcctgatacgaaaactcccattccaacggcttgtccgcgaaatcgcccaggattttaaaaccgacctgcgatttcagtcctccgccgtcatggctctacaagaggcatcagaggcttacctggtgggtctgttcgaggatacaaatctgtgtgcaattcacgccaagcgagtcactattatgccgaaagacattcagctggccagaaggatccgcggagagcgcgcatag

SEQ ID NO: 10517 - DNA, 1209 bp, Artificial Sequence
  Description of Artificial Sequence: Synthetic coding sequence
atggctgccagaccagggccactctggttactgggactgacgctgtgcgcgctcgggggtggtggcccagggctgcgccctcctccgggttgccctcagcggaggctcggcgcacgagagcgcagggacgtccagcgcgaaattttagctgtgctgggtctccccggacgcccaaggcccagagctcctccagccgcatctcgtctcccagcaagtgctcccctatttatgctggacttgtatcacgcaatggccggtgatgacgatgaagacggagcccctgcagaacaaagactgggtagagcagatctagtaatgtcatttgttaacatggtagaaagggacagggctctcggccatcaggagccgcattggaaggagttcaggttcgatttgacccagattccagccggtgaggccgtgactgcagccgagttccggatctataaggtcccatcaatccaccttctgaacaggactctgcacgtatccatgttccaggtggtccaggagcaatcaaatcgagagtctgatctgtttttcctggatttgcagacccttcgggctggagatgagggatggctcgttttggatgtcacagcggcatctgactgctggctgctaaagcggcataaggatctagggttgcggttgtatgtcgaaaccgaggatggtcatagcgtggaccctgggctcgcaggcctcttgggacagcgcgctcccagatctcaacagcccttcgtggtcactttctttcgtgcgtcaccaagcccaattcggacaccacgcgcagtgcgacctctccgcagaaggcagcccaagaaatctaacgagctgccacaagccaatcgtctgccaggtatttttgacgacgttcggggaagtcacggtcgccaggtctgtagacgccacgagctgtatgtgtcctttcaagatcttggctggttggactgggtgatcgcgcctcagggctattccgcgtactattgcgaaggggaatgcagttttccattagattcctgtatgaatgccacaaatcacgccattttgcagtccttggtccatcttatgaaacccaatgccgtccctaaggcctgttgcgctcccactaagctatcagccacgtccgttctctattacgactcatcaaataacgtgatactccgtaaacaccggaacatggtggtgaaagcttgtggctgtcattag

SEQ ID NO: 10518 - DNA, 957 bp, Artificial Sequence
  Description of Artificial Sequence: Synthetic coding sequence
atggccgctgctgctctccctccacgtccactcctgctgctccccctggtacttctgctttcaggacgccctacacgcgctgactcgaaggttttcggagatcttgaccaagtgaggatgacatcagaaggctcagattgccggtgcaaatgtattatgaggcccctgagtaaggacgcgtgttctcgcgtaaggagcggacgtgctcgggttgaggatttctacacggtcgagaccgtctcatctggcaccgattgccgatgcagttgcacagccccaccgagtagtttaaacccatgcgaaaatgaatggaagatggaaaagttgaagaaacaggccccagaactactcaagtccattaaggcaaatttaagcagggagaacgaggtcgtgaaagatagtgtcaggcacctcagcgagcaactgagacactacgagaaccacagcgcaattatgctgggtatcaagaaggaactctcacggttaggcctccagttgctgcagaaagatgccgctgccgcaccagccaccccagccactgggacgggatctaaggcccaggacactgccaggggtaaaggcaaagacatcagtaagtatggcagcgttcagaagagctttgccgaccgcggactgcctaagcctcctaaagagaaactactgcaggtggaaaagctgcggaaggaaagtggtaaaggctcattcctgcaaccgacagctaagccgcgagctctcgcacagcagcaggcggtcattcgcggattcacctattacaaagccggtaagcaggaagtcaccgaggcggtggctgacaatacactacaaggcacctcgtggctagagcaactgccccctaaggtggaagggaggtctaactccgcggagcctaactccgctgagcaggacgaggcagagccaagatcctcagaacgggtggacctcgcaagtggcacttag

SEQ ID NO: 10519 - DNA, 402 bp, Artificial Sequence
  Description of Artificial Sequence: Synthetic coding sequence
atggctctcggagtcccaatatcagtataccttctctttaacgctatgaccgctctcaccgaggaggccgctgtcaccgtaactccacccatcactgcacagcaggccgacaatattgaaggcccaatcgccttgaagttctcgcatctttgcctggaggaccacaattcttactgcatcaatggggcatgcgccttccaccatgagttggagaaggctatctgcaggtgttttacaggctacactggagaacggtgtgagcatttgacactgaccagctatgccgttgactcatacgaaaaatacatcgccattgggattggcgttggtctcctgctttcagggtttcttgtcatcttctactgttacatccgtaaacgttatgagaaggataagatatag

SEQ ID NO: 10520 - DNA, 651 bp, Artificial Sequence
  Description of Artificial Sequence: Synthetic coding sequence
atgagcagtgaggcagagacacagcagcccccagctgctcctcctgcagccccagcccttagcgcagccgataccaaaccaggaaccaccggcagtggcgcagggagtggaggtcccggagggctgacaagtgccgctcccgctgggggtgataagaaggtgatcgccacaaaggtgctgggaacggtgaaatggtttaacgtccggaacgggtatgggtttattaatcgaaacgatactaaggaagatgtgttcgtccaccagggcgcagaggctgctaacgtcacaggaccaggaggggtgcccgtgcagggcagcaaatatgcggctgaccgcaatcattaccggaggtacccacgaagacgtggaccaccgcgtaactaccaacagaactaccagaactcagaatccggagaaaagaacgaaggatctgaatccgctccagaagggcaggctcaacaacggagaccgtacaggaggcgtcgatttccgccatactatatgcggagaccttatggcagacgaccacagtattccaacccacccgttcagggtgaggtcatggagggggcagacaatcagggtgccggagagcagggacgacctgtacgccagaacatgtacaggggctaccgtcctagattccgatag

SEQ ID NO: 10521 - DNA, 756 bp, Artificial Sequence
  Description of Artificial Sequence: Synthetic coding sequence
aacgattggtctgcggaccagctttaccttgagactacagggaagagtcgcactctgcagtcggggctggccttactctatggcttcttacccgatttcgattggaagaaaatatatttcagacatcagccatccgccctgttctgcagcggaagttgttactgcccagtccggaaccagtaccttgaaaaggagcagaggcgccagtacctcctaaggctgaagaatagtcagctggagaagacgtacggcgagatggcgaagattgtcgatgttccaacaaagcagctgcgggctgcaaatcccatcgactcaatgctctgccacttctgtcataatgtgtccttcccgtgcactagaaacgggtgtgtagatatggaacactttaaagttataaagacacaccagatcgaagatgagagagaacggcgtgagaagaaactgtactttggttactccttattgggagcacacccgatcttgaatcagaccataggtcggatgcagcgagcaacagagggtaggaaagaggagttgttcgccctttattccgctcacgacgtcactctaagcccggtcttgagtgcactgggtctaagcgaagcacggtttccaagattcgcagcgagggtgaacattccatccgggtttttcacgatggccagcatgagtcactctaccccccttagcgccaaaacaaccacctctgtcctgccctccccctgcgcacggctgaagacatggtccgctctttag

SEQ ID NO: 10522 - DNA, 576 bp, Artificial Sequence
  Description of Artificial Sequence: Synthetic coding sequence
atggccgcaccacggggacgggctgcaccctggacaacagccctgctgttacttctagccagccaggtcttaagtccaggctcttgcgccgatgaggaggaagttccagaggaatgggtgctccttcatgtagtacagggccagataggcgcaggaaactatagttatcttaggctgaaccacgaaggaaaaatcgtgctgagaatgagaagtcttaaaggtgatgctgacctgtatgtttctgcaagctccttacacccctctttcgacgactacgagctgcagagcgctacgtgcggcccagatgctgtcagcatccctgctcattttcggagacctgtcggaatcggtgtttatgggcatccctctcacttggaatccgagtttgaaatgaaggtgtactacgacggcaccgtggagcaacaccccttcggagaggcggcttacccagccgatggtgccgacgctgggcagaaacatgctggcgctccagaggacgcatctcaggaagaagaaagcgtgctgtggaccatcctgataagcatcctcaagctggtactggaaattctattctag

SEQ ID NO: 10523 - DNA, 2301 bp, Artificial Sequence
  Description of Artificial Sequence: Synthetic coding sequence
atggggcgacgaagactcctggtgtggctgtgcgctgttgcagccttgctgtccggggcacaggcccgaggtacccccctgctggctaggccagccccacccggtgcatctaggtattccctgtataccactggatggcgcccaaggctcagacctggaccgcacaaagctctctgcgcctacgtggtgcaccgtaacgtcacatgtatactccaggagggggcagagagctatgtcaaagccgagtacagacagtgtcgttgggggccaaaatgcccaggcacagtgacttatcgtacagttctgcggccaaagtataaggtggggtacaagactgttacggacctcgcttggcgatgttgcccagggttcaccggcaagcgatgccctgagcacctgaccgatcacggcgctgccagcccccagcttgagcccgaaccgcagatcccaagcggacagttagatccaggtccaagaccgccttcctacagcagagccgctccgagtccccatggcagaaagggccctggattgtttggggagcgcctggagcgattggagggcgacgttcaaagacttgcccagacatacggtacactgtctgggctggtagcctctcacgaagatccgaaccgtatgactggcggacccagagcaccggcagtcccagtagggttcggtgtgatccccgaagggttagtgggacccggagatcgagcgagagggcctctaacaccgccactggacgagattctgtctaaagtgaccgaggtttccaacaccttacagacgaaggtgcagctgctggataaggtgcacggtctcgcactggggcacgaggcccacctgcaaagactgcgagaggcaccccctagcccgctaacgtctctggcccttcttgaggaatatgttgaccggaggttgcaccgactgtggggttcacttctggacgggttcgagcaaaaacttcagggtgtgcagtccgaatgcgatctcagagtacaggaggttcgcagacagtgtgaagaggggcaagctgcttccaggcgattgcatcaatcgctagatggacgcgagctagcactccgacaggaactgagccagttggggtcacagctccaaggactatctgtgtcaggtagaggcagttgctgcggccagctggccctgatcaacgcaagaatggacgggttagagagagccctacaggccgtgacggagactcagcgcggacccggagcccctgccggagacgagcttaccagactttccgcagcaatgttagaaggaggggttgacggactgctggagggcctggaaactctgaatggcacagagggcggagctcgcggttgttgcctgcgtctcgatatgggaggctggggggtggggggatttggaaccatgcttgaggaacgagtccagagcctggaagagaggctggcaaccctggctggagagctgtcgcacgatagcgcctcgcctggcagaagtgcgagaccactcgtgcaaacggaactcgcggttcttgagcaacgcttagtgagcttggagacctcatgtacacctagcacaacttccgcaatccttgattccttagtggccgaggttaaggcatggcagagccgcagcgaggccctgcttagacaggttgcttctcatgcggctctgctgcagcagctcaacggcaccgtcgcggaagtacaaggtcaactggctgagggtactggtagcagtctccagggggaaataaccctcctcaaagtcaatctgaatagtgtgtctaagagtcttaccgggttgtctgattctgtctctcaatactccgatgcattccttgccgctaatacaagtttggacgaacgggagagaaaggtggaggcagaggttcaggccatccaggaacaggttagctcacaggggagccgcttgcaggccggtcatcgccaggtgctaaacctccggggtgaactagagcagctgaaggcaggcgtggccaaggtagcctctggattgagtaggtgtcaagacaccgcacagaagctccagcatacagtcggccactttgatcagcgagtagctcaagtggagggcgcttgtcgaaggctggggctcctggccgcaggactggacagcctgccaactgagcctctgagaccacgggaagggttgtggagccatgtcgaccaacttaatagaacccttgctcagcatacccaagacatcgcacgcctcagggacgatttgttagactgccaggcacaactcgctgagcaggtgcggccaggccaggctaactag

SEQ ID NO: 10524 - DNA, 1251 bp, Artificial Sequence
  Description of Artificial Sequence: Synthetic coding sequence
atgtaccggcatggcataagtagtcaaaggagttggcctctttggacaaccatttttatcttcctgggagtagccgctatactcggagtcacaattggccttcttgtgcacttcctcgcggtcgagaagacctattactatcagggtgactttcacattagtggcgtcacctacaatgacaactgcgagaacgccgcatcacaggcttctaccaacctgtccaaagatatcgagaccaaaatgcttaacgctttccagaattcttcgatttataaggagtacgtaaagtccgaggtcatcaagctgctcccaaatgccaatggatcaaacgttcagttgcagctgaaattcaagtttcctccagctgaaggcgtttcgatgcggaccaagatcaaggcaaaactgcatcagatgcttaaaaacaacatggctagttggaacgcagtgcccgcaagcatcaagctgatggaaataagtaaagcagctagtgaaatgctaaccaacaattgttgcggtagacaagtcgcaaattccattatcacgggcaataaaatcgtgaacgggaaatcctctctggagggagcctggccatggcaggctagcatgcagtggaagggcagacactactgcggggctagtttgattagtagtcgctggttgctcagcgccgcacactgttttgctaagaaaaacaactccaaagactggacagtaaacttcggaatcgttgtaaataagccatatatgaccagaaaggtccagaacattatttttcacgaaaactactcttcccctggactgcatgacgatatagccctggtacagctggcagaggaggtgagctttaccgaatacataaggaaaatctgtctgccagaagcgaagatgaagctgtcagagaatgataacgtggtggtgaccggatggggtactctttacatgaacgggtcttttcctgtcatactccaggaagattttcttaaaattatcgataacaagatttgtaatgcttcatacgcgtactcaggctttgtaacagacactatgctttgtgctggcttcatgtccggagaagctgacgcttgtcaaaatgattccggcggtccattggcctacccagatagtcgaaatatctggcatctggtaggaattgtgagctggggggacggttgcggtaaaaaaaacaagccgggagtctatacccgcgttaccagctatagaaactggatcacttcaaagacagggctgtag

SEQ ID NO: 10525 - DNA, 639 bp, Artificial Sequence
  Description of Artificial Sequence: Synthetic coding sequence
atgctaagctcagtggttttttggggccttattgcactcatcggcacctctcgcggaagctatccgttttctcattccatgaagccccacctgcatcccagactttaccacggctgttatggtgacatcatgacaatgaagacctccggagccacatgcgatgccaactctgtgatgaattgcggaatacgcggatctgaaatgttcgccgagatggacctgcgagccattaaaccttaccaaactctgataaaagaagtgggtcagagacactgcgtggatcccgctgtgatcgccgcaatcatcagccgagaatcacatggcggatccgtgctccaagacggatgggaccatcggggtctgaagtttggactcatgcaactcgacaagcagacatatcacccggttggcgcatgggattctaaggagcatctatcccaggccacgggcatcctcacagaaagaataaaagccatacagaaaaagttccccacatggagtgtggcacagcaccttaaagggggtctatcggccttcaaaagcggaattgaggcgatagcgaccccctctgatattgacaacgattttgttaacgacatcatcgcacgagccaagttctacaagagacagtctttttag

SEQ ID NO: 10526 - DNA, 378 bp, Artificial Sequence
  Description of Artificial Sequence: Synthetic coding sequence
atggcccgaagtgccaccctggccgctgctgcgctggcactgtgcctgctgcttgcccctcccggactcgcctggtataaaccagctgctgggcattcatcctactcagtcggcagagcggcaggactgctctccggactgcggaggagtccgtacgccagaaggtcccagccctatcgcggagccgaacctccgggtggtgccggagcgtcgcctgagctgcaactacatccaagattacggtctctcgccgtgtgcgtgcaggacgtcgccccaaatctccagaggtgcgaacggctgccggacggccgaggcacctatcagtgcaaggccaacgtctttctgtctctccgggcagctgactgtctggctgcatag

SEQ ID NO: 10527 - DNA, 867 bp, Artificial Sequence
  Description of Artificial Sequence: Synthetic coding sequence
atgaataatctgtcattcagcgagctatgttgcctgttttgttgtcctccatgccctggcaagatcgccagcaaactcgcattccttccacctgaccctacctacactttgatgtgtgacgagagcgggagccgttggaccctgcatctaagcgagagggccgattggcaatactcctctcgggagaaggatgccattgaatgttttatgaccagaaccagtaaaggcaataggatagcttgcatgtttgtgcgatgttcaccaaacgccaaatacacattgctctttagtcatgggaatgccgtcgaccttggacagatgtctagcttttacattggtctgggatctcggattaattgtaacatctttagctatgattattctgggtacggggctagctctggcaagcctaccgagaaaaatctgtacgccgacatcgaggctgcttggcttgctcttagaactcgatacggaatacggccagagaatgtcattatatatggccagtccatcggtaccgtcccttcagtggatctcgccgctagatacgaatccgccgctgtaatcttgcattccccactgacctcaggaatgagagtggccttccctgacacaaaaaaaacttactgttttgatgccttccccaatatcgataaaatttccaaaatcacatccccagtgcttatcatacatggtaccgaagatgaggtgatcgacttctcacacggactcgccctattcgaaagatgtcagagacctgttgaacctctatgggtcgaaggagccggtcataatgatgtggagttgtacggtcagtatttggagaggctgaaacagtttgtgtcacaggagctggtgaatctctag

SEQ ID NO: 10528 - DNA, 417 bp, Artificial Sequence
  Description of Artificial Sequence: Synthetic coding sequence
atggtggctccagcagccagggttttcttgagggctgtaagggcagcattaacgtccacggtacccgacctgctctgtctccttgcgcgaggtagtccccgaggtttagcaagtggcaggttgcccctggcagtccattcagctcagcacggcccagggagcggtgccccttggctccgcatcgctagaagggctttacgattcgtactgtcaaagcactggggagacgattgttatctgactaacaggctctggcaggatcttaagcccccaagtcatgtggagaacggtcaagagctacgcttggcgccacctgttcagtgggccttgcaggtgcagggtaaccagctacagactgcagttctgtgtctaaggatggccccacccgagccagcaggctctcgacagcggatctag

SEQ ID NO: 10529 - DNA, 1332 bp, Artificial Sequence
  Description of Artificial Sequence: Synthetic coding sequence
atgggcggaccaagagcatgggccctcctctgccttggattactcctgcccggaggaggggctgcatggtccatcggggctgctccattcagtgggagacggaactggtgcagttacgtggtcacgagaaccatttcgtgccatgtgcaaaatgggacgtacctccaacgggtgctacagaactgcccctggccaatgagctgccccggttctagctatcgaacggttgtcagacctacctataaagtcatgtataagatcgtgacagccagggaatggcgctgctgcccaggccactctggcgtatcatgtgaggaggtcgctgcatcatcggcttccttagaacctatgtggtcgggatcaactatgagacgtatggcgctgcggccaaccgcattctccggatgtttgaactgcagcaaggtgagtgaactcactgaacggctcaaagtgctcgaagcaaaaatgacaatgctcactgtaattgaacagccggtccctccgacacctgccactccagaagaccctgcaccgctgtggggccctccccctgcccagggatctcctggcgacggcggtctccaggaccaggtgggcgcttgggggctgcctggccctacaggtcctaagggggacgcaggctcaagaggccctatgggtatgcgcggacctcccggtcctcaggggccaccaggctctcctggccgtgcaggcgctgtgggaacccccggagagagagggcctccgggtccaccaggccctcctggtccgcctggcccacctgcacctgtgggtccgccacatgctaggatcagccagcacggggatccactcctctccaacacctttactgaaaccaacaaccattggcctcagggcccaaccggacctcctggaccccctggacctatgggtccacctggccctccaggtccaaccggggtgcccggatccccaggccacatcggcccacctgggcctacagggcctaagggaataagtgggcatcccggtgaaaagggcgaaagagggctgcgtggggagcccggtccccaggggagcgcgggacagagaggcgaaccgggacctaagggcgaccctggcgaaaagagccactggggcgagggccttcaccagctcagggaagcacttaagattctggctgagcgcgtgttaatactcgaaactatgattggcctctatgaaccggaattaggatcaggtgccggtcctgctggtaccggcacaccttcattgctgcgtggaaaacgagggggacatgccacaaactataggatcgtcgcccctaggtcacgagacgaacgcggatag

SEQ ID NO: 10530 - DNA, 717 bp, Artificial Sequence
  Description of Artificial Sequence: Synthetic coding sequence
atggtcctgctgctgctggtcgccatacctttgttagtgcattcttcccggggacccgctcactacgagatgttgggccgatgtcgtatggtgtgtgatccccacggcccacgcggacccggtccggacggtgcgccagcatctgtcccccctttccctccgggagcaaagggagaggtcggaaggcggggaaaggccggactaaggggcccaccaggacccccaggcccaaggggcccacccggagaaccgggacggccagggcctccaggacctccaggacccggtcccggaggggttgcccctgccgctggttacgtgccaagaattgctttttacgcgggactccggaggccgcatgaggggtacgaggtgctgagatttgacgatgtggtcaccaatgttggcaacgcctatgaagccgcatccggaaaattcacatgccctatgcctggtgtgtattttttcgcttatcacgtactgatgagaggtggtgatgggacctccatgtgggctgacctgatgaaaaatggtcaagtacgtgcaagcgcaatcgcgcaagatgcggaccaaaattacgattacgcttccaactccgtcatcctgcacctcgatgtaggagatgaggtctttataaaactggacggagggaaagtccacggcggaaatacgaacaagtactctacattcagcgggtttattatctatccagactag

SEQ ID NO: 10531 - DNA, 282 bp, Artificial Sequence
  Description of Artificial Sequence: Synthetic coding sequence
atgaagttattcctggtgctgattatccttctgttcgaagttctcaccgacggcgcaaggctcaagaaatgtttcaataaggtgacgggttattgcagaaagaagtgtaaggtgggtgaacgctacgagataggttgtctctccggaaaactgtgttgtgcgaatgacgaagaggaaaaaaaacatgtgtcatttaaaaaaccccatcagcattcaggagagaagttgagtgtattgcaggattatatcatcctgccgaccattactatctttaccgtgtag

SEQ ID NO: 10532 - DNA, 609 bp, Artificial Sequence
  Description of Artificial Sequence: Synthetic coding sequence
atggtccgcatctggaccaccattatgattgtgttgatcctgctgcttagaatcggacctaataagcccagtctcagtgggcgtcaagccccagcccaggcccagacttcagacctggtcccttccctgtttcctcttggtttatgggcccctggtttttgcacctggtcatctcccgacgaggataaagtctggcgtccagcatgggagcaggggcctaaaggagagcctgatcctagaggtttaaggccaaggaagccggtgcccggaacaggaaaccgggactctggcactcggaggcgcctccaagatgccactgagcaggaccctcgccctggcaatgatgtcgcttcagcggaaacggctggtcctccgtccccttccggaatccgcgcacaggaccgggcaccaaggcaccgaagagccccacccgcacgcatgcccgtggctcccgcaccctccgccgacggcgaacccctgcaggaacagggaggcggtctctttcatagaacccggagcgtgtacaacggtttggagttgaacacgtggatgaaggtcgagagactgttcgtagagaaatttcatcagagcttttctcttgataactag

SEQ ID NO: 10533 - DNA, 342 bp, Artificial Sequence
  Description of Artificial Sequence: Synthetic coding sequence
atgctgccctgcttggccttgttactactgatggagctctccgtctgtacagtggctggcgacgggggagaggagcagacgctgtctaccgaggccgaaacttgggtgatcgtagctctggaggagggcgcaggccctagcatccaacttcaattgcaggaggtgaagacgggcaaggcatcgcagttcttcggactcatgggtaaacgtgtgggcggaagacctttgatacagcccaggcgcaaaaaggcctatcaactggagcacacatttcagggattgctcggcaagcgctccctctttacagagggtcgagaggacgaggcccaggggtcagagtag

SEQ ID NO: 10534 - DNA, 1269 bp, Artificial Sequence
  Description of Artificial Sequence: Synthetic coding sequence
atgggcccagcttggttatggttgttaggcacaggtattctagcgtcagtgcattgccaacccctgctcgcccacggggataagagtctgcagggccctcaacctccacgccaccagctttctgagcccgcacccgcttaccatcgcattacacccacaattactaactttgcccttagactgtacaaggagctggcagctgatgccccaggcaacatttttttcagtcctgtttccatctcaacaactctagcgctgttgtcattaggagctcaggccaacacctcagcactgattctggagggcctggggttcaacctgactgagacccctgaggcagacatacatcagggtttcagatcgctgctgcacactctggcccttccttctcccaaactggaactgaaggttggcaatagcctgttcctggacaaaagactgaagcctcggcagcattatctggactccatcaaggaactgtacggagcctttgcattttcagccaacttcaccgatagcgtgaccaccggtagacaaataaacgactacctgcggcgacagacttacggccaggtcgttgattgtctccctgagtttagtcaggataccttcatggtgctcgcaaattatatcttctttaaggcaaagtggaagcacccattctctcggtaccagacccagaagcaggaaagcttcttcgtcgatgaacggacatccttgcaggtgcctatgatgcatcagaaggaaatgcaccggtttctttacgatcaggacctagcatgtaccgtgctgcagatcgaataccggggtaacgcactggcactcctcgtgcttccggaccctgggaagatgaagcaagtcgaggccgcacttcagccgcagacgctccggaagtggggtcagttgttgctcccttccctcctcgacctgcacctgccacggttttccatctcgggaacttataatttggaggatattctgcctcaaattgggttgacaaacatcctcaaccttgaggcagacttttccggcgtgacaggccagttaaacaaaactatatctaaggtcagtcataaagcaatggttgacatgagcgagaaaggaaccgaggctggggctgcgtccgggctgctgagtcagccaccatccctcaatacgatgagcgatccacatgcccatttcaaccgcccatttctgttgttgctgtgggaagtgacaacacagtcactcttgtttttggggaaggtcgtgaaccccgtggccggatag

SEQ ID NO: 10535 - DNA, 237 bp, Artificial Sequence
  Description of Artificial Sequence: Synthetic coding sequence
atggccctgattagaaagacgttttactttctgtttgccatgttctttatcctcgtgcagttacccagtggttgtcaggctggtttggatttttcacaaccctttccgtctggagaattcgcagtatgtgaatcatgtaagcttggcaggggcaagtgtagaaaagaatgccttgaaaacgagaagcctgatggaaactgccggctcaatttcctgtgttgcagacagcggatctag

SEQ ID NO: 10536 - DNA, 2139 bp, Artificial Sequence
  Description of Artificial Sequence: Synthetic coding sequence
atggcagccgctgggcttgtggctgtcgcagcagcagccgagtactccggaactgtcgcatcgggtggtaacttacctggggtccactgcggcccttccagtggtgctggtccgggttttggccctgggtcatggagcagaagtctggatcgcgcattggaggaggcagccgtgaccggtgtgctgtcactgagcggtagaaaactgcgggaattccctcggggagcagcgaatcatgatctgaccgacactacccgggcagatttgagccggaaccgcctgtccgagattcctatcgaggcgtgtcacttcgtcagcctggaaaacctgaacctgtatcagaattgcatccggtatatcccagaggccatactgaacctgcaggccctgacatttttaaacatttccaggaaccagctctcaacactccctgttcacctctgcaatctccccttgaaggtactgatcgcttccaacaacaagctggtgtctctgcccgaagagatcgggcacctgaggcatctcatggagctggatgtgtcatgcaatgagattcagaccatccccagccagataggtaatcttgaagcattgcgggatctcaatgtgagacgcaaccatctcgttcacctgccagaggagttggctgaattgccactgattaggttagactttagctgcaacaagattacgacaattcccgtctgctatagaaatctacggcaccttcaaaccataactcttgacaacaacccactacagtcacctcctgcccagatctgcattaagggaaaggttcatatctttaagtatctgaacatccaggcctgtaaaatcgcccctgacctcccggattatgatcgacgacctttggggtttggaagttgccacgaggagctttactcatcacgaccctacggagctttagactcagggttcaattctgtggattctggggacaagagatggagtgggaatgagccgacagatgagttttcggaccttcccctgcgggtggcagaaataacaaaagagcagagactgcgtagggagtcacaatatcaggaaaatcgcggatccctggtagtgaccaacgggggagtagagcatgatctcgaccagatagactacattgatagctgcacagccgaagaagaagaggctgaagtccgtcagccgaaggggccagatcccgatagcctaagttcccagtttatggcctacatcgaacagcggcgaatttcacatgaagggtcccctgtcaaacctgtagccatccgggagttccagaaaacggaggatatgcgacggtaccttcaccagaaccgggtgcctgctgaacccagttctctgctgagtttgagtgcatcgcacaaccagctgagccacaccgatctcgaactgcatcaaaggcgcgaacaactggttgaacggacccggagagaggcacagctcgcggcactgcagtatgaggaggagaagatcaggaccaaacaaattcagcgtgacgcggtgctggactttgtcaaacaaaaagccagccagtcaccccaaaaacagcaccccctgctggatggcgttgatggggaatgcccattcccctctcgtagaagtcagcacaccgacgactctgccctgtgcatgagcctgtccggtctgaatcaggtggggtgtgcagcaaccttgccccactcttccgcatttacccccctgaaatccgatgatcggcctaacgccctgctaagtagtccagctaccgaaacagtgcaccattcaccagcatattcctttcctgccgctattcagcgcaatcaaccccagcgccctgagtctttcttattcagagccggagtgagagccgagactaacaagggacatgcctctcctctgccacctagcgctgcacctactacagattccaccgactcgatcacaggccagaattcacgccagagggaagaagagttggaattgatcgaccaactgagaaagcacattgagtatcgattgaaggtcagcctaccctgtgacctgggtgccgctttaacggacggcgtcgttctttgtcatctggcaaaccacgttcggccacgcagtgtgccaagtattcatgttccatctcctgctgtagtgtcttag

SEQ ID NO: 10537 - DNA, 213 bp, Artificial Sequence
  Description of Artificial Sequence: Synthetic coding sequence
atgagagtcttgttttttgtcttcggggtcttgtctttaatgttcaccgtgcccccagccagatctttcatttccaatgacgaatgtccatccgagtattaccactgcagacttaaatgtaatgctgacgaacatgctatacggtactgtgccgatttttccatatgttgcaagctgaaaattatcgagatcgatggccagaagaagtggtag

SEQ ID NO: 10538 - DNA, 789 bp, Artificial Sequence
  Description of Artificial Sequence: Synthetic coding sequence
atggcagccgcatccgctggagccactaggcttctgttactgcttctgatggccgtcgctgccccatccagagccagaggaagcggttgcagagcaggtacgggtgccagaggggctggcgcagagggcagagagggcgaggcttgcggaaccgtgggtctgcttctcgagcactcattcgagattgatgacagtgcgaacttcagaaagcggggatcgttgttgtggaatcagcaggacgggactctcagcctgagccagcggcaattgtctgaagaagaacgaggccgactgcgtgatgtggcagcactgaacgggctatatagagtgcgaatccccagaagaccaggagcccttgacggactcgaggctgggggttacgtgtccagcttcgttcctgcctgttcactagtggaatcacacctgtcagatcagttgacactgcacgtcgatgtggctggcaacgtcgttggagtgagcgtcgtcacccatcccggtggctgcagaggacatgaggttgaagacgttgacctggaactctttaatacctcggtccaattgcagccaccaacgacagcccctggcccagagacagcagcatttattgagagactggagatggaacaggctcagaaggcaaagaatccacaggagcagaaatcattctttgccaagtactggatgtatataatccccgtagtgctgtttttaatgatgagcggagcaccagacactggagggcaaggcggagggggaggcggaggtggcggtggtgggtccggcagatag

SEQ ID NO: 10539 - DNA, 150 bp, Artificial Sequence
  Description of Artificial Sequence: Synthetic coding sequence
atggattcaagtcgggagcccacactgggccgtctggacgcagcaggattttggcaggtctggcagagattcgacgcagatggccacggccacgagtccaagtttgcccagggcgagacagctgtgtacgactacccgcgttgtctgtag

SEQ ID NO: 10540 - DNA, 213 bp, Artificial Sequence
  Description of Artificial Sequence: Synthetic coding sequence
atgcccggagcgatgaagatctttgttttcattctggctgctttgattttgttagcccagattttccaggcacgaaccgctatccatcgcgctctcattagtaagcgcatggagggccactgcgaagctgagtgccttacgttcgaagtgaaaataggaggatgtagggcagagctcgcgccattttgctgcaagaatagaaaaaagcattag

SEQ ID NO: 10541 - DNA, 711 bp, Artificial Sequence
  Description of Artificial Sequence: Synthetic coding sequence
atgatgcccgcagagcggagactgcccctgagcttcgtgctggatgttttagaaggccgagctcagcacccgggtgtcctgtacgtgcagaaacagtgcagcaaccttcccagcgagctcccacaattacttcccgacctggaaagtcacgtgccttgggccagtgaggcacttggtaaaatgcccgatgctgtcaacttctggctgggggaggcagctgccgtgacctccctgcataaggatcactatgagaatttatactgcgtggtgtcaggggagaaacacttcctcttccatcctccttccgatcgcccatttatcccatatggtttgcgcgtccccggttgtcttcagtttccccatacgctgttgccatgggcccctgagctctacacacctgcaacgtaccagctcactgaggagggcacattcaaagtcgtggatgaagaagcaatggaaaaggtgccttggataccattagaccctttggctcctgatcttgcgaggtatccctcctactcccaggcacaggccctcaggtgtacggttcgagccggagaaatgctatacttgcccgctttgtggttccatcacgtccagcaatctcagggttgtatcgccgttaacttttggtatgatatggagtacgacttgaaatattcttattttcaattactcgactccctgacaaaggcctcaggcttagactag

SEQ ID NO: 10542 - DNA, 1098 bp, Artificial Sequence
  Description of Artificial Sequence: Synthetic coding sequence
atggctcccaagcttataacagtgctgtgtttggggttttgtctgaaccagaagatatgccctcacgccggtgctcaagacaagttttcgctctctgcgtggccaagtcctgtggtgcctctggggggaagggtgacgctctcatgccacagtcacctgagatttgtaatttggacaatttttcagacgacaggaactagatcgcacgagctgcataccggcctgagtaataacattacgatctccccagtcactccggagcatgcaggtacataccggtgtgtcggtatctacaagcatgccagcaagtggtccgccgaaagtaattctctgaagattatcgtgacaggacttttcacgaaaccatctataagcgcccatcccagctctctggtacacgccggtgcacgtgtgagcctgcggtgtcattcagaactcgctttcgatgagtttatcctgtataaagaaggacatatccagcattcacaacagttggaccagggaatggaggccggtattcactacgtcgaggctgtgttcagcatgggtcccgtcaccccggcacacgccggtgcatatcggtgttgcggttgcttttctcacagccgctacgagtggtccgctccctctgaccctctagatatcgtcattaccggaaaatataagaagccgtccctgtcgactcaagttgatcctatgatgcgtctgggcgagaagctaaccctcttttgcagttccgagatatcctttgaccaatatcatctttttcgccatggcgtcgcccatggacagtggttatctggcggacagagacatagggaggcatttcaggcaaactttagcgtggggcgtgctacgccggtgcctggaggcacttaccgctgctacggatcattcaatgattctccgtataagccacctgtgactaggtgtaacttcacccctcaggaaacccttcgcgtgctgctgtgccattcgcagaacccacctcttaatctcactccaccttggcagacccagagccccaggaaggccaacggacgaatgaagagatcccttcagcaaaagagacacagacgttcttacatgcctagttag

SEQ ID NO: 10543 - DNA, 198 bp, Artificial Sequence
  Description of Artificial Sequence: Synthetic coding sequence
atgagaaccttcctcttcctctttgctgtgctcttcttccttacccccgcaaaaaacgctttcttcgatgagaaatgcaataagctcaagggaacctgcaaaaacaattgcggtaaaaatgaggaactcatcgccctgtgtcagaaaagtctgaagtgttgtcggaccatccaaccctgtggctccatcatcgattag

SEQ ID NO: 10544 - DNA, 198 bp, Artificial Sequence
  Description of Artificial Sequence: Synthetic coding sequence
atgagaacgttcttatttctgtttgccgtgttgttttttctgactcccgcaaaaaacgccttttttgacgaaaagtgtaacaaattgaaagggacctgcaagaataactgcggtaagaacgaggaactgattgcgctctgccagaagagcctcaaatgctgccgtactatccaaccctgcggatccataatagactag

SEQ ID NO: 10545 - DNA, 237 bp, Artificial Sequence
  Description of Artificial Sequence: Synthetic coding sequence
atggcgctcattaggaaaacgttctacttcctgtttgccatgttttttatcttggtccagctgccatccgggtgccaggcaggtctggatttttcgcagccctttccgtctggcgaattcgctgtctgtgagagttgtaagcttggccgtggtaagtgtcgaaaggaatgcctcgagaatgagaaaccagatgggaactgcaggcttaacttcctctgctgtaggcaaaggatctag

SEQ ID NO: 10546 - DNA, 2868 bp, Artificial Sequence
  Description of Artificial Sequence: Synthetic coding sequence
atgtgggctgggctgctgcttagagctgcatgtgtcgccctgcttcttccaggagcccctgcaagggggtacaccggcagaaaacctcccggacatttcgccgctgaaagacggaggctcggccctcatgtgtgcctatctggtttcggaagtggttgttgtccgggttgggctccatcaatgggaggcggacactgcactctcccactttgttctttcggatgtgggagcggaatttgcatagctccaaatgtatgttcctgtcaggatggggagcagggtgccacttgcccggaaacccacggcccttgcggtgagtatggttgtgacctgacttgcaaccatgggggatgccaggaagtggctagagtttgcccagtcggtttttccatgaccgagacagccgtagggattagatgcaccgacatcgacgaatgtgtaacgtctagttgtgagggacactgtgtgaacactgaaggagggtttgtctgcgaatgtggccctggaatgcagctctccgctgaccggcattcttgccaggacaccgacgagtgcctgggtacaccttgtcagcaacgatgcaaaaactctattggaagctataagtgctcatgtagaacagggtttcatctccatggaaatcggcattcatgcgttgacgtgaacgagtgcaggagacccctcgagagaagggtgtgtcaccattcctgccataatactgtaggctctttcctgtgcacttgtcgcccagggttccgcctacgcgctgacagagtttcctgtgaagccttcccaaaggctgtgcttgcaccatcagccattctacagccacgacagcatccttcaaaaatgctgctcttgctccctgaagcgggtaggcccgcactgtcaccaggccactctcctcccagtggagcaccgggacccccagccggagttcgcaccacccggctgccgtccccaactcccaggctgccgacgagctccccctctgcacctgtatggctcctgagcacccttttagctaccccggtacccacggcttccctcctggggaatcttaggccaccaagtttattgcagggggaggtgatgggcaccccttcctcccctcgcggacccgaaagcccacgcttggccgcaggcccatcgccttgctggcatctgggtgccatgcatgaatcccggagccgctggaccgaaccgggatgctcccagtgctggtgcgaggacggaaaggtgacttgcgagaaagttagatgtgaagccgcatgcagccatccgattccctcaagagatggcggttgctgcccatcctgtacagggtgttttcatagtggtgtagttagagccgaaggcgatgtgttttcaccccctaacgaaaattgtactgtttgcgtctgcctcgctggaaacgtctcatgcatctctcctgaatgtccctccggcccatgccagacaccccctcagacggactgctgtacttgtgtgcccgtgcgctgctatttccacggacgatggtatgcagatggggcagtcttttctggcggaggcgatgaatgcaccacctgcgtatgccagaacggcgaggtcgagtgttcattcatgccatgccccgagctagcatgccctagggaggaatggcggctcggaccaggccagtgttgtttcacttgccaggagcctactccaagcacaggatgttctctggacgacaacggcgtagagtttccaattggccagatctggtctccgggagatccatgtgaactgtgcatatgtcaggcagatggttcagtgagctgcaagagaacagactgcgtagactcatgcccacatccaatccggatccccggacagtgctgtcccgactgttccgccggatgtacttataccggtagaattttctataataacgaaactttccccagtgtattagatccttgcttatcctgtatttgcctgctcgggtccgtggcttgctcacccgttgactgccccattacgtgcacataccccttccaccccgacggtgagtgctgtcccgtttgccgcgactgcaactacgaagggagaaaggtggcaaacgggcaggtttttaccctcgatgacgagccctgtacccggtgtacatgtcaacttggagaggtgtcgtgcgaaaaggtgccatgccagcgcgcatgcgcagacccagccctgcttcccggagactgttgttcgagctgccctgactccctgtctcctctcgaagaaaagcagggattatcacctcacggcaatgtcgctttttccaaagcgggacgctcattgcacggtgacacagaggccccagtaaattgctcatcgtgtccgggaccccctacagcaagcccctcgcgtcccgttctccacctcctgcagctgctcctccgcacaaatctcatgaagacccagaccctgcctacttctcctgccggtgcgcacggtccccattccctggcactgggactcaccgcaactttccccggtgagcctggcgcttccccacgcctgtccccgggaccttccacaccacctggggctccgaccctgcccctcgcctcacctggcgctccacagccgccacccgtgactccagagcgatccttcagtgcgagtggtgcccagattgtgtcacggtggcctcctctgccagggacccttctaacagaggcgtccgcgctgtcaatgatggacccgagccctagtaagacaccaataacgctgttagggccacgggtcttatctcctaccacttctagactgtcaactgcactggcggcaacaacccatcccggaccacagcagcccccagtgggagcttctcgcggagaagagtcaacaatgtag

SEQ ID NO: 10547 - DNA, 270 bp, Artificial Sequence
  Description of Artificial Sequence: Synthetic coding sequence
atggtgagctgcgaaagacgcgcatcgaaatcagtggggcagattctcctctgggactttggttacacttgcagactgtctcatcgacgccgaaactctaccgaaatactttcacgtaatctgcccgctttgtatacgggcatcaaggtgtgcgagaagcgccctagcatagatctatgtatacaccactgctcctactttcagaagtgtgaaactaacaaaatctgctgctccgcattttgcggaaatatatgtatgtcgatcttgtag

SEQ ID NO: 10548 - DNA, 600 bp, Artificial Sequence
  Description of Artificial Sequence: Synthetic coding sequence
atggagacatttcccctgctcctgctatccctcggccttgtgcttgccgaggccagcgagtctaccatgaagatcattaaggaagagtttacagacgaggaaatgcagtacgacatggctaaaagtggccaggagaagcagactattgagattctgatgaaccccattctcctagtgaagaacaccagtttatcaatgagtaaagacgacatgtcctccacactgctcactttcaggtccttgcactataacgaccccaaggggaacagtagtggtaatgataaagagtgctgcaacgacatgacggtatggcgcaaggtttcggaggcaaacgggtcctgtaagtggtcaaacaactttatccgttcgagcactgaggtcatgagaagggtccacagagctccctcttgtaagtttgtgcagaatcccggaattagctgctgcgagagtctggagctcgagaacactgtctgtcagtttacaactggaaagcagtttccacggtgccagtaccactcggttacctccctggaaaagattttaactgtcttaacaggccactccctcatgagctggctggtatgcggctctaaactgtag

SEQ ID NO: 10549 - DNA, 729 bp, Artificial Sequence
  Description of Artificial Sequence: Synthetic coding sequence
atggctgcagctacaaggggctgccgcccttgggggtccttgctcggcctcctcggactcgtgagcgccgctgccgcagcctgggatcttgcttccctccggtgcacgctcggcgctttctgtgaatgtgattttcgtccagatctccccggactcgagtgtgacctggcccagcacctggctggccagcaccttgccaaagcgctggtggtgaaggcccttaaggcattcgtgcgcgatccagcccctaccaagcctctggttctgagcctgcatggctggactgggacagggaagagctatgtcagctccctgctagcccactatttatttcagggaggattgcggagtccgagggtgcatcacttcagccccgtgttgcatttcccccatcccagtcatatcgagcgatacaaaaaagacttgaaatcttgggtccagggaaacctcacagcctgcggacgaagcttgtttctctttgatgagatggataagatgccaccagggcttatggaagtacttaggcccttcctcggttcctcatgggtagtctatggcaccaattaccgtaaagctatatttatattcattcgctggctgcttaaactgggtcatcatggtagggcccctccgcgtaggagcggagccttgccacctgctcctgcagctccccgaccagcactgcgcgcacaacgggcagggccagctgggcctggcgcaaagggctag

SEQ ID NO: 10550 - DNA, 627 bp, Artificial Sequence
  Description of Artificial Sequence: Synthetic coding sequence
atgttagggctgttggtggccttacttgcattgggtctcgcggtattcgccctgctggacgtttggtatctggtaaggcttccgtgtgccgttttgagagcacgtcttctccaacccagagttagggacctgctggccgagcagagattccccggacgagtgctacccagtgatctggacctgctactgcacatgaataatgcgaggtacctcagagaggccgacttcgcgagggtagcccacctcacgaggtgcggcgtcctcggggctctacgcgaattaagggcccacaccgtgctggccgctagctgcgcccgacaccggagatccctgaggctgctcgaacccttcgaggtccgcacaaggctcctgggctgggatgatcgggcattctacctcgaggcccgattcgtctccctgcgggatgggttcgtttgcgctctgcttcgttttagacagcacctcttagggacctcccctgagcgtgtcgtccaacacctgtgtcagcgcagagttgaaccaccagaactgcctgcagatctgcagcattggatcagttacaacgaagcctcttctcaacttctgcgaatggagtctggtttatctgacgtgacgaaggatcagtag

SEQ ID NO: 10551 - DNA, 423 bp, Artificial Sequence
  Description of Artificial Sequence: Synthetic coding sequence
atgctggtcaaattgaacagccaagctaggttgtcatctatggtgaagaaggtgaggttaccgtctcgttgtgagcctcccggaacaacatgcacagttagcgggtggggcactaccacgtcgcctgatgtcacgtttccttcggatctaatgtgcgtcgatgtgaagttaatctccccccaagactgtaccaaggtctataaggatcttctggagaattccatgctgtgtgctgggattccagattcaaagaagaatgcatgcaatggagattcaggtggcccactggtctgccggggtaccctccaaggtttggtgtcatggggcactttcccttgcggccagcctaacgacccaggtgtgtacactcaggtttgcaaatttacgaagtggataaatgatacgatgaagaagcatcgctag

SEQ ID NO: 10552 - DNA, 354 bp, Artificial Sequence
  Description of Artificial Sequence: Synthetic coding sequence
atgctgtccaaggctcacggctgtaagacagccctcagcctggggagatgccctaaaatccgggaagagtgcgagtttcaagagcgcgacgtgtgtaccaaggataggcagtgccaagataacaagaaatgctgtgtattcagctgcgggaagaagtgtctggatctaaagcaggacgtttgcgaaatgccaaaggagaccggcccttgtctcgcctattttctgcattggtggtatgataaaaaggataatacgtgcagtatgtttgtgtatggaggctgccaggggaacaataataattttcagtctaaggcaaattgtctgaacacgtgtaagaataagcgattcccatag

SEQ ID NO: 10553 - DNA, 2328 bp, Artificial Sequence
  Description of Artificial Sequence: Synthetic coding sequence
atgcacccgggaccagaggaggcaggctcgggcagatatgggcctcgctatataaccgatatgggtgccggagaggacgacgaaggctttgaggatgacttggatctcgatatcagcttcgaggaagtgaagcccctgccagctacaaagggcggaaacaagaagttcctcgtggagagcaaaaagatgtcaatctccaatccgaagaccatttctcgactgataccgcctacctctgcatccttacccgtgacaacagtagccccacaacctatccccattcagcgaaaggggaaaaacggtgtcgcaattatgagtcgactatttgatatgccctgtgatgaaacactgtgttccgctgactctttttgtgtcaacgactatacgtggggcggatcccgatgccaatgtaccctagggaaaggaggtgagtcttgctcagaggatattgtgattcagtacccccagttcttcggacacagctatgtgaccttcgaacccctgaaaaactcttatcaggcctttcagatcacgctggagtttcgagcagaagccgaagatggactgctgctgtactgcggggagaacgaacacggcagaggcgatttcatgagcctggctataattaggcggtctctgcaattcagattcaactgtggaactggggtggccataatcgtgtcggaaactaagatcaaactgggtggatggcacactgttatgctgtatcgggacggtcttaacggcctgctgcagctcaataacggcacacccgtgacaggtcagagtcagggccagtacagtaagatcacgttccgcacacccttataccttggaggcgcaccctccgcatactggctggttcgggctacaggtacgaaccgcggattccagggatgtgtgcagtcacttgctgtcaatggacgtcgcattgacatgcggccatggcctctgggcaaagctctgtctggagccgatgtgggcgaatgctctagcgggatctgcgacgaagctagctgtatccacggaggaacatgcactgctatcaaagccgactcttacatctgcttgtgtcctctgggttttaaaggtcgtcattgtgaggacgcattcaccctcacgatcccccagtttcgagagtccttgcgtagttacgccgcaacaccttggcccctggaaccacagcactatctttctttcatggagtttgagattacttttagaccagacagcggggacggggtgctgctttactcctacgacactggatcgaaggacttcctttccattaacctagctggtggccatgtcgaattcaggtttgactgcggcagcggcactggggtgctgaggagtgaggatcctctaaccctgggcaattggcacgaactgcgggtctcacgaactgctaagaacggaattttacaagtggataaacaaaagattgttgagggcatggccgaaggaggttttactcagattaagtgtaacacagatatcttcattgggggagtgccaaattatgatgacgtcaaaaagaactccggagtgctcaaacctttcagcggtagtatccagaagattattttaaacgacaggaccattcacgtgaagcacgatttcacttcaggtgtcaacgtcgaaaatgccgctcacccatgcgtgcgcgctccgtgtgcccatggtgggagttgtcgccctaggaaggagggctacgactgcgattgtccactgggcttcgagggcctgcactgtcagaaagcaattatcgaagccatagaaattcctcagtttatcggccgtagttaccttacttatgataatcccgacatcctgaagcgagtttccggatcaaggtctaatgtgttcatgcgcttcaagacaactgcaaaagacggccttttactgtggcgaggcgacagcccaatgaggcctaacagcgacttcatcagtctgggactccgggacggcgctctggttttttcatataatttggggtcaggggtcgcaagcataatggtgaacggaagctttaatgacggacgatggcaccgcgtcaaagcagtacgggatggccagtctggcaagatcaccgtcgatgactacggagccagaactggcaaaagccctggtatgatgagacagctaaatatcaacggcgcattgtacgttggcggtatgaaagaaattgccctccacactaatcgacagtacatgcggggtctggtcgggtgtattagccactttactctgtctacggattaccatattagtttagtggaagatgccgtagatggaaaaaatatcaatacatgcggcgcaaaatag

SEQ ID NO: 10554 - DNA, 1257 bp, Artificial Sequence
  Description of Artificial Sequence: Synthetic coding sequence
atgcgtacactattcaacctgctgtggctggccctcgcctgcagcccagtccataccaccctcagtaagtccgacgcgaagaaggccgcttcaaaaacactgctggaaaaagtgaaattctgcagttgttgccccggttggtcagccatggcacggtcgtggctaacagccacctctgctacccagagtcaattcagcgacaaacctgtccaggatcgtggcttggtggtgacagacctgaaggccgaatcagttgtgctggagcatcgaagttactgcagtgctaaggccagagacagacactttgccggagatgttctgggctacgtgaccccctggaactcccacggatacgacgtgacaaaggtttttggcagcaagtttacgcaaatttctcccgtgtggttgcaattgaaacggaggggtagagagatgttcgaggtcacgggactgcatgacgtggaccaggggtggatgcgcgcagttcgaaaacatgccaagggcctccatatcgtccccagactgctgtttgaggactggacatatgacgatttcagaaatgtgctggacagcgaagatgagatcgaagaattgtctaagaccgttgtgcaggtcgctaagaaccaacactttgacggatttgtcgtggaggtctggaatcagttactaagtcagaagagggtggggctgatccacatgcttacacacttagccgaggccttgcaccaggccagactcttagccctgctggtcatacctccagccattacccctggcacagaccaactaggaatgtttactcataaggaattcgagcagcttgcacccgtccttgatggcttctcattgatgacctatgactactctaccgctcaccaaccagggcctaatgctccgctatcatgggtcagagcctgcgtgcaggtcctagaccctaaaagcaagtggcggtcaaagatactattgggactcaacttttatggcatggattacgcaacatcaaaggacgccagggagcctgtagtaggcgctcgatatatccaaaccctgaaagaccacaggcccagaatggtatgggatagtcaggccagcgagcactttttcgagtataagaagagcagatctggacgccacgtcgtgttctaccccactctcaaaagcttacaagtgcgactcgagcttgccagagaactgggcgtaggggtgtcgatctgggaactgggccagggtttggattacttctacgatctgctttag

SEQ ID NO: 10555 - DNA, 813 bp, Artificial Sequence
  Description of Artificial Sequence: Synthetic coding sequence
atgatgctccgactgctctcgagccttttgttggttgcagtcgcctccgggtatgggcctccctcttcgaggcccagctctagggttgtgaatggagaagatgcagtcccttattcctggccatggcaggtttccctacagtacgaaaaaagtggctccttctaccacacttgcggcggaagcctcattgcccctgactgggtggtgaccgcaggacattgcattagcagttcccgaacataccaggttgtcctcggcgagtatgatagggcagttaaggagggcccagagcaggtgattcctattaatagcggcgatctattcgtacaccccctgtggaacagatcttgcgtggcctgcggaaatgacatcgcactcattaaactcagccggtctgcccagcttggcgatgcagtgcagcttgcatctctgcccccagcaggcgatatcctgccaaacgagactccttgctatattacaggatggggccgactgtatacaaacggccctcttccggacaaactgcaggaggccctactgcctgtagttgactatgaacattgtagtagatggaactggtggggttcgagtgtaaagaagacaatggtatgtgcaggcggtgacattagaagcggatgtaacggggactcaggtggacccctgaactgtcctactgaagatggaggatggcaggtgcacggagtgacatctttcgtatccgcattcgggtgcaacacacgcaggaagcctacagtttttacgcgcgtgtcggcatttatcgactggatagaggagactatcgcctcccactag

SEQ ID NO: 10556 - DNA, 585 bp, Artificial Sequence
  Description of Artificial Sequence: Synthetic coding sequence
atgactatgcggcacaactggacgcctgatctgtcacccttgtgggttctgctgttgtgcgcacatgttgtgaccctgttggtcagggccacaccagttagtcagacaaccacagcagctactgcgtcagtaaggtccaccaaggacccctgccccagccagcctcctgtgtttcctgctgctaagcaatgtccggctctagaagtcacatggcccgaagttgaagttccgcttaatgggacactctccctgtcctgtgtcgcctgttctcgcttcccaaattttagcatcctctactggctcgggaacggctcgtttattgaacaccttcctggacgtctgtgggagggctcgacatcccgcgagagaggttcaacagggacgcaactgtgcaaggctttggtgctggagcagctgactcccgctctgcacagcaccaacttctcttgcgtgctggtggatccagagcaggtggtgcaacggcatgtggtcctggcacagctctgggccggacttagagcaaccctgcccccaacccaggaggccctgccttcatcgcatagctcccctcagcagcagggttag

SEQ ID NO: 10557 - DNA, 1308 bp, Artificial Sequence
  Description of Artificial Sequence: Synthetic coding sequence
atgcagggacagggcaggcgcagagggacctgcaaggatattttctgcagtaagatggcgtcatatctttacggagtgttgttcgcagtgggattgtgcgcccctatctattgcgtctcacccgcaaacgctccatctgcctatcccagaccctcctcaaccaagagtactccagcgtcccaagtgtactccctcaatactgatttcgcctttagactctacagaagattggttttagagactccttcccagaatatctttttcagcccagttagcgtctccacctccctcgccatgctgtcactcggcgctcattctgtgactaaaacgcagattctccagggcctggggttcaacctgacacacacacccgagtctgctattcatcaggggtttcagcatctggtccattctctgactgtgccttcaaaagatctcaccctcaagatgggatcagctcttttcgttaagaaggaactgcaactgcaggccaatttccttggaaatgttaagagactgtacgaagccgaggtgtttagtaccgattttagtaacccaagtatagcccaggctcgcattaatagtcacgtgaaaaaaaaaactcaaggcaaagtggtcgacattatccaaggccttgatctgcttacagccatggtgctcgtgaaccacatcttttttaaggcgaagtgggagaaaccatttcatccagagtacacaaggaagaattttccttttcttgtcggggagcaggtaactgtgcacgtcccgatgatgcatcagaaggagcagttcgcattcggggtcgacaccgagctcaactgtttcgtgcttcaaatggattataaaggggacgccgtggctttttttgttctcccaagcaaaggcaaaatgagacagttggagcaggccctgtcagccagaaccttgcgaaaatggagtcattctcttcagaagagatggatcgaggtcttcattcccagattcagtatttctgcatcctataacctggagaccattctccccaaaatgggaatccaaaacgtgtttgacaagaatgctgacttcagcggaattgccaagcgggactccctgcaagtaagcaaagccacccataaggccgtgctggatgttagcgaggaaggtactgaggccaccgctgctaccacaaccaaatttatcgtgcgctccaaggacgggccttcttacttcacagtcagtttcaacaggacctttctgatgatgattacaaataaggccacagatggtatcctatttcttggcaaagttgaaaaccctacaaaatcctag

SEQ ID NO: 10558 - DNA, 393 bp, Artificial Sequence
  Description of Artificial Sequence: Synthetic coding sequence
atggcgagtgacctgataaggacaatattggccgtagccctgatcagtaaactcggcaccgcagtcgatgctgagttgatgccttccggcgcaattttgcagaataagcgcgagaacctgccccgagtgtgccacgcccttgccttcctgggaatggccagatgccaggatctgtttctcgtaagacttcaggggtggaagctcggcacacgcttccaagatggccctaggagcacaccccaagaggaggggggaagccctcagcggaagcgcggaatgccggtgcagatacactttttattgaagtcattcctgagctcccccatcacattcgcgttcattagtctggctcgtacggtgagtctggcaacagccatttgtaaaattgtgtag

SEQ ID NO: 10559 - DNA, 837 bp, Artificial Sequence
  Description of Artificial Sequence: Synthetic coding sequence
atgcagtggttgcgggtgagggagtcccctggcgaggcaacggggcacagggtgaccatgggcaccgcagcactgggaccagtatgggccgctctgctcttgttcctgctcatgtgtgagattccaatggtggagctgacctttgatagagccgtggcgtcgggctgccaacgctgttgcgactccgaggacccactggacccagctcatgtctcgtcagcctcaagttccggtagaccacacgcactcccagagatcaggccctatatcaatattacaattctgaaaggcgacaagggagaccctgggcctatgggcctgcccggatacatgggccgagaaggtccccagggggaacctggcccacaaggctccaagggagataagggagagatggggagtcctggcgctccatgccagaaacgtttcttcgcattcagcgtgggaagaaaaaccgccctgcacagcggtgaagattttcagactctcctcttcgagagggtgttcgttaatttggacggatgttttgacatggccaccggtcagtttgctgccccactcagggggatttatttcttttctttaaatgtccactcctggaattacaaagaaacctacgtccatataatgcacaaccagaaggaggcagtcattctttacgcacagccatccgagcggagcataatgcaatctcaatccgtgatgctggaccttgcctatggtgatcgcgtgtgggtgcgactcttcaaacgtcagagagagaatgcaatatattcaaatgattttgacacttacattaccttttcggggcacctgattaaggcagaggatgactag

SEQ ID NO: 10560 - DNA, 1635 bp, Artificial Sequence
  Description of Artificial Sequence: Synthetic coding sequence
atgtgcactgtagtagatccaaggatcgtaaggagatacttactgagacgtcagcttggccaaggcgcttatggtattgtgtggaaagcagtggatcgcaggaccggtgaggtagtggctatcaagaagatcttcgatgccttcagggacaagaccgatgcccagaggacatttagggagataaccctgctgcaggaattcggtgatcaccctaacattatcagcctgcttgacgtgattcgggctgaaaacgatcgagacatctatttagtctttgagtttatggatactgatctaaacgcagtgatccgaaagggcggactactgcaagatgtgcacgtccggtcaattttctaccagctgctgcgcgctaccagatttctgcacagcggccacgtggtgcaccgggatcagaagccctctaacgttttgctcgacgctaactgcacagttaagctttgcgattttggacttgcccgatctctcggggatctgcccgaagggccagaggaccaggcagtgaccgaatacgtcgcgacacgctggtatcgggcaccggaggttctcctgtcatcccataggtataccctcggtgtcgatatgtggagcctcggatgtattcttggggagatgctgcggggacgccctttgtttcctggtacaagtactttacaccagttagagctgattttggaaacaatacctccaccctccgaagaagacttgctggccctgggctccggctgtcgcgctagtgtactgcatcaactgggcagcagaccacgccaaacattggacgctttgttgccccctgataccagccccgaggccctcgatctcctgagacgactgctggtgtttgcaccagacaagcgactgagcgcaactcaggccctgcagcatccgtatgtacagcggttccattgcccctccgatgagtgggccagggaagcggacgtgcgccctagggcccacgagggggtccagctgtcagtgccagagtatcgctctagagtctaccagatgatccttgagtgcgggggttcctcgggaacttctcgggaaaaggggcctgaaggagttagtccttcccaggctcatctgcataagccaagagccgacccccaattaccctctaggacaccagtgcagggcccacgaccaaggccccagtcctcccccggtcatgatcctgcggagcacgaatctcccagggcggctaagaatgtgccaaggcagaattctgcgccactcctccagacagcactgttgggaaatggtgaacgcccaccaggagcaaaggaggcgcctccgttaactctgtcgttggtgaaaccctctggcaggggcgcagccccttcattaacgtctcaggccgcagcacaggtagcgaatcaggcactgataagaggcgattggaatcgcggagggggagtgagagttgcttccgtccagcaggttcctcctcgtctgccccctgaagctcgccctggcaggcgcatgtttagcacatctgcgttacagggtgcacaagggggtgccagagcactgctggggggttactcccaggcatatggaaccgtatgccacagcgccctggggcacctaccacttctagagggacatcacgtatag

SEQ ID NO: 10561 - DNA, 399 bp, Artificial Sequence
  Description of Artificial Sequence: Synthetic coding sequence
atgaagtcttccgggctgttcccattcctggtgttgctggccctgggaaccctggccccatgggccgtggaggggagtggcaaaagctttaaggcaggagtgtgtcctcctaaaaaaagcgcccagtgtctgcggtataaaaaaccagagtgccagtcagactggcaatgtcccggaaaaaaaaggtgctgccctgatacttgcgggattaagtgcttagaccccgtcgatacacctaatcccacccggagaaaacccggaaagtgtcccgtgacctatggacaatgtcttatgctgaatcctccaaatttctgcgaaatggatggccagtgtaaaagagacctgaagtgttgtatgggcatgtgcggcaaatcctgcgtctctcctgtaaaagcttag

SEQ ID NO: 10562 - DNA, 1401 bp, Artificial Sequence
  Description of Artificial Sequence: Synthetic coding sequence
atgaagcccccacttttagtgtttatcgtctgtctgctgtggctgaaggattcccactgtgctccaacttggaaggacaagactgccatttctgaaaatctaaagtccttttcggaggttggtgaaatagatgccgacgaagaagtgaagaaggctctgacaggcatcaagcaaatgaagataatgatggagcgcaaggagaaagagcacaccaatcttatgtcaacattgaagaagtgcagggaggagaagcaagaggccctgaaactcctaaacgaggtgcaggaacatctagaagaggaggagaggctatgccgcgagagtctggccgactcatggggggaatgtcggagctgtctcgaaaacaattgtatgcgcatatacactacatgccagccgagctggagctctgtcaagaacaaaattgaacgcttttttcgcaaaatctatcagtttctcttccctttccatgaagacaatgagaaggacctcccaatctccgaaaagttaatcgaagaggatgctcagctcacgcaaatggaggacgtcttcagccagctgactgtggatgtgaacagcctgtttaatcggtctttcaatgtgtttcgccagatgcaacaggagttcgaccagactttccagtctcattttatatcagatactgatttaacagaaccttatttcttccctgctttctctaaagaacccatgaccaaagccgacttagagcaatgttgggatatccctaacttttttcagctgttctgcaactttagtgtcagcatttatgaaagcgtttccgagactattaccaagatgcttaaagccatcgaggatctcccaaaacaggataaagccccagatcacggcggactgatcagcaaaatgctccctggccaagatagaggactctgcggcgaactcgaccagaatttgtccagatgcttcaaattccatgaaaagtgccagaagtgccaggctcacctctctgaggattgtccagacgttcctgcactgcacacagagctggacgaggcgattcggttggtcaatgtgagcaaccagcaatatggacaaatactccagatgacaaggaaacatctggaggatactgcatacctcgtagagaagatgcgtggccagttcggttgggtatccgaactcgccaaccaggcaccagaaacggagatcatattcaatagcattcaggtagtgcctaggattcatgaggggaacatatctaagcaggatgaaaccatgatgactgatctctcaatccttccatccagtaacttcacattaaaaatccccctggaggagtccgcggagtcttcaaatttcattggctacgtcgtggcaaaagcgttgcagcacttcaaagagcattttaaaacttggtag

SEQ ID NO: 10563 - DNA, 522 bp, Artificial Sequence
  Description of Artificial Sequence: Synthetic coding sequence
atgcactggaagatgttactcctgctcctcctttactacaacgccgaagcctccatgtgccaccgctggagccgagcggtgctttttcctgcggctcaccgtccaaaaagatcgagtagccttcctctgaacccggtgttgcaaacctcactggaagaggtcgaacttctctacgaattccttctggcagaacttgaaatctcgccagatctgcagatctccatcaaggacgaggagcttgccagcttacgaaaagctagtgacttcaggacagtgtgtaacaatgttattcccaagagtatcccagatatccgtcggctctcagcatcactgagttcacatcccggaattctgaagaaagaagatttcgaacggactgtcctgactttggcctatacagcctatcggaccgcgcttagccacggccatcagaaggatatatgggcccaatccctagtgtcactattccaagccctgcgacatgacttgatgcgctcatcgcagcccggtgtccccccttag

SEQ ID NO: 10564 - DNA, 1473 bp, Artificial Sequence
  Description of Artificial Sequence: Synthetic coding sequence
atggaagattccgactctgctgccaagcagctgggtctcgccgaggctgcagcagtcgctgcagcggcagctgttgccgctgccgcagccgctgctgccggtggtgaagccgaagaaccggtgctttcacgtgacgaagactcggaggaggatgctgactcagaggccgaacgtgagactcccagagtgactgcagtggccgtcatggccgctgagccaggccacatggatatgggcgcagaggcattgcctggcccagatgaagcagccgctgctgcagcgttcgccgaggtaacaaccgttacagtcgccaacgtaggtgccgctgcagacaacgtgttcaccacaagtgtggccaacgccgcttctatttccgggcacgtgctcagtgggaggaccgcactgcagatcggtgatagtctgaacaccgaaaaggcgacactgattgtggtgcacacagacggctccatcgtagagactacagggctcaaaggcccagctgcaccattgacccctgggcctcagagcccccctacacctctggcgcctggccaagaaaaggggggaacaaagtacaattgggatccgagtgtctatgattctgagctgccagtgaggtgcaggaacataagtggtactctgtacaagaatcggctgggctctgggtgggacctgaagcctagccgctgcctgctacacttatgctgtctgcttagaagacacgatttgattacagtgacccctagcggccaaatcactacatccggggctctgacttttgatcgcgcatcaactgtggaagcgacagcggtcatttctgagagccccgcacagggcgacgtgtttgccggtgcaacagtgcaggaggccagcgtccagccaccttgtcgggctagtcatcctgagccccactacccaggatatcaagacagttgccaaatagcaccattccctgaggccgcactacctactagccatccaaagattgtgctgactagtctcccagccctggctgtacctcctcccactccgactaaggccgcaccccctgccctggtcaatggcctggagctctcagaacctcgctcctggctttatctggaggaaatggtcaattccctgcttaacacagcacagcagttaaaaactctgtttgaacaagccaagcacgccagtacgtatagagaagctgccacaaatcaggccaaaattcatgccgatgccgaacgaaaagaggttattcaccctcctcgattacccaaggtactgggcctccagcagtcctgcgttaattgcggaagggaagcgatgagcgagtgcaccgggtgccacaaagtgaactactgctctaccttttgtcagaggaaggactggaaagatcaccagcatatctgcgggcagagtgcagctgtgacagtccaagcggatgaggtacacgtagcggaatccgttatggagaaagttaccgtatag

SEQ ID NO: 10565 - DNA, 1476 bp, Artificial Sequence
  Description of Artificial Sequence: Synthetic coding sequence
atgcctagcaccgtcctgcctagcaccgtgttgccaagtctgctcccaaccgctggcgcaggctggtccatgcgctggatcctgtgttggtcgcttacgctttgtctaatggcacagaccgccctgggcgcactgcacaccaagagacctcaagtggttactaaatacggtacactacaagggaagcagatgcacgttggaaagacgcctatccaggtattccttggtgtacccttttcccgacctcctctgggaatattgcgattcgctcccccagaaccacccgaaccctggaagggcatccgagacgcaactacgtatccacctgggtgtctccaagaatcctggggtcagttggcttccatgtacgtcagtacacgagagcgttacaaatggttacgtttctcagaagattgtctgtacctcaacgtatatgcccctgcaagagcacctggcgatccccagttgcctgtgatggtttggttcccgggtggagctttcattgtcggggctgcatcctcgtacgagggatcagatctcgccgctcgggaaaaggtcgtgttggtgttcctgcagcatcgtctggggatcttcgggtttctgagcactgacgactctcacgcaagaggtaactggggcctccttgatcagatggctgctcttcggtgggtccaggaaaatattgccgcattcggaggggatcctggaaacgttactcttttcggtcagtcagcaggagccatgtctatttcaggcctgatgatgtcccctttggcctctgggctgtttcaccgggctattagccagagcggaaccgcgcttttcaggcttttcatcaccagtaatccgttgaaggtcgcgaaaaaggtcgcgcacctggcgggttgcaaccataattccacccagatcctggtcaactgcctgcgcgctctttccggtaccaaagtgatgagagtatccaacaagatgagattccttcaactgaactttcagcgagatcctgaggaaatcatctggtcaatgtcacctgttgtagacggggtggtgatcccagacgatcccttggttcttctgacccagggaaaggtttcctcggtaccttatctgctcggtgtgaacaacctggaatttaattggctgcttccctatattatgaagtttcctctgaaccgccaggcaatgcgaaaggaaactataactaagatgttgtggagtactaggacacttttgaatatcaccaaggaacaagttcccctagtagtcgaggagtatctggataatgttaacgagcacgactggaaaatgctccgcaacaggatgatggatatagtccaagacgccacatttgtgtatgcaactctccagactgcccactaccacagagagactcctatgatggggatttgcccagcaggacatgcaactactagaatgaagtccacctgctcctggatccttccccaggagtgggcgtag

SEQ ID NO: 10566 - DNA, 753 bp, Artificial Sequence
  Description of Artificial Sequence: Synthetic coding sequence
atgccagcttctagcccttttctgctggccccaaaagggccaccaggcaacatgggcggtcccgtgagagaacctgccctgagcgtggctctgtggctgagttggggagctgcacttggcgctgttgcatgcgccatggctttgctgacccagcagaccgaacttcaatccctgaggagagaggtgtcacgactccagggcaccggcggaccttcccagaatggggaagggtacccatggcagagtcttccagagcagagctcggacgcccttgaggcctgggaaaatggagagcggtccagaaaaagaagggcagtgctgacccagaagcagaagaagcaacactccgtgttgcatctggttcccatcaacgcaacctcaaaagatgacagcgatgtgacagaggtgatgtggcaacccgctctgcgtcggggtcgagggctgcaggcccagggatacggagtgcggattcaggatgccggagtgtaccttctttactcccaggtactgttccaggacgtcacattcactatgggacaggtcgtctctagagaggggcaaggccgtcaagaaaccctttttagatgcatacgatccatgcctagtcatccagatagagcctacaattcctgctattccgccggtgtattccatctgcatcaaggtgacatcctgtccgtgataatccccagagccagggcaaagctcaacctcagccctcacggaacgtttctcgggttcgtaaaactttag

SEQ ID NO: 10567 - DNA, 1437 bp, Artificial Sequence
  Description of Artificial Sequence: Synthetic coding sequence
atgtcccctccgcttctgaagctgggggcagttctatcaactatggccatgatctccaattggatgagtcagacactgccctccctcgtgggcctgaacaccacacgcctcagcaccccggatacgctgacccagatctcaccgaaagagggatggcaggtatactcctcagcccaggacccagatggcaggtgtatttgcacagtagtggcgccagagcagaatttgtgtagcagagatgcaaagagcagacagctgcggcagctcctggagaaagtgcagaacatgagtcaaagcatcgaggtgctgaatctccggacccaacgagatttccagtatgtgctgaaaatggagactcagatgaagggattaaaagcaaaattccggcagattgaagacgatcggaagacactaatgacaaagcatttccaagaactgaaggaaaagatggatgaattgctgccactgattcccgtgctcgagcagtacaagactgacgcaaaactgatcactcagttcaaagaagaaatccgaaacttatccgccgtcttaacaggcatccaggaggaaattggggcttatgactacgaagagctacatcagagggtgctgtcgctagaaacaaggctccgggattgcatgaagaagttgacatgcggaaaactgatgaaaattacaggtcccgtgacagtcaagacctctggcacgcggtttggcgcatggatgaccgatccgctggcatccgagaagaacaacagggtatggtacatggatagctacaccaacaacaagatcgtccgcgagtacaaatccatagccgatttcgtctccggggctgaaagtcggacttacaatctccctttcaaatgggccggaaccaatcacgtggtgtacaacggctccttatacttcaataaatatcagtccaacatcatcattaaatactcatttgacatgggaagggtccttgcccagaggagcttggaatacgcaggatttcacaacgtttacccttacacctggggcggattctccgatatcgatctgatggctgacgaaattgggctgtgggcggtgtacgccacgaaccagaacgccggaaatattgtcatttcccaattgaaccaggacactctagaggttatgaaaagttggagtacaggatacccaaagcggtcagcgggtgaatctttcatgatctgtggcacactgtacgtgactaattctcatctaacaggtgccaaagtttattattcttattcaactaaaacatccacatatgaatatacagatataccttttcacaatcaatacttccatattagcatgctggactacaacgcacgggacagggccttgtacgcctggaacaacggacaccaggtgctgttcaacgtgacactcttccatattataaaaacagaggacgatacctag

SEQ ID NO: 10568 - DNA, 1101 bp, Artificial Sequence
  Description of Artificial Sequence: Synthetic coding sequence
atggcaagagagcggcctcctgggcgaggctgcggagtgctcagacgttgtctgctgggagcggtgcttctgttcggactacgactctgcgctgaactcaggcgggctggtccaggcagcccaacaaggtctgctccacctggacctgcatggcgcccacccggtcctcacttgccgcctgctccgggtcagcctagaggagcatctcggaggcaggtgacgtacgtccggtctggcagacgtgcaccgccaggagggggaggaagtggaacccccgagcctggatgttgcgcccctcgtgggagaccgaggcgaaaggggcctaggtggcacattgatctgcagccatgggccggatctgcccaatcacttgatgaggaggcatggagattcctgcgttacatcagcaccactcaaattgcctgtaaccacatgaatactgattccttagccacagatagttcccctacacacaagccttggtcggtgtgtctagacgacaggttcaaccttgcccaccaaattcggaataaacagtgcagactatactccctgggactgggatccgacgacacccattttgaggtgagcatggcaaacaatggatgtgaggttcataggttcgacccctcagtgaagagtgcccacatcctggagagccagcacctgtggtatcacagactgtcaatcgactggagggatccccatccagccgtggcggcacagaagccacacagcaatacacggaaactgggaagcatcctcaatgagtttggccatcacaaaatcgatgtattgaaggcggacctggagtccgccgagtggaaggtactcgaaaatcttattctggaagatgtcctcgaacagattggacagctcatcttcgagatccaccttcattggccaggatttgaggtaagcggcagcgattcctcagtggtgcgattttggtattcattactgaaggagctggaacaaaaggatttccgcctgttccatagctataaagatctcagcaaaccgcagctttttctgaagaaggatatttttaacgcctcttcttgttatacgctctcctgggtcaatactcgctggaagtag

SEQ ID NO: 10569 - DNA, 300 bp, Artificial Sequence
  Description of Artificial Sequence: Synthetic coding sequence
atgaagattccagtgctccctgccgtggtgttgctgagcctgctcgtgctgcattctgcccagggcgctacgctgggcggacccgaagaagaaagcactatcgagaactacgcaagtagacctgaggctttcaataccccattcctgaatatcgataaacttcggtccgcgtttaaagctgatgaatttttgaattggcatgctcttttcgagtccattaagcgcaaactaccctttctcaattgggatgctttccccaagctgaagggactgagaagcgctactcctgacgctcagtag

SEQ ID NO: 10570 - DNA, 618 bp, Artificial Sequence
  Description of Artificial Sequence: Synthetic coding sequence
atgatgagaaccttaatcactactcacccactccctttgctactgctcccacagcagctcctgcaactagtgcagtttcaagaggtcgacacagactttgactttcccgaggaggataaaaaagaggaatttgaggagtgcctggagaagttcttctcgacaggcccagccaggcctccaaccaaggagaaagtaaagagacgtgtcctcatcgagccagggatgccactgaatcacattgaatactgcaatcacgagataatgggtaagaacgtgtattataagcaccgatgggttgctgagcactactttctgctgatgcagtacgacgaattgcaaaagatttgttataatcggtttgtcccgtgcaagaatgggattcggaagtgcaaccgtagtaaggggctggtagagggggtgtactgcaacctaactgaggcattcgaaatccccgcttgcaagtacgagtctctgtaccgtaagggatacgttctgattacttgttcctggcagaacgaaatgcagaagcgtatcccccacactatcaacgatctcgtcgagcctcccgagcaccgctcattccttagcgaggacggggtgttcgtcatctccccctag

SEQ ID NO: 10571 - DNA, 402 bp, Artificial Sequence
  Description of Artificial Sequence: Synthetic coding sequence
atgctggactggcggctagcatcggctcactttatcctcgcggtaacactcacactgtggtcatctggcaaggtcctgtcagtcgatgtgacaacaaccgaagcatttgattctggggtaatcgacgtgcagtctactcctactgtgagggaggaaaagagcgccaccgatctaacggcaaagctgctgcttctcgacgagctggtcagtctcgaaaatgacgtgatcgaaaccaagaagaaaagatccttctctggctttgggagtcccttggacaggcttagtgccggttccgtagaccataaaggtaaacaaagaaaggtggtggaccaccctaaacgcaggttcgggatccccatggaccggattggaagaaatcggctctcaaactcaagggggtag

SEQ ID NO: 10572 - DNA, 846 bp, Artificial Sequence
  Description of Artificial Sequence: Synthetic coding sequence
atgggtagccgcggacagggcctgttacttgcttattgtttgctgctggcattcgcctccggtctggtgctgagtcgcgtgccccatgtgcagggcgagcaacaagagtgggaaggcactgaagaactgcctagtcccccagatcacgcggagcgcgctgaggaacagcacgaaaagtaccggccaagccaagatcagggactccctgcatccagatgtctcaggtgctgcgatcctgggacatcaatgtacccagccactgccgtaccacagattaacatcactatcttgaaaggcgaaaaaggcgacagaggcgataggggattacagggaaaatatggcaagaccggcagcgcaggcgctcgcggacacactggtccgaaaggacagaaagggtcaatgggcgcaccaggggagcgctgcaaaagccattatgcagcttttagtgtgggtaggaagaagcccatgcatagcaaccattactatcagacggtgatattcgacactgaattcgtcaacctgtatgaccacttcaatatgtttaccggtaagttttattgctacgtgcctgggctttacttcttcagtcttaacgtgcacacgtggaatcaaaaggagacctacctgcacattatgaaaaatgaggaggaagtggtcatcctgttcgcccaggttggagatagaagcatcatgcagtcccaatccctaatgctcgaacttagagagcaagaccaggtttgggtgcgcttatataagggtgaacgggagaacgcgatcttttctgaagagcttgatacctatatcaccttctccgggtacctcgtgaagcacgctacagaaccctag

SEQ ID NO: 10573 - DNA, 132 bp, Artificial Sequence
  Description of Artificial Sequence: Synthetic coding sequence
atgaaactcctgtatttattcctggccattctgttggctatcgaagaaccggtaatttctgccctggtgcgaaccgtggggtgttgcctggacacagcccgacagacaccccacccctccatgcatggctag

SEQ ID NO: 10574 - DNA, 861 bp, Artificial Sequence
  Description of Artificial Sequence: Synthetic coding sequence
atgaaggtgctcctgctaaccggtctgggagctctgttctttgcctactattgggacgataatttcgatcctgcatcactccagggcgcaagagtcctgctgacaggcgcaaacgctggcgttggagaggagcttgcgtatcactatgcacggcttgggtctcatttggtgttgacagctcatactgaggcacttctgcagaaagtggtcggcaactgccgtaagttgggagcaccgaaagtcttctatatcgctgcggatatggcaagcccggaggcccctgagtccgttgtccaatttgctctggacaaattggggggattggactatctcgtccttaaccacatagggggagcgcctgccggtactagggccagaagcccccaagccacgagatggctcatgcaggtaaacttcgtctcctacgtgcagctcacttctcgcgctcttccgtccctcacggatagtaaagggagccttgtcgtcgtgtcctctctgttgggcagagtgccgacttcattctcaaccccatacagcgctgctaaatttgcgctcgacgggttttttggctcactcagacgcgagcttgacgttcaggatgtcaacgtagcaatcactatgtgcgtcttgggcctcagggatcgggcttccgccgcagaggccgtccgcggagtcacaagggtgaaagctgcccctggtccaaaggcagctcttgctgtaatccgaggtggagctacaagggcagccggagttttctacccatggcgctttaggctgctgtgcctgctgagacgatggctgcctcgccctagagcctggttcatcaggcaggagctaaatgttactgctgccgctgcttag

SEQ ID NO: 10575 - DNA, 1326 bp, Artificial Sequence
  Description of Artificial Sequence: Synthetic coding sequence
atgcgagtggtgacaatcgtgatcttgctgtgcttctgtaaggccgcagaactccggaaagcctctccaggatctgtcaggagcagagtgaatcacggcagggccggagggggaaggaggggcagcaatcccgtcaaaagatacgctcccggactaccttgtgacgtgtatacctacctgcacgaaaagtaccttgactgtcaggaaaggaagctggtgtatgtcctgcccggatggcctcaagacctgctccacatgctcctcgcgagaaataagatcaggacattgaagaataacatgtttagcaagtttaaaaagctgaaatcgctggacctgcagcagaacgaaatctcaaaaatcgaatcggaggcctttttcggtcttaataagctgacaacactgttattgcagcacaaccagataaaagtactcaccgaggaagtcttcatctacacacctctcttgtcctacttgagactttacgataatccctggcattgcacctgcgagatagagacacttatttcaatgctgcaaatccctcggaaccggaacctcggtaactacgcgaagtgcgaaagtccccaggagcagaagaataagaagctccgtcagatcaagagcgaacaactgtgtaacgaggaagagaaggagcagctggatcccaaaccccaggtctcagggagacctccagttataaagccagaggtagacagtactttttgccataattatgtttttcctatccagaccctggactgtaaacggaaggagttgaaaaaggtacctaacaacattccccctgacattgttaaactggacctcagctataacaagattaaccaactgagaccaaaggaattcgaggatgtgcatgaactgaaaaagctgaacctgtcctccaatggcatcgaatttatcgatcccgctgcttttcttggtttaacacatctcgaggaactggacctgagcaacaactctctccaaaactttgactacggcgtgcttgaggacctgtacttcctaaagctcctgtggcttagagataacccgtggcgctgtgactataatatccactacctttactattggctgaaacatcattataatgtgcacttcaacggcctggaatgtaaaactcccgaagaatacaaggggtggagtgtgggaaagtatattagatcctactacgaggagtgccccaaggataaactgccagcatacccagagagctttgaccaggataccgaggatgacgagtgggagaaaaaacatcgggaccatactgcaaagaagcagagcgtgatcatcaccattgtcggttag

SEQ ID NO: 10576 - DNA, 1539 bp, Artificial Sequence
  Description of Artificial Sequence: Synthetic coding sequence
atggcagagtcaggattagctatgtggccgagcctgctcctgttgttgttgctcccaggtccacctccagtggccggactagaagatgctgcatttccacatctgggcgagagcttgcagccactcccacgtgcgtgtcccctgcggtgctcttgccctagagtcgacacagtcgattgtgacgggctggacctcagagtgttcccagacaatataactagggcagcccagcatctttcactgcaaaataatcaattgcaggaactgccctacaacgagttaagccgccttagtggtctgcgcactctgaatctgcacaataacctgatctcatctgaaggtttaccagatgaagccttcgagagtctgacgcagctgcaacacctctgtgtcgcacacaataaactgagtgtggctcctcagttccttcccagatcgctacgcgtcgccgatctcgccgcaaatcaggtgatggagatatttcccctcactttcggcgagaaacccgctctccgatccgtctatctccataacaatcaactatccaacgctggactgccacccgacgcttttagaggatcagaagctattgccactctgagtctgtcgaataatcaactgtcgtacctgccgcctagcctgccgccttctcttgagaggctgcacctgcagaataacctaatatctaaggtccctaggggagccctgtcaagacagacgcagctcagggagttgtatttacagcacaaccagctcaccgacagtggtctggacgccactacctttagcaagctgcacagtcttgaatatctcgatctctcacacaatcaattaaccactgtgccagcaggacttccacgcacactcgctatattacaccttggccgaaaccggattcgtcaggtcgaggctgctaggctgcacggcgcaagggggcttcgctacttgctcctccagcacaatcagctggggtccagtgggctgcccgcaggagcattacggccacttaggggccttcacactctccacttatacggcaatggcctcgacagggtgccacccgctttgccccgaagactgagggcactggtgctgccacataatcatgtggccgctctgggagccagagatctggtggcgacacctggactgactgagctcaacctggcctataacagactggcatcagccagggttcaccaccgggctttcagacgcctgagggcgcttcggagcttggacttggcgggtaatcagttgacccggctaccaatggggctgccaaccggcctccgaacacttcagctacagcgtaatcagctgagaatgctggagcccgaacctttggccggtctggaccagctccgggagctgtccctcgctcataatcgcttgagggtgggtgacatcgggcctgggacgtggcacgagctgcaggccctgcaggtacgccatcgtttggtgtcacacaccgtgcctagagctcctccctctccatgcctgccgtgccacgttcccaatatcctcgtgagctggtag

SEQ ID NO: 10577 - DNA, 2328 bp, Artificial Sequence
  Description of Artificial Sequence: Synthetic coding sequence
atgaaggaaggcccagaagaagctggctctggcagatatggacctcgttacatcaccgatatgggcgcaggagaggacgatgaaggttttgaggatgatctggacttggacatctcttttgaagaggtaaaaccactcccagcgacaaaaggcggtaacaagaagttcctggtcgagagtaagaagatgtcaattagcaaccccaagactatcagtcggctcatccctcccacctcagcatcactcccagtgacgaccgtagcgccacagcccatacctatccaacggaagggaaaaaacggggtggcaataatgtcacgcctgtttgacatgccttgcgacgagaccctgtgctcagccgactccttctgtgtaaatgattacacttggggaggcagcagatgccaatgcactttaggcaaaggcggagagagttgttcggaggacattgtgatccagtatccccagttttttggccacagctacgtcacctttgagccactgaaaaatagctatcaagcattccaaataacactggagttccgagccgaggctgaagacgggcttcttctctactgcggggagaatgagcacggcaggggagatttcatgtcccttgctatcattcgcaggtccctccagttcaggttcaattgcggcaccggagtagccattatcgtgtcagaaacaaagattaaactgggtggatggcacaccgtgatgttgtacagggatggtctgaatgggcttcttcagctgaataacgggacccccgtgactgggcagagccaaggccagtattccaaaataaccttccgaacaccattgtatcttgggggtgccccatctgcatattggctcgtgcgagcaaccggaaccaatcggggattccaaggttgcgttcaatcacttgcggtgaacggaagacgcattgacatgcgcccttggcccctgggaaaggctctatccggggctgatgtaggagagtgcagcagtggaatttgtgacgaggcaagttgcattcatggcggaacatgtaccgcaattaaagccgacagctacatatgtctatgcccccttgggtttaaaggcagacattgcgaggatgccttcacattgacaattccccagttccgtgaatccctcaggtcctatgcagccacaccatggcccttagaaccccagcactatctcagcttcatggagtttgagatcacctttcgtcccgatagcggggatggcgtgttgctgtattcatacgacacaggatccaaagatttcctgtctataaaccttgctggagggcacgtggaatttcgattcgactgtggctctggcactggcgtactacgatctgaggaccctctcaccctcggcaattggcatgagctgagggtgagccgaactgctaagaacgggattcttcaagttgacaagcagaagattgtggaaggaatggccgagggaggtttcacccagatcaaatgtaacacggacattttcattgggggagttcctaactatgatgatgtgaaaaaaaatagcggggtgcttaagccctttagcggctccatccagaaaatcattctaaatgatcgtactattcatgtaaagcacgactttaccagcggggtaaatgtggagaacgccgcacacccctgcgtgcgggcaccctgcgcccatggcggatcttgcagacccagaaaggaggggtacgactgcgactgccccctgggctttgagggcctgcactgccaaaaggcgattatcgaggctattgagattccccagttcattggacgaagctacctgacttatgataaccctgatattctaaaacgcgtgtcaggctccagaagtaatgtctttatgagattcaagactacggctaaggatggactcctgctgtggcgaggagatagtcctatgcgcccaaacagcgattttatttccctggggctccgggacggcgctctggtattctcatataatctgggcagcggtgtggcttctattatggtgaatggctcatttaatgacgggagatggcatagggtcaaggccgtgagggatggccaaagtggcaagattaccgtggatgactatggggcaagaacgggtaaaagccccggtatgatgagacagcttaacattaatggggcactctacgtcggcggtatgaaagaaatagctctgcacactaacagacagtacatgcgcggtcttgttggttgcataagccatttcaccttgagtacagactaccatatcagcctggttgaagacgccgtggatgggaaaaacatcaatacgtgcggtgccaagtag

SEQ ID NO: 10578 - DNA, 1431 bp, Artificial Sequence
  Description of Artificial Sequence: Synthetic coding sequence
atgaaatttcaggggcctctggcttgcctgctactggctctgtgcctgggctccggagaagcaggtccacttcagagtggtgaggaatctaccggaaccaatatcggtgaggccctgggtcacgggctgggggatgccttgagtgagggtgttggtaaagcgatcggaaaagaagccggaggagccgctggcagtaaggtcagcgaagcacttggtcaagggacccgtgaggccgttggtacgggagtgcggcaggtacccggttttggggtcgcagacgctttgggaaatcgcgtcggtgaagccgctcatgccttgggtaacactggccacgagattggtaggcaggccgaagacgttattcgccacggcgctgacgcagtcagaggctcttggcagggtgttcccggtcacaatggggcttgggagacctctggaggccacggaatattcgggtcccaggggggactgggcggtcaagggcagggtaatccgggtggattgggtaccccttgggtccatgggtaccccggtaacagcgcaggtagttttggcatgaatccacagggcgcaccatggggccaaggcggtaacggcggtcctcccaatttcgggaccaatactcagggggcagtggcccagcctgggtatgggagtgtccgcgcatccaaccagaatgagggttgcacgaacccccctccatcgggatccggcggaggcagtagcaattcgggaggcggatccggctctcaaagtggcagttctgggagtggtagcaatggcgacaataacaacggatcatcctcagggggatctagctcgggttctagttcgggcggttccagcggaggttcctcaggcggtagtagtggaaattcagggggtagtaggggcgactccgggtcggagagttcttggggctcctccacgggatccagctcaggaaatcatggaggaagtgggggaggaaatggacacaaacccggatgcgagaagcctggcaacgaggcacggggaagcggcgaaagcggtattcagaactctgaaacttcaccagggatgttcaacttcgatacattttggaagaattttaagtcaaaactggggtttatcaattgggatgccattaacaagaatcaggtgcctcctccgtcaacaagagccctgttgtattttagtcggttgtgggaggactttaagcaaaacacaccttttctgaattggaaagccatcattgaaggagccgatgcctcaagtcttcagaaacgggctggcagagacgatcagaattacaattataaccagcacgcttaccctacagcgtatgggggaaaatactctgtcaagacccctgcaaaaggcggtgtgtccccatcatcgagcgcatcccgggtccaaccaggcttattgcagtgggtgaaattctggtag

SEQ ID NO: 10579 - DNA, 1911 bp, Artificial Sequence
  Description of Artificial Sequence: Synthetic coding sequence
atgaccacctggagccttcgtagacgccctgctcgtactctcggtttgctcctcctagtggtgctgggtttcctcgtgcttcggcgtctggactggtccaccctggtgccgctacgcctgaggcacagacagcttggtctgcaggctaaggggtggaacttcatgctcgaggattcaactttctggattttcggaggcagtatacattattttagagtgcctcgtgagtactggagggatagactcctgaagatgaaagcttgtggactcaatactctcacaacatatgtcccatggaacttgcatgaaccagaaaggggtaagtttgatttctccggtaaccttgacttggaggcatttgtgctgatggctgccgaaatcggcctttgggtcatcctccggcctggcccttacatttgttcggagatggaccttggtggcctgccttcatggcttctgcaggacccgggaatgcgcctgcggactacttataagggctttacggaggcagtggacctttactttgaccatctcatgtcacgcgtagttcccctccaatataaacgtggcggtccaatcatcgcagtccaggtggaaaacgaatatggatcttacaacaaggatcctgcatacatgccctatgtgaaaaaggcactggaggaccgcggaatagtggaactgctgctgacatccgacaataaggacgggcttagcaagggaatcgtgcagggagttttggctacgattaacctgcagagtacccatgagttgcagctgctgacaacatttctcttcaatgtgcagggcacgcagcctaaaatggtcatggaatattggactggctggtttgatagctggggcggacctcacaacattctcgactcatctgaggtgctgaaaactgtgagcgcaattgtggatgccggatcctccataaacctgtacatgttccatggcggtacaaattttggcttcatgaacggagccatgcattttcatgactataaatctgacgttacatcatatgattacgacgctgtgttgacagaggcaggtgattacactgccaaatacatgaagctgcgagattttttcggatcaatttcgggtattcctcttccccctcctcccgatttactacctaagatgccttatgaacccctgactccggtcctgtatctgtcgctctgggatgcccttaaatacctgggggagcctattaaaagcgaaaagcccattaatatggagaatctgcccgtgaatgggggaaatggtcaatcgttcggctacattctttatgagaccagcattacttcctccggcattctgtcagggcacgtgcacgaccgcggtcaggtatttgtgaacaccgtgtcaattgggtttctagactataagacgaccaagatcgctgtgcctctaatacaggggtacacggtcctgagaatcctggtggaaaatagaggacgcgtaaactacggggaaaacatagacgaccagcggaagggcttaatcggaaatctctacctgaacgatagccctttgaaaaactttagaatctattccctagatatgaagaagtctttctttcagaggttcggcctcgataagtggtccagtctgccggagacccctacactgcccgcatttttcctcggatccctgtctattagctccaccccgtgtgacacattcctgaaacttgaggggtgggaaaagggtgtcgtcttcataaatggccagaatctcggtagatactggaacatcgggcctcaaaagaccctttacttaccaggaccttggttgtcaagtggcattaaccaagttatcgtgtttgaagaaactatggctggtcccgctctgcagttcacggagaccccccacttggggagaaaccaatacattaagtag

SEQ ID NO: 10580 - DNA, 672 bp, Artificial Sequence
  Description of Artificial Sequence: Synthetic coding sequence
atgacccgatggtcgagctatctgctgggctggaccacatttctgttatacagctatgaatcctccggaggcatgcatgaggagtgtgttttccctttcacttataaaggctctgtgtattttacctgcacccacatacattccctttctccatggtgtgctacaagggctgtttataacggacagtggaaatactgtcaaagcgaggattatccaaggtgcatctttccatttatttacaggggtaaggcctataactcctgtatttcccaagggagctttctgggctccttgtggtgcagcgtgactagtgtgtttgatgaaaaacagcaatggaagttctgtgagacaaatgagtacgggggaaactccctccggaagccgtgcattttcccttcaatataccgaaacaacgtggtgtctgattgtatggaagatgagagcaacaagctctggtgtcctacgaccgagaacatggacaaggacggcaagtggagcttttgcgccgataccagaatctctgcactggtccctggcttcccctgtcactttcctttcaactataagaataaaaactacttcaactgcacaaacgagggatctaaagaaaatctggtctggtgcgctacgagctacaattacgaccaggatcacacgtgggtgtactgctag

SEQ ID NO: 10581 - DNA, 1368 bp, Artificial Sequence
  Description of Artificial Sequence: Synthetic coding sequence
atgctgcaccccgagacaagcccaggcaggggccacctcttggccgtcttgctcgccctgctgggaactacatgggccgaggtttggccacctcagctgcaagagcaagccccaatggccggtgcgctgaacaggaaggagagcttcctgctgctcagtttacacaatagactgcgctcatgggttcagccgccagctgccgatatgaggagactggattggtctgacagcctagcgcagcttgcacaggcaagagccgcactctgcggaattccaacgccctccctagcgagcggcctctggcgtacgctgcaagtcggctggaacatgcaactgttaccggctggcctcgccagtttcgtggaggtcgttagcttatggtttgcagaaggccagagatattcccacgctgccggagaatgcgctagaaacgctacctgtacgcactatacccagctcgtgtgggcaacctctagccagcttggttgcggcaggcatttatgttccgccggacaaaccgccattgaggcctttgtgtgtgcctactcccctgggggaaattgggaagtgaatggcaaaacgatcatcccatacaaaaagggcgcatggtgctcactgtgtaccgctagcgtgtcagggtgttttaaggcttgggatcatgccggaggcctgtgtgaagtccccagaaacccctgccgaatgtcttgccagaatcacggacggctgaatatttccacatgccactgccattgccctccgggatacacaggcagatactgccaagttcggtgcagtctccagtgcgtccacgggaggtttagagaggaagagtgtagctgtgtttgcgacattggatacgggggtgcccagtgtgcaactaaggtccactttcccttccacacctgcgatctgcgtatcgacggagactgcttcatggtgagctcagaggcagacacttactacagagcccgaatgaagtgtcagagaaagggtggggtgctggcgcagatcaagagccagaaagtacaggacattttggcattctatcttggcagactcgagacaacaaacgaggtcatcgattcagattttgagaccaggaatttttggattgggcttacttataaaaccgccaaggacagctttagatgggcgacaggcgagcatcaggcgttcaccagtttcgcatttgggcaacccgacaatcatggcctggtgtggttaagcgccgcaatgggctttggcaattgcgtcgagcttcaggccagtgcagcttttaactggaatgaccaacgttgtaaaacccgcaataggtacatttgccaattcgcgcaggagcacataagtcgctgggggcctggcagttag

SEQ ID NO: 10582 - DNA, 1425 bp, Artificial Sequence
  Description of Artificial Sequence: Synthetic coding sequence
atggcggacatgcagaatcttgtagagcggctggaacgcgctgtgggaagacttgaggcggtttctcacacgtctgacatgcaccgaggctatgcagatagtccatccaagggtgccgctccgtatgtccaagccttcgacagccttctagcgggacctgtggctgaatatctcaaaattagcaaagagatagggggagacgtgcagaagcatgccgagatggtgcatactggtctgaaactggagcgcgctctgctggtcaccgcctcgcagtgtcaacagcctgctgaaaacaagttgtccgacctcctggcacccatcagcgagcagatcaaagaggtgattaccttccgggagaaaaacaggggctccaaattgtttaaccacctgtctgccgtgtccgaaagcatccaggctcttgggtgggtggccatggctccaaaacctggcccttacgtgaaggagatgaatgacgctgcgatgttctatacaaaccgtgtgctgaaggagtataaagatgtagataagaagcatgttgactgggttaaggcatacttatcaatttggacggaactgcaggcctatattaaggaattccacacaacgggcctggcatggagcaaaactggtcccgttgctaaggaacttagtggcctgccctccggaccaagcgctggctcatgccctccccctccacccccatgcccaccgccaccgcctgtgtctacaatatcatgcagttatgaatctgcaagccgtagctcgctgttcgctcagatcaaccagggggaatccatcactcacgccctgaaacatgtgagcgacgacatgaagacccacaagaaccccgctctgaaggcacagtccggccctgtgagaagtgggccaaaacctttttcagctcccaagccccagaccagtccatcccctaagcgagcgaccaagaaagaacccgctgtgctagaattagagggcaaaaagtggcgagtggagaaccaggaaaatgtttccaatctagtgattgaagacaccgaactaaagcaggtggcctatatctataagtgcgttaatactaccttgcagatcaaagggaagatcaattccatcactgtcgataactgtaagaagctcggcctggtattcgacgatgtggtgggaattgtggaaatcattaattccaaagacgtgaaagtacaggtgatgggaaaggtgccgaccatctccattaacaaaacagatggatgccatgcctatttatcgaaaaacagcctggattgtgagatcgtctccgcaaagagttccgagatgaacgtcttaattccaaccgagggaggagattttaatgaattcccggtgccagagcagttcaagacgctgtggaacggacaaaaactcgtgacaactgtgactgagattgctgggtag

SEQ ID NO: 10583 - DNA, 360 bp, Artificial Sequence
  Description of Artificial Sequence: Synthetic coding sequence
atgaataagatcctgtcatctaccgtgtgcttcggactcctcacattgttgagtgtcctttcttttctccagtctgtacatggacgaccctatctcacgcagggcaacgaaatcttccccgataagaaatacaccaaccgggaggaattactgctggccttgctgaataagaacttcgattttcaaaggcctttcaatactgacttggcgctgccgaataagctggaggaactcaatcagttagaaaagctgaaagaacaactggtcgaggagaaggattcggagactagttatgcggtggatggcctgttctctagtcacccatcaaagcgggcttgcttttggaaatattgtgtgtag

SEQ ID NO: 10584 - DNA, 3756 bp, Artificial Sequence
  Description of Artificial Sequence: Synthetic coding sequence
atgcgcttgctgctgctggtccctctgttgctggccccagcacccggatcctcggcccctaaagtacgcagacagtccgacacatggggaccatggagccagtggtccccttgctctagaacctgtggcggaggggtcagtttccgcgagaggccttgttatagtcagagacgagacggaggctctagctgcgtgggaccagcacgcagccaccgatcatgcaggacagagagttgtcccgacggggctagggattttcgggcagaacagtgtgcggaattcgatggagcagagtttcaagggcgtcgttaccggtggcttccatattattctgccccaaacaagtgtgaattaaactgtattcctaaaggcgaaaacttttattacaaacatcgagaggctgtggtcgacggaaccccttgtgagcccggtaagcgggatgtttgcgtggacgggtcctgcagagtcgtcggctgcgatcacgagctggattctagcaagcaggaagacaaatgcctacgctgcggcggagatggcacaacctgttatcccgtagcgggtaccttcgatgcaaacgatctgagtagagcagtgaaaaacgtccgcggagaatactacctgaatggtcattggactattgaggccgctagggcacttccagcggcatctaccattctgcattacgagagaggagcggaaggggatctggctccagagcggctgcatgctcgcggtcccacgagtgaaccactggttattgaactcatcagccaggagcccaaccccggagtgcactatgaatatcacctgccactgaggagacccagtcccggttttagttggagccatgggtcttggagcgattgtagtgcagaatgcggtggcggtcaccagtcgagacttgtgttctgcaccatcgatcatgaagcgtatcctgaccacatgtgtcagcggcaaccgaggccagccgataggcggagctgtaatttgcatccctgtcctgagaccaagcgctggaaggccggaccttgggcgccatgttcggcaagctgcggaggcggttcgcagtctagatccgtgtattgtatatccagcgatggagcaggcatccaagaagctgttgaggaggcagagtgtgcgggactgcctggcaaacccccagcaattcaggcatgcaacctgcagcggtgtgcggcatggagtccagagccatggggggaatgctcagtgtcctgtggtgtaggcgtccggaagagatcagtgacctgccggggtgaaagaggttccctccttcacacggccgcatgttcattggaggaccggcctcctcttactgagccatgcgtgcatgaggactgcccgctgctatccgaccaggcttggcatgttggaacctggggcctttgtagtaagtcctgctcttcagggactaggcggagacaagtgatctgcgctattgggcctcccagtcattgtggctctctgcagcacagcaaacccgtcgacgtggaaccgtgcaacacccagccttgccacttgccccaagaggtgccctcaatgcaagatgtgcatacgcccgcttccaatccatggatgcctctgggccctcaggaatctcctgcgtctgactctaggggacagtggtgggcagctcaagagcaccctagcgcccgtggggaccatcggggtgaaaggggagatcccaggggagaccaaggtacccatctttccgctctgggaccagccccatctcttcagcagcccccttaccagcaacctctccgaagcggcagtggaccacacgattgcaggcacagcccgcacgggtgttgcccagatggacacaccgcctcgttgggccctcaatggcagggttgccccggagcaccctgccaacagtctcggtacggttgctgtcccgatcgagtgagtgtggcagaagggcctcaccacgccggatgcactaagtcctacggcggagactcaacagggggaatgccgcgttctagagccgtcgccagcaccgtccataacacacatcagccccaggctcaacaaaacgaaccttctgaatgtagaggttcacagtttggatgctgctatgataacgtggccacagccgctggcccactcggcgaagggtgtgtcggtcagcctagtcacgcataccccgtgcggtgtctcctaccgagcgcccatggatcatgtgcggattgggccgctagatggtattttgttgcaagcgtgggccagtgtaacaggttttggtacggtgggtgtcatggcaacgccaataactttgccagtgaacaagagtgcatgagcagctgtcaaggtagcctgcacggtcccagaaggccacagcctggcgctagcggcagatcgactcacacagatggcggaggctcgagcccagccggagagcaggaaccctcacaacatcgaacgggggctgctgtccagcgtaaaccctggccaagcggcggattatggcgccaagaccagcaacccggtccgggtgaggcccctcacacccaggctttcggcgagtggccatgggggcaggaacttgggtccagggcccctggcttaggtggcgatgcgggtagcccagcacccccttttcacagcagcagttaccgaatctccctggcgggagtggaacccagcctggtccaggccgctctcggacaactggtgagactgtcatgttccgatgacactgcacccgagtcgcaagcagcatggcagaaggacggccaaccaatttcttccgataggcacaggctgcaatttgacgggagcctgattatccatccactgcaggcagaagatgcaggaacttatagctgtggtagcacacggcctgggagagattctcagaagatccagctgcgcatcatcggaggagatatggccgtgctgtcagaagccgaactgtctaggttccctcaaccacgtgaccctgcccaggattttggccaagccggtgctgcaggacccttgggcgcaatcccatcatctcaccctcagccagccaatagactgcgtctggaccagaaccaacctcgcgtcgtagacgcctctcccggtcagagaatcaggatgacttgtcgcgcagagggatttcccccaccagctattgaatggcagagggacggacagcctgttagctctcccagacaccagctgcaacccgatggctccctggtgattagcagagtcgccgtggaagacggcggattttacacatgcgtcgctttcaatgggcaggaccgggaccagcgttgggtacagcttcgggtgctgggcgagctgactatcagcgggctgccccctaccgtgaccgtgcctgagggggacactgcacggcttctttgcgtggtggccggagagagcgtcaatatcagatggtcaagaaatggtctccctgtacaggctgacggacaccgtgtacaccagtccccagatggcaccctgttgatttataatctgcgcgcacgggatgagggcagttacacgtgctctgcatatcaggggagccaagctgttagcagaagtaccgaggtaaaagtcgtttcgcccgcacccaccgcccaaccccgagatcctgggcgtgattgcgtggaccagcccgagctcgctaactgcgatctgattctccaggcccagctgtgtggtaatgagtactatagctcattctgttgtgcctcatgctctaggttccaaccccacgcccagccaatatggcagtag

SEQ ID NO: 10585 - DNA, 1731 bp, Artificial Sequence
  Description of Artificial Sequence: Synthetic coding sequence
atggctcagggagtcctctggatcttactcggtctgctcctctggagcgaccccggtactgcttccctccccctgttgatggactctgtaatccaagctttggccgaactggagcaaaaggttcctgccgctaaaacaagacacactgcgagtgcttggttaatgtccgctccaaactcaggtcctcacaatcgtttataccacttcttactgggggcttggtcattgaatgcaacagaattagacccctgtccactgagccccgagctgctgggcctgacgaaggaggttgcacgccatgatgttagggagggtaaggaatacggagtcgtgctggcccctgatggctctacagtcgccgtcgaacccctgctcgccggactggaagcgggattacagggccgtagggtgatcaacttgccactcgactcaatggcagccccatgggagaccggggacacgtttccagacgtcgtggctatcgcgcctgacgtgcgagctacctccagcccagggttacgggatggcagtccagatgttaccacggctgacattggggctaacacacctgacgccacgaaggggtgtcctgacgttcaggcgagtctccctgacgcgaaagctaagagtccacctacgatggtcgattctctcctagctgtcacattggctggtaacctgggacttactttcttaagaggatcccaaacccaaagccacccagatctgggcaccgaagggtgctgggaccaactcagcgcccctaggaccttcactctactcgatccgaaagcgtccctgctaactatggccttcctcaacggcgcactagatggcgtcattctcggtgattatttgagccggacacctgagcctcgaccctccctcagccacttgcttagccagtactacggagctggggtcgcccgagatcccggttttcggagcaattttcgaagacagaatggggctgctctgacctctgcctcgattttggcacagcaagtttggggcaccctggtgctgctgcagagactggaacctgtgcatctccagctacagtgcatgtcccaggaacagttggcgcaagtagcggctaatgctacaaaggagtttactgaggccttcctaggctgtcctgccatccatcctcgatgtcgttggggcgcagcaccctatcgagggaggcccaagcttctgcagctgccgctgggctttctctacgtacaccacacttatgtccctgcaccaccctgtacagacttcacccgctgtgcagctaacatgcggagcatgcaacgttaccaccaggacacacaggggtggggggatattggttactccttcgttgtgggttctgacggatacgtgtacgaggggcgaggttggcactgggtaggggctcatactcttggacataatagcagaggctttggcgtagccattgtggggaactacaccgcagccttgcccacagaggcggctcttcggacagtccgcgacaccctaccctcctgtgccgttagggccggactgttgcggcctgattacgccctgcttggccacagacaacttgtgcggactgactgccccggagacgctctgttcgacctgttgagaacgtggccccatttcacagctaccgttaagccaaggccggcacgctcagttagtaaacggagccgtcgggaacctcctccaaggaccctgcctgccacagacctgcagtag

SEQ ID NO: 10586 - DNA, 846 bp, Artificial Sequence
  Description of Artificial Sequence: Synthetic coding sequence
atgttgcctaaaagtagaagagcgctgaccatccaagaaatagccgcattggccaggtctagcctgcatggaatctcacaggtggttaaagaccatgtgaccaaacctactgcaatggcccagggccgtgttgctcacctgattgagtggaaagggtggagcaagcccagtgattctcccgcagctcttgagtccgcattcagctcgtacagcgacctgtccgagggagaacaggaggctaggttcgccgcaggagtcgcagaacagtttgccattgcagaggctaagctgagagcatggagctctgtggacggcgaggattcaaccgatgattcttacgatgaagactttgcaggcggaatggacactgacatggccggtcagctgcctctcgggcctcaccttcaggatctgttcacagggcacagattcagtcggccagttcgacaggggtcagttgaacccgagagtgactgttctcaaacagtgagtccagatacattgtgcagtagcctgtgctccctggaagatgggttgctgggaagcccggcacgcctggcgagtcagcttcttggcgacgagctactgctcgcaaaacttcctcctagccgggagtcagcgttccgatccttaggcccactggaggcacaagatagcctttataattcccctctgacagagagctgtcttagtcctgcagaggaggaacctgctccctgcaaagattgccaaccactctgccccccattgactggatcttgggaacgacaacgtcaggcaagcgacctggcttcttctggggtggtgtctcttgacgaggacgaggccgagccggaagagcaatag

SEQ ID NO: 10587 - DNA, 2619 bp, Artificial Sequence
  Description of Artificial Sequence: Synthetic coding sequence
atgggaatcgtgtggatcttgatgagcgtgttgccttggtggggaagatgcgcagatctcgcgatagcctccacgcagctggttccctcaacggcctctgctagaatggctctgagtagccagctcatgggtaggacagtgtggacccctatgagcgcttcagcactacaggaacctgcataccctgcacttgctaggactagcagggctcccagcgcggctagtgtcccattagcttcccggtgtcgagtaacgacggccctgatttcaacatctgcccagagatccccaacgtctgcgtctctggcaccggtcccaacagcactgggggctagttctgcaagcgctcatctcgccctgtcctccctcacaatggggaccgtggccctcacccacggaagagtctctgctagcccagtgctgcggctgggcagcgcccgttgtccaaaactgtccacccctccaaggcctgctgcagccgctgtacgagggctgggcagagccggagagaccccagccaactgcgtgcctaggcgtgcagttccagggcctgatgattctcgcgaggacgtcaacgagtgcgcggagaaccccggtgtgtgcacaaacggtgtatgtgtcaatacggacggcagcttcagatgtgagtgtccgttcggctattccctggacttcaccggcataaattgcgttgacacggacgaatgctcagtcgggcacccttgcgggcaggggacctgcactaacgtgattggaggcttcgagtgcgcctgcgctgatggtttcgagcctggactgatgatgacctgcgaagacattgacgagtgctccctcaatccactgttgtgcgcgttccggtgccataatactgaggggtcctacctctgcacctgccccgctgggtatacccttagggaagacggcgcaatgtgcagggacgtggacgagtgcgctgacggacagcaggactgtcacgcacgaggcatggaatgtaagaacctcatcggaacattcgcatgcgtttgccctcccggaatgaggcctttgccgggtagtggagagggctgcaccgacgataacgaatgccatgctcaaccggacctttgtgttaacggtcggtgtgttaacaccgcaggtagcttccggtgcgattgtgacgaaggattccagccttctccaaccctcaccgagtgtcacgacatcagacagggcccatgcttcgccgaggtgctgcagacaatgtgccgaagtttgtcgtcctcatctgaggcagtgacgagagccgaatgttgctgcggcggtgggaggggctgggggcctaggtgcgagctctgccccctgcctggcacgtctgcctaccgcaagctctgcccgcatggctcaggatataccgccgagggcagggatgtggacgaatgccggatgctggcccacctatgcgcacacggcgagtgtatcaattcactgggtagcttcagatgccactgccaggccggttatactcccgatgcgaccgcaaccacgtgtctggacatggacgaatgctcacaggtgccgaagccatgtacgtttctctgcaagaataccaagggttctttcctgtgttcctgtcccagaggctatctgctggaggaggatggaagaacatgcaaagatttggatgagtgtaccagtcgccagcacaattgtcagtttctgtgtgttaatacagttggggcatttacttgccggtgcccccctggattcacacaacatcatcaagcgtgtttcgacgtcaacgaatgtgacggtcctcatagatgccagcatggttgtcagaatcagctgggcggttatagatgcagctgtcctcaggggttcacccagcactcacagtgggcacaatgcgttgatgagaacgagtgtgccctaagccctccaacgtgcggatccgcaagctgtcgcaatacgcttggcggatttcggtgcgtgtgtccttctggctttgatttcgaccaggccctaggcggatgccaggaagtggatgagtgcgccggacgaaggggcccttgttcatactcgtgtgccaataccccaggcggtttcctgtgcggttgtccacagggttatttccgggcagggcagggtcattgcgtttccggactcggcttttctcccggaccacaggatacgcctgataaggaggagctgctgtcctcagaagcctgttacgagtgcaagatcaatggcctgagtccacgcgaccggcctcgtaggagcgctcacagagaccatcaggtgaacttggcgaccctcgattcagaagccctgcttacactaggactaaatctgtcccacttaggacgggctgagaggatattggagttgcgacccgctctggaggggctagagggcaggatccgatacgttatcgtcagaggcaacgagcagggattcttccgtatgcatcacctccggggagtgagttctctgcagctgggcaggagaagacccggaccaggaacctaccgtctggaggtagtaagccacatggcaggcccttggggggttcaaccagagggccaaccaggaccctggggccaggccttgcggctgaaagtgcagctgcagctcctttag

SEQ ID NO: 10588 - DNA, 1368 bp, Artificial Sequence
  Description of Artificial Sequence: Synthetic coding sequence
atggctaggaaggcactcaaactcgcctcttggacaagcatggctctggccgcttctggtatctatttttatagcaacaagtatttagacccgaatgattttggagccgtccgtgttggccgtgccgtcgccaccacggctgtaatcagctacgattatctgacatcactcaagtctgtgccatacgggtctgaagagtacctccagctgcggtccaagatccatgacttgttccaatcatttgacgacacaccgctaggcaccgcatctctggcacaggtgcataaggccgttctgcacgacggcagaaccgttgccgtcaaagtccagcatcccaaagtccgcgcacaaagctccaaagacattctccttatggaggtgctggtgctggccgtgaaacagttgttccccgaattcgagtttatgtggctggttgatgaagctaagaaaaacttacccttagagttagatttccttaatgaggggagaaacgcagagaaagttagtcagatgttgcggcattttgattttctgaaagtgcctagaatccactgggacctgagcacggaacgtgtccttctgatggaatttgtggatggaggacaagttaatgacagggattatatggagcggaataaaatcgacgtgaatgagatatccaggcacctggggaaaatgtatagcgagatgatttttgtgaacggcttcgtgcactgtgatccacaccctggtaatgtcttagtgcgcaagcatcctgggactggcaaagctgagatcgtgttactcgatcatggactgtatcagatgctcacagaagagtttcggttgaactactgtcacctttggcaatccctgatttggacggacatgaagcgcgtgaaggaatacagtcagcgcctgggcgcaggtgacctgtacccactgttcgcgtgcatgttgactgcacgaagctgggattctgttaataggggcattagtcaggcccctgtgaccgccacagaagatttggagatacggaacaacgccgcaaattacctcccccaaataagccacctgttgaatcatgtgccacgacagatgcttttaattctgaaaacgaacgatcttctccggggtattgaggcggcactgggtacgcgcgcatctgctagctccttcctgaatatgtcgaggtgctgtatacgagccctcgcggaacataaaaagaagaacacttgttcattctttcggcgtacccagatttcgttctcagaggcttttaacctgtggcagatcaacctgcacgagcttatcctccgggtaaaaggcttaaagctcgcggacagagttctggccctgatttgctggttgttccctgcccctctgtag

SEQ ID NO: 10589 - DNA, 1245 bp, Artificial Sequence
  Description of Artificial Sequence: Synthetic coding sequence
atgaatccaaccctcggactggctatctttctggctgtgctgctgacagtgaagggtctgctcaagccatcattcagtccacggaattacaaagcgctgtccgaggtacagggctggaaacagcgaatggctgccaaggagttagccaggcagaacatggatttggggttcaagctgctgaaaaaactcgcgttctataatcctggacggaacatcttcttatctcctctgtctatctctacagctttttctatgctctgtctgggggctcaagatagcactctggacgagataaaacagggtttcaatttcaggaagatgcctgagaaagacctgcatgaagggttccactacattatccacgagctgacccagaagactcaggacctcaaactctccatcggtaacacattattcattgatcagcggctgcagccgcagcgtaaattcttagaagacgcgaaaaatttctattctgctgaaacaatccttaccaacttccaaaatttagaaatggcccagaaacaaattaacgatttcatcagccaaaagacccatggcaaaattaacaatctcattgaaaatatcgaccctggaaccgtgatgcttctggcaaactacatcttttttagagccagatggaaacacgagtttgacccaaacgtgacgaaggaggaggacttctttctggagaaaaactcgagtgtcaaagttccaatgatgttccgtagcggcatataccaggtggggtatgacgacaaattgtcatgtaccatcctcgaaatcccttatcaaaagaacattacagccatttttattttaccagatgagggcaaactcaagcacctcgaaaagggtctgcaggtggatacgttctcgagatggaaaacattgctctccaggcgggtggtcgatgtgtctgtccctcgactacacatgactggaactttcgatctgaagaaaactctcagttacatcggggtttcaaagatctttgaggaacacggcgacctgacaaagattgcccctcacagatcccttaaggtcggcgaggcagtgcataaggccgagctgaagatggacgagcgcggtaccgaaggagccgcaggaacaggtgctcagaccttaccaatggagaccccactggtggttaaaattgacaaaccctatcttctcttaatttacagcgaaaagataccgtcggtcctttttctgggcaagattgtgaacccaattgggaaatag

SEQ ID NO: 10590 - DNA, 942 bp, Artificial Sequence
  Description of Artificial Sequence: Synthetic coding sequence
atgtctgacctcctcctcctcggacttatcgggggtttaactttgctattgctccttacactgctcgcctttgcaggctactcgggcctgcttgccggagtcgaagtgagcgctggatcaccaccgatccggaacgttacagttgcatataaatttcatatgggcctctatggggagacaggccgtctgttcactgagagctgttctataagccccaaactgcgctcaattgccgtctattacgataatccgcatatggttcctcctgataagtgccgatgtgctgtagggtcgatcctatccgaaggagaagaaagcccctcccccgaactaatcgacctttaccagaagttcggcttcaaggttttttcttttcctgcaccatcgcatgttgtcactgccacattcccatacacaaccatcctgtctatatggctggccacgcgccgagtccacccagctctcgacacatatatcaaagaacgcaagttgtgcgcctacccgaggctggagatataccaagaggatcagatacattttatgtgccctctggccagacagggcgacttctatgtgcccgaaatgaaagagacagaatggaagtggcgaggtctcgttgaagcgatcgatacccaggtggatggcacaggtgcggacacaatgagcgataccagctcagttagtctggaagtgagccctggctctcgcgagacgtccgccgctactctgtcgcctggcgctagctcaagaggctgggatgacggcgatacaagaagcgagcattcgtactcggaatccggcgcaagcggaagttccttcgaggagctggacttagaaggcgaaggcccactcggggaatctcgcctggatcccggtactgaaccactcggcaccaccaaatggctgtgggaaccgactgcccctgaaaaaggaaaagaatag

SEQ ID NO: 10591 - DNA, 603 bp, Artificial Sequence
  Description of Artificial Sequence: Synthetic coding sequence
atggcctggggcggagtgcacacctgctgctttcatttatgttgttgttgctcttggccacagggggctgtgcccgaggagctccacaaacacccgggacagaccctgcttctacagtgccagtactcacctaaaaggggtccttaccagcctaagagctggtgtcagcaaacatctccgtctcggtgtacattactggtgaccagcagcaaaccgtggacagctgttcaaaaaagtcattataccatctgggacaaacccaacgcgggattctttaatataactatgattcaacttacccaaaacgactcgggattctactggtgcggtatctacaacgctagtgaaaacatcattactgtcctccgcaatatatctctggttgtttcacctgcccctaccaccagcccaatgtggacgctcccttggttacctacttctactgtgcttattacttctccggagggtacatctggacatccctcgatcaatggttcggagacccgtaaaagcagagcacctgcatgcctgggatctggcggacctcggtttcttgtgcttgtgctctgcggactgctgctggcgaagggcctgatgctgtag

SEQ ID NO: 10592 - DNA, 1035 bp, Artificial Sequence
  Description of Artificial Sequence: Synthetic coding sequence
acaactccaagtcgagccctgccaggctggtcaaattgcagacccaggtggcgggcagggccaactccccaatcccccaccccgcagagtcgcatgaggctctcaccgggacccccttctgaatggacctggcttctgccacattttaacccctgccatcaccaccaccgccaccatcatcccaacccaactaccagtcttcttcctaccgaaccgccatcgggcccagaagtgtcttcacagggtcgcgaggcctcttgtgaagggacattgagggctgtggatcccccagtcaggcatcactcatatggcagacacgagggcgcttggatgaaggatcctgctgctagagatgataggatttacgtaactaactactactacgggaattccttggtggaatttcggaacctggagaattttaagcagggccgttggagcaatatgtacaaactcccttataattggatcggaactggccatgtagtataccaaggcgcattctactacaaccgcgcatttacgaagaatattattaagtatgatctacggcaacggttcgtggcgagttgggcactgctccccgatgtggtttacgaagacacaacaccctggaaatggagaggtcacagcgatatcgatttcgcagtggacgaatcaggcctgtgggtgatctaccctgccgtggacgaccgggatgaagcacagccagaagtgattgtcctaagtcgtctcgatcccggagatctctccgtgcatcgggagaccacatggaaaactaggctgcgccgaaactcctacggtaactgcttcctggtttgcggaattctgtacgcagtggatacatacaaccagcaggagggccaggtagcctacgctttcgatactcatactggtaccgacgcgagaccccagctgcccttcctgaacgagcacgcttacaccacccagatcgattataatcccaaagagcgggtcctctacgcttgggacaatggccatcaactgacctacactcttcacttcgttgtctag

SEQ ID NO: 10593 - DNA, 2682 bp, Artificial Sequence
  Description of Artificial Sequence: Synthetic coding sequence
atggctgaggccgctctggaggcggtaagaagcgaactgcgcgaattccccgctgccgcaagagaactttgtgtccccctcgctgtaccttatctggataaaccccctacccctcttcatttctaccgggattgggtgtgccctaaccggccttgtattatcagaaacgccctgcaacactggcccgctttgcagaaatggtctttaccatattttagagctactgtggggtcaacagaggtctccgttgccgttaccccagacggctacgccgacgctgttcggggtgaccggttcatgatgcctgcagagcgcagactccctctatcgtttgtgttggatgtcttagaggggcgagcacaacacccaggcgttctctatgtgcagaagcagtgcagtaatctgcctagtgaactgccccagctgctgcccgacctcgagtcacatgtcccctgggcttccgaagctctgggaaagatgccagatgcagtgaatttctggctgggcgaagcagccgcagtgacatctttacacaaggaccactacgagaacctctattgcgtggtctctggtgaaaagcacttcttgtttcaccccccatctgaccgtccttttatcccatatgaactctatacacctgccacataccaattaaccgaagagggaacgtttaaggtagtggatgaggaagccatggagaaagccgaggtgtccaggacctgtctgttgacagtccgggtgttgcaagcacataggttgccgagtaaagacctcgttactcccagcgattgctatgtgaccctgtggttacccaccgcgtgcagccatcgtctgcaaacccgcacggtgaagaattcgtcctccccggtttggaaccagtcatttcacttcaggatccacaggcagcttaagaacgtgatggagcttaaagttttcgaccaagacctggtaaccggcgatgatcctgtgctttcggtgttatttgatgctggcactcttcgtgccggtgagtttaggagagagagcttcagcctctcccctcagggcgaggggagactggaagtcgagttccggttacagagtctggccgatcgaggagagtggctcgtgagtaatggcgtgctcgtggctagggagctgtcatgtcttcacgtacaactggaagaaactggagaccagaagagcagcgaacatagagtacaactggtagttccaggatcctgtgagggccctcaggaggcgagcgttggtacaggtacttttaggttccactgtcctgcctgttgggagcaggaactgtctatccgcctacaagatgcacctgaagagcaactcaaagcccctttgtccgcacttcccagcggccaggtggtcagactcgtattccccactagccaagagccactgatgagggtggaactcaagaaggaagctggactgcgcgagcttgcagtgcggcttggatttggtccctgtgccgaggaacaggccttcctgtcaaggcgcaagcaagtagtggccgcagcccttcgccaagctctacagctcgacggtgatttacaggaggatgagataccagtcgtggcaataatggctaccggtgggggtatacgcgctatgacctccctttatggccagcttgctgggctgaaagagctcggcctgctggactgtgtgagttacatcacaggggcatcagggtccacatgggctctggcaaacttatatgaggacccagaatggagccagaaggatctggctgggccaacggaactgctgaagactcaggttactaagaacaagctgggcgttctggctccctcccagttgcagcggtatcgccaggaattggccgaaagggctcggttgggctaccccagctgtttcactaacctttgggcgttgataaacgaggccctacttcacgatgaacctcatgaccacaaactgtcagaccaaagggaggccttgtctcatggacagaaccccctgcccatttattgtgcccttaataccaaggggcagtcattgactacattcgagtttggagagtggtgcgagttttcaccgtacgaggtgggtttcccgaagtatggcgcattcattccttccgagttgtttggcagcgagtttttcatgggccagctgatgaagcgactgccagagtcccgaatttgttttctggaaggaatttggtccaacctatacgccgctaatttacaagactccctgtactgggcatcagaacctagccagttctgggatagatgggtgagaaaccaggccaatcttgataaggagcaggtacctctcctgaagatcgaagagcctccttccaccgctggccgaatagccgagtttttcaccgatctgctgacatggagacctctcgcacaggctacacacaatttcttgcgcggactccactttcacaaggattacttccagcacccccacttttcaacatggaaggccacaacgctcgatggcctgcctaatcagctgactccttctgaaccccatctgtgcctgctggacgtggggtatctcatcaacacctcttgcctgcctttattacaacctacgcgcgacgtggatttaatcctttcgctggactacaacctgcatggtgcctttcagggcagtggaggccaccccagacgacgccagttaggcagatag

SEQ ID NO: 10594 - DNA, 354 bp, Artificial Sequence
  Description of Artificial Sequence: Synthetic coding sequence
atgattatcgattcatcccgcatccccagtttcactcagctgcactcaactatgacaagggccccactgctattgctctgcgtggccctggttctcttagggcacgttaacggcgctacagtcagaaacgaggataagtggaagccactgaataatcctcgcaacagggacctgtttttcagaaggttgcaggcttatttcaaggggagaggcctggatcttggaacatttccgaatccgttcccaaccaatgagaaccccaggcctctctccttccagtccgaacttactgccagtgcatcggcagattatgaagaacaaaagaatagcttccacaactacttaaagggctag

SEQ ID NO: 10595 - DNA, 4143 bp, Artificial Sequence
  Description of Artificial Sequence: Synthetic coding sequence
atgagacacggggtcgcatgggccctgctggttgcagccgctttaggtctgggagcccgtggcgtgcgcggtgctgttgctttggcagacttttaccccttcggtgcagagaggggagacgcagtgactccgaagcaggatgatggcggatctggtttgcgcccactgtccgttcccttcccctttttcggagccgaacacagcggactttatgtgaacaataatgggataatcagctttctcaaggaggttagtcagttcactccagtcgccttcccaattgcgaaggataggtgtgtggtggccgctttctgggctgacgtggacaatcgcagggccggagatgtctactaccgggaagctactgatcctgcgatgttgcgcagagctaccgaggatgttagacactatttcccggagctgctggattttaacgccacctgggtatttgtcgcaacttggtatcgagtcacctttttcggtggcagttcgtccagcccagtgaatacatttcagaccgtgcttataactgatggcaaactgtcctttactatcttcaattacgagtcaattgtgtggacaacaggcacccacgcatccagcggcggaaacgctacaggcctgggcggtatcgccgctcaggccggttttaatgcaggcgatggtcaacggtacttcagcatccccggtagtcggacagctgacatggcggaggtggaaacaacgaccaacgtgggggtccctggcagatgggcttttaggattgacgatgcccaggtccgcgtggggggttgtggccatactacatcagtgtgcctggcacttcggccatgcctgaatggcggaaagtgcatcgacgactgcgtgaccggaaacccctcttatacttgcagctgcctgtccggatttacaggtagacgatgtcaccttgatgtgaatgaatgtgcatctcagccatgccaaaatggcggaacttgcacacatggaatcaacagttttcgctgtcagtgtcccgcaggtttcggtgggcctacttgcgaaacagcgcagtcaccatgtgacaccaaggaatgccagcacggagggcaatgtcaggttgagaatggaagcgccgtctgcgtctgccaggccggatacaccggcgcagcatgcgagatggacgtggacgactgtagtccagatccttgtcttaacggtgggtcctgcgtggacctggtaggtaattacacatgcctgtgcgctgagcccttcaaaggactccggtgtgagacaggtgatcaccctgtgcccgatgcctgtctatcagcaccctgtcacaacggcggaacctgcgtcgacgccgatcaaggatacgtgtgtgagtgtccagaaggattcatgggcctcgactgtagggagcgtgtgccagatgattgcgaatgcaggaacggaggacgttgtcttggtgcaaataccactctgtgtcagtgtcctttaggcttttttggcctcctatgtgaattcgaaatcaccgcaatgccttgcaatatgaatactcaatgtccagacggaggctactgtatggaacatggtggatcctacctgtgcgtctgccacactgaccataacgcgtcccattctctgccgtccccctgcgacagcgatccatgctttaacggcggaagctgtgacgcacacgacgatagttatacttgtgaatgccctaggggcttccatggaaagcattgtgaaaaggctcgcccacacctatgctcctcagggccttgccgcaacgggggaacatgcaaagaagcaggcggagagtaccactgttcttgtccatacaggttcactggcaggcactgtgagatcggtaaacctgatagctgtgccagcggaccctgtcataacgggggaacctgcttccactatattggcaaatacaaatgtgactgcccccctggcttttctggcaggcactgtgagattgctccatctccgtgtttcagaagcccatgtgtgaacggcggtacctgtgaagacagggacacagactttttctgccactgtcaggctggatacatgggcagaagatgtcaagcggaggttgattgtggacccccagaggaggttaaacatgcgactctgcgctttaacggaacaagactgggcgctgtggcgttgtatgcgtgcgatcggggttactctctatctgccccatcccggatccgagtctgccagccccacggcgtttggtcggaacctccacagtgtctcgagattgacgaatgtcgctcacagccatgtttgcacgggggatcctgtcaggacagagtagcagggtacctatgcctgtgctccacgggttacgagggagcccattgcgagttggaaagggatgaatgtcgggctcacccctgccgcaatgggggtagttgtaggaatcttccaggcgcatatgtgtgtagatgcccagctggctttgtcggcgttcattgcgagacagaggtggacgcgtgcgattcctccccttgtcagcacggagggcgttgcgaaagcggagggggagcctacctctgcgtatgcccagagtctttctttggttaccactgtgaaaccgtctcggacccttgcttttcctctccatgtgggggtaggggctattgcttagcctcgaatggctcccacagctgcacctgcaaagtgggatacaccggagaagattgtgctaaggagttatttccccctactgcgttaaagatggagagggtcgaagagtctggggtgtccatcagctggaatcccccaaatggacccgctgcacggcagatgctcgacggatacgcggtgacctacgtcagtagcgatgggagctatagaagaactgatttcgtcgatcggactagatccagtcaccaactgcaggcactagcagccggtcgtgcctataacatctctgtcttctccgtcaagaggaatagcaataataagaatgacatctctcggcctgctgtgctcctcgccaggaccagaccccgtcctgtagaaggctttgaggttaccaacgtgactgctagtacaatctcagtccaatgggctcttcatcggatccgtcacgcaacagtctcaggcgtcagagtgtccattcggcaccccgaggccctgcgggatcaggccaccgatgtggatcgcagtgtggatagatttaccttccgggcacttctgccgggaaagaggtacaccatccagctcactacgttgagtggactccgtggcgaggaacatcccacggaatccctcgcaactgcaccaactcacgtgtggacacgccctctgccacctgccaaccttacggcggcaagggttacagccactagtgcacatgttgtgtgggacgctccaactccgggttcgctactggaagcttacgtgattaacgtgaccaccagccagtccactaaatcaaggtacgtccctaatgggaagcttgcttcctacaccgtgcgcgacctcctacccggtaggcggtaccaattaagcgtcatcgccgtccagtcaactgaattgggaccacaacacagtgaaccagcccacctttacattatcacttcacctagagacggcgcagacagacgctggcatcagggcggacatcacccaagggtgctgaaaaataggccccctccggctcgcctacccgagctccgcctattgaatgaccatagtgctccagagactcctacccagccacctaggttttccgaattggtcgacggacgaggacgggtcagtgcacggtttggaggatcgcccagcaaagctgcgacagtgaggtcacacgttcccggtaactgcagtgagaacccttgccaaaacggcggtacatgtgtcccaggtgcagatgcccactcctgcgactgtggcccaggttttaagggccgacgctgcgagctcgcctgtatcaaggtttcacgaccgtgcacacggttatttagcgaaactaaagcattccccgtgtgggaaggcggtgtttgccaccatgtgtacaaacgagtttatagggtgcaccaagatatctgtttcaaagagtcttgtgaatcaaccagcttgaagaagacaccaaacaggaagcagagcaaaagccagaccctcgagaagtcctag

SEQ ID NO: 10596 - DNA, 474 bp, Artificial Sequence
  Description of Artificial Sequence: Synthetic coding sequence
atggaagccctgcgcagggcacacgaagtggcgcttagactgctgctctgtcggccatgggctagccgggcagctgctcgtcctaagccatccgcctcggaggtcctcaccagacaccttctccagcgacgtttgcctcactggacctctttctgcgtcccctatagtgccgtgcggaacgatcagttcggactctctcactttaattggcctgtgcagggcgcaaattatcacgtgcttaggacgggctgttttcccttcatcaagtaccattgtagcaaagccccttggcaggacttggctcggcagaatagattttttacagccctcaaggtagtcaacctgggaatacccacgctgctgtacgggctgggatcctggctgttcgccagagtaaccgagacggtccacacttcctatggccctatcacggtttactttcttaataaggaggacgaaggcgcaatgtattag

SEQ ID NO: 10597 - DNA, 288 bp, Artificial Sequence
  Description of Artificial Sequence: Synthetic coding sequence
atgaaaggatcccgggcactgctgctggtggcccttactcttttttgtatctgtagaatggccaccggggaggataatgatgaattctttatggacttcctccagaccctcctggtggggaccccagaagagctgtacgagggaacactgggcaaatataatgtcaatgaagatgcaaaagcagctatgactgagcttaaaagctgcatagacggccttcagcccatgcataaggcagaactcgttaaactgctagtccaggttttgggatctcaggatggagcctag

SEQ ID NO: 10598 - DNA, 1053 bp, Artificial Sequence
  Description of Artificial Sequence: Synthetic coding sequence
atgaagtgctcccttagagtgtggttcctgagcgtggcctttctgctcgtgtttatcatgtccctcctgttcacgtactcccaccattccatggccacattaccctacttggacagtggagctttggatggtactcatagagtgaaactggtcccaggttacgccggtctgcagagactttcaaaggagcgcctgtccggaaagagctgtgcttgccggcgatgcatgggggatgcaggggctagtgactggttcgattcccatttcgatggcaacatcagcccagtgtggacacgcgagaatatggacctgccacccgatgttcagcgctggtggatgatgctgcagccacagttcaaatctcacaacactaacgaggttttggagaaacttttccaaatcgtgccaggggaaaacccctatcggtttcgggatccccatcagtgccgcaggtgcgcggtggtggggaactctggcaatctgcgtggctctggttacggccaggatgttgacggccacaactttataatgcgaatgaaccaggcccctaccgtggggttcgagcaagatgtaggctctcgcactacacaccacttcatgtaccccgagtccgcaaagaacttacccgcaaatgtctccttcgtcctcgtaccctttaaagtcctcgacctactgtggatcgcctccgccctgtccactggtcagatccggtttacatacgcacccgtgaagtccttcctgagagtcgataaggagaaagtccagatttataatccagcattcttcaaatacattcacgatcggtggacagaacatcacgggagatatcctagtacaggaatgctcgtccttttctttgctctgcacgtgtgcgacgaggtgaatgtctatggcttcggggctgattcaagaggaaattggcaccactactgggaaaacaaccggtacgccggagaatttagaaagaccggcgttcacgacgcagatttcgaggcccacattatcgacatgcttgctaaagcaagcaaaatcgaggtgtatagaggcaattag

SEQ ID NO: 10599 - DNA, 600 bp, Artificial Sequence
  Description of Artificial Sequence: Synthetic coding sequence
atggcttctcccgaagcccctgaatcagtcgttcagtttgcccttgacaaactcggcggactggattatttggtcctgaaccatataggtggagcaccagccggaacacgcgcacgctccccacaggctacaaggtggctgatgcaagtcaacttcgtgtcttacgtgcagctaaccagtcgcgcattgccttctctgacagacagtaaaggctctttagtagtggtgtcaagtctcctgggaagggtacctactagttttagtactccatactccgcagccaaatttgctcttgatggcttttttggctccttgcgaagagaactggacgtacaggacgtcaacgtggccatcacaatgtgcgtgctcgggctgcgcgatagagcctctgcagcggaggctgttcgcggagtgaccagagtgaaggctgccccagggcctaaggcggcactggcagtgatccgcggaggcgctacaagggcggctggcgtgttttacccatggcgttttcgcctcctctgcctgcttcggagatggctgcctagaccccgagcttggttcatcaggcaggagcttaacgtgactgccgctgccgcatag

SEQ ID NO: 10600 - DNA, 411 bp, Artificial Sequence
  Description of Artificial Sequence: Synthetic coding sequence
atggtgcgtccctaccctcttatctactttttgttccttccactcggcgcttgcttccctctgctcgatcggagggagcctaccgacgcaatgggaggtctgggagctggggagagatgggcagacctcgccatgggacctaggccgcactccgtgtggggcagctcccgctggttgagggcgagccagcctcaagcactgcttgtgatcgctcgcggactgcagacgtctggccgtgaacatgcaggctgtcgctttagattcggtagacaagatgagggatcagaggcaactggcttcctgcccgctgctggagagaaaacatctggccctcttggtaacctggcagaagagctgaacgggtactcaagaaagaaaggagggttcagtttccgctttggccgaagatag

SEQ ID NO: 10601 - DNA, 663 bp, Artificial Sequence
  Description of Artificial Sequence: Synthetic coding sequence
atgagaggacagggcaggaaagagtctctttcagatagtcgcgatctcgatggaagctacgatcagctgactgattccgtcgatgatgagttcgagctttctacagtctgccatcgacctgagggactcgagcagctacaggagcaaacaaagtttactaggaaggagctgcaggtgctttataggggctttaaaaatgagtgtccatcaggtattgtgaacgaagaaaatttcaagcagatctactctcagtttttccctcagggcgactcaagcacttacgcaacattcctgtttaacgcctttgacactaatcatgacggcagcgtgagtttcgaagatttcgtcgccggactttccgtgattttgaggggaaccgtggatgatcgattaaattgggcctttaacctttacgatcttaataaggacgggtgcattaccaaagaggaaatgctggacattatgaaaagcatttatgacatgatgggcaagtacacatacccggcactgcgggaggaggccccacgggagcatgtcgagagcttcttccagaagatggatcgtaacaaggacggagtcgtaactatcgaggaattcatcgagagttgccagaaagacgaaaatataatgaggtctatgcaacttttcgacaacgtgatttag

SEQ ID NO: 10602 - DNA, 2175 bp, Artificial Sequence
  Description of Artificial Sequence: Synthetic coding sequence
atgcttaggacatcgacacccaatttatgcggcggactccactgtagagcaccgtggctgtcttccggtatcttatgcttatgcttaattttcttgcttgggcaggtcgggctactccaaggccacccacagtgcttggactacgggccacccttccaaccaccactgcacctggaattttgcagcgactacgaaagcttcgggtgctgcgatcagcacaaggatcgccgaatagccgctcgatactgggatataatggagtatttcgatctgaaacgacatgagctgtgtggcgactacatcaaagatattttgtgtcaggagtgttccccttacgctgcccacctctacgacgccgaaaacacacagacaccactgaggaatcttccaggtctctgttccgactattgcagcgccttccatagtaattgtcactccgcgattagcctgctaaccaatgacaggggactccaggagtcccacggcagggacgggacccggttctgtcacctgcttgacctgccagacaaggattactgcttccccaatgttttacgaaatgactatcttaatagacacctcggcatggtcgcccaggaccctcaggggtgtctgcagctctgtctctctgaggtcgccaacggcctaaggaaccctgtcagcatggtgcatgcaggcgacggtacacatagattctttgtcgctgaacaggtaggtgtcgtttgggtgtatttgccggacggaagccggttggaacagccctttctagacctgaagaatatcgtgctcaccaccccctggataggcgacgagcgcggatttcttggtcttgccttccatccaaagttcagacataatcggaagttttatatttactattcttgtctcgacaagaaaaaagtggagaaaatccgcatctctgaaatgaaggtgagccgggctgacccaaacaaagctgatcttaaatcagagcgggtgatcttagaaattgaagagccggcatctaaccataatggagggcaacttctattcggcctggacggttatatgtatatcttcactggggacgggggtcaggcaggagacccatttggtttgtttggaaacgcccagaacaaatcaagtctgttgggaaaggtgctgagaatagacgtaaacagggccggttcgcatggaaagcggtatcgcgtgccatctgataatcctttcgtgagcgagcccggtgcccatcctgctatttacgcttatgggattcggaatatgtggaggtgtgctgtggaccggggagaccctattacaaggcagggcagaggacggatcttctgcggagacgttggacagaataggtttgaagaagtggatctcatcctaaaagggggaaactatggatggcgggctaaggaagggttcgcgtgctacgataagaagctttgccacaacgcatcactcgatgacgtgctccccatttatgcttatgggcacgccgtgggcaagtcagtcaccggcggttacgtgtacagaggttgtgagtcccccaacttgaatggcctgtatatttttggtgattttatgagcgggaggctgatggcattacaggaagatcggaagaacaagaagtggaagaagcaggacctgtgcctgggctccactacatcctgcgcattcccaggtttgatttcgacccactccaagttcatcatttccttcgcagaggacgaagcaggagaactttacttcctggccacctcatatccgtccgcctatgcaccgcgaggcagtatttacaaattcgtcgacccaagccggagggctccccctggaaaatgtaagtacaagcccgtaccagtgaggaccaaaagtaaaaggatcccttttcgccctctggcgaaaacagtcctggatctgttgaaggagcagtcggaaaaggctgccaggaagagcagcagcgccaccttggcttcgggtcccgctcagggcttgtctgaaaaggggtcttcaaaaaagttggctagtcccacgtccagtaaaaacacacttagaggccctggcactaagaagaaggccagggtgggccctcacgtgagacagggtaagcgacgaaagtcccttaaaagccacagcggaaggatgcgcccttcagcagagcagaagagagccggacgaagtctgccctag

SEQ ID NO: 10603 - DNA, 1218 bp, Artificial Sequence
  Description of Artificial Sequence: Synthetic coding sequence
atgtggtacgtgagcacaaggggggtagccccaagagtcaatttcgagggagcgctgtttagcggctacgcccctgacggtggtctctttatgcctgaagaacttccacagctcgaccggggaacactttgtcaatggagtactttgtcttatcccggtttggttaaagagttgtgcgctctttttatcggctctgaactcctaccaaaagatgagctcaatgaccttattgaccgagccttctcaaggttcagacaccgggaggttgtgcacctgagtcgcctgcggaatgggttaaatgtgctggagctctggcacggagtaacctatgccttcaaggatctatccttatcttgcacaacacaatttctgcagtatttcctagaaaagagggagaagcatgtcacggtcgtggttggcacaagcggggacacgggaagcgcagccatcgagtcagtacagggagcaaaaaacatggacatcattgtgctgctgcccaagggccactgtactaaaatccaggagctccagatgactaccgtgttaaaacagaatgtacatgtgttcggggtcgagggtaatagtgatgagctggatgaacccatcaagaccgtattcgccgacgttgcctttgtgaagaagcacaatctgatgtccctgaattctattaattggtctcgtgtgctagtgcaaatggcccatcatttttttgcttactttcagtgcaccccctccctggacacccacccactccccctggtggaggtggtcgtaccaacgggagcggctggcaatcttgctgctgggtacattgctcagaagatcggccttcccattagactcgttgttgcagtgaataggaatgacataatccaccggacagtccagcaaggtgatttcagtctaagtgaggcggtcaaatcaaccctggcaagtgcgatggatatccaagtgccatataacatggaacgcgtgttctggctcctctctggatcagattctcaggtgacgcgcgctctgatggagcagttcgaacgaacccagagcgtgaacctgcctaaggaactgcactctaagtgggagcgtcaagattacgaaaaaatggctgttatggagtgtgatggatgctgtgttgagctgtgtctggggaattgcggcccacgtcgcggttcagtgaccgatatccctggcaccgctatggtgcggggaggcggatag

SEQ ID NO: 10604 - DNA, 492 bp, Artificial Sequence
  Description of Artificial Sequence: Synthetic coding sequence
atgactatgcggcacaactggacccctgacttgtcccccctttgggtcctcctcctgtgcgcacacgtggtgaccctcttggttcgcgctaccccagtctcccagactacaacggcggctacagcatcagttcggtctaccaaagatccttgtccctcacagcctccagtgttccctgccgcaaagcagtgcccagcgctagaggtgacctggcccgaggtggaggtccctcttaatgggacattatcactgtcgtgcgttgcctgttcaagatttcccaacttcagcatactctattggcttggaaacggctcctttattgaacatctccctggcaggctgtgggaggggagcacctctagggaacggggaagcaccgggtgggctgaaggaaatttggctccgcatcctcgatcaccagcgctgcagccacagcagtccaccgctgcaggactgaggctcagcacaggtccagctgctgcccaaccctag

SEQ ID NO: 10605 - DNA, 1590 bp, Artificial Sequence
  Description of Artificial Sequence: Synthetic coding sequence
atggctccagccagaaccatggctcgagccagactggcacctgctggcataccggctgtggctctctggctgctatgtacgcttgggttgcaggggacacaagctgggccaccacccgctcctccaggccttcccgcaggagcagactgcctgaatagttttaccgctggcgtccctggttttgtcctagataccaatgcctctgtgagtaatggggcaacatttctggagtccccaacagtacgccgaggctgggactgcgtccgagcatgctgtaccactcaaaattgtaacctggctctggtggagctgcaacccgatagaggagaagacgccatagcagcctgtttcctgatcaattgcctgtacgaacaaaactttgtgtgcaagttcgccccacgggagggcttcattaactacttaacccgtgaggtgtataggtcataccgccaactccgaacacagggcttcggcggttccggtattcccaaggcctgggctggtatagaccttaaagttcagccccaggagccgctggtactgaaggacgttgaaaacaccgattggaggctgctccgaggcgatactgacgttagggttgaaaggaaggatccaaaccaggtggagttgtggggactcaaagagggcacgtatctgtttcaattgactgtcacatccagtgatcaccctgaagacactgctaacgtcaccgtcaccgtcctgtccaccaagcagaccgaggactactgcctagcaagcaacaaggtgggcaggtgtagaggctcattccccagatggtactatgaccccaccgagcagatttgcaagagtttcgtgtacggcggatgtttaggtaataagaataattatctgcgtgaggaggaatgtatcctcgcttgccgcggtgttcagggcggacccctgcgcggtagttcaggggcacaggctactttccctcaaggcccttctatggagcgacggcatccagtttgtagtggcacatgccagcccactcagttcaggtgttcaaatggttgttgcattgacagcttcctggagtgtgacgatactcctaattgcccagatgcttcggatgaggcagcctgtgaaaagtatacttcgggtttcgacgaattacagagaatccattttccttcggacaaagggcactgcgtggacctgccggacacaggactctgtaaggaatctattccacgatggtattataatcccttttccgaacattgcgccagattcacctatgggggttgctatggaaacaaaaataatttcgaagaggagcagcaatgtctcgagtcctgtagagggattagcaaaaaggacgtgttcggtcttagaagggaaatccccatcccatctactggaagtgtggagatggctgtggcagtctttctagtgatctgtatcgtcgtggtggtcgccatactgggttattgcttcttcaagaaccaacggaaggacttccacggccaccaccaccatccccctccaactcccgcaagtagcaccgtgtccacaacagaggacaccgaacacctcgtctacaatcatacaacgcgaccactatag

SEQ ID NO: 10606 - DNA, 1803 bp, Artificial Sequence
  Description of Artificial Sequence: Synthetic coding sequence
atgcagggaccgttgctcttgcccggtctgtgtttcttgctgtccctgttcggggcagtaacccaaaagactaagacgtcttgcgccaagtgccccccaaacgccagttgcgtgaacaacacccactgcacttgcaaccacggatacacatctggctcgggccagaagttattcactttcccattggaaacatgcaatgacactacgtcctcgaaaaccacggaaggacggaaggagcttcagaagatcgtggataagttcgagtcactacttacaaatcaaaccttatggcgcacggagggtcggcaggagatatccagcacggcaacaactattttgcgtgacgtggagagcaaagttctcgagacagcgttgaaggaccctgaacagaaagtattgaagatccagaatgacagtgtggccatagaaactcaggccatcactgacaattgttccgaggagaggaagacattcaatctgaacgtgcagatgaattctatggatatcaggtgctcagacattatacagggggatacccaggggccaagcgctatcgcattcatttcctactcaagcctcggtaatattattaatgccaccttctttgaggagatggacaagaaagatcaggtctaccttaattcacaggtcgtaagcgctgctatcgggcctaaacgtaacgtgagcctgtccaaaagcgtcacactgaccttccagcacgtgaagatgacccccagcacaaaaaaggtgttttgcgtgtactggaagtcaaccgggcaggggagtcagtggagtcgggacggatgcttcctcattcacgtgaacaagtcgcatactatgtgtaactgtagtcacttatcaagtttcgccgtacttatggctctgaccagtcaagaggaagatcctgtgctaactgtgatcacttacgtgggcctgtctgtgtcccttctgtgtctacttttggctgccctcactttccttctgtgtaaagctattagaaatacaagtaccagcctgcatttgcagttatcactatgcctctttcttgctcacctgctttttctggtgggaatcgacagaaccgaacctaaggtcctatgtagcataatcgccggagcactgcactacctgtacctggccgcatttacctggatgctgctggaaggtgtgcatctgtttttgacagcacgcaaccttacagtggtgaactactcctccatcaatcggctgatgaagtggattatgttccctgtgggatacggcgtgccagccgtgacagtcgctatcagcgccgcttcttggccccacttgtatggcactgcagacaggtgctggcttcatttggatcagggattcatgtggtccttcctaggccctgtctgcgcgatcttctcggcgaatctggtccttttcattttagttttctggatcctgaagcgcaagttgtcctctctgaattcagaggtttccaccattcagaacaccaggatgctggcctttaaggctacagcccagctattcattctgggatgcacttggtgtctgggcctgctgcaggttggtcccgctgctcaagtgatggcttacctattcaccatcatcaatagcctccagggcttttttattttcctggtgtactgtctgttaagccaacaggtccaaaaacagtatcaaaagtggttccgcgaaattgtgaagagtaagtcagaatccgagacgtatactctgtcctcaaaaatgggtccagatagcaagccaagcgagggcgacgtgtttcctggccaagtgaagcgtaagtattag

SEQ ID NO: 10607 - DNA, 660 bp, Artificial Sequence
  Description of Artificial Sequence: Synthetic coding sequence
atgaagttgctgctgtgggcctgtattgtgtgcgtggcgttcgctcgcaaacgaaggtttcctttcataggagaagacgacaacgacgacggccaccccctccacccgagtttgaatataccatacggaataagaaatttaccccctccactgtactaccggcctgtcaataccgtgccctcctatcctggaaatacatataccgacactggtttaccaagttacccttggatcctgacctccccaggattcccttacgtgtaccatattcgagggtttccactggcaacacaattgaacgttcccccactgccaccgagaggttttcctttcgtgcctccatcacggttcttctctgctgcagcagctccagcagcaccacctattgccgcagaacccgcagcggctgcgcctctcaccgcgactccagtggcggcagagcccgcagccggagcccctgtggccgctgagccagccgcagaagccccagttggcgcagaacctgctgctgaggcccctgtggccgcagagcctgccgctgaggcgccagtgggagtagagccggctgcagaagagccgtcacctgctgaaccggctactgcgaagcctgccgcaccagagccacatccgagtccttcactggaacaggccaaccagtag

SEQ ID NO: 10608 - DNA, 1743 bp, Artificial Sequence
  Description of Artificial Sequence: Synthetic coding sequence
atgcatctgtcggccgtgttcaacgctctcctggtgtccgtgctggccgctgtgctgtggaagcacgtgcggcttcgggagcacgccgcaaccctggaggaggagcttgctttgagccggcaggccacagaaccggctccggcactccggattgactaccctaaggcattgcaaattctcatggaaggcggtacccacatggtgtgcacgggcaggactcataccgaccgcatctgtaggttcaaatggctctgttacagcaacgaagccgaagagttcattttctttcacggaaatacaagcgtaatgttacctaatcttggaagtaggaggtttcagcccgcactccttgacctgtcaacagttgaggaccacaacacccagtactttaacttcgtcgagctcccggcagccgctcttagattcatgcccaaaccagtgttcgtgccagacgtggcccttattgcaaatagattcaaccctgataatctgatgcacgtgttccacgacgacttgcttccactgttctacaccctaaggcagttccccggactcgcacacgaggcgagactctttttcatggaaggatggggagaaggggctcattttgacctttataagctcctttcacctaaacagcccctgctgcgcgcacagttgaagaccctcgggaggctgttgtgcttctcacatgccttcgtgggactttccaagattaccacctggtaccaatacgggttcgtccagccgcagggacccaaggcgaacattctagtctccgggaacgagatccggcagttcgcaagattcatgaccgagaagttgaatgtgagtcatacaggagtgcctctgggcgaggagtacatactagtctttagccgaacacagaaccggctcatcctcaatgaggcagagctcctgctcgccttggcccaggaatttcagatgaagactgttactgtgagtttggaagaccacacctttgccgatgttgtcaggctggtaagcaacgcatccatgttggtatccatgcatggcgctcagctggtgacgacgcttttcctgcctcggggagccactgttgtggaactgttcccttacgctgtgaatccggatcactacaccccctataaaactctggctatgctacccggtatggacctacagtacgtggcgtggaggaacatgatgcctgagaacactgtaacacatcctgaaaggccttgggatcagggcggaattacccatctggacagagccgaacaggcacgcatcctgcagagtcgtgaagtgccgagacatctatgttgccggaaccccgagtggctctttcgcatctaccaggatacaaaggttgatattccgagcctgattcagaccattaggagagttgtcaaaggacgcccagggcctaggaagcagaaatggactgtagggctgtatccgggtaaggtgcgggaggcacggtgtcaggcttctgtgcacggcgctagtgaggcccgtctgaccgtttcctggcagataccatggaatctcaagtatctcaaagtgcgagaagtgaaatatgaagtctggctccaggagcagggagaaaatacctacgtgccttatattctggccctgcaaaaccatacattcacggaaaatatcaagcccttcactacgtacctcgtgtgggtgaggtgtatttttaataagattctgctcggtcccttcgccgatgtcctagtgtgcaacacctag

SEQ ID NO: 10609 - DNA, 5129 bp, Artificial Sequence
  Description of Artificial Sequence: Synthetic coding sequence
atgggcttcctcccaaaactcctgctgttagcctcatttttcccagccggacaggcaagttggggagtcagctcgccccaggatgtgcagggggttaaggggagctgccttttgataccatgtatattcagcttccccgcagatgtagaggtcccggacggcattactgcaatttggtactacgattactctgggcaacgacaagtggtgagccattctgcggatccgaagctggtggaggccagattccggggtcggacggaatttatgggcaaccccgagcatagagtctgtaatcttctcttgaaagaccttcaaccagaggacagcggaagttacaattttaggttcgagattagcgaggtaaaccggtggagcgatgtgaaggggacgttagtgaccgtgaccgaggagccaagagtgcctactatcgcatcccccgtggaattgctggaggggactgaggttgattttaactgcagtaccccctacgtttgtctgcaggaacaggtccggctgcaatggcagggccaggatcctgcacggtctgtgaccttcaacagtcagaaattcgagccaacgggcgtgggtcaccttgagacactgcatatggcgatgtcctggcaggaccatggtaggatactgaggtgccaattgtctgtcgccaatcatcgggcacagtctgaaatccacttgcaggtgaagtacgctccgaagggcgtgaagatcctcctaagcccatctggcagaaatatactgcctggagagctagtgactttgacctgccaggtcaattccagctatccggcagttagttcgataaaatggctaaaagacggggtgcgccttcagacgaaaacaggggtgttgcatctcccacaggcggcttggagtgatgccggagtgtacacttgtcaagcagagaatggagtcggttcactggtaagccctcctataagcttacacattttcatggctgaagtgcaggtctcaccagcaggtcccattctggagaatcaaactgtgacattggtgtgcaacacacccaacgaggctccctcagaccttcgctatagctggtataagaaccatgtgctgcttgaagatgcccattcccacacactaaggctgcatctggccacgcgcgctgacactggattctacttctgcgaagtacagaacgtgcacggaagtgagcggagtgggcctgtaagcgtggtcgtgaaccaccctcccctgacgcctgttcttacagcctttctggaaactcaggcaggacttgtgggcatccttcattgttccgtcgtgagcgagccactcgccaccttggtgttgtcccatggcggacacattctggccagcacatccggagattctgatcattcccccagattcagcggtaccagcgggccaaactccttgcggttagagatccgcgatctcgaggagacagattcaggagaatataagtgcagcgccaccaattccctcgggaatgcgacatctaccctggattttcacgctaacgcggcacggcttttgataagccctgcagctgaagtggtggaaggtcaggcagttacactgagttgcaggagtggcttatccccaacaccagacgccagattctcttggtacttgaacggcgctctgctgcatgaaggccctggctctagccttctgctgcctgcagcatcttctaccgatgcagggtcttatcactgccgggctcgcgacggacactcagcatccggcccatcctcgccagcagtgctaactgtgttatacccgcctcggcagccaacgttcactacaaggctggacttggatgcagctggtgcaggggcaggcagaagaggtctcttactgtgtcgggtggactctgaccctcccgctaggctgcagcttctgcacaaagaccgcgtggtcgcaaccagcctcccgtcaggaggtggatgcagcacttgcggcggatgctcaccccgaatgaaagtcaccaaagcacccaatttactgcgagtggagattcacaaccccttattggaagaggagggtctgtacttgtgtgaagcaagcaacgctcttggtaatgcttccacgtctgctacatttaatggccaggccacagtgctggctattgcaccctctcacacattgcaagaaggcacagaagcaaaccttacttgcaacgtctcccgcgaagccgcagggtcccccgcaaacttctcctggtttcggaatggagtgctttgggcccagggacccctggaaactgtgactctcctgcccgtggctcggacagatgcagcactgtacgcctgccgtattctcacagaagcaggtgctcagctgagcacacctgttctgttgagcgtactgtaccctcccgatcgccctaagctgagcgcattgctggatatggggcagggccacatggccctttttatttgtacagtggattcgcggcctctggcactgctggctctgttccacggagagcacctcctcgctacatccctcggacctcaagtccctagccacggtaggtttcaggcaaaggctgaggccaattcactcaagctggaagttagggagctcggtctcggcgattcaggatcgtataggtgcgaggccactaatgttttaggctcaagtaacacttccctgttctttcaggtgaggggagcatgggtacaggtaagcccctcacctgaactccaggaagggcaggccgtggtgctgtcgtgtcaggtgcacacgggcgtaccagagggcactagctataggtggtatcgtgacggccagccactgcaggaaagtacaagcgcaactctccggttcgctgccattacactgacacaggccggagcttaccattgccaggcgcaggcccctgggtctgctactaccagtctggctgctcctatttcgctgcacgtatcttatgccccacggcacgttacacttactacattgatggataccgggcctgggagactgggtctcttactctgtcgagtcgattcagacccgcctgcccagcttagactccttcatggagacaggctcgttgctagtaccttgcaaggggtcggcggaccagagggttcttcccctcggctacatgtggccgtggctcccaatacgctgcggctggaaatccacggtgctatgctggaggacgaaggagtctacatatgtgaagcctccaacacgctcggccaggcctcagcgtccgctgactttgacgctcaggcggtgaatgtccaggtgtggccaggggctacagtgcgggagggccaactggtgaacctgacctgtcttgtatggacgactcatcctgcacagcttacttatacctggtaccaggacggacagcagaggctggacgcccacagcatacctctccccaatgtaactgtccgcgatgcgacctcttatcggtgtggcgtaggtcccccaggaagggccccaaggctaagtagaccaatcactctggacgtcctgtacgccccaaggaacctgcggctgacatatttgctggaatcccacggaggccagctggcactagtgctgtgtacagtggatagtagaccgcctgcgcagctggcactgagccacgcgggaaggctattagcatcctctacagcagcctctgtcccgaatactctgcggctggagctcagaggaccgcagcccagggacgaaggcttctacagctgtagcgctaggagtccgctggggcaagcgaatacttccctggagttgaggctggaaggagtcagggtgattttagcacccgaggccgcagtgcctgaaggcgcacctattacagtaacttgtgctgaccctgccgctcacgcacctaccttatatacttggtatcacaatgggagatggcttcaggaggggccagcagctagcctgtcattcctcgtcgccacccgcgcacacgccggtgcctactcctgccaggctcaggacgcccaggggacacggtcctcaagacccgcagctttacaagtactgtacgccccacaagacgcggttctgtcgagctttcgtgactcccgtgccagatcaatggctgtcattcaatgtaccgtagacagcgagcctccagcagaacttgccctctcacacgacggcaaggtgctcgcaaccagttcgggtgtgcactctctggcatctggtaccggacacgtgcaggtcgctcgcaacgcactcaggctccaggtgcaggacgttcctgccggtgacgacacatatgtgtgcaccgctcagaatctgctgggcagcatttcaacgatcggcaggctgcaggtggagggtgccagggtcgtcgcggagcccggactggatgtgcccgaaggcgctgccttgaatttgagttgtcgcctcctggggggacctggaccagtgggaaactcaacgtttgcctggttctggaatgacaggcgcttgcacgccgagcctgtgcccaccctcgcattcacgcacgtggccagggcccaagctggtatgtaccattgtcttgctgagttgcctacgggggcagccgcatcggcacctgtaatgctgagagtactctacccgccaaagacccccaccatgatggtgtttgttgagcccgaaggtgggctaagaggcattttggactgtcgtgtcgatagtgaacctctggcatcccttaccctgcatttgggcagtaggttggttgccagctcacagccccagggggctcctgccgaaccacacatccacgtgttggcttctccaaacgccttgagggtggacatcgaggctctgcgcccttctgaccaaggtgaatacatatgtagcgcttctaacgtactcgggtccgcctccactagcacctacttcggggtgcgggctcttcatcggctgcaccagtttcagcagctcttgtgggttctcgggcttctggttggcctgcttcttctgttgttagggctgggggcttgttatacttggcggagacgaagggtgtgtaaacaatctatgggggagaacagcgtagagatggcctttcagaaggagactacccagcttattgaccccgacgccgctacttgcgagacatccacatgcgcaccaccactcggata

SEQ ID NO: 10610 - DNA, 693 bp, Artificial Sequence
  Description of Artificial Sequence: Synthetic coding sequence
atgtgcgtgacgtatcataacgggacggggtattgtaagtgcccagagggatttctgggtgagtactgccagcaccgagatccatgcgagaagaataggtgccagaacgggggaacgtgtgtagcacaagcaatgctgggtaaggcaacgtgtcgatgcgcaagtggctttacaggtgaagactgtcagtactctacatctcatccttgctttgtatccaggccttgtttaaatggcggtacgtgccatatgctatcgcgcgatacctacgaatgcacatgtcaggttggctttaccgggaaggagtgtcagtggaccgatgcatgtctgagtcatccttgcgccaatggttcaacctgcaccaccgtggctaatcagttctcgtgcaaatgtcttactggttttaccggtcaaaaatgtgagactgatgtgaatgagtgtgacattcccggtcactgccaacacggtggcacttgcttaaacttgccaggctcgtatcagtgtcaatgtctccagggtttcacaggccaatattgtgattccctctacgttccatgtgcacccagcccgtgtgtgaacgggggaacctgcagacagacaggtgactttactttcgaatgtaattgtttacccgctacatggcccatttttccgaagttactctcgcttcaggaaaaagagtcctactgttag

SEQ ID NO: 10611 - DNA, 660 bp, Artificial Sequence
  Description of Artificial Sequence: Synthetic coding sequence
atgttcgtatcatacctgatactgacccttctccacgtgcagactgccgtcctcgccagacctggtggcgagagcatcggatgcgatgactatttgggaagtgataaggtggttgataagtgtggcgtctgcggtggtgataataccggttgtcaggtagtcagcggggtgtttaagcacgccttaacttcacttgggtaccatagggttgtcgaaattccagagggtgccacgaagatcaacattacggaaatgtacaagtccaacaagaaaaagagccacttaaagcctgcgaccagaggatcccagttctcttcggtaaaagtttgcagcgtgcctgccgcttgtaagttgcttggtactcccggtcgcgcaaggcagcctgtgccggcacccagggaattagaacacgacaagaatagtccccattgtgcctatctttcgttatacttaacctctctcgctcagagcagctggcgggtgtttagtttattcagctatgtgctcatctatttgttttcaaagtacctggccttcaacacgctatttgcattaaaacggatggcgctgcagagagacaggaaagagaagactcgagcatggtgtatatttattaagctctgcggtagggagatccagatcttacccggacctgtgtag

SEQ ID NO: 10612 - DNA, 363 bp, Artificial Sequence
  Description of Artificial Sequence: Synthetic coding sequence
atggacaacgtgcagcctaagataaagcaccgaccattttgtttctccgtgaagggacacgtcaaaatgctgcggcttgctctcactgtcaccagcatgacattttttattattgcacaggctcctgaaccgtacatcgtgataactggcttcgaggtaacggtgattttatttttcattctactgtacgttttgaggctagatagattgatgaagtggctcttctggcctttgcttgtctttgccctcgtgacggcagtgtgctgtctggcagatggcgctctcatctataggaaactactgttcaatccatccggaccatatcagaaaaagcccgtacacgagaagaaagaggtgctctag

SEQ ID NO: 10613 - DNA, 864 bp, Artificial Sequence
  Description of Artificial Sequence: Synthetic coding sequence
atggctccttggtcacacccaagcgctcaactgcagccggtggggggagacgctgtgtcacctgcactcatggtgctgctctgtttgggcaatctcagcaaggcgaccctttgggctgagccaggctccgtcatctcccgtggcaattccgtgactatccggtgtcaagggacactggaggctcaggaataccgacttgtgaaggaaggctcccccgagccatgggacacccagaacccccttgaacctaaaaataaggcaagattcagtatcccatccatgacggaacatcacgctggcaggtaccggtgctattattacagccccgcaggatggagcgaaccatcagaccctttggaattggtggttactggcttctataataaacctacactgagtgcattaccgtctcctgtggtgacttctggcgagaatgtgaccctccagtgtggatctcgcctgagattcgacaggtttatcctcaccgaggagggcgaccacaaactgtcctggaccctcgactcgcaattgaccccctcggggcagtttcaggccctcttcccagttggtcctgtcacacccagccaccgctggatgctgcgctgctacggctctcgcagacacatacttcaagtctggagcgaacccagtgaccttctcgagatccctgtctcaggagcagccgacaatctcagtccaagtcagaacaaatcagacagcggtactgcatcacacttgcaggattacgcagtcgaaaacctaatacgcatgggtatggctggtttgattttagtcgtcctgggaatactgatcttccaggattggcattcccagcggtcaccccaggcagcggcaggccgttag

SEQ ID NO: 10614 - DNA, 438 bp, Artificial Sequence
  Description of Artificial Sequence: Synthetic coding sequence
atgggaattggctgttggagaaacccactgctccttttgatcgccctggtgctgagtgccaagctggggcactttcagagatgggaggggttccagcagaagcttatgtccaagaaaaatatgaactccacactgaatttcttcatccagtcctacaataacgccagcaatgatacttatttgtacagggtgcaacgactgatcaggagccagatgcaattgaccacaggtgtcgagtatattgtgacagtcaagattggatggactaagtgcaagcggaacgatacatctaatagttcatgccctctgcagagtaagaagctgcgtaagtcactgatctgcgagagcctgatatacacaatgccttggattaactatttccagctgtggaataactcctgtctggaggcggagcacgtgggcaggaatctgcgatag

SEQ ID NO: 10615 - DNA, 1776 bp, Artificial Sequence
  Description of Artificial Sequence: Synthetic coding sequence
atgcagcaggatggcctgggggtagggacgcgtaacgggtcaggcaagggtcgttccgtacaccccagttggccctggtgtgcacctcgacctctgagatacttcggacgggatgccagagccagacgtgcacaaaccgctgcaatggccctcgctattcaggtgactgttagcaatccttatcatgtggttatcctctttcagcctgtgaccttgccctgcacgtaccagatgacatccacgcccactcagcctattgtgatctggaaatataagtcattctgtcgagataggatcgcggacgccttcagtccagcctccgttgataaccagcttaatgctcaactggcagccggtaatcccggttataatccatatgtggaatgtcaggattccgtacggaccgtgagagtcgtcgcgaccaagcagggcaatgcagtcaccctgggagactactatcagggacgtcgcataacaattactggtaacgccgatctcaccttcgaccaaacagcctggggcgactccggagtgtattattgttcagttgtgtctgcgcaggatctgcaaggcaacaacgaagcctacgccgaactgattgttctgggtcgtacttctggagtggctgaactgcttcccggatttcaggccggacccattgaggactggctttttgtggtggtggtatgcctggcggctttcctcatttttcttcttttaggtatctgttggtgtcaatgctgtcctcatacgtgctgttgctacgtccgctgcccatgttgtcccgacaaatgctgctgcccagaagcactttatgcagctggaaaggccgctacctccggagtaccctcaatttatgccccatccacctacgcccacctctctcctgccaagaccccgccaccgcctgccatgattcctatgggaccagcatacaatggataccctggaggctacccaggcgacgtggacagatcctctagtgtgcgctctggatatagaatccaggcttcccagcaggacgactcaatgagagtgttatactatatggagaaggagttagccaatttcgacccctctcgtcccggtcctccctcaggtcgggtggaaagggccatgtcagaagtcaccagcctgcatgaagacgactggagaagccggccatctaggggcccagccttaactccaatcagggacgaagagtggggaggacactctcccaggtcccctaggggctgggaccaggagcctgctcgcgagcaggctggaggcggttggcgcgctcgcaggcctcgagccagaagtgtggatgccttggatgacctaacgcccccaagtaccgcagaaagtggaagtagaagtcccacatccaacgggggtagatctcgcgcttatatgccccctagaagtcgtagccgcgacgatctctacgaccaagacgacagtcgcgatttcccgagatcaagagatccccattatgacgactttagatcccgggagaggcctccagcggatcctcggagtcatcaccaccggacaagagacccacgggacaacggaagcagatcaggagacctcccatatgatggcaggctgctggaagaagccgtgaggaaaaagggctccgaggagcggaggcggccacataaggaagaggaagaagaggcctattacccgccagccccacccccttattcagagaccgacagtcaagccagtcgcgaacgacggctgaagaaaaacctcgccctgtcgagagaaagcctggtggtttag

SEQ ID NO: 10616 - DNA, 678 bp, Artificial Sequence
  Description of Artificial Sequence: Synthetic coding sequence
atgaaccggtgccccagaaggtgccggtcccctttaggtcaagccgctcgttcactctatcagctagtaacgggctcattgagcccggatagtgtggatgacgaatttgagctgtcaactgtttgccatagaccagagggcctggagcagttgcaggaacaaacaaagtttacccgtaaagagctgcaagtactgtatcggggatttaaaaacgagtgtcctagcggaatcgttaatgaagaaaattttaaacagatttacagccagtttttcccccagggtgattcatccacctacgccaccttcttattcaatgcatttgacacaaaccacgatgggagcgttagctttgaagacttcgtcgctgggctttcagttatactccgaggcactgtggatgatcgcctcaactgggcgtttaatctctatgatttgaacaaggatgggtgtataacaaaggaggagatgctcgatatcatgaagtcaatctacgatatgatgggcaagtacacatatcctgctctgcgcgaagaggctcctagggaacatgtggagagcttcttccagaagatggaccggaataaagacggggtcgtgaccattgaggaatttattgaatcatgccagaaggatgagaacattatgcgttcgatgcaactcttcgacaatgtcatttag

SEQ ID NO: 10617 - DNA, 705 bp, Artificial Sequence
  Description of Artificial Sequence: Synthetic coding sequence
atgcccgcatcctcacccttcttactagcacccaagggcccaccaggaaatatggggggtccagttcgtgagcccgcactcagcgtcgccttatggctgtcctggggtgcggcattgggcgcagtcgcgtgcgcgatggccttgctcacccagcagaccgagctccagagcctccgtagggaggtctcgcgcctgcaggggacagggggtccttcacagaacggggaaggttatccttggcagagcctccccgaacagagcagcgacgctcttgaggcttgggaaaatggtgaacgaagccgtaaaaggagggcggtccttactcagaagcagaaaaatgactctgatgtcacggaagttatgtggcagccagccttgcgcagaggcaggggcctgcaagcccagggctacggtgtgcgcatccaggacgctggggtatatctcctgtactcgcaggtactattccaagacgtgacattcacaatgggccaggtagtgtctagggaaggtcagggcagacaggaaaccctgttcagatgtattagatccatgccctctcatcctgatcgcgcatacaattcctgttactccgccggtgtcttccatttgcaccagggtgacatcctttctgtaatcatccctcgggcacgagcaaagcttaatctatctcctcacgggacattcctggggtttgtgaaactgtag

SEQ ID NO: 10618 - DNA, 2400 bp, Artificial Sequence
  Description of Artificial Sequence: Synthetic coding sequence
atgaaacctatgcttaaggattttagcaacctgcttctggttgtcctttgcgattacgttctcggggaggcagagtatcttctgctgcgggagcccggacatgtggcactcagtaacgatacagtgtacgtggattttcagtacttcgacggtgctaacggcacgttgcgcaatgtctcggtgcttctgctagaggccaacaccaatcagaccgtgaccactaagtacttgctgactaaccagtcccagggtactctgaaatttgaatgtttctattttaaagaggccggtgactactggttcacaatgaccccagaagcaacggacaactcgactccttttccttggtgggagaagagtgccttcttgaaagtcgaatggcccgtattccacgtcgacttgaatcgatccgcaaaggctgccgaaggaactttccaggtgggactgttcactagccagcctctgtgccctttccccgttgataaacctaacatagtggtcgacgttattttcaccaactccctgcccgaagcgagaagaaatagtaggcagccactcgagattagaacctctaagcgcaccgagctggcacagggccagtgggtcgagtttggttgcgcccctctgggccctgaagcatacgtaactgtggtcctgaagctgcttgggagagattcagtgattacaagcacgggccctatcgatctggcgcaaaaattcggatataaactggtcatggtgcccgaattaacctgcgagtccggagtagaggtaaccgtcttgccacccccatgtacttttgttcagggggtggtcacagtatttaaagaagcgcctaggtaccccggtaagagaacgatccatttggctgagaattccctgcctctcggggagcggcgaacgatcttcaactgcacattgtttgatatgggaaaaaataagtattgcttcgattttggaatctcttccagatcccacttctcagcaaaagaagagtgtatgttaatccagcgaaacactgccttccagcccagttctcctagcccccttcagccccaaggacctgtaaagagtaataacatcgtcactgtgacaggtatctcactatgcttatttatcattattgcaactgtgttgatcaccctttggcggcgtttcggacgccctgcgaaatgctccaccccagcacggcacaactctatccactccccctcatttagaaaaaacagcgacgaagaaaatatttgcgagcttagtgaacagcgcggaagcttttcggacggtggggacgggccaaccgggtcccccggagacactgggataccccttacctataggaggtccggtccagttcctcctgaggacgatgcctcaggctcagagtcctttcagtcgaacgctcagaagatcattcctccgcttttctcttatcggctagcacaacaacagctgaaagaaatgaagaaaaagggcctcacagaaactaccaaggtctatcatgtgagtcaatcccctctgactgatacagccatcgatgcagcacccagcgccccacttgacctggaaagtccagaggaagccgcagcaaacaagttcaggattaagagtccttttcccgagcagcccgctgtgtccgctggtgaaagacctcctagtagattagatttaaacgtgacccaagcctcatgcgctatctctccttcccagacgctgattagaaaatctcaggcaaggcacgtagggagcagaggtggcccttctgagagatcccacgcacgaaacgctcacttcaggagaacagcttccttccatgaggctcgccaggccaggccttttcgagagaggagtatgagtaccctcacccctagacaggcacctgcctatagttctcggaccagaacgtgcgagcaagccgaggaccgcttccgtccacagagcaggggcgctcacctgtttccagagaaacttgaacatttccaggaagcaagcggaactcgcggtccgctgaatcccctgccgaagtcgtatacgctcgggcagcccctgaggaagcctgacctcggcgaccatcaggctggtctggtggccggaatagagcgcacggagccgcatcgagctcgacgcggtccaagtccgagccacaagtctgtctcccggaagcagagcagtccaatctcacctaaggataattaccagagggttagcagcctaagcccttcccagtgtcggaaagataagtgtcagagcttccccacccaccctgaatttgctttctacgacaatacttccttcggtctcacggaagctgagcagaggatgctagacctgccaggttatttcgggagcaacgaggaggacgagaccacaagcaccctctccgtagaaaagttggtcatttag

SEQ ID NO: 10619 - DNA, 927 bp, Artificial Sequence
  Description of Artificial Sequence: Synthetic coding sequence
atgagattgctaccggagtggtttcttctgctatttgggccatggctcctgcggaaggcagtctcagcccagatcccagaatccggcagacctcagtacctcgggctgcgtccggctgccgcaggtgctggcgctcctggacagcagctgcctgagccacggtccagtgatgggctgggagttggccgtgcatggtcttgggcctggccaaccaaccacactggggctctggctagggcaggagctgcgggtgccttacctgcccagcggactaaacgtaagccctcgattaaggccgcaagggctaagaagatctttggctggggtgatttctatttccgcgttcatacattgaagttctccttgttggtgaccgggaagattgttgatcacgtgaacgggacatttagcgtatattttagacacaactcatcaagccttggaaacctgagtgtgtccattgtgcctccatcaaaaagagttgaatttgggggagtgtggctgccaggacctgtcccccacccactgcagtccaccctagctcttgaaggtgtgctaccaggcctcggcccacccttagggatggccgctgcggcagccggacctggcctggggggatcgcttgggggtgctctcgcgggtccactcggtggtgcactgggggtgcctggcgctaaggaaagtcgagcttttaattgccatgttgagtacgagaagaccaaccgcgcaagaaagcaccggccatgcctatacgatccgtcccaggtgtgctttaccgagcacacacagtcacaggcagcatggctttgtgcaaaacctttcaaggtaatatgcattttcgtttcttttctgtccttcgattacaagctcgttcagaaggtttgtccggactataacttccaatctgagcatccgtactttggctag

SEQ ID NO: 10620 - DNA, 795 bp, Artificial Sequence
  Description of Artificial Sequence: Synthetic coding sequence
atgaaactgggatgcgttctgatggcatgggctctgtatctttctttgggcgtcctttgggttgcacagatgcttctggccgcatccttcgaaacgttgcagtgcgaggggcctgtgtgtaccgaggagtccagttgtcatacagaagatgaccttactgatgcacgggaggccggatttcaggtgaaagcttacactttctccgaaccgtttcatttaatagtctcgtacgactggttaattctgcaaggccctgctaagcctgtgtttgaaggagatctcctggtgctacggtgccaagcctggcaggactggccacttacccaggtgaccttctacagggatggaagcgcgctcgggccaccaggaccaaatagggagttctcgatcaccgtagtccagaaagccgactcagggcactatcactgcagcgggattttccagtctccgggacctggtattccagaaacagcctccgtagtagccattacagtgcagggtgcttcgagctccgccgcacctcctactctgaaccccgcaccccagaagtctgcagcaccgggtaccgctcccgaagaagcccctggccctttgccccctcctccaactcctagctccgaagatcctgggttttccagccccttaggtatgcccgacccccacctgtaccaccaaatgggactgctgcttaaacacatgcaggatgtcagggtgctcttaggacacctgttgatggaacttcgcgaattgtctgggcatagaaagcctggcacaacgaaggcgaccgccgaatag

SEQ ID NO: 10621 - DNA, 1362 bp, Artificial Sequence
  Description of Artificial Sequence: Synthetic coding sequence
atgctgcggatattatgtctggctttgtgcagtcttctgactggcactcgagcagatcctggggctttgttgcggctggggatggatatcatgaaccaagttcagtccgcaatggacgaatcccatattcttgagaaaatggccgctgaggccggtaagaaacagccaggcatgaaaccaatcaagggcattacaaatttgaaggtgaaggatgtgcaactgccggtaatcactctcaacttcgtccccggagtagggatctttcagtgcgtgtccacgggcatgacagtgactggaaagtctttcatgggtgggaatatggaaattatagtagccctcaacattacagccacaaatagacttctgcgcgatgaagaaaccgggctgcctgtatttaaatccgaaggctgtgaggtgatcttagtcaatgtgaagacaaacctgccaagtaacatgttgccaaagatggtaaacaagttcttagacagcactctgcacaaagtgctccccggtctgatgtgcccggctatcgatgctgtactggtctatgtcaatcgaaagtggacgaatctctctgatccaatgccggttggacagatggggactgtaaaatacgtgctcatgagcgctcctgctactacagcatcttatattcaacttgacttttcccccgtggtccagcaacaaaagggaaagaccatcaaacttgccgacgccggagaggcgctgactttccctgaagggtatgccaaaggtagtagtcagcttctgcttcccgcaacctttctgtcggccgaactcgctcttctacagaagtcctttcatgttaatattcaagacactatgattggcgagctcccacctcagaccacgaagacactggcccgttttatcccagaagtggccgttgcatatccgaagagcaagcccttgacaacccagatcaaaatcaaaaagcctcccaaggtgaccatgaagactggcaaatcactgctgcatctgcacagcacgctggagatgttcgctgcacgatggcggtctaaggcaccgatgtcgttatttttgctcgaggttcacttcaatctgaaagtgcagtactcagtgcacgagaatcagctgcagatggcaactagcttggacaggttgctttctctgtctcgtaagtcttcttcaatcgggaacttcaacgagcgcgagctaaccggtttcatcactagttatctcgaggaagcttatattcccgttgttaatgatgtgcttcaagtgggactcccattaccagactttttagctatgaactacaacctggctgagctggatatcgtcgagaacgctctcatgctggacttaaagctgggctag

SEQ ID NO: 10622 - DNA, 1323 bp, Artificial Sequence
  Description of Artificial Sequence: Synthetic coding sequence
atgagcgcacgtggcaggtgggagggcggtggaagaagggcgtgtagaggaagtctgggactggccagagcccaaggggctgaacgagtcacctcctctgaacagcgacctgcaatggccagccttgggctgctcctgctcctccttctgaccgcactgcctcctctctggtcatcttcactgcctgggctggatactgccgagagcaaagccacaattgcagatttgattctgtcagccctcgaaagagccaccgtgtttctagagcagaggctgcctgagattaatttggacggcatggttggagtgagagtgctagaggaacagctcaagtccgtgcgggagaagtgggctcaggagccactgctgcagcccttatccctccgcgtggggatgctgggagagaagttggaggccgctatacagagatcattgcattacctgaagctgtcagaccccaagtacttaagggagttccaactgacactgcagccaggtttttggaaattgcctcacgcttggattcacaccgacgcctccctggtctacccaacattcggaccacaagactctttctctgaagaacggtcagacgtgtgtctggtgcagctgttagggacaggaactgattcctccgagccgtgtggtctgtccgacttatgccgatctctgatgacgaagcccggatgctctggatactgtttgtcacaccaactcctgtttttcctgtgggccaggatgagggggtgcacacagggccctttacagcagtcccaggactacattaacctcttttgtgcgaacatgatggatctgaaccgcagggcagaggccattggttacgcatatcccacacgagatatattcatggagaacattatgttttgcggaatgggcggtttcagtgatttctacaaactccgatggctggaggccattcttagttggcagaaacaacaggaaggctgcttcggtgagcctgacgcggaagatgaagaactttccaaagcaatccaataccagcaacatttttcacggagagtcaagcgccgagaaaagcagtttcctgacagccgatcagtggctcaggcaggggtgcagtggagaaaccttggcagcctgcagcctttgcccccagggtttaagcaattctcttgtcttatattgccatcgagttgggattatcgctctgtgcccccttaccttgccaatttttacatctttctggtcgaaactggctttcatcacgtagctcacgccggactcgagctgctcatatctcgcgatccgcctactagcgggagtcaatctgttggcctctag

SEQ ID NO: 10623 - DNA, 708 bp, Artificial Sequence
  Description of Artificial Sequence: Synthetic coding sequence
atgaagtatgtcttctatctgggcgttcttgcgggaaccttctttttcgccgatagcagtgtacagaaggaagatcccgcaccttatctcgtttacctgaagagccactttaatccttgtgtcggcgtattgataaagccgagttgggtccttgctcctgctcactgctacttacctaatctgaaagtgatgttggggaatttcaagtcacgggtgagagatgggaccgagcaaaccatcaatccaatccagatcgtccgctactggaattactcacatagcgccccacaggatgacctcatgctcatcaaactagcaaagcccgcaatgctaaatcccaaagtgcaacccttgacacttgccactaccaatgtacggccaggcaccgtttgtcttctctctggtctagattggtcccaagagaactccgggaggcatcctgacctgagacagaatcttgaagctcccgtgatgtctgaccgggaatgtcagaagacagaacagggcaagagccacagaaacagtttatgcgtgaagttcgtcaaggtgttcagcagaatttttggagaggtggcggtggccacagttatctgtaaggacaagctgcagggcattgaggttggacatttcatgggtggcgacgtggggatctatactaacgtgtataaatatgtcagttggatcgaaaacacagccaaggataagtag

SEQ ID NO: 10624 - DNA, 426 bp, Artificial Sequence
  Description of Artificial Sequence: Synthetic coding sequence
atgttgaagaaaatctctgtcggggttgccggagacctgaataccgtcactatgaaactcgggtgtgtgctcatggcgtgggctctatatctgtctttaggagtgctttgggtggcccagatgctgttgggagcttcttcatcggctgctccaccaaccctcaaccccgctcctcagaagtcagcagcccctggcactgctccagaggaggccccaggcccattgcctcctccccctacgcctagttccgaggaccctggattcagcagccctctcggcatgccggacccccatctgtaccaccaaatgggcttgctgctgaaacatatgcaagacgtgcgagtgttgctaggccacttgctcatggaactgcgcgagctttcaggccatagaaagccaggtacaacaaaagccaccgctgagtag

SEQ ID NO: 10625 - DNA, 2886 bp, Artificial Sequence
  Description of Artificial Sequence: Synthetic coding sequence
atgcttgccccaagaggagccgctgtccttttgctgcacctggtcctccaaagatggttggctgccggtgcccaggccaccccccaagtatttgacttgttaccatcaagcagtcagcgcttaaatccaggagccctgcttcccgtgctgactgatcctgctctgaatgacctgtacgtgatcagcacgttcaagttgcagaccaagagtagtgcgactatttttgggctgtatagctcaacggacaattctaaatactttgagttcaccgttatggggagactgaataaagccattttacggtaccttaagaacgatgggaaagtgcatctagtagtcttcaacaacctgcagttagctgacgggagacggcaccgcatccttctcagactatcaaatctccagcgaggcgctgggtcactggagctatatttggattgcatacaggtcgattccgtgcacaatctgcctcgcgctttcgctggaccatctcagaaaccagagacaatcgaattgcgcacattccagagaaaacctcaggatttcctggaggagctgaagctggtggtacgcggtagcctgtttcaagtggcttccctgcaggactgctttctccagcagagcgaaccactggctgcgacagggaccggcgacttcaacagacagttcttgggtcagatgacacagctcaaccaacttcttggagaagtgaaagacctgctcagacagcaggtaaaagagacctcgtttctgcggaacactattgccgaatgccaggcctgcggcccactgaagttccaaagtccaacgcccagtaccgttgtgcctcccgctcctccggcacccccaactaggccccctaggcgctgtgacagcaacccttgcttcaggggagtgcagtgtaccgacagtcgggatgggttccaatgtggtccttgtcctgagggatacactggcaatgggataacatgtatcgatgtcgatgaatgcaaatatcacccctgctaccctggggttcactgcataaacctgtctcctggctttcgttgtgacgcctgtccggtgggctttactggacccatggtgcagggagtggggatttcgtttgcgaagagcaataagcaagtgtgcacggatattgacgaatgtcgcaacggcgcttgtgtgccaaactccatatgtgtaaacacattgggttcatacaggtgcggaccctgtaaacctgggtatacaggagatcagattcgcggatgcaaagccgaaagaaattgtaggaatccggaactgaatccatgcagcgtcaacgcccaatgcatagaagaacgccagggagatgtaacctgtgtgtgcggggtggggtgggcaggtgacggctacatttgcggcaaggacgtggacatagattcatatccagacgaggagctaccatgcagcgctagaaactgcaagaaagacaattgcaagtatgtgcctaactccggacaggaggatgccgaccgggacggcattggggatgcctgcgatgaagacgccgacggtgacgggattcttaacgaacaggataattgcgttctgatccataatgtggatcaacgcaatagcgataaggacatcttcggggacgcctgtgataactgtctgtctgtcctgaataatgatcagaaagacaccgacggtgacgggcgaggggatgcctgcgatgacgatatggacggcgatgggattaagaacatactagacaactgtcccaagtttccgaaccgtgaccagagagacaaagatggcgacggcgtgggcgacgcctgcgattcatgtcctgatgtaagcaatcctaaccagtccgatgtggataatgacttggtcggggacagttgcgacacaaaccaggactctgatggcgatggacatcaagattccacagacaattgcccgacagttatcaattctgctcaacttgatacagacaaagacgggatcggcgatgagtgtgatgacgacgatgataacgatggcatccctgacctagttccaccaggaccagataactgccggctggtacccaatcccgctcaggaggactctaattctgatggcgtgggggatatctgtgagtccgattttgatcaggaccaggttatagatcgcatagatgtttgccctgagaatgccgaagtcaccttgactgacttcagagcatatcagaccgtcgtgttggaccccgagggcgacgctcaaatcgaccctaattgggtggtgctaaatcagggcatggagattgtccagaccatgaattccgatcctggtctggcggtgggatacaccgcattcaacggagtcgactttgagggaaccttccacgttaacacgcagaccgacgacgactacgccggttttattttcggataccaagacagtagctctttctacgttgtcatgtggaaacagactgagcaaacctactggcaggctactcctttcagagccgttgctgagccaggtattcagctcaaggccgtcaaatcaaaaactggcccaggcgagcatctacgaaactccctgtggcacacaggtgacactagcgaccaagtgcggttattatggaaggattcccgcaatgtgggctggaaagacaaggtgtcctataggtggttccttcagcaccggcctcaagtgggatacatccgggtccgcttctacgaaggatccgagctggttgcagactcaggggtgacaatagatactacaatgcgtggcggacggttaggggtcttctgtttttctcaggaaaatatcatctggtctaatctaaaatacaggtgtaatgatacgattcccgaggactttcaggagtttcagacccaaaattttgatcgcttcgataactag

SEQ ID NO: 10626 - DNA, 300 bp, Artificial Sequence
  Description of Artificial Sequence: Synthetic coding sequence
atggataatgtgcagcctaaaatcaagcatcgcccattttgctttagcgtgaagggccacgtcaagatgttaaggctcgatatcatcaattcgctggtgaccaccgtctttatgctcatcgtctccgtactggccttgattcctgagaccaccactctgacagtgggcggaggggtgtttgccctagtaacggcagtatgctgcctagcagacggagctcttatatacaggaaactccttttcaacccctccggcccataccagaagaaaccagtccatgaaaagaaagaggtattatag

SEQ ID NO: 10627 - DNA, 408 bp, Artificial Sequence
  Description of Artificial Sequence: Synthetic coding sequence
atgagtccccatctgaccgccttactgggccttgtcctgtgcctggctcagaccatccacacccaagagggcgctttgcccaggccgtccatttctgcagaacccggaacggtgatcagcccgggtagccatgtgacttttatgtgtcgcggtccagtgggtgtgcagacgttccgcctggagagagaggaccgggcaaagtacaaggactcgtacaatgtcttcagacttggccctagcgagtcagaagctcgctttcatatagacagcgtgagcgaagggaacgctgggctctatcgctgtctctactacaaacctccaggctggtcagagcattccgatttcctagaactgctggtcaaaggaaccgtgcccggaaccgaagcctccggcttcgacgccccatag

SEQ ID NO: 10628 - DNA, 231 bp, Artificial Sequence
  Description of Artificial Sequence: Synthetic coding sequence
atgcttccatgcttggccttactgttgctcatggaattaagcgtgtgcacagtggccggtgacggcggagaagagcagactctttctaccgaagcggagacttgggagggggcaggaccctcaatccagctgcaattgcaggaagtcaagacgggaaaggcatcccagtttttcggactcatgggtaagagagtgggcggaagggaagatgaagcccagggtagcgagtag

SEQ ID NO: 10629 - DNA, 684 bp, Artificial Sequence
  Description of Artificial Sequence: Synthetic coding sequence
atgagaggccaaggtagaaaggaatccttgtccgactcaagagatttagatggcagttacgatcagttaacagattcggtcgatgatgaattcgagctgagcaccgtttgccatcgaccagagggcctcgagcagttgcaggagcagacaaaatttacgcgcaaggaactgcaggttctgtataggggatttaagaatcctggcgcactgagcttccaggagtgcccttccggaattgtcaacgaagagaattttaagcaaatttacagtcagttttttccgcaaggggattcgtccacttatgccacgttcctgttcaacgcctttgataccaaccacgacggttccgtgagtttcgaggatttcgtggcaggcctcagcgttatactgagggggacggtagatgatagacttaactgggcgttcaacctctacgatctcaataaagacggctgcatcacgaaagaggaaatgctagatataatgaagtcaatctatgacatgatggggaagtacacctaccctgctttacgcgaggaagcaccccgagagcatgttgagagtttcttccagaaaatggatcgcaacaaggatggcgttgtgacaattgaggaatttattgaatcttgtcaaaaggacgagaatatcatgcgctccatgcagctgttcgataatgttatctag

SEQ ID NO: 10630 - DNA, 876 bp, Artificial Sequence
  Description of Artificial Sequence: Synthetic coding sequence
atgatgtccgccacaggccctggtagaaagatgggctcaagaggtcaaggcctcctcctcgcctactgcttattactggcctttgcttccgggctcgtgctcagccgtgtacctcacgtccagggcgagcagcaagaatgggaagggacagaggagttacccagccctccagaccacgctgaacgcgcagaagagcagcatgagaaatacaggcctagtcaggaccaaggcctgccagcctctcggtgtcttcggtgctgcgaccctggtacaagcatgtacccggctacagcagtcccccagataaacatcacaatcttaaaaggagaaaagggagaccggggtgatcgtggcttacagggcaaatacgggaagacagggagcgccggtgcgagggggcatacgggacccaagggacaaaagggatccatgggcgcacccggtgagagatgtaaatctcattatgcagctttctccgtgggcagaaagaagccaatgcacagcaatcactactaccagacggtaatttttgacaccgaattcgtgaacctgtatgaccactttaacatgtttactggcaaattctattgctacgtaccagggctgtacttcttctctctcaacgttcatacatggaaccagaaagagacgtacctccatattatgaagaacgaagaggaggtggttatcctgtttgcccaagtgggggaccgttcaattatgcagtcccagtcactgatgttggaactccgagagcaggaccaagtgtgggtgagactgtacaagggcgaacgagagaatgccatattcagcgaagaattggatacatatatcacatttagtgggtacctcgtcaaacacgcgaccgagccttag

SEQ ID NO: 10631 - DNA, 213 bp, Artificial Sequence
  Description of Artificial Sequence: Synthetic coding sequence
atggagagaggagctggcgcaaagcttctcccgcttttgctgctcctaagagccacaggtttcacttgtgcacagacagatggtagaaatgggtatacagctgttatcgaggtgaccagcgggggaccttggggggattgggcctggcccgagatgtgtcccgatggattctttgcctctggcttcagccttaaactgggcaggatggagtag

SEQ ID NO: 10632 - DNA, 402 bp, Artificial Sequence
  Description of Artificial Sequence: Synthetic coding sequence
atgggttcctctggactgctttcgctactggtgctcttcgttctgcttgctaatgtccagggccctggactcactgattggttgttcccaagaaggtgtccaaagatacgcgaagagtgcgagttccaggaacgcgatgtgtgtactaaagatagacagtgccaggacaacaagaaatgttgtgtcttctcatgcgggaaaaaatgtttggacctcaagcaggatgtatgcgagatgcctaaggaaacaggcccttgtttggcctactttttacactggtggtacgacaagaaggacaacacatgttctatgtttgtgtacgggggatgtcaagggaataacaacaacttccagtccaaggcaaactgccttaatacgtgtaaaaataagagattcccatag

SEQ ID NO: 10633 - DNA, 771 bp, Artificial Sequence
  Description of Artificial Sequence: Synthetic coding sequence
atgtttcaaactggaggactgatagtgttctatggcttgctagcacaaactatggctcagtttggcggactgccagtgccactagaccagacgttacctctgaatgtgaaccccgctctccctctgtcgccaacaggactggcaggctcgcttactaacgcgctttctaatgggcttttgagcggaggcctgctgggtatccttgaaaatctacctctgctggatatcctgaaacccggaggaggcacgtccggcggattgcttggagggctgctaggaaaggtgacctctgttattcccggtctgaataacattattgatataaaagtgacagatccgcagctccttgagctggggcttgtacagtctcctgatggtcatagactgtacgtgacaattccactgggaataaagttgcaggtgaatacacctcttgttggagcttcacttctgaggttggccgtaaaacttgatattactgccgaaattttagccgtccgggataagcaggaaagaattcatctggtcctgggtgactgtacccatagtccagggtctttgcagatatctctcttagacgggctcggaccccttccaatccaggggttgttggattctctgactggcatattaaataaggttttgcctgagctggtgcagggaaacgtgtgccccttggtaaacgaggtgctacgcggactggacatcacccttgtgcacgacatagtaaatatgctaatccatggcctccagtttgtcatcaaggtgtag

SEQ ID NO: 10634 - DNA, 1386 bp, Artificial Sequence
  Description of Artificial Sequence: Synthetic coding sequence
atgtccttagatattcagtccctagacatccaatgcgaagaactgagcgatgccaggtgggcggagttgctccccctgcttcagcagtgccaagttgtgagactggatgattgtggattgaccgaagctagatgtaaggacatttccagcgcactgagggtgaacccagcattggcagaattaaatctgagaagcaacgagttgggggatgtgggagttcactgtgtgttgcagggcctgcagactccttcatgtaagattcagaagctgagcctacagaattgttgtttaacaggcgcaggctgtggtgtgctgtcatccaccctgcgcacattgccaacactccaggaattgcatttgtctgataacctgctcggggatgccggtctccagttattgtgtgaaggactcctggatcctcaatgccgactggagaaactccagctggaatattgctcactgagcgccgctagctgtgaaccccttgcgtcagtgcttagggcgaaacccgacttcaaggaactgactgtgagcaacaatgacatcaacgaggccggagtcagagtcctgtgccagggtttaaaggatagtccatgtcagttagaagcgctgaaactcgaatcctgtggggtgacctcggacaattgtcgagacctctgtgggatcgtggcttcaaaggctagtcttagggaacttgctcttggctcgaataagttaggagatgtcgggatggctgagttatgtccagggttactccacccctcatcacgccttcgcactctctggatatgggagtgcggtattactgcgaaaggatgtggcgatctttgtagggtgctgagagcgaaagagtctctgaaggaactctcccttgccggaaatgagctaggagacgagggcgctcgactcttgtgcgagaccttgctggaacccggatgtcaactggagtctctctgggtgaaaagttgttctttcacagctgcctgctgctcccacttttcatctgttctggcgcagaacaggtttctcctcgagctacagatctctaacaataggctagaagatgccggagttcgcgagttgtgccagggccttgggcaacccggttcagtgctgcgagtactctggctggctgactgcgacgtatctgatagctcatgctcaagtcttgcggctaccctccttgcaaaccactcccttcgcgagttggacttgagcaacaactgcctgggagatgctggaatcctgcagctcgttgaatcagtgagacagccaggatgcctgttggagcaactcgttctgtacgacatttattggagcgaggaaatggaggatcggctgcaggccctcgagaaggacaagccatctctacgagtgatcagttag

SEQ ID NO: 10635 - DNA, 534 bp, Artificial Sequence
  Description of Artificial Sequence: Synthetic coding sequence
atgcgcctactcatactgacctgcttagttgcagttgcgttggcaagacccaagctgcctcttaggtatcctgaacggctgcaaaatccatccgaatcttctgagccgattcccctcgaatcccgcgaggagtatatgaacggtatgaacaggcagcggaacattctgcgagagaagcaaacagatgaaattaaaaactgtgtggttgcagagcctgaaaaaatggaatcgtccatctccagtagcagcgaagaaatgagtctgtccaagtgcgcagaacagttctgcagacttaatgaatacaatcagttgcagctgcaaaaaatgtctaaacaggagcagattcgtcggatgaacgagaacagccacgtgcaggtgccctttcagcagctcaaccaacttgctgcctacccctatgccgtgtggtactacccacagatcatgcagtacgtgccttttccaccgtttagcgatatcagcaaccctaccgctcatgagaattatgagaagaacaatgtgatgttgcagtggtag

SEQ ID NO: 10636 - DNA, 3054 bp, Artificial Sequence
  Description of Artificial Sequence: Synthetic coding sequence
atggacctgattagaggggttcttcttaggctgttgttactcgcaagcagcttaggccctggcgctgtcagtcttagagctgctattcgcaagccaggcaaagttgggccacccctggatatcaagctgggcgcacttaactgcaccgccttttctatccagtggaaaatgccccgtcaccccggtagtccaatcctcggatacacagtgttttatagcgaagtgggcgctgacaaaagtctgcaggaacagctgcactccgtccccttaagccgggacatccctaccacggaggaagttattggagacctgaagcccggaaccgagtaccgtgtatccatcgccgcatatagtcaagcagggaaaggacgcctctcttccccccgacacgtaacaacccttagtcaggatagctgtttgcctccggcagccccacagcagccccacgtgatagtagtgagtgattccgaggtggcattgtcctggaaacctggagccagcgaggggtctgcccctattcagtattatagtgtggagtttatcaggcccgattttgataagaaatggacttccattcatgagaggattcaaatggatagcatggtcatcaagggcctggatcctgacacaaattaccagttcgccgttcgcgctatgaattctcacgggccttcccccaggagctggcccagtgatatcattcgtacactctgtcctgaagaggccggaagcggtaggtacggtccaagatacatcactgacatgggcgcaggcgaggacgacgaagggtttgaggacgacctggacctggacatatcctttgaggaggtgaagcctctaccggcaaccaagggcggaaacaagaagttcttggtggagtctaagaagatgtccatctccaatccgaagaccatctcccgcttaatccctccaacatcggccagcttgcccgtaaccacagtggccccacagccaattccaatccagagaaagggtaagaatggggtggctatcatgagcaggctatttgacatgccctgcgatgagaccctttgcagcgccgacagtttctgcgtgaacgactacacttggggcggttcccgctgccagtgtactctggggaaaggaggggagagctgtagtgaggacattgtcatacagtatccccagtttttcggacatagttacgttacttttgaaccactgaagaactcttaccaggcgtttcagattacacttgagtttcgggcagaggctgaggatgggctcttactgtattgtggtgaaaacgagcatggccgaggggactttatgagcctcgctattatacggcgtagcctgcagttccggtttaattgtgggacgggcgtggctatcatagtatccgagactaaaataaagctagggggatggcacacagtcatgctctatagggacgggctgaatgggctacttcagctgaataacgggactccggtcaccggacaatcccagggccagtattcaaagatcacattcaggacgccactgtacctaggtggcgctccatcagcatactggctggtgagagctactgggactaacagaggttttcaaggctgcgtgcagtccctggccgtgaatggccgacgcatagacatgaggccttggcccctgggcaaggcgctgtcaggggcagacgttggcgagtgttctagcggaatatgcgacgaggcttcatgcattcatggaggtacttgtacggctattaaagcggattcttacatttgcctgtgtccattaggatttaagggtaggcattgcgaagacgcctttaccctcacgatccctcaattccgggagtccctccgatcttacgcagctaccccatggcctcttgaaccacagcactatctttcatttatggagtttgagatcaccttccggcctgattcgggagatggagtgcttctctattcttacgatactgggagcaaagatttcctctccatcaatcttgccggagggcacgtggagtttcgcttcgattgcgggtccggcacaggcgtgctcagaagtgaggaccccttgactctcggcaactggcacgagctgcgggtgtctcggaccgctaaaaatggcatcctgcaggtggataagcaaaagatcgtagaagggatggctgaaggaggtttcacgcagataaaatgcaacactgatatctttattgggggtgtcccgaactatgatgatgttaagaaaaactctggagttctgaaacctttttctgggagtatccagaaaattattttgaatgaccggaccattcatgtcaaacacgatttcacctccggcgtgaacgtggaaaacgccgcacatccctgtgtgagggcgccttgcgcacacgggggatcttgccggccaagaaaggagggttatgactgtgactgtccactcggctttgagggattacactgccagaaagagtgcggcaattactgcctgaataccatcattgaggcaatagaaattcctcaatttatcggtcgctcttacctcacatatgacaaccctgatatactcaagcgagttagtggctcccgttcaaatgttttcatgcggtttaaaaccacagctaaggacggcctgctactttggagaggtgattcccctatgcgccctaactccgacttcatttcgttgggcttgagagatggcgcactcgtgttctcttataacctcggctcaggagttgcctcaattatggtgaacggctcctttaacgacggcaggtggcacagggtcaaggcagtgcgcgatggacaatcaggcaaaattaccgtagacgactatggagccaggactggaaaaagccctggtatgatgcggcagctgaatatcaacggcgctctgtatgtgggtgggatgaaagaaattgccctccacactaacaggcaatacatgcggggtcttgtcgggtgtatctcccacttcactcttagcacagattaccatataagcctggttgaagacgccgtggacgggaagaacattaacacttgtggggctaaatag

SEQ ID NO: 10637 - DNA, 1893 bp, Artificial Sequence
  Description of Artificial Sequence: Synthetic coding sequence
atgcagcaggacggtctgggcgtggggactcgcaacggaagcgggaagggaaggtctgtccacccttcttggccctggtgtgcaccaagacccctgaggtactttggaagagatgccagagctcggagagcacagacagccgcaatggcactcctggctgggggattgagcaggggactcggaagtcacccagccgctgccggacgcgacgcggtggtcttcgtgtggctccttttaagcacatggtgtactgctcccgctcgcgctatccaggtgacagtgtcaaatccatatcacgtggtgatcttattccagcccgttaccttgccttgtacttaccagatgacctccacccctactcagcccatcgtgatctggaagtataagtctttttgtcgagatcgtattgcggatgcattctcccctgcctccgtcgataaccagctgaacgcccaacttgctgctgggaatcctggatataatccttatgttgagtgccaggatagcgtgaggacggtgagggtggtcgcaacaaaacagggaaacgccgtgaccttgggggactattatcaggggagacgtattaccattaccgggaacgctgacctgacatttgatcagacagcatggggggattccggcgtctattactgctcggttgttagcgcccaagacctccagggtaataacgaggcctacgctgaattgatcgtgctcgattggttgtttgtcgtagtcgtttgcctggccgcttttctaatcttcctcctgttgggtatatgttggtgccagtgttgtccccacacctgttgttgttatgtgcggtgcccttgttgtcctgataaatgttgctgtcctgaagccctgtacgctgcaggcaaagctgccacttccggagtgccttcgatctatgccccaagcacctatgcccacctgtcacccgcaaagaccccccctcccccagcaatgatacctatgggcccagcgtataacgggtatccgggaggataccctggggacgtggaccggagcagttctgccggtggccaggggagttacgttccattgctgcgggacaccgactccagtgtggcgtccgaggtcagaagcggctacagaatacaagcctcccagcaagacgacagcatgcgagtattgtattatatggaaaaagagctggctaacttcgacccctcacgtccaggaccccctagtgggagagtggagcgcgcaatgagtgaagtaacctctctacatgaggatgactggcgcagcagacctagcagaggcccagccttgaccccaatacgggatgaggagtggggaggccactcacccagatctcccagaggttgggaccaggagcccgcaagagaacaggccggaggagggtggcgcgctcggcgtccacgagctcggagtgtcgacgccctagatgatctcactccaccctctaccgccgagtcgggttcgcgcagtccgacatctaacggtggacggtcccgggcatatatgcccccaagaagccgttccagagacgacctgtacgaccaggatgactctagggatttcccacgctcccgtgaccctcattacgatgacttccgaagtcgggagcggccacctgccgatcccaggagccaccaccacaggaccagagatcctagggataacggatcgaggtcgggggacttgccttatgatgggcgacttttggaggaagcagtacgaaagaaagggagcgaagagcggcgacgtcctcataaagaggaagaagaagaggcttattatccgccagctccccctccttattcagaaactgactctcaggcctcacgagagcgacgccttaagaagaacttggccctgagtagagagtcccttgtagtgtag

SEQ ID NO: 10638 - DNA, 750 bp, Artificial Sequence
  Description of Artificial Sequence: Synthetic coding sequence
atgctccagctctggaaactggtgcttctttgtggggttcttacagggacatctgagagcctgcttgataatctcgggaatgacctttctaatgtggtcgacaagttggagccagtgcttcatgagggccttgaaacagtagacaacacactgaaaggcatattggaaaagcttaaggtggatctcggagttctgcaaaagtcctctgcttggcagctggccaaacagaaagctcaggaagctgaaaagctcctgaacaatgtcatctctaagctcctgcctactaatacggatatcttcgggctgaaaatcagtaatagcctaatcttggatgtgaaggctgaacctattgatgacggcaaggggctgaacttaagcttcccagttaccgccaacgtaactgtggccggacccataatcggccagattatcaacctgaaggcaagcctggatcttctcaccgccgttactattgagaccgatcctcagacacatcagcctgtggccgtcctgggagagtgcgcaagcgaccccacctccatctctctgtccctcttggacaagcacagccagattatcaacaagttcgttaactccgtgatcaacactctaaaatccaccgtgtctagcctgcttcagaaggaaatttgtccccttattcgcatcttcattcactctctcgatgtgaacgtgatccagcaagtggtcgataacccccagcataagactcaattacaaaccctgatctag

SEQ ID NO: 10639 - DNA, 3057 bp, Artificial Sequence
  Description of Artificial Sequence: Synthetic coding sequence
atggtgagccactttatggggagcttaagcgtgctgtgtttcctcctcttattgggcttccagtttgtatgtccacaaccctccactcagcacaggaaggtgcctcagagaatggccgctgagggcgcaccagaggatgacgggggagggggagcacctggcgtgtggggggcttgggggccatggagtgcctgtagcagaagctgttctggtggcgtgatggagcagacccgtccatgtttaccaagatcgtacaggctgagggggggtcagaggccaggggctccagccagagcttttgccgaccacgtggtgtccgcagtgcgcactagcgtgccgctgcaccgatcaagagatgagacccctgcccttgccggaaccgatgcctctcggcagggacctaccgtgctgcgcggatcccgacacccccagccacaaggcctggaggtaactggtgataggcgatcgcggacccgcggtaccattgggcctggtaaatatggctatggaaaggcgccttacattctgcctctccagaccgacactgcgcatacacctcagcgattacggcgacaaaagttgtcctctcggcatagcagaagccagggggcaagctctgcacgtcatggatatagctcccctgcccatcaggtaccgcagcacggtccgctgtaccagagcgattcagggcctaggtcggggcttcaggctgcggaagcgcctatttatcagctaccattaacccacgatcaggggtaccccgctgcttctagcctttttcacagccctgaaacctccaacaaccatggcgtgggtacgcacggagccacacagagcttcagccaacccgcacgaagtaccgcaataagctgtatcggagcctataggcagtataagctgtgcaacaccaatgtttgtccagagtcttcaaggagcatccgtgaggtgcagtgcgcatcctataataacaaacctttcatgggccgattttatgagtgggaaccatttgccgaggtgaagggcaataggaaatgcgagttgaactgccaagccatgggatacaggttctatgtcaggcaggcggagaaagtgatcgatggcactccatgcgatcagaatggaactgccatctgcgttagtggtcagtgcaagtccataggatgtgacgattatctgggtagcgacaaggtcgtagacaagtgcggagtgtgtggtggagataataccggttgtcaggttgtgtcaggagtatttaagcacgctttgactagcctcggataccatcgtgttgtcgaaatcccagaaggtgccacgaagataaatatcaccgagatgtacaagtcgaacaactatctggcactgcggagtagatcaggtcggtcaatcataaacggaaactgggcgattgaccgccctgggaaatatgaagggggtggtacaatgttcacatataaacgccctaacgagatctcgtctacagcaggagagagctttctggcggagggacccaccaatgagatccttgatgtgtacatgatccatcagcaacccaacccaggagtgcattacgaatatgtgatcatgggcacgaacgcaattagcccacaggtgccacctcatcggagacctggagagccttttaatggacagatggtaaccgaaggacggagccaggaggaaggcgagcagaagggcagaaacgaagagaaggaggacctccggggagaggctcccgaaatgttcaccagtgagagcgcccagactttccccgtcagacaccctgatcgcttcagtccacaccgccctgataatttggtccccccagcgccacaaccaccccgacggtctcgagaccacaattggaagcagctgggaactacggagtgcagcaccacctgcgggaagggaagccagtatcctattttccgatgtgtacatcgatccacgcacgaagaagctcccgagtcttattgtgatagctcaatgaagcccacaccagaagaggagccttgcaatatttttccctgcccagccttctgggacattggggagtggagcgaatgctccaagacttgcggtctaggcatgcaacacagacaggtgctgtgtcgccaggtgtatgcaaacaggagtctcaccgtgcagccctataggtgccagcacctggagaagccagaaacaacttccacgtgccagcttaaaatctgcagcgagtggcaaatcagaaccgactggacctcttgcagcgtcccatgcggagttggccagcgcacaagggatgtaaagtgcgtgagcaatatcggggacgtcgttgacgatgaggagtgtaatatgaaactccgcccaaacgacatcgagaattgtgacatgggaccttgtgcgaagtcctggtttctgacggagtggtctgagcgctgttccgccgaatgcggggctggtgtgcggactcgctcagtggtctgcatgacaaaccacgtctccagtctgccattggaagggtgtggcaacaaccgccctgcagaagcaacaccttgcgataatggaccgtgcaccggcaaagttgagtggttcgccggttcatggtctcaatgttctatagagtgtggatcgggcacccagcagcgagaagtgatatgcgtgcggaagaacgccgatacctttgaggtgctcgacccttccgagtgctcattcttagagaagcctccttctcagcagtcttgccatcttaagccgtgcggagcaaaatggttctccaccgaatggtcaatgtgttcaaaatcctgccagggtggcttccgagtgcgggaggtccgctgcctgtctgacgatatgactcttagcaatttatgcgaccctcagctaaaacccgaagaaagggagtcttgcaatcctcaggactgtgtgccggaggtagatgagaattgcaaagacaagtactacaattgtaatgtggtcgtgcaggccaggctctgcgtatacaattactacaaaacggcttgttgcgcaagctgtacccgcgttgctaataggcaaaccggcttcttgggctcccgctag

SEQ ID NO: 10640 - DNA, 1311 bp, Artificial Sequence
  Description of Artificial Sequence: Synthetic coding sequence
atgcaaggaactccaggcggtgggacaaggccgggaccatcgcccgtggaccgcaggaccctgttagttttctctttcatcctggctgccgctttggggcaaatgaacttcactggcgaccaggtcttacgggttctcgcgaaagatgaaaaacaactgtccctgttaggagacctggagggcctaaaaccccagaaggtagacttttggagaggccctgcccgaccaagtctacccgtggatatgcgcgttcctttctccgagcttaaggacattaaggcctacctggaaagtcacggcctcgcatattcaattatgataaaagatatccaggtgctcctggatgaagagagacaggccatggcaaaatcccgcagattggagcggtcaactaactcgttcagctactcaagttaccacacactggaggagatttattcctggatagataattttgtgatggaacatagcgacattgtatcaaagatccaaatcggaaatagcttcgagaatcaatcaatccttgtgctgaagttctcgactggagggtcaagacacccagccatttggatcgacaccggaatccattcccgggaatggatcacccacgctactggcatctggacagctaataagattgtcagcgactacggcaaggacagagtgctcaccgacattctcaacgcaatggatatatttatcgaattggtgaccaatcctgatggcttcgcttttacacattcaatgaataggttgtggagaaaaaacaagtctattcggccaggaatcttttgcatcggggtggatctgaataggaattggaaaagtggcttcggcggtaatgggtccaacagtaacccctgtagcgaaacctatcacggtcccagcccgcagtcagaacctgaagtcgctgccatcgtgaacttcataacagcccacggcaatttcaaggccctcatcagcatacatagctatagtcagatgctgatgtacccttacgggcgtctcctagagccagtcagcaaccagagagagctgtacgatctggctaaggacgctgtggaggctctttataaagtgcacggcatcgagtatatattcggttctattagtactaccctgtacgtcgcgtctgggatcacggtggactgggcgtacgatagtgggatcaaatacgccttctcctttgaactccgagataccggccagtacggattcttgctgcccgcaactcaaataattcccacagcacaagagacttggatggcattaagaaccattatggagcacaccctgaatcatccatactag

SEQ ID NO: 10641 - DNA, 492 bp, Artificial Sequence
  Description of Artificial Sequence: Synthetic coding sequence
atgttccaaggcctgctgctgttgctcctgctctctatgggcggaacgtgggctagcaaagaaccactgagacccaggtgccgccctattaacgcaacactggcagtagaaaaggagggttgcccagtgtgtatcactgtgaacaccacaatttgtgcagggtattgtcctaccatgactcgcgtgctgcaaggcgtgcttcctgccctcccacaggtggtttgtaattatagagatgtgagattcgagtcaatacgactgccaggttgcccgcgaggcgtgaaccccgtcgtatcttacgcagtcgcactatcctgtcagtgcgccctgtgccgcagatcgactacggactgcggaggacctaaggaccaccctctgacctgcgatgaccctagattccaagattccagctccagcaaagcaccgcctccttcactgccctcgccaagcagattgcctggcccttccgatacgccaatactgcctcaatag

SEQ ID NO: 10642 - DNA, 213 bp, Artificial Sequence
  Description of Artificial Sequence: Synthetic coding sequence
atgccaggagccatgaagatcttcgtttttattctggccgctctcatactgcttgctcagatcttccaggccagaacggcaatccacagggccctgattagtaagcggatggaaggacactgtgaagcagaatgcctcacctttgaagtaaagatagggggatgtcgagcagagctggctcctttctgctgtaaaaacaggaagaagcattag

SEQ ID NO: 10643 - DNA, 1098 bp, Artificial Sequence
  Description of Artificial Sequence: Synthetic coding sequence
atgtggttgcttctcacgatggcctcgcttatcagtgtgctggggacaacacacggtctgtttgggaaacttcacccaggatccccggaggtgaccatgaacatctcacaaatgatcacttactggggctatccaaacgaggaatacgaagtggttaccgaggacggttatattttagaggttaaccgcatcccatacgggaagaagaatagcgggaataccgatgcaggatatgacgtgtggttgggcaactctcgcggtaatacctgggcgcgacggaacctttattacagcccagatagcgtggagttttgggctttcagctttgacgagatggccaaatacgacctgccggctaccattgacttcattgtcaagaaaacaggtcagaaacagctgcattacgtgggccactcccagggcacaaccatcggcttcattgcatttagcacaaacccatctctggctaaaaggatcaagaccttctatgctcttgccccagtcgcaacagttaagtatacaaagtcccttatcaataaactgaggtttgtaccgcaaagcctctttaagtttatttttggagacaaaattttctacccccataatttctttgatcagttcttggcgacagaggtgtgctccagagagatgctgaacctgctttgctccaacgcgttgtttattatctgtggcttcgattcgaagaacttcaacacatcacggctcgacgtataccttagccacaaccccgcagggacaagcgtgcagaacatgtttcactggacacaggcggtgaaaagcggaaagttccaggcatacgactggggctcgcctgtacagaataggatgcattatgatcagtcccagcccccatactacaacgttaccgccatgaatgtccctatcgccgtgtggaatggtgggaaggatctgctcgctgatccacaagacgtgggactcctgttacccaaacttcctaacctgatttaccacaaggagatccccttttacaaccacctggatttcatatgggcaatggatgctccacaagaggtgtacaacgatatcgtgtccatgatctctgaggataagaaatag

SEQ ID NO: 10644 - DNA, 2535 bp, Artificial Sequence
  Description of Artificial Sequence: Synthetic coding sequence
atgggccctggcgcaccctttgccagggtgggttggcctctgcccttattagtggttatggccgcaggtgtggcacctgtatgggcatctcactcaccacatctcccgagaccccattctcgggttcctccacacccctctagcgagagacgcgcagtgtatatcggagctctttttcctatgtccgggggttggcccggaggccaggcctgtcaaccggctgtggaaatggccttggaggacgttaacagccgcagagacatattaccagactacgagctaaaactgattcatcacgactctaaatgcgaccctggtcaggcaacgaaatatttatacgagctgttgtacaatgacccaatcaagataatactgatgccgggatgcagcagcgtaagcaccttggtagctgaagctgcaaggatgtggaacctgatcgtgctgagctacggtagtagcagtccagctttaagcaatcggcagaggttccccacattctttagaactcacccaagtgctacgcttcacaatccaacaagggttaaattgttcgaaaaatggggatggaaaaagatagctaccatacaacagactacagaggtatttaccagcaccctggatgacctggaagaaagagttaaagaagccggaattgagataactttcaggcagagttttttttccgatcctgctgtccccgttaaaaacttgaagagacaggatgctcgcatcatcgtagggttgttctatgagacagaggcccgaaaggtattttgcgaagtttataaagagaggctatttgggaaaaagtacgtttggttcttgattgggtggtatgccgataactggttcaagatctatgacccttccataaactgtacggtcgacgaaatgaccgaggcagttgagggacacatcacaacagaaatcgtgatgcttaatcccgctaatacccgttcgatcagtaatatgacctcacaggagttcgtcgaaaagctcacaaagagactgaaacgacatccagaagagaccggcggatttcaagaggcacccctagcatacgatgccatttgggcccttgctctggctctgaacaagacatctggtggtggaggcaggagcggcgtccgactggaggacttcaattataacaatcagaccatcaccgaccagatttatagagcaatgaattcttctagcttcgagggggtcagcgggcacgtggtcttcgacgcctcagggagccggatggcttggacattgattgaacagcttcaagggggatcttataagaagatcggatactatgactccactaaggacgatctgtcctggagcaaaaccgacaagtggataggcggtagcccccctgctgaccaaacactcgtcataaaaacgttcaggttcttatcacaaaaactgttcatctctgtgtccgtgctctcctccctcgggattgtgttggccgtcgtttgcctttctttcaacatctataactcacacgttcgctatatccagaactcccagcccaacctcaacaacctcacggcggtggggtgttccctcgcgctagccgctgtgtttcctctggggctggacggctatcacatcggtcgcaaccaatttcctttcgtatgtcaggccaggctctggctgctgggtctgggcttttctttaggatacgggtcgatgtttacaaaaatctggtgggtgcataccgtgttcacgaagaaggaggaaaagaaagaatggcgcaagactctcgagccatggaagctttacgctactgttggactgcttgttgggatggatgttcttaccctggccatctggcagattgttgaccctctgcatcggaccattgaaacttttgcaaaagaagaaccgaaagaggatattgacgtatctatcctgccgcagctggagcactgtagtagccgaaaaatgaatacctggctaggaatcttttatgggtataaaggtctgctgttactcctcgggatattcctggcatatgaaaccaaaagtgtctctacggagaagattaacgaccatagggctgtgggcatggccatttacaacgtggcagtcctgtgtcttatcactgcgcctgtgacgatgatcctgtctagccagcaagatgctgccttcgctttcgcgtccctggccatcgtcttctcatcatatattaccctggtggttcttttcgtgccgaagatgagaagactgattactcggggagaatggcagagcgaggctcaagacacaatgaagaccggttctagtacgaacaacaacgaggaagaaaaaagtaggctgctggagaaagagaaccgggaactagagaagatcatcgctgagaaggaagaacgcgtgtccgagttaagacaccagctgcagagcagacagcagctgcgaagcagaagacacccaccaactcccccagaacctagcggtgggcttcccaggggacctcctgaacctccagataggctctcgtgcgacggcagtagggtccacctgctctataagtag

SEQ ID NO: 10645 - DNA, 1020 bp, Artificial Sequence
  Description of Artificial Sequence: Synthetic coding sequence
atggtgtccaaaagcaggtggaagctgttggcaatgttggctctcgtgctcgtagttatggtctggtatagcatctccagagaggataggtatatcgaactcttctattttcccattcctgaaaaaaaggagccctgtctgcagggagaggcagagtccaaggccagcaaacttttcgggaaactgtcccctctgtgctcctactcaagggaccaaccaatatttctccgactggaagactacttctgggtcaaaacacccagcgcttatgagctgccatatggtactaagggctccgaggatctgttgcttagggttcttgcaatcacatcttcctcaatccccaagaacatacagtcactaaggtgcagacggtgtgttgtagtggggaacggacaccgcttgcgcaacagcagtctgggggatgccatcaataaatacgacgtcgttattcgcctgaataatgcccctgttgcaggatatgagggtgatgtggggtcaaagactactatgaggctcttttatcctgagtcagcgcattttgaccctaaagttgagaacaatcctgatacgcttcttgtcttggttgctttcaaagcaatggatttccattggatcgaaaccatactgagtgataaaaaaagagtccgcaagggtttctggaaacagcctccattgatctgggatgttaatcctaaacagatacgaattctaaaccccttcttcatggaaatagctgctgacaaactgctaagtctgcccatgcagcagcctcgcaagattaaacagaaaccaacgaccgggctcttggctattaccctcgctcttcatctgtgtgatctggtgcacattgcagggtttggataccccgatgcctacaacaagaagcagaccatacactattatgaacagatcaccttaaagagcatggcgggatctggacacaacgtttctcaggaagctcttgccattaaacgtatgctggaaatgggagctattaagaacctgacctcattttag

SEQ ID NO: 10646 - DNA, 1386 bp, Artificial Sequence
  Description of Artificial Sequence: Synthetic coding sequence
atgtctctggatatacaatctctcgacattcagtgcgaggagttgagtgatgcaagatgggccgagttgctgccccttctgcagcagtgtcaggtggtgaggctggatgattgtggcctgactgaggctcgatgtaaagatatcagctctgcgcttagggtcaacccggctctcgccgagctgaatttacgcagcaatgaactaggcgacgtgggggtgcattgcgtccttcagggcctgcagacccccagttgcaaaatccagaagttgagcctgcagaactgctgtttgaccggggctgggtgtggcgtgttgtcttctacgttacgcacgcttccgactttgcaagagttgcatctgtccgacaaccttctgggtgatgcaggcctgcaactcctgtgcgaagggctccttgatcctcaatgcaggctggaaaaactgcagttagaatattgcagcttgtcagcagcctcctgtgagccactggcaagcgttctccgtgcgaaacctgactttaaggaactgactgttagtaataatgacatcaacgaagccggtgtgagggttctatgtcagggacttaaagacagcccctgtcagctggaagcgctaaaactggagagttgtggagtgacatcagacaactgccgcgacttatgtggcatcgtggcctcaaaagcctccctgcgggaacttgcgctgggatccaacaaactgggagatgttggcatggctgagctctgtccaggactgttgcacccaagcagcaggttgaggacactgtggatctgggagtgcgggatcactgccaaaggctgcggggacttgtgccgggtgttgcgcgcaaaggagtccctgaaggagctctccctagcaggcaatgaattaggcgacgagggagcgaggctgctgtgcgagacccttttagagccagggtgccagctcgagtctctgtgggttaaaagctgctcctttactgctgcctgctgcagccacttcagttccgtattagcgcagaaccggttcctgctggagctgcaaatttcaaacaaccgccttgaggacgcaggggtacgtgagctttgtcagggcctgggccagcccggttccgtcttgcgcgtgctttggttggcagactgcgatgtctctgattccagctgctcatcgttggctgctaccttgcttgccaatcatagtcttcgcgaactggacctgagtaacaactgtctaggggacgccggaatcctacagttagtggagagtgtgcgacagccagggtgtctgctcgagcagctggttctctatgacatatattggtcagaggagatggaggatcgactccaagccctggagaaggataaaccctccctgagggtaattagctag

SEQ ID NO: 10647 - DNA, 1695 bp, Artificial Sequence
  Description of Artificial Sequence: Synthetic coding sequence
atggcccctaaaaaattatcatgcctccggagcttactgctgcccctgagcctcacgctgcttttacctcaggcagataccagatcttttgtggttgaccggggacacgacaggttcctcctggacggcgctcctttccgctatgtgtccggttccttgcactatttcagggtgcctcgagtgctgtgggcggataggcttctaaaaatgagatggtccgggctgaatgctattcagttctatgtgccttggaattaccacgagccacagcctggcgtctataacttcaacggcagccgtgatcttattgcttttctgaatgaggcggctctggcgaatctgctggtcattctgagaccaggtccctacatctgtgctgaatgggaaatgggcggacttccctcctggctccttagaaagcccgagattcatttaagaacatcagatccagcagataacatgactaagattttcactctgctcagaaaatacgagccccacggaccactggtgaacagcgaatactacaccggctggctcgactactgggggcagaaccactccactaggagcgtgtccgccgtcaccaagggcttggagaacatgttgaagctgggggcatcagtgaacatgtatatgtttcacggcggaacaaatttcggctattggaatggggcagacaaaaaaggcagattccttccaataaccacaagttatgattatgacgcgccaatcagcgaggccggtgacccaacccctaagctgttcgccctgcgagatgtgatctctaagttccaggaggttcccctcggtcccttacctccaccatccccgaagatgatgctcggccctgttactctgcacctcgtgggtcaccttctcgcattcctagatttgctgtgtcctagaggacctattcactccattctgccaatgacgttcgaagccgtgaaacaggatcacggatttatgctgtacagaacctacatgactcatacaatctttgagcctacgccattttgggtgccaaacaacggcgtgcatgatagagcgtatgtcatggtggacggcgtgttccagggagtggtggagaggaacatgcgcgacaagctgttcctcaccggaaaacttggctctaaattagacatcctagtggaaaacatgggtagactgtcttttggtagtaattcttccgactttaaaggattactgaaaccccctatactaggacaaacgatcctgacgcagtggatgatgttccccctgaagatagataatcttgtgaagtggtggttcccactccagctgcccaaatggccctatcctcaagctccatctgggccaaccttctattccaaaacctttcctatcttgggctcggtgggagatacgttcctctatctgcctggctggaccaaagggcaggtttggatcaacgggttcaatctggggagatactggacgaaacagggtccacagcagacattgtacgtgcctagattcctgctttttccgaggggcgcactcaacaaaattaccctattagagctagaggatgtcccactccaacctcaagtacagtttctggataagcccatcctgaattctacaagcacgctgcataggacccacatcaactctctgtccgcagacacgttaagcgcttccgaaccaatggaactgtccggtcactag

SEQ ID NO: 10648 - DNA, 1317 bp, Artificial Sequence
  Description of Artificial Sequence: Synthetic coding sequence
atgatgtacgccccagtggagttctctgaagcagagttttcgcgcgcagaatatcagaggaaacagcagttttgggacagtgtgcgtttggccctgttcactctagccatcgtagcaatcatcggtatcgcaatcggaatcgtcacccattttgtcgttgaggatgacaagtcgttctactacctggcatccttcaaggtgaccaatattaaatacaaggagaactacggcattcgctcttctcgggaattcattgagcgtagtcatcagattgagagaatgatgtcccggatttttcggcatagctccgtgggaggaagatttatcaagagtcatgtgatcaaactgagcccagatgaacagggggtagatatattaattgtcctgatcttccgctatcccagtactgacagtgcggagcagatcaagaaaaagattgagaaggctctgtatcagagcttaaaaacaaagcagctcagtttgacaatcaacaagcccagctttcgtttgacaccgatcgactcaaagaagatgcggaaccttcttaatagtcggtgcggaataaggatgacgagctctaatatgccccttccagcctcctcatccacccagcgtattgtgcaagggagagaaaccgcaatggaaggcgagtggccatggcaggcctcgcttcaactgataggaagtggacaccagtgcggcgcaagtttgatcagcaatacctggctgctgaccgccgctcactgtttttggaaaaataaggacccaacccagtggattgccacatttggcgctactatcactccaccagctgtcaagcgcaatgtgagaaagatcattcttcatgaaaattaccatagggagacaaatgagaacgatatagccctcgtccagttaagtaccggcgttgagttctcgaatattgtgcagagagtatgtctacccgatagcagcatcaagctgccgccaaagacgagcgtgtttgtgaccggtttcggtagcatcgttgatgacggcccaattcagaacacattacggcaggctagggtggagacaatttcgaccgatgtctgcaatcggaaggatgtttacgacggcttgatcactcccggaatgctgtgtgccggattcatggaggggaaaattgatgcatgcaagggagattctggcggacccttagtttacgataatcacgatatctggtatatcgtgggcattgtttcatggggccagtcttgtgcactgcccaagaaacccggtgtgtacaccagggtgacaaagtatcgtgactggatcgcttccaaaactggtatgtag

SEQ ID NO: 10649 - DNA, 4392 bp, Artificial Sequence
  Description of Artificial Sequence: Synthetic coding sequence
atggaacccagactcttctgttggactacactcttcctgctggccggatggtgtctcccaggactgccctgccctagtcgatgcttgtgctttaaatccacggttaggtgtatgcacctgatgttggaccacataccccaggtgccccagcagacgacagtgctcgatctgcgatttaataggatacgagagattcctgggtccgcttttaaaaagttgaagaacctaaatactctgctgcttaacaacaatcacatcagaaaaatcagtagaaacgcctttgaggggctggaaaatttactctacctttacctctacaagaatgagatccacgcactggacaaacagaccttcaaaggactcatctctctggaacatctgtacattcattttaaccagcttgagatgctccagcccgagacattcggcgacttgttgagactcgaacgcctgtttcttcataacaataagctgtctaaaatacctgccggtagctttagcaacctggattcactgaagaggctcaggctcgactctaacgctctcgtttgcgattgtgatctgatgtggctaggggagttgttgcaggggttcgctcaacatgggcacactcaagctgccgctacatgcgaatatcccaggaggctgcatgggagggccgtagcttctgtcactgtggaggagtttaactgccagtcccctcgtatcacgttcgagccccaggatgtagaggtaccctccggcaacaccgtctactttacgtgtcgggctgagggcaatcccaaacccgagatcatatggatccataacaatcatagtctcgacctggaagacgacaccaggctgaacgtgttcgacgatgggactctcatgattcgcaacacgagagagtcagaccagggagtctatcaatgtatggctaggaattctgcaggagaggctaaaacccagtccgcaatgttgcgctactcatcccttccagccaagccctcttttgtcattcagcctcaggacaccgaagtacttattgggacctctacaaccctcgaatgcatggccacagggcatcctcatcccttaatcacatggactcgggacaacggcctggaattggacggatccagacacgttgctacaagttccggcctgtacttacaaaacattacgcagagggaccacggcaggttcacttgccacgctaacaatagtcacggaacagttcaggcggcagctaacattattgtgcaagccccaccgcagttcaccgtgacaccaaaagaccaagttgtactcgaggaacacgccgtggagtggctttgtgaagcagatgggaatccgcctcctgttatcgtttggactaagaccggagggcagctccccgtcgagggtcagcacaccgtactctcatcaggtaccttgaggatcgatagggccgctcagcatgatcagggacaatacgagtgccaggcggtgtccagtctcggcgttaaaaaagtctccgtccagttaacggtgaaacccaaggcattggcagtgtttacccagctgcctcaagatacttctgttgaggtgggaaagaatatcaatatcagctgtcacgcccaaggggaaccgcagcctatcatcacttggaacaaggagggagtccagatcactgaaagcggcaagttccacgtcgacgatgaagggacattgaccatctatgatgccggtttccctgaccaaggccgttacgaatgcgtggctcgaaattcattcgggctggccgttacaaacatgtttctcacagtgacagccattcagggaaggcaggctggagacgactttgtggaatctagtatattagacgcggtccagcgtgtggattctgctattaactccactaggaggcatctgttctcccagaagccacacactagctcagacctgttggcccaatttcactatcctagggatcccctgatcgttgagatggccagggccggagagatatttgagcacactctgcagctgattcgcgagcgggttaagcaaggactaactgtggatctggaaggcaaagagtttcggtacaacgatttagtctccccccgaagcctcagccttatagccaatctctccggatgcaccgccagacgccctctgcccaattgttccaatcgctgcttccacgcaaagtacagagcacatgatggcacctgcaacaacttgcagcagcctacctggggggctgcgctgactgccttcgccaggctgttgcagccagcataccgggacgggatcagagccccacgcggactggggctgccagttggtagccgacagccgttaccccctcccaggctggtcgccaccgtctgggctagagcagcagcagtgacccccgatcacagctacacgaggatgttaatgcactggggatggtttttagagcatgatctggatcacactgtccccgcactatccaccgctagattctctgatggcagaccttgttcatccgtgtgcaccaacgatccaccctgctttccgatgaacacgcggcacgcggatcccagaggtacccatgcaccctgtatgcttttcgctagatcttcgccagcgtgtgccagtggtcggccatcagccactgtagactcagtctacgcccgagagcagattaatcagcagacggcttacatcgacgggtccaacgtttatggctccagcgaacgggaatcccaggcgctgcgggacccttccgttccacggggactccttaaaacagggttcccctggccaccttcggggaagcccttacttccatttagtacgggtccaccaacggagtgcgcacgacaggagcaggaatctccctgcttcctagctggtgaccacagagctaatgaacacctggcgctggctgcaatgcacaccttgtggttccgggagcacaaccggatggcaactgaattgtccgccctgaacccccattgggagggtaacaccgtttatcaggaagctcgtaaaatcgtaggtgcggaattgcagcatattacctactcacactggcttcctaaagttctcggggacccagggacgaggatgttacggggttacagggggtacaacccaaacgttaatgcaggcattataaacagctttgccaccgcagccttcaggtttggtcacaccttgatcaaccctattctatacagattgaacgcaactctgggcgaaatttctgaaggccacctgcctttccacaaggccctgttcagccctagtcgaatcatcaaggagggtggtatcgaccctgtgctgcggggtctgtttggagtggctgccaagtggcgggcaccctcttatctgctctcgcctgagctgactcagagactatttagtgcagcctactctgcagccgtcgattccgccgctactatcatccaacgtgggagggatcacggcatccccccatatgtagattttcgggtgttctgcaatttgacatctgtgaaaaactttgaggatttacagaacgagatcaaggacagtgaaatccggcagaaacttcgtaagctctacggaagccctggcgacattgatctgtggcctgccctaatggtagaggatctaatccctggtacccgggtcggtcccacgctgatgtgcctatttgttactcagtttcagagactccgggacggcgatagattctggtacgaaaacccaggagtttttacaccagcacagctgacccagctgaaacaagcttcactttcccgggtgttatgcgataacggtgatagcatacaacaggtgcaggccgatgtctttgtaaaggccgagtatcctcaagactatctgaattgctccgagattcctaaggtcgacttgcgcgtatggcaggattgttgcgcagactgcaggtcccgaggacagtttagggcggttacgcaggagtcccagaaaaaacgttctgcccagtattcttatccagtcgacaaggacatggagttatcgcacctgaggtccagacagcaggataaaatctatgtcggagaggacgcccgtaacgtgactgtcctcgcaaagaccaaattcagtcaggatttttctacgttcgcagctgagatccaggagaccattacagccctgcgtgagcagatcaataaactggaggcaaggcttagacaagccggatgcactgatgtgcgaggggtcccaagaaaagcggaggagaggtggatgaaagaagactgtacacattgtatttgcgagagtgggcaggtgacgtgtgtagttgagatctgcccacctgcaccatgcccatcccccgaactggtcaaaggcacttgctgccctgtgtgtcgcgatcgcggtatgcccagtgattctccggagaagaggtag

SEQ ID NO: 10650 - DNA, 1206 bp, Artificial Sequence
  Description of Artificial Sequence: Synthetic coding sequence
atgggccttaaggcactctgtctgggactgctgtgcgtacttttcgtaagccatttctatactcctatgcctgataatatagaggagagctggaaaatcatggccctggacgctatagctaaaacttgtacatttacagcaatgtgttttgaaaatatgaggatcatgcggtatgaggaatttataagcatgatttttcggctagactatacacagcccttatcagatgaatacattaccgtgacggacactacttttgtagacataccagtgcgactgtatttgccgaaaagaaaatctgaaaccagacggcgtgctgtgatctacttccatgggggtggcttttgtttcggcagttctaaacagagagctttcgattttttaaaccgctggactgctaatacccttgacgccgtcgttgtgggtgttgattaccgcctggcccctcagcaccactttcccgctcagttcgaggatggtctggctgccgtcaagttcttcttgcttgagaagattctaacgaagtatggagtcgatcccaccagaatatgtattgccggagactcatcaggcggtaacctcgcgactgctgtcacacagcaggtgcagaatgatgctgagattaagcacaagattaaaatgcaggtactcttgtatcccggtcttcagatcaccgattcttatctcccatctcatcgtgaaaatgaacatggtatcgtgctcactcgtgatgtcgcgattaaattggtcagcttgtacttcacgaaagacgaagcccttccctgggccatgagacgtaaccagcatatgcccttggaatcaagacacctatttaagtttgtgaactggtcgatactattgccagaaaaatacaggaaggattatgtatacaccgagccaattctaggcggtttgtcttacagtcttccgggtttgacagacagcagggcactgcctctactggccaacgactctcaacttcagaaccttcccctcacatacattctcacctgccagcacgacctgctaagggacgacggcttgatgtatgtgacaagactgagaaacgtgggcgttcaggtggtccacgagcacattgaggatggcattcatggagcactctccttcatgactagccccttctatttgcggcttgggttaagaattagggatatgtacgtcagctggcttgataaaaatctttag

SEQ ID NO: 10651 - DNA, 264 bp, Artificial Sequence
  Description of Artificial Sequence: Synthetic coding sequence
atggtgagtttgatgaaattatggattccaatgctgatgacatttttctgtaccgtgcttctctcggtgctaggtgaaatgcggaagaaacgatacgacaggaaggaactgcttctggaggagtgctggggcaaaccaaatgtgaaagagtgtactaacaagtgctcaaaggcattccgctgcaaagacaaaaattacacctgttgctggacttactgcggcaacatctgttggatcaatgtggagacaagcggagactattag

SEQ ID NO: 10652 - DNA, 813 bp, Artificial Sequence
  Description of Artificial Sequence: Synthetic coding sequence
atgagaggccagggacgcaaggagtctttgtcagactcccgggacctggatgggagctatgatcaactgaccggtcacccccctggtcctaccaaaaaagctcttaagcagcgattcctcaaactcctcccctgttgtggaccgcaggccctgcctagcgtgtcggaaacattggctgcccctgcatcattgcggccacaccggccacggctgctggaccctgacagcgtcgacgatgagtttgagttaagcaccgtttgccacagacctgaaggactcgagcaattacaggagcaaaccaaattcactagaaaagaattgcaagtgctctaccggggatttaagaacgagtgcccatctggaatcgtgaacgaggagaattttaaacaaatttacagccagtttttccctcagggagactcttcgacatacgccacctttctgtttaacgcattcgacaccaaccacgatggttctgttagtttcgaggacttcgtcgccggtttgagcgtcatcctgagaggtacagtcgacgaccgactcaattgggcattcaatctgtacgacctgaataaagatgggtgtatcaccaaggaggagatgctggatatcatgaaaagtatctacgacatgatggggaaatacacatacccggctttgcgtgaggaggccccacgggagcatgttgaaagctttttccagaagatggatcgaaataaggatggggtggttactattgaagagtttatcgaatcttgtcaaaaggacgagaacatcatgcgctccatgcagctgttcgacaacgtaatctag

SEQ ID NO: 10653 - DNA, 819 bp, Artificial Sequence
  Description of Artificial Sequence: Synthetic coding sequence
atgcacctgcggctaataagctggctcttcatcatattaaacttcatggagtatattggatcacagaacgcgtcccgcggtaggcgacagaggagaatgcaccccaacgtatctcagggctgccagggtggctgcgccacttgttctgactacaacggctgtctgagctgtaaacccagactgttcttcgcccttgagcggattggtatgaagcagataggcgtgtgtctgagcagctgccccagcgggtactatggaacgcggtatccagacattaacaagtgtaccaagtgtaaggccgattgcgatacgtgtttcaacaaaaatttctgtacaaagtgcaaaagtggtttctatttgcatctgggtaaatgcttagataattgccccgaaggcctggaggcgaataatcataccatggaatgcgtgagtatagtccattgcgaggtctctgagtggaatccttggagcccatgtacgaaaaaaggcaaaacgtgtggctttaagcgcggtacggagactcgagtgcgggagatcattcaacaccccagcgccaaagggaacctatgcccaccaaccaacgagactcgcaaatgtaccgtgcagaggaagaagtgccagaagggcgaaagaggtaaaaaggggagagagaggaagcggaagaaacccaataaaggagaatccaaggaagccatacctgactctaagagtctcgaaagctcaaaagaaatccctgaacagcgtgaaaacaaacaacaacagaagaaacgaaaggtgcaagacaagcagaagagtgtgagcgtgtcaaccgtgcactag

SEQ ID NO: 10654 - DNA, 294 bp, Artificial Sequence
  Description of Artificial Sequence: Synthetic coding sequence
atggcgaagagtttccccgtgttcagcctgctctcctttatcttgatccaccttgtactctcttctgtgagtggccctagacattggtggccaccacggggaatcatcaaagtgaaatgtccctatgaaaaagtgaatctgtcctggtataatggcactgtcaacccctgtcctgggctgtaccagcccatctgtggaactaactttatcacctacgataacccctgcattctgtgcgtagagtccctaaaaagccatgggagaattagattttaccacgacggaaagtgctag

SEQ ID NO: 10655 - DNA, 726 bp, Artificial Sequence
  Description of Artificial Sequence: Synthetic coding sequence
atgtggaccgtgagaactgaggggggtcacttccctctgcatagcccaacatttagttggcggaatgtagcttttctgttgctcctctcgctagccctcgagtggacttcagcaatgctgaccaagaaaattaagcacaaacccggtctgtgccccaaggagaggctgacctgcacaaccgagctacccgattcatgtaatacagacttcgattgcaaagaatatcagaaatgttgcttcttcgcgtgccagaaaaagtgtatggatccgtttcaagaaccatgcatgctgcccgtgcgacacgggaactgcaatcatgaagcccagcgatggcactttgattttaagaactatcgctgtaccccctttaaataccggggatgtgagggaaacgccaacaacttcctgaacgaagacgcttgtcggaccgcctgcatgctgattgtgaaggatggtcagtgccccctctttccatttactgaacggaaagagtgcccaccatcgtgtcacagcgacatagactgtccccagaccgacaagtgttgcgagagtcggtgtggttttgtctgtgcacgagcctggacagttaagaagggcttttgccctaggaaacccctgttgtgtacaaagatcgacaaacctaaatgtctgcaggacgaggaatgtcctttagtggagaaatgttgcagccactgtggactcaagtgtatggaccccagaagatag

SEQ ID NO: 10656 - DNA, 1827 bp, Artificial Sequence
  Description of Artificial Sequence: Synthetic coding sequence
atggctagagcgagagctggcgcattgctggcactctgggttttaggggcagctgcccacccacagtgcctcgacttcagacccccattccgccctacccagccactgcggctttgcgctcagtactccgattttggctgctgcgatgagggcagagatgctgagcttacgagaaggttctgggccctcgcttctcgcgtcgacgccgctgaatgggctgcctgtgctgggtacgctcgcgatctgctgtgtcaggaatgtagcccctacgccgctcatctgtacgatgctgaggatccattcactccactgaggactgtgcccggactctgtcaggactactgtctcgatatgtggcataagtgccggggactgtttcgtcacctgagtacagatcaggaactctgggccttggaggggaatctcgcacgcttctgccgctacctcagcctcgatgataccgactactgcttcccctacctgctggtcaacaagaatttaaactccaatcttgggcacgtcgtggcggacgctaaaggctgcctgcagctatgcttggaggaggttgctaatggcctgcgtaatcccgtagctatggtgcacgccagagatgggactcaccggttcttcgtggctgaacaggtgggactcgtatgggcttacctgccggaccgatctcgactgggtaagccgttcctgaatattagtagggtggtcctgacttccccgtgggaaggcgatgagcgagggtttctggggatagcctttcacccttcattccagcacaacagaagactctatgtgtactacagcgtgggcatcagaagtagcgagtggatccggatatccgagtttagagtgtcagaggatgacgagaacgccgtcgatcattcaagcgagaggattattctggaagttaaagaacccgcatcaaatcataacgggggacagctcctattcggcgacgacggatatctgtacattttcaccggagatggaggcatggccggagacccctttggaacattcgggaatgcacagaataagtctgccctgctgggaaaagtgctgcgcatcgacgtggacagaaaggaacgcggactaccttacggaatccccccagataacccattcgtgggcgaccccgctgcacaacctgaagtgtatgctctgggtgtcaggaacatgtggagatgcagctttgatagaggggatccatcatccggcacaggaagaggacgacttttctgtggcgacgtgggacagaataagttcgaggaggtggacgtagtcgaaaggggaggtaattacggatggagagcacgcgaaggatttgagtgttacgaccgatcgctgtgcgctaacacctctttgaatgatctcttgcctattttcgcctacccacacacagtcgggaaaagtgtgactggaggctacgtgtaccgtggatgtgagtaccccaatctgaacggcctgtacattttcggggattttatgtcaggacggctgatgagcctacaggagaatcctggaaccggtcaatggcaatactccgaaatctgcatgggacatggccaaacatgcgaatttcctgggctcattaataattattacccttacatcatcagcttcggggaggatgaggccggtgaattgtattttatgtccactggtgaaccttctgccaccgcccctcggggtgttgtgtacaagatcatagacgcatcctcctgcaaggccagatcggccatgcccggatacgtgcctgcgcctagcgtatgctcctctttgacctctcagccatttatactacaatggtggaagtag

SEQ ID NO: 10657 - DNA, 351 bp, Artificial Sequence
  Description of Artificial Sequence: Synthetic coding sequence
atggcccctccaagcgtaccactggtacttttactagtattgctgctcagcttggctgagacccctgcttcagcaccagctcacaggggtagaggcggttggacccttaattcagccggttacctactgggccctgtgctgcacctcccacagatgggggaccaggatgggaagcgtgagaccgctctagaaatcctggatctctggaaagcaatcgatgggctgccatactctcatcccccacaaccctctaagcgcaatgtgatggagactttcgctaagccagagataggagatctgggaatgctaagtatgaaaatcccgaaagaggaggacgtcctcaagtcctag

SEQ ID NO: 10658 - DNA, 3618 bp, Artificial Sequence
  Description of Artificial Sequence: Synthetic coding sequence
atgaggaagccgagaaggaagtcccggcagaacgccgagggacgccgatccccgtccccctatagcctcaagtgctctcccactcgggagacattgacctacgctcaagcgcaacgcatcgtcgaagtggacattgatggtcggctgcaccgcatttcgatctacgaccccttgaaaatcatcaccgaggatgaactcaccgcacaagatattacggagtgtaatagtaataaagaaaattccgagcagccacagtttcctggcaaatctaaaaagccgagcagcaaggggaagaagaaagagagctgttccaagcacgcctctggcacaagcttccacctgccgcagccaagctttagaatggttgactccggcatccagccagaggctcctcccctgcctgctgcatactatcggtacattgagaaaccccctgaggatctcgatgccgaagtcgagtacgatatggatgaggaggacctggcatggctggacatggtcaacgagaagaggagagtggacggccattccctcgtctccgccgatacatttgagctgctcgtggaccgccttgaaaaagaatcttacctggagagtcgctccagcggagcccagcagagcctgatcgacgaagatgccttttgctgcgtgtgcctggatgatgagtgtcacaacagcaacgtgattctcttttgtgacatctgcaacctggccgtgcaccaggaatgttacggggtcccatacatcccagaaggccagtggctctgccgctgctgcctgcaatccccatcacgacctgtggactgcattttgtgccctaacaaagggggagctttcaaacagaccagtgacggccattgggcccacgttgtctgtgccatctggatccccgaggtctgcttcgctaacactgtctttctcgagcctatcgaaggcatcgacaacatcccacccgctcgctggaagctgacatgctatatctgtaagcagaaggggcttggtgccgcaattcagtgccacaaagttaattgctacactgccttccatgtgacctgtgcgcaacgcgcaggcctcttcatgaagatagagccaatgcgggagacgtctctgaacggaactatcttcactgtgcgcaagacggcctactgtgaggctcatagcccgcctggggcagccaccgccagaaggaagggagactcaccgaggtcaatctctgaaactggtgacgaggagggcttaaaggaaggagacggggaagaagaggaggaggaagaagtcgaggaagaagaacaagaagcgcagggaggtgtgtccggctctctgaagggtgtgccaaaaaagtctaaaatgtcgttgaaacagaagatcaagaaggagcccgaggaagccggacaggacactccatctacccttcctatgcttgcagtgccacagattccatcttatagacttaacaaaatatgtagcggactgtccttccagagaaagaaccaattcatgcaacgcttgcacaactactggctcctgaaaagacaagccaggaatggcgtccctctcatccggcgtcttcattcacatctgcagagccagagaaatgcggaacagagagagcaagacgagaaaacctccgctgtaaaagaagaactgaagtattggcagaagctgcgccatgacctagagcgtgcccgattgctgatcgagttgatcagaaagcgcgaaaagctgaaacgcgagcaggttaaggtgcaacaagcagccatggagctcgagctgatgccttttaacgtcttgctgcgcactactctggacctgttgcaagaaaaggatcctgcgcacatctttgccgaaccagtcaatctgtctgaggtgcctgactatctcgagttcatctccaaacccatggatttcagcaccatgagacgcaaactagaaagtcacctctaccgaaccctggaagagttcgaagaagatttcaacctcatcgtcactaattgcatgaagtacaatgctaaggacactatttttcacagagcagccgtgcgcctgcgtgacttaggtggagccatcttgaggcatgccaggagacaagcggaaaacattgggtacgatccagagcggggtacccacttgcccgagagccccaagctcgaagatttttacaggttctcctgggaggatgtggataatattctcattccagagaatagagcccatctgagtcctgaggtccagcttaaggagctgctcgagaaactcgatttggttagcgctatgaggtcatccggcgctagaacaagaagagttcggttgctgcgcagggagataaacgccctcaggcagaaactggctcagccgcctccaccacaacccccttccctaaataaaaccgttagtaacggcgaactgcccgcagggccacagggcgacgccgcagttctggagcaggctctccaggaggaaccagaagacgacggcgatcgcgatgatagcaagctgccaccccctcctaccctagagcccactggtcctgcgccatcactgagtgaacaggagtcgccccctgaaccgccaactcttaagccgattaatgactccaagcctccaagccggttccttaaaccaagaaaagtcgaagaagacgagctgctggagaaatcccctctccagctcgggaacgaaccactacagaggctgttgagcgacaatggcataaacaggttgtcactgatggcccctgacacccccgctgggacccctttgtccggcgtggggaggcgaaccagtgtgctgttcaaaaaagccaagaacggtgtcaaacttcagcgcagccccgatagggtactcgaaaacggagaggatcacggcgttgctggttcacccgcaagccctgctagtatcgaagaagagcgtcacagcagaaaacgtccgcgttcacgcagctgttcagagtctgagggggagcggagcccccagcaagaagaggaaaccgggatgactaacgggttcggaaagcatacagagtcaggcagtgattctgagtgttcactgggcctttccggcggacttgctttcgaggcatgctccggcttgacgcccccaaagaggtctcgcggaaaaccagccctaagccgggtccctttcctggaaggcgttaacggtgactcagactataatggctctgggcgttccttactgttaccttttgaggaccgcggagacctcgaacccctagaactcgtgtgggccaaatgccggggttatccctcttaccccgcattgataatcgatcctaagatgccacgtgaaggcctgctccataacggagtgccaataccagtccctcctctagatgttttaaagctaggtgagcagaaacaggctgaagctggcgaaaaactgtttctggttctgttctttgataacaagaggacgtggcagtggctgccgagagataaggtgctcccgcttggcgtggaagatactgtggataaactcaagatgctggagggcagaaagaccagcattcgaaagagcgttcaggtggcgtatgatagagctatgattcatcttagccgcgtcaggggccctcattccttcgttacctcttcctacctgtag

SEQ ID NO: 10659 - DNA, 1977 bp, Artificial Sequence
  Description of Artificial Sequence: Synthetic coding sequence
atgttcgttagctatctgatcctaacgctgctacatgttcagaccgctgttttggcacggccagggggagaaagtatcggctgtgacgactaccttggttccgataaagttgtggacaagtgtggagtgtgcggaggcgacaacaccggttgccaagttgtctccggtgtgtttaaacacgccttgacctcgctcggctatcatagagtcgtcgaaattccagaaggtgctaccaagataaatattaccgagatgtataagtcgaacaattacctcgctttgaggtcccgtagtgggagatccatcattaatggcaactgggcgattgaccggccaggtaagtatgaaggagggggaaccatgtttacatataagcggcctaatgaaataagttctactgcgggagagtcctttcttgccgaggggccaaccaacgagatcctggacgtatacatgatacaccaacagcccaatcctggcgtgcactacgagtacgttatcatgggcactaacgccatctcacctcaggtgccccctcacaggcggccaggagagccgtttaacggccagatggtcacggagggcaggagtcaggaggaaggcgaacaaaagggaaggaatgaagagaaagaagacctcagaggggaagcccctgaaatgttcacatctgaatccgcgcagacattcccagtgagacaccccgatcggttctcccctcatcgtccggataacttggtgccacctgctccacagcctccacgcagaagtcgagaccataactggaagcagcttggtaccacagagtgttcaactacgtgcgggaaggggtcacagtaccccatcttcagatgtgttcatagatcaacccatgaggaggccccagagtcttattgtgactcctccatgaagcctactccggaggaggagccttgtaacatcttcccttgtcccgctttctgggacattggggagtggtccgagtgtagcaagacctgtggtcttggcatgcaacaccggcaagtgctatgtcggcaggtgtacgcaaatcggtcactgactgtgcagccttacaggtgtcaacacttggaaaagcccgagaccacctccacctgccagctcaaaatctgttccgagtggcaaattagaaccgactggacttcatgctctgtgccttgcggagtgggacagcgaactagagacgttaaatgtgtctcgaacataggcgacgtagtcgatgacgaggagtgtaacatgaagcttcgacctaacgacatagagaattgcgatatgggcccttgtgccaaatcatggttccttactgagtggtctgaacgatgttcggccgaatgcggcgcaggggtgcgaaccagatctgttgtctgtatgacaaaccacgtaagcagccttccgctggaggggtgtgggaataataggcccgctgaagccacaccttgtgacaacggtccttgtactggcaaggttgaatggtttgctggatcctggagtcagtgttcaattgaatgcgggtcaggcacccagcaacgggaagtgatttgcgtgagaaaaaacgccgatactttcgaggtgttagatccgtcagagtgctcctttctggagaagccgccatcccagcaatcgtgccatttgaaaccctgtggcgctaagtggttctccaccgagtggtcaatgtgttcaaagagctgccagggtggctttagggtgcgggaagtacgctgtttgagtgacgatatgacacttagtaacctgtgcgatccccagctaaaaccggaagaaagagaatcgtgcaacccgcaggactgcgtgcctgaggtcgatgaaaattgtaaggataagtactacaactgcaacgtggttgtccaggcaaggctctgcgtatataactattacaagaccgcatgttgcgcctcttgtacccgggtcgctaacagacagaccggattcctgggttcccggtag

SEQ ID NO: 10660 - DNA, 708 bp, Artificial Sequence
  Description of Artificial Sequence: Synthetic coding sequence
atgcggcctcttgccggtggcttgttgaaggtcgtgtttgtcgtgttcgccagcctgtgtgcttggtactctggatacctgttggcggagttaatcccagatgcacccttgtcctccgccgcttacagtatcaggagtataggcgaacgacccgtgctgaaggccccagtgcccaaaagacagaagtgcgaccactggacgccctgcccttccgacacctacgcatataggctgttgtcgggcggaggtcggagtaagtacgctaagatttgtttcgaagataaccttctgatgggcgagcagctgggcaatgtcgctagagggatcaacattgccattgtgaactatgtgacagggaacgtcaccgctaccagatgcttcgatatgtacgagggagataacagcgggcctatgaccaagtttatccaatcagctgctccaaaaagcttgctgttcatggttacctacgatgatgggtccacgaggcttaacaatgatgctaagaacgctattgaggcacttgggagcaaagagatcagaaatatgaaattccgctccagctgggtgtttattgccgctaagggcctggagctcccatccgagatccaaagggagaagatcaatcactctgatgccaagaataacagatacagcggatggcccgctgaaattcaaattgagggctgcatccccaaggagcgctcttag

SEQ ID NO: 10661 - DNA, 759 bp, Artificial Sequence
  Description of Artificial Sequence: Synthetic coding sequence
atgagggggcaaggcagaaaagaaagcctcagcgatagcagggacctggatggcagctatgatcagctcacagggcatcccccaggtccgactaaaaaagctttaaaacagcggttcttaaagcttcttccatgctgcggcccacaggctctgccgtccgtgtccgaaaactcagtcgacgacgagtttgaactctcaaccgtgtgtcaccgcccagaaggcctcgagcagttgcaagaacagacaaaatttacccggaaggagctgcaggttttgtacagaggattcaagaacgagtgtccctcaggcatcgtgaatgaggagaactttaagcagatatacagccagttcttcccacagggtgattctagcacctacgcgacattcctatttaatgctttcgacacaaaccatgacggtagcgtgtcgttcgaagatttcgtggccggtctctcggtgatccttcggggtaccgttgacgaccggctgaattgggcatttaacctgtatgacctgaataaagatggttgcatcacaaaggaggagatgcttgacataatgaaaagcatttatgatatgatggggaaatacacctaccccgcactgagggaagaggcacctcgcgaacatgttgagtcctttttccagaaaatggataggaataaagatggcgtggtgacgatcgaagagttcatcgaatcctgtcagaaagatgaaaacatcatgcggtccatgcagttgttcgacaatgtgatttag

SEQ ID NO: 10662 - DNA, 312 bp, Artificial Sequence
  Description of Artificial Sequence: Synthetic coding sequence
atgtccggcaggggcaagggcggaaaaggcctgggaaaggggggagctaaacgccaccgcaaggtgctacgggataacattcaggggatcactaaacccgctatccggaggcttgcgaggcgagggggtgtgaaacggatttccggtctgatctatgaggaaactcggggtgtcctgaaagtgtttctggagaacgtaatcagagacgctgttacttataccgagcacgccaaacggaaaactgtcacagctatggacgtggtgtacgcacttaagagacaaggtcgtacactgtatggttttggaggctag

SEQ ID NO: 10663 - DNA, 3120 bp, Artificial Sequence
  Description of Artificial Sequence: Synthetic coding sequence
atggaggtgactgccgtggcgacacagggtggatatggtagcagcgattgggttacgagttacctgttgatgttctctgatggagggaggaattggaagcagtacagacgcgaagagagtatttgggggttccccggaaataccaacgcggactccgtggtgcattaccggctccagccccctttcgaagcccgatttctgagattcctccctctggcctggaatcctcggggacgaatcggcatgcgaattgaagtgtacggttgtgcctacaagagtgaagtagtgtacttcgacggccaatccgcgcttttataccggctcgacaagaagcccctcaagccgattagagatgtgatcagccttaagttcaaggccatgcaaagcaacggcatcctgttgcacagggaagggcagcatggcaatcatatcaccctcgagctcatcaaaggtaaattggtcttctttctgaactccggcaatgcaaaactaccgagtactatcgctcctgttactctcaccctgggttctctgctggacgatcaacattggcacagcgtactgattgagctactggatacacaagtcaacttcacagtagacaagcacactcaccactttcaggcgaaaggggattccagttatcttgatctgaattttgaaatctctttcgggggtatcccgactcctggtaggagtcgggcattccgcagaaagtcattccacggctgcctggagaacctgtattataacggtgtggatgtcacggagctcgccaagaagcataagcctcagattttaatgatgggcaatgtttcgttttcgtgtccgcagcctcagacagtccctgtgacatttctttccagcaggtcttacttggctcttcccggaaattcaggagaggacaaggtcagcgtgactttccagttccgcacttggaacagggcgggacacctgctctttggtgagctgcgaaggggcagcggctcatttgtgctgtttctgaaagatggaaagcttaaactgagcctgttccagcctgggcaaagcccgcgaaacgttaccgccggtgccggactgaatgacggccaatggcactctgtaagtttttcagccaaatggagccatatgaatgtcgtggtggacgacgatactgctgtgcagcccctggttgctgtgcttatcgacagcggcgacacttactacttcgggggatgtcttgacaactccagcggctctggctgcaagtcacccctgggaggctttcaagggtgccttagactgattaccatcggggacaaggcagtggatccaatactggtgcaacagggcgcattagggtcctttcgggatcttcagatagactcttgtggtataaccgaccgatgcctcccttcctattgtgaacatggcggagagtgcagccagtcctgggacactttttcatgcgattgtctgggcacaggctataccggagagacatgccacagctccctttacgagcagtcttgcgaggcacacaaacacagggggaatccctccggcctttactatatcgatgcggatggcagtggaccactgggcccattcctagtgtattgcaatatgacagcagatgccgcatggaccgtcgtgcagcacggagggccagatgctgtgacactccgaggcgctccttccggccatccaagaagcgcggtgtcctttgcctacgccgctggggcaggccagttaaggtcagcggttaatctcgctgagcgctgcgaacaaagactggcgctgcgctgtgggacggcccgacggccagacagccgagacggcacgcctctatcttggtgggtggggcgtaccaatgaaacccacacttcctggggaggatctctgcctgatgctcaaaagtgcacctgtggcctggaaggaaattgcatcgactcccaatattattgcaactgcgatgccggtcggaacgagtggactagcgacactattgtccttagccagaaagaacacctccccgtcacacagatcgttatgactgatgccggaaggccacacagcgaagctgcttacactttaggaccactgctgtgccgaggcgatcaatcattctggaacagcgccagctttaataccgagacaagctatctccatttccctgcatttcacggagagctgactgcagatgtgtgcttcttttttaagaccacggtgtctagtggagtctttatggaaaacttggggataactgacttcattcggatagagctgagggcccctaccgaggtgacctttagcttcgatgtcgggaatggaccttgtgaggtcactgtccagtctcctacccctttcaacgacaatcagtggcaccacgtgcgggcagagcggaatgtcaaaggcgcatccctgcaagtggaccagttgcctcagaaaatgcagcctgcacccgctgacgggcacgttcggttacagttgaacagccagctgttcatcggtggtacagctactagacaaagaggttttcttggctgtattagatccctgcaacttaacggggtcgctctagatctagaggaacgggcaaccgtgacccccggagtggagcctgggtgtgcaggacactgttccacctacgggcacctgtgcaggaacgggggacgctgcagagagaaacggagaggggtaacctgcgactgcgcattctccgcctacgacggacccttctgctccaatgagatcagtgcatattttgccactggcagttccatgacttaccatttccaagaacactatacgctgtccgagaacagctcctctctggtgtcttctcttcatcgcgacgttacgctgactcgtgaaatgatcaccttgtcctttcggacaactcgcacaccctcactcttgctgtacgttagctctttctatgaggagtatctcagcgtgatcttggcgaacaatgggagtctgcagatacgatacaagcttgaccggcatcagaaccccgacgccttcacattcgactttaagaacatggccgacggccaactgcaccaggtgaagatcaacagggaggaagcggtggttatggtcgaagtgatccctcagatgcaaaagtcaaattag

SEQ ID NO: 10664 - DNA, 1257 bp, Artificial Sequence
  Description of Artificial Sequence: Synthetic coding sequence
atgaggtccctcctgctcctctctgcgttttgtctgttggaggctgccttagccgcagaagtcaagaagcctgccgctgctgctgcgcctgggaccgcagaaaaactatcccccaaggcagcgactcttgctgagcggtcagcaggcctggctttcagtctgtaccaggcaatggccaaggatcaagccgtagaaaacatcctagtctccccggttgtcgtcgcaagctccctcggccttgtgtctctgggtggcaaggctaccactgccagccaagctaaggcagtgctttctgccgagcagttgagagatgaggaagtacacgcgggacttggtgagctgttgcgttctctgtcaaattcgactgctcggaacgtgacatggaagctggggtctcggttgtacggaccgagctccgtttcctttgcggatgacttcgttagaagctctaagcagcactacaactgcgaacatagcaagattaattttcgagataagagatccgccctccagtcaatcaatgaatgggctgcacagaccaccgacggaaagcttcccgaggtgacaaaagacgtggagcggaccgatggagctctgctcgtcaatgctatgtttttcaaaccacactgggacgagaaattccatcataaaatggtggataatagagggttcatggttacgaggagctacacagttggagttatgatgatgcatagaacgggactatacaactattacgacgatgaaaaggagaaactacagatcgtagagatgcctctggcccataagctttccagcctgattattttgatgcctcatcacgtcgaacccctggaaagactggaaaagcttctgacaaaggaacagctaaaaatttggatgggaaagatgcaaaaaaaggccgtggccattagcttgccaaaaggggtggttgaggtcacacacgacctccagaagcacctcgctgggttaggactcacagaagcaatcgataagaataaggctgacctctctcgtatgtcaggcaagaaggacctgtacttggcatcggtgttccacgcaacagctttcgagctggatacagacggcaatcccttcgaccaggatatttatggaagagaggagctgaggagtccaaaactgttttatgccgatcacccttttatattcctggtccgggatacccagtccgggtctctgttgtttatcgggaggctggtgaggccaaaaggagacaagatgcgcgacgaactgtag

SEQ ID NO: 10665 - DNA, 378 bp, Artificial Sequence
  Description of Artificial Sequence: Synthetic coding sequence
atgcagctcctgaaagcactgtgggctctagccggtgcggcactgtgctgttttctggtgttggtgatccacgctcaattcctcaaggagggacaattagcagcaggcacgtgcgagattgtgaccttggaccgcgattcctctcagcccagaaggactatcgcacggcagacagctagatgcgcctgccgtaaggggcagatagccggtaccacacgcgctcgcccagcttgtgtggatgcaaggattatcaagacgaaacagtggtgcgatatgctgccttgcctggaaggcgaggggtgtgatctgctcattaatcgcagcgggtggacttgcactcagccgggtggccgtatcaaaactacaactgtatcttag

SEQ ID NO: 10666 - DNA, 5858 bp, Artificial Sequence
  Description of Artificial Sequence: Synthetic coding sequence
atgcccgcactggggccagctctgctgcaggcgctctgggccggatgggtcttgaccctgcagccactgccgccaaccgctttcacacctaacggcacctacctgcagcatctggcacgtgatcccaccagtggaacgctttacctgggcgcaacaaattttctgtttcaacttagccccggtctgcagttagaggctacagtgagcactggccctgtactggattctagggattgtttgcctcccgtgatgcccgacgagtgcccacaggctcagcccacaaacaaccctaatcaactcttgttggtttcccccggtgcactggtggtctgtggcagcgtgcaccaaggagtgtgtgaacaaagaaggttgggacagctggagcaactactgctgcgaccagagaggcccggtgacacacagtatgtggctgcaaacgaccctgccgttagtactgtggggctggtggctcagggactggcgggagagcccttgctctttgtgggccgtggctacacatctcggggtgtaggaggtggaatccccccaattaccacccgcgctctctggccccctgacccgcaggcagctttctcctatgaggagaccgcaaagctggccgttggtcgcctctctgaatactcccatcacttcgttagcgcattcgcccgaggcgcaagtgcttatttcctgtttttacggcgagacctgcaggctcagagtcgggctttccgtgcatatgtgagccgtgtgtgtctacgggatcagcattactacagttatgtggaactgccacttgcttgcgaaggagggagatatggcctcattcaagccgcagctgttgctactagcagagaagtcgcccacggagaagtcctgttcgcagccttttcctccgccgcacctccaactgtcggaaggccaccatctgccgctgccggtgcctccggagcgtccgcactgtgcgctttccccctggacgaagttgacagactggcaaatcggacccgggatgcatgctacacccgcgagggacgagcggaggatggaacagaggttgcctacattgaatacgatgtcaatagcgactgtgcccagctgccagtagatacattagacgcttacccttgcggctccgaccacactcctagcccaatggcatctcgagtgcctctggaagcaactcccattctcgagtggcctggtattcaactaacggccgtggcagtcactatggaagatggacatactattgcctttctgggggattcacagggacaacttcatcgcgtctatctgggcccaggcagcgatgggcacccgtacagcactcagagtattcagcagggcagcgccgtgtccagagacttgactttcgatggcaccttcgaacatctgtacgttatgacacagtccactctccttaaggtcccggtggcctcttgcgcacagcacctggactgcgcaagctgtttggctcaccgagacccctattgtgggtggtgtgtactgctgggcaggtgctccagacgtagcgagtgtagccgaggacagggacccgagcagtggttgtggtcttttcaaccagagttagggtgcctgcaagttgcagccatgtcccccgcaaatatcagccgggaggaaacccgagaggttttcctaagcgttcccgatctcccgcctttgtggcccggagaatcttactcatgtcactttggcgagcaccagagtcccgctttgctcacaggttctggtgtgatgtgtccatcccccgatcccagtgaagcaccagttcttcccaggggagccgattatgtgtccgtcagtgtggagctccggtttggtgccgtagtcatcgcaaagacgtctttgagcttctacgactgtgttgcggtgacggaactgcggccatcagcccagtgtcaggcctgtgtttcaagccggtggggttgtaattggtgtgtctggcaacacctgtgtacccataaagccagctgtgatgccggaccgatggtggccagtcatcaatcccccttggtttcgcccgacccccctgccaggggggacggggattctgctgagctggagggacctcccgcaccgttgattcttccgtcttcactggactaccaatacgatacacctggcttgtgggagctggaggaggctaccctgggcgcatccagttgtccatgtgttgagagcgtgcagggcagtaccctgatgccagtgcatgtcgaacgggagattcgcctgctcggacgaaacctgcatctcttccaggatggacctggagataatgagtgcgtgatggaactcgaggggcttgaagtcgttgttgaagctcgcgttgagtgcgagccgcctccagatacgcaatgccacgtcacatgtcagcagcatcagctttcgtatgaagctttacagcctgaacttcgcgtgggcctgttcttgaggcgggcaggaaggctgcgagtggattccgctgagggactgcatgtagtgctctacgattgcagtgtgggacacggcgactgcagtcgctgccaaaccgccatgcctcagtatgggtgcgtgtggtgtgaaggtgaaagacccaggtgcgtgacacgcgaggcctgtggggaagcggaagccgtcgccactcagtgccccgcacctctaattcatagcgttgagcccctaacaggcccagtcgatgggggaaccagagtgactatacggggtagcaacctgggccagcatgtgcaggatgtactgggcatggtgactgtggccggagttccctgcgccgtggacgcccaggagtacgaagtgtctagttcgttggtgtgcatcaccggcgctagcggagaggaggttgcaggcgctacagccgttgaggtacccggtagaggcagaggtgtgtctgaacatgacttcgcctatcaggaccctaaagtgcactctatatttccagcgagaggccctcgtgcaggcggtacacgactgactctgaacggatcaaagttgctgactgggagactggaagatatcagggtggtggtgggtgaccaaccttgccacctgcttccagagcagcagagcgagcaattgcggtgcgagacttcccccagacccacaccagctaccctgcccgtggccgtgtggttcggggctactgagcggagacttcagaggggccaatttaagtataccttggaccccaacatcacctctgccggacccactaagtcatttctgagcggtggacgtgagatctgtgtaagaggacagaatctggacgtggtccaaacccccagaattagagtgaccgttgttagtcggatgctgcagcccagccagggcctgggccgacggagacgcgtggtccccgaaaccgcgtgctccctgggtccatcttgtagcagtcagcagtttgaagagccttgccacgtgaacagttcgcaactgattacatgcagaactcccgcactacccggactccccgaggatccttgggtccgggtcgaatttattcttgacaacctggtcttcgatttcgccacccttaacccaacacccttctcatatgaggccgaccctactctgcaacctctaaaccctgaggaccctactatgccattcaggcacaagccagggtccgtattctccgtggagggcgagaacttagatctggcaatgtcgaaggaggaggtggttgctatgattggagatggcccatgtgtggtcaaaactctcacgcggcatcacttgtactgtgaaccaccagtcgagcagccgttgcccagacatcacgcgcttagagaggctccagactcacttccggagttcacagtgcaaatgggaaacttaaggttttctctgggtcacgtgcaatatgacggggaatcgccgggtgctttccccgttgctgcccaagtcggtctgggcgtgggcacatctctcctggccctcggagttattattatcgtgctcatgtaccggagaaaatccaagcaggcccttagagattataaaaaagtacagattcaactggagaatcttgaaagctctgtaagagataggtgcaaaaaggagttcacagatcttatgactgagatgactgatctgacttcggacctgctggggtccggcatccctttcctggattataaagtctatgcagaaagaatcttttttcctggccatagagagtcccccctacacagggaccttggtgtgccagaaagtcggaggcctaccgtagaacagggactgggccagttatccaacctgctcaattcaaagttgtttctgacaaagtttatccacaccttggagtctcagagaaccttttcggctagagacagggcatacgtcgcctcgcttctcactgttgctctgcatgggaagctggaatattttaccgatatccttcgcacccttctgagtgacctggtggcgcagtatgttgccaagaatcctaagctcatgctccggaggaccgaaactgtggtcgaaaaactgttaacgaactggatgtccatctgtctgtatacatttgtgagagactctgtcggtgaacctctttacatgctttttagggggattaagcaccaggtcgacaagggaccagttgatagcgttactggaaaagccaaatatacactgaatgacaatcgtcttctgagagaagacgttgaatacagacccctgaccctgaacgctcttctggctgttggccctggagccggtgaggcccagggagtgcccgtaaaagtcctcgactgtgacactatttctcaggcaaaagagaagatgttggatcagttatacaaaggagtgccactgactcagcgtccagaccctcgcactcttgatgtagagtggcgaagtggggtggctggacacctcatcctgtcagacgaagatgttacatccgaggtccaggggctgtggcgccgactgaacacactacaacactataaagtgccggatggcgcaactgtggcactcgtcccttgtctgaccaaacacgtgctacgcgaaaatcaggattacgtacccggagagcggaccccaatgctcgaagatgtggacgagggaggaattagaccgtggcatctggtcaagcccagcgacgagcctgagccgcctcggcctagaaggggctctctgcggggaggtgagcgggagagggctaaagcaattcccgagatctacttgacccggctgctatccatgaaaggaacgcttcagaaattcgtggacgacttgtttcaggtcattctcagtacctctcgacctgtacctctggcagtgaaatatttcttcgacctgcttgacgagcaggcgcagcagcacggcatctctgaccaggacactatccacatttggaagactaatagtctgcccctgcgcttttggattaatatcataaagaatccacagttcgtgttcgatgtgcagactagcgataacatggatgccgtgctcctcgtgattgcccagaccttcatggatgcctgcaccttggccgatcacaaactgggacgcgactctcctataaataaactgttgtatgcgagagacattcccaggtacaagcgtatggtcgagcggtactatgcggacattcgccagacggtgccagcatcagatcaggagatgaactccgtactggccgaactttcttggaattactccggcgacctgggcgctcgagtcgctttgcacgaattatataagtacatcaataagtattacgaccagattattaccgctctggaggaggatgggactgctcaaaaaatgcagttgggctacaggctgcagcaaatcgccgcagcagtggaaaacaaagtgacagacctcta

SEQ ID NO: 10667 - DNA, 342 bp, Artificial Sequence
  Description of Artificial Sequence: Synthetic coding sequence
atgcttgtactcttcctgctggggaccgtgtttcttttgtgtccctattggggagagctccatgacccgataaaggcaactgagatcatgtgttatgaatgtaagaagtaccatttgggcctgtgctatggggtcatgacgtcttgctcactgaagcacaagcagtcttgcgccgtggagaatttctacatcctcacccgcaaggggcagtcgatgtatcactattcaaagcttagctgtatgactagctgtgaggatatcaatttcctggggtttactaagcgtgtcgaacttatttgctgtgatcactccaactactgcaatctaccagaaggggtgtag

SEQ ID NO: 10668 - DNA, 6408 bp, Artificial Sequence
  Description of Artificial Sequence: Synthetic coding sequence
atgcctgcgttgggccctgccctcctccaggccctgtgggccggatgggtattgacgctgcagcccttacctccgacggccttcacccccaatgggacttatctgcaacacctcgcaagagatcccacaagtgggactttgtatctcggagcaacaaactttctctttcagctgagccctggcctgcagttggaggccacagtgtctactggcccagtgcttgactcgagggactgcctcccacccgttatgccagatgagtgcccgcaggcccagccaaccaacaaccccaaccagctgctgctcgtgtcccccggagccctggtagtgtgcgggagcgttcatcagggcgtgtgcgaacagaggcgactaggccagctcgaacagctgcttcttcgtcctgagcgccctggcgacacccagtacgtcgccgcaaatgacccggcagtgtctaccgtgggtctcgtggcacaggggctagcgggagaacccctactctttgttggacgaggctatacttcccgcggagttggcggaggtatccctcccattactacgcgggcactgtggccaccagacccacaagccgcattttcttatgaggaaaccgccaaattggcagtgggaaggttaagcgagtatagccaccacttcgtgagtgcttttgctagaggagcatctgcctacttccttttcctgagaagggatctccaggctcagtctagagcttttagagcttacgtcagccgagtgtgtttgcgagaccagcactactattcctacgtggaattgcctctcgcatgcgagggtggaagatacggccttatccaggcagccgcagtcgcgacttctagggaagtcgcccacggcgaagtgctgttcgcggctttctcctccgctgcccctcccacagtggggcgacctccatcggctgctgccggagcctccggtgcctctgcgctgtgcgccttcccattagacgaggtggatagattagccaacagaacaagagacgcttgttacacacgcgaaggtagagccgaggacggaactgaggtggcatacatagagtacgacgtgaattccgactgcgcacagctccccgtggacactcttgatgcatatccatgtggctctgaccacacgcccagtcctatggctagtcgggtgccgctggaggccacccccatactggagtggcctggaatacagcttaccgccgtggccgtgaccatggaggacggccacacgattgccttcctaggggactcgcagggtcaactgcaccgtgtttatttaggacctggaagcgatggacatccctactctacacagtctattcagcagggtagcgccgtttcaagagatttaaccttcgatgggactttcgagcatctgtacgtcatgactcagtctactttgcttaaagtgccagtcgccagttgtgcccaacatttagactgcgctagctgtttagcccatcgcgacccatactgtgggtggtgcgtgctgctgggacggtgttcccgcaggagcgaatgctcaagaggccaaggccctgaacagtggctttggtccttccagcctgaactggggtgtttacaggtagcagcaatgagccccgcaaatatcagccgcgaagagacacgggaggtctttctgtcagtgcctgatctgccccctctatggcccggtgagtcctacagctgtcatttcggggaacaccaatccccagcactgcttaccggatcaggagtgatgtgtcctagcccagacccatcggaggccccagtccttccacgcggtgccgactatgtctctgtcagcgtggagctgaggtttggcgctgtggttatcgctaaaacgtccctgtctttctacgattgtgtggccgtgacggaactccggccttcagcgcagtgccaagcgtgcgtgtccagtcgctggggatgcaattggtgcgtgtggcaacatctctgcacacataaagcgagctgtgatgccggacctatggtggcctctcatcagtcccctttagtctctcctgacccccctgccagaggaggtccctcacccagcccacccaccgctcccaaagcccttgcaaccccagcgcctgacacactacctgtggagccaggagcaccctccacagcaactgccagcgatattagcccgggtgcttccccttcactgctatccccttgggggccatgggctgggtccggatccatctcgtctcctggatctaccgggtctcctctccacgaggaaccaagtccaccgtcaccccagaatggacctggtacagccgtaccagcaccaaccgattttcgcccatcagcaactcccgaggatttactggcttcgcctcttagcccttccgaggttgccgctgtgccacctgccgatccaggacctgaagccttgcaccctaccgttcccctcgaccttccaccagctaccgttccagcaaccacttttcccggagcgatggggtccgttaaacctgccttggactggttgacgcgcgaaggaggcgagttgcccgaggcggatgaatggaccggtggcgacgccccagccttcagcacatccactctcctgtcaggggatggggacagcgccgagctggaaggtccccctgctcctctgatcctcccgtcatcactggactatcaatacgacacacctggcctgtgggaacttgaggaggccacattgggcgcttcttcatgtccgtgcgtggaatctgtgcaaggtagtacactgatgcctgtccatgtcgagcgcgagatacgtctgctgggcagaaatttgcacctatttcaggacggcccaggagataatgaatgcgtgatggaattggagggtctggaggtcgtggtggaagccagagtggagtgtgagccacccccagatacccagtgtcacgtgacctgccagcagcaccagctctcttacgaagccctacagcccgaattgagggtcgggctgttcttgcgacgggctgggcgacttagagttgattctgcagagggcctccatgttgtgctttatgactgcagtgtgggccatggtgattgttcaagatgccagactgccatgccacagtatggctgtgtgtggtgtgagggcgagcggccacgctgtgtgacccgcgaagcttgcggcgaggcagaggctgtagcaactcagtgtcccgcacccctcatccactccgtcgagccccttaccggtccagtggacggcggtacccgagttacaattcgtggttcaaatttgggacagcatgtgcaggacgtacttggaatggttactgtggcaggggttccctgcgcagttgatgcccaggaatatgaggtaagttcatccctggtttgcattacgggagctagcggggaagaagtcgcaggggcaaccgctgtggaagttcctggccgaggaagaggagttagtgaacatgacttcgcataccaagaccccaaagtccactccatattccccgctaggggccctagagcaggaggaacccggttgacgctgaacggctccaaactactgacaggacgactggaggacattagggtggtcgtaggtgatcaaccttgtcatctgctgcctgagcagcagagcgaacagctgcgctgtgaaacgtcccctaggccaacgccagccactctgccagtggccgtgtggtttggggctactgaaaggagactgcagcggggacagtttaagtataccctcgatccaaacatcacatctgcaggtcctacaaaatcttttctgagcggagggagagagatttgtgtgcggggtcagaacctcgatgtggtgcaaactcctcggattagagtgactgtggtgagccgaatgttacaaccaagccaggggctcggaaggcgacgtcgagtggtgccggagacagcgtgctctctggggcctagttgcagctcccagcagttcgaagagccatgccatgttaactccagccagctgattacttgccgtactcctgcgttgcctggacttcctgaagacccttgggtcagagtagaatttatcctcgacaacctggtttttgattttgctactctaaaccctactcccttttcctatgaggcggacccaacgctgcaacctctgaatcccgaagatcctacgatgccattccgacataagcccggtagcgtctttagtgtagagggggagaacctggacttggccatgtcaaaggaggaagtggtcgcgatgattggcgacgggccttgcgtcgtgaagaccttaacacggcaccacttatattgcgaacccccagtggaacagcccttaccaagacatcacgctctgcgagaagcccctgattccctgcccgagttcaccgtgcagatgggcaacctccggttcagcctaggccacgtccaatacgacggcgaaagccctggagcattccctgtcgccgctcaggtaggtctcggcgtcggtacaagtctgctcgcgctcggcgtcattatcatagtgctgatgtaccggaggaagtccaaacaggcactgcgggactacaagaaagtccagatacagctggagaatctggagagctccgtgcgcgatcgatgcaaaaaagaattcacggaccttatgacagaaatgaccgacctcaccagtgacctgctgggcagcggcattcccttccttgactataaggtgtacgccgagagaattttcttccctggccatcgcgaatcccctcttcaccgagacctcggtgttcccgagagcaggcgtcctaccgtggagcaagggctggggcaactgtccaatttgcttaattcaaaactctttctgaccaagtttatccacacactggagagtcagagaacattttccgctcgggacagggcctatgtggcttcactccttacggtggcgctgcatggaaaactcgagtactttacagatatcctgcgtacactgttgtcagaccttgtcgcccagtacgtcgcaaagaaccctaaactcatgttaaggcgaactgagaccgtcgtggagaagctgctgactaattggatgtctatatgcctgtacaccttcgtgagagatagcgtgggggaacccctgtacatgttgttccggggtattaagcaccaggtggataaagggccagtggattcggttacaggcaaggcaaaatatacactgaatgacaaccgtctcctgcgagaggacgtcgagtacagaccacttacactcaacgcccttctggccgttgggccaggggctggagaggcccagggagttccagttaaagtgctggattgtgatactatttctcaagccaaagaaaaaatgctggaccagctgtataagggggtcccgctgactcagcgccctgaccccagaacgcttgatgtggaatggagatccggtgtcgcagggcacctcattctgagtgacgaggatgtcaccagcgaggtgcaaggtttgtggcgaagacttaacaccctgcagcactacaaagttccagatggagcaacagtcgcccttgtcccgtgccttacgaagcatgtgctgcgagagaatcaggattatgttcccggagaacgaacaccgatgctggaagacgtggacgaggggggaatccgcccttggcatctggttaaaccgtcggatgaacctgaaccccctcggccaaggagaggatctttgcgcggtggggaaagggagcgagccaaggctattcctgagatatatttaactagattgctgagcatgaaaggcaccctgcagaaattcgtagacgacctgtttcaggtgatcctctccacaagccgcccagttccgcttgcggtaaagtacttctttgatttgttagacgagcaggctcagcagcatggaatttctgaccaagacacaattcacatttggaaaacaaatagcctcccactgcggttttggatcaacatcatcaagaacccccagtttgtctttgatgtgcaaacctctgacaacatggatgcggtgctgctcgtgatagctcagacctttatggacgcatgtacccttgctgatcacaagctcggcagagattctccaattaacaagctcctttatgccagggatatacccagatacaaaagaatggtggaacggtactacgctgacattcgtcagaccgtccctgctagcgaccaagaaatgaatagcgtcctggccgaactctcatggaactacagcggggacctcggtgcacgagtggcgcttcatgagctgtacaagtacattaataagtactacgatcagattatcactgccctggaagaagacggcaccgcccagaaaatgcagctcggataccgcttgcagcaaatcgccgctgctgttgagaacaaggtaaccgatctgtac

SEQ ID NO: 10669 - DNA, 390 bp, Artificial Sequence
  Description of Artificial Sequence: Synthetic coding sequence
atgcggccactgaaacctggggctcccctgcctgctctctttctgctggctctggcgctgagtccccatggagcccacgggaggcctcggggtcggagaggggcaagggtgaccgataaagaacccaaacccttactgtttttaccggcagcaggtgctgggagaacaccatcagggagtagaagtgctgagatctttccacgggacagcaacctgaaagacaagtttatcaaacacttcaccggcccagtcaccttctcacccgaatgcagcaagcattttcataggctttactacaacaccagagaatgcagcacacccgcttattacaaaaggtgtgccaggcttctgaccagattagctgtaagtcccctgtgctcacaaacttag

SEQ ID NO: 10670 - DNA, 252 bp, Artificial Sequence
  Description of Artificial Sequence: Synthetic coding sequence
atgcgcctgagcgtttgcctgttgatggtttccctcgccttgtgctgctaccaggcccatgccctggtttgccccgcagttgcatccgagattaccgtctttttgttcttgtcagatgcggctgtgaacctgcaggtggccaaacttaatccgccacctgaagccctggcggctaaactagaggtcaagcactgcacagaccaaattagcttcaaaaagcggctctccctgaagaagagttggtggaaatag

SEQ ID NO: 10671 - DNA, 1455 bp, Artificial Sequence
  Description of Artificial Sequence: Synthetic coding sequence
atgtggtacgttagcactagaggagtggcacctagagtgaatttcgaaggcgctttgttttctggatatgcaccggacggcggtttgtttatgcctgaggagcttccccaattggatagagggactctgtgccaatggtcaaccttaagctaccctggcctggtgaaggagctgtgtgcactgttcatcggcagcgagcttttaccaaaagacgagttgaatgacctcatagatagagctttcagcagatttcggcacagagaagtcgtacacttgagcagattgaggaatgggctgaacgtgctggagctgtggcatggggtcacttacgccttcaaggatctgagtctgtcttgcacgacacaattcctgcagtactttttggagaagagagaaaaacacgttacagtggtagtcggcacatccggtgacactgggtctgccgctattgaaagcgttcaaggggctaagaacatggacatcattgtgctgctgcctaagggacattgcacaaagattcaggagctgcagatgaccacggtgctaaagcaaaacgtgcacgttttcggcgttgaagggaattcagacgaactcgacgaacctatcaagaccgtctttgccgatgttgcctttgtgaagaaacacaacctgatgtcactcaattcaataaactggagcagggtgctggtgcagatggcacaccatttcttcgcttactttcaatgtacaccaagtctggacactcaccctctgccactagttgaggtcgttgtccccacgggagccgcagggaaccttgccgcaggctacatcgcacaaaaaatcggcctgccaatcaggctggtcgtggccgtgaatagaaacgatattattcaccgcactgtgcagcaaggggacttctccctgtccgaggccgtgaagagcactctggcttccgctatggacattcaggttccctacaatatggagagagtcttctggttgctatctggcagcgatagtcaagtgacgcgagcccttatggaacaatttgagagaacccagagtgtgaatctcccgaaagaactccacagcaaactctcggaggcggttacctccgtgagtgtgagcgatgaagctatcacccagaccatgggtcgctgctgggatgagaatcagtacctcctgtgtccccacagtgcagtggccgtgaactaccactaccaacagattgaccgtcaacaaccaagtactcctcgatgctgtctggctcccgctagtgcagcaaagttcccagaagcagtcctggccgctgggctgactccagagactcccgctgaaatcgtggctttagaacataaggagacacggtgcaccctgatgcgccgtggagacaactggatgctgatgctgagggacacaatcgaggatctttccaggcaatggcgcagtcatgcacttaataccagtcagtag

SEQ ID NO: 10672 - DNA, 159 bp, Artificial Sequence
  Description of Artificial Sequence: Synthetic coding sequence
atgaagctgtgcgttacagtcctctctttattggtgctggtcgccgcattttgttcactggcacttagtgccccatccaataagcccctcgaggcctctaagtccgcgttaacaccagtatcacctggatcgaggtcaacctgtatgacctggaattag

SEQ ID NO: 10673 - DNA, 675 bp, Artificial Sequence
  Description of Artificial Sequence: Synthetic coding sequence
atgcgagtcagcggtgtgttaaggttactggcactcatcttcgcgattgtcaccacctggatgtttattcgctcttatatgagctttagcatgaagaccataaggctgcctaggtggcttgctgcgtcgcctacaaaagaaatacaggtgaaaaaatacaaatgtggcttgataaaaccctgtccagccaactacttcgctttcaagatttgttccggcgctgctaacgtggtcggccctactatgtgttttgaggaccggatgatcatgagtccagttaaaaacaatgttgggagaggcttaaacatagcgttagtgaatgggactactggcgctgtgttagggcaaaaggcatttgatatgtactctggagatgtgatgcatctcgtgaagtttttgaaagagatcccaggtggggcactcgtcctggtggcctcctatgacgaccctgggaccaaaatgaatgatgaaagtcggaaactcttttccgatctaggctcctcttacgcgaaacagctggggtttagggattcatgggttttcatcggggcaaaggatctccggggtaagagtccatttgagcagttcctcaaaaacagtcctgataccaataagtatgaaggctggcctgaattactagaaatggaggggtgcatgccacccaagcctttctag

SEQ ID NO: 10674 - DNA, 1404 bp, Artificial Sequence
  Description of Artificial Sequence: Synthetic coding sequence
atgttaattttttggaccatcacactctttctgttgggtgctgccaagggcaaggaagtctgttacgaggatctgggctgcttttcagacactgagccatggggaggtactgctataaggcctctcaagatccttccttggtctcctgagaagatcggaactaggtttctgctctacaccaacgagaatcccaacaacttccagatattgctgctatcggatcctagtacaatcgaagcctctaacttccagatggaccggaagacccgtttcatcatccatggatttatagacaagggggatgagagttgggtgaccgacatgtgcaagaaactgttcgaggtagaggaagtgaattgcatctgcgttgactggaaaaagggcagccaagcgacatacacacaagctgctaataatgtgcgagttgtgggagcccaggtggcgcaaatgctggatatcctgttaactgagtactcctatcctccctctaaagtacacctcatcgggcactcactgggggcacatgttgccggtgaagccggaagcaaaacccctggtctgtctagaatcaccgggctggaccccgtggaggcctcgtttgagtcaacacccgaagaggttcgcttagacccatccgatgcggattttgtcgacgtgatccacaccgatgcagcccctctgatccccttccttggatttggtactaaccagcagatgggtcacttagactttttccctaatggcggagagagcatgcctggctgcaaaaagaacgcgctgtctcaaatagtggatctggacggcatttgggctggcactagagattttgtcgcgtgcaaccatcttaggagctacaaatactacctggagtctatcctgaacccggacggctttgcggcttatccctgtaccagctacaagtccttcgagtcggacaaatgctttccctgtccagaccaaggatgtccacaaatgggtcattacgcagacaagttcgctggacgtacaagcgaggaacagcaaaagttcttcctcaacaccggcgaggccagtaacttcgccaggtggcgatacggcgtgtccattacactgtctggaagaaccgcaacaggccagatcaaggtggccctgtttgggaataagggcaatacccaccagtactcaatttttcgagggatcttaaagccaggatcaacacattcatacgaattcgacgccaaactggacgtagggacaatcgagaaggtgaaattcctctggaataataacgtcattaaccctactctgcctaaggttggcgctactaaaattaccgtccagaagggcgaggagaagaccgtgtacaatttttgcagtgaggatacagtgagagaggatactctactcacactgaccccatgctag

SEQ ID NO: 10675 - DNA, 237 bp, Artificial Sequence
  Description of Artificial Sequence: Synthetic coding sequence
atgggatcaggattaccactcgtgctgcttttgacactcctgggatcctcccatggcaccggcccaggtatgaccctccagttgaagctgaaggagtctttcctgacaaactcctcctatgagtccagctttctggagcttctggagaagctgtgcctcttgcttcatctgccatcggggacttcagtgacgctgcaccacgcgaggtctcagcaccacgtagtctgcaatacgtag

SEQ ID NO: 10676 - DNA, 291 bp, Artificial Sequence
  Description of Artificial Sequence: Synthetic coding sequence
atggagcataaggaagtggtgctgttgcttctcttatttctcaagagtggacagggagagcctctcgacgactatgttaacacgcagggaccgtcactgttcagcgtcaccaaaaaacagctgggagctgggtccagggaggaatgtgctgccaagtgtgaggaagacaaggagtttacttgcagagccttccagtaccatagtaaagaacaacagtgtgtaatcatggccgagaatcgtaaaagcagtatcatcattaggatgcgcgatgctgtgctcttcgagaagtag

SEQ ID NO: 10677 - DNA, 1083 bp, Artificial Sequence
  Description of Artificial Sequence: Synthetic coding sequence
atggggctgctgctcttggtgcccctgctcttgctccccggatcatacggcttacccttctacaacggcttctactattcaaactctgcaaatgatcagaacttaggaaatgggcacggcaaggacctcctaaatggggttaagctggtcgtcgaaacacctgaggagacactctttacctaccagggagctagcgtgattctcccttgcaggtaccgatatgaacctgccttagtgagtccgagacgggttcgcgtgaagtggtggaaactgtcggagaacggtgccccagaaaaagatgtgctagtggcaatcggcctgagacaccggtccttcggggattaccagggtagggtccacctccggcaggataaggaacacgacgtgtcactcgagatccaagatcttagacttgaggattatgggaggtacaggtgcgaggtgatcgatggcctggaagacgaatctggcctggtggagctggagctacgcggtgtcgtgtttccatatcagtcaccaaacggcagatatcagtttaattttcacgagggtcagcaggtctgtgccgaacaagccgctgtggttgcatcatttgagcagttgttccgcgcttgggaggagggtctggattggtgtaacgcgggatggctgcaggacgcaacagtccagtatcccataatgctgccgcgacaaccttgcggcggacccggactggccccaggggtgcgttcctacggcccacggcaccgcaggttgcatcgatatgatgtcttctgttttgccactgctctgaaaggaagagtatactacctcgagcaccccgagaagctgacccttactgaggcgagagaagcatgtcaggaggatgacgctactatagccaaagttggtcagctgttcgcggcatggaagttccatggattggaccgctgcgacgctggctggcttgccgacggatcagtgcggtatcccgtggtgcatccacatccaaactgtggacctccagaacccggagtccgctcctttgggtttcccgaccctcagagtcggttatatggtgtgtactgctacaggcagcattag

SEQ ID NO: 10678 - DNA, 810 bp, Artificial Sequence
  Description of Artificial Sequence: Synthetic coding sequence
atgattagaacactgctgttatcaaccctggtagcgggtgctctctcttgtggcgaccctacatacccaccttatgttactcgagtggtcggaggcgaggaagccagacctaactcatggccatggcaggtgtctctgcagtatagttctaacggtaagtggtaccatacttgcggaggatcactgattgcgaactcctgggtgctgactgccgctcattgcatctcaagttccagaacgtatcgcgtggggcttggaagacacaatctgtacgtggcggagtccgggtcactagccgtgagtgtaagcaaaatagtggtgcacaaagattggaactccaatcagattagcaagggtaacgacattgctctgctgaagctggcgaatcccgtgtcattgactgataagattcagctcgcttgtctgcctcctgccggtaccatacttcccaataattacccttgttacgtaaccggttggggcaggctgcagaccaacggggcagtccccgatgtgctccagcaggggcgactgttggtggtagactacgccacatgctcctctagcgcctggtggggttcctccgtgaagacttccatgatctgcgctggcggtgatggagtgatctcttcatgtaacggcgacagcggaggtcccctgaattgtcaggcatccgacggcaggtggcaggtacacggaattgtttcattcggcagtcgcctgggatgcaattactatcataagccgtccgtgttcacccgagtgtcaaactatattgactggatcaattccgttatagccaataattag

SEQ ID NO: 10679 - DNA, 1122 bp, Artificial Sequence
  Description of Artificial Sequence: Synthetic coding sequence
atgctcccctggctcttagtattttcagcattgggtatccaagcgtggggtgattcctcctggaacaaaacccaggctaaacaggtttccgaaggtctgcaatatcttttcgaaaacatcagccagttgaccgaaaagggtttgccaaccgacgtgagtactaccgtctcaagaaaagcttggggtgctgaagccgtaggatgctcaatccagctgacgacccccgtaaatgttctggtgatccatcatgtgcccggtctggaatgtcatgatcaaacggtgtgttcacagcgcctgagggaactccaggcccaccacgtacataacaatagtggatgtgatgtggcctataactttctggtgggtgatgacggcagggtgtatgaaggcgttggctggaatatccagggtgttcatactcagggatataacaacatctctttaggtttcgccttcttcggtacaaaaaaaggacactctcccagcccggctgcactgtccgctatggaaaatctaattacatacgccgtccagaagggccatttgagtagctcgtatgtgcagccactcctaggcaagggcgaaaactgcctcgcaccacgccagaaaaccagcctgaaaaaagcctgccccggagttgtcccacggtcagtttggggcgcacgggagactcactgtccacggatgacgctccccgctaaatacgggatcatcatccacaccgctggacgcacatgtaacatttctgacgaatgccgtctgttagtacgggacatccagagcttttatattgatcgcttgaaatcgtgcgacatcgggtacaactttttagttgggcaggacggggcaatatacgagggagtcggctggaatgtccagggttcatccactcccggatacgacgatatcgccctgggaattacatttatgggcacattcaccggaatccccccaaacgctgctgcactggaagcagcccaggacctgatccaatgcgcgatggtcaagggctatctgactccaaattatctgctcgtaggccacagtgacgtggcacgcaccctaagcccaggtcaagccctgtacaatatcatctccacctggccacatttcaaacattag

SEQ ID NO: 10680 - DNA, 327 bp, Artificial Sequence
  Description of Artificial Sequence: Synthetic coding sequence
atgaggcagcggctgcttccatcggtgacctctctgctgttggtggccttgctgtttcctggttcgtctcaagcaagacatgtgaaccacagcgctacagaggccctgggcgaacttagagagcgcgctcccggacagggcactaacggattccagctcttgagacatgccgttaaacgcgatttgctgccacctaggaccccaccctaccaaggtgatgtgccccctggcatccgaaatactatctgccatatgcaacagggcatttgtcgccttttcttctgtcattccggcaccggacagcagcacagacagcgatgcgggtag

SEQ ID NO: 10681 - DNA, 708 bp, Artificial Sequence
  Description of Artificial Sequence: Synthetic coding sequence
atgagcccacccctgctgaaattaggcgctgtgcttagtaccatggccatgatttcaaattggatgtcacagacactgccaagcctggtcgggcttaacaccacccgactgtcgacgccggacacccttacgcagatcagccccaaggagggttggcaggtatactctagcgcacaggatccggatgggagatgcatctgcaccgtggtcgcccctgagcaaaatctatgtagcagagacgctaagtcaagacagctccggcagctgctcgaaaaggtgcaaaatatgtctcagtccatcgaggtcctgaacctgcgaacccagagagacttccagtacgtgttgaagatggagacacagatgaaggggcttaaggccaagttccggcagatcgaggatgacagaaagacacttatgacaaaacatttccaggagctcaaagagaagatggacgagctgttgccccttatcccggtcctcgagcagtacaagacagacgccaaactcattactcagtttaaggaggaaatcagaaacctgagcgctgtgcttaccgggatccaggaagagatcggagcgtacgattacgaagagcttcaccaacgggttctgtcccttgagacccggttgcgcgactgcatgaagaagctgattgacctgaaaaagcggaaggaagaggagaagcggcaacagaaaggcgaggcttag

SEQ ID NO: 10682 - DNA, 606 bp, Artificial Sequence
  Description of Artificial Sequence: Synthetic coding sequence
atgaacctgaattgcccaccttgcgtaaccggcttaagagtctggtcaagttgccgctctaagccaaattctagggctcgaagctgtcgtagctgcacaggggctagtcgcaccctgccttctcaccatatgagccacgtggaatgtcctagcggcattgtgaacgaagaaaattttaagcaaatttacagccagtttttcccacagggagacagcagtacctacgctaccttcctgtttaatgcctttgataccaaccatgacgggtcagtgtcattcgaggactttgtggccggactcagtgtgatcctgcgcggaacagtggatgaccggctgaattgggccttcaatctctatgacttaaacaaggacggctgtatcaccaaggaagagatgctggacatcatgaagagtatctacgatatgatggggaaatatacatatccggctctgagggaggaagcccctagagaacatgtggaatcgttctttcagaagatggatagaaacaaggatggggtagtgacaatagaagaattcatcgagtcttgtcagaaggatgaaaacatcatgcgcagtatgcagctctttgacaacgttatctag

SEQ ID NO: 10683 - DNA, 693 bp, Artificial Sequence
  Description of Artificial Sequence: Synthetic coding sequence
atgagattagctggcccactgagaatcgttgttctggtggttagcgtcggagtcacgtggatcgtcgtgtcaatcttgctgggtggcccaggctctgggttcccacgcattcagcagctgttcacaagccccgagtcaagcgtgaccgccgctccaagggccagaaagtacaagtgtggcctgccccagccgtgccccgaggagcacttagccttccgggtggtgtctggtgcagctaacgtgattggccctaagatctgtctggaggataagatgctcatgagcagcgtgaaggataatgtgggaagaggcttgaacatagctctggtcaatggggtgtccggggagctgatcgaggcaagggcctttgacatgtgggcaggagacgttaacgatctcctgaagttcatcagaccattgcatgaaggaacccttgtgttcgtagccagttacgacgaccccgctaccaaaatgaacgaggaaacgcgcaagttgttcagtgagctggggagccgcaacgccaaagagctcgctttccgcgactcatgggtctttgtaggcgctaaaggtgtccaaaacaagtctcctttcgaacagcacgtcaaaaacagcaaacattccaataagtatgaaggctggcccgaagctctagagatggagggctgtattcctcgccgaagtactgcatcatag

SEQ ID NO: 10684 - DNA, 684 bp, Artificial Sequence
  Description of Artificial Sequence: Synthetic coding sequence
atgcgtgtagcaggcgctgccaaacttgtggtggctgtggctgttttcctcctcaccttctacgtgatcagccaagtatttgagattaaaatggacgctagtctggggaatttatttgcgcgttccgcattggacactgccgctaggtcaaccaaaccaccgagatacaagtgcggcatctcaaaagcctgtcccgaaaagcacttcgccttcaagatggccagtggagccgcaaatgtggtgggacctaagatttgcttggaggataacgtcctgatgtcaggcgtcaagaacaacgtcggtcggggtattaacgtagccttagcaaacggaaagactggagaggtgctggacactaagtactttgatatgtggggtggcgacgtggcacccttcattgaattcctgaaggccattcaggatggcaccattgtactgatgggaacctacgacgacggcgcaaccaaactcaacgatgaagctagacgtctaatagcagacctgggctctacaagtatcacgaacctcggcttcagggacaactgggtgttctgcggcggaaaaggcattaagaccaagtctcctttcgagcaacacataaagaacaacaaggatactaataagtacgaagggtggcccgaagtggtggagatggaggggtgtattccgcagaagcaggactag

SEQ ID NO: 10685 - DNA, 1656 bp, Artificial Sequence
  Description of Artificial Sequence: Synthetic coding sequence
atggaagattctgatagcgccgctaaacagctcgggttagccgaagctgcggcagcagggggagaagccgaagagcccgtgctgagtcgtgacgaagattccgaagaagatgccgactctgaggccgaacgcgaaacgcccagagttactgcagtggccgtgatggcggctgagcccggacacatggatatgggggctgaggcactccctggaccagacgaagctgcagcggctgcagcctttgccgaggtcaccacagtaacagtcgctaacgtgggggctgcagctgacaacgtgttcacaacgagtgtggctaacgcagccagtatcagtggtcatgtgctgtcgggcagaaccgccctccagataggtgactcactcaacaccgagaaagcaacattgatcgtagtccacactgatgggtccattgtggagaccactgggctgaagggaccagctgctccattgacccccggaccccagtcccctcctacacccttggctcccggacaggagaagggaggtactaagtacaactgggatccttctgtgtacgattctgagttgcctgtgaggtgccggaatattagcggcactctgtataaaaacagactgggatccggcggacggggaagatgcatcaaacaaggagagaactggtatagccccacagagtttgaggccatggctggcagagccagtagtaaggactggaaaagatctattcgttatgccggacgcccactgcagtgtctgatccaagatggaattttgaatccacacgcagcaagttgcacttgtgccgcttgctgtgacgatatgacactcagtggaccagtgcggctcttcgtgccgtataagaggcgaaaaaaggagaatgaactgcccaccactcctgtgaagaaagactcgcctaaaaacattacattgctgccagcaacagccgctactactttcaccgtgacccccagcggccagataaccacatcgggtgcacttacctttgatcgggcaagcactgtcgaggccactgctgtaatatctgagtcacccgctcagggagatgtttttgccggagcaaccgtccaggaagctagtgtgcagcctccctgccgtgcatctcaccccgaaccacattacccagggtaccaggatagttgccaaattgcacccttcccagaggcagcactgccaacctctcatcctaagattgttttgacttctctccccgcactcgctgtaccacctccaactccgactaaggctgcgccaccagcccttgtcaatggtctcgaactctcggagccaagaagctggctgtacctggaagagatggtgaatagcctgctgaacacagctcagcagctgaaaaccctatttgaacaggcaaaacatgctagcacttatcgagaggctgcgacaaaccaggctaaaatccatgctgacgcggagaggaaggaacaatcatgcgtcaactgcggcagagaagcgatgtcagagtgtacagggtgtcacaaggtcaattactgttccacattttgtcagcgaaaggactggaaagaccatcagcatatctgcggtcagagtgctgccgtgactgttcaggcagacgaagtgcacgtcgctgagtctgttatggagaaggtgactgtgtag

SEQ ID NO: 10686 - DNA, 2022 bp, Artificial Sequence
  Description of Artificial Sequence: Synthetic coding sequence
atgaaacctggcggattttggctgcatctgactctgctgggggctagtttacccgctgccttagggtggatggatcctggtacatcccggggtcctgacgttggtgtgggcgagtctcaggcggaggaacccaggtcgtttgaagttacaaggcgtgaaggtctaagttctcacaacgagctgctggccagttgtgggaagaagttctgtagccgcggatcccggtgtgtactctccctggctcctgaggaccgggtgtccgtgaccactgttaccgtggggctgtccactgttctcacctgtgcggtgcatggagatctcaggccccctattatctggaagcgcaatggccttacactgaactttctggatctggaagacatcaatgactttggcgaagatgattcactctatatcacgaaagtgacgacaatccacatgggcaactatacatgccatgcttccggccacgagcagctgttccaaacacatgtactgcaggtcaacgtcccccctgtgataagagtttacccagagagccaggcgcaggaacccggtgtggccgcttctctgcgttgccacgccgaagggattcccatgcctcggataacttggctgaaaaacggagtagacgtgtccacccagatgtccaagcaactatctctgctcgcaaacggtagcgagctacacatctcgtccgttcgatatgaggatacaggtgcctatacttgtatcgctaagaacgaggttggagtcgacgaggacatcagcagtctttttattgaagatagtgcaagaaagaccctcgcgaacatcctttggagggaagagggcctgtccgtcgggaacatgttttacgtattttccgacgatggcataatagtgatccaccctgtggactgcgaaatccagcggcatcttaagcccaccgaaaagatctttatgtcctacgaggagatttgcccccagcgggagaaaaatgcaacccagccttgccagtgggtcagcgctgtgaacgtgcggaaccgatatatttacgtcgcccagccagcactatcccgcgtgctggtggtggacatccaggcacagaaggtcttgcagagtattggagttgatccgctcccagctaagttgagttacgacaagtcccacgaccaagtatgggtgcttagttggggagacgtacataagtctagaccttctctccaggtgatcacagaggcaagtacaggccagtcacaacatctcataaggaccccgttcgcaggcgtagatgactttttcattcctcctaccaatttgatcattaaccacattcgatttggcttcatcttcaacaagtctgaccccgctgtgcacaaggtggatctcgaaaccatgatgcctcttaagacgattgggctgcaccatcacggttgcgtacctcaggccatggctcacacccatctaggtggatatttttttatacaatgccggcaagacagccccgcatccgcggctagacagctcctggtcgacagcgtgactgatagcgtcttggggcctaatggcgatgtgacaggtaccccccacacgagcccggatggcagattcatcgtcagcgcagcggcagattctccttggttgcacgtgcaggagataactgtcaggggagagatccagacactctacgacctccagatcaacagcggtatcagtgaccttgcctttcagcgtagcttcaccgaaagcaatcagtacaatatctatgcagccctccataccgagcccgacctgctattcttagagctgagcacaggtaaagtgggtatgctgaagaatttgaaggagcctcctgctggccctgcacagccttggggtggaacccacaggataatgcgggatagcgggctttttggccagtatctattaacccctgccagagagagtttattcctcattaacggacgccaaaatactctgcggtgtgaagtcagtggcattaagggcggaactaccgtggtttgggtgggcgaggtctag

SEQ ID NO: 10687 - DNA, 2007 bp, Artificial Sequence
  Description of Artificial Sequence: Synthetic coding sequence
atggacctggtcctgaaacgatgtctgttgcacttagcggtcattggagccctcctggccgtcggtgctactaaggtccctcggaatcaggactggctcggcgtttcacgacagcttcggaccaaggcatggaatcgacaactataccctgagtggacggaggcacagcgcctggactgctggaggggcggacaagttagcctcaaggtgtccaacgacggcccaacgttgattggcgctaatgctagctttagtatcgctctgaatttcccaggctcccaaaaggtgcttcccgacggacaggtgatttgggttaataatacaatcatcaacggcgatcaggtttggggagggcaacccgtgtatcctcaagagacagacgacgcctgtatcttccccgacggtggaccctgcccatctgggtcttggtctcaaaaaaggagcttcgtttacgtctggaaaacgtggggtcagtactggcaagtgctcggcggacctgtcagcggcctaagtattggtaccggcagggcgatgctcgggacacatacaatggaagtgacggtgtaccatagacggggaagccgaagctatgtgccgctggctcactcctcttcagcgtttaccattactgaccaggttcctttttcagtgtccgtctctcagctacgtgcactggatggcggaaataagcattttttacgcaatcagcccctgactttcgccctccagctacatgacccgtctgggtatctcgcagaggcggacttgtcctatacctgggactttggggattcgtcaggaacattaatctcacgagccttagtcgtgactcatacttaccttgagccgggacccgtgaccgcgcaggtcgtgctgcaagctgctatccctctgacctcatgtggttcctcgccagtgcccggtaccactgacggccaccgtcctacagccgaagccccaaacaccactgctgggcaggtgccgacaacagaggtggtgggcacaacccccggacaggccccaaccgccgagccctctgggaccaccagcgtgcaagttccaacaaccgaagtcattagcacagccccagtgcagatgcccacagccgaatccaccggtatgacaccagaaaaagttccggtgtcagaagtgatggggactactctggcggaaatgtccaccccggaggcaactggtatgactcctgctgaggtatccattgtagtgttgagcggaactaccgctgcccaggtcactaccactgagtgggttgaaactactgctagagagctaccaattcccgaacctgaggggcctgatgcgagctccatcatgagtaccgagtccattaccgggtcgcttggccctctgctggacgggaccgcaaccctccgcttagttaagcggcaagtcccactggattgcgtgctgtatagatacggtagcttcagcgtaacattagacatcgttcagggcatagaatcagctgaaatccttcaagccgtaccgtctggagagggggacgcttttgaactgactgtttcctgtcagggcggtctccccaaggaagcatgtatggaaatttcatcacccggttgtcaaccaccagctcaaagactgtgtcagccagtcctcccttctcccgcatgccagcttgtccttcaccagatcctgaaaggaggcagtggaacctattgcctcaatgtttctcttgctgataccaattctctggcagtcgtatcaacccagctgatcatgcccgtgccgggaatcctgttgactggacaggaggcaggactggggcaagttccacttattgtcgggatcctcctggtgctgatggctgtggtgctcgcatctctgatatatagaaggcgcctcatgaaacaggacttttccgtcccacagttgcctcactcgtcttcacattggttaaggctccctagaatattctgctcgtgccctatcggcgagaatagcccactgctgagtgggcaacaggtgtag

SEQ ID NO: 10688 - DNA, 1746 bp, Artificial Sequence
  Description of Artificial Sequence: Synthetic coding sequence
atgcagcaagacggcttgggagtcggtacacggaacggatccggcaagggacggtccgtgcacccatcttggccttggtgtgcacctagaccactgcgctatttcggccgagatgcccgtgcgaggagggcacagacagctgcaatggccttactcgcgggtggccttagcagagggctgggtagtcatccagcagctgcgggacgcgacgcagtcgtgtttgtctggctcctcctcagcacgtggtgcacggccccagcgagagccattcaggtgaccgtgagtaatccatatcacgttgtcattctattccaaccagtgactctcccctgcacgtaccagatgaccagcacaccaacacaaccaattgtcatctggaagtataaaagcttttgccgggatagaatcgctgacgctttcagccctgcttcagtggacaaccaactcaacgcacaactcgctgctggaaaccccggatacaacccctatgtcgaatgtcaggactctgtccggaccgttcgggtagtcgccaccaagcaaggaaacgcagttacgctcggagattactaccagggccgtaggatcactattacggggaatgcagacctaacctttgaccaaacggcttggggcgactccggcgtctattactgcagtgtggtctccgcacaggaccttcaaggaaacaatgaagcctatgcagagcttatagtcctggtgtacgcagcaggcaaagccgctacatctggcgttccttcgatttatgcaccctccacctatgcccatctttcacccgcaaagacaccgccaccacccgctatgatcccaatgggtcccgcatataacggctaccccggaggatatccaggagacgttgaccggagctccagcgcaggagggcaggggagctacgtgccacttttacgcgatactgactcatccgtagcttcagaggtgcgatccgggtaccgaattcaggcttcacaacaagacgactccatgcgagtgctgtattatatggaaaaggagctggccaattttgatccttcgagaccgggtcccccatccgggagagtggagagagctatgtccgaggtcacctccttacatgaggatgattggaggagtaggccatctcgcggtcctgctcttacccccatacgagacgaggagtggggcggtcacagccccaggtctccaagaggatgggatcaggaacccgcaagagaacaagctggcggaggatggagggctaggaggccacgtgctcgttctgtcgacgccctggatgacctcactcccccaagcaccgccgagtccggttcacggagcccgaccagcaacggtggccgtagtcgggcatacatgcccccacggtcaaggagcagggacgatttgtacgaccaggatgactcacgcgactttccacgatcacgcgacccccattacgacgattttaggagccgcgagaggcccccagcagatcctcgatcgcaccaccatagaacccgtgatccaagggacaatggcagcagaagcggagatctgccatacgacggcaggctgctggaggaggcggtgcggaagaagggatcggaagaacgtcgcagaccccacaaagaggaggaggaagaggcttactacccccctgcaccacctccctactcagaaactgattcccaggcatctcgggaaaggaggctgaagaaaaatcttgctctgtctagagagtctctggtggtgtag

SEQ ID NO: 10689 - DNA, 1959 bp, Artificial Sequence
  Description of Artificial Sequence: Synthetic coding sequence
atgcctccgcctttgcctctcttacttctgaccgtcttggttgtcgctgctgcaagacccggatgcgagttcgagcggaaccctgccggagagtgccatagaccccctgccgctgacagcgcaacatgcgtggatctgcaactgaggacttgttctgatgccgcatacaatcacacaactttcccgaatctcttacagcaccggagctgggaggtggttgaggcgagcagtgaatatattcttctgtctgtgctacaccaactacttgaaggccagtgcaatcctgacttgaggttattaggatgcgccgtactggccccacgttgtgagggcggatgggtgcgtcgcccttgtcggcacatctgtgagggacttcgtgaggtgtgtcagcctgccttcgacgcaatcgacatggcatggccgtactttctggattgccatagatacttcacacgggaggacgaagggtgttatgaccccttagagaagcttcgcggtggcctcgaggcggacgaggctctgccttccgggctcccccctacctttattcgcttcagtcaccactcctatgctcaaatggtgcgggtgctaagaagaacagccagcagatgtgcacacgtggctcggacgtatagtatcgggaggtcattcgatggacgtgaactgctcgtcatcgagttctcttccaggcctggacagcatgaactaatggagcctgaggttaaactgattggaaatatacacggtaacgaagtggcaggcagagaaatgctaatctatctggcccagtacctctgcagcgaatatctactcgggaacccgaggatccagcggttgctcaacaccactcgcatacatctgctgcctagcatgaaccctgacggatatgaggttgcagccgctgaaggggcaggttataatggttggacttccggacggcagaatgcacagaatctagacttgaaccggaatttccctgacctcacctccgaatactatcgtttggctgagaccaggggggctcggtcagaccatatccctatcccacagcattattggtggggaaaagtcgcgccagagaccaaggcgatcatgaaatggatgcaaaccattccctttgtcctttccgcttcactccacggaggggacctagtggtgtcttaccctttcgactttagtaagcatccacaagaagagaagatgttttctccaacaccagacgagaagatgttcaaactgctgtcccgcgcatacgctgatgtgcacccgatgatgatggatcgctctgagaatcggtgcggaggcaattttctaaagcgtggctccattatcaatggcgcagattggtactctttcacaggcggtatgtctgatttcaattacctgcataccaactgcttcgaaataacagtggagctgggatgtgtcaaatttcccccagaagaggccctgtatattctctggcagcacaacaaggaatccctgctcaatttcgtggagactgtgcatcgcggtattaaaggtgttgtgactgataagttcggtaagcctgtgaagaacgccagaatcagtgtgaagggaatcaggcacgacatcacaaccgctccagatggcgattattggaggttgctgcccccaggcatccatatcgtgatcgctcaggcccctgggtacgctaaggtaatcaagaaggtgataatcccagctcgaatgaagcgggctggtcgagttgacttcatcctgcagcctctcggaatgggccctaagaatttcatccatgggctgagaaggactggcccacacgacccactcggaggagccagctccttgggcgaagccaccgagcctgatccacttagggcacgcaggcagccgtccgcagatggcagcaagccctggtggtggtcttactttacatccctcagtacacacagacctcgatggctgttgaagtactag

SEQ ID NO: 10690 - DNA, 279 bp, Artificial Sequence
  Description of Artificial Sequence: Synthetic coding sequence
atgaaactgtgtgttaccgtcttaagtttactggttctcgtagccgctttctgttctctggcgctgtctgcccctatgggaagcgacccacctaccgcgtgctgtttctcctacacggcaagaaaactacccaggaattttgtggtagactattatgagacctcatctctctgttcccagcctgccgttgttggattcttgggtcggaaggggaagcaagtgtgtgcagacccgagtgagagttgggtgcaagaatatgtgtacgacttagagttgtag

SEQ ID NO: 10691 - DNA, 249 bp, Artificial Sequence
  Description of Artificial Sequence: Synthetic coding sequence
atgcgacaacgcctgctgccatcggtgacttctctgttgctcgtggctttactctttcccggatctagtcaggctcgccacgtgaaccattccgctacagaagcactgggtgagctgcgtgaacgggcaccaggacaggggacaaacggtttccaattgctacgtcacgccgtgaagcgagatttattgccacctcgcactccgccataccagggaactggccagcagcaccgtcaaagatgtggatag

SEQ ID NO: 10692 - DNA, 411 bp, Artificial Sequence
  Description of Artificial Sequence: Synthetic coding sequence
atggacaatgttcagccaaagattaagcaccgccctttttgtttctcagtcaagggtcacgtcaagatgctgcgcctggcactgacggtgacttctatgacgtttttcataatcgctcaagccccagaaccctacattgtaataaccggtttcgaggtcactgtgattttgttctttatcctgctgtacgtcctgaggctggaccggcttatgaagtggctgttctggccgttgctggatattattaactccctcgttacaaccgtgttcatgctaatcgtatccgtgctcgcactgattcccgaaacaacaaccttgaccgttggaggaggagtctttgccctggttacagccgtatgttgtctggcagacggcgcactgatctacaggaaattactcttcttgcgctag

SEQ ID NO: 10693 - DNA, 1068 bp, Artificial Sequence
  Description of Artificial Sequence: Synthetic coding sequence
atgcagctgacaacctgcttgagagaaactctgtttaccggcgcatcacagaaaacgtctctttggtggctggggatcgcgtcttttggcgtgcccgaaaagctgggttgtgccaacctgccacttaatagcagacaaaaggagctttgcaagcgcaaaccctatttgctcccaagcatccgcgaaggggctagactgggcatacaagaatgcggcagccaatttcgacatgaacgatggaactgtatgattacagctgctgccacaacagctccaatgggtgcgagtccattatttggatacgagctgtcctctggtaccaaggaaactgccttcatctacgctgtgatggctgctggtctggtccattctgtcacacgcagttgtagcgctggtaatatgaccgaatgtagttgtgataccactctacagaatggaggatccgctagcgaaggttggcactggggtggctgttccgacgacgtgcagtatggaatgtggttcagccgtaagtttttggatttccctatcggaaatactaccggaaaggaaaacaaggtgcttttggcaatgaacttacataacaacgaggccggtaggcaagccgtggctaaactcatgagcgtcgactgccgttgtcacggggtttcggggagctgtgccgttaagacatgctggaaaactatgtcctcgttcgaaaagattggccacctgctgaaggacaaatatgagaatagtattcaaatctccgataagaccaagcgcaaaatgagaagaagggaaaaggatcagagaaagattcccattcataaagacgatttgttgtacgtgaataaaagtccaaactactgcgtggaggacaaaaaactagggattcccggtacccagggacgcgagtgtaacaggaccagtgaaggagctgatgggtgtaaccttctgtgttgcgggcgtggctataatacccacgttgtgcgtcatgtggagcgatgcgagtgcaaattcatctggtgttgctacgtacgctgcaggagatgcgagtcaatgacagacgtgcacacatgcaaatag

SEQ ID NO: 10694 - DNA, 2916 bp, Artificial Sequence
  Description of Artificial Sequence: Synthetic coding sequence
atgctcaggagaccggcaccagccctggctccagccgcaaggctcttactcgccggactgctatgtggcggaggagtgtgggccgctagagtgaacaagcataaaccctggttggagccaacgtatcatggaatcgttactgaaaacgataatacggtcctgttggaccctccactgatcgctctggacaaagatgcgccactgaggttcgccggtgagatctgcggattcaaaatccacgggcaaaacgtccctttcgatgccgtcgtagtggacaagtccacaggtgaaggggtaatccggtccaaggaaaaattggattgtgaactccagaaagactactctttcactattcaggcatacgactgtggtaaaggacctgatggtactaacgttaagaaatcgcataaggctaccgtccacattcaggtgaacgacgttaacgagtatgcacctgttttcaaggaaaagagctataaggccactgtgattgagggcaagcagtacgactctatcttacgcgtggaggctgtggatgcggattgcagccctcagttcagtcaaatctgctcctacgaaatcattacacctgacgtgcctttcactgtcgataaggacggctacatcaagaataccgaaaagcttaattacggcaaagagcaccagtataaactgaccgtgactgcctatgattgcgggaagaagagagcaaccgaggacgtgttagtgaagatctcaatcaagcccacttgtactcccggatggcaaggttggaacaatcgcattgagtatgaacccggaactggtgccctagccgtcttccctaacattcacctggagacatgtgacgaaccagttgcaagcgtgcaggctaccgtggagctggaaacttctcacatcggcaaggggtgtgacagagacacatatagtgagaagtcactccatagactgtgcggagctgccgctgggaccgccgaactccttcctagtccatctggatctctcaattggaccatgggcttacccaccgacaacgggcatgatagcgaccaggtgtttgaattcaatggtacccaggcggttcgtattccagatggcgtcgtgagtgtgtctcccaaggaaccctttaccatctctgtgtggatgcgtcatggaccattcgggcgtaagaaggaaaccatcctgtgcagctccgacaaaaccgatatgaatagacatcattatagtctgtatgtgcacggctgccgcctgatctttctgtttcgccaggacccgtccgaggagaagaaataccgtcccgcagagttccactggaagctaaaccaggtttgtgatgaggagtggcaccactacgtgctcaacgtcgagttccccagtgtgaccttgtacgtcgacggcaccagccatgaaccgttcagtgtgacggaagattaccccctgcacccttctaagattgagactcagctcgttgtgggagcctgttggcaggaattttccggagtggaaaacgacaacgaaactgagccagttactgttgcttcggcaggcggagatcttcacatgacgcagttttttcggggaaatctggcaggcctaaccctaaggtcaggaaagcttgcagataaaaaggtcatcgattgtctctacacgtgtaaagaaggcctagacctgcaggtactagaagactcgggtcggggtgtccagatccaagcccacccttcgcagctggttctcacactggagggggaagatctgggcgaactggacaaagcaatgcagcatattagctatctaaactcccgacaattccccacaccagggatcaggcgattgaagataactagtaccatcaagtgcttcaacgaagctacatgcatttctgtgcccccagtcgacgggtatgtgatggtgttgcagccagaggagccaaagatctctttaagtggagtccaccacttcgcacgggcagcttccgaattcgagagcagcgagggagtgttcctcttcccagaactgaggattatctccaccatcacacgcgaagttgaacccgagggggacggtgctgaggatcccactgtccaagaatctctggtttccgaggagattgttcacgacctggacacgtgcgaggtcacagtcgagggcgaggagcttaaccacgaacaagaaagcttggaagttgatatggcgcgactgcagcagaaagggattgaggttagctctagcgagttgggaatgacctttactggcgtagatacaatggcctcatacgaagaggttttacacctgcttcggtatcggaactggcacgcacgaagtcttctggacagaaagtttaaactgatatgctccgagttaaatggacggtatatttccaatgaattcaaggtggaggtgaatgtgattcacacggccaatccaatggagcacgctaaccatatggcagcacagccccagtttgtacacccggaacacagaagtttcgtggatctgagtggacacaatttagctaacccgcacccattcgcagtagttccctctacagccacagtggtgatcgttgtatgcgtaagctttctggtgttcatgataattctcggagtctttcgcatacgtgcagcccaccggagaacaatgcgcgatcaggatacaggaaaggaaaatgaaatggactgggacgattccgccctgactattaccgttaaccctatggaaacctatgaagatcagcattcttccgaagaggaagaagaggaggaggaagaggaggagagcgaagacggcgaagaagaggacgatataacctcggcggagtctgaatcctctgaagaagaggaaggcgaacagggcgatccccagaatgccacgagacagcagcagctggagtgggacgacagcacactgtcctactag

SEQ ID NO: 10695 - DNA, 564 bp, Artificial Sequence
  Description of Artificial Sequence: Synthetic coding sequence
atggttgccgcaaccgtagcggctgcctggctgctattgtgggctgcagcgtgcgcccagcaggaacaagatttctatgattttaaagcagtgaatatacggggaaaactggtgtcccttgaaaagtacagggggtctgtgtccttagtagttaacgtggcatccgaatgcggctttacggatcaacactatagagccttgcagcagctccagcgggacctcgggccacaccacttcaacgttctcgcctttccctgcaatcagtttggccagcaggagccagacagcaataaagagatcgagtcatttgcgagacgcacctactctgtgagctttccgatgttttcgaaaatcgcggtgaccggtacaggagcacaccctgcctttaagtatttggcacagacgagtgggaaggagcccacctggaatttttggaagtacctcgtggccccagacggcaaagtggtgggagcctgggatccaacagtgagtgtagaggaagtaaggccacagatcactgccctcgttcgaaaacttatcctcctgaaaagggaggatctgtag

SEQ ID NO: 10696 - DNA, 303 bp, Artificial Sequence
  Description of Artificial Sequence: Synthetic coding sequence
atgtggggattcctggtactcaaggctcgctggctggtgacccctgtgaggacattagctaccgaggcaggccagaagcccagtctacgtggactgcttgacgttgggaacattcagcacagagctgcgcgagctcgtggcttgactcgaggcgtgattagagtgagtcctcaagagcggagccagcagaatcagtctgcgcctaaagggccaactcctagtaccagaccaaaaccccgtacacttggacctcaagctcactctcttgctctgcaatctgtcgacctcctttttcgaccgtag

SEQ ID NO: 10697 - DNA, 2352 bp, Artificial Sequence
  Description of Artificial Sequence: Synthetic coding sequence
atgcgttggcagtgcggaacacgcttcagaggtctaagaccagcagtggccccatggacggccctgctggctctaggtcttcccggatgggtccttgccgtctctgccaccgccgcagccgtggtgccggagcagcacgctagcgtggctggccagcaccccctggactggctgttaactgaccgcggacctttccacagggcccaagaatatgcggacttcatggaaaggtaccggcagggattcactactcgctacaggatctaccgcgagttcgcacgatggaaggtaaacaacctggctcttgaaaggaaagacttcttctctcttccgttgccactggcccctgagttcatccgtaacatcaggttactggggcgaagacctaacctgcaacaagttactgagaacttgatcaagaaatatggaacccacttcctcctgagcgccacactggggggtgaagagtcgctgacgatcttcgtggataaacagaaactgggacgtaagacggaaacaaccggcggagcttcaattattggaggcagcggcaatagtactgctgtgtcgctggagacactgcaccaattggccgcaagctactttattgatagagaatccacattaaggcgactccatcacattcaaattgccaccggcgcaattaaggtgaccgagacacgtactggcccattgggctgttctaactacgacaacctcgattccgtttcatccgtcctagtacagtctcccgaaaataaagtgcaactgctgggcctccaggtgctacttccagagtacctgagagagcgatttgtagcagctgcacttagttatatcacatgcagttctgagggagagctggtgtgtaaagaaaacgattgttggtgtaagtgctctcccactttccccgaatgtaattgtcctgacgccgatatacaggctatggaggatagcctcctccaaatacaggatagttgggccacccataataggcagtttgaggagagcgaagaattccaggccctgcttaagaggttgcctgacgatagatttctcaacagcaccgcaatcagccagttttgggccatggacactagcctgcaacaccgctaccagcaactgggcgctggcctgaaggttctgttcaagaaaactcaccggatcctgcggaggttgttcaacctgtgtaaaagatgtcacagacagccacggtttaggcttcctaaggagcgatcacttagttactggtggaatagaatccagagtctgttgtactgtggagagtctacattccctggcacatttctggagcagagccacagttgtacctgtccgtatgatcaaagtagctgtcagggcccaatcccgtgcgccctgggggagggtccggcttgtgcacattgcgcccctgacaattcgacacggtgcgggtcatgcaacccgggatacgtgttggctcagggactgtgccgacctgaggtggccgaatctctggagaattttctaggtcttgagacggacctgcaggatttggaactcaaatatctgctgcagaaacaggattcacggatagaagttcactctatcttcattagcaatgatatgaggcttggctcctggtttgatcccagttggcgtaagagaatgctgctcacgcttaagagcaataaatataagcctgggctcgttcacgttatgctcgctttgtcccttcagatatgtcttactaaaaactctacgctcgaaccggtcatggccatctacgtaaacccgttcgggggtagtcactctgaatcctggttcatgcctgtgaacgagggctctttccccgattgggagaggactaacgtggatgccgcagcccaatgccagaactggacgattaccctagggaatcgttggaagacgtttttcgaaaccgtccacgtgtatttgcggtcccgaattaagtccttggacgattcttcaaacgagaccatctactatgaacctctagagatgaccgacccgagcaagaacctcggctacatgaaaattaatactttgcaagtcttcggctatagcctgccttttgatccagatgctatcagggatcttatcctccagctcgattacccttatacacagggtagtcaggatagtgctctcctgcagcttatcgagctgcgcgatcgggtaaatcagctgtcaccaccagggaaagtcaggctggatctctttagttgcttgttgcgacacagactgaagttggctaacaacgaggtcggtcgaatccagagctccctgcgggctttcaactcaaaactgccaaatcccgtggaatacgaaaccggaaagctgtgttcatag

SEQ ID NO: 10698 - DNA, 2016 bp, Artificial Sequence
  Description of Artificial Sequence: Synthetic coding sequence
atggctcagctgtttctccccctgctagcagcactggtccttgcccaggctcccgcagcccttgctgatgtgctcgagggagattcctcggaggatagggcctttcgggtgcgcattgctggggatgcccctctgcagggggttcttgggggtgccctaacgatcccctgccacgtacactaccttcgcccacctcctagccgtcgggctgtgctgggatcccccagagtgaagtggaccttcctctcgcgcggacgcgaggccgaggtgttggtagccaggggcgtcagggtgaaggtgaacgaagcgtatcgcttccgtgtggcactaccggcatatcccgcttcattgacggacgtctcacttgcacttagtgagctccgcccaaacgactccggtatatatcgttgtgaagtgcagcacggcatcgacgacagctctgacgcagttgaggtgaaggttaagggcgttgtgttcctgtaccgggaaggatctgccagatacgccttctcattctcgggggcacaggaggcttgtgcaagaatcggagcccatattgcaacacccgagcaattatacgccgcttacctcgggggttacgaacagtgcgacgccggatggctatccgaccaaaccgtgcgctatccaattcagaccccgagggaggcctgttatggggatatggatggatttcccggagtcagaaactacggggtggtggaccccgatgacctttacgacgtctattgttacgctgaggatcttaatggcgaactgtttcttggcgacccgcctgaaaagttgacactggaagaagctagggcctactgccaggagcgaggcgctgagatagcaactacaggacagttgtatgctgcttgggacgggggacttgaccactgttcccccggatggctggccgatggctctgtgcgatatcccattgtgaccccgagccagaggtgtggcggagggttgccaggagtgaaaaccttattcttgttccccaaccagaccggttttcccaacaaacacagtaggttcaatgtgtactgtttccgggactcagctcagccctccgctatccctgaggcttccaacccagcctccaatcctgctagtgacggtctggaggccatcgtgaccgtgacggaaaccctggaggagttgcagttgccccaagaagccaccgaaagcgagtcacgcggagctatctacagtattccaatcatggaggacggcggtggtggctctagcactcccgaagacccggctgaggcaccacgaacgctcctcgaatttgaaacccagagcatggtccccccaacaggcttttcagaggaggagggaaaggccttggaggaggaagagaagtacgaagatgaagaggagaaggaggaggaggaagaggaagaggaggttgaagatgaagctctgtgggcctggcctagcgaactaagcagtcccggaccagaagccagcctgcccacggaacctgccgctcaggaagagagcctgtctcaggcacccgcacgcgctgtgctccaaccaggggcatctcccctgcctgatggggagtctgaagcaagccgccctccccgtgttcatggacctccgactgagaccctacctactcctcgggagcgaaaccttgcctccccctccccaagcaccctcgtggaagcgagggaagtaggcgaagcaactggtggccctgaactttccggcgtgcctcggggagaatcggaagagacgggcagcagcgagggcgctccttccctactgcccgcaacacgagcaccggaggggactagggagctggaggcgccaagcgaggacaacagcggccgaacagctccagctggcacaagcgtccaagctcagcctgtcctgccaactgactcggcttcccgcggaggtgttgccgttgtccccgcttcaggcaacagtgctcagggaagtacggccctgagtattctgctgctttttttcccattgcaactgtgggtgacctag

SEQ ID NO: 10699 - DNA, 375 bp, Artificial Sequence
  Description of Artificial Sequence: Synthetic coding sequence
atgtataagctcgccagttgctgtctgttgtttatcggtttcctgaatcccttactgtcacttcccctgctggacagcagggagatttctttccagttgtcggcccctcacgaggacgctcggctcactccagaagaactagagagagcttcgttgctgcagatattacctgagatgcttggtgccgaaaggggcgacatcttgaggaaggccgattcttcaactaacatttttaacccacggggaaacctgcggaaattccaggacttttcaggtcaagaccctaatatattactctctcacctgctagctcgtatttggaaaccgtacaaaaagagagaaactccggactgtttttggaagtactgcgtgtag

SEQ ID NO: 10700 - DNA, 1326 bp, Artificial Sequence
  Description of Artificial Sequence: Synthetic coding sequence
atggaatttgagttcgatcggctgcgcgcattccaggcaatgcaggttcactgtaataacatgcacactctgggtgctcggcttcctggtggtgtggaatgtcgattccgccgaggacccgctatggcctgggaaggcgaaccaatgcgccataacctgggaggaaatctcggcgatccgcgtgcaagggctgtatcggtccccctcgggggtcgggtggctagattcttacagtgccgattccttttcgctgggccttggctcctcttcagcgaaattagctttatcagcgacgttgtcaacaactcctctcctgccctggggggaaccttcccccctgctccctggtggcctcccggtccaccaccaacaaacttttcaagcctcgagctggaacccaggggacagcagccggtagccaaagctgaggggagccctaccgcaatcctaatcggctgccttgtggctatcatcttgctgctgctcctgataattgccctgatgctgtggaggttacactggaggcgattgttgtctaaggtgcttgaaagtcacccccgaacccggagccccggactcgtggggatccggcctacacctttgcccgtttctcctatggcactcaggtgctgcagccctattcagccaactgcgtctttctggccacttacccctgtccccttggaggcgcgtgctccgcctcaccccccaggcccaaaccctcccaccccccgtggtgtgactggtgggaacacatatgccgtccctgccttaccacccggagcggtcggcgatggccctccccgtgtagattttccaagaagtcgcttgcgcttcaaggagaaacttggtgaggggcagtttggcgaagtccacctttgtgaggtggacagcccacaggacctggtgagcctggactttcccctgaatgtaagaaagggtcaccctctgctagttgcagtgaagatcctgcggcctgacgctaccaaaaacgcacgaaatgattttctcaaagaggtgaagatcatgtcacgtcttaaagatcccaatatcatccgcctacttggtgtctgtgtgcaggacgaccctttatgtatgatcaccgactacatggagaatggtgatcttaatcagtttctttcagctcaccagctggaggacaaggctgctgagggcgcaccaggagacggtcaggctgcccagggtccgaccatctcctaccctatgctgctgcacgtggctgcccagattgcttctgggatgcgctacttagctactctaaactttgtgcacttctggggggagaggcatcgctttctgcattag

SEQ ID NO: 10701 - DNA, 1950 bp, Artificial Sequence
  Description of Artificial Sequence: Synthetic coding sequence
atgcaacaggatggcctgggtgtagggaccagaaatggcagtggtaagggtcggagcgttcatccaagctggccctggtgcgcacctcgtcccctacggtacttcggacgggacgctcgagctcgacgggctcagactgccgcaatggcccttctggccggaggtttgtctcgcggtctcggttcacatccagcggctgctggacgggacgcagtggttttcgtttggctgcttttgagtacctggtgcaccgctcctgctcgggcaatccaggtcaccgtctcaaacccataccatgtggtaattctctttcagccagttaccttgccctgtacttatcaaatgacgtctactcctacacagccaatcgtgatttggaagtacaagtcattctgcagggaccgcattgccgacgcattctctcctgcctcggtggataaccagctaaacgcccagcttgccgctggaaacccaggctataacccttacgtggaatgccaagactcagtgcggacggtgagagtggtcgctactaagcagggaaacgctgttacgctgggagattactaccaggggagaaggattacaatcacaggaaacgcagatctcacattcgaccagacagcctggggggactcaggcgtctattactgttctgtggttagtgcacaagacttgcagggcaacaacgaggcatatgccgaacttatcgttttggggaggacgtctggcgtggctgagctgctgcctggattccaagccggacccatagaggattggttattcgtggtcgttgtgtgtctggccgcattcctaattttccttttgctcggcatttgttggtgccagtgctgtcctcatacttgctgctgctatgtcagatgcccatgttgcccggataaatgttgctgtccggaggctctttacgccgcagggaaagccgcaaccagcggcgtcccctctatttacgcacccagcacctatgcccaccttagccctgccaagacgccaccgcctcccgctatgatccccatgggacccgcttataacggctacccaggcggatacccaggcgatgtggaccggtcttcgagcgctggagggcagggctcatatgtcccattactccgggacaccgacagcagtgttgcctctgaagtgagaagcggctacaggatacaggcatcccagcaagacgactctatgagggtactgtactatatggagaaagaactggcaaacttcgacccatcacgtccaggtccaccctcagggagagtagaacgcgctatgtccgaggtcaccagcctgcatgaagacgattggcgctcacggcctagccgtggccctgcccttacaccaattagggatgaggagtggggaggtcacagcccgagaagtccccgagggtgggaccaagaacccgctcgggagcaggccggtggcggatggagggctagaaggccccgagccagaagtgtggatgctctggatgacctaactccaccgtccaccgctgagagcgggagccgctccccgactagcaacgggggtagaagccgggcttatatgccccctcggagccgctctagagatgacctgtacgatcaggatgattctcgagatttcccaaggagccgcgaccctcactatgacgattttcggtccagggagcggccaccagccgatcctcgctcacaccaccatcggacgcgcgatccccgtgacaatggcagtagatcgggcgatctgccgtatgatggcagactgttggaggaagctgtcaggaagaagggctccgaggagaggaggaggccacataaggaggaagaagaggaggcttattatccccctgcgcctcccccatatagtgagaccgacagccaagcatcacgggagaggcgtttaaaaaagaatctggcactgtcccgagaatctctcgttgtgtag

SEQ ID NO: 10702 - DNA, 402 bp, Artificial Sequence
  Description of Artificial Sequence: Synthetic coding sequence
atgtcagaacgagtagagaggaactggagcactggcggttggttactggctctctgcctcgcctggctgtggacccacttgaccttggcagccctgcagccacctaccgcaactgttctagtccaacaggggacatgcgaggtgatcgcagctcaccggtgttgtaaccggaacaggatcgaagagaggtctcagactgtaaaatgttcctgctttagcggccaagtggctggtacgacccgcgctaagccttcgtgcgtggatgcgtctatcgtcctgcagcggtggtggtgccaaatggagccttgtctgcccggagaggaatgtaaggtactgcctgatttgtcagggtggtcatgcagctcaggacataaagtcaagactacaaaggtcacccggtag

SEQ ID NO: 10703 - DNA, 699 bp, Artificial Sequence
  Description of Artificial Sequence: Synthetic coding sequence
atggtagccgcaaacacaagggccccagaagatacccgggctcctgccggacccaaaccgtcatcttgcgaatgggccgtctgctgggcacccgcacgctgtcggatcagcgcaaccgcttgtgggaattcgtgggaccgccctgcaggacggacgcaactgctgtggactccggctgcacctaccgccatggccgaagtggggccaggacacacacccgcacatcccagccaaggagctgtcccacccagtcgcgcagcagcagagccacacctgaagcctagcccctccgagctgcaaaccgctggcccagccgctacaatccccgctcggctctgtactaggaaacccaggctcgtctacacacaatgttggtatgtgaaggagcccaaacaccccgagatcgttaccccgtggggtaccgccgctcggcattcttggagacagcatcagatgctgtccgcaagcgaaagacggtgtctgcctcgggacgtggagcaaaagctgggcccagagcatactgggccttgtcttgacgaacaggggcgagaggctgagctggccaggtccggcccttcagccgctgggcctgtgcgattgaaacctggcctggtccccggactattcctgctgtcctgtacaacctcgcctagcacttgtctcccagtgggccaagaaggcgaacgaggcatgctgtag

SEQ ID NO: 10704 - DNA, 711 bp, Artificial Sequence
  Description of Artificial Sequence: Synthetic coding sequence
atgtgtgtgacatatcacaacggtactgggtattgtaagtgcccagagggattccttggcgaatactgccaacaccgggacccatgcgaaaagaaccggtgccagaacggcggaacgtgtgtcgcacaagcaatgttaggaaaagccacttgccgatgtgcctcaggcttcacaggagaagactgccagtactcaaccagtcatccgtgtttcgtctccagaccgtgtctgaatggcggaacatgccatatgctctcgcgggacacatacgagtgcacttgccaggtgggcttcacaggcaaagagtgtcagtggactgacgcctgcctgagccacccctgcgcaaacggtagcacttgtaccaccgtggccaaccagttttcctgtaagtgccttactgggtttacagggcagaaatgcgagacagacgtgaacgagtgcgacatacctggacactgtcaacacggcggaacatgtctaaatctgcccggttcataccagtgtcagtgtttacagggcttcacaggccaatactgcgactctctttatgtaccatgcgccccttcaccatgcgtaaacggcggaacgtgccgccagactggtgactttacctttgagtgcaactgcctccccgaaactgtgaggagaggaaccgaactgtgggaacgcgaccgcgaggtgtggaatggcaaagagcacgatgagaattag

SEQ ID NO: 10705 - DNA, 204 bp, Artificial Sequence
  Description of Artificial Sequence: Synthetic coding sequence
atggacaatgtccaacccaagattaagcatcggcctttctgcttctcagtgaaaggccatgttaagatgctgcgactcgtgtttgcactagttaccgctgtttgttgtctcgctgacggcgctttaatctatcgcaagctcttgtttaatcccagcggcccttaccagaaaaagcccgtgcacgagaagaaagaggtcctctag

SEQ ID NO: 10706 - DNA, 75 bp, Artificial Sequence
  Description of Artificial Sequence: Synthetic coding sequence
atgctcgtggatgggccatcagagagacctgctctgtgttttctgctgctggcagttgccatgtcatttttctag

SEQ ID NO: 10707 - DNA, 3345 bp, Artificial Sequence
  Description of Artificial Sequence: Synthetic coding sequence
atgctcgccagctcttctcggatcagggctgcctggacccgcgctcttttgctgccattgctcctagcgggaccagtcgggtgcctgtctagacaggagctctttccattcgggcctggccagggagatctggagctggaagatggtgatgattttgtcagcccagcactggagctttctggagccctgagattctatgacagatccgatattgacgctgtgtatgtcacaactaacggaataatagcaacgtccgaaccccctgcaaaagaaagccacccaggcctcttcccacccacttttggcgcagtggcaccattcttagctgatttagacacaacggacggactgggcaaggtgtattatagggaagatctttctccttccataacccaacgggctgccgagtgtgtgcacagaggattccccgaaatttccttccagccttcctctgccgtggttgtgacatgggaatccgtcgccccataccaggggcctagtagggacccggaccaaaaggggaagagaaacacgtttcaggcagttctggcttctagcgatagctcctcctatgctatcttcttataccctgaggatgggttgcagttccataccactttctccaagaaagagaataaccaagtcccggcagtggtggcattcagccagggatcagtgggcttcttgtggaagtctaatggtgcttacaacatctttgccaatgatagagagtctgtggagaatctggccaagtcttccaactccgggcagcagggcgtttgggtctttgagatcgggtcccccgctaccactaatggcgtagtacccgctgacgttatcctgggaacagaggacggagcagagtatgatgatgaggatgaggactacgaccttgcaacaaccagactgggcctcgaagatgtgggcaccacccccttctcctacaaagcgctccgcaggggaggtgccgacacctattctgtaccatccgtgctgtctccgcgacgcgctgcaaccgagagaccactcgggccacctaccgagcggacgaggagtttccagctcgccgttgagacctttcaccagcagcacccacaagttatcgatgttgatgaggtggaggagactggcgtggtattcagttataacacagactccaggcagacctgtgctaataatcgccatcagtgctcagtacacgcagagtgcagggattatgctacgggattctgctgcagttgtgtggctgggtatacaggaaacggcagacaatgtgtggctgaaggcagcccacaacgcgtcaatggaaaggtcaaaggtcggatattcgtggggtcttcacaggtcccaatcgtgtttgagaataccgatctgcactcttacgtagtgatgaatcatggtcgaagctatactgccattagcacaattcctgagaccgtcggctacagcctgctgcctttagcgcctgttggagggatcattggctggatgttcgctgtggagcaggatgggtttaaaaacggcttcagcattaccgggggagagtttactcgccaagcagaggtgaccttcgtgggccacccaggaaacctggtgataaagcagagattcagcggtattgatgaacacggccacctgactattgacacggaattagaggggagagtacctcagattccctttggaagttcggtgcatattgagccatatactgaactctaccactactccaccagcgtcattacatcctcctctactagggagtatacagtgacggaacccgagcgggacggcgcatcaccgtcccgtatatacacatatcaatggagacagactatcacattccaggaatgcgttcacgacgattcccggcctgcactgccttctacacaacaactcagtgtcgatagtgtgttcgttctatataaccaggaagagaagattctgcgatatgccttaagcaatagcatcggccctgttagagagggaagtcccgacgctctgcaaaacccttgctatatcgggacccacggctgtgataccaacgctgcctgtaggcccggacccagaacacaatttacttgtgagtgttcaattggatttcgtggtgatggcaggacttgttacgaggtagaaaaaacgcggtgccagcatgagcgagaacacattttgggagcagctggagccaccgacccccagcgcccaatcccaccagggttgtttgtgccagagtgcgacgcccacgggcactatgcccctactcagtgccatggttctacaggctactgttggtgcgtagacagagacggcagggaggttgagggcaccaggacaagaccaggaatgaccccaccctgtctgtccaccgtggcccctcctattcatcaggggccagctgtgccaaccgctgttatacctcttcctccaggcacgcacctcctgtttgcccaaaccggtaagatcgaacgcctcccattggaaggtaatacaatgagaaaaaccgaagctaaagctttcttacatgtacccgctaaggtcatcattggcctagccttcgactgcgtcgataagatggtgtattggacagatatcaccgagccctctattggcagagcctcattacacggcggagaacccacaacaatcatacggcaagacctgggcagtccagagggcattgcggttgatcacctcggcaggaacatattctggactgactcaaaccttgatcgcatagaggtagctaagcttgatggtacacagagacgtgtgctatttgaaaccgatcttgttaacccgaggggaatagtgactgactcagttagggggaacctgtattggaccgactggaatagagacaaccccaagatcgagaccagctacatggatgggaccaatcgacgcatcctggtccaggacgacctgggactaccaaacggacttacctttgatgccttctccagccagctttgttgggtcgacgctggcacaaacagagctgagtgccttaatccgtctcagccaagtaggcgaaaagccctggagggattgcaatatccttttgcagtgaccagctacggcaaaaatctgtattttaccgactggaaaatgaattccgttgtcgccctcgacctggcaatatctaaagagaccgacgccttccagccccacaaacagacgagactgtacgggattactactgccctgtctcagtgtccacaagggcataactactgtagtgtgaacaacggcggatgtacccatctgtgtctcgccacaccagggtcccgaacgtgtaggtgcccggataatactctgggcgtggattgcatagaacaaaaatag

SEQ ID NO: 10708 - DNA, 2172 bp, Artificial Sequence
  Description of Artificial Sequence: Synthetic coding sequence
atggggtccagatgcgctctcgccctggccgtgttgtccgccctgttgtgccaagtgtggtcgtctggggtgttcgagcttaagttgcaggagttcgtgaataagaagggactcttaggaaacaggaattgttgcagggggggagctggccctccaccttgcgcctgtaggacttttttccgggtgtgtctcaaacattatcaggcatcagtatccccggagcccccttgtacttacggcagtgccgtgacacctgtgctgggagttgactctttttctctgccggatggcggtggcgcagatagtgctttctctaatcctattagattccccttcggatttacctggccaggaactttctctcttattattgaggcactacacacggattccccagacgatctcgccacggaaaatcccgagcgattaatttcccggctggcgacacagagacatctgacagtgggggaagagtggtcacaggatctgcactccagtggtcgcactgatctcaaatatagttacaggtttgtgtgcgacgaacactactatggagaaggatgtagcgttttttgccgccctagagacgacgccttcggtcatttcacctgcggtgagcggggagagaaagtttgtaatccaggttggaaaggcccttactgcaccgagcccatttgcctgcccggatgcgacgaacagcatggcttctgcgataagcctggcgagtgtaagtgccgggtgggatggcaggggcgatactgtgacgaatgcatcaggtatccaggatgtctccatgggacctgtcagcagccttggcagtgtaactgtcaggaaggctggggcggtcttttttgcaatcaggatttaaattactgtacgcaccataaaccttgcaaaaatggagccacttgtacgaacactggacaaggaagctatacgtgcagctgcagaccaggctacactggggctacctgcgaactaggaatcgacgagtgcgacccctctccctgtaagaatggtggctcctgcacagacctcgaaaactcctacagctgtacctgtccacctggattttacggcaagatttgtgagttaagtgccatgacatgtgccgatggaccgtgttttaatggaggcaggtgcagtgattcgcccgacggcggttacagctgcaggtgcccagtgggatacagcggatttaactgcgaaaagaagattgattactgtagcagcagtccatgcagcaacggcgcaaaatgtgtggatttgggcgatgcatatctgtgccgctgccaggcaggttttagcggcaggcactgtgacgacaacgtggacgactgcgcctcctccccgtgtgctaacggcggaacctgtagagacggggtcaatgacttctcatgcacctgcccccctggttatacgggacggaattgcagtgcaccagtgtcccgctgtgagcacgctccatgtcacaatggcgctacctgtcacgagagagggcataggtatgtatgtgagtgtgcgcgaggttacgggggaccgaactgccagtttctcctgcctgaactacctcccggacccgcagttgtagacctgactgagaagctcgagggtcaaggcggtcccttcccatgggtggcggtttgtgccggagtgattctcgttctgatgctgcttcttgggtgtgccgcagttgtggtatgcgtcagacttaggctgcaaaagcataggccgccagccgacccctgccgcggagaaaccgaaactatgaacaatttagcaaattgccagcgtgagaaggatattagcgtctccatcattggagcaacacagatcaaaaacaccaacaagaaggccgacttccacggagaccactccgctgacaaaaatgggttcaaagctagatacccagccgtcgattacaatttggtgcaggatttgaaaggggacgatactgcagtgcgcgatgcccactccaaaagagataccaaatgccaaccccaaggctccagcggggaggagaaggggactccaacgactttacgaggcggagaggcatccgaacggaaacgccctgacagcgggtgttccacatcaaaggataccaagtatcaaagcgtctacgttatctccgaggagaaggacgagtgcgtcatagcgacagaagtttag

SEQ ID NO: 10709 - DNA, 981 bp, Artificial Sequence
  Description of Artificial Sequence: Synthetic coding sequence
atggctgcccctgcaagtgtcatggggcctctgggcccaagtgcgctgggcctgctgctcttactactggtcgtggccccaccacgcgttgctgccctagttcataggcagcccgagaatcaagggatctcactgactggttccgtggcatgcggaagaccctctatggaggggaagatccttggcggagtccctgccccagaaaggaaatggccatggcaggtcagtgttcactacgccggactgcatgtctgtgggggtagcatcctcaatgaatattgggtcctgtcagctgcacactgtttccaccgagacaagaacattaagatctatgatatgtatgtcggccttgtgaatctgcgagtggccggaaaccacacccagtggtatgaagttaatagagtcattctccatccaacttatgagatgtatcacccaattggcggagatgtggcactggtacagttgaagactagaattgtcttcagcgaaagtgtgctaccagtttgtctcgctacacccgaggtaaacctcaccagcgccaattgctgggctacaggatggggtctcgtatcaaagcagggagagacctcagacgagttacaggagatgcagttaccattaatcctggaaccgtggtgtcacctgctgtacggacacatgagctacatcatgccggacatgttgtgcgcaggtgacattcttaatgcaaagaccgtctgtgaaggggatagcggcggaccactcgtgtgcgaattcaacagatcatggctccagattggcattgtcagttggggtcggggatgctccaaccccctttacccaggagtctacgcctctgtgtcatatttctctaagtggatctgtgacaatattgaaattacccccacgcccgctcagccagcccctgctctgtcgccagccttgggccctacccttagcgtcctgatggccatgttggccggatggagtgttctgtag

SEQ ID NO: 10710 - DNA, 1596 bp, Artificial Sequence
  Description of Artificial Sequence: Synthetic coding sequence
atgtctcttgcagcctattgtgtaatctgctgtcgccgtatcggcacaagcacatcacctcctaaatcgggaactcactggcgggatataaggaatatcatcaagttcacaggcagcttaatcctcgggggatccctgttcctgacgtatgaggtgctggccttgaaaaaagctgtgactcttgatacgcaggtcgtggagcgtgaaaagatgaagtcttatatttatgttcacactgtaagcttggacaagggagagaaccacggcattgcctggcaagccaggaaagagctgcacaaagccgtaagaaaggtcctcgcaacatcggccaaaatccttcggaatccctttgccgaccccttctctactgtcgacatcgaggatcacgaatgcgccgtttggctgctgctccggaaatcgaagagcgacgataagacgactcgtctggaggctgtgcgtgagatgtccgaaacgcatcactggcatgattaccagtaccggatcatcgcccaggcttgtgaccccaagacactaattgggcttgcccgttccgaagagagtgatctcagattcttcctgcttcccccacccttgccttcactcaaggaggactccagtaccgaggaggagctgagacagctgttggcttccctgcctcagaccgaactggacgaatgtatccagtacttcaccagcctggccctgagcgaatccagtcagagtctcgcggctcagaaaggcggattgtggtgcttcgggggaaatggcctcccctacgccgagtcttttggggaagtcccatccgcaacggttgaaatgttctgcctggaagctatcgtgaaacacagcgagatcagcacccactgcgataagatcgaggcaaatggaggtctccagttactgcagaggctgtatcgcttgcacaaagactgccccaaagtccaacggaacataatgcgcgtgatcggtaatatggcccttaacgaacatctccattccagcattgtgcgttcaggttgggtatcaataatggccgaggctatgaaatctccacacatcatggaaagttcacatgctgccagaattctggctaatcttgaccgggagacagttcaggaaaagtaccaagacggggtgtatgtgctgcatccccagtatcgtactagccaacccattaaagctgatgttttgtttattcacgggttgatgggggcagcgttcaagacttggcgccaacaggactccgaacaagccgtgatagaaaagcccatggaagatgaggacaggtataccacatgttggcctaaaacatggctcgctaaagactgccctgcgttgcgcataatctcagtggagtacgacacaagccttagtgattggcgcgctagatgccccatggaaaggcgtagtttgttatcaatcagttccggtatcgtggaggggttggagtctccactccacagcgaggcgaccaactttttggggtcatcggagctgctcgtgcttggtattggccagtggttcggttatcatatcgcctgggaagtattcctttcaaaacgctgttgctggaaacccttgcgcagccagaaatag

SEQ ID NO: 10711 - DNA, 1596 bp, Artificial Sequence
  Description of Artificial Sequence: Synthetic coding sequence
atgagcctcgctgcatactgtgtgatttgctgccgccgaattggcacttctacctccccaccgaaaagcggcacccactggcgtgacataagaaacatcataaaattcacaggctctttgattctggggggttcactgtttcttacctacgaggtgctggcactgaaaaaagccgttaccctcgatactcaggtcgtcgagcgggagaagatgaaatcttatatatacgttcacacagtgagtctcgataaaggcgaaaaccacggaatcgcctggcaagctagaaaggagctacacaaagctgtgcggaaagtgctggctactagtgcaaagatactgcgaaatccgtttgccgatcctttctccaccgtcgatatcgaagatcacgagtgcgctgtctggctgctcctgcggaagagtaagagcgatgacaagactacgcggttagaggctgtgcgagaaatgagtgagacccatcattggcacgactaccagtatagaatcattgcccaagcgtgcgatccgaagacgctgattggcctggcacgcagcgaagagagcgatctgcgtttcttcctgttgccaccgcctctgccaagcctcaaggaggactcctcgactgaagaggaactgcggcagttgctagctagcctgcctcagacagaactggacgagtgcattcagtactttacgagtcttgccctgtcagagagtagtcagagccttgccgctcagaagggcggtctgtggtgcttcggaggtaatggcttgccttacgcagagagcttcggcgaagtgcctagcgctactgtggagatgttctgtctcgaagcaatcgtcaaacattctgagatatccactcactgcgataagattgaggccaacgggggactccagctgttacagcggctctacagactgcacaaggactgtcctaaagtgcaacggaacataatgagagttatcggaaatatggccctgaacgagcacctgcattctagcatcgtccggtccggatgggtttccattatggccgaagccatgaagtcgccacacataatggagtctagtcatgccgctagaattctcgctaatctcgatcgggagactgttcaggagaagtatcaggacggcgtgtatgttttgcaccctcagtaccgcacaagccagccaatcaaggccgatgtgctgtttattcacgggctgatgggtgcagcctttaagacctggcgccagcaggacagtgaacaggccgttattgagaagcccatggaggacgaggaccgctataccacgtgctggcccaagacctggctggcgaaggactgtcccgcactgaggatcattagcgtggagtatgatacatctctgtcagactggcgcgctcgctgcccaatggaacggcgtagcttgctgagcatatcatccggcattgtagaagggctggagagtccactgcattcagaggctaccaactttctcggatccagtgaacttctggtgcttggcattgggcagtggttcgggtaccacatcgcatgggaagtgttcctgagtaaacgctgctgttggaagcccctgaggtctcagaaatag

SEQ ID NO: 10712 - DNA, 1965 bp, Artificial Sequence
  Description of Artificial Sequence: Synthetic coding sequence
atgtctctggctgcctactgcgtgatctgttgtaggaggatcggaaccagcacgtccccacccaaaagtgggacacactggagagacatccgaaatattatcaaattcaccggctctctcatattagggggttccctgtttctcacatatgaggtgctcgcactcaagaaggcagttacactagatacacaagttgtcgagcgggagaagatgaagtcatacatttacgtacataccgtaagtctcgacaagggcgaaaaccatggtatagcctggcaagccaggaaggagctgcacaaggcagtccggaaggtcctggccacctccgctaagattctgcggaatcctttcgcagaccctttctccactgtggacattgaagaccacgaatgcgcagtgtggctgttactaaggaagtcaaaatccgacgataagactaccaggctcgaggctgtgagagaaatgagcgaaacccatcactggcatgactatcaatatcgcattatagcccaggcctgcgatcctaagacactcatcggcctggctcgtagtgaagaatccgaccttcgcttcttcctgctgcccccacctttgccaagcttgaaggaagacagctcaaccgaggaagaactgaggcagttgttggcctctcttccccaaaccgaactggacgagtgtatccagtactttacctctctcgctctgtccgagtcctcacagagtctggcggcacagaaaggaggactctggtgttttggagggaacggcctaccatatgcggagtcctttggcgaggtgccttctgccacggtcgagatgttttgtttggaagccattgttaagcattccgaaatttctactcattgcgacaaaatcgaggccaatggtggcctgcaattgctacaaaggttgtaccgactgcataaggattgccccaaagttcagaggaacattatgagagtcatcgggaatatggctcttaatgagcacctgcattctagcatcgttcggagcgggtgggtgtccattatggctgaagcaatgaaaagcccacacattatggaaagttcccatgcagcccgtattctagccaatttggaccgggaaaccgtgcaggaaaagtatcaggatggggtctatgtgcttcacccccaatatcgtacatcacagccaatcaaggccgatgtactctttatacatggactgatgggagcggctttcaaaacttggcgtcagcaggattctgagcaggctgtgatcgagaagcccatggaggacgaggaccgttataccacatgttggccgaagacctggctggcgaaagattgcccagcacttagaattatcagtgttgaatacgacacttctctcagcgactggagggcccgttgccccatggaacggaaatccatagctttccggagcaacgagctactgcgcaaattgcgtgccgcaggtgttggggaccgcccagtggtctggatttctcactcaatgggcggactgctcgtgaagaaaatgctgctggaggccagcaccaaacccgagatgagcaccgtcattaataatactcggggaatcattttttattcagtaccgcatcatggaagtcgcctggccgagtactcggtaaatattcgatacctgctattcccatccctggaagtcaaggagttgagcaaagattcaccggctctcaagaccctacaggatgacttcctggagtttgctaaggacaaaaactttcaagttcttaattttgtggagaccctgcccacatacatcggctccatgattaagctacacgtagtgcctgtcgaaagcgctgatcttggcatcggtgatcttatcccagtggatgtaaatcacttgaatatttgtaaaccgaaaaaaaaggacgcctttctgtaccagaggaccctgcaatttatacgtgaagccctggccaaggatcttgagaactag

SEQ ID NO: 10713 - DNA, 1509 bp, Artificial Sequence
  Description of Artificial Sequence: Synthetic coding sequence
atggcacagagatgcgtgtgcgtgctcgctctggttgctatgctgcttctggtatttcccactgtcagcaggtccatgggacccaggtctggcgaacatcaaagagcatcaagaatccctagccaattttccaaagaagagcgtgtggcaatgaaagaagcactgaagggagccattcaaatcccaacggtgacgttctcaagcgagaaatcaaacaccactgccctagctgaattcggcaagtatattcacaaggttttccctaccgttgtgtccacttcatttatccagcacgaggtggtggaggagtactcccacctgttcactattcagggaagtgatccctccctgcagccatacctgttaatggcccactttgatgtggtccctgctccagaagaagggtgggaggtaccaccatttagtggcctcgagcgagatggcattatttacgggaggggcacccttgacgacaaaaattcggtgatggcattgttgcaggccctggagttattactgattagaaaatatatccctaggcggagcttctttatctccctcggacatgatgaggagtcctctgggacgggggctcagaggatttcggcactcctgcagtcacgcggagtccagctcgcattcattgttgatgaaggaggcttcatcttagacgacttcatcccaaatttcaaaaagcccattgctctgatcgctgtgagtgagaaaggctccatgaacctgatgttgcaggtgaatatgacttcaggtcactcttctgcccctcccaaagagacctccatcgggatcctagccgctgcggtctctagactggagcagacacccatgcccataattttcggatcggggacagtagtcaccgtgttgcaacaactcgctaatgagttcccattccccgttaatattattttaagcaatccgtggttgtttgagcccctcatttctcggttcatggagcgcaatcctttaacgaatgcaatcattcgaaccactaccgctctgaccattttcaaggccggagtgaagtttaacgttatcccccctgtagcccaggccacagttaatttccgcatacacccgggacagaccgtccaagaggttctggagctcaccaaaaacatcgtggccgacaacagagttcaatttcatgtcttaagcgcattcgatcctttgccggtgtccccctcggacgacaaggccctgggatatcagctcttgcgccagacggtgcaatccgtctttccggaagttaacatcactgctcctgtgacgagtatcggcaacactgactcccgcttcttcacaaacctgacgactggaatatataggttttaccctatatacatacagcccgaagactttaagcggattcatggcgttaacgagaaaatctccgttcaggcctacgaaacccaggtcaagttcatcttcgaattaatacaaaatgccgacacagaccaagaacccgtgagccacttgcacaaactctag

SEQ ID NO: 10714 - DNA, 999 bp, Artificial Sequence
  Description of Artificial Sequence: Synthetic coding sequence
atgagattgctggcgttcctcagcctccttgccctcgttctgcaggaaacaggaacagcctctctccccaggaaagagaggaaaagacgggaagagcagatgcctcgtgaaggagactccttcgaggttttgcccctgaggaacgacgtactaaacccagacaactacggtgaagtcatcgatttatctaattatgaagagctcacagactatggagaccagctgcccgaagtcaaagttacttcgctggctcctgctactagcataagccctgccaagagtactacagctcccggaactccgtcaagtaaccccacaatgacgcggcctacaacagctggcctgctactgtctagccagcctaaccacgggctccccacctgtcttgtgtgcgtgtgcctcggatctagtgtctactgtgacgatattgaccttgaagacatcccaccattacccagacgaacggcctacctgtacgcccgattcaacagaatctccagaattcgtgccgaagatttcaagggtctgactaaactgaaacgcatagaccttagcaacaacctgatcagtagtatcgataatgacgcgtttcggttactgcacgctctgcaggatttgatactgcctgaaaatcaactcgaagcacttcctgtgctcccatccgggatcgaattcctggacgtccgtttgaaccggcttcagagcagcggcattcagcccgcagcgttcagggcaatggagaagctccaattcttatacctgtcggataacctcctggattccatcccaggcccactcccattgtccttgaggagcgttcacctccagaacaatttgatagagacaatgcagagggacgtgttctgtgatccagaggagcacaagcacacacgccgacagctggaggacatcagacttgacggcaaccccatcaatctaagtctgttcccttccgcttacttttgcctgcccagactgcccatcggccgattcacctag

SEQ ID NO: 10715 - DNA, 1401 bp, Artificial Sequence
  Description of Artificial Sequence: Synthetic coding sequence
atggttcgcagcgtggcctgggccggattcatggttttgcttatgattccatggggttctgcagcaaaactggtgtgttattttactaattgggcacagtatcgccagggtgaggctcgctttctgccaaaggacttagaccccagtctatgtacccatcttatttatgcttttgcaggcatgacaaatcatcaacttagcaccaccgagtggaacgacgaaactctctatcaagaattcaatggcctgaagaagatgaatccgaagttaaaaaccctgctggcaatcggaggatggaactttggaactcagaagtttactgatatggtggctacagctaataatagacagacgttcgttaactctgccatccggttcctgcgtaaatacagtttcgacggactggaccttgactgggagtaccctggcagccaaggaagccctgccgtcgataaggaacggttcacaactctcgtgcaggacctcgctaatgctttccagcaagaagctcagacaagtgggaaagagaggctgttgctgagcgcggctgtccccgctggacagacttacgtggacgctgggtatgaggtagacaagattgcccagaacttggacttcgttaacctcatggcttacgactttcacgggtcatgggaaaaggtcactggtcacaactctccactctataagagacaggaagaatcaggagctgccgcatctctgaatgtggatgccgcagtgcaacagtggctgcagaaaggcacacctgcctcaaagctgattctcggcatgccaacatacggtagatctttcactctagcctctagttccgatactcgcgtcggcgcaccagcaaccggatcgggtacacctggtcccttcacgaaggaaggcggtatgttggcatattacgaggtttgctcatggaaaggcgcaaccaaacaaagaattcaggatcaaaaagttccttacatattccgcgacaaccagtgggtgggttttgatgacgtggaatctttcaaaactaaagtttcctatctgaagcaaaaagggctcggaggtgccatggtctgggccctcgatctcgatgatttcgccggattttcctgcaatcagggtagatatccgttaatccagaccttgagacaggaattaagtctcccttacctgcctagtgggacacccgagttggaagtgccgaagccaggacaaccgagcgaacccgaacatggtcctagccctggccaggacaccttctgccaggggaaggccgatgggttgtacccgaaccctcgggaacgctcctctttctattcttgcgccgctgggaggttatttcaacagtcatgccccaccggactggtcttcagtaattcttgtaagtgttgcacctggaactag

SEQ ID NO: 10716 - DNA, 1596 bp, Artificial Sequence
  Description of Artificial Sequence: Synthetic coding sequence
atgaggctctgcctgggcagaccgcatcccagaggccacagccgggtgggcaagagtgagagaggccgtggcgctcggggactagcaaggcagaggactcttgaagatgaggaggaacaggagcgcgaaagacgcaggcggcaccgtaacctgtctagtactaccgatgatgaggccccaaggctgtctcagaacggcgatagacaggcctctgcatcggagaggcttccctccgttgaagaggcagaagtgccgaaacctctgccccctgcatcaaaagacgaagacgaagacattcagtctattctgagaacaaggcaggagagacggcagcggaggcaagtggtagaggccgcacaagcccctattcaggagagactggaggcagaggagggccgaaactccctgagccccgtccaggcaacccaaaagccactggtctctaagaaggaacttgagatcccacctcggaggaggctgtcaagagagcagagaggaccttgggccctggaagaagaaagcttggtgggacgcgagcctgaagagaggaaaaagggcgtgccagagaaatcccccgtgctcgaaaaaagtagtatgccaaagaagacagctcccgagaagtcacttgtgtccgacaaaactagcattagcgagaaagtactggcatccgaaaaaacctccttgtctgagaagatagctgttagtgagaagaggaacagctcggagaaaaagagtgtgctcgagaagaccagcgtttccgagaagagtttggcacctggaatggccttaggctccggacggagactggtgtccgagaaggcatccatttttgaaaaggcgcttgcatctgaaaaaagccccaccgctgatgctaaacctgctcccaaaagggcgacagcttctgaacagcctctggcccaggagccccctgcaagtggagggtcgcccgctacaactaaggagcaacgtggaagagccctgcctggcaaaaaccttccaagtcttgccaagcaaggcgctagcgatcctccaacagtagcaagtcgcctcccacctgtgactctccaggtcaaaattccatcgaaggaagaagaagccgacatgtcgagccccacacagagaacttattcaagcagcctcaagcgctcatcacccagaacaatctcctttaggatgaaacctaagaaggagaattcggagacaacactgacaaggtcagcaagtatgaagctgcctgataatactgtgaagcttggcgaaaagctggaaaggtaccatacagcaattcgtcggagcgagtctgtaaagtctcggggtctcccatgtaccgagttatttgtcgcccctgtgggtgttgccagcaagaggcacctgttcgagaaggaactggcagggcaatcaagggccgagcctgcctcttcaagaaaggaaaatctgagactgagcggggtagtcacctcaaggcttaatctgtggatatcccgaacacaggagagtggggatcaagatcctcaggaggctcagaaagcctcgtccgccaccgaaagaacccagtggggccagaagtctgactctagtctggacgccgaagtgtag

SEQ ID NO: 10717 - DNA, 1782 bp, Artificial Sequence
  Description of Artificial Sequence: Synthetic coding sequence
atgaaggccgatcttaagcagcatcaccatcactggagcatatttagctatattcggctccgactcccatcaatgcttcttctgttttctgtgattctgatttcatgggtcagcactgtaggtggagaagggacattgtgcgactttcccaagatccaccacgggttcctgtacgacgaagaggattacaaccctttttcacaagtgccaactggggaagtgttttactattcttgcgagtacaactttgtgagcccgtctaaaagtttttggacacgaattacctgtacagaggaagggtggtctcctactccaaaatgtctgcgaatgtgtagtttccccttcgtcaagaacgggcacagcgagagctccggcctaattcacctagaaggagacacggtgcagataatctgcaatacaggatatagccttcagaataatgagaagaatatttcatgcgtggaaagaggctggagtaccccaccgatatgcagcttcacaaaaggcgagtgccacgtccctatactggaggctaatgttgacgcccaacccaagaaagagtcctataaagtgggagatgtgctgaaatttagctgtcggaaaaacctgattcgtgtcggctccgactccgtgcagtgctatcagtttgggtggtcccccaactttcccacctgtaaaggacaggtaaggagctgcgggcctcctcctcagctgtcgaatggggaggtgaaggaaataaggaaagaagagtacggccacaacgaagtcgttgaatacgactgtaaccctaatttcatcattaatggccctaagaaaattcagtgcgtggacggtgaatggacaactcttccaacctgcgtagagcaggtaaagacttgcggatatattcccgagctggagtatggctacgtgcagccaagcgttcctccctaccagcacggcgttagtgttgaggtgaactgcagaaacgagtatgccatgatcggaaataacatgattacatgtattaacggaatctggacagaactgcctatgtgtgtggccacccaccaactcaagcgctgcaagatcgccggagtcaacattaaaacattgcttaagctttctggtaaagaatttaatcacaattcgcgtatacggtatagatgcagcgatatttttcggtatcggcactccgtgtgtatcaatggaaagtggaatcccgaagtcgattgcaccgaaaagagggaacagttctgtccgccaccccctcaaattccaaacgcccagaacatgacgaccaccgtgaactaccaggatggagagaaggtggcagtgctgtgcaaggaaaattacctgctgcccgaagccaaggagatagtgtgtaaggatggtcgatggcagtcactccccaggtgcgtcgaaagtactgcatattgcggccctcctccaagcattaacaatggggataccacgagttttcccctgagtgtgtacccaccgggttcgacagtgacatataggtgtcaaagtttctataaactacagggcagtgtaaccgtgacctgtcggaacaaacagtggtccgaaccaccgcgatgtctggatccctgtgtagtgtccgaggagaatatgaataaaaataatatacaacttaaatggaggaacgatggcaagctctatgccaagacgggcgacgccgtggagtttcagtgtaagttcccccacaaggcaatgatcagctcccctccgttccgagctatctgccaagaagggaagttcgagtatcccatctgtgagtag

SEQ ID NO: 10718 - DNA, 2301 bp, Artificial Sequence
  Description of Artificial Sequence: Synthetic coding sequence
atgatttggagaagccgggctggagccgaactttttagtttgatggccctatgggagtggatcgccctgtcattgcattgctgggtcctggccgtcgcggctgtttccgaccagcacgctaccagtccttttgactggctgctaagcgacaaaggcccatttcatcgttctcaggaatatacggactttgttgaccgttcgcggcagggattctccacccgctacaaaatttatagggaatttggtcgttggaaggtgaataatctggccgtagagaggaggaacttcctcggcagtccgctgccgctggcacctgagtttttccgtaatatacgactgctgggcagacggccaacactgcagcaaataacagaaaacctcataaagaaatatggcacgcactttctgctgtccgcaactcttggcggagaggagagcctcacaatctttgtggataagaggaaactcagtaagcgcgcagagggcagcgactccaccaccaactcttctagcgtgacccttgagaccctgcatcagctagcagcgagttattttattgatagggacagtacgctacgtcgacttcatcatatacagatcgcttccacggccatcaaagtgacagagacccggactgggccacttggctgcagtaattacgacaacttagactccgtctctagtgtcctagttcaatctcctgaaaataaaattcagctgcaagggctgcaagtgctcctccccgattatttacaggagcgcttcgtccaggctgcgctgtcttatatagcttgtaattcagaaggggagttcatatgcaaagaaaacgactgttggtgccactgtggacccaagtttcctgagtgtaactgccctagcatggacatccaggccatggaagagaatttgttgcgtattaccgaaacttggaaggcctataatagtgacttcgaggagtccgacgaattcaaactgtttatgaaacggttgcctatgaattacttcctaaatacctctacaattatgcatctctggaccatggactcaaatttccaacgcaggtacgagcagctggaaaattctatgaagcagctcttcctcaaagctcagaagatcgtgcacaaactgttctcgctgtctaagcggtgtcacaagcaaccactgatatcactcccccgtcagaggacatcaacatactggttgacccgcattcagtccttcctttattgcaatgagaacgggctgctgggttcttttagtgaagaaacacatagctgtacctgccccaacgaccaggttgtctgtaccgccttcctgccatgcaccgtgggggacgctagtgcttgcctgacatgcgcacccgataatagaacccggtgtgggacctgtaacaccggatatatgctgagccagggtctgtgtaagccagaggtcgctgaatctaccgatcattacattgggttcgagacggacctccaggacctcgaaatgaaatacctgctccagaagactgatcggaggatagaggtgcacgctatatttatctcgaacgatatgcggctgaattcctggttcgatccttcctggcgcaagaggatgttgctgacattgaagtccaacaagtacaaatcttctctagtgcatatgatactgggtcttagtctccagatttgcctgactaagaactccaccctcgaacccgtgctggccgtgtatgtgaatcctttcggtgggagccattctgaatcctggtttatgccggttaatgagaattccttccctgactgggaacggactaagctggacttgcctttgcaatgctataattggacccttacattaggcaacaagtggaagaccttcttcgagaccgttcatatctacttacgcagtcggattaagagcaatggaccgaatgggaatgaaagcatctactacgagcctctggagttcatagatcccagtagaaacctgggatatatgaagatcaataacattcaggtgtttggatattccatgcattttgatcccgaggcaatccgggacttgattttgcagctcgattatccatatactcagggcagccaggacagcgccctactccagctcctcgagatcagagacagagttaacaagctttctcccccaggccaaagacgactggacctattttcctgtctgctgcggcaccgtctcaagctgtccacctccgaggtggtcagaattcagagtgcactccaggcctttaatgcaaagcttcctaataccatggactatgacaccacaaagctatgcagttag

SEQ ID NO: 10719 - DNA, 1815 bp, Artificial Sequence
  Description of Artificial Sequence: Synthetic coding sequence
atgcgcagatgcaactcaggctcagggcctcccccatccttgttgctgctgctgctgtggctgctggctgtgccgggagccaatgccgcaccccgtagtgctctttactcaccctccgaccccctcactctcctccaagccgatacagtgaggggggctgttctgggcagtagatcagcttgggccgtggaatttttcgcaagctggtgcggccactgcatagcattcgcacctacctggaaggcactggctgaggatgtgaaagcctggcgtcccgcattgtacttagccgcactggactgtgctgaagaaactaactctgcagtgtgcagggatttcaacattcccggattcccgactgtacggttctttaaggccttcacgaagaatggatctggggctgttttcccagtcgcgggagccgatgtccagaccctacgcgagagactcattgatgcactggagagtcaccacgatacctggccaccggcatgcccacctttggagcctgcaaagctggaagaaattgacggattttttgcgagaaacaacgaggaatatctggccttgatctttgaaaaaggcggtagctacttgggcagagaagtcgcgcttgatctgtcccagcacaagggagtggcggtaagacgcgtgcttaacaccgaggccaacgtggttaggaaattcggggtgactgactttccttcatgttatctcctttttaggaatggatctgtcagtcgggtaccagtcctcatggagagcaggagtttctatactgcctacctccagcggttgagtggtcttacaagggaggctgcacagaccaccgtggcacctaccacggctaacaagatcgccccaaccgtctggaagttagccgatagaagcaagatatatatggccgacctggagtcagcactgcactacatcctgagaatcgaggtgggccgattccccgtcctggagggccagcgactggttgcactcaagaagtttgtcgccgtccttgctaaatactttcctggacgacctctggtccaaaacttcctccactccgtcaacgaatggctcaaaagacagaaaagaaacaagatcccctattcctttttcaaaacggccttggacgatcgaaaggagggcgcagtgctcgccaagaaggtgaactggatcggatgtcagggctccgaacctcactttcgcggttttccatgttctctgtgggtcctgttccatttcctgacggtgcaggcagctcggcagaatgtggaccattctcaggaagccgcaaaagccaaggaagtgcttccagccattcggggatacgttcattatttctttggctgccgggactgtgcctcacattttgaacagatggctgctgcctccatgcatcgcgtggggtctccgaacgcagccgttctctggctgtggagcagccataaccgagtgaatgcaaggcttgccggtgctcccagcgaggatccgcaattcccaaaagtccaatggccccctagagagctctgtagcgcttgccacaatgaacggctggatgtgcctgtgtgggatgtggaagcgaccttgaactttctgaaggctcatttcagtccctctaacattatactggatttcccggcagcaggttcggccgctcggcgagacgtgcagaacgtagcggctgctcccgagcttgctatgggtgcgttggaactggagtccaggaactcaactctcgacccaggaaaaccagaaatgatgaaaagcccaacaaatacaacaccccatgtacccgcagagggcccagagttgatttag

SEQ ID NO: 10720 - DNA, 2244 bp, Artificial Sequence
  Description of Artificial Sequence: Synthetic coding sequence
atgaggagatgtaatagtgggtccgggcctccgcctagtcttttgttgttacttctgtggctcttagctgtccccggagcgaatgctgctcctagaagtgcgctatattctccctcagatcccctaacccttctgcaggctgacaccgtacggggtgcagttttaggttccaggtccgcttgggccgtggaattcttcgcttcctggtgtggtcactgtatcgccttcgcacccacgtggaaagccctggccgaagatgtgaaggcctggcgtcccgcactgtatctcgcagcactcgactgcgccgaagaaaccaattcggcagtctgtagggactttaatatccccggattccctaccgttagatttttcaaggcttttaccaagaacggatctggggcagtgtttccggtcgccggtgcagacgtgcagacgttgagggagcgcctgattgatgccttggagagccaccatgatacttggccaccggcttgtcctccccttgagcctgctaaacttgaggagatcgacgggtttttcgctaggaacaacgaagagtacttggcgttgattttcgagaagggaggctcctatctgggccgtgaggtggccctcgatttgtcgcagcataaaggagtggccgttcggagagtgctgaacaccgaagcgaatgtagtgagaaagtttggggtgacggactttcccagctgctacctcctgttcagaaacggcagcgtaagtcgcgttcctgttttgatggagtcacgatccttctacaccgcataccttcagaggctgtccggcttaaccagagaagcagcccagaccactgtggccccaacaacggccaacaagattgctcctaccgtctggaagctggccgatagaagcaaaatctacatggcagacctggagagcgcgctgcattatatactacgcattgaagtgggcaggttcccagtactcgagggccaacgcctggtggcgctgaaaaaattcgtggcggtgcttgctaagtacttccccggacggcctctcgtgcaaaatttcctgcactcagttaatgagtggcttaaacggcaaaaacggaataaaatcccctatagctttttcaagacagctctggacgaccgaaaagagggagccgtcctggcaaaaaaagtaaattggattggatgccagggatccgaacctcactttcgcggatttccttgttcactgtgggtgctgtttcacttcttgactgttcaggcagctcgccagaatgtggaccactcccaggaggctgcgaaagccaaggaggtgctccctgcgataagaggctatgtgcattacttctttgggtgtcgagattgcgccagtcacttcgagcagatggctgcagcctccatgcacagggtaggatcccccaacgccgcagtcctgtggctttggtcatcacacaaccgggtgaatgcgcgactcgcaggagcgccatccgaagacccccagttcccaaaggtgcaatggccaccacgggaactctgtagcgcctgccataacgagaggctggacgtccctgtttgggacgtagaagccactttgaactttctgaaagcgcattttagtccttctaatattattttagactttcccgcagcgggtagcgccgctaggcgcgacgtgcagaacgtggcagcggcaccagaattagcaatgggcgctctcgagctggaatctaggaattctacacttgatcctggaaagcccgagatgatgaagtctccgactaatactacacctcatgtgccagcggaggggcctgaggcatcgcgccctccgaagctccaccctggtctgagggccgctcctggtcaagagccgcctgagcatatggctgagcttcagaggaacgaacaggagcagccattgggccagtggcatctgtccaaacgggacacaggcgcagcgctgttagccgaaagcagggcagagaaaaataggttgtggggccctctcgaggtacgaagggtggggagaagttccaagcaattagtggacatccctgaaggacagctggaggcacgagccggtcgcggacgagggcagtggctgcaggtgctgggtggtgggttcagttacctggatatctcactttgcgtcggtctttactcactctcattcatgggattgctcgccatgtacacctactttcaagccaagatcagggccctgaaaggacacgccggacaccccgcagcctag

SEQ ID NO: 10721 - DNA, 1476 bp, Artificial Sequence
  Description of Artificial Sequence: Synthetic coding sequence
atgaaaaccttcacctggaccctgggcgtcctgttcttcttgctggtagataccggccactgccgcggaggccagttcaaaattaagaaaattaatcagcgcagatatcctagagctactgacggtaaggaagaggcaaagaaatgtgcatatacctttctggtgcccgagcagcgcattaccgggcctatctgtgtcaataccaagggccaggatgctagcacaattaaggacatgattacccggatggatctcgaaaacctgaaagatgtgctctctcgacagaagcgggaaatcgacgtgctgcagcttgtcgttgatgtcgacggaaatatcgtgaatgaggttaagttgctccgaaaagagtctcgcaatatgaattctagggtgacgcaactgtacatgcagttactgcacgagataatacgaaagcgcgacaattccctggagctgtcacagctagagaacaaaatcctgaacgtaacaaccgagatgctgaaaatggcgacaaggtatcgagagctggaggtcaaatatgcaagtctgacagatctagtgaacaatcaatctgtgatgatcacactgctcgaggagcaatgcctccggatttttagtagacaggacactcacgtatcccccccattagtacaggtggtcccacagcacatccccaactcccagcaatatacccccggactactgggtggtaatgagatccagcgcgaccccggttatcctcgcgatctgatgccccctccagatcttgcaactagccctacaaagtccccatttaagattccgcctgtcacttttatcaacgaaggacctttcaaggactgccagcaggcgaaggaggcagggcactcagtgtccggtatctacatgatcaaaccagaaaactccaacgggccaatgcagttatggtgcgaaaacagtttggaccctgggggatggactgttattcagaagcggacagacggatctgtgaatttcttccgaaattgggagaattacaagaagggattcgggaatatagatggcgagtactggctgggcctggaaaacatctacatgctgtccaaccaggataactacaagttgctgatagaactcgaggactggagcgataagaaagtctatgctgagtattcgtcatttaggctggagccagaaagcgagttttatcgccttcgattaggaacttatcaaggcaatgctggggatagtatgatgtggcacaatggcaagcagtttacaactctggaccgcgataaagacatgtacgctggtaactgtgcccacttccacaagggtggctggtggtacaacgcctgtgcacattcgaatttgaacggcgtgtggtacagagggggtcactatagaagtaagcatcaggatgggatattctgggcagagtataggggtggcagctactctctgcgggcagtgcagatgatgatcaagccaattgactag

SEQ ID NO: 10722 - DNA, 2484 bp, Artificial Sequence
  Description of Artificial Sequence: Synthetic coding sequence
atgatgtgcctgaagattttgagaatttcacttgcaattctggctggctgggccctgtgctccgccaacagcgagctgggctggacgcgcaaaaaaagcctggtagaacgcgaacatctcaatcaggtactacttgaaggtgagcgctgctggctcggagcaaaggttaggcgcccaagagcatctccccagcaccacctctttggagtgtatccttccagggctggtaactatctcaggccataccccgttggcgaacaagagattcatcacactggcagaagcaaacccgatactgaaggcaacgctgtgagcctggtgccaccggacctgacagaaaatcccgctggactgaggggagccgttgaggagccagcagcgccttgggtgggggatagccctatcggtcagtcagaactcctcggggatgatgacgcctacctgggaaatcagcgctcaaaggaatctctgggggaggcgggtatccagaagggttcagcaatggcggcaacaacaaccactgcaatttttaccactctgaatgagcccaagccagaaacacagaggcggggatgggccaaatcaagacaaaggaggcaggtgtggaaacgtcgcgctgaagacgggcaaggcgatagtgggatcagtagtcacttccagccatggccaaagcactccttgaaacatcgggtcaagaaatccccgcctgaagagagtaaccagaatgggggagagggaagttacagagaagcagaaaccttcaacagccaggtcggcctgccaatcctctatttttcgggtagacgagagaggctgttgctgagacccgaagtgctcgcggagattccgcgagaggcgttcactgtggaagcttgggtaaaacctgagggaggccagaacaaccccgctatcatcgctggagtctttgacaattgctctcatactgtgtcagataagggctgggcacttggaatcagatcaggaaaggacaagggcaagcgagacgccaggttttttttctccctctgtactgatagagttaagaaagcaaccattttaattagccatagccgatatcagcctgggacgtggacacatgtggccgcaacttacgatggtcggcacatggcgctttacgtggacggaacccaggttgcgtctagtctcgatcagagcggtccgctcaattcaccattcatggcttcctgccggtctctgctcctgggcggagactctagtgaggatgggcactacttccggggacatctgggaactcttgtattctggagcacggctctcccccagtcacatttccagcatagctctcaacattcctctggagaagaggaggccaccgacctggttctgacagcatcattcgagcccgtaaatactgaatgggtcccattcagggacgagaagtatcctcggctggaggtgctgcagggatttgaacccgagccagaaatcctgtcccccttacaaccgcctctgtgcggccaaacagtttgcgacaatgtcgaactcatctcccagtacaacgggtattggccgctgaggggtgagaaagtcatcaggtaccaggtagtgaatatatgcgacgatgaaggcctgaatcccatagtcagtgaggagcaaatacggctccagcacgaagccctgaacgaagcgttttccagatacaacattagctggcagctcagtgtgcatcaagttcacaactccaccctgagacacagggtagtgctcgtcaattgtgaacctagtaagatcggaaatgaccattgcgatcctgagtgtgagcatccgttgacaggttacgatggaggggactgccgactccaaggcaggtgttattcctggaacaggcgggatggcctctgccatgttgaatgtaataatatgcttaatgatttcgacgatggggattgttgcgatccccaggtcgccgacgtaaggaaaacatgctttgatccagattctcctaaaagggcatatatgtccgtaaaggaactcaaagaagccctccagctgaacagcacccattttctaaatatttattttgcctcgagcgtccgggaagatctcgccggagcagccacctggccatgggacaaagacgcagtgacgcacctcggtgggatcgttctgtcaccagcatactacgggatgcccggtcatacagatactatgattcacgaagttggccacgtccttggactataccacgtattcaaaggagtgtctgaacgtgaatcttgcaatgacccttgcaaggaaacagtgccctcaatggagacaggcgacctgtgcgctgatactgcacccacccctaagtcagagctgtgtcgcgagcctgagcctacaagtgacacttgtgggttcacaaggttccctggcgcaccgttcacaaattacatgtcttacacaggtatcaccaccgtattgttttgttttttgctacgaatccatggcggtctctag

SEQ ID NO: 10723 - DNA, 5376 bp, Artificial Sequence
  Description of Artificial Sequence: Synthetic coding sequence
atgatgtgcctcaaaatcctgagaatctcactggcgattctcgctggatgggctctctgttctgccaattccgagctcggatggactagaaagaagtcactggttgagcgggaacatttgaatcaggtcctgctggaaggggagaggtgctggctgggagccaaagtgcggcgaccgagagcatcaccacagcaccatcttttcggtgtctacccctcacgcgcaggcaactacttacggccttacccggtgggcgagcaagaaatccatcacactggcaggtccaagcctgacaccgaaggcaacgctgtttctttagtcccacccgatctgactgaaaacccggctggcctgaggggtgccgtcgaagaacctgcggctccctgggtcggcgacagccctatcggtcagagcgagctgctcggggatgacgatgcatacctcggcaatcaaagaagtaaagagtctttgggcgaagccggaattcagaagggcagcgcaatggcagctacgactacgaccgccatctttaccacgctgaacgaacccaaacctgagacacagaggcggggatgggcaaagagcagacagcgcaggcaagtctggaagcgccgagcagaagacggtcagggagactccgggatcagctcacactttcaaccctggccaaaacactctctgaagcaccgggtaaagaaaagccctcccgaggaaagtaatcaaaatgggggagagggctcatatcgagaagccgaaacatttaacagccaggtgggcctccccattctttactttagcggacgcagagagcgcctcctgctaagaccagaggtccttgccgagattccaagagaggcatttacagtggaggcctgggtgaagcccgaaggcggacagaacaatccggcaataatcgcaggagtgttcgataactgctcccatacagtttcggataagggatgggccctcggtatcaggtcaggaaaagataagggcaagagagatgcacggttcttctttagcctgtgcactgacagagttaagaaggccacaatactcatttcacatagtagataccagccgggaacgtggactcacgttgccgctacatacgacggcaggcacatggccctctatgtagacggcactcaggttgctagttctctcgaccagagcggtcctcttaattccccctttatggctagctgccgcagcctgttactgggtggagactctagtgaggatgggcactattttcggggacacctggggactctcgtgttttggtctaccgctctgcctcagtcccacttccagcatagtagccagcacagtagcggcgaggaggaggctacggacttggtgctgaccgcctccttcgagccggtaaacaccgaatgggtgccctttcgcgacgagaaatatcctcgcttggaagtactgcaggggtttgaacccgaaccggagattttaagcccactccagcctcccctctgcggccagactgtttgcgacaatgtagagctgattagccagtataatggatactggcctttgcgtggggagaaagtcattagataccaggtggtaaatatctgcgacgatgagggcttgaatccaattgtatccgaagagcaaatccgactccaacatgaagccttgaacgaagccttttcaaggtacaacatctcttggcagctttcagtccaccaggtccacaactccactttacggcatcgcgttgtactcgtgaattgcgagccctctaagatcgggaacgatcactgtgatcctgaatgtgaacatccactcactggttatgacggcggtgactgccggctgcaaggcaggtgctactcctggaatcggagggacggactctgccatgtggagtgcaataacatgcttaacgacttcgatgatggcgattgttgcgacccgcaggtggctgacgttcgaaagacttgttttgatcccgattccccgaaaagggcttatatgagtgttaaggagctgaaagaggcactgcaactgaactccacccatttcctcaatatttactttgctagtagtgtccgtgaagacctggccggtgccgctacatggccctgggataaagacgccgtaacccatttgggtgggatcgtgctaagtccagcgtactacgggatgcccggacataccgataccatgatccacgaggtcgggcacgtgttagggctctatcatgtgtttaaaggcgtgtccgagagggagtcttgcaacgacccctgcaaggagaccgtacctagtatggaaaccggtgacctgtgcgcggatactgccccaacaccaaaatcagaactgtgccgagagccagaacctacctcagacacttgtggcttcactcgatttcctggcgctccattcactaactatatgagctataccgatgacaactgtacagataatttcacacccaatcaggtagcaaggatgcactgttacctggacctcgtttaccagcagtggacagagagccgaaagcccacacctataccaatccctcccatggtgattggtcagaccaacaaaagtctgacaatccattggctgcccccaatctcaggagttgtctatgaccgggcatcaggatccctgtgcggggcatgcacagaggatggaaccttccgccaatacgttcataccgcttcatcaagacgcgtgtgcgattctagtggatattggaccccggaggaagccgtcgggccacctgacgtcgaccagccgtgtgagccttcacttcaggcatggtccccagaggtgcatctataccacatgaatatgacagtcccatgtcctacagagggctgtagcctggaactgttgttccaacaccccgtccaggctgatactttgacactctgggtcacatctttctttatggagagcagccaggtgctctttgacactgaaattctgctggaaaataaggagtctgtgcatctgggacccctggacactttttgtgacatccctttgactattaagctccatgtggatggtaaagtttctggcgtcaaggtttacacctttgacgaacgaatagagatcgacgctgctctgctgaccagtcagccccactcaccactgtgtagtgggtgcagacccgtacgctatcaggtactgagagatcctccttttgcttctgggctgcctgttgtcgtcacccactctcatagaaagtttacagatgtcgaggtcacgccagggcagatgtatcagtaccaggtcctagcagaagctggaggcgaactcggagaagcatcaccaccccttaatcacattcatggcgcaccatactgcggggatggaaaagtatccgagcggctcggagaagagtgcgacgacggtgacctggtatcaggagatggctgctccaaggtttgcgagttagaagagggctttaactgcgtgggcgagcctagcctgtgctacatgtacgaaggggacggcatctgcgaacccttcgagagaaagacatcgattgtggactgtggcatatatacacccaaggggtatctggatcagtgggcaaccagggcttatagctctcatgaggacaaaaagaaatgcccagtgagcctcgtcaccggggagccacactctctcatctgcaccagctaccacccagatctccccaatcacagaccgctgacagggtggttcccatgcgtggcctcagaaaatgagacacaggatgatagaagcgaacagcctgagggaagcctgaagaaggaggatgaggtgtggttaaaagtgtgcttcaaccgtccgggagaggcccgtgctatcttcatctttctaacaactgacggactggtgccaggagagcatcagcagcccacagtaaccctgtatcttaccgacgtgcggggatctaaccactcactggggacctatggcctttcttgtcagcataacccactaatcataaacgtcacacatcatcagaatgtactgttccaccacactaccagtgtgcttctaaacttttcgtcccccagagtgggtatcagcgctgttgcactcaggactagtagcagaatcggcctcagtgccccatcaaattgcatctccgaagatgagggacagaatcatcagggacagtcatgcatccatcggccttgcggtaagcaggactcctgtccaagcctcctcttagaccacgccgatgtggttaactgtacctctatcggacctggcctgatgaaatgcgctatcacatgtcagagagggtttgctttgcaggctagttcgggacagtacattcggcctatgcagaaggaaattctccttacctgttcctcaggtcactgggaccagaacgtctcttgcctcccggttgattgcggagtgcctgatccgtccctggtgaactatgccaacttctcgtgcagtgagggtaccaaattccttaaaagatgctctatcagttgcgtgccccctgcgaaattacaggggctttcgccatggttgacctgtctggaggatgggctgtggtccctgcctgaggtctattgtaagctggaatgtgatgctcctcctatcatactgaacgcaaatctgttgctaccacactgcctacaagacaaccacgatgtgggtaccatttgtaaatatgaatgcaagccaggctactacgtggcagaatccgctgaggggaaggtgagaaataaattattgaaaatccagtgcctcgaggggggtatctgggagcaaggatcttgtattccagttgtatgtgagcccccaccgcctgtgttcgaagggatgtacgagtgcactaatggcttctccctcgatagtcagtgcgttctgaattgtaatcaggagcgcgagaaactccccatcctctgcacaaaagaaggcctctggacccaagaattcaagctgtgcgaaaatctgcagggcgagtgccctccaccgccatctgaactgaactctgttgagtataagtgcgaacagggttacggaattggagccgtgtgctctccactctgtgtcattccaccatctgaccctgttatgcttccagagaatatcaccgctgatactctggagcactggatggagccagtaaaggtgcagagcatcgtttgtaccggacgcagacagtggcatcccgaccctgttctggtgcactgcattcagagttgtgagccattccaggcagatggctggtgcgataccatcaataaccgagcatattgccactacgacggaggcgactgctgcagctctactctcagcagcaagaaggtaattcctttcgcagccgactgtgacttggacgaatgtacgtgcagggatcctaaagccgaagagaatcagtat

SEQ ID NO: 10724 - DNA, 702 bp, Artificial Sequence
  Description of Artificial Sequence: Synthetic coding sequence
atgaaagaccctttggccaaggacgagcggatctacgtgaccaattactattacgggaatactctcgtagagtttcggaacctggagaactttaagcagggacgatggagtaatagttataagctgccctacagctggattggcacagggcatgtcgtatacaatggcgcattctattataatcgggcttttacaaggaatatcatcaaatatgacctcaagcagcggtacgttgccgcttgggccatgctgcatgacgtagcctatgaagaggctacaccttggcgatggcaaggccactccgacgtggactttgctgtagatgaaaacggcttgtggctgatctatccagccttagacgatgaaggattcagtcaggaggttatcgttttatcaaagcttaacgcagcagacttatccacacagaaggaaactacttggcgtacaggcctccgccgaaacttctacggcaactgcttcgttatatgcggcgtgctgtacgctgtggattcttacaaccagaggaatgccaatatctcttatgctttcgatacacacaccaacactcaaattgtacctaggctgctctttgagaacgagtattcatacactacacagatcgactacaacccaaaggaccgtttgttatatgcatgggataacggacaccaagtcacctatcacgtgatttttgcctactag

SEQ ID NO: 10725 - DNA, 579 bp, Artificial Sequence
  Description of Artificial Sequence: Synthetic coding sequence
atgcttaaaaagatctctgtgggtgtggcaggtgatctgaataccgtcacaatgaagctcggttgtgtcctgatggcctgggccctgtacctcagtttgggagtgctgtgggtcgcgcaaatgctgctggcggcttctttcgagacccttcaatgcgagggccctgtctgcacagaagaatccagttgtcatacagaggatgacttaaccgacgccagggaagccggttttcaagtcaaggcctatacattcagcgagccctttcaccttatagtttcttacggcgcttcttccagcgcagccccaccaacgctgaacccagccccacagaaatcggcagcccctggcactgcccctgaggaagctcctgggccactgcctcccccacccaccccttcctccgaggaccctgggttttcctcgcctctcgggatgccagacccgcacctgtaccaccaaatgggactgctgctgaaacatatgcaggacgtacgcgtcctcctgggccatctgctgatggaactccgcgagctgagtggacatagaaaaccgggtactactaaggccacggctgagtag

SEQ ID NO: 10726 - DNA, 459 bp, Artificial Sequence
  Description of Artificial Sequence: Synthetic coding sequence
atgctgctggctgcctcctttgagaccctacaatgcgaaggacccgtgtgcacagaagagtcttcttgtcacacagaagacgacctgacagacgcccgagaggctggattccaagtaaaagcttatacattctccgaacctttccatttaattgtcagctatggagctagctcttccgcagcgccacccaccctgaaccctgcaccccagaagtctgcagcacccggtacagcccctgaggaggcgcctggccctttgccgcctcccccaacaccttcatccgaggatccaggcttttcttcacctttaggaatgcccgatcctcacctgtaccatcagatgggactgctccttaagcacatgcaggacgtacgggttctgctcggccacctgttgatggagctgagagagctcagcgggcaccggaaacctggaactactaaagccaccgcagaatag

SEQ ID NO: 10727 - DNA, 1098 bp, Artificial Sequence
  Description of Artificial Sequence: Synthetic coding sequence
atgaagctgggctgcgtgctgatggcctgggcactttacctcagcctcggggtgttgtgggtggctcagatgctgctggcagcagggtgtcacgcagctgctagtttcgaaaccttgcagtgcgaagggccagtgtgtacagaggaaagctcctgccacaccgaggatgatttgacagacgccagagaggcagggtttcaggtcaaagcctataccttcagtgagccctttcacctcatcgtttcctatgattggctgatcctccagggccctgctaaacccgtgttcgaaggggacttgctcgtcctcaggtgccaggcctggcaagactggccacttacacaggttaccttttatagggatggttcagccttgggtcctccaggccctaatagggaattcagtattacagtggtgcagaaagcggattctggccactatcattgctccgggatcttccaaagccccggtccaggcataccagaaactgcttccgttgtggctatcaccgtgcaagaattattcccagccccaatcctgagggctgtaccgagtgccgagccccaggctgggagcccgatgaccctctcatgccagactaagctgcctctgcagaggagcgctgcgaggctgctgttttccttctacaaagacgggagaatagtgcaatccagaggcctatcctcagagttccagatccctacagcgtccgaggaccatagcggcagttattggtgcgaggccgctaccgaggataatcaggtgtggaagcagtcacctcagttagagatcagggtccaaggtgcttcgtcttcagccgctcctccaactctaaatcctgcgccacagaagtctgctgcacctggcacggccccagaggaggcaccaggcccactgccccctcccccaacaccttcttccgaggaccctggcttctcatcaccgctggggatgccagacccccatctgtaccaccaaatgggattgttacttaaacacatgcaggatgtaagagttctgctgggacacctcctgatggagctccgtgagcttagtgggcatagaaaacccggaacgacaaaggccaccgccgagtag

SEQ ID NO: 10728 - DNA, 711 bp, Artificial Sequence
  Description of Artificial Sequence: Synthetic coding sequence
atgctgaagaagatatccgtgggcgtagccggagatttaaataccgtcactatgaaactgggctgcgtcctcatggcctgggctctgtacctgagtctgggcgtgctgtgggtggcgcagatgctgctggagctctttcccgctcccatcctcagggcggtcccttcagccgagccccaggccggtagccccatgacccttagttgccagacaaagcttccactccagcgcagcgccgcaagactgctcttctcattctataaagacggccgaatagtacagtcccggggattatcttctgaattccagataccaactgcatcagaagaccactctgggtcatactggtgcgaagccgcaacagaggataatcaggtgtggaagcagagcccccagcttgaaattcgtgtgcagggtgctagcagctctgcagcgccaccaaccttgaacccagcacctcagaagagcgctgcccctggaacagcccctgaggaggccccaggcccactgccccctccgcctactccctcatctgaggacccagggttctcttcaccgctgggcatgcccgacccccacctgtaccatcagatggggttactcctaaaacatatgcaggatgtgcgggtgcttttggggcatctactgatggagttgcgcgaactgtctggtcacagaaaacccggaacaacaaaagccacagccgaatag

SEQ ID NO: 10729 - DNA, 1149 bp, Artificial Sequence
  Description of Artificial Sequence: Synthetic coding sequence
atgctgaagaaaattagcgtgggcgtggccggtgacttaaacacggttaccatgaaactggggtgcgtccttatggcatgggctctctacctgtctctcggagtgctctgggtggctcagatgctgctcgccgcaggatgtcatgccgctgcttccttcgaaactctccaatgcgagggtcctgtgtgcacagaggaatccagctgccacacagaggacgatctgactgacgccagagaagctggattccaggtcaaggcctatactttcagcgaacccttccaccttatcgtgtcgtatgactggctgatcctgcaaggacccgcaaagccggtattcgaaggcgatttgttggttctccgctgtcaggcctggcaggactggcccctgacgcaagtgacgttctatagagatggaagcgcgctgggaccaccagggccaaatcgcgagttcagtattaccgtcgttcagaaagctgactccgggcactaccattgcagtgggattttccagagcccaggaccaggcatccccgaaaccgctagtgtcgttgcaatcaccgttcaggagctgttccctgcccctatcctcagagccgtcccctccgctgaacctcaggctgggagtcctatgacactttcctgccagactaaattgccactccagcggtccgccgcaaggctgctgttttctttctataaggatggaagaatcgtgcagtctagagggctttcgagtgagttccagattcctactgccagcgaagatcactcgggaagctactggtgcgaggccgcaaccgaggacaaccaagtctggaagcaatccccccagctggagatccgtgtgcagggcgctagctcttcagcagcaccacccacactcaaccccgcaccccagaagtcagcagccccagggaccgccccagaagaggcacccggaccccttccaccgcctcccaccccctcctccgaggacccagggttcagttcaccgctcggtatgcccgacccacacctctaccaccagatgggcctgctgctcaaacatatgcaggacgtgcgggttctgctgggccacctcctgatggagttgcgcgaactttccggccaccgaaagccaggtactaccaaagcgactgcagagtag

SEQ ID NO: 10730 - DNA, 738 bp, Artificial Sequence
  Description of Artificial Sequence: Synthetic coding sequence
atgtctcggctgagggcactcctaggattggggctgttagtagccggtagtcgtgtgcctagaattaaatcccagacaatagcctgccggtctgggcctacatggtggggtccacaacggctgaactctggcggaagatgggactctgaagtgatggccagtaccgttgtcaaatatctgtctcaggaggaagcgcaagccgtcgaccaggagctgtttaacgaatatcagttttcagtggaccagctgatggagttagcgggactgtcttgtgccactgccatagccaaggcataccccccaacgtccatgagtcggagccctccaacagttctggtcatttgtggcccaggtaacaatggaggggatggtctggtctgcgcacggcacctgaagctttttgggtatgaaccgacgatttattatccaaagcgcccaaataaaccactgttcacagccttggtgacccagtgtcagaaaatggacattccttttttaggggaaatgcccgctgagccgatgactatcgacgagctctacgaactcgtggtggatgccattttcggtttctcattcaaaggagacgtgagagagccctttcactcaatcttgtccgtgttgaaagggctcactgttcctatagccagcatcgatatccctagcggcgctgggatacaaaaagtgggatggggacgcctggggccttacccaccagactcctgccctcaccaggtatag

SEQ ID NO: 10731 - DNA, 783 bp, Artificial Sequence
  Description of Artificial Sequence: Synthetic coding sequence
atgtcacggctaagggcacttttaggccttgggctgctggttgcaggctctcgcgtgcccaggattaagtcacagacgattgcctgccgttccggcccaacatggtggggcccacagaggctgaactctgggggaagatgggactcggaggtgatggcttccaccgtcgtgaaatatctgtcccaggaagaagctcaggcagtagaccaggaattgttcaatgaataccagttttccgtagatcagcttatggagctggccggactaagctgcgcaacagctatagcaaaggcatatccacccacgagcatgtctcgctcaccccctaccgtcttggtcatttgtggcccagggaacaatggcggagacggactcgtctgtgctagacacctgaaactgttcggttacgagccaactatttattatcccaagaggcccaacaagccgttgtttactgcattagttacccaatgccagaagatggatattccttttttgggggaaatgccagcagaattgcaaggtaggtgcagcgggactgtgccccaacaccccgagtgcccggaggggactcactgcgcacattgccagcacagacacagcttgaggatgggaaggggcgaagggaaatgttggagagatccagcacgcctggcccacatccctcattcacctcaaaagatatgcaaccctgtgtatcggtccctgcccctccccggaggcagtttctgtgcgacatgtagcggcgaggaggtgcccgctgaacctgccacattgccatag

SEQ ID NO: 10732 - DNA, 867 bp, Artificial Sequence
  Description of Artificial Sequence: Synthetic coding sequence
atgagtcggctgcgcgcacttctgggactcgggctcctcgtggcaggctcccgagtgccccgtatcaaaagccagaccatcgcctgcagaagcggacccacatggtgggggcctcagaggctgaattctggaggaagatgggactccgaagtgatggcatccaccgtggtcaagtatctatcccaggaggaggcgcaagccgttgaccaggaacttttcaatgaataccaattctctgtggatcaattgatggaactggccggtcttagttgtgcgaccgcaatcgccaaagcttacccacccacttctatgtcgcggagtccccctactgttcttgtaatttgcggacctggcaacaacggaggagatgggctggtgtgtgccaggcacctgaaactgttcggctatgaacccactatatactatccaaagaggccgaataagcctttgtttacggcactcgtcacccagtgccagaagatggatattcccttcctaggggaaatgcccgctgagcctatgactattgatgagctttatgagctggtagtggacgcgattttcgggttctcctttaagggcgatgtacgcgaacctttccacagcatcctgagcgttctgaagggtctgaccgtgcctatcgctagtattgacattccttccggatgggatgtggagaaagggaacgccggaggtatccagcccgatctcttgatctccttaaccgcccctaaaaagtctgcgacgcaattcactggcagatatcactatctgggcggtcggtttgtaccgccagctctggagaagaagtaccagctgaacctgccgccttacccggatactgagtgcgtctacaggctgcagtag

SEQ ID NO: 10733 - DNA, 879 bp, Artificial Sequence
  Description of Artificial Sequence: Synthetic coding sequence
atgcatctgaggctgatttcctggcttttcattatcttaaactttatggaatacatcggctcacaaaacgcaagccgcggtcggagacagcgccgaatgcatccaaatgtgtcccagggatgccagggtggttgtgcaacatgctctgattataacggatgcctgagttgtaagcctcggctgttctttgcccttgagcggatcgggatgaagcagattggagtgtgtttgtcaagctgcccctccggctattatggaacgcgatatccggatatcaacaagtgcacaaaatgcaaggccgattgcgacacctgcttcaataagaacttttgtactaagtgtaagtcaggtttctatctccacttaggaaaatgcctggacaactgccctgaggggctggaagctaataatcacaccatggagtgcgtgtctattgtacattgtgaagttagcgaatggaatccctggtccccatgcacaaagaaaggaaaaacatgcggatttaaaaggggcactgaaactagggttcgggagataatacagcatccgtcagcgaaggggaacctgtgtccccctactaatgaaactcgcaagtgcacagtccagaggaaaaaatgccagaagggtgagcgcggtaagaagggcagggagagaaaacgaaagaagccaaataagggtgaatctaaagaagcaatccctgatagcaagtccctcgagagttctaaggagatccctgagcagagggagaataaacagcagcagaaaaaacgaaaggttcaggataaacagaagtcaggcatcgaagttaccttagccgagggcctgacttcggtgtcccagcggacacagcctacgccttgtcggaggcgctatttgtag

SEQ ID NO: 10734 - DNA, 2871 bp, Artificial Sequence
  Description of Artificial Sequence: Synthetic coding sequence
atggagacccaagaactgcgcggtgctttggctctgctgctgctatgttttttcacttccgcctcacaagatctccaggtcatcgacctgcttactgtgggggagagccggcaaatggtggcggtcgctgaaaagataaggactgccctgctgacagccggtgacatttacctccttagtaccttccggctccctccaaagcagggaggcgtgctattcggactctactcaagacaggacaacacaaggtggctagaagcaagcgttgtgggaaagattaataaggtccttgtgaggtaccagcgcgaagatgggaaggtgcacgcggttaaccttcagcaagccggtctagccgacgggagaactcatactgtactcctgaggctgcgcggtccatccagacctagtcctgcactgcatttgtatgtcgactgcaagctgggagaccagcacgccggactccccgcactggcacccatcccccctgccgaagtggacgggctggagattcgcaccggccaaaaagcctatctgaggatgcaggggttcgtggaaagcatgaagatcattcttggcggaagcatggctcgcgtaggagcattgagtgagtgccccttccagggcgatgaatctatccactccgctgtgactaacgctttgcactctattctgggagagcagacaaaagccttggtaactcagctgaccttgttcaaccagattttggtggagctgcgggacgacataagagatcaggttaaggaaatgtccctgatcaggaacaccattatggagtgtcaggtctgtgggttccacgagcagagaagccattgctctccaaatccgtgcttccgcggagtggattgcatggaagtttacgagtatccgggataccggtgtggaccctgcccaccagggcttcagggaaatggcacacattgctccgatattaatgagtgcgcacacgccgatccttgttttccaggatcctcttgcatcaacacaatgccgggtttccactgcgaagcgtgccccagaggctataaagggacccaggtcagcggcgtcggcatagactatgcgcgtgccagtaaacaagtgtgtaacgacattgacgagtgtaatgatggtaataatgggggatgtgacccaaattctatttgcacgaacacggtgggttccttcaagtgcggtccttgcaggctgggcttcctggggaaccagagtcaaggttgtctgccggcacgcacttgccacagccccgcacattccccttgtcacatacacgctcattgtctcttcgagaggaatggagcggtaagctgccaatgtaatgtgggctgggccggtaatgggaacgtgtgtgggaccgatacagacattgacgggtaccccgaccaggccttgccctgcatggataacaacaagcactgtaagcaggacaattgcttgctgacaccaaattcaggccaagaagatgccgataacgatggagtgggagaccagtgcgatgatgacgccgacggcgatggtatcaaaaacgtggaggacaattgccgcctgttcccgaacaaggaccaacagaactccgatacagactcattcggcgacgcctgtgacaactgcccgaatgtgcctaataatgaccagaaagacaccgatgggaatggagagggcgatgcctgcgacaatgatgttgatggtgacggtattccaaatggcctggataactgccccaaggtgcccaaccctctgcagacagatagggacgaagacggtgtaggggacgcatgcgattcctgtccggagatgagcaatcccacccaaactgatgccgacagcgatctggtcggcgacgtttgtgataccaacgaggactccgacggagacgggcatcaggacacaaaggataattgcccacagctgccaaacagcagtcaattagactccgacaacgacggcctgggggatgaatgtgacggcgacgacgataatgacggaatccccgattacgtgcctcctggtcccgacaactgtagattggtgcctaaccccaaccagaaagattccgacgggaacggagttggcgacgtttgcgaggatgatttcgataacgacgccgtggtcgaccctttagacgtgtgtccggagtctgcagaggttaccctgactgatttccgcgcttaccagaccgtcgtgctggatcctgagggagacgcccagatcgacccaaactgggtggtcctgaatcagggcatggagattgtacagacaatgaattctgatccgggtctagccgtggggtacactgccttcaacggggtcgattttgaagggacattccatgtaaacaccgtaacagacgatgactacgctggcttcctattcagttaccaggatagtggaagattctatgtagtgatgtggaagcaaacagagcagacatattggcaggccactccctttagggctgtcgctcagcccggattgcagctgaaggcagtcacatccgtgtctggcccaggagagcatttgcgcaatgccctttggcatactgggcacacacccgaccaggtgaggctactatggaccgaccccaggaacgtgggatggagggacaaaacaagttaccgttggcaactgctacaccgaccccaggtgggctacatccgtgtaaaactgtacgagggtccccaactggtggcagatagcggggtaattattgatacctctatgagaggtggcaggcttggagtcttttgcttttctcaagagaacataatctggagtaatctccaataccgctgtaatgataccgttccagaggattttgaacctttccggagacagcttctccagggacgggtgtag

SEQ ID NO: 10735 - DNA, 1110 bp, Artificial Sequence
  Description of Artificial Sequence: Synthetic coding sequence
atgcttccatggctgttggtcttttcggctttggggattcaagcctggggcgattcaagctggaacaaaactcaggccaaacaagtgagcgaagggctgcagtacctcttcgaaaacatttcacaattgacggaaaaggacgtcagtacaacggtttcacggaaggcatggggggctgaggccgtggggtgctctatccaattgaccaccccagtcaacgttcttgtgattcatcacgtacctgggctggagtgtcacgaccaaaccgtgtgcagccagcggctgagggagctgcaggcccaccatgtgcacaacaactctgggtgtgacgtggcctataacttcctggttggagacgatggcagagtgtacgagggggtgggctggaatattcagggggttcacacccagggctataataatatcagcttgggtttcgcctttttcggaacaaagaaagggcacagccccagcccagccgctctcagcgcaatggaaaatctgatcacttacgcagtgcagaaaggccatttgtcttcatcctacgtgcagcctctgctaggcaaaggggagaactgtctggccccacgacagaagactagcctcaaaaaagcctgtcctggggtcgttccgaggagcgtgtggggcgctcgggagacccactgtcctaggatgactctcccagccaagtatggaattataatccatacagccggtaggacctgtaatatctcagacgaatgtcgccttttagtgagagatatacaaagtttctacatcgaccgcctgaagtcttgcgatatcggatacaatttcctagtcggtcaagatggcgctatctatgagggagtcgggtggaatgtgcagggatcaagcacacctgggtacgacgacattgctctgggaattacatttatgggtaccttcactgggatccctccaaatgcagcagctctggaggcagcccaagatctcatccagtgcgccatggttaaaggctaccttaccccaaattaccttctcgtgggacattcagatgtggcacgtacattatcgcctggccaggctctttacaatattatctctacctggccccatttcaagcattag

SEQ ID NO: 10736 - DNA, 675 bp, Artificial Sequence
  Description of Artificial Sequence: Synthetic coding sequence
atggagaagatcccatttgtactgggcggtaaccttcagggcggagagttggtggtcgcctacccttacgatctcgtacgaagcccgtggaagactcaagagcacacacctaccccagacgaccacgtgttccggtggctggcctacagttacgcttccactcatcgactgatgaccgacgcacggaggagagtctgccataccgaggactttcagaaagaagaggggacagtgaatggtgcgagctggcatactgtagcgggaagcctcaatgattttagttatctgcacacgaactgtttcgaactctctatttacgtagggtgcgacaagtatccacacgagagccagctccccgaagaatgggagaacaaccgggagagtttaatcgtgttcatggaacaggttcatcgcggaatcaagggcctggtccgagattcacatggcaaaggcattcccaatgctatcatatctgtggagggcatcaaccatgatatcagaaccggcagggtcagcttgcagaagctgtcccttgcatgccgccgagtccgttgtgcgtttgctctcagctctagctcaactatgattgtgagacccccacagccctatgggaccgtgccacactcttcccctgacccagtgacaacaaaaatcagcccccttcggaacttctag

SEQ ID NO: 10737 - DNA, 285 bp, Artificial Sequence
  Description of Artificial Sequence: Synthetic coding sequence
atgccagtgatcgctgggggtatattggcggcattattgctgctgatcgtggtagtactttgtctttatttcaaaatacacaacgcacttaaggcggcaaaggaacccgaggccgtcgccgtgaaaaatcataatccagataaggtctggtgggcgaagaactcacaggcaaagacaatagccaccgagagctgccccgcactccagtgttgcgagggatatagaatgtgcgcatcctttgactctctgcccccttgttgctgcgacatcaatgaaggcctgtag

SEQ ID NO: 10738 - DNA, 285 bp, Artificial Sequence
  Description of Artificial Sequence: Synthetic coding sequence
atgcccgtgattgcgggaggaattctcgccgctctactcctgctcattgtggttgtcctctgtttgtatttcaaaatccataacgctctgaaagctgccaaagaacctgaggcggttgccgtaaagaaccacaacccagataaggtgtggtgggcaaaaaattcgcaggccaaaaccatcgcaacagagagctgccccgctcttcagtgttgcgaaggatacagaatgtgtgcgtccttcgacagcctgcctccctgttgttgcgacatcaacgaggggttatag

SEQ ID NO: 10739 - DNA, 1026 bp, Artificial Sequence
  Description of Artificial Sequence: Synthetic coding sequence
atggtccccgctgctggcgcacttctgtgggtgctgctgctcaaccttggccctcgtgccgctggtgcacagggccttacacaaacccctacagaaatgcagcgcgtgtcgcttaggttcggtggacctatgacacggtcttatagatcaactgcaaggacggggcttccgagaaaaaccagaatcatcttggaggatgagaatgatgccatggcagatgcggaccgcctagccggtccggctgccgctgagctgttggcagccacagtctcaacagggttctctagaagcagcgccatcaatgaggaggatggaagttcagaagagggcgtcgtgatcaatgccggtaaggattctactagtagagagctgcccagtgcaacgcccaacacagccggatcttcatccaccagattcattgctaattcacaggagccagagatccggctcacctcttcactgccccgttctcccggaaggtcaaccgaagacctccccggttcacaggccaccctgtctcaatggagcacacccggaagcactccgtctaggtggccttcaccctcgcccacggccatgcctagtccagaggacctccggttggtgctaatgccgtgggggccttggcactgtcattgtaaatccggaactatgagcagatccagaagcggaaaacttcatggacttagcggcaggctgagggtgggcgctctgagccagctgcgcacggagcacaagccatgtacatatcagcagtgtccctgtaacaggctgagggaagaatgtccgcttgatacttccctgtgtactgacaccaattgtgcatctcagtctaccaccagcacccgaacgaccaccacccccttccccactatccacctgcgctcctcccccagtttgccacctgcgtctccctgccccgcactcgccttctggaaacgcgtacggatcggcctggaggacatttggaactccctatcctcagtattcacagagatgcagcccatcgaccgcaaccagaggtag

SEQ ID NO: 10740 - DNA, 366 bp, Artificial Sequence
  Description of Artificial Sequence: Synthetic coding sequence
atggatgtactgtttgttgccatcttcgccgtgcccctgattctgggacaggaatacgaggatgaagaacgactcggtgaggatgagtattatcaggtcgtgtattactacactgtgacaccttcatatgacgacttctccgcagatttcactatcgattactcaatattcgagagcgaagaccgactaaaccggcttgataaggacattacagaggccatcgagaccacgatctcgctggaaactgcccgagcggaccatccaaagccggttacggtaaagccagtcacgactgagccagttgaagagggatgttacgactccctcgatgggtcactggctcgcggaaattggaagataaaatag

SEQ ID NO: 10741 - DNA, 396 bp, Artificial Sequence
  Description of Artificial Sequence: Synthetic coding sequence
atggacgtcctgttcgtggcaatctttgcagtgccactgatcttgggacaggagtacgaagacgaggagagattgggcgaggatgaatattatcaagttgtctactattacacagtcactcccagctacgatgacttcagcgcggattttacgattgattatagcatctttgagagcgaagatcggttaaatagactggacaaggacatcaccgaggccatagaaactaccatctctctcgaaactgcaagggctgatcatccgaagcccgtgaccgtcaagcccgtcacaactgagcccagtcctgaccttaacgatgccgtgtccagcctcaggtcccctatcccattgctactatcctgcgccttcgtgcaagtggggatgtactttatgtag

SEQ ID NO: 10742 - DNA, 396 bp, Artificial Sequence
  Description of Artificial Sequence: Synthetic coding sequence
atggatgtccttttcgttgccatctttgccgtacccctgatcctaggtcaggaatatgaggacgaggagcggctaggagaggacgagtactaccaggtggtttattactataccgtcaccccatcctatgacgacttctcagctgactttactattgactactctatatttgaatccgaagaccgcctgaacaggctggacaaggacattacagaggcgatagaaacaaccatatcactcgagaccgcacgggctgaccaccccaaacctgttacagtcaagccggtaacaactgagcccagtcctgacctgaacgacgcagttagtagtcttcgcagccccattcccttgttgctaagttgtgctttcgtgcaggttgggatgtactttatgtag

SEQ ID NO: 10743 - DNA, 312 bp, Artificial Sequence
  Description of Artificial Sequence: Synthetic coding sequence
atgtccgggaggggaaaagggggtaaaggactggggaaaggcggtgccaagcgtcatcgaaaggtgttgagagataacatccagggtattaccaagccggcaatacgcagacttgctcgtaggggcggagtgaagcgaatctcaggactgatctatgaggaaaccaggggtgtactcaaggtcttcctcgagaacgtgattagagatgccgtgacctataccgaacatgccaaacgtaaaaccgtgaccgcaatggatgtcgtttacgcactgaagcggcaaggtaggaccctgtacggcttcgggggatag

SEQ ID NO: 10744 - DNA, 312 bp, Artificial Sequence
  Description of Artificial Sequence: Synthetic coding sequence
atgtctggccgagggaagggcggaaaaggactgggcaaagggggagctaagcggcataggaaagttctccgagacaacatccaaggcattacgaaacccgcaatccggagactcgcacggagaggcggtgtgaagcgcataagtggcctgatttacgaggaaacacggggagtactgaaggtattcctcgagaacgtgattcgagacgccgtgacctataccgagcacgcaaagcggaagacagtcaccgctatggacgtggtttacgccttgaagcgacaggggcgaactctgtacggctttggcggttag

SEQ ID NO: 10745 - DNA, 1404 bp, Artificial Sequence
  Description of Artificial Sequence: Synthetic coding sequence
atgcttggaatctggatcgtcgcctttttattctttgggacgtcacggggtaaggaggtttgttacgagaggctcgggtgttttaaggacggtctgccctggacacgaaccttttcgaccgagcttgtagggttgccctggtcacctgaaaaaatcaacactcggttcctcctgtacacgatccataatcccaatgcctatcaagaaatatccgccgtgaatagttccaccatccaggcctcgtacttcggaacagataagataacgaggatcaatattgcagggtggaagaccgacgggaagtggcaacgagatatgtgtaacgtgctccttcagctagaggacattaactgtatcaatcttgattggatcaacggttccagggagtacatccacgccgtgaataacctgagagtggtgggcgctgaggtagcttacttcatcgatgtactgatgaagaaatttgaatactcgccttcgaaagtgcatctgattggacactcactgggagcccacctggcaggggaggctggctcaagaattccaggactcggtcggataacaggtctggacccggcaggcccatttttccacaacacccccaaagaagtacggctcgaccctagcgacgctaactttgttgacgtgattcacacaaatgcagcccgaatcctgtttgaattgggagtgggcacaatagacgcctgtgggcacttagacttctaccctaacgggggaaaacatatgcccggatgtgaagatttgatcacacctttgctgaaattcaatttcaacgcatataaaaaagaaatggcctctttctttgactgtaaccatgctcggtcttatcaattttacgctgagtcaatactgaatccagacgcgttcatcgcatatccgtgccgctcctatacgtcctttaaggcgggaaattgctttttttgcagcaaagaaggatgtcccactatgggacacttcgcagacagatttcattttaaaaatatgaaaactaacggctcacactattttttaaacacaggctccctgtcccctttcgcacggtggagacataaattgagcgttaagctgagtgggagcgaagtgacgcaaggaaccgtgttccttcgagtgggaggggctgtgcgcaagacaggggagtttgctatcgttagtgggaaactcgaacccggaatgacgtataccaaactaattgacgctgacgtgaacgtcggaaacattacctctgtacaattcatttggaagaagcacctgtttgaggacagtcagaacaaacttggtgccgagatggtgattaatacaagcggaaaatacggttataagtccacattttgctctcaggacattatgggcccaaacatcctgcagaatttaaaaccctgctag

SEQ ID NO: 10746 - DNA, 1287 bp, Artificial Sequence
  Description of Artificial Sequence: Synthetic coding sequence
atgatcactggggtgttctccatgaggctgtggaccccagtcggggtcctcacaagtctcgcttattgtcttcaccagagaagagtcgccctcgcggaacttcaggaagctgatggacagtgtcccgtggaccggtctctactcaaactgaaaatggtgcaggtggtttttagacacggtgcgagatctccattgaaaccactgccccttgaagaacaggtggaatggaatcctcaactgttggaggtcccaccacagacccagtttgattatacagtaacaaatctggcaggaggcccaaagccttactccccctacgactctcagtatcatgaaaccactcttaaaggcggtatgtttgccggtcagctaacgaaggttggcatgcagcagatgtttgcactcggggagcgcctgcggaagaactacgtagaggatatcccattcctgtcccctacttttaacccacaggaggtgtttatcagatcaaccaatatctttaggaacctggagtccacaaggtgcctactagctgggctttttcagtgccaaaaggaaggcccaataattatacacactgatgaggcggactccgaggtgctgtatccgaattatcagagttgttggagccttaggcaaagaacccggggtaggcggcagaccgcctctcttcagcctgggatttccgaagatctcaagaaggtaaaagatcgcatggggattgactcatccgacaaggtcgatttcttcattctcctggacaacgtagccgctgagcaggcccacaacctcccaagttgccctatgctgaaacgttttgcaaggatgattgagcaaagggccgtcgataccagcctctacatcctgcctaaggaggacagggagtccctccagatggcagtaggcccttttctgcacatcctggagtcaaacttgctgaaagcagtcgactcagccacagctcccgacaaaattaggaagctgtatctgtacgcagcacacgatgtgaccttcatccccctgctgatgacactgggcatttttgaccacaaatggccacccttcgccgtggatctgactatggagctctatcaacacctggagagtaaggagtggtttgtacagttatactaccacggaaaggaacaggtgccccgtggatgtccagacggactttgtccgctcgacatgttcctgaatgccatgtcagtctacactctgagtccggagaagtatcatgcattgtgctcccagactcaggtgatggaggtaggaaatgaagaatag

SEQ ID NO: 10747 - DNA, 711 bp, Artificial Sequence
  Description of Artificial Sequence: Synthetic coding sequence
atgtgtgtgacataccataacggcactggatattgtaaatgcccggagggtttcttaggtgagtattgccagcacagggacccatgtgagaagaaccgctgccagaatggcggaacatgtgtggcccaagctatgctgggcaaggcgacctgtcgctgcgcttctggttttactggcgaggactgtcaatattccacttcgcacccctgctttgtaagtcgtccatgccttaatggaggcacctgccacatgctttcccgagatacatatgagtgcacttgccaggtggggttcacagggaaagagtgccaatggactgacgcctgcctcagtcatccttgtgccaatggaagcacgtgcaccactgtcgcgaaccagttttcatgcaagtgtctgacaggctttaccggccaaaagtgtgagaccgacgtaaacgaatgtgatattcctgggcactgtcagcacgggggaacctgcttgaacctcccaggatcttaccagtgtcagtgtctgcagggttttacaggtcagtactgtgacagcctgtatgtcccctgcgccccttctccttgcgtgaatggcggaacctgccgccagactggcgatttcacttttgaatgtaactgtcttcccgagactgtgcgcaggggcacggaactgtgggagcgagatcgtgaggtttggaatggtaaagagcatgacgagaactag

SEQ ID NO: 10748 - DNA, 990 bp, Artificial Sequence
  Description of Artificial Sequence: Synthetic coding sequence
atggttacaaaggctttcgttctgctggctatctttgcagaagctagcgccaaatcttgtgccccaaataaggccgatgtgatcttggttttctgctatcccaaaaccataattacaaaaattcccgagtgcccgtatggttgggaagtgcaccagcttgctcttggaggtttatgctacaatggtgtccatgagggcggatactatcagtttgtcataccggacctaagccccaaaaacaagagttattgcggaactcagagcgagtacaaacctcccatctaccacttctattctcacattgtcagtaacgacactacagtgattgtaaagaatcaacccgtgaactacagtttttcgtgcacctaccattcgacatacttggtcaatcaggctgcttttgatcaacgtgtagcaaccgtgcacgtaaagaatggatccatgggaactttcgagagccaactttcactcaacttttatacaaatgctaaattcagcattaagaaagaggcaccatttgtcttagaggcatctgagatcggaagcgacctctttgctggggtggaagctaaagggctgtccatcagattcaaagttgtactgaacagttgttgggctacgccctcagcagatttcatgtatcccttacagtggcagctgatcaataaagggtgccctaccgacgaaaccgtactcgtgcacgagaatgggagggaccacagagccaccttccagtttaatgcttttcggttccagaacatacctaagttgtccaaggtgtggcttcattgtgagaccttcatatgtgatagtgaaaaactttcttgccccgtaacttgtgataagcgtaagcgcctgttacgggatcagaccggaggagtgctggttgtggagctttcgctccggtccagaggatttagctctctgtatagcttttctgacgtccttcaccacttgataatgatgttgggaatctgtgctgtgttgtag

SEQ ID NO: 10749 - DNA, 1161 bp, Artificial Sequence
  Description of Artificial Sequence: Synthetic coding sequence
atggcgcagtggcactgttcacagaggacacaggctggtggtcatggtgtgggggagcggctggctcaatgccaggaccagtcaagtcgccacgccgcagaactgcgggacttcaagaacaaaatgctcccattgctagaagttgctgagaaggagagggaggcattacgaaccgaggccgatacaatttccggcagggttgatcgactggaaagagaggttgattatctagagactcaaaaccccgctctgccctgcgtggagtttgacgagaaagttacaggaggacccggtacaaagggaaagggaaggagaaacgagaagtatgacatggttactgactgcggctataccatctcccaggtgagatcaatgaagatcctgaaacgatttggagggcctgcagggctctggaccaaggatcccctgggccaaactgagaagatctacgtcttggatgggacacaaaatgacaccgctttcgtttttcccagactgcgagactttacattagcaatggccgctagaaaagcctcccgcgtgagagttccgttcccatgggtaggcaccgggcagctggtctatggcggttttttatattttgctagacgacccccaggtaggccaggcggagggggagagatggaaaacactctgcagctgataaagtttcacctggctaacaggacggtggtcgattcatccgtgtttcccgctgaaggtctgattcccccatacggccttactgctgatacctacatcgaccttgccgcagacgaagaaggtctgtgggctgtgtatgccactcgggaggatgatcgccacctgtgcctagcaaagttagacccacagaccctggatacagaacagcagtgggatacaccttgcccaagagaaaatgcagaggccgcttttgtgatctgtggcactctttacgttgtatacaatacacggcctgcttctcgcgctcgtattcagtgctccttcgacgcatccggtactttgactccagagcgtgcggctctgccttacttccctcgcaggtacggtgcccatgcttctctgcgctacaatccccgagagcgccaactttacgcctgggatgacggctaccagattgtctataaattggagatgcggaagaaggaggaagaggtgtag

SEQ ID NO: 10750 - DNA, 510 bp, Artificial Sequence
  Description of Artificial Sequence: Synthetic coding sequence
atgtccgaacgcgttgaaagaaattggtcgacaggtggctggctcctggcactgtgtctggcatggctatggactcatttaacccttgccgctctgcagccccctactgcaaccgtcctcgtgcagcagggcacctgtgaggttatcgcggcacatcgatgctgcaaccgaaataggatcgaggaacgttcccagacagttaagtgctcctgcttcagcgggcaggttgctggaactacacgcgctaagcctagctgcgttgatgacctgttattagctgctcactgcgcgcgacgggatcctcgcgcagcacttaggctgttgttgccgcagccgccaagcagctgtagagatggtggcgtacgttggtcaccagcttgcagggggaggagtgtccggtgtagcagaacctgtagggacggcgctgccgctgttgacacaaaatccaaaccacccaggtcccacgactcctcttgggggtcccgtccaggccaggagagactggactag

SEQ ID NO: 10751 - DNA, 693 bp, Artificial Sequence
  Description of Artificial Sequence: Synthetic coding sequence
atgaggctggcaggccctcttcgaattgtggtgctcgtggtaagtgtgggcgtaacttggattgtggtctcgatacttctggggggacctggcagtggatttccacgcatccaacagctgtttacatctcctgaaagcagcgtcaccgcagccccaagggcccgaaagtacaagtgcgggttaccacagccttgcccagaggagcacctagcctttagagtggtctccggggcagcgaacgtgataggacctaaaatctgcctggaggataaaatgctcatgtcatccgtaaaagacaacgtgggtaggggactgaatatagcactggtgaacggggtttccggcgagctcatcgaggccagggcatttgacatgtgggcaggcgatgtcaatgacctgctgaaattcatccgtcctttacatgaaggaactctggtcttcgtggcaagttatgacgatcctgcaactaagatgaacgaagaaaccagaaagctcttttcagagttaggctctaggaatgctaaagaactcgcttttagagattcctgggtttttgttggcgctaagggcgtgcagaataaatctccctttgagcagcacgtgaagaacagcaagcactcgaataaatatgaagggtggcccgaagcgctggagatggagggctgcattcctcgcaggtcaacagccagttag

SEQ ID NO: 10752 - DNA, 1176 bp, Artificial Sequence
  Description of Artificial Sequence: Synthetic coding sequence
atgctacgaccaggcggagcagaagaagcggctcaactgccgctacggagggccagtgctccggtgcccgtgccgtcccccgcagctccagatggatcacgcgctagcgctcgcctaggactcgcctgcctcctgctattacttttgctgacgttgcccgctagagtagataccagctggtggtatataggagcactgggggcacgggtgatctgcgacaacatccctggactggtctctcgccaacgacaactgtgtcagagataccctgatataatgcggagtgtaggggagggggctcgggaatggatccgagagtgtcagcaccagtttcgacaccatcgttggaactgcactacgctggacagggatcacacggttttcggtcgtgtcatgctccggtcgtcaagggaggcggcatttgtgtacgccatttcatccgcgggagtcgttcacgctattacacgggcatgctcacaaggcgagctgagcgtctgctcatgtgacccctacacacggggtaggcatcatgaccaaaggggagattttgactggggtggctgttcagacaacatacattacggagtgaggtttgccaaggctttcgttgatgctaaggaaaagaggctgaaagatgcacgcgcattgatgaacctccacaacaaccgatgtgggaggaccgctgtgaggagatttttaaagctggaatgcaaatgccacggggtgagcggttcatgtacactgagaacctgttggagggccctcagcgactttcggagaaccggcgactatctaaggcggcgttacgatggtgctgtccaggttatggccactcaagatggggctaattttacagctgccagacaaggataccggagagctacccgcacggacttagtctatttcgataactctcctgattactgtgtactggacaaagcagctggcagcctgggaacagcaggacgggtgtgtagcaagaccagcaaaggtacagacggctgcgagattatgtgctgcggcagaggctatgacacaacccgggtcaccagggtgactcagtgcgaatgtaaatttcattggtgttgtgccgtgagatgtaaggaatgtcgcaacaccgttgacgttcatacctgcaaagctcccaagaaggccgagtggctagaccaaacttag

SEQ ID NO: 10753 - DNA, 1119 bp, Artificial Sequence
  Description of Artificial Sequence: Synthetic coding sequence
atgctggacgggctgggagtggtggccattagtattttcggtatccagctgaaaaccgaaggaagcctgaggactgcagtgcctggcatacctacccagtctgcatttaacaaatgtctgcagcgctatataggagcactgggggcacgtgtaatttgcgataacatcccaggtttagtgtcaagacagaggcaactttgtcagcgctaccccgatatcatgaggagcgtaggcgaaggcgctcgggaatggattagggaatgccagcaccagttccgccaccatcggtggaactgtacgactctcgatcgggatcacactgtctttggccgagtgatgcttcggagcagtcgggaggccgcatttgtgtacgcgatttccagcgcaggggtcgtgcacgctataactagggcatgttctcagggagaattgtctgtgtgctcctgcgacccatacactagaggtcgccaccacgaccagcggggtgactttgattgggggggatgttcagacaatatccattacggagtgcgattcgctaaggccttcgtcgatgcaaaagagaaacggctgaaggacgcacgagcactgatgaaccttcacaataatcgatgcggaaggaccgcggttagaaggtttctgaagctcgagtgtaagtgccacggtgttagcggtagttgtacgctccgaacgtgttggagggcgctgtcagattttagaaggactggagactatctgagacgccgatatgacggagcagtgcaagtgatggcaacccaggacggggcaaacttcacagcagccagacagggatacaggcgcgcaactagaaccgatcttgtatatttcgacaactcccctgactattgcgttctagacaaagccgctggttcactgggcaccgccggtcgcgtctgttcgaagacctcaaaaggaaccgacggatgtgagataatgtgctgcgggaggggctatgatacaaccagggtcactcgagtgacgcagtgcgagtgcaagttccattggtgctgtgcggtgaggtgtaaagaatgcaggaacacagtggacgtgcatacttgtaaggcccctaagaaggccgagtggctcgatcaaacctag

SEQ ID NO: 10754 - DNA, 1242 bp, Artificial Sequence
  Description of Artificial Sequence: Synthetic coding sequence
atggaaaatatgttgctttggctcattttcttcacccccggatggactctgatcgacgggtccgagatggagtgggattttatgtggcatctgagaaaggtgcccaggattgtcagtgaaagaacgtttcatctgacctccccagcctttgaggccgatgcaaagatgatggtgaataccgtgtgcggtatcgagtgccagaaagagctccccacacccagcctatccgaactcgaggattatctatcttatgaaacagtttttgaaaacggaacaagaacactaacacgagttaaggtgcaggatcttgtcctggagccgacgcagaacataaccaccaagggagtgtccgtgcgacgcaagagacaggtgtacggcactgattcaagattctccatcctagacaagcggtttctcaccaacttcccctttagcacggcggtcaaactaagcacaggttgttccgggatactcatctcgccccagcatgtgctcacggcggcacactgcgtccacgatggaaaggactacgtcaagggttctaaaaaattgcgtgttggtcttttaaagatgcgaaataaatccggaggaaaaaagcgcagggggtcgaagcgctcaaggcgcgaggctagtgggggagatcaacgcgagggtacacgtgagcacctccgagaaagagcaaaggggggaagacggaggaagaagtccgggagaggccaacggattgcagaaggcaggccttctttccaatggacgcgcgtgaagaacactcacatccctaagggctgggcgcgaggtgggatgggggacgctacacttgattacgattatgctctgttagagctcaaacgggcacataaaaaaaagtatatggaattagggatttcgcccactatcaagaagatgccaggcggtatgatccacttctccgggttcgacaacgatagggctgatcagttggtctacaggttttgctcagtgtcggacgaatctaacgacctgctgtatcagtattgcgatgcagagtccggcagtaccggctccggcgtgtatctgagactgaaggacccagataagaaaaactggaagaggaaaatcatagctgtgtactccgggcaccagtgggtggatgtgcatggcgtgcagaaagactataacgtggcagtacgcataactcccctcaaatatgctcagatttgcctgtggattcatggaaatgacgcaaactgcgcctacggatag

SEQ ID NO: 10755 - DNA, 1143 bp, Artificial Sequence
  Description of Artificial Sequence: Synthetic coding sequence
atgggtgcgacaactatggatcagaagtcactgtgggctggctctgcgtacaagctcgtttgctatttcaccaattggtcccaggacaggcaagagcccggaaagttcacacccgagaacatcgaccccttcctttgctctcacttgatttactcgttcgccagcatagagaataataaagtgatcattaaggataagtctgaagttatgctgtaccagacaatcaactctctgaaaaccaaaaatccgaagttaaaaattctgctgtccatcgggggttacctcttcggaagcaagggttttcacccgatggtggatagttccacatctagactggaatttattaattccatcatactcttcctgagaaatcacaattttgatggccttgacgtcagctggatttatcctgatcagaaggaaaacacacatttcacagtgctcattcacgagcttgcagaggcctttcaaaaggactttaccaaaagcactaaggagcgattgctgctgacagccggagtgtctgcgggaagacagatgatcgacaattcgtaccaagtagaaaaacttgcgaaagacctggatttcatcaatttactgtcttttgatttccacggcagttgggaaaagccactcattacgggccacaactcaccgctgtccaagggatggcaggatcgtggtccatcgtcgtattacaacgttgagtatgcagtggggtactggatacacaagggaatgccctcggaaaaagtcgtcatgggcatccctacctacggtcactccttcacacttgcatctgcagagacaaccgtgggcgcaccggcttcagggccaggtgccgcaggtccaattacagagtctagtggctttctggcctattacgaaatatgccagtttttaaaaggtgctaagatcacccgacttcaggatcagcaagtgccctacgctgtgaagggtaaccagtgggtgggttatgacgacgtcaagagcatggaaactaaagtccaatttctaaagaatctcaacctgggtggtgcaatgatttggtccatagacatggacgattttactggcaagagctgcaaccaggggccatatccactggtacaggctgtaaagcggagtttgggcagcctgtag

SEQ ID NO: 10756 - DNA, 1173 bp, Artificial Sequence
  Description of Artificial Sequence: Synthetic coding sequence
atgggagccaccacaatggaccagaaatcattatgggcgggtgtcgtcgtcttactcttactgcaaggagggtccgcctacaagttggtgtgttattttaccaattggtcacaggataggcaggagccgggaaagtttacccccgagaatatcgatccattcctgtgcagccatttgatttatagttttgccagtatagagaacaacaaggtcatcatcaaggacaaatctgaggttatgctgtatcaaacgattaattcactgaaaacgaagaaccccaagttgaagatcctcctgtccattggcggttacctgttcggcagcaagggatttcaccctatggtggacagcagtacctctcgactggagtttattaactctatcattctcttcctccgcaatcacaacttcgacggactggacgtgtcttggatctaccccgatcagaaagagaatactcattttactgtgctgatacacgaactggcagaagcgtttcaaaaggatttcaccaaatccacaaaggaaaggctgctgctgaccgcgggagtgagtgccggaaggcagatgatagataattcttatcaggttgagaagctggcaaaggatctggatttcataaatcttttgtcttttgatttccacggtagctgggagaagccactcattaccggccataatagccccctctccaaagggtggcaagatcgcggacccagcagttactataacgtggagtatgccgtaggatattggatacataagggtatgcccagcgagaaggtggtgatgggaattcctacctacgggcatagcttcaccttggcaagcgccgagaccaccgtgggagctcccgcatccggaccaggggcagctggtccaatcaccgagtcgagcggatttctggcatattatgagatatgccagtttttaaaaggggctaagattactcgactgcaagaccagcaggttccatacgctgtaaagggcaaccagtgggtggggtacgatgacgttaagtctatggaaaccaaagtgcaatttctgaagaatctcaatctgggcggtgccatgatttggagtatcgatatggacgactttaccgggaagtcatgcaaccaggggccttatcctctagtgcaggcagtcaagaggtccttgggtagcctgtag

SEQ ID NO: 10757 - DNA, 2202 bp, Artificial Sequence
  Description of Artificial Sequence: Synthetic coding sequence
atggctggaggcagagagacctgcctgccactgatcggcttcatcctgatctgcttaaagatggtggctagtgccaaatccgcccctgagattcccacgattgatcaggcgtactccaaattgtcaaactccattactgtcgaatgggcaaccgttccgggagctacgagctacctactgacagccgaggatggggatacagtcatcgaaactaccgtggctaactcacccggaaccgtaaccgggctcaaagccgctacgtggtatgaaataaccataagatccatctccgcagccggtcgtagccaagcttccccacctaagcaggcaaaaactgtgctcgcggcacctattttggaagtctcaagccctagctccgatagcatcttggtccaatgggaggctgtttacatggccattgctttttcagtcagtatcatgagagcaaatgggttgggatccatctggaaagaaaacacaaccaacactagcctcacattcacatctctcgaagctggcacgctgtacaccatcaaggcatacgcctggaatgccaatagaattccaggcgatgactcaacgtgcaaccagcgcacttcacctcgggctcccgcaaatatccaggtttcctttgatagcggcgcactgaaggcctcattttcatgggccagagccgagggggcattcaactatacagtcatggcgctctctgactcttccgagttgacctgctccactaccttcagcagctgcacaatctcctccctgcagtgcggcactgaatatctgataagtgtactcgctagcaatgatgccggatcctccaagtcgtcctctgccatgacattaaaaaccgtggcctgcgctcccggtcgggtcaccatccaggaagatcctccaggccacctgagcgtggcatggtccagcgtcgatcttggcgattattacgtcgttttcgttaaatctgatgatgggctggaggttcattgcaacacatctttgacacagtgtaatttcttgagtgagtgtgggtttacttactttattagcgtctttgtgtacaacaaagccggtcagagccccctcggcgacatttttaattacaccacagccccttgctgccccagcgacattaacccagtactggttagctctgaccgggtggagattgtatggagtcctgttcgaggcgcagagttgtacgagaccaaggcggtcgacggctataacatggttgagtgcaacgacactacacccgcttgtacactgtctgcactggaatgcgatacaaaatacaacattaccgtgtattcatttaatgaagtcaggggcagtaatatgagttgtacgccccaatttatcactaccgcgccttgctcacccgaaattaagaacgtttctcgagacgccttctctatgatcaatgtgcattggaggagcactaatgatgacgcgacttatacggtgactgcccagggagagaaaggattatatcagtgttcgtcaacgggcgagagctgcactatgagaggattaccctgcgggagtgttttcagtgtgacagccgtggctgaaactcaggccggtcggagcctgccaagctatagcgtaccgttggagactgttccctgttgccccacagggttgacagtaacccagataacccaaagcgtcattaatgtatcttggactattgggcgagtcgcccagacccacgtggctgtcttagagtctcatacaggccagtccaaatgccacactcaccaaaatcattgtctactgggatgcatcacctgtgggataaactacaccgtgacactgaaggcaatcagcgccactggcctcacagccgactgtagctaccagtcatacttttcgggcgcatgttgccccctcggagttaagttgtatagacttggcccaaacggaattagaatctattggcaggcttcgaggggctccgctaattactccaccgacctgtacgggtccaagggcattttcacctgcacgccatcagccggtttgagcttttgtgacgtcaccgaaatcccatgcggagacgtttacactgttatggtgtctcctgttgccaaaaccggtttgaagctaactttttgcccaaagaagatctactctgtcacatgttctggaagcacattggggatggtgatctaccgtggtaaaagaaacgaagagtag

SEQ ID NO: 10758 - DNA, 555 bp, Artificial Sequence
  Description of Artificial Sequence: Synthetic coding sequence
atgaggggacaaggcagaaaagagtccctgtctgactctagggatttagacgggagttatgaccagctcactgacagcgtggacgatgaattcgagctgagtaccgtgtgtcacaggccagagggtctggaacagctccaggaacagactaaattcacaagaaaggagttacaagtactgtatagaggcttcaagaacgagtgtccttccggcattgtaaatgaggagaatttcaagcagatctattcccagtttttccctcagggagactcatccacctatgctacatttctctttaacgctttcgataccaatcatgacggctcagtgagctttgaggagatgctggacataatgaagtccatctatgatatgatgggaaaatacacctatccagcattgcgtgaggaagcccctcgcgagcacgtggagagcttctttcagaagatggaccggaacaaggatggagtcgtgaccatcgaagaatttatcgagagttgccagaaggatgagaacattatgcggtcaatgcagctctttgacaacgtcatctag

SEQ ID NO: 10759 - DNA, 759 bp, Artificial Sequence
  Description of Artificial Sequence: Synthetic coding sequence
atgcggggacaaggacggaaagagagcctttccgactcccgagatctcgatgggagctacgatcaacttaccgggcatccccctggtcctacaaaaaaagctttaaagcagaggttcctgaaactgctgccatgctgtgggccacaagccctcccatcagttagtgagtctaacgtcgacgacgagtttgagctttccacggtgtgccaccgacctgagggattagagcagctacaggagcagacaaaatttactaggaaagaactgcaagtcctgtaccggggatttaaaaatgaatgtccttccggcattgtgaacgaggaaaatttcaagcagatctacagtcaattctttcctcagggagattcttcaacatatgctacttttctgtttaacgcttttgacacaaaccatgatggatcagtgtcttttgaggactttgtggccggtctgagcgttatcttacggggaactgtagacgacagacttaattgggctttcaacctgtatgatcttaacaaggacggctgcattactaaagaggaaatgttagacataatgaaaagcatctacgacatgatgggcaagtatacctacccagcgttacgagaagaagcaccccgagaacacgtcgaatcattctttcagaagatggaccggaacaaggacggggtggtgactatcgaggagtttatagagtcctgccagaaagacgaaaatatcatgcgaagcatgcagctgtttgataacgtcatctag

SEQ ID NO: 10760 - DNA, 1377 bp, Artificial Sequence
  Description of Artificial Sequence: Synthetic coding sequence
atgcaggctactagcaatctccttaatctgttgctcctttctctgtttgcaggtctggatccaagcaagactcaaatctccccgaaggaaggctggcaagtttattctagcgcccaggaccccgacggcagatgcatttgcactgtggtggctcccgagcagaatctgtgcagccgggacgctaaatctcggcagttgcgccaactgctcgaaaaggtccaaaatatgtcccaatctatcgaagtcctcaatttaaggactcagcgggatttccagtacgtgttgaagatggagacgcagatgaaggggctcaaggctaagttccggcaaattgaggacgacaggaagacattgatgacgaagcacttccaggagctcaaagagaaaatggatgagcttctccccctgattcccgtgcttgaacaatacaaaactgacgccaaactcattacccagttcaaggaggaaatccgtaacctgtcagccgtgctaaccggtattcaagaggagatcggagcatacgactatgaggaactgcatcagcgcgtgctgtcattagagaccaggctacgggactgcatgaagaagcttacctgcggcaagcttatgaaaatcacagggccagtcacagtcaagacctcagggactcgttttggagcctggatgactgacccactggcctccgagaagaacaatcgcgtatggtacatggattcctacacaaacaacaagatagtgcgcgagtacaagagcattgctgattttgtctcaggagccgagagtagaacctataacctgcccttcaaatgggccggaacgaatcacgtcgtgtacaatggttctctatatttcaacaagtaccagagtaacattatcattaaatattcatttgacatgggaagggtgttggctcagagaagcctggaatacgctggctttcataatgtgtatccttacacgtggggtggatttagtgatatcgatctcatggctgacgaaatcgggctttgggctgtttacgccacgaaccagaacgcaggcaatatcgttatctcgcaacttaaccaagataccctagaagtgatgaaatcctggtctaccggctaccccaagaggagtgccggagagagctttatgatatgcgggacgctatacgtgaccaactctcacctgaccggagccaaagtgtattacagttatagcactaagacatctacttacgagtataccgacataccctttcacaatcagtatttccacatatctatgttggattataacgctcgagaccgggctctttatgcctggaataatggacaccaggtgcttttcaatgtgaccctgtttcacatcatcaagaccgaagatgacacatag

SEQ ID NO: 10761 - DNA, 915 bp, Artificial Sequence
  Description of Artificial Sequence: Synthetic coding sequence
atgctgcccccaccacggccagccgcagctctcgccttgccggtcctactgctgcttttggtcgtcctgaccccacctcctactggagctcgaccctccccaggccctgattatctgcgcaggggatggatgaggctcctggcggagggggagggatgtgccccatgccggccagaggaatgtgctgctccgaggggctgcttggcaggaagagtcagggacgcctgcggctgttgttgggagtgtgccaatttggaagggcagctttgtgatctggaccctagcgctcatttctacgggcattgcggggagcagcttgagtgtcgattggacacgggcggagacctcagccggggagaagttcccgaaccactatgtgcctgtcgatcacagtctcccctgtgcgggagcgacgggcacacctattctcagatttgtagactccaagaagccgcacgtgcccgtcccgatgctaatttaactgtggcccatccagggccatgcgagtccggtccccagatcgtcagtcacccgtatgatacctggaatgtgacaggtcaggacgtgatcttcggctgcgaggttttcgcctaccccatggcgtctattgaatggcggaaagacggccttgatatccagctgccgggagatgatccacacattagcgtgcagtttcggggtgggcctcagaggtttgaggttacgggctggctgcaaatacaggctgtccgtcccagtgacgaaggaacataccgctgtctgggtaggaacgccttgggacaggtggaggctcctgccagcttgacagttttgactccagatcagctcaactccacgggaattcctcaactccgatctcttaatcttgtccctgaagaagaagccgaaagtgaggagaacgatgactattactag

SEQ ID NO: 10762 - DNA, 327 bp, Artificial Sequence
  Description of Artificial Sequence: Synthetic coding sequence
atgaccccctctcgacttccttggctcctttcatgggtttcagcgacagcttggagggccgcaagaagcccactgctgtgccactctttacgtaaaacgagtagcagccagggagggaagtctgaactcgttaagcaatccctgaaaaagcccaagttgccggagggacgttttgacgcgccagaagattcccacctagagaaggaaccgctggagaagtttccagatgacgttaacccggtgaccaaggagaagggagggccacgcggacctgagcctactcggtatggggactgggagcgtaaagggagatgcattgatttctag

SEQ ID NO: 10763 - DNA, 663 bp, Artificial Sequence
  Description of Artificial Sequence: Synthetic coding sequence
atggctggactatctaggggctcagccagagccctccttgcagctttgcttgcctctacactactggccctcctcgtgagcccagccaggggccgagggggacgagatcatggcgattgggacgaagcctctaggctgcccccattgccaccacgcgaggatgcagccagggtggctagattcgtgactcacgtgagcgattggggagcactggcaacaatttccacccttgaggccgtgcgtggacgacccttcgctgacgtgctctcactgtccgatggccctccaggcgcaggttccggcgtgccctacttctacttgagtccactgcaactctccgtgtctaatctgcaggagaatccgtatgcaaccctaactatgactctcgcacagacaaatttctgcaaaaagcacggcttcgaccctcaatctcctttgtgcgttcatattatgctctccggaacagttaccaaggtgaacgagactgaaatggatatcgccaaacactcgttattcatccggcacccagaaatgaagacctggcccagtagccacaattggttcttcgctaagttgaatattacaaatatatgggtactggactactttggtggtccaaagattgtcactccagaggagtactataacgtcacagtgcagtag

SEQ ID NO: 10764 - DNA, 2760 bp, Artificial Sequence
  Description of Artificial Sequence: Synthetic coding sequence
atgggcctgttcagggggttcgtgttccttctggtcctctgtctgttgcatcagagtaacacgagcttcattaagttgaataacaatggttttgaagacatagttattgtcatcgaccctagtgtgccagaggacgaaaaaatcattgaacagatcgaggacatggtgacaacagcatcaacgtacctcttcgaggcaaccgagaaaaggtttttttttaagaatgtcagcattttaatcccagaaaattggaaagaaaaccctcagtacaagcggcctaagcatgaaaatcacaagcatgctgatgtcattgtcgccccaccaacgctgcccggacgggacgagccttacacaaagcaatttactgaatgtggtgagaagggcgagtacatccattttaccccggatttgctacttggaaaaaaacagaatgagtatggtcctccgggaaagctcttcgtgcacgagtgggctcaccttcgctggggggtatttgatgaatacaatgaagaccagcctttctaccgcgcaaaaagtaagaaaatcgaagctactcgctgctccgctggcatttccgggcgaaatcgtgtgtataaatgtcagggtgggagctgcttgagtagagcctgccggatcgatagcactactaaactgtatggaaaagattgtcaattctttcccgataaagttcagaccgagaaggcttcaatcatgttcatgcagtctattgacagtgtcgtcgaattttgtaatgagaagacccataatcaggaagcgccaagcctgcagaacatcaaatgtaatttcagaagcacgtgggaggtgattagtaatagcgaggattttaaaaatacaatacctatggtgacccctcctccccctccggtgtttagtctcctcaagatctctcaacgcatagtgtgccttgtgctggataagtccggctcgatgggaggtaaagatcgcttgaaccgcatgaatcaggcggcaaaacacttcctattacaaaccgttgagaacgggagctgggtagggatggtgcactttgacagtactgcgacgatagtgaacaaactgattcagattaaatcatccgacgagagaaacaccctgatggccggtctccctacttaccccctcggaggcacctcaatttgttccgggatcaaatatgcgttccaggtgatcggcgagttgcatagccagttagacggctctgaggtcctgcttctcacggacggtgaggacaacactgcctccagctgtattgacgaggtgaagcaatccggggctattgttcactttattgccttaggacgggctgcggacgaggccgtcatcgaaatgagcaagattacaggtgggtcccatttttacgtgtccgacgaagcccagaacaacgggctgattgatgctttcggtgctttgacctcaggtaataccgacctgtcgcaaaaatctttacaactagagagcaaaggcctcaccctgaattccaacgcctggatgaatgacaccgttattattgacagcacagtggggaaggataccttcttcctcatcacctggaactcattgcccccatccatttccctttgggacccatccggaaccatcatggagaactttactgtggatgccacctcaaaaatggcctacctgtccatccctggtaccgctaaagtgggtacttgggcatataatctgcaggcaaaagctaatcccgagacactgaccattaccgtaacctctcgagcggctaactcttccgtccctcctatcaccgtgaatgctaaaatgaacaaggatgtcaattccttccctagcccaatgatcgtgtatgctgaaattctgcagggatatgtgcctgtcctgggggcaaacgtgacagcctttatagagtcccagaatgggcatacagaggtactggagctgctggacaatggtgccggagccgacagtttcaaaaatgacggtgtgtacagcaggtacttcactgcctataccgaaaatggccgatacagccttaaggtgagggctcatgggggagctaacaccgcccgactcaagctaagacctcccctgaatagagcagcatatatcccaggctgggtcgttaatggggagatagaggcaaacccaccacgcccagaaatcgatgaggacacacagacaaccctggaggatttttcacgaaccgcttcaggcggtgctttcgtggtcagtcaggtgccttcactccccctgcccgatcagtacccacccagccagattaccgatctcgatgctactgtgcacgaggacaagatcattctgacatggacagctccgggagataacttcgacgtggggaaagtccaacgatatatcatccgtatctctgccagcatccttgatctacgcgactcttttgacgacgcactgcaagttaatacaactgacctgagtccaaaggaagccaactcaaaagaatccttcgcattcaagcccgaaaatatttccgaagagaatgctacgcatattttcatcgccatcaaatctattgataagagcaacctcacatcaaaagttagtaatatagcacaggtcaccctgttcattccccaggctaaccccgatgacatcgatccgacgcccacgcctactccaacccctacacccgacaagtcccacaactcaggtgtcaatattagtaccctggttctgagtgtcatcggttccgtggtgatagtaaactttattctatcaactacgatctag

SEQ ID NO: 10765 - DNA, 1938 bp, Artificial Sequence
  Description of Artificial Sequence: Synthetic coding sequence
atggcacctagcgccgatcccggaatgagcagaatgcttccgttcttgctacttctgtggttcctgcccatcacagagggaagtcagcgggctgaacccatgttcacagccgtgactaattctgtgcttccccctgactatgacagcaatccgactcaattaaactacggagtcgccgttaccgacgtcgaccatgatggagacttcgaaatcgtcgtagccggatacaacgggccaaatctggtgcttaagtatgacagagctcagaaacgactagtgaacatcgcagtcgacgagagatcctcgccctattacgccctcagagacagacagggcaatgccatcggcgtgactgcttgcgatattgacggcgatgggagggaagaaatttattttctcaataccaacaacgcttttagcggcgtggccacttacacagacaagctgtttaagttccggaacaacagatgggaagacattctctctgatgaagtcaatgtcgccaggggtgtagctagcttgttcgccggacgtagcgttgcatgcgtggatcgcaagggatcagggaggtactctatatacatcgccaactacgcatacggtaatgtcggaccagatgccctgatcgaaatggaccctgaggcctctgacctgtctcgaggtatattagcccttagagatgtggccgcagaggccggtgtctctaagtatacggggggtcgaggagtctccgttggccctatcctgtcatcatctgcctcagacattttctgcgataacgaaaatgggcctaactttttattccacaacagaggcgacgggactttcgtggatgctgcagctagcgctggagtcgacgaccctcatcaacacggcaggggagttgccctagctgacttcaacagggatggaaaggtagatatagtgtacgggaattggaatggtcctcatcgcttgtacctgcagatgagcacgcatggaaaggtgcggttccgtgacatagcgagtcctaagtttagcatgcctagccctgttaggaccgttattacagccgactttgacaacgaccaggagctggagattttctttaataacatcgcatataggagctccagtgcaaatcggttgttccgagtgattagacgcgagcatggagaccccctgatcgaagaattgaaccccggtgacgccctggaacccgaagggcgtggaaccggtggggttgtcacagacttcgatggggatgggatgctggaccttattctgagtcacggggagtccatggcacaaccgcttagcgtctttcgcggaaatcaagggttcaataacaactggctgcgggttgttccgcgtactcgctttggcgctttcgcaagaggagcgaaggtggtcctctatacgaagaagagcggcgctcatctccggatcatcgatggcggttctgggtatctttgcgagatggaaccggttgctcacttcggattgggaaaagacgaggcttcaagtgtggaagtgacatggccagacggaaagatggtgagcagaaatgtcgcatcaggagagatgaacagcgttcttgaaatcctttaccctcgtgacgaggatacattgcaggatccagcacccctggaatgtggccagggtttctctcaacaggagaacgggcactgcatggacaccaatgaatgcatccaatttccgttcgtgtgccccagagataaacctgtctgcgtaaacacatatggctcatatcggtgccgtactaacaaaaagtgttcgaggggatacgaacctaacgaggacggcaccgcctgtgtggctcaggtggcttttcttggcggatactccagcgcggcttcccgtatcagcgaacccctcagtagagccagctatctcagcctgggactgggattatgtctccagctgtacgccctgtag

SEQ ID NO: 10766 - DNA, 1986 bp, Artificial Sequence
  Description of Artificial Sequence: Synthetic coding sequence
atggctcctagcgccgatcccggaatgtctagaatgctgccctttcttctcctactctggttcctgcctattacagagggatcccagcgcgcagaacctatgtttaccgcggtgacaaactccgtactcccacctgactacgatagcaatcccacacagctcaattatggggtggccgtgacggatgtcgatcacgatggagactttgagattgtagtcgctggttacaatggccctaacctcgtactgaaatatgaccgagctcagaagaggctggtcaatattgctgtagatgaacgatccagcccatactacgctttacgcgataggcaggggaacgccattggagtgacagcctgtgacattgatggggatggtcgtgaggaaatctatttcttgaataccaacaacgcatttagcggcgtcgcaacctacacggacaagcttttcaaattccgcaacaacagatgggaagatatcctgtccgatgaggtgaacgtagcaaggggcgtggcctctctgttcgctggcaggtccgtagcatgcgttgatcggaagggaagcggtaggtatagtatctacatagcgaattatgcctacgggaacgtgggaccagacgcccttatcgaaatggatcccgaggcttccgacttgtcgcgcggtattctggcccttcgtgatgttgccgcagaagctggggttagtaagtatacgggaggtcgcggagtctccgtcggtccaatccttagttcctcagcgagtgatattttctgcgataacgagaacgggcctaacttcttatttcacaatcgaggtgatggcactttcgtcgatgccgcagcctcggctggcgtggacgatccacaccagcatggccgaggtgtcgcactggctgatttcaatagagacggtaaggttgatatcgtgtatggcaattggaatggaccccacaggctgtatcttcagatgtctacccatgggaaggtgaggtttcgtgacatagcatcaccgaaattttctatgccgtcccccgttcgaactgtgattactgccgacttcgataacgaccaagaacttgagatttttttcaataatatagcataccggtctagcagcgcaaaccgcctgttccgggtaatacggagggaacatggcgaccctcttatagaagaactgaacccaggcgacgccttggaacctgaaggacgcggaaccggaggagtagtgacagatttcgacggggacgggatgcttgacttgattctttcacatggagaatccatggcgcagccactatcagttttccgcggaaaccaggggtttaacaacaattggttacgagtggtgcccaggaccaggtttggggctttcgctagaggcgctaaggtcgttctttatacaaaaaaatccggcgcacacctgcgcatcatcgatggcggttccgggtacctgtgcgagatggaaccagtcgcccatttcggcttgggcaaggacgaagcgagttccgtcgaggtcacttggccagatggaaagatggtcagtaggaacgtggcttctggggagatgaattctgtgcttgaaattttataccctcgcgacgaggacacactccaggaccccgcaccgctggagtgtggccaggggttctcgcaacaagagaatggccattgtatggacacaaacgagtgcatacagtttcccttcgtctgccctagggataagcctgtgtgcgtgaacacctacggcagttatcgctgtcggacaaacaaaaaatgttctagaggatatgaacccaatgaggatgggactgcctgcgtcggcaccctcggacaatcaccgggaccaaggcctaccactcccaccgccgctgccgcaaccgcggctgcagcagctgctgccggtgcagccactgccgctcccgtgcttgtcgacggcgacttaaatcttggttccgtagtgaaggagagttgcgagcccagttgttag

SEQ ID NO: 10767 - DNA, 1230 bp, Artificial Sequence
  Description of Artificial Sequence: Synthetic coding sequence
atggctctgactccgggttggggatcttcggcaggcccagttagacccgaactgtggctactgctttgggccgcagcttggaggctgggcgcatctgcgtgtcctgccctttgtacgtgtaccggtactactgtggattgccacggtaccgggttgcaagcaatccccaagaacattccacggaacacagagagactcgaactcaacgggaacaacattacaagaatccacaaaaacgattttgccggactcaaacagctccgggtgctccagctcatggagaaccagattggggctgtggagcgaggagcctttgatgacatgaaggagctggaacggttaagactgaaccgaaaccagttgcacatgcttccagagctcctgtttcagaacaatcaggctttatcacgcctagacttgagtgagaatgccatacaggccattcctagaaaggcttttcgcggagctacggatctgaaaaacctccaacttgacaagaaccagattagctgcatagaggaaggggctttcagagctctacgtggcttggaggtcttaactctaaataataacaacatcacaactataccagtctcttcttttaaccacatgcccaagctacggacttttaggctgcattctaatcacttattttgtgattgtcacctggcttggttaagtcagtggctacgccaacggcctacaatcgggctctttacccagtgtagtggcccagcctccctgcgtggccttaatgtggccgaggtacagaagtcggaatttagctgctcaggacagggtgaagcgggacgggtcccaacgtgtaccctttcttctggaagttgccctgctatgtgtacctgtagcaacggaattgtcgactgcaggggaaagggactgacagccattccagccaatctccctgagaccatgactgagatcagacttgaactcaacgggatcaaatcaatacctccaggggcattttccccctaccgaaaactgcgcagaatcgacctgtcaaacaatcaaatcgccgaaatcgctccagacgccttccaagggttgaggtcactcaatagcttgcatacaggacccgtcacttgcccacatactactgggacacactcatcccactgccgcgcatttgctgtggcggtgccgcatagcagaaacgacctagaggctatgttcgaggaggaggtgccccgaatcttttactccgcatag

SEQ ID NO: 10768 - DNA, 1143 bp, Artificial Sequence
  Description of Artificial Sequence: Synthetic coding sequence
atggctttgacaccaggctggggttcttccgcaggccctgtgcggccagagctttggctgctcctgtgggcagccgcttggagattaggagcatccgcctgcccagccctctgcacatgcactggaaccaccgtggattgtcatggtacggggctccaggcaattccaaaaaatatccccagaaatactgaaagacttgaactgaatgggaacaatatcacccgaatccataagaatgattttgccggacttaagcaattacgcgtgctccagctcatggaaaaccaaatcggagccgtcgaacggggagcgtttgacgacatgaaggagctggaacgactcgatctcagtgaaaacgccatccaagccataccccgtaaggccttcagaggtgccactgatctaaagaacctgcagctggacaagaaccagatttcctgtatcgaggagggcgcttttagagctctgcgaggcttagaagtgctgacactgaacaataataacatcactactatccctgtgtctagttttaaccacatgcccaaactaaggaccttcagactgcacagtaaccacttgttctgtgattgccacctggcttggctttcacagtggctgcggcagcgacctaccattggactgtttacccagtgttccgggccagcatctcttagaggactgaacgtggccgaagtccagaagtccgagttcagctgctccggtcaaggcgaggcaggccgtgtgccaacatgcaccctctcaagcggcagttgtcctgccatgtgtacctgtagtaatggcatcgtggattgcaggggcaaggggctgaccgccataccagcgaacctccctgagactatgacagagatcaggctcgagttaaacgggattaagtcaatcccccctggcgctttttctccctatcgcaagctaaggagaattgatctgtctaacaaccaaattgcagaaatcgcccctgacgcctttcagggcctgaggtccttgaattctttggtcctctacggtaataagatcaccgacctgcccaggggagtctttggtggactatatactttacagctgctcctcctgaacgcaaataaaattaattgtatccgacccgatgcgtttcaggacctgtag

SEQ ID NO: 10769 - DNA, 2448 bp, Artificial Sequence
  Description of Artificial Sequence: Synthetic coding sequence
atggctctcacccccggatgggggtcaagcgccggaccggtccgacccgagctatggctcctcctctgggctgccgcttggaggctaggagcgtctgcctgtccggcattgtgcacctgtacaggcactacagtggactgccacgggacaggcctgcaggcaatccccaagaatatacctagaaacactgagcgcttagagctgaacggtaacaacatcacccgcatccacaagaatgacttcgctgggcttaaacagttgcgagtcttacagctgatggagaatcagatcggcgctgtggagcgaggggcattcgatgatatgaaagaattagagaggctccgcctaaacagaaaccagctgcatatgctgcccgaactgctcttccaaaacaatcaggccctgtctcggttggacctttccgaaaacgcgatccaggccattcccaggaaagcttttaggggagccactgatctaaagaacttgcaattggataaaaatcagatctcttgcattgaagaaggagcctttcgagccctgagagggctcgaagtgttgaccctgaataataataatattacaacaattccagtctcctcttttaaccacatgccgaaactgcgaacctttaggttacactccaaccacctcttttgcgactgccatctagcctggctctcccaatggctgcgacagaggccaactatcggtctctttactcagtgctccgggcctgcctctctacggggactgaatgtcgctgaagtccagaagtccgaattttcttgttcaggccaaggagaggcaggccgagtccccacctgtacattatccagcggaagctgtcccgctatgtgcacttgctcaaacggtatcgtcgactgccggggtaaaggactcacagcaataccagctaacctcccagagaccatgaccgaaatcagattagagttgaatggtattaagtctatcccccctggtgcttttagcccttatcgaaagctccgcagaatctgtccactcagcttctgtagcccatgcagagacctgagcaacaatcagatcgccgagatagcaccggatgccttccaggggttaagatcccttaattcactagtgctttacggaaacaaaattaccgacttgccacgaggagtttttggtgggctatatacactacagctcctcctcttgaatgcgaacaagattaactgcattaggcctgacgcattccaagatctgcagaacctgtcgttactgtcgttatatgataataaaatccaaagccttgcgaagggaacatttaccagtttgcgagccatccagactctgcacttagcacagaatcccttcatctgtgactgtaacctgaagtggctcgccgatttcctgcgaaccaatccaatcgagaccagtggcgctcggtgtgccagcccaaggagacttgccaataagcgaatcgggcagattaagtcaaaaaagttcagatgctctgccaaagagcaatatttcattcctggaactgaagactaccagctgaactccgagtgcaacagtgacgttgtttgcccccacaaatgcaggtgcgaagcaaatgtcgtagaatgctcgagcctcaagttaactaagattccagagagaattccccagtccacagccgagctacgcctaaataacaatgaaatatccattctggaggcaactggtatgtttaagaaattgacccacctgaaaaagattaacctaagtaacaacaaagttagcgaaatcgaagacggcgcttttgaaggggcagcctctgtgtcagagctccacctaaccgcaaaccagctcgagtcaatcagaagcggaatgttccgcggactggatggcctgcgaacactgatgctgcgcaacaaccggatatcatgtattcataacgacagtttcacaggccttcggaatgttcgcctgttaagtctgtatgataatcagatcaccaccgtttctcctggtgcctttgatacactgcagtctctttctactctgaacttactcgcaaacccttttaattgcaactgtcagttggcttggttaggaggctggctcaggaaaagaaaaattgtaacaggcaaccccagatgtcagaaccccgactttctgagacaaattcctctccaagacgtggcattccctgatttccgatgcgaggaagggcaggaggaaggaggctgtctgccaaggccccaatgtccacaggagtgcgcctgcctagataccgttgtgagatgttcaaataagcacctccgggctctacccaaaggcatcccaaaaaatgtgacagaactctacctggacggaaaccagttcacgctcgtgcccggacaactgagtacatttaagtatctacagctggttattctctcatacaacgcgctgcagtgcattccaccactggccttccaatag

SEQ ID NO: 10770 - DNA, 4386 bp, Artificial Sequence
  Description of Artificial Sequence: Synthetic coding sequence
atggccctgacaccgggttggggaagcagtgcaggtcctgtgcgtccagagttgtggctgctgctgtgggctgcggcttggcggctcggagcatccgcgtgtccagctctttgtacgtgtactggcactaccgtggactgtcacggaaccgggctgcaggccataccaaaaaatatccctcgaaatacagagcggctcgaactgaacggaaacaacatcactcgcatccataagaacgatttcgccggactgaaacagctgagagtgctgcagctaatggagaatcagatcggagctgtggagcggggagcctttgacgacatgaaggagctggagcgacttcggctgaatagaaaccaacttcatatgctgcccgagctacttttccaaaataaccaggccctgagcagactcgacctgagtgaaaacgcgatccaggctatccccaggaaggcatttcgaggcgctaccgatctgaaaaacctccagctcgataagaaccaaataagttgtatagaagaaggggcatttcgggctctccgaggtctggaagtgttaacgctgaataacaacaacattacaactatcccagtgtcctccttcaaccatatgccaaaattaaggacatttcgcctacacagcaatcacttgttctgcgactgtcatctcgcctggctcagtcaatggctgcgccagcgcccaactatcggactttttacccagtgttccggccctgcttcactgagggggctgaacgtggctgaagtgcagaagtctgagttctcctgctccgggcaaggggaggccggacgagtgccgacgtgtacactctcatccgggagttgtcctgcgatgtgcacctgctccaatgggatcgtggactgccgcggtaagggcctcaccgccattccagccaacctcccagagactatgaccgaaatccggctcgagctcaatggcattaagtccatcccgcctggggcatttagtccatatcggaaactgaggagaatcgacctgagtaataatcagatcgccgagatcgctcctgatgccttccaagggcttcgcagtctgaactccctggtcttgtacggtaataaaattacagacctccccagaggggtatttggcggactctataccctccagctgcttctcttgaacgctaacaaaattaactgtattaggcctgacgcctttcaggatttacaaaacctatccctgctatctctctatgacaacaagatccagtcacttgcaaaggggacctttacgtccctacgcgcaatccagacccttcacttagctcagaacccgttcatttgtgactgcaacttgaaatggctggcggattttctgcggacaaacccaattgagaccagtggagccaggtgcgcttctccacgtcggctggccaacaaacggataggccaaattaaatctaaaaaatttcgctgtagcgccaaagagcaatatttcattccgggaacagaggactatcagctaaactcggagtgtaatagcgacgtcgtatgtccacataaatgcaggtgtgaagctaatgtcgtggagtgctcttctttaaagctgacaaaaattcccgagcgcatcccccagagcacagctgagctgcgcttgaacaacaacgagattagcatactagaggcgacaggaatgtttaagaaattgactcacctaaaaaaaatcaacctgagtaacaacaaggtctctgagatcgaggatggggcttttgaaggagccgcatccgtaagcgagctgcatctcacagcaaaccagctggagagtattaggtccggaatgttccgtgggctggacggactcaggacactgatgctccgcaacaatcgcatctcatgtatccacaacgatagcttcactggcctaagaaatgttcgcttactcagtctatacgataatcagattactaccgtttcaccaggagccttcgataccctgcagtcgctctctaccttaaacttgctggctaacccttttaactgtaattgtcagctggcttggctcggtggatggctccgaaaacgcaaaatcgtgacaggcaatccccgatgtcagaatccagactttctccgacagattcccctgcaggacgtggcttttcccgacttccgctgtgaagagggccaagaagaagggggttgtctgcctcgtccacagtgcccacaagagtgtgcttgtcttgacaccgtcgtgcggtgcagcaacaagcatctccgggcattgccaaaagggatcccaaaaaatgtcactgaactctatctcgatgggaatcagtttacactggtgccgggtcagttgagcacctttaaatacctgcagttggtcgacctttcaaacaataagattagctcactgtccaattcatcttttactaatatgtctcagctgacgacacttatcctcagctataatgccctgcaatgtattcccccactcgcctttcaagggctccgaagtttgagactgctctcattgcacgggaatgatatttctaccctgcaggaaggcatcttcgctgatgttacttctcttagtcacctggccattggcgcaaacccactgtactgcgattgccatctgcgatggttgagtagctgggtcaagaccggatataaagagcctggcatcgccaggtgcgctggtccccaggatatggaaggaaagctgttgttaactactccggctaaaaagttcgagtgccagggccctccaactctggcagtgcaggccaagtgcgatttatgcctctcatctccgtgccaaaatcagggtacttgccataacgatccactggaggtgtataggtgcgcttgtccttccggatacaaaggtcgagattgcgaggtatctctggacagctgtagttcaggcccatgcgaaaatggagggacctgtcatgctcaagaaggcgaggacgcacccttcacttgctcctgccccacaggtttcgaaggcccaacgtgtggcgtgaatacggacgattgtgtcgaccacgcctgtgctaatgggggagtctgtgtagacggtgtggggaattatacatgccagtgtccactacaatacgagggaaaggcctgtgaacaactggtcgatctctgcagcccagacctgaacccttgtcagcacgaagcccaatgcgttggcactccggatggtcccagatgtgagtgcatgcctgggtacgccggagacaactgcagtgaaaatcaagatgattgtcgcgatcatcgatgccagaatggcgctcagtgtatggatgaggtcaactcttacagttgcctgtgtgccgagggctacagcggccagctttgcgaaattccccctcacctgccggcaccaaaaagcccgtgcgaagggacagagtgccagaatggggctaactgcgtcgatcagggcaatcgacccgtatgtcagtgcttgccaggatttggcggtccagagtgcgagaagctcctgagtgtgaatttcgtcgaccgtgatacttatctgcagttcacggacttgcagaattggcctagggctaatattaccctgcaagtctccaccgccgaggataacggaatcctgctctacaatggcgacaatgaccatatcgccgtcgaactttaccaaggacacgtacgggtgtcttacgaccccggttcctacccttcatctgcgatctacagtgccgagaccattaacgacggacagttccataccgtggaactggtcgcattcgaccagatggtcaacctgtcaatcgacgggggaagccctatgacaatggacaactttggaaaacactataccctgaattctgaagcccctctgtatgttggcggaatgccggttgacgtaaattccgccgcattccggttgtggcagatcttaaacggcaccgggtttcacggatgtatcagaaatctctacatcaataacgagctccaagatttcaccaaaacacaaatgaaacccggtgtagtgccagggtgtgagccctgtcgtaagttgtactgcctgcacggaatctgtcagcccaatgctactccaggacccatgtgtcactgcgaggctggttgggtggggttgcactgcgaccagccggctgatggaccatgccacggccacaagtgtgtgcacgggcagtgtgtgccacttgatgccctcagctattcttgccaatgccaggatggatacagtggcgctctctgcaaccaatcccccagcgccggtggaacacttagcggcacctttacccgctcccggggtgctatgccctccgccagaccacgcgcaccctgtcatggctggtctgcaggcgctcgcgctcaggccagagccgctgccagggccttcggatag

SEQ ID NO: 10771 - DNA, 570 bp, Artificial Sequence
  Description of Artificial Sequence: Synthetic coding sequence
atggaagctacaggcacagacgaggtcgataagctgaaaactaagttcatttcagcgtggaataacatgaaatatagctgggtgctaaaaacaaaaacttacttctcccggaactcacccgtgcttcttttgggtaagtgctaccatttcaaatacgaggatgaggataaaacactcccagcagagtcaggctgcacaattgaagatcacgtgatcgcgggaaacgttgaggagttcaggaaggacttcatatcccgaatctggctgacctaccgtgaagagtttccacagatagagggcagtgccctaacaactgattgtgggtgggggtgcactttgcgcaccgggcagatgcttctggcccaggggcttatcttgcactttctgggaagagcatggacatggcccgacgccctgaacattgagaatagtgatagtgaaagctggacctctcacactgtaaaaaaattcaccgcctccttcgaagcctcactgtctggggagcgcgagtttaagacacctactatttcactcaaagaaaccattggcaagtattctgacgatcactag

SEQ ID NO: 10772 - DNA, 1377 bp, Artificial Sequence
  Description of Artificial Sequence: Synthetic coding sequence
atggaagctactggaactgacgaagtggacaagcttaagactaaatttatttcggcttggaataacatgaagtactcttgggtcctgaaaacaaaaacatatttttcccgaaacagcccagtattattgttagggaaatgttaccactttaagtacgaggatgaggataaaacacttccagccgaatctggatgcaccatagaggatcatgtgatcgccggaaacgtcgaggagtttcggaaagattttattagccggatttggcttacctaccgcgaagagttcccccagatcgagggctcagcccttacaactgactgcggctggggatgcacattaagaaccgggcaaatgttattagctcaaggattgatccttcatttccttgggcgagcttggacctggccagatgcgcttaatattgagaactctgactccgagtcttggacatcacacaccgtgaagaagtttacagcctctttcgaggcatctctgagcggggagcgagaatttaagacacccactattagcctcaaggagaccattggcaagtattctgatgaccacgagatgagaaatgaagtgtaccataggaaaataatctcatggtttggcgacagccctctggccctgttcggcctgcatcaactgattgagtatgggaagaagtccggcaaaaaagctggagactggtatggtcctgcggtggtcgcacatatcctgcggaaggctgtggaggaagccaggcacccggatctgcagggtatcactatctacgttgctcaggactgtaccgtgtacaactctgacgtgattgataagcagtctgcctcaatgactagcgacaatgccgacgataaggcagtgattatcctggtgccagtacggctgggtggtgaacgcactaacactgattaccttgagtttgtgaaaggcattttatcattagagtactgtgtcggaattatcggcggtaaacccaaacagtcatattactttgcgggtttccaggatgactccttgatttatatggatccacattattgccagtcatttgtggatgtctccataaaggatttccccttggagacttttcattgccccagcccaaagaaaatgagttttagaaaaatggatccatcttgtactatagggttctactgccggaacgtgcaggatttcaagcgcgcttcagaggaaatcactaagatgctgaaattttcaagcaaagaaaaatatcctttattcactttcgtcaacggccactctagagattacgacttcacatctactaccaccaacgaggaggatctcttttccgaggacgagaagaagcagctcaagaggttcagcactgaggaattcgtgttactctag

SEQ ID NO: 10773 - DNA, 8178 bp, Artificial Sequence
  Description of Artificial Sequence: Synthetic coding sequence
atggaacagactgactgcaagccatatcagcctttgcccaaagttaaacacgagatggacctggcatatacttctagcagtgacgagtctgaagatggacgcaagcctcggcagtcttacaactccagggaaaccttacacgagtacaaccaggaacttaggatgaactacaactcacagtctaggaaacgtaaagaggttgagaaatctacacaagagatggaattttgtgaaacaagccacactctctgcagcggttatcagaccgatatgcattcagtttcgcgacatggctaccagctagaaatggggagcgacgtcgacacagaaaccgaaggcgctgcctctccggaccacgcactccgcatgtggataagaggaatgaaatctgaacactcaagttgtttaagtagcagggctaatagcgccctgtctctaaccgatacagaccatgaaaggaagagcgatggcgaaaatggctttaaattctcacctgtgtgttgtgacatggaggcccaagcgggttccacccaggatgtccaatccagtccccacaaccagttcaccttccgcccactgcccccacctcccccaccgccacatgcttgtacttgcgccagaaagccccctcccgctgctgacagcctccagaggcggagcatgacaacaagatcccaaccctctcctgcggcacccgctccgccaacatccacccaagactcagtgcacctgcataattcatgggtgctgaactccaatatccccctcgaaacgcggcattttctcttcaagcatgggtcaggatcatcagcaatcttcagcgcagcaagccaaaactatcctcttacatcaaatacggtctattcccccccaccccgacccttaccccgttctaccttcagtcgaccagctttcacttttaataagccctaccggtgctgcaattggaaatgtacggctctgagtgccaccgcgattactgtgacgcttgccctcctgttggcctatgtgatcgccgtgcacctcttcggcctcacgtggcagctgcagccggtcgagggagaactctacgccaacggagtttccaaagggaatcgaggaaccgaatccatggacacaacatattcccctattggaggtaaggtgtctgacaagagcgagaagaaggtgtttcaaaagggcagagccatagataccggtgaagtcgacatcggggctcaggtaatgcaaaccattccgcctggcctgttttggaggtttcaaataacgatccaccaccccatctatctgaagttcaacattagtctggcaaaggattctctgttgggcatctacggacgtagaaacatcccacctacccatacccagttcgactttgtcaaactgatggatggtaagcagttagtgaaacaggacagtaaaggttcggatgacactcagcatagcccgcgtaacctgatactgaccagccttcaggagaccggatttatcgaatacatggatcagggaccgtggtatctggccttctataatgacggcaaaaagatggaacaggtcttcgttttaaccaccgcaatcgagatcatggatgattgcagtacaaattgcaatggaaatggcgaatgcatctccgggcattgtcattgttttccaggctttctgggacctgattgcgctcgggatagctgcccagtgctgtgcggtggaaacggtgagtacgagaaaggccattgcgtgtgtcgtcacggctggaaagggcctgaatgcgacgtcccagaagaacagtgtatcgacccgacttgctttggacacggcacgtgcataatgggcgtgtgtatatgcgttcccggatataagggagagatctgtgaggaagaggactgcctggatccaatgtgttcaaatcatggtatctgcgtgaaaggcgagtgtcattgcagtacaggctggggtggggtcaattgcgaaacaccactcccggtgtgtcaggaacagtgcagcggccatggaacttttctccttgacgcgggagtctgctcttgcgaccctaaatggacagggtctgactgttctaccgagctgtgcactatggagtgtggctcacatggggtgtgtagtcgtggcatttgtcaatgtgaagaaggctgggttgggccaacctgcgaggaacggtcttgtcatagccactgtaccgagcatggccaatgcaaagacggcaagtgcgaatgttctccgggttgggaaggcgatcactgcaccattgcccactacctggatgcagtaagggacggttgcccgggactgtgctttggaaacggacgttgtacactggaccagaatggatggcactgtgtttgtcaggtcgggtggtccggaaccggctgtaatgttgtgatggagatgctgtgtggcgacaacctggataacgatggagacgggctcactgattgcgttgatcctgattgctgtcaacagagcaattgttatatctcacccctttgtcaagggagtcccgaccctctagacctgattcaacagtctcaaacactgttttcccagcatacttctaggcttttctatgatcggatcaagtttctaattgggaaggactctacccacgtgattccgcctgaggtttcctttgattccaggcgggcatgcgtgatcagaggacaggtggtcgcaattgatggcaccccactggttggcgtgaatgtcagcttcttacaccactccgattatggctttaccatcagccggcaagatggaagctttgacctcgtggctataggaggcatttcagtaatcctgattttcgatcgctcgcccttcctcccagagaagaggaccctctggttaccctggaatcagtttatcgtggtggagaaggtgaccatgcagcgcgtcgtgagtgaccctccctcctgcgacatttctaatttcatatcccccaatccaatcgtgctgccaagcccattaacaagcttcgggggttcctgtcctgaaagaggcactattgtcccggagctgcaggtggtgcaggaggagatccctatcccgtcctccttcgtgagactctcctatctgagtagcaggacccccggttataagaccctcttgcgtatcctcctgacacactccaccatccccgtcgggatgattaaggtccacctcacggttgcagtggagggtcgtctcacccagaaatggttccctgccgcaatcaatcttgtctatactttcgcctggaacaaaactgatatctacggacaaaaagtgtggggactggctgaggctctcgtgagcgtgggctacgagtacgaaacatgtccagatttcatactgtgggagcagcggaccgtcgtgctgcaggggtttgaaatggacgccagtaacctggggggttggagtctgaacaaacaccacatcctcaatccacagtcagggattatacataagggaaatggggagaatatgttcatcagccagcagcctccggtgataagcaccatcatgggcaacggtcaccagcgcagcgtagcgtgtaccaattgtaatgggcctgcacataacaataaactgttcgccccagtcgctctggcctccgggccagacggaagcgtatacgtgggtgatttcaacttcgtgaggcgcattttcccatcaggtaacagcgttagtatattagaattatccacatccccagcccataagtattacctggccatggatcctgtgtcggagtctctgtacctatcagatactaacactaggaaggtgtataagctgaaaagcttagtcgaaactaaggatctatcgaagaatttcgaagtcgtcgcaggcactggggatcagtgcttgccctttgatcaatctcactgcggcgacggcggtagagccagtgaagcctctctgaacagtccacgtggaatcaccgtcgatcgacacggctttatttacttcgtggacggtacaatgattcgaaagattgacgagaacgccgttattactaccgtgataggatctaatggattgacctctacacaacccctgtcttgcgatagcggcatggacattacacaggttcgcctcgaatggcctactgatctggcagtgaatccaatggataactcgctgtacgtattagataataatattgtgctgcagatcagtgaaaatcgaagggttagaattatagctggcaggcccatccactgtcaggtgccaggtatcgatcactttttagtctctaaggtagccatccacagtacccttgagagcgctagagctatcagcgtttcccacagtggactgttatttattgccgaaactgatgagaggaaggtcaatcgtatccaacaagtgacaaccaacggagaaatctatataatagccggagcccctaccgactgtgactgcaagatcgacccaaactgcgattgcttctccggagacggcggatacgctaaggatgccaagatgaaggctccatcctcgcttgctgtctcaccggatggtactctctacgtggctgacctggggaatgtgagaatccgcaccatctctcgcaaccaggctcacctcaacgatatgaatatctacgaaatcgcttcacctgccgaccaggagctgtatcagttcaccgtaaatggcacacacctacacactctgaatctaataactcgggactacgtgtacaactttacctacaattctgagggagatctcggagcgatcacgagtagtaatggaaacagcgttcatatacgtagagatgccggtggtatgcccctgtggctggtagtgcctggtggacaagtttactggctcactatcagtagcaatggagtgctgaaacgtgtttcagcccaaggttataatcttgctctcatgacatacccagggaatacgggcctgctagccaccaaatccaatgagaacggctggaccactgtatatgagtacgatccggagggccacctcacaaatgcaacattccccacaggggaagtgagctcgttccactccgacttagaaaagctgactaaagtcgaacttgatacatctaatagagaaaacgtcctgatgagtacaaaccttacagcgacatctacgatctatatcctgaaacaggagaatacccaaagtacataccgcgtcaatccagacggatcactgagggtaactttcgcctctggcatggagatcgggctgtccagcgaaccacatattctggccggagccgtaaacccgactcttggcaaatgcaatatcagccttcccggtgagcacaacgcaaatctaatcgagtggaggcagaggaaggaacagaacaaaggcaatgtcagcgccttcgaacggcgtctgagagcccataatcggaacctacttagcatagatttcgatcatattaccaggacaggaaagatttatgatgaccatagaaagtttactttacgaatcctgtacgatcagaccggaaggccaattctctggagcccagtgtccagatacaatgaggttaatatcacttactctccctcagggctagtgacttttattcagcgaggaacctggaacgagaaaatggaatacgatcaatctgggaaaattataagtcggacctgggcggacggaaaaatctggagctacacttacttagagaagagcgtgatgctgcttctgcacagccagaggcgatatatcttcgaatatgaccagcctgattgcctgctctccgtcactatgcctagcatggtccggcatagtttacaaacaatgctgtccgttggttattacagaaatatatatactcccccagactcaagcactagcttcatacaggactacagccgggacggtcggcttctacaaacgctgcaccttggcaccggaagaagagtgctgtacaaatatacaaaacaagctcgtttgtctgaggtgctgtacgataccacccaagttaccttaacctatgaggaatcctcaggggttataaagactatccatctgatgcacgatgggttcatctgtacaatcagatacagacagactggcccactgattggcagacaaattttccggttctcagaagaggggcttgtcaatgcccgtttcgactattcctacaacaactttcgggtgacctctatgcaagccgttatcaacgaaacccctttgcctatcgacctgtacaggtatgtcgacgtctccgggaggacagaacaattcgggaagttctccgttataaactacgacctgaaccaggtgattacaactacagtcatgaaacacacaaaaatcttctcagccaacggccaggtaattgaagtccagtatgagatactgaaggccatcgcttattggatgaccatccagtatgataacgtcggccgaatggtaatttgtgatataagggtaggcgtggatgccaacattaccagatatttctatgagtacgacgccgatggacagctgcagactgtgagcgtcaacgacaagacacagtggaggtattcctacgatttgaatgggaatatcaatttgctaagccacggaaagagtgcgagactgacccctttgcgatacgatctgagagaccggataacgcgtttgggagaaatccagtacaagatggacgaggatggctttctccggcagcgcggtaatgacattttcgagtacaactccaacggactccttcagaaggcatataataaggcctctggctggacggtgcagtactattatgacggtttagggagaagagtcgccagcaagagctccctcggacaacacctgcaattcttctacgcggacttgaccaatcccatccgcgtcacgcacttgtacaaccatacatcctcagagattacctcattgtactacgatctgcagggtcacctgatcgcaatggaattgtccagtggtgaggaatattatgtcgcctgtgacaatactggcacaccccttgctgtgttctcatcacgcggacaggtaattaaagagatattgtacaccccctatggggacatttaccacgatacataccccgatttccaggtcatcatagggtttcacgggggactctacgacttcctcaccaaacttgtacatctcggccaaagggactacgacgttgtggccggaaggtggactacccccaaccaccacatttggaagcagctgaatctgttgccaaagccgttcaatttatattcgttcgagaacaactaccccgtcgggaaaatacaggacgtggctaagtatactaccgacatacggtcttggctggaattatttggcttccaactacacaatgtgttgccaggttttccgaagcccgagctagagaacctggagcttacctatgagcttctccgtctgcagacaaagacccaagagtgggaccccggaaaaactatactgggaatccagtgcgagctgcaaaagcagttgaggaattttattagcctggaccagctgccaatgaccccccgatacaatgacggcagatgtctcgaagggggtaagcagcctcggttcgcggcagttccatctgtgttcggcaagggcattaaatttgccatcaaagatggcatcgtgacagccgatatcattggggttgctaatgaggatagccgcagactggcggctatcctgaataacgcacattatctggaaaacctgcatttcacgatcgagggtcgcgatacccactatttcataaagctgggctccttggaagaggaccttgtgcttatcggaaacaccggtgggagacggatcctggagaacggtgtaaatgttaccgtgtcccagatgaccagtgttctcaacggtagaactcgcaggtttgctgatatccagctgcaacatggtgcactctgttttaacatccggtacggcacaactgtggaggaggaaaagaatcatgtgttagaaatcgctaggcaacgggctgtcgcccaggcctggacgaaggagcagcggagactgcaggaaggcgaggagggtataagggcctggaccgagggtgaaaagcagcagcttttgtcaacagggagagtgcagggatacgacggctactttgtgctgtccgtagagcagtaccttgagctcagtgactcagccaacaatatacatttcatgcgtcagtccgagattggtagacgctac

SEQ ID NO: 10774 - DNA, 204 bp, Artificial Sequence
  Description of Artificial Sequence: Synthetic coding sequence
atgaaaattcaactcttcttcttcattttgcacttttgggtcacgattttaccagcaaaaaagaaataccccgaatacggttcgttggacctccgccgtgagtgcagaatcggaaacggccagtgcaagaatcaatgtcacgaaaatgagatccggattgcgtactgcataagacccggaacgcattgttgcctgcaacaatag

SEQ ID NO: 10775 - DNA, 831 bp, Artificial Sequence
  Description of Artificial Sequence: Synthetic coding sequence
atgaagcagattctccatccagcattagagacaacagcttgtaccaatcacttcaatgcagatccatgctccaccggatttgtcttcccagctatgacccttttccctgtgctgctttttctcgtggctgggctgttaccaagcttccccgctaacgaagacaaggatcccgcattcacggcgttgttgactacgcaaacccaagttcagcgcgagatcgttaataagcacaacgagctgcggagggccgtatctccccctgccagaaacatgcttaaaatggagtggaataaagaagccgcagctaatgcacagaaatgggctaaccagtgcaactataggcacagtaatcctaaggaccgcatgactagcctcaaatgtggagagaatttgtatatgtcaagcgcatcttcctcctggagtcaggctattcagtcctggtttgacgaatacaatgactttgactttggggtaggtcctaagactcccaatgcagttgtgggccactatactcaagtggtatggtacagcagctacctggttggctgtggtaacgcctactgccccaatcagaaggtgctaaagtattactatgtctgccagtactgcccggcagggaactgggctaacaggctgtatgtcccatatgaacagggagctccttgcgcctcctgtccagacaattgcgacgacggactgtgcaccaacgggtgcaagtatgaggatctgtactcaaactgcaagtcactaaaattgacccttacctgcaaacatcaactcgtgagagactcctgtaaggcgtcctgtaattgttcaaatagcatctactag

SEQ ID NO: 10776 - DNA, 1350 bp, Artificial Sequence
  Description of Artificial Sequence: Synthetic coding sequence
atgttagccgaatggggtgcttgcctgttattggctgtggccctcttggggccagggcttcaagctcaggcaatggagggagttaagtgtggcggagtgctctcggcaccttccggcaatttcagttcacccaatttccccagactatacccgtacaacactgaatgcagctggctcatcgttgtcgctgagggctctagcgttctgttaacattccacgcttttgacctggagtatcatgacacatgcagcttcgatttcttagaaatttacaacggcgctagcccagataaaggcaaccttctgggtcgtttctgtggaaaggtacctccaccaccattcactagcagttggcacgtgatgagtgtcattttccacagcgacaaacatgttgcctcccatggattctccgctggctaccaaaaggatgtgtgtggaggtgtacttaccgggttatccggcgtcctgacctccccagaatatcccaacaattatcctaactcaatggagtgccactgggtcattagggcggcaggccctgcacatgtgaagctcgttttcgtggacttccaggtcgagggcaacgaggaatgcacctacgattacgtggccgtcttaggtggacctggccctaccaggggacatcactattgcggctccacaagacctcctacacttgtatcactgggacatgagctacaagtggtcttcaaatcggactttaatattggaggcagaggattcaaagcttactattttagcggggaatgccaggaggtgtacatggcgatgcgcggtaatttctcaagcccacaatacccctcctcctatcccaacaatataaggtgccactggaccatcaggctgcctccaggttatcaagtcaaggttttcttcctcgacttggacctcgaggagccaaacagcctgactaagacatgcgatttcgaccacctggccgcatttgatggagcctcagaggaggcccctctgttgggcaattggtgtgggcatcatctgccccctcctgttacaagcagtcacaatcaactccttctgctgctgcatacagatcgatcaacaacacgccgagggttttccgtcgcatatatcggtggtcaactcggctgcggatcaggctcaacggaaggagagggagaggctctgcagccccagagcctgcagtctccctcgagcattcctccagtctgtcccgcaccccctatgaatgggctgctgcagttgctcctgcactggttgcacccctgccccttgtcaggcccacttaggttggatggtacagcaccggcatgcttccactattgtcgagcatcctttccgagtttttag

SEQ ID NO: 10777 - DNA, 1434 bp, Artificial Sequence
  Description of Artificial Sequence: Synthetic coding sequence
atgacctcgaagttcctgctcgtctcattcatattggccgcactgagcttatcaacaactttcagcctgcagcccgaccagcagaaggtgcttctcgtttcttttgacggatttaggtgggactatctgtataaggtgcctacgcctcactttcactacataatgaagtacggtgtgcacgtgaagcaggttacaaacgtattcattaccaagacctatcccaaccactatacactggtcaccggcctgtttgcagagaaccatggcatagtggccaatgacatgtttgacccgatccgaaataaatctttcagcctggaccacatgaatatctatgacagcaaattctgggaagaagctaccccaatatggattacaaatcagcgagcgggtcacacgagcggggctgctatgtggccaggcaccgatgtgaagattcataagcggtttcccacccattacatgccatacaacgagtcagtatccttcgaggacagagtcgcaaagatcattgagtggttcacttcaaaggaaccaataaacctcggactattatattgggaagacccggatgatatggggcatcatctcggtcccgactcgccactgatgggtccagtgataagtgatatagataaaaaactggggtacctgattcagatgctgaagaaggctaagttgtggaataccctgaatctgatcataacaagcgaccacgggatgacccaatgctctgaagaaaggctgattgagctggaccagtacctggacaaggatcattatactcttatcgaccaatctcccgtcgccgctattctccccaaagaagggaagttcgatgaggtgtacgaggctctaacgcatgctcatcctaatttaactgtgtataaaaaagaggacgtgcccgagcgttggcattataaatataactccagaatccagcctatcatcgccgtcgctgatgaaggatggcacatactgcagaataaatcagacgatttcctgctgggcaaccacggatatgacaacgctctcgcggatatgcatcctatcttcttggctcacggcccagctttccggaaaaattttagcaaggaagctatgaacagcaccgatctctatcccctactctgccacctcttaaacattacagcgatgccacataacgggtcattctggaatgtccaggacttacttaactcggcaatgccccgagtggtaccttatacccagagcaccattttgcttcccggaagtgtaaagcccgcagagtacgaccaggagggctcttatccctattttatcggcgtatcgttgggtagcattattgtgattgtgtttttcgttattttcatcaaacatcttattcactcacagattccagcattgcaggatatgcacgccgaaattgcgcagcccttgcttcaggcctag

SEQ ID NO: 10778 - DNA, 1479 bp, Artificial Sequence
  Description of Artificial Sequence: Synthetic coding sequence
atgggaagtgccccttgggctcccgttctcctgttggcactcgggctccgcggactccaagctggtgcccgacgggctcccgaccccggatttcaagagcggttttttcagcaaagactggaccacttcaattttgagcggttcggaaataagacatttcctcagagatttttggtgtctgacaggttttgggtgcggggtgaaggacctatctttttctataccgggaatgagggcgacgtttgggccttcgcgaacaacagtgctttcgtcgctgaattggccgctgagcggggagcactcctagtgttcgccgaacatagatattacggcaaaagtttgccattcggtgcccaatccacccaacgcggacacaccgagctattaacagtcgaacaagccctggctgatttcgcagagctgcttagggctttaaggagggacctcggcgcacaggatgcacccgcaattgccttcggcggatcgtatggagggatgctgtccgcctacctgcgaatgaaatatcctcacttagtggctggcgcactcgccgcatccgccccagtcctggccgttgccggactaggcgattctaaccaatttttccgcgacgtcacagccgattttgagggtcagagccctaagtgcactcagggcgtaagagaagcatttcgacagattaaggatctcttcctgcagggagcctatgacacagtgcgatgggagtttggaacatgtcagcctctgtcagatgagaaggacctaacacaattattcatgtttgcgagaaacgctttcacagtcctcgcaatgatggactacccttaccccaccgattttctgggcccactccctgctaaccctgtgaaagtggggtgcgatcgcctgctgtcggaagcccagcggatcactggtctgagagcactggccggactggtgtataatgcgagcggttccgagcattgctatgatatttatcggctgtaccatagctgcgctgacccaacggggtgcggcactgggcctgacgcgagggcttgggattaccaggcgtgtacagagattaaccttacttttgccagcaacaacgtaactgatatgtttcctgacttgcctttcactgacgagctgcgccagcggtattgcctcgatacctggggtgtgtggcccaggcccgactggctgctgacatctttttgggggggagacctccgagccgcatcaaatataattttttccaatggtaatcttgatccttgggctggtgggggtatccgccgtaatttgtccgcttcggtaatcgctgtgaccattcagggaggggctcaccacttggatctacgggcaagccatccagaagatcctgcaagcgtcgtggaggctagaaagcttgaagcaaccatcatcggcgaatgggtcaaggcagctcgtagagagcagcaacctgcactgagaggcggtccccgtctgtccttatag

SEQ ID NO: 10779 - DNA, 2850 bp, Artificial Sequence
  Description of Artificial Sequence: Synthetic coding sequence
atgatcctcagcctcctgttttcgctgggcggaccactcgggtggggtcttctgggcgcatgggcccaagctagctctacaagccttagcgatctacagagtagtcggactcctggagtgtggaaagccgaagcagaggacaccggaaaagatccagtgggtaggaactggtgcccctatcctatgtctaagctggttactctactggctctgtgtaaaaccgagaagtttctcattcatagccagcagccgtgcccacagggcgcacccgattgtcagaaagtgaaggttatgtatcgtatggcgcacaagccagtttaccaggtcaagcagaaagtacttacttccctggcatggcgctgctgtcctggctacaccgggccaaattgtgaacaccatgatagcatggcaattccagaacccgctgaccctggcgattctcatcaggaacctcaggacggtcccgtgtccttcaagcctggccacctggccgcagtcatcaatgaagtagaagtgcaacaggagcagcaggaacacctgctcggtgacctgcagaatgatgttcacagggtggcggacagtctaccgggtctgtggaaagctctgcccggtaacctcaccgcggcagtgatggaagcaaatcaaacaggccatgaatttcctgatcgctcactcgagcaagttttactgcctcacgtggataccttcctccaggtgcacttttcccccatctggcggagcttcaaccaaagcctgcacagcctcacacaggcgatcaggaatctgagtttggacgtggaagccaaccgccaggccatctccagggtccaggactccgcagtcgcaagggctgattttcaggaactcggagcaaaattcgaggccaaggtccaggaaaacactcagcgtgttggacagctgcggcaagacgtggaagaccgcctgcatgcccagcacttcacacttcacagaagtatctccgaactgcaagcagatgtggacactaagctaaaacgcctccacaaagcgcaagaagctcctggcactaatggatccctggttctggccacaccaggcgcaggtgccaggccagaacccgattctcttcaagcccgtctgggccagctccaacggaacctgtctgagctccacatgactaccgcccgtagggaggaggaactccagtacaccctggaggacatgcgcgctacgctgacgcgacacgtcgatgaaataaaggaactgtacagtgagagcgacgaaactttcgaccagatttctaaagtggagcgccaggttgaggaactgcaagtgaatcataccgccctgcgggagctgagggttatcctgatggaaaagagtttgatcatggaggagaacaaagaagaggtcgagcggcagttgctggagctgaaccttaccttgcagcacctgcaggggggtcatgccgacctgattaagtacgtgaaggactgcaactgccagaagctgtacttggatcttgatgttatcagagagggccagcgggacgctactcgcgctctggaggaaacgcaggtgtcactcgatgagaggagacagctcgatggctcctcactgcaggccttacagaacgccgtcgacgccgtgagtctagcagttgacgcacataaggctgagggcgagcgcgcacgtgctgctacttctaggctacgcagccaggtccaggccctcgatgacgaggtgggcgcactaaaggccgcagctgctgaagccaggcatgaggtgcgccagttgcatagcgccttcgcagcactgttagaggacgccctcagacacgaagcagtactcgcagctcttttcggcgaggaagtgctagaggaaatgtccgaacagacccctgggcctctgcccttatcttacgagcaaatccgtgtggctctgcaggatgcagcctctgggctgcaggagcaggcattagggtgggacgagttggctgccagggtgacagcccttgaacaggcatcagaacctcctcgacctgctgagcacctggagccatctcatgacgccggtcgcgaggaggccgcaactaccgccctagcgggacttgcgagggagctgcagtccctcagtaacgatgtgaagaacgtgggcagatgttgtgaggccgaggctggtgccggagcggcttcactcaacgcctccttgcacggattgcacaatgcgctgtttgccacccagagaagtctcgagcagcatcagaggttgtttcattccctatttgggaactttcaaggactcatggaggcgaacgtatcgcttgatctcgggaaattgcagactatgctctcaagaaagggcaagaaacaacagaaagatctagaggcaccaagaaaacgggacaagaaggaggcggagccactcgtggacatacgggttaccggccctgtacctggtgcccttggcgcagccttgtgggaagccggaagtcccgtggccttctacgctagcttcagcgaaggaacggcagccctacagaccgtgaaatttaacaccacttacatcaacatcgggtctagctattttcccgaacatggttactttcgcgcaccagagcgaggcgtctatcttttcgccgtctcggtggaattcggccctgggccaggtacaggacagctggtgtttggtggccaccaccgcacgcctgtctgtacaactggacaggggagcggatcaaccgctaccgtgttcgctatggcagaactccagaaaggtgaacgtgtctggtttgagctgacccaaggaagcattaccaagcgcagtctctcaggcacagccttcggcggttttctgatgttcaagacctag

SEQ ID NO: 10780 - DNA, 246 bp, Artificial Sequence
  Description of Artificial Sequence: Synthetic coding sequence
atgagactgctcgtcctcagttcactgctgtgcatcctgcttttatgtttcagcattttttcaaccgaagggaaacggagacccgcaaaagcctggtcaggccgacgcacgagactttgctgtcatcgagtaccatcccccaacagtaccaatttaaaaggccaccatgtgcgcctctgcaagccctgcaagctagaacccgaaccaaggctgtgggtagtcccaggagctctcccacaagtgtag

SEQ ID NO: 10781 - DNA, 690 bp, Artificial Sequence
  Description of Artificial Sequence: Synthetic coding sequence
atgtcgtttctccaggatcccagtttctttacgatgggaatgtggtccattggcgctggagccctgggggcagccgcactggccctgctcctcgctaacacggatgtgttcctctcaaagccacagaaggccgctctggagtacctggaggatatcgatctcaaaaccctcgagaaggagccacggacttttaaggcaaaagaactttgggagaagaacggcgctgtgattatggccgttcgcagacccggatgttttctatgccgggaggaggcggctgacctgtcaagcctgaagagcatgttggaccagctgggagtacctctttacgctgtcgtcaaagagcacatccgcaccgaagtgaaggattttcagccctacttcaaaggagagatctttctggatgagaagaagaagttctatggacctcaacgtcgtaaaatgatgtttatgggattcattcgcctgggtgtgtggtacaacttttttcgtgcctggaacggcggtttctctgggaatctggagggtgaaggcttcatcctcggaggggtgtttgtggtgggttcgggaaaacaaggcattttactggagcatcgggagaaggaattcggcgataaagtgaatctgctctctgtgcttgaggcagctaaaatgattaaaccgcagacgctcgcgtcagagaagaaatag

SEQ ID NO: 10782 - DNA, 657 bp, Artificial Sequence
  Description of Artificial Sequence: Synthetic coding sequence
atggggatgtggagcatcggggctggcgcattgggcgcagcagccttagcactgctactcgccaacacagatgtgtttttgtccaagccccaaaaagcagccctggaatatctcgaggatattgacctgaagacacttgaaaaagagcccagaacctttaaggcgaaggagctctgggagaaaaacggcgctgtgattatggcggtacgcagacccggatgcttcctttgtcgggaggaggccgcagatctgagctctctgaaatccatgctggaccagctgggagtccccctgtacgccgtcgtcaaggagcatatccggaccgaagtaaaggatttccaaccctattttaagggagaaatttttctggacgagaagaagaaattctacggccctcagagaagaaaaatgatgtttatgggctttattaggctgggcgtttggtataacttctttagggcctggaacgggggattcagtggtaatctggaaggcgaaggattcatactgggaggagtgtttgtagtagggagtgggaaacaaggtatcctgctcgaacaccgagagaaagagttcggtgataaagttaatttgttgtctgttctcgaggccgcaaagatgatcaaaccccagactctcgcttccgagaaaaagtag

SEQ ID NO: 10783 - DNA, 690 bp, Artificial Sequence
  Description of Artificial Sequence: Synthetic coding sequence
atgtctttcctgcaagacccctcattctttacaatgggaatgtggagcattggcgcaggggcactgggcgctgccgcactggccctgctcctcgcaaacaccgacgtgttcctcagcaaaccccagaaggccgctctggagtatctagaagacatcgacctgaagacgctggaaaaggagccacgcacatttaaagcaaaggagctgtgggagaaaaatggggctgtgattatggctgtccgacgcccagggtgtttcctctgccgtgaggaagcagcagatctgagcagcctgaaatcaatgctcgaccaattgggagtgcccctgtacgcggtcgtgaaggagcatataaggaccgaagtgaaggatttccagccctattttaagggcgaaatttttctggatgagaaaaagaagttttacggaccccagcggcgaaagatgatgtttatgggattcataagactcggcgtgtggtataatttctttagagcgtggaacggaggcttctctggtaacctggagggggaaggctttattttgggcggagtcttcgttgtgggctccggaaaacagggcatccttcttgaacaccgagaaaaggaattcggcgacaaagtaaacctgctttccgtcttagaggccgcaaagatgatcaagccgcagaccttagcaagcgagaagaaatag

SEQ ID NO: 10784 - DNA, 690 bp, Artificial Sequence
  Description of Artificial Sequence: Synthetic coding sequence
atgagcttcctgcaggatcctagctttttcactatgggtatgtggtccatcggtgccggagccctgggtgccgctgccttggccctcctattggcaaatacggatgtgttcctttcgaaacctcagaaagccgcacttgagtacctggaggatatcgacttgaaaactctagagaaagaaccacgcacatttaaggccaaagagctttgggaaaaaaacggcgctgtgattatggccgtgcggaggcccggatgttttctgtgccgggaggaagcggctgacctgtcctcacttaaaagtatgctagaccagctcggggtgcctctgtacgcagtggtcaaagaacacatcaggactgaagtcaaagacttccagccatacttcaagggagaaatttttttggacgaaaagaagaagttttacggtcctcagagacgcaagatgatgttcatgggtttcattcgcctcggagtgtggtataactttttccgggcatggaatggtgggttcagcggcaacctcgaaggcgagggatttatcctggggggtgtgttcgtggtgggatcagggaaacagggcatactcttagaacatagggagaaggagttcggcgataaagttaacttgctctctgtgcttgaggctgccaaaatgatcaagcctcagacactggcgtcagagaagaagtag

SEQ ID NO: 10785 - DNA, 1248 bp, Artificial Sequence
  Description of Artificial Sequence: Synthetic coding sequence
atgtcaccctttctgtatttagtcttgctcgtcctgggactgcacgccacaatacattgcgcatcccctgaaggtaaggtgacagcctgtcactcctctcagccgaatgccacactgtataaaatgagtagcattaatgcagattttgcttttaacctgtatcggagatttacggtcgagacccccgataagaatatcttcttcagccctgtgagcatctccgcagcactggttatgctgtcattcggagcctgctgcagcacacaaacagaaatcgtggaaacacttgggttcaatctaaccgacacccccatggttgagatccaacatgggttccagcacttgatatgctctctcaatttccctaagaaggagctggaactccagattggcaatgcgctctttataggcaaacatctcaaaccgctggctaaattcttgaatgatgtgaaaacactttacgagaccgaggtgttttctaccgacttcagcaatataagcgcagcaaagcaagagatcaacagccatgtagagatgcaaaccaaagggaaggtcgtggggctaatccaggacttgaaaccgaatacgatcatggtcctggtcaactatattcatttcaaagctcagtgggccaatccctttgatcccagcaagactgaggactcatctagtttcctgattgataagacaaccaccgttcaggtgcccatgatgcaccaaatggaacagtactaccatctcgtggacatggagctcaactgcactgtgctccaaatggactattcaaagaacgccttagcgctgtttgtgctaccaaaggaaggtcagatggaatctgtggaagctgccatgtcctccaaaacactcaagaagtggaatcgcctcctgcaaaaaggctgggttgacctctttgtgcccaagttctccattagtgccacatacgacctgggagccactctccttaaaatgggcattcagcacgcatattcggagaacgctgatttcagtggtctgacagaagacaacggcttgaaactttctaatgctgcccacaaggctgtgctgcacatcggagagaaagggacagaagccgctgccgtgcccgaggtagagctcagtgaccaaccggagaatacatttctgcaccccattattcaaattgaccgctcattcatgctcctcatacttgaaagatcaacccgctccatcctgttcctcggaaaagtcgtgaatcctactgaggcttag

SEQ ID NO: 10786 - DNA, 240 bp, Artificial Sequence
  Description of Artificial Sequence: Synthetic coding sequence
atggcccctcagactctgctgccagtcttagttctgtgcgttctacttctgcaagcccaaggcggatatagggacaagaagcgaatgcagaagacgcagttatctcctgagatcaaggtgtgtcaacagcagcctaagctgtacctgtgcaaacacttgtgcgagtcacaccgcgactgccaggctaataacatatgttgttccacctactgcggtaatgtttgcatgagcatcttgtag

SEQ ID NO: 10787 - DNA, 486 bp, Artificial Sequence
  Description of Artificial Sequence: Synthetic coding sequence
atgggcctgagcggactgctgcccattctggttccattcattctcctgggggacattcaggagccagggcacgcggagggtatactcggtaagccatgtcctaaaattaaggtagagtgcgaggtggaagagattgaccaatgcacaaagcccagggattgtccggagaacatgaagtgctgtccctttagcagaggcaagaagtgcctggattttcggaaaatatatgcagtttgtcaccgccgattagcccctgcgtggcccccttaccatacaggcggtacaattaagaagacaaaaatctgtagcgagttcatatacgggggtagccagggtaataacaataattttcagaccgaagccatctgtttggtgacgtgtaagaagtatcacaaatccgccctgctgtacacaatccggaggagcttgaacaatctacaggaccttgcgcacaaccctgggcttagtccccgtgttcccgactag

SEQ ID NO: 10788 - DNA, 261 bp, Artificial Sequence
  Description of Artificial Sequence: Synthetic coding sequence
atggggctgtcgggactcctcccgatactggtgcctttcatccttctgggggacattcaggagcctggccacgctgaagggatcctcgggaagccatgcccgaagatcaaagtggagtgtgaggtcgaagagattgatcagtgcactaagccacgggactgccctgaaaacatgaagtgttgcccattttcaaggggcaagaagtgcctggatttcaggaaagtgtcactgacactgtaccacaaggaggaactggaatag

SEQ ID NO: 10789 - DNA, 375 bp, Artificial Sequence
  Description of Artificial Sequence: Synthetic coding sequence
atgcctgcatgccgcttgggtccactggctgctgccctgcttctctcccttctgcttttcgggtttacgttagtatccggtactggagctgagaagaccggtgtatgtccagagctgcaggccgatcagaactgcacccaagagtgcgtttcagattctgagtgtgccgacaacctgaaatgttgttcggcaggatgcgccacgttctgttccttgccgaatgataaggaggggtcttgcccccaagtcaatatcaactttcctcaactggggctctgtcgagatcaatgtcaggtggatagtcagtgcccgggacagatgaagtgctgcagaaacggatgcggcaaggtgagctgcgtcacccctaatttctag

SEQ ID NO: 10790 - DNA, 1428 bp, Artificial Sequence
  Description of Artificial Sequence: Synthetic coding sequence
atggccgacatgcagaacctagttgagcggctcgagcgcgctgtcggcagattggaggctgtatcacacacctcagatatgcacaggggatatgcggacagtccttctaaggcgggagccgctccgtatgttcaggcttttgatagcctcctggccggtccagtcgccgagtacctgaaaatcagtaaagagataggcggtgatgtgcagaaacacgctgaaatggtccatacaggattgaagctggagcgggcacttttggtgactgcctcccagtgccaacagcctgccgaaaacaagctgtccgatctgctcgcacccatctcagaacagatcaaggaagtcattacattcagggaaaagaaccggggatctaaactgttcaaccacctgagtgccgtgtccgagtccattcaggctctcggctgggtggcaatggcccctaagccgggaccatacgttaaggaaatgaatgatgccgcaatgttctacacaaatcgggtgctgaaagaatataaggacgttgataagaaacatgtcgactgggtaaaagcgtatctgtccatctggactgaattgcaagcatacatcaaggagttccatactaccgggctagcctggagcaagactggaccggttgcaaaggaactaagcggtctgccatcaggaccgtccgcgggttcctgtcccccaccccctccgccatgcccccctcctcctcccgtctcaactatctcctgctcctacgagtcggcaagtagatcatccctgttcgctcagatcaaccagggagagagcataacgcacgcgctgaaacacgtgtccgatgatatgaagacacacaagaatcccgcattgaaagctcagagtggacctgtgcgttcagggcctaaaccattttctgctcctaaaccacagacaagtcctagccctaaacgagctacgaaaaaggaacccgctgtattagaattggaaggaaagaaatggcgagtggaaaaccaggagaacgtttccaacctggtcatagaagataccgagctcaagcaggtggcctacatttacaagtgtgttaatactaccctgcaaattaagggtaagatcaacagtattaccgttgataactgcaaaaaattaggactggtcttcgacgacgtggtgggtatcgtggagataataaatagcaaggacgtaaaggtccaggtcatggggaaagtgccaaccatcagcattaacaagacagatggttgtcatgcctacctgtctaagaactctctagattgcgaaattgttagtgcgaaaagctcagaaatgaacgtacttatccccaccgaggggggagacttcaatgaatttcctgtgccggagcagttcaaaaccctgtggaacggccagaagctcgtgacaactgtcactgagatcgcagggtag

SEQ ID NO: 10791 - DNA, 438 bp, Artificial Sequence
  Description of Artificial Sequence: Synthetic coding sequence
atggccgacatgcagaatctggtggaacggcttgagcgggcagtggggcgattggaggctgtgtcgcacacgtctgacatgcatagagggtacgctgactcccctagcaaggctggcgcagccccttacgttcaggcgtacatcaaggaattccataccacagggctggcttggtctaagacaggtcctgttgcaaaagaattaagtggtttaccttcaggaccatccgccggaagttgcccacctccccctccaccctgcccacccccaccccctgtatccaccattagctgttcttacgaaagtgcaagcagatccagcctattcgcacagataaatcagggcgaatcaatcactcacgccctgaaacacgtgagcgacgatatgaagacccacaagaatcctgccctaaaggcccagagcgggcctgtacgctag

SEQ ID NO: 10792 - DNA, 1428 bp, Artificial Sequence
  Description of Artificial Sequence: Synthetic coding sequence
atggctgacatgcagaaccttgtggaacggcttgagagagcagttgggaggctcgaagctgtctcgcatacctcagatatgcatcggggatacgccgacagcccatcgaaggccggagcggcaccatacgttcaagctttcgattccctgctggccggacctgtcgccgaatacctgaaaatttcgaaagagattgggggtgatgtacaaaagcatgcagaaatggtgcataccggcctgaaactagagcgagctctcctcgtgacagcatcccagtgccagcaaccagctgagaacaagctttccgatctgttggcgccaatttccgaacagattaaggaggttatcacatttcgggaaaaaaaccgcggatctaagctgttcaaccacctgtcagccgtgagcgagtccattcaggctctggggtgggtggccatggcacctaaacctgggccttacgtgaaggagatgaacgatgcggctatgttttacaccaacagggtactcaaagagtacaaagatgtcgacaagaagcacgtcgactgggtgaaagcctatctttccatttggacggaactccaggcctacattaaagagtttcataccaccggcctggcctggagtaaaaccggtcctgtagccaaggaactgtcaggtttgccttcaggtccttcggctggctcctgccctccccctccccctccctgtccccctccccctcccgtgtcaacgatatcctgctcgtacgaatccgcttccagaagctccctcttcgctcagataaaccagggagagagcattacacatgccttgaagcacgtatcagatgacatgaagactcacaaaaatccggcactgaaggcccagagtggaccggttagatctggacccaaacccttttccgctccaaaacctcagacctcgccaagtccaaagcgtgctacaaaaaaggagcccgctgtcctggaactcgaaggcaagaagtggcgggttgaaaaccaggaaaacgttagcaacctcgtgatagaggatactgagttgaagcaggtggcttacatttacaagtgcgttaacaccactttacaaatcaagggcaagatcaactcaatcacagttgataattgcaaaaaacttggtctcgtgtttgacgacgttgtggggatcgtggagattattaacagtaaggacgtcaaggtgcaagtcatgggcaaggttccaaccatctctataaacaaaactgatggctgtcacgcttacctgagcaaaaacagcttggattgtgagattgtgagtgccaagtcatcggagatgaacgttcttatccccacggagggtggtgacttcaacgaatttcctgtccctgagcagtttaagacactgtggaacggacaaaaactggtgaccaccgtcacggagattgctggttag

SEQ ID NO: 10793 - DNA, 1425 bp, Artificial Sequence
  Description of Artificial Sequence: Synthetic coding sequence
atggccgatatgcaaaacctggtggaaaggctggaaagggcggtggggaggctagaggccgtgagccacaccagtgacatgcaccgtgggtatgccgactccccttccaagggagccgctccttatgttcaagcttttgattcactcctggcaggcccagtggcagagtacctaaaaatttcgaaagagatcggaggggacgtgcagaaacacgctgaaatggtgcatacgggtctcaagttggagcgagcccttctggtaacagcttctcaatgccagcagcccgctgagaacaaactgagcgatctgttagccccaatatcagagcagatcaaagaggtgatcacttttcgcgagaaaaatcggggttctaagttattcaatcacctgagcgcagttagtgagtccattcaggccctagggtgggtcgccatggcccctaagcctgggccttacgtcaaggaaatgaacgatgctgccatgttctatacaaatcgcgtgctcaaggaatataaagacgtcgacaagaagcatgtcgattgggtgaaagcctatttgagcatctggactgaactgcaggcgtatatcaaggagttccacacaaccgggcttgcctggagcaagacaggacccgtggccaaggaactatcaggtttaccatcagggccatctgccggatcatgtccaccacctccacctccatgcccccctccaccgccagtgtcgacaataagctgtagttatgaaagcgcttcccgcagtagcctctttgcccaaattaaccagggtgagagcatcacacacgccctgaaacatgtttctgatgacatgaaaacccataagaatcccgcactgaaggcccagtcgggacccgtcagatctggcccaaagcctttctcagctccaaaaccgcaaacctcccccagccccaaaagggccacaaaaaaagagcctgccgtgctggagctcgagggcaagaaatggcgcgttgagaaccaggaaaatgtcagtaatctcgtaatcgaggacacagagctgaagcaggttgcctacatctataaatgtgtgaatacgacactgcagattaagggaaaaattaattccattactgtggacaactgcaagaagctgggtcttgtcttcgacgatgtggttggtattgtggagattatcaattccaaggatgtgaaagtccaggtcatggggaaggtgcccactatcagtatcaataagaccgatggctgtcatgcttatctgtcaaaaaactctctagattgcgagatagtttccgctaagagttccgagatgaatgttttaattccaacagaggggggtgattttaacgaatttccagtgcctgagcagtttaaaacactgtggaacggccagaaactcgttaccaccgtgacagaaatagccggttag

SEQ ID NO: 10794 - DNA, 1425 bp, Artificial Sequence
  Description of Artificial Sequence: Synthetic coding sequence
atggctgatatgcaaaatctggttgagcgcctggaacgagctgtcggaaggctcgaggcagtcagtcacactagcgatatgcaccgaggctatgccgatagtccgagcaagggcgcagcaccatacgtgcaggcatttgactctttactggcagggccagtggccgaatacctcaagatttccaaagagattggcggagacgttcagaagcacgccgagatggtgcacactggcttaaagttggaacgagcacttctagtgactgcctcacagtgtcaacagcccgcagaaaacaagctcagtgacctcctggctcccatcagcgagcagattaaggaggttattacgttcagagagaaaaatcgtggctcaaaactgtttaatcacctttccgccgtttcagagtccattcaggcattaggatgggtggctatggcccctaagccaggaccgtacgttaaggaaatgaatgacgccgcaatgttctatacaaacagggtcctgaaggaatataaagatgtggacaaaaaacacgtagattgggtgaaagcctacctgagcatttggaccgaactgcaggcctatatcaaagaatttcatacgacaggcctggcatggtccaaaaccggtcccgtcgcaaaggagttatccgggttacctagcggcccatctgccggttcttgcccgcctccaccgcctccatgcccaccacctcccccagtgtccaccatttcttgctcctacgagtctgctagcagatcctctctgttcgcgcagataaatcaaggggaatcaatcacacatgccctgaagcacgtgtctgacgatatgaaaacccataagaatccggcacttaaagcgcagtccgggcctgtgagatccgggccaaaacctttcagtgctcccaaaccacagacgtcccctagccctaaaagggccaccaagaaagaacccgcagtgctagagcttgaaggaaagaagtggcgcgtggagaaccaggagaatgtgagcaacttggtgatagaagatactgaactgaagcaggtcgcctacatctataagtgtgtgaacactacactgcagataaaaggaaaaatcaactcaatcaccgtcgataactgcaagaaattaggcctcgtatttgatgatgtggttgggatcgtggagatcatcaattccaaagacgtgaaggtacaggtgatgggcaaggttccaacaatatctatcaataaaaccgacgggtgtcatgcgtacctgagcaagaattctctagattgtgagattgttagcgccaaaagctccgagatgaatgtgcttattcctactgaaggcggtgacttcaacgagtttcccgttcctgagcaatttaagactctgtggaatggtcagaaactggtgaccacagtgacagagattgccggatag

SEQ ID NO: 10795 - DNA, 1428 bp, Artificial Sequence
  Description of Artificial Sequence: Synthetic coding sequence
atggcggacatgcagaatctcgtggaaaggcttgagcgcgcagtgggaaggctggaggccgtgtctcacacgagtgatatgcatcggggttacgccgatagccctagtaaggcgggagccgcaccatacgtccaggcttttgattctctgctggccggtcctgtggcggagtacttaaaaatatcaaaggaaattgggggtgatgtccagaaacatgccgagatggtccatacagggcttaaacttgaaagggccctgctggtgacagcttcccaatgccagcagcctgcagagaacaagctgagtgacctgcttgcccctatttcagaacagataaaggaggtgatcacatttagggagaaaaaccgaggttccaagctgtttaatcatctctcggctgtgtcggaatccattcaagcccttggctgggtcgcgatggcaccgaaacccggaccgtacgtgaaggaaatgaacgatgctgcaatgttctacaccaaccgcgtgcttaaggagtataaagatgttgacaagaagcacgtggactgggtcaaggcatacctgtctatatggaccgaactccaggcatacataaaagagttccacaccacaggcttggcatggtcgaagacaggacctgtcgccaaggagctatcagggcttcccagtgggccatctgctggctcatgccctccaccaccacctccctgcccccctccccctcctgtgtccacaatcagctgcagctatgaatcagccagtcggagcagtctatttgcccaaatcaaccagggtgagtctataacgcacgctcttaaacatgtcagtgacgacatgaagacacataagaatcctgcattgaaggctcagagtggacctgtgcgcagcggcccaaagccttttagcgccccaaagccgcagaccagccctagtcctaagcgtgcgactaagaaagaacctgctgtgttggagttagagggcaagaagtggcgggtagagaatcaggagaatgtctcgaaccttgtgatcgaggatacggagctcaagcaggtcgcctatatctacaagtgtgtgaatacgacacttcaaattaagggaaagataaatagcataactgttgataactgtaagaagctggggctggtatttgacgatgtcgttggcattgttgagataatcaactctaaggatgtcaaggtccaggtaatgggaaaggtcccaaccatttctatcaacaagacagacggttgccacgcttacctctctaaaaatagcttagactgcgaaatagttagcgctaagagtagcgagatgaacgtgctgatccccaccgagggcggtgacttcaatgagttcccagttcctgagcagttcaagacactatggaacggccaaaagttagtcaccaccgtgaccgaaattgcgggatag

SEQ ID NO: 10796 - DNA, 1209 bp, Artificial Sequence
  Description of Artificial Sequence: Synthetic coding sequence
atgactgccttgccaggtcctctttggctgctaggcttggcactgtgcgcactgggaggcggtggaccaggcctccggccaccaccaggctgcccccagcgacggcttggcgctcgcgaaagacgcgacgtgcagagggagatcttagctgtgttaggtctccctggacgcccacgcccacgggctccgcctgcagctagtagattgccggcatccgcaccgttatttatgctggatctgtaccacgcaatggctggcgacgatgacgaggatggggctcccgctgagcggagactgggaagggcggacttagtaatgtcattcgtgaacatggtcgagcgcgatcgggcacttggacatcaggagccccactggaaggaatttaggttcgatcttacccagattcccgctggcgaagctgtcacagccgctgagttccgaatctacaaagtgccaagcattcatctcttgaatcggacactgcatgtgagtatgttccaggttgtccaggagcaatcaaacagagaatctgacctgttcttcctcgacctccaaacactacgagcaggggatgagggctggctggtcctcgacgtcactgccgcttccgactgttggctgctcaagcggcataaggaccttgggcttcggctgtatgttgaaacagaagatggccattctgtagatcctggactcgctggactcctggggcagcgggctccaagatcccagcagcccttcgtggtaacattctttagggcttcacccagtcctattcgcaccccgcgtgctgtaaggcctttgagaaggaggcaacccaagaagagcaatgaactccctcaagcaaataggttaccaggtatcttcgacgatgtgcacggaagccatggacgccaagtctgccgcagacatgagctttacgttagttttcaggaccttggttggctcgactgggtgatcgctccccagggctactccgcttactactgtgagggtgagtgctcgtttcctctcgatagttgcatgaacgcaaccaatcacgcaatcctgcagtccctggttcaccttatgatgccagacgccgtgcccaaagcctgttgcgccccaaccaagcttagcgcaacaagcgtactgtattacgattccagcaataacgtgattctccggaagcataggaatatggtagtaaaggcctgtggctgtcactag

SEQ ID NO: 10797 - DNA, 804 bp, Artificial Sequence
  Description of Artificial Sequence: Synthetic coding sequence
atggcagcaattaggatgggcaagcttaccaccatgcctgcaggactgatctatgcatcagtcagcgtgcatgctgcaaaacaggaagagagtaaaaaacagctggtgaagcccgagcagctaccaatctatactgcacctcccctccagtcgaagtatgtggaagaacaaccgggtcacttacaaatgggattcgcaagtattcgaaccgcaacaggatgctacatcggttggtgtaagggggtgtacgtgtttgtgaagaacggaataatggatacggtgcagtttgggaaggacgcatacgtatatctgaaaaatcctccacgagactttctgcccaagatgggtgttatcactgtgagcgggctggctggactggtgagtgccaggaaggggtcgaagttcaaaaagatcacgtatccactagggctggctactctgggggctactgtgtgttatccggtccagagtgtgattatcgctaaagtcaccgcaaaaaggtacatgctacaagcctccaagttcctggagcagctgaatcactgcggtcaaaaggctgccaaaaaatctcactcactcaacttaaagaaaacaaagctagggtccagctccgagatagaagtccccgcaaagacaacccatgtactgaagcactccgttcctctgcccaccgagctcagctccgaagctaaaactaagagtgagtctacttccggagccacacagttcatgccagaccctaaattgatggatcatggccagagccatcctgaagatatagatatgtattctacccgtagttag

SEQ ID NO: 10798 - DNA, 807 bp, Artificial Sequence
  Description of Artificial Sequence: Synthetic coding sequence
atggcggcaatcaggatgggcaaactaacaactatgcctgcgggattgatttatgccagtgtaagcgttcatgcagccaaacaagaggagtcgaagaagcagttggtgaaaccagaacagttacctatctacaccgcaccccctctgcagagcaaatatgtcgaggaacaacccggtcatttgcagatgggttttgccagtattcggacagctaccggctgctatatcggctggtgtaaaggtgtctacgttttcgtcaagaacggaattatggacaccgtgcaattcggaaaagatgcatacgtctatcttaaaaaccccccacgcgactttctgcctaagatgggagtgatcacagtgagcggccttgccggtctggttagcgcacgaaagggctcaaaattcaagaagataacctaccccctgggtcttgctactcttggagctaccgtctgttatccagtgcagagtgtaatcatcgctaaagtgaccgccaagaaggtgtacgccacgtctcagcagatcttcggagcagtgaagtctctctggacaaagagttccaaggaggaaagtctccccaagcccaaggagaagacaaaactggggagctccagcgagattgaggtccctgccaagaccacacacgtgttgaagcacagcgtgccactgcccacagaactatcatctgaggctaaaaccaagagcgagtctacttctggagccacccagtttatgcccgatcccaagctgatggaccacggccaatcgcaccccgaggacattgacatgtatagcacacgctcttag

SEQ ID NO: 10799 - DNA, 3672 bp, Artificial Sequence
  Description of Artificial Sequence: Synthetic coding sequence
atggccccactgagagcactgctgtcctacctgctgccactgcattgcgccctgtgtgctgcggcaggctctcgaacgcctgagcttcacctctccggaaagctgtccgattatggcgttaccgtgccgtgttccacagatttccgagggaggttcctctctcatgttgtatctggacccgcagcggctagcgctggttcaatggtggtggacacacctcccacgctacctcgtcacagttctcacctgagagtggcgagaagccctctacaccctggcggtacactgtggccagggagagtcggccgacactctctgtatttcaacgtgacagtctttggaaaagaactgcacctcagattgaggccaaacaggaggctggtagtcccgggaagttccgttgaatggcaagaggatttccgggagctttttaggcaacctctccggcaggaatgtgtatacaccggcggtgtcacagggatgcccggtgccgcagtggccatatcaaactgcgacggtttagccggactcatccggaccgacagtaccgattttttcattgaaccactcgaaagagggcagcaggaaaaggaggcatctggacgaacgcacgtggtgtaccgcagggaggccgtgcagcaggagtgggccgagccagatggagacttgcataatgaagcctttgggctgggcgatctgcctaacctgttgggtctggttggagaccagctgggggacactgaaaggaaacggaggcacgctaagcccggttcctattcaattgaggtgctgcttgtggttgacgactccgtcgtaaggtttcacggaaaagagcacgtgcagaactatgtgctgactctcatgaacatcgtggatgagatctatcacgatgagtccttgggtgtccatatcaacattgccctggtcaggctgataatggtaggctatagacagtccctgtccctaattgaacggggtaatcctagcagatctctcgagcaggtttgcaggtgggcccattcacagcagcgccaggaccccagccacgcagagcaccacgatcacgtggtgtttctcacccggcaggatttcggaccttccgggtatgccccagttactggaatgtgccacccactgcgctcatgtgcgctcaaccatgaagacggcttctcaagcgcttttgtgatagcccatgaaacgggccacgtgctgggaatggaacacgacggacagggcaacggatgcgcagatgaaaccagcctggggtctgtgatggccccactcgtgcaggccgcattccaccgctttcactggtctcgttgcagcaaacttgaactgtctaggtatttgccctcctacgactgcctgttagacgatcccttcgaccctgcctggccgcagcctcctgagctccctggcattaactactccatggacgagcaatgtaggttcgactttgggagtggttatcagacttgcctagctttccggaccttcgaaccgtgcaagcagctgtggtgttcacaccctgataatccatatttttgcaaaacaaagaaaggccctccattggatggtacagagtgcgcacctggaaaatggtgcttcaagggccattgtatttggaagtcacccgaacagacatacggccaggatggcggttggtctagctggacgaagttcgggtcatgcagtcgcagctgcggaggtggcgttcggtcacgctctaggtcgtgtaacaatccatccccagcgtacggtggtagactgtgtctgggcccaatgtttgagtaccaggtttgcaactccgaggagtgccccggaacatacgaggactttagggcacagcagtgtgcaaaacgaaacagctactatgtccatcagaatgctaagcactcatgggtcccttacgagcccgacgatgacgctcaaaagtgcgaactcatttgccagtccgccgacactggcgatgtggtgttcatgaaccaagtggttcacgacggcacgcggtgttcgtaccgggacccttattccgtttgtgctcggggagaatgtgtgcccgttgggtgtgacaaggaggtcggctctatgaaggcagatgacaagtgcggcgtgtgtggtggcgacaattctcactgtcgcactgttaagggcacacttggcaaggcttctaaacaggcaggggctctcaagcttgtacagatacctgctggcgcacggcacatccagatcgaggcactggaaaaatctccccatagaatcgtggtcaagaatcaggtgaccggctctttcatcctcaatcccaagggaaaagaagccactagtcgaacttttaccgccatggggctcgaatgggaagatgcagtggaggacgccaaagagagccttaagacatcaggtcccctccccgaagccattgcgatcctggctctgcctccgaccgagggcggtcctagatccagcctggcttacaagtacgtaattcacgaagacctgctgcctttgatcggcagtaacaacgttctgctcgaggagatggatacctacgaatgggccctgaaatcttgggccccatgtagtaaggcatgtgggggaggaatccagttcaccaagtacggctgtaggcgccgacgggatcaccacatggtccagcggcatctctgtgaccataaaaagaggccaaagccaatcagacgcaggtgtaaccagcatccttgcagtcagcccgtttgggtaacagaggagtggggagcctgctctagatcctgcggaaagcttggcgtccagacaagagggattcaatgtcttttgcctctctcaaacggtacccataaagttatgccagccaaagcttgcgctggtgatcgcccagaagctcgcagaccctgcttgcgagttccttgtcccgctcaatggcgtctgggagcctggtctcaatgctctgccacatgtggagagggtatacaacagcgccaggtggtctgtaggactaacgcaaacagcctcgggcactgcgagggggataggccggacacggtccaggtctgtagcctgccggcatgcggcggtaatcaccagaactcgacagtccgggctgacgtgtgggagctggggacgcctgaagggcagtgggtgcctcagtctgagcccttacaccctataaataaaatcagttcaacagaaccgtgtaccggggaccgttctgtcttttgccagatggaggtgctggatcgctattgttccattccaggctaccatagactttgctgtgtgtcgtgcatcaagaaagccagtgggcctaaccccggtcctgaccccggaccaacttctttaccacccttctccacaccaggcagtcctctgccagggccacaggaccccgcagatgctgccgagcctcctgggaagccaacaggatcagaggatcaccagcacggaagggcgactcagctgcccggtgcattggacacctcctctccaggcacgcagcatcctttcgcaccagaaacgcctattccaggtgcctcctggagcatctccccaaccacgcctggagggcttccatggggctggacccagaccccaacaccagtgcctgaagacaagggccaaccgggagaggacctccgccatcctggaacttctctccccgctgcatcacccgtgacctag

SEQ ID NO: 10800 - DNA, 3681 bp, Artificial Sequence
  Description of Artificial Sequence: Synthetic coding sequence
atggctcctctgcgcgctctgctctcgtaccttctccccctgcactgcgcgttatgcgccgctgccggtagccggacccccgagctccacctctcgggtaagctttctgattacggggtgacggtcccttgctcaaccgatttccgtgggagattcctgagtcatgtcgtctccgggcctgctgccgcttccgcagggtcaatggtggtcgatacaccccctacactgccccgacactcatctcatcttcgcgtggcgaggagtcctctccatccaggtgggaccctgtggcccggtcgcgtcggtagacattccctctacttcaacgttacagtcttcggcaaggagctgcacctgaggctcaggcccaaccgcaggttggtggtgccaggatcttccgtggagtggcaggaggatttccgcgagctcttccgccagccactgagacaggagtgtgtctacaccgggggagtgacggggatgcccggagccgcagtggccatctctaactgcgacggactcgctgggctcattcgaacggactctaccgatttttttatagagccactcgagcgcggacagcaggagaaggaagcgagtggtagaacccatgtcgtttatcggagagaggctgttcagcaggaatgggcagaaccagatggggacctccataatgaagctttcggtctaggcgaccttcctaacctcctgggccttgttggggatcaactcggagataccgagaggaagcgtcggcatgctaaacccggatcatattctatcgaagttctcctggtggtcgatgacagtgtggtccgttttcatggtaaagaacacgttcaaaattacgtgctcacccttatgaacatcgtggatgagatttaccatgacgaatcccttggggtgcacataaatatcgctctggtccggcttattatggtgggctatagacagtccctgagcttaatcgagcgcggaaacccatcacgtagcctcgagcaggtgtgtcggtgggcacacagccagcaacgacaggatcccagtcacgcagaacatcacgatcatgtggtttttttgactcggcaggattttggaccttctggtatgcaaggttacgcccctgtcaccggtatgtgccaccctctgcggtcttgcgcactaaatcacgaggatggattttcctcagcgttcgtaatcgcccatgagacaggccacgtgctgggcatggagcacgatggccagggcaacgggtgtgccgatgaaacctccctgggctccgtgatggcgccacttgtgcaggcagctttccaccggtttcattggtcccgctgtagcaaactcgagctgtctcgatacttgccttcatatgactgtttgctggatgaccctttcgaccctgcctggcctcagcctcccgagttgcccggtatcaactactctatggacgagcagtgtcgcttcgatttcgggtctggctaccagacttgcctggcttttagaacgtttgagccatgtaaacagctgtggtgttctcaccctgataacccttacttttgcaaaactaaaaaaggaccaccactggatggcaccgaatgcgctcccggtaagtggtgtttcaagggccactgtatttggaagtctcccgagcaaacttacgggcaagatggcggttggtcatcttggactaagttcgggtcctgttcccgttcatgtggaggcggagtacggtctagatcccgcagttgcaacaatccttcaccagcctatggagggaggctgtgcctcggaccaatgttcgaataccaggtttgtaatagtgaggagtgtccgggtacttacgaggattttagagctcagcagtgcgctaagcgcaactcatattatgtgcatcagaatgccaagcattcatgggtcccctacgaacccgatgatgacgctcagaaatgtgagctgatttgccagagcgccgatactggcgacgtggtgtttatgaatcaggtggtgcacgatggcacccggtgctcataccgcgacccttattctgtctgcgcgcgaggggagtgcgtgcctgtgggctgcgataaggaagtcggctctatgaaggctgacgataaatgcggtgtctgcgggggagataatagtcactgtcggacagtaaagggcacactgggaaaggctagcaagcaggccggtgccttaaaattggttcaaatacctgccggtgcaaggcatattcaaatagaggcattagaaaaaagccctcatagaatcgtagttaaaaaccaggtcactggcagcttcatcctcaacccaaaaggtaaggaagccacttcaagaacctttactgccatgggcctggaatgggaagatgcagtcgaggacgctaaggagtctctgaagacgagtggcccactccctgaagccatagccatactagcattgccgcctacggaaggagggcctcggtcgagcctcgcctacaagtacgtgatccatgaggacttactcccacttatcgggtcaaataacgtcttactagaggaaatggatacatacgagtgggcccttaaatcttgggccccatgcagtaaggcgtgtggtggtggtattcagttcacaaagtacggttgccgcagaaggcgagatcatcacatggtacaaaggcatctgtgcgaccacaagaaacggccaaaacctattcgccgtcggtgtaaccagcacccctgtagccagcccgtgtgggtgactgaggagtggggtgcatgttctcggtcatgtggaaaactgggcgttcagacaaggggcatccaatgcttactaccattgtcaaacgggactcacaaggtgatgcctgccaaggcgtgtgccggtgaccgacccgaggctagacggccatgtctgagggtcccctgtcctgcccaatggagattaggcgcttggagtcagtgctccgcgacttgtggcgaggggattcaacagaggcaagtcgtgtgtcgcaccaatgccaattctctgggccattgcgaaggagatcgccctgacaccgtccaagtctgctctttgcccgcatgcggtggaaaccaccaaaactcgaccgtgcgagccgacgtgtgggaactcggaacgcccgaagggcagtgggtcccccagtcggagccactccaccccattaacaagatatcatctaccgaaccctgcacaggcgaccgctctgtgttctgccagatggaggtgcttgatcgctactgttccatcccagggtaccaccgcctgtgctgtgtgtcatgtataaagaaagctagcggaccaaatcctggcccagatccaggtccgacctctctgccccctttctccacaccgggatcaccacttcccggaccccaagacccagcagacgcagctgaacctcccggaaagccaacagggtctgaggaccatcagcatggacgcgcaactcagctccctggcgcactggatacatcaagtcccggaacccagcatcccttcgcacctgaaactcccatacctggcgctagctggtccatcagcccaacaactcctggtggcttgccttgggggtggactcagacacctactcctgttcctgaagacaaaggtcaacccggtgaggatcttagacatcccggaacatcactgcccgctgccagccctgtgacatag

SEQ ID NO: 10801 - DNA, 762 bp, Artificial Sequence
  Description of Artificial Sequence: Synthetic coding sequence
atggccgctgcaacaaggggctgtaggccctggggctccctgcttggactgctgggccttgtcagcgcagccgcagctgcctgggacttggcctccctgaggtgcaccctgggggcattttgtgagtgtgactttaggcccgacttaccagggctcgaatgcgacctcgcccagcatctcgcgggtcagcacttagctaaagcactggtagttaaagccttgaaagctttcgtgagggaccctgctcccacaaaacctctcgtactgagcctgcatggttggactggcacgggaaagtcctatgtgtctagtttactggcgcactacctgtttcaaggtggactccggtctcctcgagtccaccacttctcccccgtgctgcactttcctcaccctagccatatagaaaggtataaaaaagatctcaaatcctgggtgcagggaaatcttacagcatgtggccgatccctcttccttttcgatgagatggacaagatgccacctggcctcatggaggtcctccgtccattcttgggcagtagctgggtcgtctacggcaccaactacagaaaagccatcttcattttcatccgatggggcccagctctccagtgggctcagtggggcggtcacttctccgaagtgcagctgtatagtctctctctgtgttcccagcagaacccagtcccacacggtttgtcctgggctttcccagtaccctctgctacattgagagatgatattgtgattcccccaggctag

SEQ ID NO: 10802 - DNA, 966 bp, Artificial Sequence
  Description of Artificial Sequence: Synthetic coding sequence
atggccgctgctactaggggatgtaggccatggggcagcttactagggttgctcgggctagtttccgccgctgctgcagcctgggatctcgcatccctgcgctgcaccctgggcgcattttgtgagtgcgattttcgtcccgatctgccaggactggagtgcgaccttgcgcaacacctggccggacaacacttggctaaggccttggtcgtgaaggccctgaaggccttcgtccgggaccccgcaccaaccaagccacttgttctttctcttcatggctggaccggaaccggaaagtcgtatgttagttcattacttgctcactatctgtttcaggggggtttgcgatcccctcgagtgcaccattttagccccgtcttacactttccacatccaagccacatagagagatacaagaaggacttgaaatcctgggtacaaggaaatctgacagcatgcgggcgtagcctgtttctgtttgacgagatggacaagatgccacctggcctcatggaagttttgcgcccatttttggggagttcctgggtggtatacggaacgaactaccggaaagccatttttatttttatttccaataccggaggcaaacagatcaatcaggtggctttggaggcttggagatctcgccgtgaccgggaagagattctgttgcaagaacttgagcccgttatctccagggccgtgctggataacccccatcacggtttcagtaactcaggaatcatggaggaacggctgcttgacgctgtagttccgtttctgcccctacagcggcaccacgtgcgccactgcgtcctcaacgagctcgcgcaattggggctggagcccagggatgaggtggtgcaggctgtgctcgactcgaccactttttttcccgaagacgagcagcttttcagctcaaatggttgtaaaaccgtggctagccgaatagctttttttctttag

SEQ ID NO: 10803 - DNA, 576 bp, Artificial Sequence
  Description of Artificial Sequence: Synthetic coding sequence
atgcaggtgtggtgtgatcagcgccatgatcccggtggatggactgtcattcagcggagactggacgggtcagtgaactttttccgtaactgggaaacgtataagcaggggttcggaaatatagacggggaatactggctgggactagagaatatctactggctcactaaccagggaaactataaacttctggtgaccatggaagattggagcggccgaaaagtgtttgccgaatatgcatcgttccggttagagccggagtcagagtattataagcttagacttgggagataccatggaaacgcgggtgatagcttcacatggcataacggtaaacaatttactacgctggatagggatcacgacgtttataccggcaattgcgctcattaccagaaaggagggtggtggtataacgcttgcgcccacagcaacctcaatggggtttggtaccggggagggcattaccggtcacgctatcaagacggggtgtattgggcggagttcagaggcggtagctactccctgaagaaggtggtgatgatgatcagacccaaccctaacacatttcactag

SEQ ID NO: 10804 - DNA, 1482 bp, Artificial Sequence
  Description of Artificial Sequence: Synthetic coding sequence
atgcgcccactgtgcgtaacatgttggtggttagggctactagccgctatgggcgctgtcgctgggcaagaagacggctttgaaggcaccgaagagggcagcccccgagaatttatctatttaaacaggtacaaacgagctggagagtcccaggataagtgcacctacacctttatcgtgccccagcaaagggtgacaggcgctatttgtgtgaactctaaagaaccggaggtcctcctggagaacagagtccataagcaggagttagagctcctgaataacgaactgctcaagcagaaacggcagatcgagacgcttcagcagctggtcgaagtggatgggggaatcgtctctgaggttaagttgttgcggaaggagtctcgaaatatgaatagcagggtgacccagctctatatgcagctgttgcacgaaataatcaggaaacgggacaatgcgctggagttgtcgcagttggaaaataggatcctgaatcagacagccgatatgctccagctggctagcaagtataaggacttggaacataagtaccaacacctcgctacactggcgcacaaccagtccgagatcatagcacagctggaagaacattgccagagggtaccttcagctcggcctgtgcctcagccaccacctgctgctcctcctcgggtctatcagcccccaacttataatcgcatcatcaaccagatctccactaatgaaatccagtctgaccagaatcttaaagttctacccccacccctacccactatgcccacacttactagcctgcctagctccacagataagccttcaggcccatggcgcgactgtttgcaggccttagaagatggccacgatacaagttccatctacctggtgaaacctgagaatactaacagactcatgcaggtctggtgcgatcagcgacacgacccaggaggctggaccgtgatccagaggcggttggacggctccgtgaactttttccggaattgggaaacttacaagcagggattcggaaatatcgatggtgaatactggttggggctggagaacatctactggctgaccaaccaaggcaactacaaattactggtgaccatggaagactggtctgggaggaaggtctttgccgaatatgctagtttcagactcgagcctgaatctgagtactacaagctgcgccttgggcgttatcatggaaatgccggagacagcttcacatggcataatggtaagcaatttacgacgctggatcgcgaccatgacgtctacactggcaattgcgcacactaccagaaggggggttggtggtacaatgcctgcgcacattctaacctgaacggtgtttggtatcgcggaggacactacaggagtaggtaccaggatggcgtgtattgggcagagttccgtggaggctcctatagcctgaagaaggtggtgatgatgatcagaccgaatcccaataccttccactag

SEQ ID NO: 10805 - DNA, 1959 bp, Artificial Sequence
  Description of Artificial Sequence: Synthetic coding sequence
atggccgctgccgctcttccacctcgaccgttactattgttgcccttggtgcttttgctgtccgggcgacctacccgcgcagactccaaagtcttcggggatctggaccaggtgcgcatgacgtcagaaggaagcgattgccgatgcaaatgtatcatgcgcccactgagtaaggacgcctgcagtcgcgttagatcaggcagggctagagtggaggacttctacacagtagagaccgtctcttccgggactgattgtcgctgtagctgtaccgcccctccatcatcactgaacccctgtgagaatgagtggaagatggaaaagctcaagaaacaggctcctgaacttctcaaactgcagtccatggttgatctgctggaaggcaccctatacagtatggatttgatgaaagtgcatgcgtatgtccacaaagtcgcaagtcagatgaacacactggaggagtcaatcaaagccaaccttagccgagaaaacgaggtggtgaaggatagcgtgcgacatctgtccgagcagctgaggcattacgagaatcacagcgctatcatgttagggattaaaaaagaactgagccgattgggccttcaattgttgcagaaagatgctgccgcagcgcctgcaacccctgcgactggaacaggcagcaaggcgcaagacactgcgagaggaaagggcaaggacataagtaagtacggaagcgtgcagaagtccttcgccgacagaggactccccaaaccaccaaaagaaaaacttttgcaagtcgagaaactcaggaaagaatccggaaagggttcattcctccagcccaccgccaagcccagggctctggcacagcaacaagccgtgatcaggggctttacgtattacaaggctggcaaacaggaggtgaccgaggccgtcgccgacaacacgcttcagggaacatcatggctggagcagctgcccccaaaagtcgagggtcgcagtaactccgcggaacctaattctgcagagcaggacgaagccgaaccaaggagctctgaacgtgttgacctagcatctgggacccctacctcaatcccagccaccaccacaacagctacgacaacgcctacaccaaccacttcactgctccccaccgagcctccttccggccctgaggtcagctcacagggacgagaagcctcatgcgaaggaaccctcagagcggttgacccccctgtgagacaccactcttatggtaggcacgaaggggcttggatgaaagatcccgcagccagggacgaccgcatctacgtgaccaactactactacggcaactcactagtggaattcaggaatttagaaaatttcaagcagggtcgctggagtaacatgtacaaactgccttacaattggattggtactggccatgtggtttatcagggcgcattctactacaatcgtgcttttaccaagaacatcattaaatacgatctgcgccagaggttcgtggcttcatgggcgctccttcccgacgtggtgtatgaagacaccacaccctggaagtggcgtggtcacagcgacatcgatttcgccgtcgacgagtccggattgtgggtcatctatcctgcagtcgatgacagagatgaggcccagccagaggtgatcgttctgtctaggctggatccaggcgacctgtccgtgcaccgcgaaaccacgtggaagacccgtctgaggcggaactcatacggcaattgctttctcgtttgtggaatcctgtatgcagttgatacatataaccaacaagaaggccaagtagcatacgctttcgacacccataccggaacagatgcccgaccgcagctcccttttctgaatgagcatgcttacaccacccagattgactacaacccaaaagaaagggtactctacgcctgggacaacgggcaccaactcacatacacattgcacttcgtggtttag

SEQ ID NO: 10806 - DNA, 1641 bp, Artificial Sequence
  Description of Artificial Sequence: Synthetic coding sequence
atgaaaaaccaggataaaaagaatggggctgccaaacaatcgaatccaaaaagctcacctgggcagcccgaggcgggacccgagggcgctcaggagaggccttctcaagccgctcctgcggtggaggccgaaggcccagggtcctcccaggcccctcggaagcctgaaggcgcacaggcaaggacagcccagagcggagctctgcgcgacgtgagcgaggaactgtcaaggcagctcgaggatatactctccacttactgcgttgacaacaaccagggaggtcctggcgaagatggcgcacagggagaacccgcagaaccggaagacgcagaaaagtctaggacatatgtggcccgtaatggcgagccagagcccacgcccgtggtcaacggggaaaaggagccttccaaaggtgaccccaacaccgaggaaatcaggcagtctgacgaagttggggatcgtgaccaccgacgccctcaggagaaaaagaaggctaaaggattagggaaggagattaccttactaatgcagacattaaacaccctgtccacaccggaggagaagcttgccgcactgtgtaaaaaatatgcggaactgctggaagaacaccgaaattcacagaagcaaatgaaactgctgcagaaaaaacaatctcaattggttcaggagaaggaccacctgagaggggagcacagcaaggcagtcttggctcgctcaaaattggagagcctttgtcgggagcttcagcggcataataggagcctgaaagaggagggtgtgcaacgtgccagagaggaagaagaaaagcggaaggaggtgacaagtcacttccaggtgactttgaatgatatccagcttcagatggagcaacacaacgagagaaattctaagctcagacaggaaaatatggagcttgccgagcgcctgaagaagctgattgaacagtatgagctgcgcgaggaacacattgataaagtgttcaagcataaggatctgcagcagcaattggtcgacgccaagctgcagcaggcccaggaaatgctgaaagaagcggaggaaagacaccagagagaaaaagatttcttactgaaggaagcagtggagagtcaacggatgtgcgagctgatgaagcagcaggagacccacttgaagcaacagctggccctgtacacggagaagtttgaggagttccagaacacgctgtcgaagtccagcgaggtattcactacctttaaacaagaaatggaaaagatgacaaagaagatcaaaaagctcgagaaagagactaccatgtaccgcagtcggtgggaaagcagcaacaaggctctgctcgaaatggccgaggagaaaaccgtgcgagacaaggaacttgaaggtctgcaggtaaaaatacagaggcttgaaaaactgtgtcgtgctcttcagactgagcgcaacgatctgaataaaagagttcaagacctgagtgcaggcggtcaagggagcctgaccgatagtggcccagagcgcagaccagaaggcccaggcgcacaagctccaagctcccccagggtgaccgaggctccatgttaccccggtgcccctagcactgaggcctcagggcagactgggccacaggaacccacgtccgcacgcgcatag

SEQ ID NO: 10807 - DNA, 1641 bp, Artificial Sequence
  Description of Artificial Sequence: Synthetic coding sequence
atgaagaaccaggacaaaaagaatggggctgcaaagcagagcaaccctaaatcatcaccaggccagccagaggccggacccgagggagcacaggagaggccttcacaggcggctcccgctgttgaagctgaagggcctggttccagccaggctccgcgtaagccagaaggagcacaggcacgaacagcccagtcgggggctttgagggacgtgtctgaagagctgtcacggcagctggaagacatcctttcaacctactgtgtggacaacaatcagggaggcccaggggaagatggtgcgcagggcgagcccgctgaacctgaagatgccgaaaaatcgcgcacctacgtggctagaaacggagaaccagagccaacaccggtagtgaacggtgaaaaagaaccctctaagggcgatccaaatactgaggagattcggcagtctgacgaagtgggagatagggatcaccgccgaccacaggaaaagaagaaggcaaagggcttgggcaaggaaataaccctgttgatgcaaacccttaacactctctccacccccgaggaaaagctcgcggcactgtgtaagaagtatgctgagctgctggaagaacaccgcaacagccaaaagcagatgaaactgctgcagaaaaaacagtcccaacttgtgcaggaaaaagaccacttaaggggcgaacactccaaggctgtgcttgccaggagcaagctcgagtctctctgcagagagctccagcggcataatagatccctgaaagaagagggcgttcagcgggctagagaggaggaagaaaagcgcaaagaagttacctcacacttccaagtcactctcaacgatattcagctccaaatggagcagcataatgaaagaaatagtaagttgcgacaagaaaatatggaattagcagagcgacttaagaagttgatcgagcagtatgagctgcgggaggaacacattgacaaagtcttcaagcacaaggacctgcagcaacagttagtggacgctaagttgcagcaggcccaagagatgctgaaggaggctgaggagcgacatcaacgagagaaagacttccttttgaaggaggccgtggagtctcagcgaatgtgcgaattaatgaagcagcaagagacacatttaaagcaacagctggccctctataccgaaaagttcgaagagtttcaaaatacactaagcaagagctccgaggtattcactacattcaagcaagaaatggaaaaaatgactaagaaaatcaagaagctggagaaggagaccacaatgtaccgctctagatgggaatctagcaataaggcactcttggagatggctgaagagaagactgtgagggacaaagagcttgagggacttcaagtgaagatccagcgcctggagaagctttgtcgcgcactgcagactgaaagaaacgacctaaataaaagagtgcaggacttgtctgccggtggccagggcagcttaaccgactcaggcccagaacgccgaccggagggccctggcgctcaggcaccctctagtccacgcgtgacagaggccccatgctacccaggcgctccatccacagaggcctccggacaaacaggccctcaggagcccaccagcgcccgtgcttag

SEQ ID NO: 10808 - DNA, 1392 bp, Artificial Sequence
  Description of Artificial Sequence: Synthetic coding sequence
atgcatggttcctgtagcttcttgatgctacttctgcctttattgctgctactcgtggccactacaggtcctgtcggagccctgacagatgaggaaaagcgattgatggttgagctgcataatctgtatcgtgcccaggtcagtccgaccgccagcgatatgctgcacatgcgctgggatgaggagcttgccgcattcgctaaagcctatgctcgtcagtgtgtctggggtcataataaggagcgtggcaggagaggggaaaacctgtttgcaatcacagatgagggtatggatgtccctctggccatggaggagtggcaccacgagcgagagcactacaatttgtctgccgctacatgcagtccaggacagatgtgcgggcattatactcaggtcgtgtgggcaaagacagagcggatcggatgcgggtcacacttttgtgaaaagctgcagggcgtggaggaaacgaatattgagctgcttgtttgtaattacgagcctccaggaaacgttaaaggtaagcgaccctatcaagagggaaccccctgtagccagtgtcccagcggttaccattgcaaaaactccctgtgtgagcctattggatctcctgaggatgctcaagatctgccataccttgtgaccgaggctccttcttttcgggctactgaggcatctgactccagaaaaatgggcaccccaagtagcctggccaccgggatccccgctttcttggtgacagaggttagtggatcactggctactaaggcccttccagcggtcgagacccaggctccaaccagccttgccaccaaggatccaccatccatggccaccgaggcgccaccctgtgtgacaaccgaagtccctagcatcctggcggctcattctctgcctagtcttgatgaagagccagtaacttttcccaagagcacacatgtgcccatccccaaaagtgccgataaggtcacagataaaaccaaagtgccgtctcgttcacccgaaaacagtctggaccccaaaatgtcattgaccggcgctagggagcttctgccccatgcacaggaggaggcggaagcagaggctgagctgcccccttcatctgaggtgctggcttcggtgttcccggctcaggacaaaccaggcgagttgcaggcaaccctggatcacacaggccacacctcaagcaaaagccttcccaatttcccaaataccagtgcaacggcaaatgctacaggcggtagggctctagccctgcagagtagtcttcctggggctgagggcccagacaaaccatcagtggtgtcaggtctcaactcagggccaggccacgtgtggggcccactgctcggacttttactactgcccccattggtcctggctggaattttctag

SEQ ID NO: 10809 - DNA, 459 bp, Artificial Sequence
  Description of Artificial Sequence: Synthetic coding sequence
atgatgctgccacaatggcttctgctccttttcttgcttttctttttcttattcctgttaacaaggggttcactctcccccactaaatataacttgctagagctgaaggagtcatgtatcagaaatcaggactgcgaaaccggatgctgccagcgtgcccctgacaattgcgagtcccattgtgctgagaaggggtcagagggaagtctctgccagacccaagtgttctttggtcaatatagagcgtgcccctgcctccggaatctcacctgcatttactctaaaaacgaaaaatggctctccattgcttacgggcgatgccaaaagataggacgccagaagctggccaaaaaaatgtttttagtcttgcctcctagctgctgcttgttgctgctgcatctcctcagctcacttcccagggcactctgtagcccctgttccccagagccccctccctag

SEQ ID NO: 10810 - DNA, 366 bp, Artificial Sequence
  Description of Artificial Sequence: Synthetic coding sequence
atgatgcttccgcagtggctcctgctcctgtttttgctattttttttcctctttctgctgacccgaggttcactgagcccgaccaaatacaaccttctggaactgaaagagagttgtattcggaatcaagactgcgagacagggtgctgccagcgtgcgcctgataattgcgaatcccattgcgccgaaaaaggctccgagggctccctatgccaaactcaggtattctttggacagtacagagcatgtccctgtctgcggaacctgacatgtatctactccaaaaatgaaaaatggctgtctatcgcctacggaagatgccaaaagatcggacgtcagaaactcgctaaaaagatgttcttctag

SEQ ID NO: 10811 - DNA, 1122 bp, Artificial Sequence
  Description of Artificial Sequence: Synthetic coding sequence
atgcgcctcctggcttggttaatctttctggcgaattggggaggcgctcgagccgaacccggaaagttctggcacatcgccgacctccatctcgatccagattacaaggtgtccaaggacccctttcaagtgtgtccgagtgctgggtcccagccggtgcccgatgcagggccatggggagactatctgtgtgacagtccctgggccctcatcaattcatcaatttacgccatgaaggaaatcgaaccagagcccgattttatcctgtggactggggacgatacaccacacgtgccggacgaaaaactcggtgaggcggcagtcctggagattgtcgaacgcctcactaagttgataagggaggtctttcccgacaccaaggtttatgctgctctgggaaatcatgactttcacccaaagaaccagtttccggcaggcagcaataatatttacaaccaaatcgccgagctatggaagccttggctctcgaatgagtctatcgcgctgttcaagaagggagcattctattgtgagaagctcccgggaccttcaggagcgggtagaatagtcgtgttaaataccaatctgtattatacgagtaacgcacttacagccgatatggctgatcctggacagcaattccaatggcttgaggacgtcctcacggacgccagcaaggcgggtgatatggtctacatcgtgggccacgtgcccccagggttctttgagaagacccagaataaggcatggtttagagaaggctttaatgagaaataccttaaggttgtccggaaacatcaccgagtgattgcaggccaattctttgggcaccaccacaccgattcattccggatgctgtatgatgatgccggagttccgatctcggccatgttcatcaccccgggtgtgacgccttggaagacaaccttgccaggcgtagtgaacggggcaaacaacccagccatccgggtcttcgaatatgatcgagccacactatctctaaaggttcgttctcctgccgaagctcggggtggaggctgggagggcttgaaatgcatcaccaccttcccacactctcagttgatccacctacccctcaccactgagccacaggagggctag

SEQ ID NO: 10812 - DNA, 810 bp, Artificial Sequence
  Description of Artificial Sequence: Synthetic coding sequence
atgaggctgctggcttggctgatctttctggctaattggggcggagccagagccgaaccagaggaggctcagggcccttgcgctcaagaaaagggcaagggtcctccaccgacttcaatccttgcaagtctcgcccctgggctggaagccggtaagttctggcatattgcagaccttcatctggatccagattataaagtgtccaaggacccatttcaggtatgcccttccgctggctcccaaccagtcccagacgcaggcccttggggggactacttatgcgatagtccctgggcgctcattaacagttccatttacgccatgaaggagattgagccagagccggacttcatcctgtggacaggcgacgacacaccacacgtcccagacgaaaaattgggtgaagcggcagttctggagatcgtcgagagacttactaaacttatacgggaggtgtttcccgatacaaaggtttatgccgcactgggcaatcatgattttcacccaaagaaccagttcccagctgggtcaaataacatctacaatcaaatagccgagctgtggaaaccctggctgagtaacgagtcaatcgccctcttcaaaaagggcgcattctattgcgagaaactgcctggaccatctggagccggtcgtattgtggtgctgaataccaatctttattacacctctaatgcgttgaccgctgatatggccgatcctggccagcaattccagtggcttgaggacgtgctgacagacgcttcaaaagccggagatatggtgtatatcgtagggcacgtccccccatag

SEQ ID NO: 10813 - DNA, 1368 bp, Artificial Sequence
  Description of Artificial Sequence: Synthetic coding sequence
atgcggctgcttgcctggctcatcttcctggctaactggggtggtgctagagcggaacctggaaagttctggcacattgccgacctgcacctggaccctgattacaaggttagcaaagacccttttcaggtgtgcccgtcagcaggatcccaacctgtgcccgatgccggtccgtggggtgattatctgtgtgattccccttgggccctgatcaacagcagcatctatgcgatgaaggaaatcgagcctgagcctgatttcattttatggactggcgatgatactccgcatgtgccagatgagaagctgggagaagcggcagttttggaaattgtcgaaaggctgaccaaattgattcgcgaagtgttccccgacaccaaggtctatgcagctctggggaaccacgacttccatccaaaaaatcagttcccggcaggctcgaacaatatatataatcaaatagcagaactctggaagccgtggctatctaacgagtcaattgccttgtttaagaaaggagccttctactgcgagaagttacctggcccttccggggcaggcagaatcgtggttttgaatacaaatctttactatacgagtaacgctctcactgccgacatggctgatcctggacaacaatttcagtggctcgaggatgttctgacagacgcttctaaagccggagacatggtgtatatcgtgggccatgtcccacccggattttttgagaagacacagaacaaggcctggttcagggagggttttaatgaaaaatatctcaaggtagttcgcaaacaccaccgggtgatcgccggacagttctttggccatcaccacacagactccttccgcatgctctatgacgacgctggtgtgcctatttctgccatgttcattactcccggagtaaccccttggaaaacgacactaccaggagtcgttaatggtgccaataaccccgctatcagagtctttgagtatgatcgggctaccctctcactgaaggatatggtgacgtatttcatgaatttgtcgcaggccaatgcccaagggacccctcgctgggagctggaataccagctgacagaagcttatggcgtgcctgacgcatccgcacattccatgcataccgttctggacaggattgctggcgatcaaagtacacttcagaggtactacgtatataactcagtgagctattccgcgggagtgtgcgacgaagcgtgcagcatgcagcacgtgtgcgctatgagacaagtcgacatcgacgcctataccacctgcctctatgcgagtggcactacccctgtgccgcagctccccctgctgctgatggcactgcttggcctgtgcaccctagtgctgtag

SEQ ID NO: 10814 - DNA, 867 bp, Artificial Sequence
  Description of Artificial Sequence: Synthetic coding sequence
atggcacttgcccctcctcctcgcggattgtggcaggcaaaagatatctcacctattgtcaaagcagccaggagagacggcgagcttttgctgtccgcccaactcgactcagaggagagagacccaggagtacctcggcctagcccatacgcaccttatatcctcgtctacgccaacgatctcgcgatttccgagcctaactcagtcgccgtgactctccagaggtatgatccgtttcccgctggggatcccgagccacgcgcagccccaaataacagcgcggaccccagagtaagacgggctgctcaagcaacaggccctttgcaggacaacgagctccccggactcgatgaacgaccgccaagggcgcacgctcagcattttcacaagcatcagctgtggccctcaccgttcagggctctgaaacctagaccgggaagaaaggaccgcagaaagaaggggcaggaggttttcatggcagcctcccaagttctcgattttgacgagaagacaatgcagaaggctaggcgcaaacaatgggacgagcccagggtctgttcgcgcagatacttgaaggtggatttcgctgatattggttggaacgaatggattatctcaccgaagagctttgacgcatattactgtgccggtgcctgcgagtttcctatgccaaaaatagtgcggccttccaaccacgcgaccatccaaagcattgtacgcgctgtaggcattatccctggaatacctgagccctgctgcgtgcccgacaagatgaattcacttggagtgctgttcttggacgaaaatagaaacgtggtactcaaggtctaccccaatatgagcgtggacacatgtgcttgtcgctag

SEQ ID NO: 10815 - DNA, 1626 bp, Artificial Sequence
  Description of Artificial Sequence: Synthetic coding sequence
atgcccttcagactcctgatccctctcggcttgctgtgcgcactgctaccacagcaccatggcgctcctgggccagacggtagcgctcccgacccagcgcactactccttctcactcacattgattgatgccctagatactctcctgatcctgggaaatgtgtcagagttccagagggtggttgaggtgctgcaggattcagttgacttcgatatcgacgtgaacgcctccgtatttgagacaaacatcagggtcgtgggcggactgttgagcgctcatctgttaagcaagaaagccggagttgaagtcgaagccggatggccttgctccggcccactgctgagaatggctgaggaagccgctcgtaagctgctccctgcttttcagacccccacaggcatgccgtatggtacagtcaatctgttacacggtgtaaatcctggagagacccctgtgacatgcacagccggaattggaacctttatcgtcgaatttgctacgctgtcctccctgacaggggaccccgtgtttgaggatgtggctcgggtggctctcatgagactgtgggaatcccggagcgatatcgggctggttgggaatcacatagatgtattgaccggcaagtgggtggctcaagatgctgggattggggcaggggttgactcttactttgaatacctcgtgaagggcgcaatcttgctgcaagacaagaagttgatggctatgttccttgaatacaacaaggccataagaaactacacccggtttgatgactggtatttgtgggtgcagatgtataaaggaaccgttagcatgcccgtgtttcagagtttagaagcctattggcctgggctacagtccctcatcggggatattgacaacgctatgagaacgttcttgaactactacacggtctggaagcagttcggcggactgccggaattttataacatacctcagggatacactgtggagaaacgggagggctacccattgagacccgagctgatcgagagtgctatgtatctctacagagcaaccggcgatcctacactgctcgagttaggacgggacgccgtggagagtatcgagaaaatttccaaggttgaatgtggtttcgctaccattaaagacctcagagatcacaaactggataaccgaatggagagtttcttcctagccgagacagtgaagtacctatacctgctattcgatccaaccaacttcatacacaacaatggatctacgttcgacgctgtgatcacgccctatggagaatgtatcctcggtgcaggtggctacatctttaacactgaagctcacccgattgatcctgccgcactccactgttgtcaacgcttgaaagaagagcagtgggaggtggaggacctaatgagggaattttactcactaaaacgatctaggagcaaattccagaaaaacacagtgtcttcgggcccatgggaacctcctgcccgacccggaacattgttctcccccgagaaccatgaccaggctcgcgaaaggaagccggctaagcagaaagtgccactcctgtcttgcccttcacaaccgtttacatcaaaactagccctcctgggacaagtgtttctcgactcaagctag

SEQ ID NO: 10816 - DNA, 1737 bp, Artificial Sequence
  Description of Artificial Sequence: Synthetic coding sequence
atgcccttccggttactgattcctcttgggctcctttgtgccctgctccctcagcatcatggagccccaggccctgatgggtctgctccagaccctgcccactaccgggagcgcgtgaaagccatgttctatcacgcctacgattcctatttggaaaacgcgttcccctttgacgagctgcggcctctgacctgtgacggacacgacacatggggatcttttagcctcacccttattgacgcactcgatacactgctgatactcggaaatgtgagcgagttccaaagggtcgtggaggtgttacaggacagtgtggatttcgacattgacgtcaatgcctcggtgttcgagactaacatcagagttgtcgggggactactgtcagcacatctgctttcaaaaaaggccggagtggaagtggaggctggttggccatgcagcggccctctgcttagaatggcagaagaagcggcaaggaaactgctgccagcatttcaaacacccacgggcatgccttacggcactgtaaacctgctgcatggagtcaatcccggtgagacacccgtaacctgcaccgccggtatcgggacgtttattgtagagttcgcaactctgtcctctctcaccggcgatccagtttttgaagatgttgccagagtggcacttatgcgcttgtgggaatctagaagtgacattggtttggtgggtaaccatatagacgtgctgactggcaaatgggtcgcccaagatgctggaatcggtgccggagttgattcgtatttcgagtacctggttaaaggcgctattcttcttcaggacaagaaactgatggctatgtttctggagtacaacaaagcaataagaaactatacccgctttgatgactggtacttatgggtacagatgtataaaggcaccgtgtctatgcccgtcttccagagtctcgaggcttactggcccggactgcagtccttaattggtgacatcgataatgcaatgagaactttcttgaattactataccgtgtggaagcagttcggaggcttacccgagttttacaatatcccccagggctacacagtggagaaaagggagggatatcccttacgacctgaattaatcgaatccgcgatgtacctatatcgtgctacgggtgatccgactctgctagagctcgggagggacgccgtggaaagtatcgaaaagatttccaaggtggaatgcggatttgctacgattaaggacctcagagatcataaactcgataatagaatggagagctttttcctggccgagactgttaagtacctctacctgctcttcgaccctaccaattttatacataacaacggctctaccttcgatgcggttatcacgccctacggtgagtgtatcttgggggctgggggttatatcttcaacaccgaggctcacccaatcgatcccgctgctcttcattgctgccagcgcttaaaagaggagcagtgggaagtggaggacctgatgagagagttctatagtcttaaacgctcccggtccaagttccaaaagaatacagtgtcaagcggcccttgggaaccaccagcccgaccaggcacactgttctccccagaaaatcacgaccaggccagggagagaaagccggcaaagcagaaggtcccgttgctatcctgcccctcccagcccttcacatccaagctggccttgctcggtcaggtgtttctggatagtagctag

SEQ ID NO: 10817 - DNA, 495 bp, Artificial Sequence
  Description of Artificial Sequence: Synthetic coding sequence
atgcgcagctgttacgtggcccaggctggcctaaagctcccaggctcatctgatcccccagcctccgctagccagtccacacgcattacagcatctggctacggtcccccatcgtccaggccaagctctcgtgtggttaacggagaagatgctgtgccctacagctggccatggcaggtgtctctgcagtacgaaaagagtggctccttctatcacacgtgcgggggatcgttaatcgcccctgattgggtcgtgactgcagggcactgtatatctagtagtaggacataccaggtagtcttgggtgaatatgacagggccgttaaagaaggccctgagcaggtgattccaattaactccggagacctgttcgtccatcccctgtggaataggagttgcgtcgcctgcggaaacgacatcgctctcataaaactgtcccgcagtgctcagctgggcgacgctgtgcagttggcttccttaccgccagccggttag

SEQ ID NO: 10818 - DNA, 3663 bp, Artificial Sequence
  Description of Artificial Sequence: Synthetic coding sequence
atgccaggattactaaactggatcacgggggcagccctccctctcaccgcaagtgacgtgacctcatgtgtctccggctatgcgctgggcttgaccgcttcactgacttatgggaatcttgaggctcaaccatttcaaggcctgtttgtataccctctggatgagtgtactaccgttattgggttcgaggcggtcattgccgaccgggtggtgaccgtccagatcaaggacaaggctaagctggaaagtggtcacttcgacgcgtcccacgtaaggtcacctaccgtgaccggcaacattctgcaggacggagtgtcaatcgcccctcattcctgtacccccggaaaggtcacccttgatgaggatctcgaacgcatcctctttgtcgctaacttgggcacgatcgctcccatggagaacgttacaattttcatcagtacttcatctgaactcccaaccttgccttcaggagctgtgagagtgctgctgcccgctgtgtgcgccccaaccgtgccacaattctgcacgaagtctactggtacttccaatcagcaggcccagggaaaagatagacattgctttggagcttgggctcctggttcatggaacaagttgtgcctggctaccctgctgaacaccgaggtgtcaaatcccatggaatacgaattcaatttccaattagagattagggggccatgcttacttgccggagtggaaagcccgactcatgagatacgcgctgatgcagcaccatccgctcgttccgcgaaatcaatcattattacgctggctaacaagcataccttcgacaggccggtggaaattctaatacaccctagcgaacctcacatgccacatgtacttatagagaaaggcgatatgacacttggagagtttgaccaacacctgaagggcaggactgatttcataaagggtatgaaaaagaaatctcgagcagagcgaaaaacagagataattcgaaagcgcctgcataaagacattccacatcacagtgtgataatgctgaatttctgtcccgatttgcagagcgtgcagccctgcttgcgcaaagcccatggggaattcatatttctcatcgaccggtcttcctcaatgtctgggatctctatgcatcgagtgaaagatgcaatgctcgtggcactgaaatctctcatgccagcttgcctctttaacattattggattcggaagcaccttcaagtctttgttcccttcctctcagacctacagcgaggactctctggccatggcctgtgatgatattcaacgaatgaaggccgacatggggggaacaaatatcctctcacctctgaaatgggtgatcaggcagcctgtccataggggccatccgcgactcctgttcgtgatcaccgatggcgcagtgaacaacactgggaaggtgctggaactggtgcggaatcacgcattttctacacgctgctattcgttcggtatcggccctaatgtgtgtcatcgcctggtcaaggggctggcatccgtttccgaaggcagtgcagagctccttatggaaggagagcgactgcagcctaagatggtaaaaagtctgaaaaaagctatggccccagtcttgtctgacgtcacagttgaatggatctttccagagactaccgaagtgctggtctcgccggtgtctgcatcatccctttttccaggggagaggcttgtggggtacggcatcgtgtgcgatgcctcccttcacataagcaaccccaggtcagacaagaggcgacgatattcaatgctacatagccaggagtcaggaagcagtgtcttctaccactctcaggacgacggacctggactggagggcggtgattgcgccaaaaacagcggcgcacccttcatactgggccaggccaagaatgcacgcttggccagcggagactctactactaagcatgatctgaatctgtcccagcgccgacgagcgtactctacgaaccaaattaccaatcacaagcccctgcccagggccactatggccagtgatccaatgcctgctgctaagcgataccctctcagaaaagccaggttacaggacctaactaaccagacctcactggatgtccagaggtggcagatcgacttgcagcctcttctcaacagcggtcaggacctgaaccaagggccaaagctccggggtcctggcgctcgccgtcccagcttgcttccccagggctgtcagcctttcctgccctgggggcaggaaactcaagcatggtccccagtgagggagcgcacaagcgactctcggtcaccgggtgacttggaaccctcccaccaccctagcgcttttgaaactgaaacgtcttccgattgggatccacccgcagagagccaggagagggctagcccatctaggcctgcaactccggcacctgttctgggaaaagccctggttaaaggcctgcacgatagtcagagattgcagtgggaagtgtcctttgagttaggaacacccggaccagaaagggggggagcccaagacgctgacctgtggagtgaaacttttcatcacttggctgcacgtgccattattcgtgattttgagcagctggctgagcgggaaggagaaattgaacaaggctcaaaccgtcgataccaggtttccgcattgcatacatccaaggcttgtaacataatcagcaagtatacagcgtttgttccagtggacgtgagcaaatcccgctacctgccaaccgtcgtggagtaccccaattccgcagctctgagaatgttgggctcccgcgcactggctcagcagtggagaggtactagcagtggttttggcagacctcagactatgctcggtgaggatagcgccccaggaaacggcaagtttcaagccttgaatatggaagcttccccaactgccctcttttctgaggccagatcgccagggagagaaaagcacggagccagtgagggacctcaaaggtctttggcgaccaataccctgtcttctatgaaagcttccgaaaacctctttggctcttggctgaacttaaacaaatccagacttctgacaagagcagccaaaggcttcctgtctaagccactgatcaaggctgtagagagcaccagcggaaaccagtccttcgactatatccccctcgtttccctccagcttgcgtcaggagcctttcttctcaatgaagcattttgtgaggccactcatatccccatggagaagctgaaatggacttcaccgttcacttgtcaccgtgtgagtctcactacccggcctagtgagtccaaaactccatctccccagctatgtacttcatcccctcccagacatccctcctgtgattctttttccctagagcccttggctaaggggaagctgggtctcgagcctcgagcagtcgtggagcacaccgggaagctgtgggctactgtcgtgggtctggcctggctcgagcactcctccgcatcgtatttcacagaatgggagctggtggcagcaaaggccaatagttggctcgagcagcaggaggtccccgaaggtagaacacaggggaccctgaaggccgctgcgaggcaactattcgtcctcctgaggcactgggacgaaaatctcgagttcaacatgctgtgctacaatcctaactacgtttag

SEQ ID NO: 10819 - DNA, 3051 bp, Artificial Sequence
  Description of Artificial Sequence: Synthetic coding sequence
atgcctggcctcttgaattggattacgggtgctgccctgccacttacagcgagtgacgtcactagttgtgtttccggttacgctctgggactcacagccagcttgacttatggcaatctcgaagcccagccattccaggggctctttgtgtatccactcgacgagtgtactacagtcatcggcttcgaagccgtgatagccgatcgggttgtaactgtccagattaaggataaggccaagcttgagtccgggcactttgatgcaagccatgtgaggtctcccacagtcactggaaacatcttgcaagacggcgtgtccatcgcccctcattcttgtactcccggaaaagtgaccctggacgaagatctggagagaatcctgtttgttgccaatctgggtactattgcacccatggaaaatgttactatcttcatctctacctcatccgagctgcccaccctgccaagcggagccgtgcgggtcttgctccctgctgtatgcgcacccaccgtgccacaattctgtacgaaatctaccggcactagcaaccagcaggcacaggggaaggatcggcattgcttcggtgcatgggcacccggaagctggaataaactgtgtttagccaccctactcaataccgaggtctccaatccgatggagtatgaatttaacttccagctggagattcgcggaccgtgcctgctggctggagttgagtctcccacccacgaaattcgggcagatgctgccccaagcgctaggtccgccaagtcaattattattacgctggccaataaacatacttttgaccgccctgtggagatcctaatccacccatccgaaccccacatgcctcatgtgctcatcgaaaagggagacatgaccctgggcgagtttgatcagcatctgaaggggcgtaccgattttatcaaggggatgaagaaaaagtctcgcgctgaaagaaagaccgagataattcgaaaaaggctgcacaaggatattccgcatcactcagtgattatgctcaatttctgtccagatttgcaaagcgtccaaccttgccttcgcaaggcccacggcgaattcatcttcctgatcgaccgttcatcctccatgtccggaatctctatgcatagggtcaaagacgcaatgttagtagccctgaaatccctgatgccagcatgcctcttcaacatcatcgggtttggctcaacatttaagagtctgttcccctcttcccaaacgtattcagaggactcgcttgcaatggcatgcgacgatatacagagaatgaaagcagacatggggggaaccaatattctctctcccttgaagtgggttatccggcagcctgtccaccgcggacacccaagactgttgtttgtaataaccgacggcgctgtcaataatactggcaaggtgctagaactggtaagaaaccatgccttctcgactcgatgttacagtttcgggatagggccaaacgtgtgccataggctggtgaagggtctggcctctgtgtccgagggctccgctgagcttttgatggaaggggagcgcctgcaacctaagatggtgaagtctctaaagaaggccatggctcccgtgctctccgacgtgacggttgaatggatttttccagaaactacagaggtgttagtcagccctgtctctgcaagcagtctattccccggtgagagattggttggctacggaattgtctgtgacgcctcgcttcatatcagcaacccaagatcagacaagagacgcaggtactctatgctgcacagtcaggagagcggaagttcagtgttctatcattctcaagatgacgggcctgggctcgagggaggggactgcgcaaagaactcaggcgcaccttttattctgggtcaggctaaaaatgcacgcctcgctagtggagactcaacgaccaagcatgatctgaatctatcgcaacggaggcgagcctattccacgaatcagatcacaaaccataaacctttgccgcgagccactatggcttcagacccaatgcccgctgcaaaaaggtacccgctgcgaaaggctagactccaggatctaaccaatcaaacctccctcgacgttcaaagatggcagattgatttgcaacctttgttgaattctggacaggacttgaatcaagggcctaaacttcggggaccaggagcgaggcgcccatcgctgctgccacaaggatgtcagcctttcttgccttggggacaagagacccaggcctggtcacctgtccgcgaaaggacgtccgacagcaggagcccaggagatctagagccttcacatcacccaagtgctttcgagacggagacctcatccgactgggacccaccagcggagtcccaggaacgagccagcccttcccggcctgcaacaccggctcccgtgctcggtaaagctctcgtcaaaggcctgcacgactctcagagactccagtgggaagtttcctttgaactcggcaccccgggtcccgaacggggaggagcccaggacgcggacctgtggagtgagacatttcaccacttggctgcacgcgctataattagagatttcgagcaattggctgagagggaaggagagattgagcaaggctccaaccgacggtaccaggttagtgccctccacacttcaaaagcctgtaacattatttctaagtatacggccttcgtccccgtggacgtctctaagtcaaggtaccttccaacagtggtggaatatcctaactccgctgcactcaggatgctgggtagccgggcactggctcaacagtggcggggaacttccagtgggtttggacgaccacagactatgctgggtgaggactcagccccaggtaacgggccacgtaagtgttctcagaccctgatgggatttaagactaagaccgaaactgaacacagcgtgcgtggctggaagcccagaggcgctctgcagaatcagtctgtgctatcaacctcctggtcacattggcccccaaagcctcggcgtacaagcagtacgccagagccatcctag

SEQ ID NO: 10820 - DNA, 3663 bp, Artificial Sequence
  Description of Artificial Sequence: Synthetic coding sequence
atgccagggctcctaaactggatcacaggcgcagccctccctttgacagcctctgacgtcaccagctgtgtgtccgggtacgctcttggcctgaccgcttctcttacatacggaaatctcgaagctcagccttttcagggtctgtttgtgtaccctcttgacgaatgtaccaccgtcatcggattcgaggcagtcatcgctgatagagtggtcaccgtgcaaattaaagacaaggcaaaactggagagtggccattttgacgcttcccatgtccggtctcccaccgtgactggcaacatattgcaggacggcgtgtccatcgctcctcacagttgcacgcccggaaaagtaacactggacgaggacttagaacgaatactattcgtggcaaacctcggaacaatcgcccctatggagaatgtgactatattcattagcaccagttcagagcttcctaccctcccaagtggcgctgtaagagtactcctcccggctgtttgtgcccctacggtgccccagttctgtacgaagtctacaggaacgtcaaaccaacaggcacagggaaaggatcggcattgttttggagcctgggctcctggcagttggaacaagctgtgcctcgccactttactgaataccgaggtttcaaatcccatggaatacgaatttaattttcagctcgagattcgcggaccgtgtctgttggcaggtgtggagagccccacccacgagatcagagcagacgccgctcctagtgccagatctgcaaagagtatcataattactctggccaataaacacacttttgatcgtcccgtcgagattctcatccatccgtcagagccgcacatgcctcatgttctgattgagaagggcgatatgactttgggagaatttgatcagcatttgaaaggacggaccgactttattaagggcatgaaaaagaaatctagagcagagcggaagaccgagataatccggaagaggttgcacaaagatatcccgcatcacagcgtaatcatgctgaacttctgccctgatttacaaagtgtgcagccatgcctacgaaaggcccacggggaatttatttttctcatcgatagaagttcatccatgtccggaatctccatgcatcgagtgaaggatgccatgctggtggctctgaagtccctgatgcctgcatgtttatttaacatcattggcttcggctcaaccttcaagtctctattccccagttcacaaacttatagcgaagatagtctggccatggcctgcgatgacatacagagaatgaaggctgacatggggggaaccaatattttgagccccttaaagtgggttattcggcaacctgttcacagaggacacccccgactgctcttcgtgattaccgatggcgctgtgaataacactgggaaggtcctcgaactggtgcggaaccacgcattttccacacggtgctatagcttcggtatcggacccaacgtgtgtcaccggcttgtaaaaggattggcctcggtctcagaagggtctgctgaactcttgatggaaggggagaggcttcagccgaagatggtcaaatcactgaagaaagccatggcaccagtgctttctgatgttacagtagagtggatatttccagaaaccactgaggttctggtcagccccgtttcagccagcagcttgtttccaggagaacgccttgtgggttatggaatagtgtgtgacgccagcctgcacatcagcaacccacgcagcgataaacggagacggtattccatgctgcactctcaagaatctggctcctccgtgttctaccatagccaagacgatggaccaggcctcgaggggggagattgcgccaaaaatagcggcgctcctttcatcctgggacaagccaaaaacgcgcgtttagcttcaggcgacagcactacaaaacatgatctgaacctcagccagcggcgacgggcatactcgaccaatcaaatcaccaatcataaaccgctgcccagggccactatggcatcagatccgatgcctgccgctaagcgctatcctctgaggaaagcgcgtctgcaagacttgaccaaccagacttccttggacgtgcaacggtggcagatcgacctgcagcccctccttaatagtggccaggaccttaaccagggacctaagctgcgagggcctggagccagacgtccctcactcctcccacagggttgtcaaccattcctcccatgggggcaggagacacaggcctggagtccggtgagggaaagaacctccgactctagaagtcccggagatcttgagccatcccaccacccatcagcgtttgagaccgagacatcatcagactgggaccccccagccgagtcccaggagcgtgcctctccctccaggcccgctaccccagccccagtactcggcaaggccctggtgaagggcctgcatgacagccagaggctccagtgggaagtgtccttcgagttgggaacccccggacccgagcgcggtggtgcacaggacgctgatttatggtctgaaacatttcaccatctggctgctcgggctattattcgtgacttcgagcagctggcagagagagaaggcgagattgagcagggatcaaaccgtcgctatcaggtgagcgcccttcacactagcaaagcctgcaacatcatatccaagtatacagctttcgtacccgtggatgtgagcaagtcccgctacctccctaccgtcgtggaatatccaaattcggccgctctccgaatgctcggctccagagccctcgctcagcaatggaggggcacctcgtccggcttcggtaggccacagacaatgctgggtgaagacagcgcaccaggcaatgggaaattccaggccttaaatatggaagcttcccctacagcgctgttctcggaagccaggtctcccggtagggagaaacacggcgcatcagaaggccctcagcgctccttggccactaatactctttcgagcatgaaggccagtgaaaacctcttcggttcatggttaaacctgaacaagtctcgcttgctcacacgcgcagctaaggggttcctgtctaaacctctcatcaaggccgtcgagagcacttccgggaatcagagtttcgattacattccattagttagcctgcagcttgcctctggtgcctttttgttgaacgaagccttctgtgaggcaacccacattcctatggaaaaactgaaatggacttcacccttcacttgccaccgcgtatccctaacaactcgtccgtctgaatctaagactcccagcccgcagctctgcacatcctcacccccaagacatccatcctgtgactcgttctcattggagccacttgctaagggtaagttaggccttgagcctcgggctgttgttgaacataccggcaagctgtgggcaacagtggtaggcctagcgtggttggagcactcgagcgcctcatattttacagaatgggaactcgtcgcagccaaagctaattcctggctggaacagcaagaagtgcccgaaggacgcacacaggggacccttaaagccgctgcccgtcagcttttcgtgctgttgagacattgggacgagaacctggaatttaacatgttatgctataatcccaattacgtgtag

SEQ ID NO: 10821 - DNA, 5234 bp, Artificial Sequence
  Description of Artificial Sequence: Synthetic coding sequence
atgcgacttctgtgggggctcatctgggcctccagttttttcacattgagtctgcagaagccacggctgctgctgttctctcccagcgtggtgcaccttggtgtgccactctctgtgggtgttcagctgcaggacgtaccgaggggccaggtggtcaaaggaagcgtattcctgaggaatccgtcgcggaacaatgtcccatgctctccaaaagtagacttcaccttgtcctctgagcgagactttgcgttgctgtcactacaggtgcccctaaaggacgctaagtcttgcggactccaccagctgcttcgcggtccagaggttcagctcgtcgctcattctccatggctcaaggattccctttcacgcacaacgaacatacagggaatcaacctccttttctcctcacggcgaggccacctgttcctccagactgatcaacctatatataatccaggccagagagttcgttacagggtgtttgctctcgatcaaaaaatgaggccttccaccgacacaattaccgtaatggtggagaactcacatggtctccgagtaaggaagaaggaggtgtatatgccatccagtatttttcaggacgatttcgtgatccctgacataagtgaaccgggaacctggaaaatctctgcacgcttctctgacggtctggaaagcaatagcagcacccagttcgaggtgaagaaatatgtgttgcctaatttcgaagtgaaaatcactccaggcaaaccctacattctcacggtaccgggacacttagacgaaatgcaactggatatccaggcacgatacatctatggaaagcccgtgcagggcgtggcttatgtgcggttcggcctgctcgacgaggatggcaaaaaaactttcttccgtggattggaatcccagaccaaactggtgaacggccaaagccacatcagtttgtctaaggctgaatttcaggatgctctggaaaaactcaacatggggatcaccgatctgcaaggcctgcgcttgtatgtagccgcagccattattgagtaccctggtggagagatggaggaggccgagttgacatcctggtatttcgtgagtagtccgttttcactagatctgagcaagacaaaacggcacctagtgcctggggcaccatttctgctccaggccctcgtccgtgagatgagcgggtctcctgcttccggcattccagtcaaggtctctgctactgtgagctctcctggttctgtgcccgaagtccaggatattcaacagaacacagatggttctgggcaggtcagtatcccgattataatacctcagacgatctctgagctccagctgtccgtttcggctggctcacctcatcctgcgatcgccaggctgactgtcgcggctccaccgtcgggagggccaggcttcttgtcaatcgagcgtcccgacagccgaccaccccgagtcggagataccctgaacctgaacctgagagctgtggggtcgggggctactttcagccactactactatatgatcctttctcggggacagatcgtgttcatgaaccgagaacctaagcggactctcacaagtgtgagtgtatttgtcgaccaccatctggcacccagcttctatttcgtggcattctactatcatggagatcacccagttgcaaactcgcttcgggtggatgttcaggctggggcttgtgagggcaagctcgagttgagtgtggatggtgccaagcagtacagaaacggagagagcgtgaagttgcatcttgaaactgattcccttgccctggtggccctgggcgcactggacactgctctctacgctgcaggatccaaatcgcataagccactcaacatgggaaaggtctttgaagctatgaactcatacgacttgggctgcggccctgggggaggcgactctgccctgcaggtttttcaagccgcagggctggcgttctccgatggggaccaatggacactgtctcgcaaaaggctgtcatgtcctaaagagaagaccaccagaaaaaaaagaaatgtcaactttcagaaggccatcaatgagaagttaggacaatacgcctcaccaacggccaaaagatgttgtcaggacggcgttactcgtctccccatgatgagatcatgtgagcagagagcagctagggtgcaacagccagattgtagggaaccgttcctgtcctgctgtcagtttgcagagtccctacggaaaaaatccagggacaaaggccaagcagggctacagcgagcgctcgaaattctgcaagaagaggatctaattgacgaagatgatattccagtccggagcttcttccctgaaaattggctgtggcgcgtcgagaccgtggacagattccagatcctcacactgtggctacctgatagtctcacaacctgggaaatccacggcctgtccttgtctaaaacaaaaggactctgtgtggcaactccggttcagctgagggtgttccgcgagttccatcttcacttgaggctccccatgagtgtccggcgattcgaacaacttgagctgagaccagtcctgtacaactacctagacaagaacctgacagtgagcgtccacgtgagtcctgtggaagggctgtgcctggcaggcggtgggggactcgcacagcaggtcctcgtccctgccggtagcgcacgccctgtggccttttctgtagtcccaactgctgccgcagccgtgtccctcaaagttgtcgccagaggttcctttgagttccctgtcggcgatgcagtgtctaaagtgctgcagattgagaaagagggcgcaatacacagggaggaactagtatatgaacttaaccccttggaccaccggggtcgcactctggaaattcccggtaacagcgatccgaatatgattcccgacggggacttcaacagctacgtacgtgtaacagcatccgatccactggataccttggggagcgagggcgcattgtcgcctggtggggtggcctctctccttagactgccacggggatgtggggaacagacaatgatctacttggcccctacactcgccgcttctaggtatctggataagaccgaacagtggtctacgctaccgcctgaaaccaaggaccacgccgtggacttgattcagaagggctacatgagaatccaacagttccgaaaagccgacggctcctatgctgcttggttgtccagaggcagcagtacatggctaactgcatttgtgttgaaggtgcttagtttggcacaggaacaggttggtggtagtcctgaaaaacttcaggagacttctaactggctcctgtctcagcagcaagccgacggtagcttccaggatcttagtccagtcatccatcggagcatgcaaggagggttggttgggaatgatgaaacggtggcattgaccgcatttgtgacaatcgctctgcatcatggactcgccgtgttccaggacgagggcgctgagcctttgaagcaacgcgttgaagcgtccattagcaaggctagttcctttctcggcgagaaggcgtctgcaggattattgggggctcacgcggctgctatcaccgcgtacgcactcacactgactaaggccccagccgacttgagaggcgttgcccataacaatcttatggccatggcacaagagacgggagataatctctactggggttctgtaaccggatcacagtctaacgccgttagccccaccccagctccccgaaacccgagtgacccaatgccacaggctcctgctctttggatcgagactacggcttacgccctgctgcaccttctgttacacgaaggcaaggccgagatggccgaccaagccgctgcatggctaactagacagggcagctttcagggcggatttagaagcacgcaggatacggttatcgcccttgatgctctctctgcatattggattgcctcgcacaccacagaagagcgtgggctgaatgttacactctccagcaccggacggaatggattcaagtcccatgcactgcagttgaataacagacagatccgtggactggaggaggagttgcaattttccctgggctcaaagattaacgttaaggttggaggcaatagcaagggcacactgaaagtgttaaggacctacaatgtgttagacatgaaaaacacgacttgccaggatttgcagattgaagtaactgtcaagggacatgtggagtatacgatggaggcaaatgaggattacgaggactatgaatatgatgagctacctgcaaaggatgatcctgacgctcctctgcagccagtcacacctctgcagctgtttgaaggcaggaggaatagacggcgacgagaggctccaaaggtagtggaagagcaagagagtagagtccactacaccgtctgcatctggaggaacggtaaggtcggactgtcagggatggccatcgcggacgttaccttgctgagcgggttccacgccctgcgagcagatctagagaaattgacaagtttgagtgaccgctacgtgagtcactttgagacagaaggaccccacgtcttactgtacttcgatagcgtccccacctctcgcgaatgcgtcggattcgaagcagtccaggaagtgcctgtgggtctggttcaaccagcctccgcgaccctgtacgactattacaatcctgaacgacgctgctccgtgttctacggcgcaccttcaaagtcgaggctgttggccacactttgcagtgcagaggtgtgtcagtgcgccgagggcaagtgtcccagacagagacgcgctctagagagaggcttacaagatgaagatggctacagaatgaaatttgcctgctattatcccagagtagagtatggtttccaggtgaaggtcctgcgggaggactctagggctgctttccgactcttcgaaacaaaaatcacccaggtgcttcactttaccaaggacgtgaaggctgctgcaaatcagatgagaaactttctcgtgagagcttcttgccgactcagactggagccagggaaggagtacctgatcatgggactcgacggcgcaacctatgatttggaaggacatcctcaatacttgctggatagtaacagctggatagaagagatgcccagcgagagactatgccgcagcacaagacaacgtgccgcttgtgcccagctcaatgattttttacaggaatatggcacccaggggtgtcaggtcta

SEQ ID NO: 10822 - DNA, 1242 bp, Artificial Sequence
  Description of Artificial Sequence: Synthetic coding sequence
atgaagggagccttaggctccccagtggcagccgctggggctgcaatgcaggaaagctttggctgcgtcgtggccaataggtttcatcagctcctggacgacgaatctgacccattcgacatcctccgcgaggctgaacggagaagacagcaacagctgcagcgaaaaagaagagacgaagccgctgccgcagctggggctgggcctcgaggaggcagatcccccgctggtgcgtccggccatagggcgggtgccggaggacggcgagagagccagaaggagcgaaagtccctgcccgctcctgtagcgcaaagacccgacagtcccggtggcggactgcaggcgcctgggcagaaacgtacgcccaggagaggagagcagcagggttggaacgactccaggggtccagagggaatgctggaaagagcagaacgccgatcttatcgagagtataggccatacgaaacggaacgccaggcagactttactgctgaaaagttccccgatgagaaacccggagaccgcttcgaccgcgaccggccattacgaggcagaggcggtcccagaggcggtatgagaggacggggtagagggggacctggcaaccgagtgttcgatgctttcgaccaacgtggcaaacgggagttcgaaaggtatggcggtaacgataagattgctgttcgcaccgaagataatatgggcggttgcggagtacggacttgggggtccggtaaggataccagcgatgtagaacccactgcgccaatggaggaacccactgtggtagaggaatcccagggcacaccggaggaggaatctccggctaaggttcctgagctcgaggtcgaagaagagactcaagttcaggagatgaccctggacgagtggaagaacctgcaggaacagacccgcccaaaaccagagtttaacatcaggaagccagagtcgacagtgccttccaaggcggtggttattcacaagtcaaagtatagagatgatatggttaaggatgattatgaagacgactcgcacgtgtttcgcaagccagctaatgacataacctctcaactcgaaatcaacttcggaaacttgccccgacccggacgcggtgctcgagggggaaccagaggcggacgcggtcggattagaagggctgaaaattatggcccacgcgcagaggtggtgatgcaagacgttgcacctaaccccgacgatccagaggacttcccagccctcagctag

SEQ ID NO: 10823 - DNA, 927 bp, Artificial Sequence
  Description of Artificial Sequence: Synthetic coding sequence
atgaaaggtgccctgggatctccagtggccgcagccggagccgctatgcaggaatcctttggttgtgttgtcgctaaccgcttccatcagctactggacgacgaatccgacccgtttgatatcctgcgcgaagccgagaggcggaggcagcaacagttgcagcgcaagcggcgtgacgaagcagccgctgccgcaggggctgggcctcggggtgggaggtctccagccggagcttctggacatcgcgctggagccggaggaagaagggaaagccagaaagagagaaaatccctgccagctcctgttgcccagagacccgatagcccaggcggtgggctgcaggccccaggccagaaacgcaccccgcgaaggggtgaacagcagggttggaacgattcccggggtcctgaggggatgttagagagggccgagcgccgatcctatagggaataccgtccttacgagacagagcgccaggcagatttcaccgcagagaagttccccgatgagaaggtgccagagctggaagtcgaggaggaaacccaggttcaggagatgaccctcgacgaatggaagaaccttcaggagcagactagacctaagcccgagttcaatatacgcaagcccgagtcgaccgttcctagcaaggcagtcgttatccacaaatcaaagtatagagatgatatggtgaaggacgactatgaggatgactcccacgtgtttagaaaaccggcaaacgacattacctctcagctggagatcaactttggcaatctccctagaccaggaagaggagccagaggcggaactcggggtggtcggggaaggataagacgggctgaaaactacggacctcgcgcagaggttgtcatgcaggatgttgcgccaaacccagacgatcccgaagattttcccgctctttcgtag

SEQ ID NO: 10824 - DNA, 1437 bp, Artificial Sequence
  Description of Artificial Sequence: Synthetic coding sequence
atgccacgtcgtggttactctaaaccaggcagttggggatccttctgggctatgttaacgctcgtgggtctggtgactcatgctgcacagcgggctgacgttgggggtgaagcggcaggaacctcaatcaaccatagtcaggccgtccttcaacgcctacaagagctgctgcgccaagggaacgcgagcgatgtagtactccgagtgcaagcggcaggcacagacgaagtgcgagtgttccacgcacacagactactattagggctgcattctgagcttttcctggaactgctgtccaatcagtctgaagccgtcctccaggagccacaggactgtgccgcagtgttcgataagtttatcaggtacttgtactgcggtgaactaacagtgcttttgacccaggcgattcccctacatcggctggcgaccaaatacggtgttagctctctgcagagaggcgtggctgactacatgagagctcacctggccggtggagctggccctgcagtcggctggtaccattatgctgtgggtacaggcgacgaggccctgagagaatcctgtcttcagtttctggcttggaatttaagtgctgtggcggcaagtaccgagtggggggctgtcagtcctgagctgctatggcagttgctgcagaggagtgacctcgtactgcaggatgagctagaactgttccacgccctggaagcctggctcggcagagccaggccacctccagctgtggccgagagagcactccgggcaatcagataccccatgattccgcctgcccagctgttccagttgcaggcccgatccgccgctcttgctaggcacggtccagctgtggctgatctccttctgcaggcctaccagtttcatgcggcttcccccctgcattacgctaaatttttcgatgtgaatggatcggctttcctcccacggaactatcttgctcctgcatggggtgccccttgggtaatcaataacccagctagagatgaccgatccacctcgttccagacccaacttggacctagcggtcatgacgcagggaggcgcgtcacctggaatgtgttattcagcccccgatggctgcctgtctcactgaggcctgtgtatgcggatgcagctggcacagccctccccgcagctagacctgaagatggcaggccgaggctcgtggtgactcccgctagtagtggaggtgacgcagctggcgtctcatttcagaagactgtccttgtcggggcaagacaacagggcagactgctggtccgacacgcctattcttttcaccagtcgtccgaggaggccggagatttccttgcccacgccgacttacagcgacggaattcagagtaccttgtggagaacgcacttcatctgcacttgattgtcaaaccagtgtaccacactctgattaggacacccaagtag

SEQ ID NO: 10825 - DNA, 477 bp, Artificial Sequence
  Description of Artificial Sequence: Synthetic coding sequence
atgtgttgcccgggaggccattacaccttgatcctccggaggggcaacaggttcagacgtgagaagagacctgcaaaggtgaccggggctcagaccgaggtacagctggccccacctctaccgagggggagggcacgcaggagcccatggagtgtgccaatatccctgtctattgaccgccttgagttcgacctgctgtaccccgctatcaagggagacaccatccagctgtacctgggtgcaaagcttctggacagtcagggcaaagtcactaaatggttcaacaattctgctgcttctctgacgatgccgaccctggataacatcccatttagcctaattgttagccaggacgtggtgaaagctgctgttgccgctgtgctcagtcctgaggagtttatggtattgttggatagtgttctgcccgaatccgcacacaggctgaagtcctccatcggactaataaatgagaagtag

SEQ ID NO: 10826 - DNA, 771 bp, Artificial Sequence
  Description of Artificial Sequence: Synthetic coding sequence
atgtttcagaccggaggcctgatcgtcttttatggcctcctcgctcaaacgatggcccagtttggaggtctgccagtgcctctcgaccaaacactacctctcaatgttaaccctgctctacctctttcccctactggtctggccggatcacttacaaatgcattaagcaatggtctcctatcagggggactgctgggcattcttgagaatcttcccctactggatattctgaagccaggtgggggaacctcgggtggtttattgggtggactgctcggaaaggtgacatcagtgattccagggctcaataacataatagatatcaaggtgacagatccacagttgttggagctgggcctggtccagtcacccgatggccatagactttacgtcaccatccccctagggattaaactgcaagtcaacacacctctcgtgggagcctctctattgcgactcgctgtgaaactcgatattaccgctgagattttggccgtcagggacaagcaggagcgtattcatctcgttttgggcgactgcacacatagccccggttccttacagatctcactgctcgatggcctggggcctctgcccatacaggggctgctggacagtctcacagggattctgaacaaggtcttgccagagctggtccagggcaacgtctgtcccttagtgaacgaggtcctgcggggtctcgatattacactggtccacgatattgtgaacatgctaatacatggccttcagtttgtcattaaggtatag

SEQ ID NO: 10827 - DNA, 771 bp, Artificial Sequence
  Description of Artificial Sequence: Synthetic coding sequence
atgttccagaccggaggactgatcgtcttttatggactcctggcccaaacgatggctcagtttgggggactgcctgttccactggatcaaacccttcccctcaatgtcaatccagctctgcctctttcacctacaggactcgccggttcccttaccaatgccttgagcaatggcctcctgtccggcggactgctgggtatcctagaaaacttgccgctgcttgatattctgaagccgggagggggaactagcggaggcctcctaggcggtctactgggaaaagtgaccagcgtcatccccggactaaacaatataattgatattaaggtaaccgacccccagctgctcgagctgggactggtccaatcgccggacgggcaccggttgtatgtaacaatccctctagggatcaagctgcaggtcaacacccctctggtgggcgcaagtttgctgagactggcagtaaaattggatatcactgcggagatacttgctgtccgggacaagcaggaacgcatccatctggtccttggcgactgcactcattcaccagggtcgctccagatttccctgttggacggcttgggacccttgccaattcaaggactgctagacagtctgaccggcatcctgaacaaagtgctgcctgagctcgttcaggggaatgtctgccctctggtcaatgaggtccttcgaggactcgatattacccttgtgcacgatatcgtcaacatgttgatacacggactccagttcgtcattaaagtctag

SEQ ID NO: 10828 - DNA, 657 bp, Artificial Sequence
  Description of Artificial Sequence: Synthetic coding sequence
atgatgtgtccactctggcgactgcttatattcctcgggctcctggcgctgcctctcgcccctcacaagcagccgtggccaggcctcgcccaggcccatcgtgacaataagagcaccttggcacgtatcatcgcccaaggtctcatcaagcacaatgcggagagccggatccaaaatattcactttggggacagattgaacgcttccgcccaggtcgcccctgggttagttggttggcttatcagtggcaggaaacatcagcaacagcaggagagtcgctcctttgacaataatatcgtgaagatgtgtgctcatatgagcatcgtggtggaattctggctggagaaggatgaatttggaagaagagaccttgtgatcggaaaatgcgacgcagagccaagttccgtgcacgtggccatcctgaccgaagccatacctccaaaaatgaatcagtttctctacaacctaaaagaaaatctacagaaggttcttccacatatggtggagtcgcaggtttgtcctctgataggggaaatactcgggcagcttgatgtgaaattactgaagagcctgatagagcaggaagcggcacatgaacctactcaccacgagaccagccagccgagcgcatgccaggccggagagtcacctagttag

SEQ ID NO: 10829 - DNA, 765 bp, Artificial Sequence
  Description of Artificial Sequence: Synthetic coding sequence
atgatgtgccccctgtggaggctcctcattttcttggggcttctggcactgccattagctccccacaagcagccctggccgggactggcgcaagcccatagagataacaagtctactctggctcgaattattgctcaaggcctcatcaaacataatgctgagtccagaatccagaatatccatttcggtgatcgactgaacgcttccgctcaagtcgctcctgggttggtcggttggctaatttcgggccgaaaacatcaacagcagcaggagtcatcaatcaatatcaccaatatacagttggattgcgggggtatccagatctcctttcataaggagtggttctccgccaatatctcgcttgaattcgatttggagctcaggccatcttttgacaacaacattgtcaaaatgtgcgcccatatgagtattgtggtggaattctggctggagaaagatgagtttgggaggcgtgatcttgtaattggaaaatgtgatgctgagccaagcagtgtccatgtcgctattctcactgaggcgatccccccaaaaatgaaccagtttctgtacaatctcaaagagaatctgcagaaagtgttgccccatatggtagagtcacaggtttgccctctgataggggagatactaggccaactggacgtgaagctgttaaaatcgctgatcgagcaggaggcagctcacgaacctacccatcatgagacttcacagccttctgcctgtcaagccggtgaatcgccaagctag

SEQ ID NO: 10830 - DNA, 1635 bp, Artificial Sequence
  Description of Artificial Sequence: Synthetic coding sequence
atgaaaatctccatgatcaattacaaatccctgctggcactactgtttattctggcatcctggatcattttcaccgtgtttcagaactctaccaaggtgtggtccgcccttaacctatcaatttcattgcactattggaacaactctacaaagtccttgtttccgaaaacccctcttattagtcttaaacccttaacagagacagagctgagaatcaaagagatcatagagaagttggaccagcagattccccctcggcctttcacccatgtcaataccactacatccgcaacacatagcaccgctacgattctcaatcctcgggatacatactgccggggagatcagcttcatatacttctcgaggtgcgggatcacctggggagacgtaagcagtatggtggcgattttctcagggcccgtatgtcctccccagcactgatggctggggctagcggcaaagtgaccgactttaataacgggacatacctcgtgtcgtttaccctgttttgggaggggcaggtgtcattatctctcctgctaatccatcccagcgagggagtaagcgcactgtggtccgctaggaaccagggttacgacagagttatcttcaccggacagtttgtgaacggaaccagccaagtccactccgagtgtggattgatattgaacactaacgctgaactctgccagtacctagataatcgagaccaggaggggttctactgcgtacgccctcagcacatgccctgcgcggcactgacacacatgtacagcaagaataagaaggtctcctacctgagtaagcaggagaagagtctgttcgagcgaagcaacgtgggagtggagatcatggaaaagttcaacaccatctcggtctctaagtgcaacaaggaaacagtcgccatgaaggaaaaatgcaagtttgggatgacttccaccatcccttcaggacacgtgtggcgcaacacatggaatcccgtgtcatgttctctagcaactgtcaaaatgaaggaatgcctgcgaggtaaactgatttacctcatgggtgattcaacaattagacagtggatggaatactttaaagcgagtataaacacgctgaagagtgtagacttacatgagtctgggaaactccagcaccagctggctgtcgatcttgaccggaacattaatatacagtggcagaaatactgttatcccctaattggaagcatgacctattctgttaaagagatggagtatctgacaagagccatcgacaggacgggtggcgagaagaacacagtcatagtcatcagtttaggacagcacttccgaccatttcccatcgacgtgtttatccggagagctcttaatgttcacaaggcaatacaacacctgctgctccggtcccctgatactatggttatcattaaaacagagaatatccgggaaatgtataatgacgcagaacgcttctccgacttccatggctatattcagtatctgattatcaaggacatatttcaagacttgtccgtgtctataatcgatgcttgggacataaccatagcttacggaaccaataacgtgcaccctccacagcacgtagtcggtaatcagatcaatatcctgttaaactacatctgttag

SEQ ID NO: 10831 - DNA, 1845 bp, Artificial Sequence
  Description of Artificial Sequence: Synthetic coding sequence
atgtggatggcctggtgtgttgcagccctgtccgtcgtggcagtctgtggtacttctcacgagacgaacacagttctaagagtgaccaaagacgtcctgtctaatgcgatctccggcatgttgcagcagtctgacgccctgcacagtgccttgcgagaggttcctcttggtgttggagatattccatacaacgattttcacgtgcgtggccctccacccgtgtataccaatgggaagaagttggatggcatctaccagtacggtcacatcgaaaccaacgataacactgcccagctgggcggaaagtatagatacggagagattctggagtcagagggatctatcagagacctgcgcaacagtggctatagaagcgctgaaaacgcttacgggggacacaggggactgggaagataccgggctgccccagtgggaaggttgcaccggagagagctgcaaccgggagaaattcctccaggggtggccaccggagctgtcggcccaggtgggctactgggcacgggaggcatgttagccgcagacgggatcctggccggtcagggcggattgctgggagggggaggtctcttaggagacgggggactactgggcggagggggagtgcttggcgtgctgggcgagggtggcattctaagcactgtgcaaggaatcactggcctccgcattgttgaactaacactaccaagggtgagcgtgcggttgctgccaggcgtgggcgtatacctgagcctctacactagagtggcaattaatggaaagagtctgattggcttcctcgacatcgcggtggaagtgaatatcaccgccaaggtgcggcttaccatggatcgaaccggctaccctcggttggtaattgagcggtgtgatactcttttaggcggaataaaggtgaagttgctgcggggactgctgcccaacctcgtggacaacctggttaacagggtgctggctgacgtgcttccagatctgctgtgcccaattgtagatgtggtccttggccttgtaaatgatcaactgggattggtggactctctcattccactggggattcttggtagtgtccagtacacttttagttccctaccgctggtgactggtgaatttctagagctcgacttaaacacacttgtgggagaggccggagggggactgatcgactaccctctcgggtggcctgccgtgagcccaaagcctatgccggagttacctcctatgggggacaataccaagtcccagctagcaatgtcggctaattttctgggatctgtgctcacattactgcaaaaacagcatgcccttgatttagatatcaccaacggaatgttcgaagagctccctccattgaccaccgccacattgggcgctctgatccccaaggtgttccagcagtacccagaatcctgtcctcttatcatccgcatccaggtattgaacccgccatccgtgatgttgcaaaaggataaggcattggttaaagttctggccacagcggaggtaatggtgtctcagccgaaggatttggaaaccaccatttgtttgatcgacgtggatactgagttcctggcatcattctccaccgagggcgacaagctcatgatagacgcaaagctggaaaaaacgtcactcaacctccgcactagcaacgtgggcaactttgacataggactgatggaagtcttggttgaaaagatcttcgacctggccttcatgcctgctatgaacgccgtattaggcagcggagtgccacttcctaagattctgaacattgatttttcgaacgcggatatagacgtgctggaggacctactggttctcagcgcctag

SEQ ID NO: 10832 - DNA, 1431 bp, Artificial Sequence
  Description of Artificial Sequence: Synthetic coding sequence
atgcaaccggtcatgctggcgctgtggagtctgctgttattatggggactggcaacgccttgtcaggaactgctagaaactgttggtaccctcgcacgcatagacaaagatgagttggggaaagccattcagaatagcttagtcggcgagcctattcttcagaacgtgctaggatctgtgacagctgtcaaccgtggactcctaggctctggaggattgctggggggtgggggattgcttggccacgggggagtgtttggggtggtggaggaactgagtggactaaaaatcgaagagctcacgcttccaaaggtcttactcaagctgttaccaggttttggcgtccagctgagcctccataccaaggtggggatgcactgcagcgggcctttggggggtctcctgcagctcgcggctgaggtgaacgtcacaagcagagtagcgctcgcagtaagctcacgtggcacaccaattttgatcctgaaaaggtgcagcaccctgctgggccatatctccttgtttagcggcctcctgccaacccctctcttcggcgttgtggaacagatgctgtttaaggttctgcccggactgctctgccctgtcgtggactcagtccttggagtggtgaatgaactgttgggcgcagtcttgggactggtaagtttgggagctctgggaagtgtggaattctccttagcgaccttgcctttaatttcgaatcagtacattgaactcgacattaatcccatagtgaaatccgttgctggggatattattgactttccgaagtcaagagcccctgccaaagtccctcccaaaaaagatcacacatctcaggtcatggtcccactctatctcttcaatactacttttggactgcttcagactaacggtgctctggacatggatataacccctgaattggtgccctctgatgtgcccctcacgactacggacctcgctgctctcctccctgaggctctcggaaagctccccctccatcagcagttactgctcttcttgagagtgagggaggcccctacagtgactcttcacaataaaaaggcacttgtatcgctccccgctaacatccatgtgttattttatgtcccgaaaggcactcctgaatctctgttcgaactgaactcggtcatgacagttagggctcagctggccccatcggctaccaagctccacattagcttgagcctcgagaggctgtccgtaaaggtcgcttccagcttcactcacgcatttgatggctcccgcctcgaggaatggctgtctcatgtagtaggagctgtgtatgcaccaaagttaaacgtcgcccttgatgtgggtatacccctacctaaagtactgaacattaatttcagtaattcagttttggaaatagtcgagaacgccgtcgtgctgaccgttgcctcatag

SEQ ID NO: 10833 - DNA, 585 bp, Artificial Sequence
  Description of Artificial Sequence: Synthetic coding sequence
atgcaggatgccccattgagttgtttgtcgcccaccaagtggagctctgttagttccgccgattccacagagaagagtgcttccggagctggcacgcgcaacctcccctttcagttttgtctgcggcaggcactgcgcatgaaggctgccggtatcctgactctcattggctgtctggtgacaggtgcagagtcgaaaatctatacacggtgcaaactcgcaaagattttttcccgcgctggcctagataactattggggattcagcttgggcaactggatctgtatggcttactatgaatcaggttataataccacagctcagacggttttggacgatggcagtatagattacggaatctttcaaatcaactccttcgcatggtgtaggcgcggaaagctcaaagaaaacaaccactgccacgtggcctgttccgcattgatcacggacgacttaactgatgctattatttgcgcccgaaagatcgtcaaggagacacaaggcatgaactattggcagggctggaaaaaacactgcgaaggacgagacttatccgagtggaaaaaagggtgcgaagtatcctag

SEQ ID NO: 10834 - DNA, 1266 bp, Artificial Sequence
  Description of Artificial Sequence: Synthetic coding sequence
atggggtttctaagccctatctacgtcatttttttcttctttggagtgaaggtgcactgccagtatgaaacataccagtgggacgaggactatgaccaggaaccagacgacgactaccaaactggctttccttttcggcaaaacgtggactacggagtaccatttcatcagtatactcttggatgtgtaagcgaatgtttctgtcctactaatttcccatcctctatgtactgtgataaccggaagctgaagacaattccaaacatccccatgcatatccaacagctctacctccagttcaacgagattgaagctgtgactgctaatagtttcattaatgccacccacttgaaagagataaacttaagtcacaataaaatcaagtcccaaaagatcgactatggtgtgttcgcgaaactgcctaatctgttgcaactgcacctcgagcataacaacctggaagaattccctttcccgttgcctaagagcctcgagaggctacttttggggtacaacgagatctccaaactgcagacaaatgccatggatggcctcgtgaaccttactatgcttgacttatgctacaactacttgcatgacagcttgttgaaggataagatttttgcgaagatggaaaaacttatgcagctgaatctttgttccaatcgactggaatcaatgccacccggactcccaagcagcttgatgtatttgtccctggagaataactctattagcagtattccagagaagtacttcgataagctccctaagttgcacaccctccgcatgagccacaataaattgcaggacatcccctacaacatctttaacctccccaatattgtggaacttagcgttggtcacaataagctcaagcaagccttctacattcctcgcaatttggagcacttatacctgcagaacaatgagattgagaaaatgaacctaactgtgatgtgccccagcatcgatcccctccactaccatcacttaacgtatattcgcgtggatcagaacaaacttaaagaacccatcagttcctacatattcttttgtttcccccacatacacacaatctactacggtgagcagaggtccaccaacggacaaactattcagttgaaaacccaggtgtttcgaagattccccgacgatgatgacgagtccgaggaccatgacgaccccgacaatgctcatgagagtcctgaacaggagggcgcagagggccatttcgacctgcactattacgagaaccaggagtag

SEQ ID NO: 10835 - DNA, 252 bp, Artificial Sequence
  Description of Artificial Sequence: Synthetic coding sequence
atgctgtgttgctgccccttggcagatgccttacttattttcctcgagaccggatcatgttttcagcccggacagcagtcagaaaccctgtcacagaagcagaataagaccaataacaagaaatgggccggaggagccggatgtagaccctttaggttatggtgggtcggtaggagtcgcggagccggtgtccagctgtattcgacaaaaaaaggatggatactgcgaggaaagggagggaccgaagcatag

SEQ ID NO: 10836 - DNA, 2559 bp, Artificial Sequence
  Description of Artificial Sequence: Synthetic coding sequence
atgctgcctaccgaggtgcctcagtcccaccctggacctagtgctctccttctgctgcagctccttctgccgcctacgtctgcttttttccccaatatttggtcactactggcagcccctggttccatcacacatcaggatctcaccgaagaggcagcgctcaatgtgaccctgcaattgttcctcgagcagccccctcccggtaggccccctctaaggttggaggacttcctcggaaggaccttacttgcagacgacttgttcgcagcctatttcgggccaggatcatccagaagattccgagcagctctcggtgaggtgtcccgcgctaacgcagcccaggacttcttgcctaccagtcggaacgatcccgatctgcattttgacgccgagcggctcggacagggacgagcccgactcgtcggagccctgagagagactgttgttgcagcgagagcgcttgatcatactttagcccgacagagactaggagccgctctgcatgcgttgcaggacttttactctcactcaaactgggtcgagctgggagagcagcaaccccacccccacctgctgtggccacgtcaggagctgcagaatctggcccaggtagcagatcccacttgcagcgactgcgaagagttgtcttgtccacgtaattggctcgggtttacccttttaaccagtgggtactttgggacccaccctcctaagccaccgggaaagtgtagccacggagggcattttgataggagctcctcacagcccccaagaggcggaattaataaggacagcacatcccctgggttctccccacatcacatgctgcatttgcaagctgcaaagctggcgctgctcgcctccattcaggcctttagccttctgcgcagcaggctgggagatcgcgatttcagccgcctgctggatattacccccgcaagtagcctctcattcgtgctcgatactactgggtcaatgggcgaagaaatcaacgcggctaagattcaagctagacacctggtagagcagagacggggatcccctatggaaccagtgcattatgtgctcgtcccatttcacgatccgggatttggcccagtgtttactacaagtgatcctgactctttctggcagcagcttaatgagattcatgcactggggggtggcgatgagcctgagatgtgtcttagcgctctgcagctcgcgctgctccacaccccaccactcagcgatatcttcgtgttcaccgatgcctccccaaaagatgcgttcctcacaaaccaggttgagagcctgacacaagaacggagatgtcgtgtgacattcctagtaaccgaggatacttcacgtgttcaggggagagcccgtagggagatcctctcccctctgagattcgaaccctataaggcagttgccttagcttcagggggagaagtgattttcacgaaggatcaacacatccgcgacgtcgcggctatcgtcggagagtccatggccgcacttgtgacattgcctctagacccaccagtcgtggtgcccggtcagccgttggttttttcagttgacggcttgctccagaaaatcactgttcgcatccatggtgacatctcctccttctggatcaagaaccctgctggagtgtcacagggacaggaggagggaggaggcccactaggccacacccgccgttttgggcaattctggatggtgaccatggacgaccctcctcaaactgggacttgggagattcaagttacagccgaagacacccccggagtaagagtccaagctcaaactagcttagacttcctgtttcacttcgggatccccatggaagacggaccccatcccggactgtacccactcacacagccagtggccggactccagacccaactgctcgttgaggtaaccggcctggggtctagggcgaatcccggagaccctcagccccacttttctcacgtgatactccggggagtccccgagggagctgaactgggacaagtccctctcgagcctgttggaccccctgagcgtgggctcttggccgctagcctgagccccacgttactgtcgaccccacgacccttcagtttggaactgataggccaggacgccgcaggcagaagactgcatcgcgcagccccacaaccgtccaccgtggtgccagtgttgcttgaactgtccggacccagcggtttcctcgccccaggcagcaaagtcccactcagtctccgcattgccagcttctctgggcctcaagacctggacctgcgcacatttgtgaatccaagcttttctttgacaagcaatctgtccagggcccatcttgagttaaacgaaagcgcttggggtcggctgtggctggaggtgccagacagcgctgccccagatagcgttgtcatggtcacagttaccgcaggagggcgtgaggctaacccagtaccaccaactcacgcctttttaaggttactagtgtcggctcctgcacctcaagtgcgtaatcactatttcccatcccaaggaccagcccaccacccctatcggcttatttag

SEQ ID NO: 10837 - DNA, 2676 bp, Artificial Sequence
  Description of Artificial Sequence: Synthetic coding sequence
atgctcccaaccgaggtgccgcagtcccatcctggacccagcgctctcttattactgcaactcctactcccacccacatccgctttcttcccgaatatttggagcctattggccgcaccgggatccatcacccaccaggacctgaccgaagaagcggcactgaacgttaccctgcagctgttcttagagcaacctccacccggtagaccccctttgaggcttgaagattttctcggccgaactctccttgccgacgatctgttcgctgcctatttcgggccaggatcaagtcgtaggtttcgagcagccctgggtgaagtcagtcgggctaacgccgctcaggactttctccccacctctcgaaatgaccctgatttgcattttgatgccgaaagactaggtcaggggagggcaaggctcgtgggtgccttaagagagaccgtggttgcagcccgtgccctggatcatacactagccaggcagaggctcggagctgccttgcacgcgttacaagacttttattcacactctaactgggtagagctaggagaacaacagcctcaccctcacctgctctggcccaggcaggagctgcagaatctggcgcaggtggccgaccccacatgctcagactgcgaagagttatcctgccctcgcaattggttgggatttaccctgctgacttccggctacttcggcacacatcctccaaaacctcccggaaagtgttcacacggaggacacttcgatagaagttccagccaacccccacggggaggaattaataaggattcaacttctccgggtttctctccacatcacatgctccacttgcaggctgccaagctggctctcctcgcctctatccaagcgttctccctccttcgctctcgcctcggggatcgcgatttcagtaggctattggacatcaccccggcttctagcctaagcttcgtcctggatacaacaggttccatgggcgaggaaattaacgccgcaaaaatacaagccaggcatcttgttgaacagcgacgtggatctccaatggaacccgttcattacgtgttggtgccgtttcacgaccccggattcgggcctgtgttcaccacctccgacccagattctttctggcagcagttgaacgaaatccatgcattgggcggaggtgacgaaccggagatgtgcctgtcggctctgcagctagcgcttctgcatacgccaccactgagcgatatttttgtatttactgatgcgtcaccgaaggatgcttttttaaccaaccaggtggaaagtctgactcaagagaggcgatgtcgggtgacctttctggtcaccgaggatacctctagggtgcagggcagagctagaagagaaatcctgtcaccactgcgcttcgaaccttacaaagccgtcgccctagcttctggaggcgaggtgatttttactaaagatcaacatatcagagacgtagccgctattgttggagagagcatggctgcactcgtcaccttacctcttgacccgccagtggtcgtccctgggcaacctctggtcttttcggtggatggcctgctgcagaagatcaccgtgaggatccatggcgatatttctagtttttggatcaagaaccccgctggagtgagccaaggccaagaggaagggggtgggcctctggggcatactagaagatttgggcagttttggatggtgacaatggacgatccgcctcagacaggcacctgggaaatacaggtcaccgcagaggacactcctggcgtgagggtccaggcccagactagcttagacttcctctttcatttcggcatccctatggaggacggtccccacccaggcctgtatcccttgacccagcccgtagccggactgcagacgcaactcctggtggaagtgacaggacttggctcccgcgcaaatccaggtgacccacagccccactttagtcacgtaatccttagaggcgtgcccgaaggggcagaactggggcaggtccctcttgaacctgtgggacctcctgagcgcggtttactggctgcatccctgagcccaactctgctgagcacaccgcgaccgttttccttggaactgattggacaggatgctgccggacgacgcctacacagggccgctccccagccttccaccgttgtgcccgtgctcctagaactgagcggaccttctggcttcttggctcctggctcaaaagtgccgctgtctctgcgcatcgcctctttctctggaccacaggatttggatctgaggacctttgttaaccctagtttttcactgacgtccaacctgagcagagctcatctggaacttaacgagtccgcatggggcaggctgtggctggaagttccagatagcgctgcacctgactctgtggtaatggttaccgtgacagctggtgggcgtgaggcgaacccagtaccccctacgcacgcattcctgagattgctggtctctgccccagcaccgcaggaccgtcacaccaccccaactggtagcagcgaccccatccttaccactgccactccagccttttcaccctttaccctggtgacacagggaagagctggtgcaggtctggctgcaggcagtccgtggtggggcacagtgggtggagtactcctgttgttgggcctggcaagttggtag

SEQ ID NO: 10838 - DNA, 552 bp, Artificial Sequence
  Description of Artificial Sequence: Synthetic coding sequence
atggtcaggatctggaccactattatgattgtgctgatcctgcttttgaggatcggccctaataaaccaagcttgtctggccgtcaggctccagcccaagcccaaacctcagacttggtgccttccctcttcccccttgggctttgggcacctgggttttgtacctggagttctccagatgaagataaacggcctaggaagccagttcccggtacaggaaatcgagatagcggaacaaggcgtcggctgcaggacgcaaccgaacaggatccaaggccaggcaatgacgtcgcgagcgcggagaccgcagggcctccttcgccatctggcatcagagcacaggatagagctcccagacaccggagagctccgcctgcccgtatgcctgtcgcccctgccccaagcgctgacggtgagcctctgcaggaacagggaggaggcttgtttcaccggacccggagcgtctataacggtctggaactaaatacctggatgaaagtggaacgtctattcgtcgagaaattccatcagagcttcagcctcgataattag

SEQ ID NO: 10839 - DNA, 444 bp, Artificial Sequence
  Description of Artificial Sequence: Synthetic coding sequence
atggccggaccggcaggatctcagtccctggggccactctgctttcattctagcccccaagccttgtatacggtgttgctgatcgtgctggttatgatgtcactggtgtttggaaaatttgttcccgtcaactgggagccaccgcaaccacttcccttccccaagtacctgcgatgctaccggtgtctgctcgagactaaggaattaggttgtcttctcgggagtgatatctgcctgactccagccggatcgtcctgtattaccctgcacaagaagaattcttctggctccgatgtgatggtgagcgattgtcgtagcaaggaacaaatgtctgactgttctaatactcgcacctctcctgtatccggcttctggatcttttcacagtattgcttcctcgatttctgcaacgatccccagaacaggggtttgtacactccttag

SEQ ID NO: 10840 - DNA, 447 bp, Artificial Sequence
  Description of Artificial Sequence: Synthetic coding sequence
atgcagaccttcccagttgctggggcacttgatccagcaatcttagatacaagttccccacaggctctgtacactgtgctgcttatcgtgttggtgatgatgagtctggttttcggaaagtttgtgcccgtgaattgggaaccgcctcagcctctcccatttcccaagtatctcaggtgttatagatgcctcttggagacaaaggaacttgggtgcctgcttgggtccgacatctgcctcaccccagcaggctcctcatgcatcaccctgcacaaaaaaaactcttcaggtagcgacgtgatggtgagtgactgtaggtccaaggaacagatgagcgactgttcaaacacgcgcacatcccctgtgagtgggttctggatcttctcacaatattgcttcctcgatttttgcaatgatccccagaatcggggactatataccccttag

SEQ ID NO: 10841 - DNA, 606 bp, Artificial Sequence
  Description of Artificial Sequence: Synthetic coding sequence
atgaaggtgcatatgcttgtgggtgtgctggttatggtcggattcaccgttggcaaggtgccggtgccagatattcgtacatgtcacttctgtctggtcgaggaccccagcgtgggctgcattagcggaagtgagaagtgcactatcagtagctctagtttatgtatggtaattaccatatactacgatgtaaaggtgcgttttatcgtacggggttgcggtcagtacatctcttatcgctgtcaggagaagagaaacacatactttgccgagtactggtaccaggcgcaatgttgccagtatgactactgtaacagttggtcgagcccccagctgcagtcaagcttacccgaaccccatgaccggcctctcgcgctgccactctcagacagccagatccagtggttttaccaagcactcaatctaagtctccccttgccaaacttccacgctggaaccgagccagatggcctagaccccatggtgacacttagccttaatctgggcctgtcattcgctgaattacgacggatgtacctgttcctgaacagcagtgggttactggtgctgccccaagccggacttttaactccccatcccagctag

SEQ ID NO: 10842 - DNA, 345 bp, Artificial Sequence
  Description of Artificial Sequence: Synthetic coding sequence
atgctcggaggcgaggaggccaggccgaacagttggccgtggcaggttagcctgcagtactctagtaatggacagtggtaccatacctgtgggggatccctgattgcgaattcgtgggtactgacagccgctcattgcatccgacagatcatcaaagctcataaagtcttgcagagatgctcattaattttatttttcgtccgtgacctgtgctctagccagctggaactcacaggggtcagtgccggaagttcgggtatctaccgggtcatgctgggccaacacaatctgtatgtggccgaatctggttcactggccgttagtgtaagcaaaatcgttgtctag

SEQ ID NO: 10843 - DNA, 810 bp, Artificial Sequence
  Description of Artificial Sequence: Synthetic coding sequence
atgatccgcaccttactattgtcgacactcgttgccggagccctgtcatgtggcgtctcaacatatgcacctgacatgtctagaatgctcggcggagaggaggccagacccaattcctggccatggcaagtgtcccttcagtacagcagtaatggtcagtggtaccatacttgcggtggatctctcattgcaaacagctgggtgttgaccgccgcacattgtataagttcctctgggatctacagggtgatgttggggcagcataatctttacgtggctgagtccggttcactcgccgtgagcgtgtccaaaattgttgtgcataaggactggaacagtgatcaggtgagcaaagggaatgatattgctttgctaaagttagccaatcctgtgtccctgactgacaagatccagttagcatgccttccgccagcgggaacaattttacctaacaattacccgtgctatgtcacaggatggggcagacttcagacaaatggggctctgcctgacgacctcaaacagggacagctattggtcgtcgactacgccacctgcagttcatccggttggtgggggtctaccgttaaaactaatatgatctgtgctggaggggacggcgtcatttgcacatgtaatggagacagtgggggtccactcaattgtcaggcatctgatggaaggtgggaggtgcacggcataggaagtctgacctccgttctggggtgcaattattattataagcccagtatattcactagagtgtcaaattataatgattggatcaactccgtgatcgccaataattag

SEQ ID NO: 10844 - DNA, 567 bp, Artificial Sequence
  Description of Artificial Sequence: Synthetic coding sequence
atgtttcaccagatctgggccgcacttctgtatttctacgggattattctgaactcaatatatcagtgtccagaacactcccaactcacgactcttggcgtggatggcaaggagttcccggaagtgcacctgggccagtggtattttatcgctggggctgctcccactaaagaggagttggccaccttcgatcccgtggacaatattgttttcaacatggccgctgggagcgcaccaatgcaattacatctgcgcgcaacaattagaatgaaggacggcctttgcgtgcctcgcaagtggatctatcatctgactgagggtagcacagatctgcgcaccgagggccgtccagacatgaaaaccgagctgttctcatcgagctgtccgggagggatcatgcttaatgaaacgggccaagggtaccagcggttcctgctctacaatagatcgcctcaccctccagagaagtgcgtggaagagttcaaatctctgacaagttgtctcgatagcaaggctttccttctgaccccgaggaatcaggaagcctgcgaactctctaataactag

SEQ ID NO: 10845 - DNA, 390 bp, Artificial Sequence
  Description of Artificial Sequence: Synthetic coding sequence
atggccgctggcagcgctcctatgcagctgcacttgagagctacaattagaatgaaggatggcctctgtgttccaagaaagtggatttaccatctgaccgagggtagcaccgaccttcggactgaagggagaccagatatgaaaaccgagctgttttcctcctcttgccccggagggatcatgctcaatgagactgggcaggggtaccagagattccttttgtataatcggtccccgcatccacctgagaagtgtgtcgaagaattcaaatctctcaccagctgtctggactcgaaagccttcctattgacaccacggaatcagggtaaaggcctcaagtcgcacaagaccggtctggggctgacgaaaagttcgggagtgaccggctag

SEQ ID NO: 10846 - DNA, 351 bp, Artificial Sequence
  Description of Artificial Sequence: Synthetic coding sequence
atggcagctggcagcgcaccgatgcagttacacctgagggccacgatccgcatgaaggatggtctctgcgtccctcgcaagtggatctaccatttaaccgagggtagtaccgacctgcgcactgaggggaggccagacatgaagactgaacttttcagctcctcttgccccggtgggatcatgcttaacgagacgggacaggggtatcaacggtttctactgtataatcgatccccacacccacctgagaaatgcgttgaggagtttaaatctctgacttcttgtctagatagcaaagccttcctactgacaccccgtaaccaggaggcatgcgaattatccaacaactag

SEQ ID NO: 10847 - DNA, 435 bp, Artificial Sequence
  Description of Artificial Sequence: Synthetic coding sequence
atgattagaacgctgctcctgtctaccctggtggcaggagcacttagttgtggggatccaacctacccgccttatgttacaagagtggtgggcggagaggaggctcgccctaactcgtggccctggcaagtgagcctgcagtattcttcaaacgggaagtggtaccatacgtgtgggggttcactcatcgccaatagttgggtcctcactgccgcacattgcatcagtcaatccatggtacagtgcgcccataaagtgctgcagcggtgttccctgattctgttttttgttcgggacttgtgcagttctcagctggaactgaccggcgtgtcagccggatcatcaaggacttatcgggtaggacttgggcgacataatctctacgtcgctgaaagtggcagcctcgccgtctccgtgtctaagattgtggtgtag

SEQ ID NO: 10848 - DNA, 204 bp, Artificial Sequence
  Description of Artificial Sequence: Synthetic coding sequence
atgaaactgttgctactgacactgactgtattgctcctgctgagccagctgaccccgggaggtacacagaggtgctggaatctttacggcaaatgtaggtacaggtgttccaagaaagagcgggtctacgtctattgtattaacaacaaaatgtgttgcgtgaagcctaaataccagcccaaggagagatggtggccgttttag

SEQ ID NO: 10849 - DNA, 231 bp, Artificial Sequence
  Description of Artificial Sequence: Synthetic coding sequence
atgaagctgctgctgctgttactgaccgtcaccctgctccttgcgcaagtgaccccagtgatgaagtgctggggcaagagcgggcgttgtaggaccacatgcaaggagtccgaggtgtactatattctgtgcaaaactgaagccaagtgttgtgtcgaccccaagtatgtgcccgtcaagccaaaactgacagatacgaatacaagtttggaaagtacgagtgccgtgtag

SEQ ID NO: 10850 - DNA, 267 bp, Artificial Sequence
  Description of Artificial Sequence: Synthetic coding sequence
atgaagctcctttatttattcctggcaattctactcgccattgaggaacctgtgattagcgtggagtgctggatggacggtcactgtcggctgttgtgtaaggatggggaggattccatcattagatgcagaaaccggaaaagatgttgtgttcccagtcgataccttaccatccagcccgtgactatccatgggattctaggttggaccacgccccagatgtccactaccgcccctaagatgaaaaccaatattaccaatagatag

SEQ ID NO: 10851 - DNA, 255 bp, Artificial Sequence
  Description of Artificial Sequence: Synthetic coding sequence
atgaagctactctacctctttctcgcaattctgctagcgatcgaagagccagttatcagtgggaaaaggcacattctacgctgcatgggtaacagtgggatatgcagagcctcttgtaagaagaacgaacaaccgtatctctactgtcgaaattgtcagtcttgctgtttgcagagctatatgcggatttccattagcgggaaggaggagaacactgactggtcatacgagaagcagtggcctcgacttccctag

SEQ ID NO: 10852 - DNA, 2631 bp, Artificial Sequence
  Description of Artificial Sequence: Synthetic coding sequence
atgggcccagaagctctctcatccctgctcctcttactattagtagcctctggggacgctgacatgaagggccattttgaccctgctaagtgtagatacgccctcggaatgcaggatagaacgattcccgatagcgatattagcgcttcttctagctggtcagatagcactgctgcaagacattctaggctagaaagtagcgatggcgatggcgcttggtgtccagcgggatcagtatttccaaaagaggaagaataccttcaagtggacctccagaggctgcacctggtggcattagtcggcactcagggtcgacacgccggtggtttagggaaggagttttcaaggtcatatcgcctgagatattcccgggacggcaggcgctggatgggttggaaagacagatggggacaggaagtgatttcgggcaacgaagatcccgaaggggtggtcctgaaggacctaggaccccctatggtcgcccgtttggtgcgtttttaccccagagcagatagggttatgtccgtttgtctacgagtcgagctttacggatgcctgtggcgcgacggtctattgtcatataccgctcctgtgggtcagaccatgtacctgtcagaggccgtctatttgaacgatagcacctatgatggtcacactgttggcggactccagtacggaggcctgggtcagctcgcagatggagttgttggtttggatgattttcgtaaatcacaggaactgcgagtttggccgggatatgactatgtgggctggagtaaccactcattcagcagcggctatgtggagatggaattcgagtttgaccgccttcgcgctttccaggccatgcaggtacactgcaacaatatgcacactctcggggctagattgccaggcggtgtggagtgccggttcagaagaggcccagctatggcctgggaaggggagcctatgcgccataatctggggggtaacttgggagatccgagagcaagagctgtgtctgtgccgttaggcggacgggttgctcgcttcctgcagtgtcggtttctgttcgcagggccttggctgctgttttccgagatttcatttatctcggatgtggtcaacaactccagccccgctctaggcggtacattccctcctgcaccgtggtggccccctggaccacctccgacaaactttagctcactggaactggaaccgcgagggcagcagcctgtcgcgaaggctgaggggtcacccaccgctatacttatcggatgccttgtggctatcattctcctgcttctattgattatcgccttaatgttgtggaggctgcactggaggcggctactcagtaaggccgagcgtcgtgtgctggaggaagaattaactgtgcatttatccgttccaggagataccatattgatcaacaaccggccaggccctcgggagcctcctccctaccaggagccccgtccccgtggtaacccccctcactcagccccttgtgtgccaaatggaagtgcctacagcggagactacatggaacccgagaagcctggcgcacccctgttgccccctcccccacagaatagcgtgccgcattatgccgaggcagatatcgtgaccctgcagggcgtgaccggagggaacacttatgctgtgcctgctctgccccctggagcagtcggcgacggtccccctcgagtggactttcctagatcacgtcttaggtttaaagaaaagctgggcgagggacaatttggagaggtgcacctgtgcgaggtggactccccccaggatctggtgtcattggatttccccctgaatgtgaggaagggacaccccctgttagtggcggtgaagatactgaggcctgacgcaactaagaacgcccgaaacgattttctcaaggaggtgaagatcatgtctcggctgaaggatcccaacatcattaggttattgggcgtttgtgtgcaggatgatcccctttgcatgattacagactacatggagaacggcgacctcaaccagttcttgtctgctcatcagttagaggataaggccgctgagggagcccctggagacggccaagccgctcaggggcctaccatctcctaccctatgctattacatgtggcggcacagattgctagcggcatgaggtacttggcgaccctgaactttgtgcatagggacttggccactcggaattgccttgtgggcgaaaactttaccattaagatagcggatttcgggatgagcagaaacctctatgccggagactattaccgtgtgcagggcagggccgtgctgcctattcgatggatggcctgggagtgtatactgatgggaaaatttaccacagccagcgatgtctgggctttcggcgtgacgctgtgggaagtgctgatgctttgcagagctcagcccttcggccagctgactgacgagcaggtgatcgagaacgctggcgaattcttccgagatcaaggccgtcaggtctacctaagcagacccccagcttgccctcaggggttgtacgagctgatgctgcgctgttggtcccgcgagtcagagcagcggccaccatttagtcaacttcaccggttcctggctgaggacgcattaaatacagtttag

SEQ ID NO: 10853 - DNA, 2742 bp, Artificial Sequence
  Description of Artificial Sequence: Synthetic coding sequence
atgggacctgaggctctgagctccctcttgttgctcctactagtggcctccggcgatgcagatatgaagggccatttcgatccggcaaaatgccgctacgctctgggaatgcaagataggacgattcccgacagtgatatctccgcctccagttcctggtccgattctacagcggctcggcatagccggttggaatcatccgacggtgatggcgcttggtgccccgctggaagcgtcttccccaaagaggaagaatatttgcaggtggatttgcagcgtctccacttggttgctctggtgggaacacaaggccgacatgccggaggcctcggaaaagaattttctagatcttacaggcttcggtacagtagggacggacgacgctggatgggttggaaggaccggtggggacaggaagtaatctctggaaacgaagatcccgagggagtagtgctgaaagacctgggtcctcctatggtggctcgcctggtgcgcttttatccaagagctgatagagtaatgtctgtgtgcctccgcgtagagctgtacggttgcctctggcgggacggcctgttgtcatataccgcaccggtcgggcaaacaatgtacctgtcagaggctgtttatcttaacgactctacttacgatgggcacacagtcgggggactccagtatggcggactcgggcagttagcggacggagtggtcgggttagatgactttagaaagagccaggagctgagggtatggcccggttatgactatgtgggctggtctaaccattcatttagctcaggatacgttgagatggaattcgaatttgaccgcctgagggcattccaggccatgcaggtgcactgtaataacatgcatactctgggagcgcgactgcctggcggagtcgagtgtcgcttcagacggggacccgctatggcctgggagggggagcctatgagacataacttgggtggcaatctgggagaccccagggcgcgagccgtgtcagttccgctaggcggacgggttgcgagatttctacaatgccggtttctgttcgctgggccatggctgctgttcagtgagatttcattcatctctgacgtcgtgaacaacagctctcctgccttaggaggcaccttccctccagctccctggtggccacctggccctccccctaccaacttcagctcactggagcttgaaccacgaggacagcaacctgtagctaaagccgaaggtagtcctacggcgatcctgattggttgccttgtagccatcattctgctgcttttactcattatcgcattgatgctttggcgactgcattggcgcaggctgctcagtaaggctgagaggcgcgtgctcgaagaagagttgacggtgcacttgagcgtgcccggagacacaatacttatcaataatcgtccaggacctagagaacctccgccttaccaggagccaaggccgaggggaaatcctcctcattctgcaccttgcgtccctaatggttccgcactgctcctgagcaatccagcttacaggctcctacttgccacatatgctcgcccacccaggggacccggaccaccaactccggcatgggcgaagcctactaacacccaagcgtactcgggagattatatggagccagaaaaacctggggcacccctgttaccaccacctccgcagaattccgtgcctcattatgccgaggcagacatcgtcacactgcagggagtgaccgggggaaacacctatgccgtgcccgctctgcctcccggagccgtgggagacggtccaccacgggtagactttcccagatcaagattgcgcttcaaggagaaactaggagagggccagtttggggaggtgcacctttgtgaggtcgatagccctcaggacctggtcagcctggacttccccctgaatgtgaggaaaggacatcctctcctggtcgccgtaaagatcctgcgacccgacgcgacaaagaacgcaagaaatgatttcctgaaggaagtgaagattatgagccgcctgaaagatccaaacatcatccggctgctgggcgtatgcgtgcaggacgatccactctgcatgatcactgattatatggagaacggagatctgaatcagttcctttccgcccaccagttagaggataaggccgctgagggagcacctggtgacggtcaggccgctcagggcccaactattagctaccctatgctactgcatgttgctgcccagattgcaagcggcatgcggtatctcgctacccttaatttcgtacaccgcgacctggctactagaaactgcctggtgggagaaaacttcactatcaaaattgccgattttggcatgagccgcaacttgtacgcgggagactactaccgagtccagggcagagctgtactgccgattcgttggatggcttgggaatgcatccttatgggcaaatttactactgcgagtgacgtgtgggctttcggcgtgacactgtgggaggtgttgatgctctgtagagctcagccattcgggcaactgactgacgagcaggtcatcgagaacgcaggcgagtttttcagggaccagggtaggcaagtctatctgagtaggcccccagcatgtccacaaggcctttacgagctaatgctgcgctgctggagtagagagagtgagcagcgcccacctttcagccagctccaccgttttctggctgaggatgcgttgaacactgtctag

SEQ ID NO: 10854 - DNA, 2631 bp, Artificial Sequence
  Description of Artificial Sequence: Synthetic coding sequence
atggggccagaggccctgtcgagcctcctgctgttgctgctggttgcaagtggcgacgcggatatgaaggggcatttcgatcctgcgaaatgccggtatgccttggggatgcaggaccgcactattccggactcggacatttccgccagttccagctggtctgacagcacagcggcacgacactcccgcctcgagtcttcggacggagatggtgcctggtgccctgctggctcggtgtttcccaaggaggaggaatatctgcaggtggacctgcaacgcctgcatcttgtggccctagtggggactcaaggacgacatgctggcggactcggcaaggaattctcccggtcctatcgcttgagatactcccgtgacggcagacgatggatgggctggaaggaccgctggggtcaggaggtaattagtggcaacgaagaccccgagggggtagttctgaaagatctcggcccaccaatggtggcacggttggtcaggttttatccgcgtgctgacagggtgatgtcagtatgtctgcgggtggaactgtacggttgcctttggagagatggcctgcttagctatactgctcctgtaggacagactatgtatctgtccgaggccgtgtacctgaatgattctacctacgatggtcacacagtcggaggcctgcagtacgggggtttgggtcaactggccgatggagtggttgggcttgatgactttcggaaatctcaggagctgcgtgtgtggccaggatatgattatgtggggtggagtaaccactcattctccagcgggtatgttgagatggagttcgaattcgatcgccttagagcctttcaagctatgcaggtgcattgtaacaacatgcataccctcggggctcgcctgcctggcggagtggagtgtcgattcagaagaggtccagcaatggcttgggagggagagcccatgcggcacaacctgggaggtaatttaggtgatccacgcgctcgggctgtatcggtgcctttgggtggtcgggtggccaggtttctgcagtgcaggttcttatttgcgggtccatggttattgtttagtgaaatctctttcatcagtgacgtggtgaacaatagctcacccgcattaggcggtacctttcctcccgcaccgtggtggcctccaggtccgcctccaaccaatttcagttcactagaactcgagccccgagggcagcagcccgtggccaaggctgagggaagccctaccgccatactgatcggctgccttgtagcaatcatccttttgctgctactcatcattgcattgatgctctggaggctgcattggcggaggctgttatctaaggccgagagacgggtgctggaagaggagctaaccgtgcatctgagtgtgcctggagatacgatcctgatcaataatcggccaggccctagagagccaccgccttaccaggagccgagacccaggggcaatccgccacactcagctccttgcgtgcctaatggctccgcatatagcggcgattacatggagcctgaaaagccaggcgcacctttgctgccccctccaccacagaatagtgtgccccactacgcagaggctgacattgtgactcttcaaggcgtgactgggggaaacacctacgccgtccccgctctccccccaggcgcagtaggcgacggaccacctagagtggacttcccaaggagtcgtctgcggttcaaggaaaagctgggagaaggccagttcggcgaggtgcatctctgtgaagttgattccccgcaggacctggtatctctggatttcccactgaacgtaaggaaagggcatcctctacttgttgccgtaaaaatcctccggcctgatgcaactaaaaacgctagaaatgattttctgaaggaggtaaaaatcatgtcacgtctgaaagaccctaatatcatccggctgctgggagtgtgcgtgcaagacgatccactgtgtatgattaccgattatatggagaatggagatctcaaccagtttctcagtgcacaccagttagaagacaaggctgccgaaggagcacctggcgacggacaggcggcacagggtccgacgatatcttaccccatgttgctgcatgttgccgcacagatagctagtggcatgagataccttgctacactaaacttcgttcacagggatctggcaacacgcaattgtctggttggcgaaaattttactataaagatcgcagactttggaatgtccaggaatctgtacgcgggagactactatagagtgcaaggtcgcgctgtgttgcctatccgatggatggcctgggagtgcatcctgatgggcaagtttaccactgcttctgatgtctgggctttcggagtcacactgtgggaagtgttgatgctttgtcgggctcaacctttcggacaactgacagatgaacaggtaatagaaaatgcaggtgagtttttcagagatcaagggaggcaggtttatctatcgagaccccctgcttgcccccaaggtctgtacgagctgatgctaaggtgctggtctcgtgagtccgaacagcggcctccgttctcccagctgcaccgctttcttgccgaggatgctctgaacactgtgtag

SEQ ID NO: 10855 - DNA, 2631 bp, Artificial Sequence
  Description of Artificial Sequence: Synthetic coding sequence
atggggcctgaggccctcagtagcttgctgctcctattgctggttgcatccggggatgccgatatgaaaggacatttcgatccagccaagtgccgctatgcactcggcatgcaggatagaacaatccccgatagcgatatttccgcttctagtagttggtcagatagcaccgctgccagacactcgagactcgagagctctgatggagacggggcttggtgccctgccggttccgtctttccaaaggaggaagagtacctgcaggtggacctacaaagactgcacctggtggcgctagtcggcacccagggacggcatgctgggggactgggtaaggaatttagcaggtcctaccgcctccgatatagccgcgatggacggaggtggatgggttggaaggatagatgggggcaggaggtaatttccggaaacgaggacccagaaggagtggtcctgaaagatctggggcctccaatggtggcaaggctggtgcggttctatccacgcgctgaccgcgtaatgtccgtctgtctgagagtcgaactttatggatgcctatggagggacggactgctgtcttacaccgccccagttgggcaaaccatgtacctgtcagaagcagtttacctgaatgacagcacctacgacgggcacacagtgggcggtctccaatatggaggtttgggccagctggctgatggggttgttggattagatgacttccgaaaatctcaggaattacgagtctggcccggatatgactacgttggctggagtaaccatagtttctcatcagggtacgtcgaaatggagtttgaattcgatagactcagggccttccaggccatgcaagtccattgcaataacatgcatacgctgggggctcgcttgcccggaggcgttgagtgtcgctttagaaggggcccagccatggcctgggagggcgagcccatgagacataatctggggggaaacttgggggatccccgagcccgtgcagtgtccgtgcctctggggggtcgggtagccaggttcctccagtgtcgatttctatttgctggtccgtggttgttatttagtgagatctcctttattagcgatgtggtgaacaactccagtccagcactcggaggtacatttcccccagcgccatggtggccgcctgggcctcccccaacgaacttttcatcactcgaactggaaccccgaggccaacaacccgttgctaaagcagagggtagtcctactgcaatattgatcggatgtcttgtagcaattatactgctgctgctactcattattgctctgatgttgtggcgccttcattggcgtcggctgctttcgaaagccgagcgacgggtgctcgaggaagagttaactgtccacctgagcgtcccgggagacacgatcctgatcaataacaggccgggacccagagagccacccccttaccaggaaccaaggccaagggggaaccctccgcattcagccccatgtgtgcccaacgggtctgcctactccggggactatatggagcccgaaaagcctggggctccattgctgccaccccctccgcagaacagcgtgcctcattatgcagaggccgacatagtgacattgcagggcgtcaccgggggtaatacctatgcggtgccggctctccctcccggagcagtgggcgacggacctcctcgggtggatttcccccgatcgagattgcgcttcaaggagaagctgggcgaaggtcaatttggcgaggttcatctttgcgaggtcgattccccccaggatctcgtctcactggactttcccttaaacgtacgaaagggccacccgctgctggtggctgtgaagatcctacgacccgacgccactaaaaatgcacggaacgactttctcaaggaggttaaaatcatgtcacggttgaaagaccccaacatcatccggttacttggagtatgcgtgcaggacgacccgctgtgtatgattactgattacatggaaaatggggatctaaatcagttcctaagtgcccaccaactggaggacaaggctgctgagggtgcacccggtgacggccaagccgcacagggacctaccatctcttatcccatgttactccacgtcgccgctcagattgccagcggtatgcgatatctggcaacgttaaatttcgtacatagggatctcgcaactcgaaactgcttggtcggagaaaactttaccattaagattgcagacttcggcatgtccaggaacttatatgcgggtgattattaccgcgtgcagggtagggcagtccttccaatccgttggatggcatgggaatgtatcctaatgggtaagttcacaacagcttcagatgtttgggcctttggggtcacactgtgggaagtcttgatgctctgccgggcacaaccttttggccagttgactgatgagcaggtaattgaaaacgctggagaattttttcgcgaccagggcaggcaagtgtatctgagcaggccccctgcatgccctcagggcctttatgaactgatgctccgttgctggagtcgcgagtccgagcagcgtccacccttctcgcagctgcaccgctttctggcggaggatgctctgaatacagtgtag

SEQ ID NO: 10856 - DNA, 2760 bp, Artificial Sequence
  Description of Artificial Sequence: Synthetic coding sequence
atgggacccgaggctctgagctccttgctcctgctcctattagtcgcttccggggacgcagacatgaaagggcactttgaccctgccaagtgcaggtatgcgttaggcatgcaggacagaaccatccccgatagcgatattagcgcctcctctagttggtccgatagcaccgccgctagacattcccggttggaatcctccgatggggatggagcctggtgcccagcgggttccgtgttcccaaaagaggaagagtatctacaggtagatctgcagcgactacatctcgtggcactggttggcactcagggcaggcacgcaggcggacttggtaaggaattcagcagaagctatcgcctccgttattccagagacggaagacgatggatgggatggaaagaccggtggggccaggaagtcatttccggaaatgaagaccccgaaggggtggtcctgaaagacctgggtccaccaatggttgctagactcgtaaggttctatcctcgggctgatagggtcatgtcagtgtgtctgagagtggagctttacgggtgtctttggcgggacggactgctctcttatactgcccctgtcggtcaaactatgtacctaagcgaggcagtttacttaaacgatagtacatatgacggccacaccgttggaggactgcagtatgggggactcgggcaactcgctgatggcgtcgtcggactggatgacttcagaaaatctcaagagctgcgagtatggcctggctacgattacgtcggatggtccaatcactcattttcgagcggctatgtcgaaatggagtttgagtttgaccgccttagagcattccaggctatgcaggtgcactgcaacaacatgcatacgctcggagccagactgcccggaggtgtggagtgcaggttcagacggggaccggctatggcatgggagggtgagccaatgcgccacaacctcgggggaaatctgggagatccacgagctcgtgccgtctcggtcccactggggggtcgcgtagctaggtttctgcagtgcaggttcctgtttgcgggaccttggctgctctttagtgaaatctcctttatatctgacgtggtcaacaatagttcccccgcactgggcggaacattccccccagcaccttggtggccgcctgggcctccacccactaacttcagcagcctagagctggagccacggggtcagcagccggtagctaaggccgagggctctccaactgctatcctgatcggctgcctcgtggcaatcattctgttgcttttactgatcatcgccctaatgctctggcggctgcattggcgaaggttactgagtaaagcggagcgaagggtcttggaggaagaactgacggtacatctgtcggtgccaggggacacgatactgattaataatcgccctgggccaagggaaccccctccctatcaagaaccccgacctcgcggaaatcctccccacagcgcaccgtgcgtgcctaacggaagtgctctgctgcttagcaatcccgcttaccgcctcctgttggcaacctatgcaagaccacctagaggacccggaccccctacacctgcatgggctaagcctactaatacacaggcatattccggcgactacatggagccagagaagcctggtgccccactgctgcccccacccccacagaatagtgttcctcactatgccgaggctgacatagtgactctgcagggggtgaccggaggcaacacctacgctgtacctgctctccctcctggcgcagtcggcgacgggcctccccgagtggactttccaagaagcagactgaggttcaaggagaaactgggcgagggacagttcggcgaggtgcacctatgcgaagtcgacagtccacaagatttggtgtccctcgacttccccttgaacgtgaggaagggccacccattgctggtggccgtcaagatattgcggcctgacgccacaaaaaatgcttccttctccttattttccaggaacgacttcctaaaggaggttaagatcatgagcagactcaaggacccaaacatcattagactgctgggagtttgcgttcaggacgacccactctgcatgatcaccgattatatggagaatggagatctgaaccagttcctatctgcacaccagctagaagacaaggccgcagagggggctcccggagacggtcaggctgctcagggcccaactataagttatcccatgcttctacatgtggccgcacagatcgccagcggcatgagatatctcgctactcttaacttcgtgcacagggacttggctacaaggaactgcctggtcggagagaacttcacaatcaaaatcgccgattttggcatgtcacgtaacctatacgctggcgattactatcgcgtgcagggcagagccgttctgccgatcagatggatggcctgggagtgcatcttaatggggaaatttacgacagcttcagacgtgtgggcattcggagttacactgtgggaagtgctgatgctctgcagagcgcagcctttcgggcagttgacggacgaacaggtcatagaaaacgcaggcgaatttttcagagaccaggggcgacaggtctacctgtcaagacctcctgcatgcccacaggggctctatgaactcatgttacgctgttggagtcgtgagtccgagcaacggcctccgttttcacagctgcacaggtttctcgctgaagacgctctgaacactgtttag

SEQ ID NO: 10857 - DNA, 1041 bp, Artificial Sequence
  Description of Artificial Sequence: Synthetic coding sequence
atgctgaagaagcccctctccgcagtcacgtggctgtgtatcttcatcgtggcgttcgtgagtcaccccgcttggcttcagaagctgtcaaagcacaagactcccgctcagccccaactgaaggccgctaactgctgcgaggaagtgaaagaactcaaggcacaggtggctaacctgagtagtcttttgtccgaactaaataagaaacaggagcgcgactgggtgagcgtcgtcatgcaggtaatggaacttgagagtaactcaaagcgcatggagagccggctcaccgacgctgagtcaaaatacagcgaaatgaacaaccagatagatattatgcaattacaggccgctcagacagtgacacagacgagtgcagatgccatctacgactgttcaagcttgtaccagaaaaactacagaataagtggagtgtacaagctgccacccgacgactttctgggctcacccgagttggaagttttctgcgacatggagacttctggtggagggtggaccatcatccagcgcagaaagtctgggctggtcagcttctatcgcgattggaagcagtataagcaggggtttggttccattcgaggagatttctggctggggaacgaacacatccatagattgtctcgacagcctaccagattgagagttgagatggaagactgggaggggaacctaagatatgcagaatattcccattttgtgctgggaaatgagctgaatagttacagactgtttttaggaaattacacaggtaatgtgggcaatgatgccttgcagtatcacaacaacaccgctttctcaaccaaagataaagacaacgataactgcctggataagtgtgcacaactgaggaaaggcggatattggtataactgctgtacagactcaaatctgaatggcgtctattatagactgggggaacataataaacacctggatggcattacctggtatggttggcacggatctacttactctctgaagagagtcgagatgaaaattcggccagaagattttaaaccctag

SEQ ID NO: 10858 - DNA, 1056 bp, Artificial Sequence
  Description of Artificial Sequence: Synthetic coding sequence
atgaaaggaagggccgttagctttgatcccctagcttgccaggggcttaatgcctcacccggatccctgacctctccattgagaagaatccgcagcctcaccggacgcgaggtacttacgcccttcccgggtctgggaaccgccgcagctccggcacaaggaggagcccaccttaaaccccattccctggtactgccaatcaccgccctgccgcctccacctttggccttacgaggccgtcaggcaacctctaagctgcccccatttctttctagcccattcccaccatccctgtgcccctgggtgcccgatcctggcttcaaggagactgcgttcctgtacgctgtgagctccgccgctcttactcacactctggccagagcctgcagcgccggtcgtatggagcgatgcacttgcgacgactcacccggtcttgagagccggcaagcatggcaatggggagtttgcggcgacaatttaaagtactcaacaaaattcctctcaaactttcttggatcaaaaaggggcaacaaagatcttcgggctcgggcagatgctcacaacacacatgtggggatcaaggccgtgaaaagcgggctaagaactacttgcaagtgccatggggtgagcgggtcttgcgcagtcagaacatgctggaaacagttgtccccattcagagaaactggtcaggttttgaagctaagatacgattcggctgtcaaggtgtcctcagccacgaatgaagcactgggaaggctcgagctgtgggcccctgcacgtcagggcagcctgacgaaaggtctggcccctagaagtggggatcttgtgtatatggaagactctccgagcttttgcaggccaagcaagtattcaccgggaacagcaggcagggtttgtagtcgagaagcctcctgtagttccctgtgctgtggaagaggctacgatactcagtcacgcctggtggcattcagctgccactgccaagtccagtggtgttgctacgtggaatgtcagcaatgcgtgcaagaggagttggtttatacatgcaaacattag

SEQ ID NO: 10859 - DNA, 462 bp, Artificial Sequence
  Description of Artificial Sequence: Synthetic coding sequence
atgaagcatcttaggccccaattccctctgattctggctatctactgcttctgcatgttacagatcccatcctctggcttcccacagccactcgccgatccatcagacggcctggacattgttcaactcgagcagctggcttactgtctgtcacagtgggctcctctgagtcgacaacctaaggacaatcaggatatttataagaggttcctcttccattactcacgcactcaggaggctacccaccctgtgaaaaccgggttccctcccgtccatccgctgatgcacctggcggcaaagctggcaaatcggagaatgaagcggattttgcagaggggcagtggaacagctgccgtcgatttcactaaaaaggaccatactgcaacatggggcagaccttttttcctgttcagaccacgcaatgggcgaaacatagaggacgaagcacaaattcaatggtag

SEQ ID NO: 10860 - DNA, 765 bp, Artificial Sequence
  Description of Artificial Sequence: Synthetic coding sequence
atggcagccgctagtgcgggagctacaaggctcctgctactgttgttgatggcagtagccgctccctcacgtgccaggggctccggctgcagagccggtacaggggctagaggcgcaggggctgaggggagggaaggcgaagcctgcggaacggtgggcttactgttagaacattccttcgagattgatgactccgcaaacttccgaaagcgtggcagtctgctgtggaaccaacaagacggcaccctgtctttaagccaacgccaactttccgaggaagagcgtggcagactgcgagatgtcgctgccctcaatgggttataccgtgttcggattcccagacgccctggggcactggatggccttgaggcaggaggctatgtgtccagttttgtgccagcatgttcgctggttgaaagccacctcagcgaccaattaaccctccacgtggacgtcgcaggaaacgtcgttggggtgtctgtagtaactcaccccggtgggtgccggggacacgaagtggaagatgtggacctggaactgtttaacaccagcgtgcagttacagccccctacaaccgccccagggccagaaaccgctgcatttatcgaacgcctggagatggagcaggcccagaaggcgaagaacccccaggagcagaagtcattttttgcaaagtattggcacatcatccttggtggagccgtgctgctgaccgctctgaggccagctgctccagggcctgccccaccaccccaggaagcctag

SEQ ID NO: 10861 - DNA, 810 bp, Artificial Sequence
  Description of Artificial Sequence: Synthetic coding sequence
atggccgcagcaagtgccggtgcaaccagactactgctcctattattaatggctgtggccgcaccctcacgagccagaggcagcggatgccgggcaggaacaggggctcggggagctggagccgagggccgagagggcgaggcatgtggcacagtcggactcctcctggaacatagcttcgaaatcgatgactcggctaacttcagaaagcgcggaagtttattgtggaaccagcaggatggcactctttccctatcccaacgccagctgtctgaagaagaaagaggaaggctccgagatgtggctgcactgaacggactgtatcgcgttcggatacctcgcaggcctggagctctggacggcctagaagccggagggtatgtgagctctttcgtaccggcatgctcactggtcgagagccatttgtccgatcagctcacccttcatgtcgatgtggccggtaacgttgtgggagtgagtgtcgtgacccatcccggtggctgtcgcggacacgaagtagaggatgtggaccttgaattgttcaacacatctgttcaattgcagcccccaacaactgcacccggaccagaaaccgcggcttttattgaacgcctggaaatggagcaggcccagaaagcaaagaatcctcaggaacagaaatctttctttgcgaagtattggatgtacatcattcccgtcgtgctcttccttatgatgtcaggggctcctgacaccggaggccaaggaggtgggggagggggaggtggagggggaggcagtggccgatgttgtgtccctccctccctctag

SEQ ID NO: 10862 - DNA, 480 bp, Artificial Sequence
  Description of Artificial Sequence: Synthetic coding sequence
atgtcctctccccaaagacggaaagctatgccttgggctctgagccttttgctcatggggttccagctcttggtgacctatgcttggtgttccgaggaggagatgggtggcaacaacaagatcgtgcaggatccgatgtttctagccacagtggaatttgccttaaacactttcaatgtccagagtaaagaggagcacgcttatcggctgctgcgggtgctttccagctggcgggaagatagcatggaccgaaagtggcgcggaaaaatggtcttcagcatgaatctgcagctgcggcaaaccgtctgccgcaaattcgaagatgatatagataattgccccttccaagagagcttggagctcaataatgtgcggcaggggattagctttccacaagtccatagctgtggatgttgcatgggctgtggggtgggcacgggtgcagcagacaaagccatccctcgcgataagggtaagtag

SEQ ID NO: 10863 - DNA, 1737 bp, Artificial Sequence
  Description of Artificial Sequence: Synthetic coding sequence
atgctgctgttactgctgctcgcacctctctttctgaggccaccaggcgctggcggtgcacagaccccaaacgcaacctccgaaggttgccagatcattcatcctccttgggagggcggaattagatatagagggttaactcgcgaccaggtgaaggcaatcaacttcctacctgttgactacgaaatcgaatacgtttgtcgaggcgaaagagaggttgtggggcctaaagtgcgcaaatgcctggctaacggttcatggaccgacatggacacaccatctcgttgcgtgcgcatctgttccaaaagctacctaacacttgagaacgggaaggtattcttgactgggggtgacttaccagccctcgatggcgctcgcgtggattttcggtgcgatcccgattttcatctcgtgggatcctcacgctcaatctgttcacagggccagtggagtacccccaagcctcactgccaggttaaccgaacccctcatagtgagcggcgagctgtgtatattggggctctttttcctatgtcgggaggctggccaggcggtcaggcgtgccagccagcggtcgagatggccctggaggatgtgaattctcggcgtgatatcctcccagactatgaactgaagctcatacatcatgactcgaaatgcgacccaggacaggccaccaagtacctctatgagttactctacaacgatccaataaagataatacttatgcctggttgttcttcggtgagtactcttgtggctgaggcagcgaggatgtggaaccttatcgtactcagttatggctctagctccccagccctatcgaaccgccaacgctttccgacattctttagaacacatccttccgctacattgcacaaccccacacgggttaaactcttcgaaaaatggggctggaagaaaatagccacaatccaacagactaccgaggtgtttacttcgacactggacgacctggaggaaagggtcaaggaagctggtattgagatcacattcagacagtcgtttttctccgacccagccgtgccagtcaagaaccttaagcggcaagatgccaggattatagtcggactgttctatgaaacagaagccagaaaggtattttgcgaggtttacaaggaaaggctgtttgggaagaagtacgtgtggtttctcatcggctggtatgctgataattggtttaagatatacgacccctcgattaactgtaccgtagacgagatgactgaggccgtcgagggacatattactacggagatcgtgatgttgaatcctgcaaacacacgctccattagtaatatgacttctcaggagttcgtggagaagctaacaaagaggctcaaacgacacccggaggagactggaggtttccaggaggctccgttagcatacgacgctatctgggcactggccctggccttgaacaaaacatcaggcggaggagggcgaagcggcgtaagattagaagactttaattataacaatcagaccatcaccgaccagatttatagagccatgaattccagtagcttcgagggggtgtctggccatgtcgtgtttgatgcttccggctccaggatggcttggaccctaattgagcagttgcaggggggttcatataagaaaatcggttattatgattccaccaaagatgacttatcttggtctaaaacagacaagtggatcgttattagcaggacacattctcccacatag

SEQ ID NO: 10864 - DNA, 444 bp, Artificial Sequence
  Description of Artificial Sequence: Synthetic coding sequence
atgctagggctgccatggaagggaggcttgtcctgggcattgctactgctgctgctgggctctcagattctcctgatctacgcctggcacttccatgaacagagagattgtgatgaacacaacgtgatggccaggtatttaccggcaactgtagagtttgccgtgcacacttttaatcaacaatctaaagattactatgcgtacaggttaggtcacatcctgaacagttggaaagagcaggtggaatccaaaacagtcttctctatggagttgttgcttggaagaacgcgatgtggcaaattcgaggacgacatcgacaattgccatttccaggagagtacagaactgaacaacacatttacctgtttcttcaccatcagcacgagaccgtggatgactcagttcagcttgctcaacaaaacctgtctggagggcttccattag

SEQ ID NO: 10865 - DNA, 444 bp, Artificial Sequence
  Description of Artificial Sequence: Synthetic coding sequence
atgtggagcctccccccatcccgggcattgagttgtgccccacttctcttgcttttcagtttccagtttttggtcacatacgcctggcgattccaggaggaagaggagtggaatgatcagaaacagattgctgtctacctgcctcctacactggagttcgccgtctatacattcaataagcaatctaaggactggtacgcctataagttggtgcccgtgctggcatcttggaaagagcagggctacgacaagatgacatttagcatgaacctgcagcttggacggacgatgtgcgggaaattcgaggacgatattgacaactgcccctttcaggagtcaccagaattgaacaatacctgcacatgtttcttcacaattggaatcgagccatggcgcactaggttcgatctgtggaataagacttgttccggaggccattcttag

SEQ ID NO: 10866 - DNA, 2535 bp, Artificial Sequence
  Description of Artificial Sequence: Synthetic coding sequence
atgggcccaggtgcaccattcgccagggtgggctggcccttgccgctgttagtggtgatggcagccggagttgctcctgtgtgggcatctcacagccctcacctgccaagaccccatagtagggtgcctcctcacccctcatcagagcgtcgcgctgtgtacattggcgctctctttcctatgtctggtggatggcctggaggccaggcctgtcagcccgcagttgagatggcactcgaagacgtaaacagccgccgagacatcttgcctgactacgaactcaagcttatccatcatgatagcaaatgcgaccccggacaggcaaccaagtatttatacgaactgctgtataacgaccctattaagattatacttatgcctgggtgcagtagcgtgagtacactggtggccgaagccgctcggatgtggaacctgatcgttctgagctacggaagttcctcacccgcactgagtaatcggcagcgctttccaactttttttagaacccaccccagtgcaaccctgcacaatccgacacgcgtaaagctttttgagaagtggggatggaagaagatagcgacgatccaacagacgacagaggtgtttactagtaccctggacgacctggaagagcgcgttaaagaggccggaattgaaatcacttttcgtcagagcttcttttccgaccccgcagtgcccgtaaagaacctgaagaggcaggatgcgcgtatcatcgtgggactcttctacgaaaccgaggctagaaaggtcttctgcgaagtctacaaggagagactctttggcaagaaatatgtctggttccttattggatggtacgccgataactggtttaaaatatatgacccttcaatcaattgtaccgttgacgaaatgactgaagcggtcgaaggtcacatcacgaccgaaattgtcatgcttaacccggctaacacaaggtcaatttccaatatgacatcccaggaatttgtggagaaattaacgaagagactgaaacggcatcctgaagagaccgggggatttcaagaggcccctctcgcatatgacgccatttgggcactcgccctggctctgaataagacctccggcggtggagggaggagcggagtgaggctggaggactttaactataacaaccagaccattacagaccaaatctatcgggcaatgaactccagctccttcgagggggtgtcggggcatgtggtctttgacgccagtgggagtcgaatggcatggacacttattgagcagctccaaggcggatcatataaaaaaatcgggtattacgactctacaaaggatgatctgtcatggtccaagactgacaaatggatcggcggtagcccgcctgccgatcagaccttggttattaaaacctttagatttttatctcagaagctgtttatcagcgttagcgtgcttagttcccttggaatcgtgctcgccgtcgtgtgtctgtctttcaacatctacaattcccacgtccgctacatccaaaacagccagccaaaccttaataatcttaccgccgtcggctgttctctggcgttggctgctgtattccctcttgggctggatggttaccatatcggccgtaaccaatttccatttgtctgtcaggctcgcttgtggctactgggcctgggatttagtttgggatatggcagcatgtttacaaagatttggtgggtccacactgttttcaccaaaaaggaggagaagaaggaatggcgaaaaacgctggagccctggaaactgtacgctaccgtgggactgttggtggggatggatgtgctgacactcgcaatttggcagattgttgacccactgcatagaactatagagacgtttgccaaggaagagcctaaggaagatatcgacgtgagcatactgcctcagcttgagcactgcagcagtagaaaaatgaacacatggttaggcatcttttacgggtataaaggattactgctgctgttgggcatcttccttgcgtatgagacaaagtctgtaagcacagaaaagattaatgatcatagggctgtagggatggcgatttacaacgtggcggtattatgcctcattaccgcgcctgtgacaatgatcctaagctcacagcaggacgctgcttttgcgttcgcttccctcgccattgtcttctccagttacatcaccctggttgtgcttttcgtacctaaaatgcgacgtctgatcacccgcggtgaatggcagtctgaggcacaggataccatgaaaactggttcgagcactaacaacaacgaggaagagaagtcacgattgcttgaaaaggagaacagagagttggagaagattatagctgaaaaggaggaacgcgtgagtgaactgcggcatcagctgcagtctagacagcagcttagatcccgaagacatccaccaacacccccagagccttcaggcggtttgcctagaggaccccctgagccaccggatcgcctgtcatgcgatggctcaagggtgcacctgctttacaagtag

SEQ ID NO: 10867 - DNA, 2700 bp, Artificial Sequence
  Description of Artificial Sequence: Synthetic coding sequence
atgctgctgctgctcctgttggcccctctgttcctgagacctcctggcgctggcggagcccagacccccaacgccacttcagagggttgccagatcatccaccccccttgggaggggggaattagatacaggggcctgaccagggatcaggtaaaggccataaatttcttaccagtcgactatgaaattgaatacgtgtgccgtggagagagggaagttgtagggcctaaagtgaggaagtgcctggccaacggatcttggactgatatggacaccccaagccgctgcgttaatcggacaccacatagcgagaggcgcgcagtgtacatcggcgcactgtttcctatgtctggaggatggcccggaggtcaggcttgccagccagcagttgagatggcactggaggacgtgaattctaggcgcgatatcctgcccgactacgagctgaaattaattcaccacgactcaaaatgtgaccctggccaggccacaaaatatttgtatgagcttctgtataatgacccaatcaaaatcatactcatgcctgggtgtagcagtgtcagtacgctcgttgccgaagcagccagaatgtggaacttaatcgttttatcatatggcagcagttcccctgctctgtctaaccggcagcggtttcctaccttttttcggactcacccctctgccacactccataaccctactagagttaaattgtttgagaagtgggggtggaagaagatcgcaacaattcagcagaccaccgaggtgttcacaagcacacttgacgatctggaggagagggtcaaggaagcaggaatcgagatcaccttccgacagagcttcttttcggaccctgccgttcctgtcaaaaacctcaagcgccaagacgccaggatcatcgtgggacttttttatgaaacagaggcgagaaaagtgttttgcgaagtctacaaggagaggttgttcggcaagaaatatgtgtggttcttaatcgggtggtacgccgataactggttcaagatctatgatccatcgatcaactgcactgttgacgagatgacggaggccgttgaaggccacataactaccgagattgtgatgctcaacccggctaataccaggtcgatctcaaatatgacgagtcaggaattcgtagagaagctgacgaagagactcaagaggcaccctgaagagactggaggctttcaggaggccccactcgcttatgacgcaatctgggccctggcactggccctgaataaaactagcggaggcggtggcaggagcggggtcagattagaagatttcaactataacaatcagaccataaccgatcaaatttacagggcaatgaattcgagcagcttcgaaggcgtctcaggtcatgttgtgtttgacgcatctgggtcaagaatggcatggacacttattgaacagctgcagggcggttcatataagaaaatcggttattatgacagcaccaaagatgatttgtcttggtctaaaacagacaaatggattggaggctccccacctgccgatcaaaccctggtaatcaagacttttcgttttctgagtcaaaagttgtttattagtgtcagcgtcctcagctcactaggcattgtgttggcagtggtgtgtttgagttttaatatctataactcacacgtccgctacatccagaatagccagccaaatctgaataacttgactgccgtggggtgctcactcgcccttgcggctgtattccctctcgggctcgatggctaccacattggtcgaaaccagttcccttttgtgtgccaagctcgtctctggttgttaggcctgggtttcagtttaggttatgggagtatgttcacaaagatctggtgggttcataccgtgttcacaaagaaagaagaaaagaaggaatggaggaagaccctcgagccctggaaactttacgccaccgttggcctactcgtcggcatggacgtgttgacccttgctatctggcagatcgttgaccctctccaccgcaccattgaaactttcgcaaaggaggagcctaaggaagacatcgacgtttccatcctgccccagctggagcattgttctagccggaaaatgaacacctggctgggaattttttatggatacaagggcctgctgctcctgctaggtattttcttagcatacgagaccaaatcagtcagtaccgaaaaaatcaacgaccatagggccgtgggaatggcgatttacaatgtggctgtcctgtgtctcatcactgctcctgtgaccatgattcttagttcacagcaggacgcggcatttgccttcgcaagcctcgctatcgtcttcagcagctatataactttggtcgtactcttcgtcccaaagatgcgacgccttataaccagaggggaatggcagtccgaagcacaggacacgatgaagaccggctcatcaacaaataacaacgaggaagaaaagtctagattactagaaaaagagaacagggagttggagaagatcatcgcagagaaggaagaaagggtgagtgaactgaggcaccaactgcagagccggcagcagttacggtccaggcggcacccaccaacgcctcctgaaccgagtggcggacttccccgaggccctccagaacctccagatcggttgtcctgtgatgggagccgggtgcatctcctgtataaatag

SEQ ID NO: 10868 - DNA, 2886 bp, Artificial Sequence
  Description of Artificial Sequence: Synthetic coding sequence
atgctccttctgctactgctggccccactctttctgaggccaccgggagctggaggagcacaaacccctaacgccacaagtgagggctgccagataattcacccaccttgggagggtgggattaggtacagaggccttacacgcgaccaggtaaaagcaatcaactttttacccgtggactacgagatcgaatatgtgtgccgaggagaacgagaggttgtgggacctaaggtacgcaagtgtctggcaaacggttcctggactgacatggacacacccagcaggtgtgtgcgcatctgctccaaatcttatctgaccctcgaaaatggaaaggtattcctgacaggaggtgacttacctgcgcttgatggggctcgcgttgatttcagatgcgacccagactttcatcttgtgggttcctcccggagtatctgttctcagggacagtggtccacccccaagcctcactgccaagttaacaggacacctcattcagagaggcgcgctgtgtatattggggctctctttcccatgagtgggggttggccagggggacaggcctgtcaacctgccgtcgagatggctctggaggacgtcaactctcggcgagatatcctgcccgactacgagctgaagctcatccatcatgattccaaatgtgatccaggccaggccacaaagtatttatacgagttactctacaatgatcctatcaaaattatcctcatgccagggtgtagcagcgtttctacactggtggcggaagccgcacgaatgtggaacctaatagtgttaagttacgggtctagctcacccgctttgtctaatcgacagagatttcccactttctttagaacacacccaagcgctaccttacacaatcccactagggtgaagctgttcgaaaagtggggttggaagaagatcgcgaccattcaacagacaactgaggtctttacttccacccttgatgacctagaggagcgcgtgaaagaggccggaattgagattactttccgacagtcctttttcagcgatcccgctgtgccggtgaagaacctcaaacggcaggacgccagaatcatagtgggattgttctatgagactgaggctcgtaaagtcttttgcgaagtatataaggagaggctgtttgggaagaaatacgtgtggtttttgattggatggtacgctgataattggtttaagatctatgatccgtcaatcaattgcaccgttgacgaaatgaccgaagcagtcgaggggcatataacgaccgagatcgtgatgttgaatcccgctaacacgaggtccatctccaacatgaccagtcaggaattcgtggaaaagctgactaaacggctaaagaggcatccagaagaaacaggaggtttccaggaggctcctctcgcctatgacgccatttgggcccttgctctcgcactgaacaaaacgtctggaggtggcggacgatcaggcgtgagactggaggatttcaactataacaaccagaccattaccgaccaaatctaccgcgcaatgaactcttcttcttttgagggtgtgtctggccacgtagtcttcgatgcgagcggatcgcggatggcgtggactctcattgagcagttgcaaggaggatcttataagaaaattggttactatgatagcaccaaagacgacctctcttggtccaaaacagacaagtggattggcggtagccccccagctgatcagaccttggtgatcaaaacattccgcttcctcagccagaagttgtttatctcggtgtctgtgcttagctccctcggcattgtccttgccgtggtgtgtctctcttttaacatctataatagccacgtcaggtatatccagaacagccagccaaacctcaataatcttacggccgtgggctgctcattggcgttagcagccgtcttccccctgggtttagacggatatcatatcgggcgaaaccaatttccatttgtatgtcaagcacgcctgtggctgctggggctgggattctccttgggctacggctccatgttcacaaagatatggtgggtacataccgtcttcacaaaaaaggaggagaagaaggagtggcgcaaaacactggaaccttggaagctctatgctaccgtcggtctgttagttggaatggatgtgctcaccctcgcgatttggcaaatcgtagaccctcttcaccgtactattgagacttttgccaaggaggagccgaaggaggatatcgacgtgtccatcctgcctcagctggagcactgttctagcagaaagatgaatacatggctagggatattttatggatacaagggccttctgttactcctaggaatcttcctcgcttacgagacaaagagtgtgagcacagaaaaaataaatgatcacagagctgtgggcatggccatatataatgttgccgtgctttgtctcatcaccgcgcctgtgaccatgatccttagcagccaacaggacgccgcatttgccttcgcgtcactggcaattgtcttctcaagctacattacactggtggtgctgttcgtaccaaagatgcgccgtctgattacacgaggcgagtggcaatcagaggcgcaggatactatgaagactggatcctccacaaataataacgaggaagaaaaaagtaggctcctggagaaggaaaaccgagaactcgaaaagattattgcggaaaaagaagagagagtgtccgaattacggcaccagttacagtccagacagcagcttcgatctcgccgacatccaccaactccacctgaaccctctggcggtctgccaagaggccctcccgagccacccgaccgtttgtcgtgtgacgggtcaagagtgcacctgttgtacaagtag

SEQ ID NO: 10869 - DNA, 882 bp, Artificial Sequence
  Description of Artificial Sequence: Synthetic coding sequence
atgaacaacctttcattctccgagctttgttgtctcttctgctgcccaccgtgtccgggaaaaatcgctagcaagctggcctttctccctcccgacccaacttatactcttatgtgtgacgaatccggctcgcggtggactctccatctgtccgagagagcagattggcagtattcatccagagaaaaagacgcgattgaatgctttatgacgcgtactagtaaaggaaatcgtatcgcctgcatgttcgtcagatgctcaccaaatgccaaatacacattattattctcccacgggaacgccgtggatctaggacaaatgtcttctttttatataggactgggaagcagaattaattgcaacatattttcatatgattactccggttacggagcatcgagtggaaagcccaccgagaaaaacctgtacgccgacatcgaggctgcctggctggccttaagaacacgttatgggatccggcctgaaaatgtaataatttacggccagtccattgggactgttccctccgtggatctggccgctaggtacgagtcagctgctgttattctgcactcacctctcacttctggaatgagggtggcatttcccgacactaaaaaaacctactgtttcgatgcttttcctaacatagataagatctccaaaattacttctcccgttttaattattcacgggaccgaggacgaggtcatcgacttttcccacggactggccctgttcgaaaggtgtcagaggccagtcgagcctctgtgggtggagggtgccggtcacaatgacgtcgaactgtacggccagtacctggagagattgaaacagttcgtgagccaagaattggtgcagaaacacaaagaaggaaagtag

SEQ ID NO: 10870 - DNA, 1155 bp, Artificial Sequence
  Description of Artificial Sequence: Synthetic coding sequence
atgtggtacgtgagcactcggggagtcgctccgagagtcaactttgagggagccttattctcaggctatgccccagacggagggctattcatgcctgaggaactgccccagctagatagaggcacgctttgccaatggagcactttaagttatccgggactagtgaaggaactttgtgcactgtttatcgggagtgagctcctaccaaaggacgaactgaacgatcttatcgatcgggctttttcgcggtttaggcatcgggaggtagtccatttgagccgactgcgcaatggcctgaatgttctggagctgtggcacggcgtgacctatgccttcaaagatctttccttgtcttgcaccacccagtttctgcagtacttcctggaaaagcgcgagaagcacgtgactgtcgtggttggcaccagtggagacactggttcagccgcaatagagtctgtgcagggggcaaagaacatggacattatcgtgctcttgcctaagggacattgtaccaaaattcaagagctacagatgaccacagtcctgaaacagaatgttcacgtcttcggggtggaaggaaactctgacgaactcgacgaacctataaagaccgtgtttgcagacgtggcattcgtcaagaagcacaatctgatgagcctgaattcgattaactggagccgggttctggtccagatggcccatcattttttcgcttattttcagtgcacaccctcccttgatactcaccctcttcctttggtggaggtcgtggtcccgactggggcagcaggcaaccttgccgcaggttatattgctcagaagatcggcctgcctatccgtctggtagtcgctgtcaatagaaacgacatcatccataggactgtgcagcagggcgactttagcctatccgaggctgtgaaaagcaccctcgcctccgcaatggacattcaggtaccatataatatggagcgcgtgttttggcttctctccggatccgattcacaagtcactcgggctttgatggaacaatttgagagaacacagagtgttaatcttccgaaggagcttcactcaaagcactcgccggtgctgccgaggccttgcctgtgttcccaggtgcccggaagctgtccgggttgctggcctgatccatag

SEQ ID NO: 10871 - DNA, 2889 bp, Artificial Sequence
  Description of Artificial Sequence: Synthetic coding sequence
atgcttcgccgtccagcacccgctctcgctcccgctgccaggctgctgctggccggtctgctctgtgggggaggagtttgggcagctcgtgtcaacaaacataagccctggctagagccaacatatcatggaatcgtgacggaaaacgataatactgtccttctcgacccaccactgattgccctcgataaagatgctcccttgaggttcgccgagtcatttgaagtcactgtaacgaaagaaggagaaatctgcggcttcaagatccatgggcagaacgtgcctttcgacgccgtggtggtcgataagagcacaggagagggcgtgataagatccaaagagaagctggactgtgaattgcaaaaggactatagcttcactatccaggcatatgattgcggcaaagggcctgacggaacaaacgtgaaaaagtctcataaagctaccgtgcatatacaggtaaacgacgtcaacgagtacgccccagttttcaaggagaaaagctacaaggctacagtcatcgagggcaaacagtacgatagcatactgagggtggaagctgtggatgcagactgttccccacagttcagtcagatttgctcatatgagataatcacgcccgacgtgccatttaccgtggacaaggatgggtacatcaagaacactgaaaagctgaattacgggaaggagcatcagtacaaactgaccgtcacagcctacgactgcggcaaaaagcgggcaactgaggatgttctcgttaagatttcaataaaaccgacttgcaccccgggatggcagggttggaataatcggattgagtacgagccgggaaccggtgccctcgctgtgtttccaaatatacacttggagacatgtgacgaaccagtggcctccgtccaggctaccgtcgagctggagactagccacattggtaagggttgtgatcgcgatacttactcagagaagagtctgcaccgcctttgtggcgcagccgctggaactgccgaactcctgcccagccctagcgggtcgttaaattggactatgggtctgccgaccgataacggccatgacagtgaccaggtgtttgagtttaacgggacccaggccgtcagaatacctgatggggtcgtcagtgtttcacccaaggagccattcaccataagtgtgtggatgcgacacggacctttcgggaggaagaaggagactatcctctgttcctcggataagaccgacatgaatcgccaccactactctctgtacgttcacggctgcaggctgatattcctgttccggcaggatccatcagaagagaagaagtatagacccgcagagttccactggaagctgaaccaggtatgcgacgaagagtggcatcactacgtgcttaacgtggaatttccttctgttacgctgtatgtcgatggcaccagccacgagccattttctgtgacggaggactacccgctgcatccaagtaaaatcgagacacaactggtggttggcgcatgctggcagggaggggatctccacatgacccagttctttagaggcaatctcgctggcttaaccctgagaagcgggaagctggcagacaagaaagtgattgactgcctgtacacctgcaaggagggtctggatctgcaggtgcttgaggattccggaagaggggtgcagattcaagcccacccaagtcagctggtcctgactctcgaaggggaggacctaggagaactcgataaggccatgcagcatatatcttatctaaacagccgacaatttcctacccctggcattcgacgactcaaaatcacatccaccattaagtgctttaacgaagccacttgcatttcagtaccccctgtcgatggttacgtgatggtcctccaacccgaggaaccgaagatcagcctgtccggagttcaccatttcgctcgagccgctagcgagttcgaaagttcagagggagtgtttttgttcccagaactgagaataatcagcacaattacgcgggaagttgagccagaaggggatggagccgaggatcccaccgtgcaagagtctctggtgtccgaagagatagtccacgatctagacacatgcgaggttaccgtagaaggcgaggaactgaaccatgaacaagaaagtctagaagtggacatggccagactccagcagaaaggaatcgaggtttccagcagcgagttgggtatgactttcactggggtggataccatggcttcttatgaagaggtcctgcatctgcttaggtataggaattggcatgccagatccctgcttgacagaaaattcaaactaatatgcagtgagctgaacggcaggtacatctccaatgagttcaaggtggaggttaacgtaattcataccgcaaatccaatggaacacgccaaccatatggcggctcaaccacagttcgtgcacccagagcacagaagcttcgttgacctttcaggccacaacctggctaatccccaccccttcgcggtagtaccaagcactgccacggtggtaatcgtggtgtgcgtgtcctttctcgtgttcatgatcattctgggggttttcaggatccgagccgctcaccgccgtacaatgcgcgaccaggatacagggaaggagaacgagatggactgggacgacagcgcgctcacaatcaccgtcaaccccatggagacttatgaagatcagcactcgagtgaggaagaggaggaagaggaggaggaagaggaatctgaggacggggaggaagaagatgacataacttccgccgaatctgagagctctgaggaagaggagggcgaacaaggggatccccaaaatgccacccggcagcagcagctcgaatgggatgactccaccctctcctactag

SEQ ID NO: 10872 - DNA, 2946 bp, Artificial Sequence
  Description of Artificial Sequence: Synthetic coding sequence
atgcttcggaggccagcaccggctctggccccagcggctcggctcctcctggcagggctcctttgcggcggtggagtgtgggctgcacgggtgaacaaacacaaaccatggttggaacctacctatcatggcatcgtcacagagaacgataacactgtgctcttggatcccccattgatcgctctcgataaggacgcgccactgaggttcgctgagtcttttgaggttaccgtgacaaaagagggcgaaatttgtgggttcaaaatccacggtcaaaacgtgccattcgacgctgtggttgtcgataaatctaccggcgagggggtcatcaggagcaaggaaaagttagattgcgagctgcagaaggattattcgttcactatccaggcatacgactgtggcaaaggacccgacggtaccaacgtgaagaagagtcacaaagcaaccgtacacatccaggttaacgatgtaaacgaatatgcacccgtttttaaggagaagagctacaaggctactgtgatagaggggaagcaatacgactctatcttgagagtggaagcagtcgacgctgactgctccccccagttctctcagatctgttcctacgaaatcataacccctgacgttccctttactgtggataaggacggctatataaagaatacagagaagttaaattatggtaaagaacaccagtataaactgaccgtcactgcatacgactgtggtaaaaagcgcgcaacagaagatgttctggtaaaaatctcgattaagcctacctgtacccccggatggcagggctggaacaatcgtatagagtatgagccagggaccggcgctttggctgtctttcctaacatccacctggagacctgcgacgaaccagtagcgtccgttcaggcaacagtggaactggagacctctcatatcggaaaagggtgtgacagggatacatatagcgagaagagcttgcacaggttatgcggggctgcggctgggaccgctgagctgctgccttctccttccggcagtctgaattggactatggggttaccgaccgacaatggtcacgattctgaccaagtgtttgagtttaacggcacccaagccgtgcgcattcctgacggtgtcgttagcgtgagcccaaaggaacctttcacgatctcggtttggatgaggcatggcccattcggcagaaagaaagaaaccatactttgcagtagcgacaagactgacatgaaccgtcaccattattccctgtacgtgcacggctgccgccttatattcttatttagacaggacccgagtgaagagaaaaaataccgccctgccgaattccactggaaactcaatcaggtctgcgacgaagaatggcaccattatgtactgaacgttgagtttcccagtgttactctgtacgtggatggaaccagccacgagcctttttcggtcaccgaggactacccacttcatccctctaagatcgagactcaattggtggtcggcgcatgctggcaagagtttagtggagtggaaaacgataacgagaccgagcctgttaccgtggctagtgccggtggtgacctccatatgacccagttcttcagaggaaacctcgccggactgacactgagaagcgggaaactggcggataaaaaggtaatagattgcctgtatacctgtaaagaggggctggatctgcaggtccttgaggatagcggacgtggcgtgcagattcaggctcatccaagtcagctggtgctgacgctggagggcgaggacctgggtgaactggacaaggccatgcagcacataagttacctcaacagcaggcagtttcccacaccagggattaggagacttaaaattacatccactattaaatgtttcaatgaggctacttgcattagcgtaccccctgtagatggctacgttatggttcttcagcctgaagagccaaaaattagtctcagtggcgttcaccactttgcaagggcggcttccgaattcgagtcttctgaaggggtatttctgttcccagagctgaggataatctctactattactagggaagtggagccggaaggcgacggagcagaagaccctaccgtccaggagagtttggtgagcgaggaaatcgtgcacgatctagatacgtgcgaggtaactgtagaaggggaggaacttaatcatgaacaggagagcttagaagtcgatatggcacgactccagcagaaagggatcgaagtttcctcatcggaactgggaatgacattcactggagtggataccatggcctcttacgaagaggtcctgcacctgctgcggtatcgcaactggcatgctaggtcccttctcgacagaaagtttaagctaatctgttctgagctgaacggacgatacatttctaatgagtttaaggtggaagtgaacgttatccacacagccaacccaatggagcacgctaatcatatggccgctcagccccagtttgtccatcctgaacacaggtcatttgtagatctgagcggccacaacctcgcgaaccctcatcccttcgctgtcgtgccctccacagctactgtagttatcgtggtatgtgtaagtttccttgtgtttatgatcattcttggcgtcttccggattagagccgcacaccgcaggacaatgagggaccaggatacggggaaggagaacgagatggactgggatgactcagccctcacaatcacagttaatcccatggaaacttacgaggaccagcattcatctgaggaggaggaggaagaagaagaggaggaagagtctgaggacggggaggaagaagatgacataacaagtgctgaatcagagagctctgaggaggaggagggcgaacagggcgatcctcagaatgctacacgtcagcagcagttagaatgggatgactccacactttcatactag

SEQ ID NO: 10873 - DNA, 678 bp, Artificial Sequence
  Description of Artificial Sequence: Synthetic coding sequence
atgtctgggtgctccaaaaggtgtaaattaggtttcgtaaagtttgcccaaactatctttaaactgattaccgggaccctgtctaaagataagatcgaggatgaactggaaatgacaatggtctgccatcggcctgaaggactggagcaacttgaagctcagacaaacttcacgaaacgggagctgcaggtgctttaccgcggtttcaagaatgagtgcccaagtggggtggtgaatgaagacacctttaagcagatctatgcccaatttttcccacatggagatgcaagcacctacgcacactacctgttcaatgccttcgatacgacccaaactggctctgtcaagtttgaggacttcgtgacagccttgtcgatccttctacggggaacagtccatgaaaagctcaggtggaccttcaacctgtacgacatcaacaaggatggctatatcaataaagaggagatgatggacattgtaaaggcaatttatgatatgatgggcaagtatacctaccccgtgctgaaagaggatacgcctcggcagcacgttgacgtgttcttccaaaaaatggacaaaaataaagacgggattgtgactttagatgagtttcttgagagctgccaggaagacgacaatatcatgcggtctttacagctgttccaaaacgtcatgtag

SEQ ID NO: 10874 - DNA, 420 bp, Artificial Sequence
  Description of Artificial Sequence: Synthetic coding sequence
atgtacaagcttgcatcttgttgtcttctgtttattgggttccttaatccattgctgtcactcccccttctggactctagggagatctcctttcagctctcagccccacacgaagacgcacgtctgacccccgaggaactggaaagagcctcgttgttgcagatcctgcccgaaatgctcggtgctgagagaggcgatatcctccggaaggcagactcttccacgaatatcttcaacccgagagggaacctgaggaagttccaagacttttcgggccaagaccctaacattcttctttcacacttgttggcacgcatttggaaaccttataagaaacaacgccgaaagctcaggcaggatctacgcctctggaaaaaagaaccgggtcttcgcatcttcaagaactacgtttgggtgtag

SEQ ID NO: 10875 - DNA, 879 bp, Artificial Sequence
  Description of Artificial Sequence: Synthetic coding sequence
atggaggtgacggcagtggccacacaagggggttacgggtcttccgattgggtcacctcttatcttctgatgttctccgacggcggtcgaaactggaagcagtataggcgcgaagagagcatctggggctttcctggtaataccaatgccgattctgtcgtgcattaccgactgcagcctccctttgaagccagatttttgcgcttcctccccctcgcctggaacccacgcggacggataggaatgaggattgaagtgtatggatgtgcatacaagtctgaagtggtatattttgacggccaaagtgccctgctgtatcggctcgacaagaagccccttaagccaatccgcgacgtgatttccctgaagtttaaggcaatgcaaagcaatgggatcctgcttcacagggagggccaacacgggaaccatatcaccctcgagcttatcaaaggaaagctggtcttcttcctgaactccggaaatgcgaaactcccgagtacaatagctccagttacactgacgctgggcagccttctcgatgaccagcactggcatagtgtcttgattgagttacttgatactcaggtgaactttactgtggataagcacacgcatcatttccaagccaagggggacagcagttacctggaccttaatttcgaaataagttttgggggtataccaacgccgggacgaagccgcgcttttaggagaaagagtttccacggctgcctagagaatttgtactacaatggtgtcgatgtcaccgagctggccaagaaacataaaccgcaaatcctcatgatggaacttgcccacggcttacaggaccagaatctgaagatctctctgacagtgtgccaccaaaccacgcagtag

SEQ ID NO: 10876 - DNA, 783 bp, Artificial Sequence
  Description of Artificial Sequence: Synthetic coding sequence
atgaagacgagcgacggatttactttaaatgctgaatcctacgtgagtttcacaactaagctcgacatacctacagctgcaaagtatgagtatggcgtgccccttcagacaagcgatagtttcctgcggttcccgtctagtttgaccagctccctatgcaccgacaataatccagctgccttcttggtgaatcaggcagtgaagtgcacacgcaagatcaacctcgagcagtgtgaagagatcgaagccctgtcgatggcattctactctagcccggaaatcctgagggttcccgatagtagaaagaaggtgcctattaccgttcagtctatcgtcattcagtccctgaataaaacactgacacgccgtgaggatacagacgtgctccagccgaccctggtgaatgcaggccacttctcactgtgcgtgaacgtggtgttggaagtgaagtattccttaacctatactgatgccggagaagttaccaaggctgacttgtcttttgtgttggggaccgtatcttccgtcgtggtgcctctacagcagaaattcgagatacattttttgcaaactgactggtcctctcctgtgtctgctcggtccacggagggggaagaacctgcagtgggccctgggctccctcgcctaagagggcctttttggaaattcccaggccctgggcatgctggccttggggctcaccctcttcaccacccagtgattcagcaggaggggttcctcccagctcccaggggctttggttacaggtccgaggtggactag

SEQ ID NO: 10877 - DNA, 3624 bp, Artificial Sequence
  Description of Artificial Sequence: Synthetic coding sequence
atggcaagtgtggcatgggccgtccttaaagtgctgcttctgttacctacccagacttggtctcccgtcggtgcgggtaatcccccagattgcgatgctcctcttgcctcagctctgcccaggtccagtttctcgtcctcttctgagttatcttcatcccatgggccaggtttttcgcgtcttaataggagagacggcgcaggaggatggacccctctagtcagtaataagtatcagtggctccaaatcgaccttggcgaacggatggaggtaacggctgtggccactcaaggagggtacggctcatcagactgggtgactagttatcttttgatgttttccgatggcggacgaaactggaaacagtatcgccgagaggagtctatatggggctttccaggtaataccaacgcagattcggttgtacattacagactccagcctccgtttgaagccagattcctcagattcctgccacttgcttggaatcccagaggcagaattgggatgcgaattgaggtgtacggctgcgcgtataagtccgaggtggtctattttgacgggcagtctgccctcttgtatcggttggataagaaacctctcaagcccatccgggacgtgataagcctgaagtttaaagccatgcagtccaacggaatcttgctgcacagagaaggccagcacggcaaccacataacccttgaattgattaaggggaagctggtgtttttcctgaatagtggaaatgcgaagctgccaagtaccatcgcacccgtgaccctgacgctcggctcattactggacgatcagcactggcatagcgtgctgatcgagcttctggacactcaagtgaattttaccgtggataaacacactcaccacttccaagccaagggcgatagctcgtatcttgacctaaactttgaaatctcatttggaggtatacccactcccggacggtcacgcgcatttagacggaaatctttccatgggtgcctggaaaacctgtactacaacggcgtagacgtaacagaactggctaagaagcataagcctcagatcctgatgatgggtaatgtctctttctcttgtccgcagccacaaacagtccccgtgacttttttatcctctcggtcatacctcgctcttccaggcaattccggggaggacaaagtatctgtgacctttcagttcaggacttggaatagagcaggacatctgcttttcggcgaattaaggcggggaagtggatcctttgtgctttttctgaaggacggaaaactcaaactgtcactcttccagcccggacagagtccgagaaatgttacagcgggtgcgggactgaacgacggacaatggcattctgtgtcattttcagctaagtggagccacatgaacgtcgtcgttgacgatgataccgctgtgcagcctctagtggctgtgcttattgattcaggggatacatactacttcggtggctgccttgataattcttctggctcagggtgtaaatcacccctcggagggttccagggctgtctcagattgatcactataggtgacaaggcagttgacccaatcttagtgcagcaaggagccctcggttctttccgcgaccttcagatagactcctgtggcatcacagacaggtgcctccctagctactgcgaacatggcggtgagtgctcccagtcttgggatacttttagttgcgattgccttgggacaggttacaccggggagacctgccactcctcgctctacgaacagagctgcgaggcacacaaacacagaggaaatccttccggtctttactacatcgacgcagacggtagtggccctctcgggcctttcctggtgtattgtaatatgaccgacgcggcttggacagtagtgcaacatggcggacctgatgcagtgacactccgcggtgcgccatctggtcacccacgtagtgctgtatccttcgcgtatgctgcgggagcgggtcagctgcgatccgccgtgaatcttgccgagcgctgcgaacagagactggccctcagatgcggaacagcgcgtcggcctgattctcgggacggaactccgttgagctggtgggtgggtagaaccaacgagacccatacatcgtggggaggctccctgcctgatgctcagaaatgtacatgcggcctggagggcaattgcatcgattcacagtactattgcaattgtgacgctggaagaaacgaatggacgtccgacacaatagtcctgtctcaaaaagagcacctccccgtcacgcagattgtgatgactgacgccggtcgaccacacagcgaggctgcgtacaccctcggaccactactgtgtcgaggggatcagtccttttggaatagcgcctcttttaacactgagacaagttacctccacttccctgcctttcacggcgagctgacagccgacgtttgcttctttttcaagactacggtgtcatctggcgtctttatggagaacttgggcatcactgattttattaggatagaactccgcgcaccaactgaagtaaccttcagctttgatgttggcaacggaccctgcgaggtgacggtccagagccctacgccgtttaatgacaaccaatggcatcatgtcagagcggaaaggaatgtgaagggcgcaagcctgcaggtggatcagctgccacaaaagatgcagcccgcaccagccgatggccatgtgcggttgcagctcaacagccagctcttcatcgaaatctcagcttatttcgccaccggaagctccatgacctatcattttcaggagcactacacactgtcagagaatagttcctccctcgtgtcttctttgcatcgggacgtaactctcacccgcgaaatgatcacactcagcttccggaccacccggactccaagcctcctgttatacgtgtcaagcttttacgaggaatatctgagtgtgatcctagctaacaatggctctttacagatccgctataaactcgacaggcatcagaacccggatgcatttaccttcgactttaaaaacatggctgacggtcaactgcaccaagttaagatcaaccgggaggaagcggtggtcatggtggaggtgaaccagagtactaaaaagcaggtgattctatcgagcgggaccgagttcaacgctgtaaaatcccttatcctcggcaaggtgctcgaagctgcaggagcagacccagacacccggcgtgcagctactagcggcttcaccggctgtctgtctgctgtgcggttcggcagggctgctcctctgaaggccgcattgcgaccgtctggaccatcgcgggtgaccgtgagaggccatgtggcgcctatggctaggtgcgcagcaggagccgcttcagggtcccctgctagggaattagcccctagactggcaggcggagccggaaggagcggccctgctgatgaaggagaaccattagtcaacgccgaccgtcgagacagcgcagtcatcggcggagtgatagccgttgtgattttcatcctcctgtgtatcaccgcaatagccatccgcatctaccagcagcgcaagctgcgaaaagagaacgagtctaaagtctccaagaaagaggagtgttag

SEQ ID NO: 10878 - DNA, 2238 bp, Artificial Sequence
  Description of Artificial Sequence: Synthetic coding sequence
atggcctcggtggcgtgggccgtgctgaaagtccttcttctgttgcccacccaaacctggagtcccgtcggagcaggaaacccacctgactgtgacgctcctctcgccagcgccctgccacgtagcagtttcagcagttccagtgagttgtccagcagccacgggccaggcttcagtcggctcaaccggcgagacggagcgggtggctggaccccgcttgtgtccaacaagtaccagtggctgcaaatagacttgggcgagcgaatggaagtaactgcagttgccacacagggaggatacggttcatcagattgggtcactagctatctcttgatgtttagtgacgggggaaggaactggaagcagtaccggagagaagagtcgatttggggattcccaggaaataccaacgccgactctgtcgtccattacagattgcaaccgccatttgaagccagatttttgagatttctgcccctggcatggaacccgcgaggaagaatcggaatgagaatcgaggtatacggttgtgcatacaaatccgaagttgtctacttcgatgggcaatcagctctgctctaccggttggataaaaagccgctgaagcctattcgggatgtgattagtcttaagttcaaggctatgcagtcgaacggtatcctactgcaccgagaagggcagcacggaaatcacatcactctggagctgattaaaggtaagctagtgtttttcttgaactccggaaacgccaaactgcccagtaccatcgcccctgttaccctgactctgggcagtctcctggatgaccagcattggcatagcgtcttgatcgagctgctggatacacaggtgaacttcactgtcgataagcatacgcatcacttccaagcaaaaggtgattccagctaccttgatcttaactttgagatcagtttcggaggcatacccacacctggccgatcccgagccttcaggagaaaatctttccacggctgcttggagaacctgtattataatggagttgatgtcaccgagctggcaaagaaacacaagcctcagatcctaatgatgggaaacgtgtcctttagttgtccgcagccccagaccgttcccgtgacatttctgagctcccggtcctatctcgctctgccaggaaactctggggaggacaaggtgtctgttacctttcagtttagaacctggaatagggctggccacctgctgtttggcgagctgcggcgtgggagtggctccttcgtgctgtttctgaaagatggaaaactgaagttgagtctgtttcagccgggacagtcacctagaaacgtgactgctggggcaggattaaatgacggacagtggcactctgtgtctttctccgcaaaatggtcccacatgaatgtcgtagtggacgatgatacagccgtccagcctctggtggctgtgctcatcgactccggagatacttattacttcggcggttgcctcgacaatagcagcggctccggatgtaaatctcccctcgggggatttcaaggctgcctccggctgattacgataggagacaaggctgtagacccgatcttggtgcagcagggggctttgggtagtttcagggatttacagatagactcttgcggtatcactgatcgatgcctgccatcttattgtgagcacggaggcgaatgttcccagtcctgggatactttcagctgcgactgcctaggcaccggatacacgggcgagacttgtcattcctctttgtatgaacagagctgcgaagcccacaagcaccgaggaaacccctccgggttgtactatattgatgctgatggctcggggccattgggtcccttcctcgtctactgcaatatgaccgatgcagcttggaccgtcgtccaacacggagggccagatgcagtcaccctgagaggggctcccagcggccatcctcgttcagcggtgagtttcgcctacgcagcgggagcaggtcagctgaggagcgcagtaaacttggcagaaagatgcgagcagagattagccttgcgctgcggaacggccagacgaccagattctcgggatggcacacccctgtcctggtgggtggggagaactaacgagacgcacacttcttgggggggtagtctccccgacgctcagaagtgcacatgcggactagagggaaactgcatcgacagccaatattactgtaattgcgacgccggacggaacgaatggtag

SEQ ID NO: 10879 - DNA, 549 bp, Artificial Sequence
  Description of Artificial Sequence: Synthetic coding sequence
atggagccgcagctgggtcccgaggccgcagccctgcgcccaggatggctggctcttctactgtgggtctcagcgttaagctgttcattttctctgccagcctcgtcgctgtctagcctggtgccacaggtgcgtactagctacaatttcggacgtacgtttctaggtctcgacaaatgcaatgcctgcatcggaaccagtatctgcaaaaaatttttcaaagaagagatccgctccgataattggctcgcttctcacctgggcttgcccccagattctctgttgtcataccctgctaattattccgatgatagtaagatttggcgccctgtggagattttccgattagtaagcaaataccagaatgaaatttccgaccgtcgcatatgcgcgtctgcgtcagctccaaagacctgcagcatcgagagggtcctacggaaaactgagagatttcagaagtggctccaggccaaacggctgacccctgacctggttcaggactgccatcagggccagcgggaactaaagttcctctgcatgctccgatag

SEQ ID NO: 10880 - DNA, 282 bp, Artificial Sequence
  Description of Artificial Sequence: Synthetic coding sequence
atggatagcctgcgcaaaatgttaatctcagtcgctatgcttggcgcaggcgcaggcgtgggctatgcactgcttgtaatcgtgacgccaggagaacgcaggaagcaggaaatgttgaaagagatgcctctacaagacccgcgtagtcgggaggaggccgcaaggactcagcagctgctactcgctaccttacaggaggctgcaaccacccaagagaacgtggcttggagaaagaactggatggtaggcggagaaggcggagcaggcggacggtcaccatag

SEQ ID NO: 10881 - DNA, 387 bp, Artificial Sequence
  Description of Artificial Sequence: Synthetic coding sequence
atgggaaagtccgcaagtaagcagtttcacaacgaggtgttaaaagcacacaacgagtaccgacagaaacatggtgtcccgcctctcaaactgtgtaaaaacttaaaccgtgaggcgcagcagtacagcgaggcactggcttcaacgcgcatacttaagcactctccagagtcctctaggggccaatgtggcgagaatttggcctgggcttcctacgaccaaacgggacatttcacggccatggtatggaagaacaccaagaagatgggggttggcaaggccagcgctagtgatggctctagttttgtggttgccaggtatttcccagctggaaatgtggtgaatgagggtttcttcgaggaaaatgtactgcccccaaaaaaatag

SEQ ID NO: 10882 - DNA, 465 bp, Artificial Sequence
  Description of Artificial Sequence: Synthetic coding sequence
atggggaagtcagctagcaagcagttccacaacgaagtcctgaaggcgcataatgagtacagacagaagcacggcgttccgcctctcaagctgtgcaagaatcttaatcgtgaagcacagcagtatagcgaagccctggcttctacccggattttgaaacactcccctgagagctcacggggtcaatgcggagagaacttagcatgggctagctacgaccagacaggcaaagaggtggcagacaggtggtactcagagatcaagaactacaattttcagcagcctggctttacctctggaactgggcacttcacggctatggtgtggaagaacacgaagaaaatgggagtgggcaaagctagcgcatcggatggatcgagcttcgtcgtggcccgttattttcccgcagggaacgtagtaaatgaaggattttttgaagaaaacgtcctcccacccaagaagtag

SEQ ID NO: 10883 - DNA, 831 bp, Artificial Sequence
  Description of Artificial Sequence: Synthetic coding sequence
atggacagctcacgagagccgacactggggcgtctagacgctgctgggttctggcaggtgtggcaaagatttgatgcagacgaaaagggatacatcgaagaaaaagaactagacgcattttttctccacatgcttatgaaactgggcactgatgatacagtcatgaaggccaatctgcataaggttaagcaacagtttatgacaactcaggacgcctctaaggatggccgtatccgtatgaaggaattggccggtatgttcctaagtgaagatgaaaatttccttcttctgttccgcagagagaatccccttgactccagcgtggaattcatgcagatctggcggaaatatgatgccgattcgtctggattcatttctgcagccgaacttaggaactttttgcgtgacctgtttctgcaccataagaaggctatcagtgaagcgaagctggaggagtatacgggaacgatgatgaagattttcgatagaaacaaagatggacgtctggatctgaatgacctggcacgtatcctcgccctgcaagaaaatttcttgttacagttcaaaatggatgcttgttccactgaggaacgtaagagagatttcgaaaaaatatttgcctattacgacgtttctaaaactggcgctttggagggaccagaagtggacgggttcgtgaaggatatgatggaactggtgcagccttcaatcagtggagtggacctggataagtttagggaaatcctgttgcggcactgcgatgtaaataaagacgggaaaatccagaagtcagagctggccctgtgtcttggcctgaagatcaacccgtag

SEQ ID NO: 10884 - DNA, 216 bp, Artificial Sequence
  Description of Artificial Sequence: Synthetic coding sequence
atgcccgcaggtgtgcccatgtctacatacctcaaaatgttcgcggcttctctgctggcaatgtgcgccggtgccgaagtcgtgcatcgctattatcgccctgacctgacaatcccagagatccccccaaaaaggggtgagctcaagacagagctactggggttgaaagaacggaaacacaagcctcaagtctcacaacaagaggagctcaagtag

SEQ ID NO: 10885 - DNA, 1287 bp, Artificial Sequence
  Description of Artificial Sequence: Synthetic coding sequence
atgaagcctatgctgaaagacttttccaatcttctgctcgtcgtgctttgcgactatgtcctcggggaggccgaatacctgttgcttcgtgaacctggccacgtggcactcagcaatgacactgtgtatgtggactttcagtacttcgatggtgctaatgggaccttacgaaatgtgagtgtgctcttgcttgaggcgaatacgaaccagacagtcacaacaaagtacctcctgaccaatcaatcacagggaaccctcaaattcgagtgtttctactttaaagaggctggagactactggtttaccatgaccccggaggcgaccgataattcaacaccgtttccatggtgggagaagtccgccttccttaaggtagagtggcctgtcttccacgtcgatctcaaccggagtgctaaagctgctgagggaactttccaggtaggcctgtttaccagtcagcctttatgtcccttccccgtcgataagccaaatatcgtggtggacgtgatcttcaccaatagcctgcccgaggccagaagaaatagcagacaacctctcgaaattagaacctcgaagcgcaccgagctcgcccaaggccagtgggtcgagttcgggtgtgcaccattgggccctgaggcttatgtaactgttgtgctgaaactcctgggaagggatagcgtaatcaccagtactgggcctatcgacctggcacagaaatttggatataagctcgtgatggtgcctgaactcacgtgtgagtctggagttgaagtgacagtgcttcccccaccatgtacgtttgtgcaaggtgtggtcaccgtcttcaaggaagcccctaggtacccgggaaaacgaactatccacctcgcagaaaattcacttccactgggggagagacggaccattttcaattgcacgctcttcgacatgggaaagaataagtactgcttcgactttggtatcagttcaaggtctcacttcagcgccaaggaagagtgtatgctgattcagcgaaacacagagacatggggcctgtggcagccgtggtctcagtgtagtgccacttgtggtgatggggtcagagaacgtagacgtgtatgcctgacttcttttccctcgtctcccgtatgtcctggcatgagcctcgaagcttcactttgttcactggaagagtgcgcaggacgcttccgatcgtgttgcccaggctggagtgcaatggtaagaagccgcctgacaaattcagcaagtagggttcaggccattttactgcctcaacccctggcttag

SEQ ID NO: 10886 - DNA, 312 bp, Artificial Sequence
  Description of Artificial Sequence: Synthetic coding sequence
atgaaactgtgtgtgactgtgctgtccttgctcgtgttggtggccgcattttgtagcttggcgctgtccgctcccatggggtcagacccgccaactgcttgctgtttcagctacacagccagaaagcttcccagaaatttcgtagtggattattacgagacgagcagtctgtgttctcaacctgccgtagtttacagggaaagtgccagttcagccgcaccaggcaggatacccagtacccgtgccgctccacacggtccatggtcaggacggggaagatgtctgccgcaggcaagggacaaagcccgttag

SEQ ID NO: 10887 - DNA, 279 bp, Artificial Sequence
  Description of Artificial Sequence: Synthetic coding sequence
atgaaactctgtgtaactgtgcttagtctgctggtgttggtcgccgctttttgtagtttagccctatcagccccaatggggagcgatccccctaccgcatgttgtttctcctacactgccaggaaactgcccaggaactttgtggtcgactactacgagacaagctctctgtgctcgcagccagccgtcccatgggattctaatcttggcaagcaagtgtgtgccgatcccagcgaaagttgggtccaggaatacgtgtatgacctagagttgaattag

SEQ ID NO: 10888 - DNA, 282 bp, Artificial Sequence
  Description of Artificial Sequence: Synthetic coding sequence
atgcaggtgagcacggcagcacttgctgtgctcttgtgcacaatggccctgtgcaaccaggtattgtctgcccctctggccgctgataccccgacagcctgctgtttcagctatacttcaaggcagattccacagaacttcattgccgattactttgagacctctagtcaatgttccaaacctagtgtcatcttccttactaagagaggaagacaggtctgcgccgaccctagtgaagagtgggtccagaagtacgtgtccgaccttgagttgagcgcttag

SEQ ID NO: 10889 - DNA, 1869 bp, Artificial Sequence
  Description of Artificial Sequence: Synthetic coding sequence
atgggcaagtctgaggggccagtgggcatggtggaaagcgcagggagagccggtcaaaagcggcctggtttccttgagggcggattactcctcctgctgttactagtgaccgccgctctagtggctttgggtgtgctctacgccgacaggcggggaaagcagttgcctcgactggcttccagactttgttttttgcaggaggagcggacctttgtgaaaaggaagcccaggggaattcccgaagctcaggaagtctccgaggtatgtacaaccccaggctgcgtcatagcagcggcacgtatcttgcagaacatggaccctactaccgaaccgtgtgacgacttctaccagtttgcttgcggcggatggcttcgtagacatgtgatcccagaaaccaactcacgctacagcatctttgacgtgctccgcgatgaacttgaagttatcctgaaggttgagcttgagacccagcttgccaaagccacagtgccacaggaggagcggcatgacgttattgccctatatcatcgcatgggcctggaagaactccagtcccagtttggtctgaaaggcttcaattggacactgtttattcaaaccgttctttcgtctgtgaaaattaagctcctgcccgatgaggaagtggtggtttacggcataccctacctgcagaatctggagaacatcattgacacgtatagcgctcggaccatccagaattatctcgtgtggcgcttggtactggatcgcattgggagtctatctcagagatttaaagacacgagagttaactaccgaaaagctttattcggcactatggttgaggaggtgagatggcgagagtgcgtaggctacgtgaattccaacatggaaaacgctgttggcagtctttatgtgcgggaggccttccctggcgactctaagagcatggtcagagaactgatagataaagttcgaaccgtgttcgttgagacactcgatgaactggggtggatggatgaggaatctaagaagaaggcccaggagaaggccatgagtatccgggaacagatcggtcacccggattacattctcgaagagatgaatcgccgacttgatgaagagtattcaaatctcaactttagtgaggatctgtatttcgagaattctctacagaacctcaaagtgggggcacagcgcagcttaaggaaacttcgcgagaaggtggacccgaacctttggatcatcggcgcagcggtggtgaatgcgttttattcccccaaccgcaatcagatcgtgtttccggctgggatcctacagcccccatttttcagtaaggaacagccccaggcgctcaatttcgggggtatcggcatggttattggacacgagattactcatggatttgatgataatggcagaaattttgataagaacgggaatatgatggactggtggtcaaatttttccacccagcattttcgagagcagagcgaatgtatgatttaccagtacggaaactattcttgggaccttgccgacgaacaaaacgttaacgggtttaacaccttgggcgaaaacatcgcagacaatggcggagtacgacaggcttacaaggcatatctcaagtggatggccgaaggtggaaaagatcaacagctaccaggtctcgaccttacccacgaacagctattttttatcaactatgctcaggtctggtgcggttcttaccgcccagaattcgcaatccagagcattaaaaccgacgtccattcccccctcaaataccgggtcctgggctcacttcagaatcttgccgctttcgctgatacctttcactgcgccagaggaactcccatgcacccaaaggaacgatgtcgggtgtggtag

SEQ ID NO: 10890 - DNA, 2340 bp, Artificial Sequence
  Description of Artificial Sequence: Synthetic coding sequence
atgggcaagtccgaaggacccgtaggcatggtcgaatccgcgggacgggctggccagaagaggccaggtttcctggagggaggcctgctgttgcttttactactagtgactgcagctctagtggcgctaggtgtgctctatgcagatcggcgtggaaagcagcttccacgactggctagtagactttgtttcttacaggaggaaagaactttcgtgaaaagaaaaccccgtggtatccctgaggcacaggaggtgagcgaagtttgtacaactccaggatgtgtcatcgccgctgctcgcatactacagaatatggacccaactaccgagccctgtgacgacttctatcaattcgcctgtggtggttggctcaggaggcatgtgataccggagaccaactccagatattctatcttcgatgttcttagggatgagctcgaggtgatactcaaagcagtcttggaaaattctacggctaaggaccgaccagctgtcgagaaagctcgtactctgtaccgctcctgcatgaaccagtctgttattgaaaaacgcggtagccagccattgttagacatccttgaagtcgtcggtggctggcctgtggccatggacaggtggaacgaaactgtagggttggaatgggagttggaacgtcagctcgcactgatgaattcacagttcaaccgcagggtcttgatagacttattcatttggaacgacgatcagaatagctcaaggcacatcatctatatcgatcagcctacgctgggcatgcctagccgagagtattactttaatggcggatccaaccggaaagtgcgcgaggcctacctccagttcatggtaagtgtggccacgctcttgagagaagatgcaaacctgcccagagatagttgcctggtgcaggaagatatggttcaggtgttagagttggagactcagctggccaaagcgactgtcccccaagaggaacggcacgacgtgattgccctgtatcatcggatgggtctggaggaattacaatcacagttcgggttgaaaggctttaactggacattattcatccagaccgtcctgagcagtgtcaagatcaagttactgcctgacgaggaagtcgtggtgtacgggatcccttacctacagaacctggagaatattatcgacacttactcagccagaactatacagaactatttagtgtggaggttagtactggacagaatcggctctctgagtcaacggtttaaggatactcgagttaattacagaaaagctctctttgggaccatggtagaggaagttcggtggagggagtgtgtgggatacgtgaattccaatatggaaaatgcagtggggagcctatacgtccgagaagcctttccaggcgactctaagtcaatggtgcgggagcttattgataaggtacgcactgtttttgtggagacgctcgatgaactcgggtggatggacgaggagagcaagaagaaggcacaggagaaggcaatgtcaatccgcgaacagataggccacccagactacatcctggaagagatgaaccgcaggctggatgaagagtatagcaacttgaattttagcgaggatctatactttgagaacagcctgcaaaatctgaaggtgggcgctcagaggagtctaagaaaacttcgggagaaagtagaccctaatctttggataattggtgccgcagtggtcaatgccttctactcacccaataggaatcagatcgttttcccagctgggatcctgcagccacccttcttttcaaaagagcagccacaagcattgaacttcgggggaattggcatggttattgggcacgaaattacgcatggctttgacgacaacggccgtaatttcgataagaacggaaacatgatggactggtggtctaatttcagcacccagcatttcagggaacagagtgaatgcatgatctatcagtacggaaactacagctgggacctggccgacgagcaaaacgtgaatggcttcaacacgctcggcgagaacattgcggataacggcggagtgagacaggcttacaaggcatatctgaaatggatggcagaaggtggtaaggaccagcagctgccaggcctggacctgacccacgaacagttgttttttatcaattatgcccaggtctggtgcggatcctatcgacctgaatttgctatccaatctatcaaaaccgacgtccattcccccctgaagtacagggttctaggatccttgcaaaatttagccgcattcgctgatacattccactgcgcaaggggaacacctatgcatcctaaagaaagatgccgcgtatggtag

SEQ ID NO: 10891 - DNA, 258 bp, Artificial Sequence
  Description of Artificial Sequence: Synthetic coding sequence
atgtccgtccatatgcctgcaatgaagatttgcgaaaaactgaagaagttggatagtcagatctgtgagttgaagtacgagaaaacgctcgatcttgcaagcgttgatctgcgaaagatgcgcgtcgcggagctaaaacagatcctgcatagttggggtgaagagtgcagagcttgcgccgaaaagactgactacgtcaatctgattcaggagcttgccccaaagtacgccgcaactcatcctaaaacagagctgtag

SEQ ID NO: 10892 - DNA, 657 bp, Artificial Sequence
  Description of Artificial Sequence: Synthetic coding sequence
atggggcgtgtgttcctgaccggagaaaaggctaattctatcctgaagagatatccaagggcaaatggcttctttgaggagatccgtcagggaaatatcgagagagaatgcaaagaggagttttgcacattcgaagaggctagagaggcattcgagaataacgaaaagaccaaggagttttggagtacatatactaaggcccaacaaggagagagtaaccggggatccgattggttccagttttatctgacattccctcttatctttggactatttattatcttattggtcatctttttgatttggcgctgcttccttaggaacaagacgcggaggcagaccgtaacggagggccatattccatttccccagcatctgaacattattacacccccacctcctccagacgaggttttcgactcgtctggactctctccaggtttcctcggctatgtcgtgggcaggtctgactccgtctctaccagactttcaaattgcgacccaccacctacatatgaagaggccactgggcaggtgaacctgcaacgctcagagacagaaccccacttggatcctccacccgagtatgaagacatagtcaactcaaatagcgctagcgctatacctatggtacccgttgttacaacaatcaagtag

SEQ ID NO: 10893 - DNA, 1365 bp, Artificial Sequence
  Description of Artificial Sequence: Synthetic coding sequence
atggccagacctaacaaattcttgctgtggttctgctgcttcgcatggctgtgcttccctatcagtctggggtcccaggctagcggtggagaagctcagattgctgcgtccgccgaactggagtcaggcgctatgccctggtccctgctgcagcacatcgatgaacgagacagggcaggtttactgcccgcactgttcaaggtgttgtccgtgggcagaggtgggtcccctcggttgcaacccgacagcagagctttgcattacatgaagaagctatataaaacttatgctaccaaagaaggcattcctaaaagcaatcgatcccacctatataacacggtgaggctttttaccccttgcacacgacacaagcaggcgccaggggatcaggtgaccggcattctgcccagcgtggaattactgtttaatctagacaggatcactactgtggagcacctgctgaagtcagttctgctatacaacatcaacaacagcgtctcattttcatccgcggtaaagtgtgtgtgcaatctgatgataaaagagccaaagagcagctctcggaccttaggacgggcaccttattcatttacttttaatagtcagttcgaattcgggaaaaagcacaagtggattcagatagacgtcaccagccttctccagcctctggtggcctccaataaacgatctatccatatgagtataaactttacttgtatgaaagatcaactcgagcacccctctgcccagaacgggcttttcaatatgacccttgtatcgccctctctcatcttatacttaaatgatacctccgcccaggcctaccacagctggtattcccttcattataaaagaaggccatcccagggaccagatcaggagcgctccctctcagcttatccagtcggggaggaagcggctgaagatggtcggtcctcgcaccatcggcaccgtaggggccaggagacagtgtcgtcagaactgaaaaaaccattaggccctgcctcatttaacctttcagagtattttcgccaatttctgctaccccagaatgaatgtgaattacacgacttcagactctccttttctcaattgaaatgggataattggatcgtagcgccacacaggtacaatcctagatattgcaaaggggactgcccccgagccgtggggcaccggtatgggtcccctgtgcacactatggtgcaaaatatcatctacgagaaactggatagcagcgtacctcggcctagctgcgtaccagcgaagtatagtcccttgagtgtcctcacgatagagccagacggctccattgcctacaaggagtacgaagacatgatcgctactaagtgcacttgccggtag

SEQ ID NO: 10894 - DNA, 417 bp, Artificial Sequence
  Description of Artificial Sequence: Synthetic coding sequence
atgacctggagacaggctgtcttactctcgtgcttctcagcagtggtgctcctgtccatgttgagagagggaacatctgtatcagtgggaaccatgcagatggccggtgaggaggcctccgaggacgcaaagcagaagatattcatgcaggaatctgatgcatcaaatttcctgaaaaggaggggcaaaagaagccctaagagtcgggacgaggtaaatgtggagaaccggcaaaaactgagagtggacgagctgcgtagagagtactacgaagagcagaggaacgaatttgaaaatttcgtggaggagcagaacgatgagcaggaagaaaggtctcgcgaagcagtggagcagtggcgtcagtggcactatgacgggcttcaccccagctacctgtataatagacatcatacttag

SEQ ID NO: 10895 - DNA, 729 bp, Artificial Sequence
  Description of Artificial Sequence: Synthetic coding sequence
atggccttgaaaaataaattctcctgcttgtggattcttggcctttgtctcgtcgctactacctcctctaagattccgagcatcaccgaccctcattttattgacaactgcattgaggctcacaatgagtggaggggcaaggtaaacccccctgccgctgatatgaaatatatgatctgggataaaggtctggctaagatggccaaggcctgggcaaaccagtgcaaattcgagcataacgactgccttgacaagtcttataaatgctatgccgcttttgaatacgtgggcgagaacatctggctcggaggtatcaaaagttttacccccaggcatgccatcaccgcctggtataatgaaacgcaattttacgattttgactctttgtcctgctctcgcgtatgtggccactacacccagctggtctgggcaaattccttctatgtgggttgcgctgtggcaatgtgtcccaacctaggcggagcttccaccgctatattcgtctgcaattatggtcccgcaggaaatttcgctaatatgcccccttatgtgaggggcgaaagttgcagcttatgttccaaggaggagaaatgcgtcaagaacctatgccgcaccccacagctgatcattccaaaccagaacccttttctgaaacccactggcagagcaccacagcagaccgcttttaatcctttcagcctcggtttcctgctgctgaggatcttttag

SEQ ID NO: 10896 - DNA, 813 bp, Artificial Sequence
  Description of Artificial Sequence: Synthetic coding sequence
atgctccggcagttgctactggcagccctgtgtttagctggacctcctgcccctgccagagcctgccagctgcccagcgaatggcggccattatccgaggggtgtcgggcagagctggccgagactatcgtgtatgccagggtgttggctctgcacccagaggcgcctggcttatataaccacctgccttggcaatatcacgcaggccagggcggtctcttctattctgccgaggtcgaaatgctgtgtgaccaagcttggggcagcatgctcgaggttccggctggctctagactgaacttgactgggttaggatacttctcatgccattcccacactgtggtgcaggattacagctacttcttctttctgcgcatggatgagaactataacctgttgccccacggagtcaacttccaggacgcgattttcccagacacccaggaaaacagacggatgttctccagcctttttcagttcagcaattgcagccaggggcagcagcttgccacattttcatccgattgggagatacaagaggacagcaggctcatgtgttcttccgtccagaaggctcttttcgaagaagaagatcacgtgaagaaactccaacagaaggtggccactctggaaaaaaggaatcgccagctgagggaacgcgtcaagaaggttaagagatctctgagacaagccagaaagaagggacgacatctggagctagcgaatcagaagctctctgaaaagttggccgcaggcgcattgccacatattaatgctcgcggtccggtgagaccaccctacctgcgaggctag

SEQ ID NO: 10897 - DNA, 438 bp, Artificial Sequence
  Description of Artificial Sequence: Synthetic coding sequence
atggatgagaactacaacttactaccacacggcgtcaactttcaggatgccatcttcccagacactcaggagaatagaagaatgttcagtagcctttttcaattttccaattgttctcagggccagcaattggctacgttttctagtgattgggaaatacaagaagactcaagattgatgtgttctagtgtccagaaggccctcttcgaagaggaggatcatgtgaaaaagctgcagcagaaggtcgcaacattagaaaagcgcaacaggcagctgagggagcgcgtgaaaaaggttaagcgaagcttacgacaggcgagaaaaaagggcaggcatctggagttagctaatcagaaactgtcagagaaactggcagccggagccctgcctcacattaacgctagaggacctgtccgcccaccataccttcgcggatag

SEQ ID NO: 10898 - DNA, 1830 bp, Artificial Sequence
  Description of Artificial Sequence: Synthetic coding sequence
atggaactcggctgctggacacagttaggccttacattcctgcagttgctgctgatatcaagcctcccgagggagtacactgtcatcaatgaggcatgccccggtgccgaatggaacatcatgtgcagggagtgttgtgagtacgaccagatcgagtgtgtgtgcccaggtaagagggaggtagtgggatataccataccttgttgcaggaatgaggaaaatgagtgcgactcttgtttgatacatccaggctgtactatttttgaaaactgcaaaagttgtcgaaacgggtcctgggggggaacattggatgacttctatgtcaaaggcttttattgcgcagaatgtagagccggttggtacgggggagactgtatgccatgcagttcgagtccttgcttccacgacgggacctgcgtgctggacaaggcaggaagttataagtgcgcctgtcttgccggatatacaggccagaggtgcgagaatctccttgaggagaggaactgtagcgatccaggcggtccagtcaacggataccaaaaaatcacagggggtccaggcctgatcaatggacgccatgctaagattgggacagtggtgtcattcttctgtaacaacagctatgtgctaagtggcaatgaaaagaggacgtgccaacagaacggtgagtggtcaggaaagcagccaatctgtatcaaagcgtgccgggaaccaaaaatctctgacctggtgcggcgacgcgtcctgcccatgcaagtacaatctagggagactccattgcaccagctctattctgctgccttttcaaaacaaaagctgcagtctgcaccaaccaagaaacccgctctccccttcggagacttaccaatgggataccagcacttgcacacccagctgcagtatgaatgcattagtccattttaccgcagattggggtcctcccgaaggacctgtctccgtactggcaaatggtctggcagggccccttcatgcatcccaatttgcggcaaaatagagaacattaccgctcccaaaacacaagggctgcgatggccttggcaggccgcaatttatcgacggactagcggggtgcacgatgggagcttacataaaggggcatggttcctagtgtgttccggagcactggtaaacgaacgaacggtggtggtggcagcgcactgtgttaccgacttgggcaaggttacaatgattaagaccgcagacttgaaagtggtgctaggaaaattttatcgtgacgacgatcgcgacgagaaaactatccaaagcctgcaaatctctgctatcatcctccaccccaattacgatcccatactcctcgacgcagacatcgctattctgaagttgttggataaggccaggatttcaaccagagtccaacccatctgcttggcagcctctagggatttatcaacttcgttccaggagtcccatatcacagttgccggttggaacgtgcttgctgatgtcagatctcctggtttcaaaaatgatacccttaggtctggcgttgtttctgttgtggacagtctgctgtgtgaagaacagcatgaagatcacggtatccctgtttcagtcacagacaatatgttttgcgcctcctgggaacctactgcccctagcgatatttgcacagcggagacaggaggtattgcagctgtctcgtttcctggcagagcgtctccggagcctcggtggcacctgatgggactcgtgtcctggtcctacgacaaaacctgtagtcacagactaagcacagccttcacaaaagtgcttcccttcaaggattggattgaacggaacatgaagtag

SEQ ID NO: 10899 - DNA, 2163 bp, Artificial Sequence
  Description of Artificial Sequence: Synthetic coding sequence
atggaactgggctgttggacgcagctcgggctcaccttcttgcaactcctgctgatctccagtctacccagggaatacacggtcataaatgaggcgtgtccgggtgccgagtggaacatcatgtgccgagagtgttgcgaatatgaccaaatagaatgtgtctgtccgggaaagcgggaggttgtcgggtacaccattccatgttgtaggaatgaagagaatgagtgtgactcctgcctgatccatccagggtgtacgatatttgagaactgcaagtcatgcagaaacggatcctggggaggcactctggacgacttctacgttaaggggttttattgtgccgagtgtcgagccggttggtacgggggagactgtatgagatgcgggcaggtattaagagcacccaaggggcagatattactggagtcctatcctcttaacgctcactgtgagtggaccattcatgccaaacctggatttgtgattcaactgaggttcgtaatgctgtcactcgaatttgattacatgtgccagtatgactatgtcgaagtcagagatggggacaatcgagatggacagattatcaaaagggtgtgcggtaacgagcggcctgcccctatccagtcgattgggtccagcctgcacgtgttattccattctgatgggtctaaaaatttcgacggttttcatgcaatctacgaagaaattaccgcgtgtagttcaagcccttgctttcacgatgggacatgtgtactggataaggccggttcatacaagtgtgcctgtctggctggttacacaggacaacggtgcgaaaatctcctggaagaaaggaactgtagtgacccaggtggcccagtcaatggttaccaaaagatcactgggggacctggccttataaatggacggcacgcaaagatcggcaccgtcgtcagttttttctgcaataacagctatgtactcagtggtaacgagaaacggacctgtcagcagaatggcgaatggtccgggaagcagcctatctgcatcaaagcatgcagggagcccaaaatctcagacctggtgagaaggcgggtgctcccaatgcaggtgcagtccagggaaacccccttacatcagctctattctgccgctttttcaaaacagaagttgcagtctgccccaaccaagaagccagctctgcctttcggtgatctgcctatgggataccagcacctccatactcaactccagtatgagtgtatcagccccttttacagacggctgggaagcagtaggagaacctgtttaaggaccggcaagtggagtggacgcgcaccaagttgcatacccatttgtgggaagatcgagaacatcacggctccaaaaacgcagggcctacgctggccatggcaagccgcaatttatcgacgaacttccggggttcacgatggatctctccataagggcgcatggtttctcgtgtgcagcggcgctctcgtcaatgaaagaactgttgtagtggctgctcactgcgtgacagatctgggcaaggtcactatgatcaaaacagccgatctgaaagttgtcttgggcaagttttaccgggatgacgacagggacgaaaaaacaatccagagcctgcagataagtgctataatcctccaccccaattacgaccctattctgctcgatgctgacatcgcaatcctaaagctccttgacaaggccagaatctcgaccagggtgcagcctatatgtctggccgcttccagagacctatccacttcattccaggagagtcatatcaccgtggcaggatggaacgtgttggcagacgtgaggagccccggttttaagaacgacaccttgcgatctggggtcgtgtccgtagtggatagcctactgtgcgaggaacagcatgaagatcatggaattcctgtatcagtaaccgataatatgttctgcgccagctgggaaccaaccgctccctctgatatctgcaccgcagaaaccggaggaatcgccgcagtttcttttccaggaagagcgtccccagagccccgttggcatctcatgggcctcgtatcatggtcctatgataagacgtgtagtcataggctgtcgacagcctttacaaaggtccttcctttcaaggactggatcgaacgcaatatgaagtag

SEQ ID NO: 10900 - DNA, 1134 bp, Artificial Sequence
  Description of Artificial Sequence: Synthetic coding sequence
atggaggccctcttgcttggtgcagggctcttgctcggggcatacgtcttagtctattataatctagtaaaagcaccaccatgtggcggtatggggaatctccggggtcggactgccgtggtgactggagccaatagcgggatcggtaagatgaccgccctggaattggcccgacgaggtgctcgagtcgtgctcgcatgtagaagccaggaacgtggtgaggcagccgctttcgatctgaggcaagagtccgggaacaatgaggtgatattcatggccctggatctggcgtcactggcgagcgttcgcgctttcgctactgcttttctgtcttctgaaccccgactcgacatccttattcataacgctggaatctcttcttgcggtcgtactcgggaggcgtttaatcttcttctgcgggtcaaccatatcggcccttttttgctaacacacctcctgttaccttgcctcaaagcttgtgcccctagtcgggtggtggtcgtggcttctgctgcccattgtcgagggaggctcgatttcaagcgccttgaccgacccgtggtcggctggcggcaggaactgagagcttacgctgataccaagctcgcgaacgttctgttcgctagggagctggcaaaccaattggaagcaactggggtaacttgctacgccgctcacccaggcccagtgaactctgagctatttcttagacacgtccccggttggctccggcctcttttgagaccactcgcttggttggtgctgagagcacctaggggcggtgctcagactcctttgtattgcgctcttcaggagggcattgagccactgagcggacgctactttgctaattgccatgttgaggaggtgcccccagctgcacgtgacgacagggctgcccaccggttgtgggaagcctcaaagaggttagccggactaggcccaggcgaggatgctgaaccggatgaggacccacagtcggaggattctgaggcaccatcatcactctctacccctcatccagaagaacctactgtctcccagccctacccatccccccagtccagccctgaccttagcaaaatgacacataggatccaagcaaaggtggagcccgagattcaactgtcctag

SEQ ID NO: 10901 - DNA, 381 bp, Artificial Sequence
  Description of Artificial Sequence: Synthetic coding sequence
atgatctcattccatgtgatctttctgtcactgggcagaggcaaactgttcctgcccgtcaacttctgctttcttaagctcaagaactctcaggtcaggatccctaaggattttacctgcaacctgcatgtcctcttcaggacagtccaaggcgaggatagaaacaccatgttcagaggacactggagcatctattcccggaactttcccttggcggtagttccggcttatgtaaccgaagacgggaagaatacaagccacagagcctcaggacaattttgcaacgccctatcgcagggggaaattccctctagcctccaactcgtgaacagctatgctttagaacccaggactgacatgccctgtaactttctgacctag

SEQ ID NO: 10902 - DNA, 876 bp, Artificial Sequence
  Description of Artificial Sequence: Synthetic coding sequence
atggctgtcaccttgagcctactgctgggtggacgcgtatgtgccgcagtgactcgttgtggatttgccacccgcggagtggccggacccggacccatcggcagagagcccgatccggatagtgactgggaacctgaagaacgcgagttgcaggaggtggaatccaccctgaagcgtcaaaaacaagcgattcggtttcaaaagattaggagacaaatggaggctcccggtgcacctcctagaacattgacctgggaggcgatggaacagatccgatatttacacgaggaatttccggaatcttggtccgtgccaagactggccgaagggttcgatgtgtctaccgatgttattcgtagggtgctgaagagtaagttccttcctaccctggagcagaagctcaaacaagaccaaaaggtgctcaagaaagccggactggcccacagcttgcagcacctgcgagggagcggcaacacttccaagctgcttccggctggacacagcgtgagtggctccctgctaatgcctggccatgaggcttcaagtaaggacccaaatcatagtaccgctctaaaagtgattgaaagcgacacccatcgcaccaatacaccccgaaggagaaaggggagaaataaagaaatccaggatctggaagaatcctttgtgcctgtcgctgctccattgggccatcctcgcgagctgcaaaagtattcaagcgatagcgagagcccaagggggactgggagcggggctctgcctagtggacagaaactggaagagctgaaggccgaggagcctgacaattttagtagcaaggtagtgcaaagaggtagagagtttttcgatagtaacgggaatttcttataccgtatttag

SEQ ID NO: 10903 - DNA, 2541 bp, Artificial Sequence
  Description of Artificial Sequence: Synthetic coding sequence
atgtttaaatgttggagcgttgtgctcgtcctgggatttattttcctcgagtctgagggccgacctaccaaagaggggggttatgggctgaagagctatcaaccactgatgcggctccgacacaaagagaagaatcaggagtccagtcgagttaagggtttcatgatccaggatggaccattcgggagttgtgagaacaaatattgtggcctcggcagacactgtgtgaccagtcgagagactggccaagcggagtgtgcgtgcatggatctctgtaagcggcattacaaaccagtatgcggtagcgatggcgagttttacgagaatcactgtgaggtgcatcgtgccgcttgtttgaagaaacagaaaattacgatcgtccataatgaggactgtttcttcaagggtgataaatgcaagacgacagagtatagtaagatgaagaacatgctccttgacctccagaatcaaaaatacattatgcaggagaatgaaaatcctaacggtgatgacatctcacgtaaaaagctactggttgaccagatgtttaaatactttgatgctgactcaaatggactagttgatatcaacgagctgacccaagtgataaaacaagaggagctgggcaaagatctgtttgactgtactctctatgtgctcctgaagtacgacgacttcaatgcagacaaacacctggctctggaggagttctacagggcctttcaggtgattcagttatccctcccagaagatcaaaaactgtcgataaccgcggctaccgtggggcagtccgcagtactgtcctgtgctattcagggcaccctgagacccccaatcatctggaagcggaataacatcatcctcaataacctcgatctggaagacatcaacgatttcggggatgacggatctctgtatataactaaggtaaccactacgcatgtgggaaattacacctgctacgcagacggctacgagcaggtgtaccaaactcatatctttcaggtgaacgtgccacctgtgatcagagtctaccccgaatcacaggcccgtgagccgggagttacagcgagtctcagatgtcacgctgaaggcatacccaaaccccagctcggctggctgaagaatggtatcgatataacccctaagctgagcaagcaacttactttacaggccaacggtagcgaggtgcacattagtaacgtcagatatgaagacactggcgcatatacttgcatcgccaaaaatgaagctggagttgacgaagacatatcttctctctttgtggaggatagcgccaggaagacacttgctaacatattgtggcgcgaagaggggctggggatcggcaacatgttctacgtgttctacgaagacgggataaaggtgatccaacctattgagtgtgaatttcagcgccacattaagccctctgaaaagctgctcggctttcaagacgaggtatgcccaaaagcagagggagatgaggttcagcggtgcgtgtgggcttctgctgtcaatgtcaaagacaagttcatctatgttgcccaacctacgctcgatcgggtcttgatcgtggatgttcagtcccagaaggtagtgcaggctgtgtccacggatccagtgccggtgaagctgcactatgataaatcacatgaccaggtgtgggttctgagctggggcacccttgagaaaacaagccctaccctccaggtcatcaccttggcctctggcaacgtcccacaccacactatccatacgcaacctgtcggtaagcagtttgatcgcgtagatgacttctttattcctacaaccacgttaattattacccacatgcgctttggttttattctgcataaggatgaggcggctctccagaaaatcgacctcgagactatgagttacatcaagacaatcaatctcaaagattacaagtgcgtaccgcagtctctggcttatacacatctcgggggatactactttataggctgtaaacctgatagcacgggagccgttagtcctcaagtcatggttgatggggtgactgactccgtgattggcttcaactccgatgtgaccggcaccccatacgtgtcccccgacggtcattatttggtcagcattaacgatgtgaagggactcgtgcgagtgcagtatatcacaataagaggggagattcaggaagcgttcgatatctacacaaaccttcacatttccgatctggcctttcaaccctcctttaccgaagctcatcagtataacatttatggctcttcctctacgcaaaccgacgtcttgttcgtggagctgagtagcggaaaagtgaagatgattaagtcccttaaagaacctctgaaagctgaagaatggccttggaatcgcaagaacaggcagatccaggacagcggccttttcggccagtacttgatgactccaagtaaagattccttgttcattctggacggtaggctgaataagcttaattgtgagatcactgaagtcgagaagggtaatacagttatctgggtgggggacgcttag

SEQ ID NO: 10904 - DNA, 291 bp, Artificial Sequence
  Description of Artificial Sequence: Synthetic coding sequence
atgcgagtgacatcagctacctgcgctctgctgctggcgttgatctgtagcgttcagctaggcgatgcttgtctggatatcgacaaacttctggccaatgtagtgttcgacgtgtctcaggacctgcttaaagaagagctcgcccgttataacccttcccctctgactgaggagagtttccttaatgttcagcagtgcttcgcaaacgtgagcgtgacagagcgctttgcacactctgtggttataaagaaaatcctgcagtctaatgattgtatagaggctgcgttttag

SEQ ID NO: 10905 - DNA, 1971 bp, Artificial Sequence
  Description of Artificial Sequence: Synthetic coding sequence
atgagaaccgtggttctcactatgaaggcctccgtgatcgagatgtttctggtgttgctggtcaccggagtacactctaataaagagactgcgaagaagataaaaagacctaagtttaccgtcccacaaattaactgcgatgtaaaagccggaaagattattgaccccgagtttattgttaagtgcccagccggttgccaggaccccaagtatcacgtctacggaacagacgtctacgccagctactcaagcgtgtgcggtgctgccgtccatagcggcgtcctggacaattcaggtggcaaaattctggtgaggaaagtggcaggccagtctggttacaagggctcctatagcaatggggtacaatcattgtccctccctcgttggcgtgaaagctttatcgtgctggagagcaagccaaagaagggggtgacgtatccctctgcactcacctacagctcttcaaaaagccccgctgctcaagcaggagaaaccaccaaggcatatcagcgacccccaattccaggcacaacggcccagcctgtgaccctcatgcaactcttagccgtaaccgtggctgtggccaccccgactacactgccaagaccctcacccagcgcagcatcaactacctccatccctagaccccaatccgtcggccaccgaagccaggaaatggatctatggtccaccgccacctatacgtcttcccagaacagacctcgggcagaccccggactcgtgcctaaagaggagttatcgacacagtcccttgagcccgtcagtctgggagatcccaattgcaagattgacttaagcttcctcatcgacgggagtacatcaattggtaagcgacgattcaggattcaaaaacagctccttgcggatgtggcgcaagccctggacatcggcccagccggtcccctgatgggtgttgtgcagtatggagacaatccagcgactcacttcaatctgaaaactcatactaattcaagggatctgaagactgcgatcgagaagatcacacagcgcggtgggctgtctaacgtggggcgtgccatctcctttgtcaccaagaatttctttagtaaggccaacggtaacaggtcaggtgcccctaatgtcgtggtcgttatggtagacggatggcctaccgataaagttgaagaggccagccgcctggccagagaatctggtattaacatatttttcatcactatagaaggggctgccgagaatgaaaaacaatatgtggtcgagccaaacttcgccaacaaagccgtatgtcgaactaatggcttctattccttgcatgtgcagtcctggttcggactgcacaaaacactccagcctctggtgaaacgcgtgtgcgacactgacaggctagcttgttcaaagacctgcctcaactctgctgatataggtttcgttattgatggctcatctagtgttggcaccggcaatttccgaaccgtgctacaattcgtgaccaacctcacaaaggaattcgaaatcagcgacactgatacacggatcggggctgtgcagtatacttatgagcagcggctggagttcggatttgataagtactcttcaaagccagatatcctcaacgctattaagagggtcgggtactggtcaggcggtacatctaccggagctgcaatcaactttgctttggagcagttgttcaagaaaagcaagcccaataagcgtaaactgatgatattaattacggacggccgtagctacgatgatgtacggattcccgcaatggcagcgcacttaaaaggcgtcattacttacgcaattggcgtggcttgggccgcacaggaagagcttgaggttattgctacgcaccccgctagggaccactcttttttcgtggacgaattcgacaatctccaccagtacgtgcctcggatcattcagaacatttgcaccgagtttaattcccagccgaggaactag

SEQ ID NO: 10906 - DNA, 2082 bp, Artificial Sequence
  Description of Artificial Sequence: Synthetic coding sequence
atgcgcactgtcgtcctaacaatgaaagccagtgtcatagaaatgttcttagttcttctcgtaaccggagttcatagtaataaagagactgctaaaaaaataaaacggccaaagttcactgtgccacaaatcaactgcgatgtaaaagctgggaaaatcatcgaccccgagtttatcgtgaagtgtcctgccggatgccaggatccaaaataccacgtgtatggcacagatgtgtatgcgtcttattcatcggtctgcggcgcagctgtgcattcaggtgtgttggacaatagtggagggaaaatactggtccggaaggtggctgggcagtcaggctacaaggggtcctattccaatggagttcagagtctgtcgctccccagatggcgggaaagttttattgtgcttgaatctaagccaaaaaagggggtcacatacccctctgcattgacatactcatcttccaagtccccagcagcccaggccggagaaaccaccaaggcataccaaagaccaccgatcccaggtactactgcccaacccgtgaccctcatgcagctactagccgtcaccgttgcggtggcaacacctacgacattaccgaggccttccccgtccgctgctagcaccacaagcattcctagacctcaatcggtagggcatcgttcccaggagatggatctgtggtcaaccgcgacatacacatcatctcagaacagacctcgggcagatcctggcattcagcgccaggaccccagtggggcagccttccagaaacctgtgggtgcggatgtgtcgctgggggaaatggacagttggaagccaggttccgtgctgctagatgagggcctggtgcctaaagaagaactgagcacacagagcctggagcccgtgagccttggtgaccccaactgcaaaattgacttgtctttcctgatagacggctcgactagcatcggcaaacgtcgtttcaggattcagaagcagctgctggccgatgtcgctcaggcgctggatattgggccagcgggaccgcttatgggagtcgtgcagtatggcgataacccagctacgcatttcaacctgaaaacacatactaattccagagacctgaagactgccatcgaaaaaatcacccagcgaggtggtttaagcaacgtgggacgcgcaatctccttcgtgaccaagaacttcttctccaaagccaatggaaacagatcaggggctccaaacgtggtcgttgtgatggtggatgggtggcccacagataaagtcgaggaggcctctagactggcaagggagagtggcataaatatcttttttatcaccatagagggtgctgcagagaatgagaagcagtacgttgtggagccgaactttgctaataaggccgtctgtcggacgaacggcttctattccctccacgtacagtcatggtttgggcttcataaaaccctgcaacctctggttaagagagtctgtgacacggataggctcgcttgttccaagacttgtctgaattctgccgatatcgggttcgtcattgatgggtcctcttccgtgggcactggaaacttccgaactgtacttcagtttgtcacaaatctcacaaaggagttcgaaatttccgacaccgacactcgaataggagccgtgcagtacacgtatgagcaacggctggaatttggattcgataagtactcttcaaagccggatatactgaacgccatcaaaagggtggggtactggtcaggtgggacctcaacaggggcagcaataaacttcgctctggagcaattgttcaaaaagtctaagccgaacaagcgcaagttaatgatcttaatcaccgacggcagatcttatgacgacgtgcgtatccctgccatggcagctcatctgaaaggagttatcacttacgctattggcgtcgcttgggcagcacaggaggagttagaggttattgcaacccatcctgcaagagatcattcatttttcgtggatgaatttgacaacctacaccagtacgtgccccgtattatacagaacatctgtaccgaattcaatagtcagccaaggaactag

SEQ ID NO: 10907 - DNA, 555 bp, Artificial Sequence
  Description of Artificial Sequence: Synthetic coding sequence
atgttttgtctactgcatttgtgtttttacttagcgaattttgcctccagtatcaaacggactcacgccgttaatggatgttgcggcctccaaatgatagccctgtgggctcaaagcagtggaaatgccgatgccagggttgaggaaattttggctggggaggagagacgcctagctgctcttctcgggtctcagggcatgcgcttttgggtctgtttagcggcttgcagggcaatgtggggactggcggctcgacggggtagggcagaagattccagttcaagccccgttgacgcctctaaattcccctggcggggaggccagcatcggacaactatgatgccatgtctcctgagagtgggggtgttcaggccatgccacgtccgacccactggcgaccccagctgtgatgtccagcctcctagacttggattctccagggtgccagacactcaggtggcattctacggaagtgggcactgggatcccacacctttcagcgtgcattcctgtttctttaactttcaggtgcgtaaaataatttttttactgtag

SEQ ID NO: 10908 - DNA, 864 bp, Artificial Sequence
  Description of Artificial Sequence: Synthetic coding sequence
atgacttcagcggctcactactatccaaaactcatgagcataatgggcaacgtcctaagattccttccagctttcgtgaggatgaagcagctgattgaagaaggctacgtgggggaacccctggtctgcgaggttcaggtccacggtggttctttgctgggcaagaaatacaactggagttgtgacgacctgatggggggaggtggcctccattctgtgggtacatacatcatcgacctgctgaccttcctcaccggtcaaaaggccgtgaaggtccatggactgctgaaaaccttcgtgaaacagactgaccatatcaagggtatacgccagataacatccgacgacttttgcactttccaaatggtgcttgagggcggagtctgttgtacagtcaccctgaattttaatgtgccaggagagttcaagcaggatgtaacagtggttggcagcgccggacgcctgctcgcagtggggacagacctgtatggtcaacggaactctgcgcctgagcaggagcttctcgtgcaggacgccacaccggtgtcaaatagcctcctgccagagaaagccttcagtgatatcccttcaccttacctcaggggtacaataaaaatgatgcaggctgtcagacaggcatttcaggatcaggacgacaggcgaacttgggacgggaggcctctgactatggctgccacttttgacgactgtctctatgcgctttgcgtcgtggacactataaagcggtccagccagacaggggagtggcagaacatcgcaatcatgacagaagagccggaactctcaccagcgtacttgataagtgaggcgatgaggcgctcccgtatgtctttgtactgctag

SEQ ID NO: 10909 - DNA, 1173 bp, Artificial Sequence
  Description of Artificial Sequence: Synthetic coding sequence
atgctgcctggcgtaggagtcttcgggacaagtctcaccgctcgtgtgattatacccctgttgaaggacgaaggttttgctgtcaaagccctatggggacggactcaggaggaagccgaggaactcgcaaaagaaatgtctgtaccgttttacacctcacggatcgacgaggttctcctacatcaggatgtcgatctggtctgtattaaccttcctccacctctgactcggcaaattgcggtgaagacgcttggcatcggcaagaatgtgatttgtgaccggaccgccactcccttggacgcctttcgaatgacctcagccgctcactactacccaaagctgatgagcattatgggcaatgttcttcgattcctgcctgcctttgtgcgcatgaaacagctcattgaagaggggtatgtcggcgagcccttagtatgcgaagtgcaggtgcatggtggcagcttactgggaaaaaaatataattggtcgtgcgacgacttaatgggtgggggaggtctccactccgtggggacgtatattatcgacctcctgacgttcctgacgggacaaaaggccgtgaaggtgcacggcctgctaaagaccttcgtcaagcagactgaccacatcaaaggtataagacagataacttccgatgatttttgcactttccagatggttctcgaggggggtgtctgctgcactgtgacccttaatttcaatgtccccggagaatttaaacaggacgtgacagttgttggtagcgctgggaggttgctggccgtgggaacagatctgtacggccaacggaatagcgctcccgagcaggaattacttgtgcaggacgcgacaccagtttcaaattccctgctgcccgaaaaagccttctccgatatcccttcaccttacctgagaggaactatcaagatgatgcaggccgttcgacaagcctttcaggatcaggacgaccggaggacatgggatgggcgtccacttacgatggccgcaacctttgacgattgcctgtatgcactgtgcgtcgtcgacaccattaaacgctctagccagacaggggagtggcaaaacatagctattatgacagaagagcccgaactgagccctgcctacctaatttcagaggctatgcggagaagcagaatgtcgctctattgctag

SEQ ID NO: 10910 - DNA, 5718 bp, Artificial Sequence
  Description of Artificial Sequence: Synthetic coding sequence
atgcagagtcggcttctgttgctgggggcacccggaggtcacggaggacctgcttcccggcgaatgcgcttattactgcgccaggttgtgcaacgccgtcctgggggtgatcggcagcgaccagaagttaggcttctacatgctggctctggcgcagataccggcgatactgtgaatattggggatgtcagctacaagctgaagatccccaaaaatcctgaactggtgccacagaactatatatcggacagcctggcccaatcggtggtgcagcatctaaggtggataatgcaaaaagatttacttggtcaggatgtgtttctcataggacccccaggccctctgcgcagatcgatcgccatgcagtatctggagctcacaaagagagaagtagagtacatagccttatcccgcgatacaactgagaccgacctaaaacagagacgtgaaatccgggctggtacagctttttatatcgaccaatgtgctgtgagggctgcgacagaaggaagaactctcattctggaaggattagaaaaggcagagaggaacgtgctgcccgtccttaacaacctgctcgagaaccgggaaatgcagctggaagatgggcgttttctgatgagcgccgagaggtacgataaactgctgcgcgaccacactaagaaagagctggacagttggaagatcgtccgcgtttcagaaaatttcagagtcatcgctctgggcctgcccgtaccccgatactctgggaaccctttggatcccccactccgatccaggtttcaggcccgtgacatctactacctcccttttaaagatcagctgaagttactctactcaataggcgctaacgtgagcgctgagaaggtctcccaactcctatcgtttgccacaaccctttgctcccaggagtcctcaacactgggcctgcccgattttcctcttgactctttagcggcagctgttcagatcctcgactcgttccccatgatgcccataaaacacgcaattcagtggctctacccctacagtattctgctcggtcatgagggcaaaatggcggtggagggcgtgctgaagaggttcgagcttcaggattctggttccagccttctcccaaaagaaatagtgaaagtagagaagatgatggaaaaccacgtctcacaagcaagcgtgacgatcagaatagccgacaaagaggtgaccattaaagtgcccgcaggcacgagactgttgagccagccttgcgcctctgacagatttatccaaaccctaagccacaagcagctgcaagctgagatgatgcaatcccacatggtgaaggacatttgtctgatcggtggaaagggctgcgggaagactgtgattgccaaaaactttgctgataccctgggctacaacatcgaaccgatcatgctgtatcaggacatgactgccagggaccttctccagcagaggtacacccttccaaacggagatactgcctggcgttcctctcccctcgtgaatgcagcactggagggaaagctagtgctcttagatggaattcatcgggttaacgcaggaacactggctgtccttcaacggttgattcacgatagagagctcagcctgtacgatggttctagactcctccgtgaagatcgctacatgaggttgaaggaagaactccagctgtccgatgaacagctgcagaagcgttcaattttcccgatccatccatccttccgcataattgcactagccgaaccaccagtgatcggcagtaccgcccatcagtggctaggacctgaatttctcaccatgttcttcttccattacatgaaacccctggtcaaaagcgaagagatacaggtcattaaggaaaaggtgcctaatgtccctcaggaggctcttgacaaactgttaagttttacccataaactgagggaaactcaggatcctacagcgcagtctttagcagccagcctgagtacgagacaacttctgcggatcagtcgtcggctgtcacagtaccccaatgaaaacctgcacagtgcagtgaccaaagcttgtctttccagattcctccctagcctcgcgaggagcgctctggaaaagaatctcgccgacgccacgatagagatcaataccgacgacaacctcgagccggagcttaaggactataaatgcgaggtgacatcgggcactctgcgcataggcgcagtcagcgcaccgatttacaatgcgcatgaaaagatgaaagtgcccgatgtgctattctatgataatattcaacacgtgattgtgatggaagatatgctaaaggatttcctgctgggcgagcacctgttgctggtgggtaaccagggtgtcgggaagaacaaaatagtcgatcgctttcttcatctattaaatcggccacgcgagtacatccagttgcatcgcgatacaaccgttcagaccttaactcttcagccctccgttaaggatggcctgatcgtttatgaagatagtcccctggtgaaggctgttaagctcggccacattctggtggtggatgaggctgacaaagcgccaacaaacgttacttgcatcctaaaaaccctggtggagaatggggaaatgattctggctgacgggaggaggatcgtggccaactccgcgaacgtgaacggccgagagaacgtggtcgtgatccatccagatttccgcatgatcgtgctggccaatcggccaggattccctttcctggggaacgacttcttcgggactctaggcgatatcttctcctgtcatgctgtggacaatccaaagccacattccgaattagagatgctgcgccagtacggaccaaacgtacctgagccaatactgcagaaattagtcgcggcttttggcgagctgcgctctctcgccgatcaaggcattattaattacccctactctacacgtgaagttgtcaacatcgtgaagcacctgcagaaattccccacagaggggctttcgagcgtagtgagaaacgtgttcgacttcgattcctacaacaatgatatgagggaaatcctaatcaacaccctccataagtacggaattcccataggggctaagccgaccagcgtccaactagccaaagagcttacactcccagagcagacattcatgggctactggactatcggccaggcccgatcgggtatgcagaaactcctgtgccctgttgagactcatcacattgatatcaaaggaccagctttaatcaacattcaggagtacccaatagagcggcatgaagagagatcattgaactttacagaggagtgcgccagttggcggattcccctcgacgaaatcaacatcatttgtgacatcgccacctcacacgagaacgaacaaaacacactttatgtggtgacctgcaaccccgcttcgttgtattttatgaatatgaccggcaagagcggcttttttgttgacttttttgacattttcccaaggacggcgaatggtgtgtggcatccgttcgtaactgtggcccctcttggcagcccgttaaagggccaggtcgtcctccatgagcagcagtctaatgtgatcctattgctggacaccaccgggcgagcactccacaggcttatattacccagtgagaaatttacttccaagaagcccttctggtggaataaggaggaggcagaaacatacaagatgtgcaaggagtttagccataagaattggcttgtcttttacaaggaaaagggtaattctctgaccgtgcttgacgttttggaggggcgtacacacaccatctccctccccattaacctaaaaacggtgtttttagtcgccgaagacaagtggctgctggtagaatccaaaacaaatcagaagtacctgctgacaaaacctgctcacattgagtccgaaggttctggcgtctgtcagctgtatgtgctgaaagaggaacctcccagtactgggtttggggtgacacaggagactgagttctcaatcccacacaaaatctcaagcgaccagctttcttccgagcacctatcatccgcagtcgagcagaagatcgcctctcccaatcgtattctgtcggatgaaaagaattatgccaccattgttgtcgggtttcccgacttgatgagcccctctgaggtctattcctggaaaaggccttcatccctgcataagaggtctggcaccgatacctccttttaccgaggcaagaagaagagggggacacctaaacagagcaactgtgtgaccctcctggacacaaatcaggtggtgcgcattctacctccgggtgaagttcccctgaaagacatatatcctaaagacgtgacaccaccccagacttccggctatattgaggttaccgatctgcagtctaaaaaacttaggtacataccaattcctcgctcagaatccctcagtccctataccacgtggctcagcaccattagcgatacagacgctctgctggcagagtgggataaatcaggggtagtgacagtggatatgggaggacacattaggctgtgggagacaggacttgagagattacagcggagtctaatggaatggagaaacatgatcggccaggacgaccgcaacatgcagatcactatcaaccgagacagtggagaggacgtttcctcacctaaacatgggaaggaagacccagacaatatgcctcatgtggggggaaatacttgggcaggtggaaccggcggaagagacacggccggactcggtgggaagggaggtccctaccgcctggacgctggccatacagtgtatcaagtctctcaagcggagaaggatgccgtaccagaagaagtgaagcgtgccgctagagagatggggcagcgggcattccagcaaaggctcaaagagattcagatgagcgagtatgatgctgctacttacgaaagattttcgggcgctgtaagacggcaggtccacagtctgagaattatcctcgacaacctccaggccaaaggaaaggagcggcaatggcttcgccaccaggcaaccggagagctggacgacgctaagattatcgacgggctaaccggcgagaaagccatctataagagacgcggagaacttgaaccgcagcttggtagcccccagcaaaagccaaagaggctgcgactggtggtcgacgtgagcggtagcatgtataggtttaaccggatggatgggaggttggaaaggacgatggaagcagtctgcatggttatggaggcgtttgaaaactatgaagaaaaattccaatacgatattgtcggccactcgggagacggatataatattggactcgtgccaatgaacaagatcccaaaagataacaaacagcggctggagattctgaagacaatgcacgctcacagtcagttctgcatgtccggggaccatacgctagagggaaccgagcatgcaatcaaggagatcgttaaggaagaggctgatgaatacttcgtcatcgtgctttctgacgcaaatctgtctcgctatggcattcaccctgcgaagttcgctcaaatcctgaccagagatcctcaggttaatgcattcgccattttcattggttcattaggggaccaagctactcgcttgcagcgcactctgcctgctggcagatcctttgtggcaatggacaccaaagacatccctcaaattctgcagcagattttcacaagcactatgctgtcaagcgtgtat

SEQ ID NO: 10911 - DNA, 561 bp, Artificial Sequence
  Description of Artificial Sequence: Synthetic coding sequence
atggaagccctgccgctgctggctgccaccacaccagatcacggcagacaccgcaggctgctccttctgccactcctcctgttcctattgcctgcaggagcagtgcagggctgggagacagaggaaagacccagaacacgggaggaggaatgtcatttttacgccggaggacaggtgtatcccggagaggccagtcgcgtgagtgttgcagaccattccctacacttgagcaaagcaaagatcagtaagcccgcaccctattgggaaggcacggcggtcatagatggtgagtttaaggaactgaaattgaccgactacagaggaaagtacctggttttctttttctatcctctcgacttcacattcgtgtgtccaactgaaatcatcgccttcggagacagactagaggagttccgatcgattaatacagaggtggtggcatgttcagtagacagccagttcacccacctggcctggtccgtttcctatacatacattcgcagaaagaagaggatggacctattactgaagcacggacagatcacgttggatatgatttag

SEQ ID NO: 10912 - DNA, 816 bp, Artificial Sequence
  Description of Artificial Sequence: Synthetic coding sequence
atggaagctctgcccttactggccgcaaccacaccagaccatggccgacacaggcgcctcctcctcctccccttgctcctgttcctgctgcctgctggagcagtgcagggatgggaaaccgaggaaaggcccagaactcgggaagaagaatgccatttctacgccggaggccaggtgtatccaggcgaagcatccagagtaagcgtcgccgaccattcgctgcatttgagcaaagccaaaatcagcaagcccgcaccctactgggaaggaactgctgtcatcgatggcgagttcaaggaacttaagctgaccgactatcgcggaaagtacctggtcttctttttctaccccctcgatttcacgtttgtctgccctaccgaaattatcgcttttggcgatcgacttgaggaatttcgatctataaacacagaagtggttgcttgtagtgtggattcacagtttacacatctagcatggatcaatacaccacgacggcaaggcggtctgggccctatccgcattcctctacttagcgatttaacccaccagatctccaaagactacggtgtatacctggaagattccggacacacactgcgcggacttttcatcatcgatgacaaaggaatcctgcggcagatcacactgaatgaccttcctgttggcaggtctgttgatgaaacgctgaggctcgtacaggctttccaatataccgacaagcatggcgaggtctgccctgccggttggaagccaggtagcgagaccatcatccccgaccccgcaggcaaactcaagtatttcgataaattaaattag

SEQ ID NO: 10913 - DNA, 558 bp, Artificial Sequence
  Description of Artificial Sequence: Synthetic coding sequence
atggatcatcggagccgactccgaggaaccggactgaatcggatacctggtactcaatcgcgggctccgcgagtccctctgcccttccatgtccagcaagaagccagagaaggagaggactgggagcgggaaccgccacggcagagacctccaatctacgaacctccggagagcgaagaacttcccgataatgtgatggtatccaagccagccccttattgggagggcacagccgtgatcgacggtgagttcaaagagctaaagctgaccgactatagaggcaagtacctggtgttttttttctacccactggattttacattcgtctgtccaactgaaatcatcgccttcggcgacaggctggaagagttccggagcataaataccgaagtggtcgcctgtagcgtggattcacagtttacccaccttgcatggataaacaccccccgacggcaagggggtcttggccctattagaattcccctcctgagcgatctgacacaccaaatcagcaaggattacggagtctacctggaagactcagggcataccctgtag

SEQ ID NO: 10914 - DNA, 843 bp, Artificial Sequence
  Description of Artificial Sequence: Synthetic coding sequence
atggcacgtttctgggtgtgcgtcgcaggcgcaggcttttttctggcttttctggttctgcatagtagattctgtgggagcccagtcctgaggaactttacattcgccgtgagttggagaacagagaaaattctgtacaggctggacgtcggttggcctaagcatcccgagtacttcacaggcactacgttttgcgtggcagtggactctctgaacgggctcgtttacataggacaaagaggggacaacattcccaagattcttgtattcaccgaggacggctactttctcagggcctggaattacactgttgacactccacacggcatcttcgccgcttccacactgtatgagcagagcgtgtggattaccgacgttgggtcggatttcatgatcctgtggcttcatggcgaaaacgggactggcccagccaaatttaatatccctcactccgtgacactggactctgcgggtcgcgtctgggtggccgaccgtggtaataagaggatccaggtgttcgacaaggatactggcgagtggcttggcgcatggaacaactgcttcacggaagaagggccatcttctgtccgatttaccccagacggaaagtaccttattgtcgctcagctgaacctctctcggcttagtgtggtggctgctcccccagtcgggtctataggtgagtgttccgtgatttccactattcaactcgccgaccaggttttgccccatctgctagaagtggacaggaagaccggcgcagtatacgtggccgaaattggtgcaaaacaggttcagaagtacgtccctttgaacagttacgtgccctctttcggctcgtag

SEQ ID NO: 10915 - DNA, 1044 bp, Artificial Sequence
  Description of Artificial Sequence: Synthetic coding sequence
atggctcggttctgggtgtgcgtggcaggagctgggttcttcttagcttttctggttctgcacagtagattctgtggaagtccagtgctgcggaacttcacattcgctgtcagttggcgaacggaaaagatactttatcgacttgacgttgggtggcccaaacatcctgagtatttcacgggcaccactttctgcgtagctgtggattcactgaacggcctggtgtacataggccaacggggagacaacattcccaagattctggtatttactgaggatggatacttcttaagggcctggaattatacagtagacacccctcacgggatcttcgcagctagcaccctctacgagcagtccgtgtggatcaccgatgtgggatccggattcttcggccacactgtaaagaagtactcttccttcggcgatcttgtgcaggtcctggggactcctggaaagaaaggtacctccttgaatcctctgcaattcgacaatcctgccgagctgtacgtggaggacactggcgacatctacatcgtggatggcgacgggggtctgaataatcgcttaattaagctctctcaggattttatgattctttggcttcacggagagaatggcacaggcccagcgaagtttaacattccccactctgtgaccctggactccgcagggcgagtctgggtggctgatagaggaaataaaagaatccaagtcttcgataaggataccggcgagtggctgggcgcatggaataattgtttcaccgaagaagggcctagtagtgtgcgcttcacacctgacgggaaatacctgattgtcgctcaactgaatctttccagactgtctgtggtggccgcacctccagttggctcaatcggcgagtgctcggtgatttccactatccagctcgctgaccaggtgttgccccacttactggaagttgataggaagaccggggctgtttacgtggccgagatcggtgccaagcaagtacagaaatacgtcccgctaaattcgtatgtgccttcattcggatcgtag

SEQ ID NO: 10916 - DNA, 1707 bp, Artificial Sequence
  Description of Artificial Sequence: Synthetic coding sequence
atggtgttgcttcactggtgtctgctgtggctgctcttccccttgagctcaaggactcagaaattacccacaagagacgaggagctgtttcaaatgcaaatccgggacaaggctttcttccacgattctagtgtcattccagacggagccgagattagcagctaccttttccgggatactcctaaaagatacttcttcgtcgtagaagaagataacaccccactctccgtgacggtgactccttgcgatgctccgctggagtggaagctttccctgcaggagctgcccgaagataggtccggcgagggatcaggcgatctggagccgctagagcagcaaaaacagcagatcattaacgaagagggcacagagttattttcctacaaagggaatgacgttgaatatttcataagttcatcgagccctagtgggctgtaccagttggacctcctgtctacagaaaaagatactcacttcaaggtgtacgccacaacaactccagaatccgaccagccataccccgagctcccatatgacccgcgtgtcgacgttacctccctcggcagaacgaccgttacactggcctggaaaccttccccaaccgcctcgctgttgaaacagcctatccagtactgtgttgtgattaacaaggaacacaactttaagagcctctgtgcagtagaggctaaactgtccgcggacgatgcattcatgatggccccaaagcctgggctcgactttagcccttttgacttcgcccatttcggtttcccatccgacaatagcggtaaagagagatcgttccaggccaaaccatcccctaaactcggcaggcacgtatatagccggccaaaagtcgacatacaaaaaatttgtatcggcaataagaacatcttcactgttagtgatctgaagcctgatacacagtactactttgatgtattcgtagtcaacataaacagtaacatgtcaacagcctacgtgggcaccttcgctcgtactaaagaggaggccaaacagaaaactgtggaactgaaagatgggaagattacagacgttttcgtgaaacgaaagggcgcaaagttcttacggttcgccccagtgagcagtcatcagaaggtaaccttcttcatccattcatgcctcgacgccgtccagatccaggtcagaagagacggcaaactgctgttgtctcaaaacgtggaaggcatccaacagttccaactgcgtggtaaacctaaagcgaaatacttagtgagattgaagggcaacaaaaagggagcttcaatgctgaaaatcctggcgactacaagaccaacaaagcagtcattcccgtcactgcccgaggacaccagaataaaagccttcgataagctacgcacttgctccagcgccacggtggcctggctgggtacgcaggagcgaaataagttttgcatctataaaaaagaggttgatgataattacaatgaggaccagaaaaaacgcgagcagaaccagtgccttggacctgatataaggaagaagagcgagaaagtgctctgcaaatatttccattcacagaatcttcagaaggccgtgaccaccgaaaccatcaaaggcctgcagcctggtaagagttacttgctcgacgtatacgtcataggccacggcggacacagcgtgaagtaccagtcgaaggtggtgaagacacgtaagttttgctag

SEQ ID NO: 10917 - DNA, 489 bp, Artificial Sequence
  Description of Artificial Sequence: Synthetic coding sequence
atgaaagggttcaccgcgacgctgttcctctggacacttatatttccgtcctgttctgggggtgggggaggaaaagcatggcctactcatgtggtatgttccgactctggccttgaagtgttatatcagtcctgtgacccactgcaggacttcggcttctccgtcgagaagtgctccaagcagctgaaatctaacattaatatccgtttcgggatcatcctgcgagaagatatcaaggaactcttcctggatctggctctcatgtcgcaggggagctcggttctgaacttttcttacccgatatgcgaggcggcacttcccaaattttcattctgtggaagaagaaagggggaacaaatttattatgccggaccagtgaacaatcccgaattcacgattccacaaggagaataccaggtgctactggagttatataccgagaagcgaagcaccgttgcctgcgctaacgctaccatcatgtgttcctag

SEQ ID NO: 10918 - DNA, 1698 bp, Artificial Sequence
  Description of Artificial Sequence: Synthetic coding sequence
atggacttcctcctagcgctagtattggtctctagcctctatttgcaagcagccgctgagttcgacggcaggtggcccagacaaatagttagctctatcggcctgtgcaggtacgggggtcgaattgactgctgctggggatgggcacgacaatcctggggccagtgtcaaccggtgtgtcagcctagatgtaaacatggagagtgcatcgggccaaataagtgcaaatgtcaccccggatatgcaggtaaaacctgcaaccaggatctgaacgagtgtggcctaaaacctcgaccctgtaagcatcgctgtatgaacacctatggatcttacaagtgttattgtctgaacggctacatgttgatgccagatggctcctgtagtagcgcgctgacatgtagtatggcgaattgtcaatacgggtgtgacgttgtgaagggtcagattcgttgtcagtgtccatctcccggactgcagttggctcccgacggaaggacctgcgtggatgtggatgaatgcgctacaggccgagcatcttgtcccaggttccgtcagtgcgtaaatacctttggaagctatatctgtaagtgtcacaagggctttgatctgatgtatattggtgggaaataccagtgtcacgatatcgatgagtgctcgctggggcagtatcagtgtagtagcttcgcccgatgctacaatattcgcggtagctataaatgtaaatgtaaagagggctatcagggagacggactgacatgcgtttatattcctaaagtaatgatcgaaccttctgggcctattcatgtgcccaaggggaacgggacaatcctcaagggcgatactggcaacaataactggataccggatgtgggctccacctggtggcctccaaagaccccatacatcccacctattatcactaaccgacctacaagtaaacccaccaccagaccgacaccaaaaccaaccccaatccccacccctccacccccaccgcctctcccaacggagctgaggactcctcttcccccaacaactcccgaacggccaacaacgggactgacgacaatagcccctgccgcaagcactccccctgggggtatcacagtggacaacagggtgcaaactgacccccagaaacccagaggcgatgtgttcattccacgtcagccaagcaatgacctgttcgagatcttcgagatcgagcgcggtgtgtcagctgatgatgaggccaaagacgacccgggagtactggtccattcatgcaactttgatcacgggctctgcggatggatcagagagaaggataatgatctgcactgggaacccatccgggatcccgctggagggcagtaccttaccgtgagtgcagccaaggcaccgggtggtaaagcagctcggctagtcctgcccttgggccgactcatgcatagtggggatctgtgcctgtcatttaggcacaaagtcacagggttgcacagtggaactctgcaagtgttcgttagaaagcatggcgcacatggcgctgccctctggggaagaaacgggggacatggctggcgtcagacgcagatcacgttgcggggtgccgacatcaaatccgtcgtgttcaaaggtgaaaagcgacgcggtcataccggggaaatcggtttggacgacgtcagtctaaagaaggggcattgctcagaggagagatag

SEQ ID NO: 10919 - DNA, 1413 bp, Artificial Sequence
  Description of Artificial Sequence: Synthetic coding sequence
atgaaacgtagcgtggctgtgtggttattggttggcctgtccttaggcgtaccccaattcgggaaaggagacatatgcgatcccaatccttgtgagaacggtggtatctgcctgccagggctggctgacggctctttttcctgtgagtgccctgatggtttcactgatcctaattgtagctctgtggttgaggtggggccatgcacaccaaatccctgccataatggcggaacatgcgaaatctcagaggcttaccgaggagatacgttcattggttatgtgtgtaagtgcccccgaggttttaatggcatccattgccaacataatattaacgaatgtgaagtcgaaccgtgtaagaatggcggtatctgcaccgacctagttgctaactacagctgtgagtgtcctggcgaattcatggggaggaattgccagtataagtgcagtggccctctagggattgagggcggaattatcagtaatcaacagattacagcatcctccacccatcgcgcactgtttggactccagaagtggtacccttactatgcgcgactgaacaaaaaaggtctcatcaacgcatggaccgccgcagagaacgaccgctggccatggatccagatcaatctccagagaaagatgcgagtgactggtgtcattacccagggggcaaaacgcattggcagcccggagtacataaaatcctacaaaatcgcttacagtaacgatgggaagacttgggccatgtacaaagtcaaagggaccaatgaggacatggtgttccgaggcaacatcgataacaatacaccctacgcgaactcttttacacccccaatcaaggcacaatatgttaggttgtatccacaggtctgccgtcggcactgtaccctgcgcatggaactcttgggatgcgagctaagcgggtgttccgagcccctgggtatgaagtccggccacatccaggattaccagattacggctagcagcatattccgcactctgaatatggacatgtttacctgggagcctaggaaggccagacttgacaagcaagggaaagtcaatgcttggacgtctgggcacaacgatcaatcacagtggttgcaggtggacctgttagtgcctaccaaagtcacgggaattatcactcagggagctaaggacttcggccacgtacagttcgtcgggagttataagctcgcctactccaacgacggggagcattggactgtgtaccaggatgaaaagcagaggaaagataaagtgttccagggcaattttgataatgacactcaccgcaaaaacgtcatagatccgccaatctacgcgcgacacattcgcatcctgccttggagttggtatggcagaatcacgctgcggtcggaactcttgggttgcacagaagaggagtag

SEQ ID NO: 10920 - DNA, 1254 bp, Artificial Sequence
  Description of Artificial Sequence: Synthetic coding sequence
atggcttcctacttgtatggtgtgcttttcgcggttggcctgtgtgcccctatctattgtgtaagcccggcaaatgcaccgtccgcgtatccccgtccatcatcgactaaatctaccccggcttctcaggtgtacagcctcaatactgacttcgctttccggttgtaccggagactggtactggagaccccaagccagaatattttcttctcacccgtgtcagtcagtaccagtctggccatgctgtcccttggggctcattcagttactaaaactcagatattacaaggacttggatttaacctcactcatacacccgagagcgctatacatcagggcttccagcatctggtgcactcccttacggttccctccaaggacttgaccctgaagatgggatcggctctattcgttaagaaggagctccaattgcaggcgaacttcctgggcaatgttaaaagactgtatgaggcagaggtgttctccaccgatttctccaatccatcgatcgctcaagccaggatcaattcccatgtgaagaagaagacacagggtaaggtagttgatattattcaagggctggacctattaaccgcaatggtgctggtcaatcatatctttttcaaagccaagtgggagaaaccgtttcatccagagtacactcgtaagaactttcccttccttgtgggcgagcaggtgacggtacatgttcctatgatgcatcagaaagaacagtttgcttttggtgttgacactgaactcaactgctttgtactgcagatggattacaagggcgatgcagtcgcattttttgtacttccatctaaagggaaaatgagacagttggaacaggctttgtctgcgagaactctacgaaaatggagtcacagtctgcagaaacggtggatcgaagtgttcattcccagattctcaataagtgcatcgtacaacctggagacgatcctgcctaagatgggaattcagaatgtctttgataaaaacgctgatttctccggcattgcaaagcgcgattctcttcaagtgtccaaagccacccataaagccgtattagacgtatcagaagagggtaccgaggccaccgcagcaaccaccacgaaatttatcgtgagaagcaaagacgggccttcttacttcacagtgtctttcaacaggacatttctgatgatgataactaataaggcaactgatgggatcttgttccttggtaaagtcgagaatccaaccaaatcctag

SEQ ID NO: 10921 - DNA, 486 bp, Artificial Sequence
  Description of Artificial Sequence: Synthetic coding sequence
atgctgatgccagtccatttcctgttgctgctgctgttgttgctcgggggacccagaaccggccttccacacaaattctacaaggccaagcccatcttctcttgtctgaataccgctttaagcgaggcagagaagggacaatgggaggatgcgagcctgctcagtaaaaggtctttccattatcttcgcagtcgcgatgcctcgagcggtgaggaggaagagggcaaagagaaaaagacattcccgatttctggtgcccgtggcggagccagagggacgcgctacaggtacgtcagtcaggcacagcctcgtggaaaaccaagacaggatactgcgaagagcccccaccgaactaagttcactctcagtttggatgtgccgacaaacattatgaacctgttgttcaatattgccaaggctaagaacctgcgcgctcaggctgctgccaatgcgcatctcatggcccaaatcggtaggaagaagtag

SEQ ID NO: 10922 - DNA, 2091 bp, Artificial Sequence
  Description of Artificial Sequence: Synthetic coding sequence
atggcgatggctcgactagggtcctggctgggcgaggcacagtggctggcgctggtgtccctctttgtagccgctctggccaccgttggcctgtatctggcacagtgggctctggcgagagcccgaccacagcctcaaagaagggcggtggaacccggagaggggccaagacctggctcagatgccctactctcgtggatccttactcttggttcctggcggtctcagtggcaggcagcatgggttacggctcttaatgaggaggctgaaaggaagggtgggccaccgtttctttctttcgaagaggatcccagacagcaagccttggagttggtggtgcaggaagtcagctctgtcctgagaagcgccgaagagaaggtggttgtatgccacgtcgtgggccaggcaatccagtttttagtgtcagaaacccccgcattgggcgcaggttgccggctatatgatatgaggctaagccctttccatctccaactcgaattccacatgaaagagaagagagaggatctccagattagttggtctttcatctctgttccagaaatggctgtcaatattcagcctaaagccttgggggaggatcaggtggcggagacgagcgctatgtcagatgtactcaaggacatcctgaagcacctggctggctctgccagtccctcggttgtactgataaccaaacccaccaccgtgaaggaagcacagaacctgcaatgtgctgcctcaacagcacaagagtcctgccccccaaaaccgccacgggctcacgaactgaaactacttgtccgtaatatccacgtcctgctcctgagcgagccaggcgcatctggacacattaatgccgtgtgtgttgtccaattaaatgaccctgttcaacggttctccagtacacttacaaaaaacacacctgacctgatgtgggaggaagaatttacctttgagttaaatgcaaagagtaaggagctgcatctgcagatcagcgaggcagggcgtagtagcgaaggactgcttgccaccgccacagtaccactcgacctgtttaaaaaacagccgtcaggaccacaaagctttacactgacaagcggcagcgcttgcggttcaagcgtgctggggagtgtgacggctgagttcagttacatggagcctggggaattgaagtcctggccaatacctcctcctgtgcctgcggcaaaaattgaaaaggataggacagtaatgccctgtgggaccgtggtgacaaccgtcactgcagttaaaactaaaccccgagttgacgttggcagagcatctcctctgtctagtgacagcccagtcaaaacaccaatcaaggttaaggtgatcgaaaaagacattagcgtccaggccatagcttgcagaagtgcgcctgttagcaaaactttgtcatcctcggacaccgagctgctcgtactgaatggcagtgaccccgttgcagaagtcgccatcagacagctgtcggagtcctccaaactcaagttgaaaagtccccgtaagaaaagcaccattatcattagcggaatttcgaagaccagcctgagtcaggatcacgatgccgcactgatgcaagggtatacagcgtccgttgatagtacccatcaggaggatgcccctagccacccagaacgggctgccgcttccgctccgccagaagaagctgaatccgcacaggctagcctcgcccctaaacctcaggaggacgagctggattcttgggatctcgaaaaagaaccgcaggcagccgcttggagcagccaggtgctgctcgacccagacggcgacgagcttagcgagtctagcatgtccgtcctcgagcccggaacggccaagaagcataaggggggaatactgcgtaaaggagctaaactattctttcgacgcaggcaccagcaaaaagacccgggtatgtcacagagccacaacgatctggtgttcctggaacagccggaaggcagtagaagaaagggtattaccctaaccagaatattaaacaagaaactgttgagccgccacaggaataaaaatactatgaatggggcaccagtcgagccatgcacttag

SEQ ID NO: 10923 - DNA, 669 bp, Artificial Sequence
  Description of Artificial Sequence: Synthetic coding sequence
atgcccgcaagctcaccattccttctggctccaaaaggtccccctggcaacatggggggacccgtcagagaacccgctctgtcagtggccttatggctctcctggggagccgctctcggcgcagtagcctgcgctatggccttgctgacccagcagacggaactgcaatccttgagacgggaggtgtcaagactccagggtaccggaggacctagtcagaacggcgaaggatatccttggcagagcctgccggagcagcattctgtgctgcatctggtccccataaatgcgacctccaaggacgactcggacgtcactgaagtaatgtggcagccggcactccgacgcggacgaggtttgcaggctcagggatatggggtccgaatccaggacgcgggagtgtacctgttatactcccaggtgctgtttcaggatgtcacgtttacaatgggtcaagtcgtgagtagggagggacaggggcgacaggagacgctgtttcgctgtatccggtctatgccaagtcaccctgatagagcctacaactcatgttactccgcgggagtcttccacctacaccaaggcgatattctgagtgtaattattcctagagcgcgagcaaagctgaacctgtcaccccatggtacgtttctaggtttcgttaagctgtag

SEQ ID NO: 10924 - DNA, 2205 bp, Artificial Sequence
  Description of Artificial Sequence: Synthetic coding sequence
atgtgggggctgcttctggccttggcagcctttgctcctgcagtgggcccagccctgggcgcaccgaggaactctgtgctcggactcgctcagccaggaactactaaggtgccaggcagcaccccagccctacactcatcccccgctcagccccctgctgagacagctaacggtacatctgaacagcacgtcagaattagggtgataaaaaagaagaaggtgataatgaagaagcgcaagaagcttactctgactcgaccaacgcctctggtcactgctggcccactggtaactcccacacctgccggtacattggaccccgctgagaaacaagaaaccgggtgccctcctctcggcctggaatccttgcgagtgtccgacagccggctagaggcctccagctctcagtcctttggcttaggcccacacaggggcaggttgaacatacaatcaggactggaagacggtgatttatatgatggagcttggtgtgccgaggagcaggacgcggacccctggttccaggttgacgctggccacccaacgcgcttcagcggggttatcactcaaggcagaaatagcgtgtggcgctatgattgggtgacttcttacaaggtacaattcagcaacgatagtcggacatggtggggctccaggaaccattcctccggtatggatgccgtatttcctgccaacagcgaccccgagacacccgtgctgaaccttctgcctgagccccaggtagcacgcttcatccgcttattaccccagacttggctgcagggtggtgctccttgcctgagagcagaaatactcgcttgccccgtctcagatcctaatgatctcttcctagaagcacctgcctctggtagcagcgaccctctggattttcagcaccataactataaagctatgaggaaacttatgaagcaggtgcaagaacagtgtcctaatattacgcgcatttattctatcggcaagtcctatcaggggctcaagctgtacgtcatggaaatgtctgataagcccggtgaacacgagttgggggaacccgaggttaggtacgtggccggaatgcacgggaacgaagctctgggacgagagctgctgctgctactgatgcagttcctgtgtcatgaattcttgcgtggtaacccccgagtgactcgactgttaagcgaaatgcggatccacctgttaccttcaatgaaccccgacggatacgagatcgcctaccataggggctctgaactggtgggctgggctgaggggagatggaacaatcagtccattgacctgaaccataacttcgctgacctaaacacgcctctttgggaagcccaggatgacgggaaggtgcctcacatcgtgcccaaccaccacttacctttgcctacatactatactttgccaaatgctacagtggcacccgaaacacgcgctgtgatcaagtggatgaagagaattcctttcgttctttcagctaatttgcatggtggagaactggtcgtttcctatcctttcgatatgacacgcactccttgggctgcacgggagctcactccgacccccgatgatgctgtgttccggtggctgagcacggtttacgccggttctaacctggctatgcaggatacctcccggagaccctgccattcccaagatttctctgtgcacggcaacataattaatggggctgactggcacaccgtacctggatccatgaatgatttctcttatttacataccaattgcttcgaggtaaccgtggagttgagctgtgataagtttcctcatgaaaacgaactccctcaggagtgggagaacaacaaggatgcgcttctcacatacctcgaacaggtgagaatgggaatcgcgggagtggttcgggataaagatactgagttaggcatcgctgacgccgttatagccgtggacggcatcaatcacgatgtcactaccgcttggggaggggattattggagactacttacccctggtgattacatggtaacagcatcagcggaagggtaccatagtgtcactcgcaactgccgagtcacatttgaggagggaccatttccctgtaacttcgtcctgactaaaacgccgaagcagaggcttagagaactgcttgctgcgggagccaaagttccacccgacttacggagaagactcgaaaggttgaggggccagaaagattag

SEQ ID NO: 10925 - DNA, 759 bp, Artificial Sequence
  Description of Artificial Sequence: Synthetic coding sequence
atgcgagccccattgcttccccctgcccctgtcgtgctgtcacttctgattctcgggagtggccactacgcagctggcttggacctcaatgatacctatagcggaaagagagagcctttctcgggagaccactctgccgatgggttcgaggtgactagccgttcagagatgtcatctggctctgagatttcccctgtgtccgaaatgccctcatcctccgaacccagtagcggagctgattacgattacagtgaagagtatgataacgagcctcagatccccggttacattgtggacgatagtgtcagggttgaacaggttgtaaagcctcctcagaacaagactgagtccgagaacaccagcgacaagcccaagagaaagaaaaagggtgggaagaatgggaagaatagaagaaaccgcaagaaaaagaacccatgtaacgcagagttccagaatttctgtatccatggcgagtgcaaatatattgagcacctggaggcagtcacttgcaaatgtcagcaggagtacttcggcgagcgctgtggcgaaaagtccatgaaaacccatagcatgattgactcctcgctcagtaagatagccctcgcagctatcgccgctttcatgagcgctgttattctgactgctgtcgcggtgataaccgtgcagctccggagacagtacgtcaggaagtatgaaggcgaggccgaggagagaaagaagctccgccaggagaacggaaatgtccatgcaattgcttag

SEQ ID NO: 10926 - DNA, 8486 bp, Artificial Sequence
  Description of Artificial Sequence: Synthetic coding sequence
atgcccaaaagggcacattggggggcattgtccgttgttctgatcctgttgtgggggcaccccagagtggccttggcttgtcctcacccatgcgcatgctatgtgccgtctgaagtccactgcacgttcagatctctcgcaagcgtgcccgcaggaatagctaagcatgtggagcgaatcaatctcgggttcaattccatccaggcgttaagcgagacttcttttgctggactgactaaactggagctcctgatgatccacggtaacgaaatcccttccattcccgacggtgcccttagggacttgtcgtcccttcaagtgtttaagttctcatacaacaagcttagagtgatcactggacagacactccagggcctctccaatctgatgaggctccacatcgaccataacaagattgagttcattcacccacaggctttcaacggactcacctccctgcgtcttctccacctggaagggaacctgttgcatcagttgcatccaagtacattttcaacctttacgtttcttgactacttccggctatcaacaataaggcatctgtacctggccgaaaacatggtgagaactctgccggcttcaatgctacgtaatatgccactgcttgagaatctctatctccaggggaatccctggacgtgcgactgtgaaatgagatggttcctcgagtgggacgccaaatccagaggtattctgaagtgtaaaaaagacaaggcttacgaaggcggacagctgtgcgctatgtgtttcagccccaaaaagctttataaacacgagatccataagctcaaggatatgacatgtcttaagcccagcatcgagagtcctctcagacagaacaggtcgcgctctatcgaagaagaacaggagcaagaagaagacggaggaagccagcttattctggaaaaatttcaactccctcagtggtcaatctcattaaatatgaccgacgagcatggtaacatggtgaacttagtatgtgacatcaagaagccaatggatgtttataaaatccatttaaatcagaccgatcctcccgacatcgacataaacgccaccgtcgctctggatttcgaatgtccaatgacgagagaaaactacgagaaactctggaaactgatcgcctattactctgaggtcccagtgaaactgcaccgtgaactcatgctgagtaaagaccctcgcgtgagctatcaatacagacaggatgctgacgaagaagccctatactatactggggttcgcgcacagatcctggccgagcccgaatgggtgatgcagccctcgatcgatattcagctaaacaggaggcagagcactgctaagaaggtgttactgtcttattacacacaatatagtcaaaccatcagcactaaagacacgagacaggctcgcggaagaagttgggtcatgattgaacccagcggtgccgttcagagagatcagaccgttctcgagggcggtccatgccagctgtcctgtaatgttaaagcttcagagtcgccatcgatcttctgggtcctccccgatggatccattcttaaggccccaatggatgatccagattcaaaattttctatactctcctccggctggttgaggatcaagagcatggagccctctgatagcggcttgtatcagtgtatcgctcaagtgcgcgatgagatggaccgcatggtctacagggtgctagtgcagagcccttcaacccaaccagccgaaaaggacaccgtgaccatcgggaagaatccaggtgaaagcgttaccctcccgtgcaacgctctggcaatcccagaggcacacttgtcatggatcctacctaatcggagaatcatcaacgatctcgcaaacacatcgcacgtttacatgctccccaatggcacgctcagcatcccgaaagtccaggtgagcgactcaggctactaccgctgcgtagccgtaaatcagcaaggcgctgaccacttcactgttggcatcacagttaccaagaagggctctggacttccttctaaaagggggcgtagacctggcgctaaagcgctgtccagagtcagggaagacattgtggaagacgagggtggttcagggatgggagacgaagaaaacacctcgcgcagactgttacaccccaaagaccaggaagtatttctcaagacaaaggatgatgccatcaatggagacaagaaggccaagaaaggtcgtcgcaaattgaagttgtggaagcatagcgaaaaggaacctgaaaccaacgttgccgagggacgcagggtgtttgaaagcagacgccgtataaatatggctaacaagcagattaatcctgagagatgggccgatatcctagctaaagtacgaggcaagaatttgcctaaggggacagaggtcccacctctgatcaagactacctcaccaccttcactctctttggaggttacacctccgtttcctgcgataagtccgcctagtgcgtctcccgtgcagaccgtgacttcagctgaggaatcatccgcggatgtgccactcctcggggaggaggagcatgtgctaggcacgatatcctccgccagtatgggacttgaacataaccacaatggggtaatcttggtggagcccgaggtcaccagtactcccctcgaggaagtggttgacgatttatccgaaaagacggaggagattacatcaactgaaggcgatctcaagggaaccgccgctcccacccttattagtgagccctacgagccatcccccactctgcacacactcgataccgtctacgagaaaccgacccacgaagagactgcaaccgagggctggtccgctgctgatgtcggaagcagcccggagcccacctcaagcgaatacgagccacccctggacgctgtgagtttggctgagtcagagccaatgcaatatttcgatcctgacttggagaccaagagtcagccagatgaggataaaatgaaggaggacacattcgctcacttgactcccaccccaacgatctgggtcaacgattcatctacctcccagctatttgaggatagtaccattggcgaaccaggcgtgcccggacagagccacctacagggcctaacagataatatccacctggttaagagctccttgtcaacccaggatacgctgctgataaagaaaggtatgaaggaaatgtctcaaaccctgcaggggggaaacatgcttgagggggatcccacacactctaggagcagtgagagtgaaggtcaagaaagtaagagcataaccttgcctgatagtactctggggattatgagcagtatgagcccggtcaagaagcctgctgaaacaactgttggcactctgctggacaaggacactacaaccgccactaccacgccacgacagaaagtggcaccttcaagtaccatgtcaacccatccttctcgcaggcgaccaaatggccgacgccgactccgcccaaataagtttaggcacagacacaaacagaccccaccaaccactttcgctccctccgagaccttttccactcagcctacccaagccccagatattaagattagtagtcaggttgagagctccctggtcccaacagcctgggtagacaacacggtgaatacccctaagcagttggagatggagaaaaacgcagagccaacgagtaagggcacccctaggcgcaaacatggcaagaggccaaataagcatcgttatactccatccacagtctcctccagagcctcagggagtaaaccatccccttccccagaaaacaagcacaggaacatcgtgacaccttcaagtgagaccatcctcctccctcgaacagtaagtctcaaaaccgagggtccttatgattccctggattatatgaccacaacaaggaagatctattcttcctaccccaaggtgcaggagacactgcctgtcacctacaagcccacaagtgatgggaaggagatcaaggacgacgtcgccaccaatgttgacaagcataagagcgacatcctcgttactggagagagcattaccaacgcgattcccactagtcgatcactggttagcacaatgggggagttcaaggaggagtccagtcccgttggattccctggcacgcctacttggaacccctctaggactgcacagcccggacggctgcagaccggcattcccgtgactacaagcggagagaacctcacagatcctccgcttctgaaagaacttgaggacgttgacttcacaagcgaattcctgtcttccctgactgtaagcacaccatttcatcaggaggaagccggtagcagcacaactctgtcctccatcaaggttgaagttgcctcttcgcaggccgaaaccacaacattagaccaggatcatctagaaacaacagtggccatccttctttctgagactaggccgcaaaatcatacacctacagccgcacgaatgaaagagcccgcatcttcatcgccttcaacaatcctgatgtccctaggacaaaccacgactactaagcccgcacttccatcccctaggatctcccaggctagtcgcgactcaaaagaaaatgttttcctcaactatgtgggaaatcctgaaacagaggcaacgccagtcaataatgaaggaacccagcacatgagcggacccaatgaactctcaacaccctctagtgaccaggacgcatttaatttgagcacgaagctggaacttgagaaacaggtctttggcagtaggagtctgccccgaggcccagactcccagcgccaggacggcagggttcatgcatcacaccagttgacgcgagtgcccgcaaaacctatattgcctaccgctactgtgcggctccccgagatgtctactcaaagtgcttccagatatttcgtaacatctcaaagccctcggcattggactaataaacctgaaattactacatacccatctggggctctgccagagaataagcagtttacaacaccaagactgagttcgacgacaatccccctacccctgcatatgtccaaaccctccatcccttccaaattcaccgatcgcagaactgaccagttcaacggctacagcaaggtgttcggcaataacaacatccctgaagcaagaaaccctgtcggcaagcccccatctcccagaataccacattactctaacgggaggctaccttttttcaccaataaaaccctgagcttccctcagctcggtgttacccgaagaccccagatcccaacgagcccagctcctgttatgagagagcgaaaagtgatacccggttcctataatagaattcacagtcacagcacttttcatctcgatttcggccctcctgccccacctctgctccacacacctcagacaacgggatcacctagcacaaatctgcagaatattccaatggtgtccagtacacagagcagcatctctttcattacctcatctgtgcaatctagcggtagcttccatcagagttccagcaagttttttgctggtggaccccctgccagtaaattctggtccctaggcgagaaaccacagattctcacgaagtccccacagacggtgtccgtgactgccgagactgacactgttttcccgtgtgaggctaccgggaagcccaagcctttcgtgacctggacaaaggtgtccacaggagccctgatgaccccgaatacccgcattcagcgctttgaggttttgaagaatggaacactagtaattcgaaaagtgcaggtacaggatcgagggcagtacatgtgcacagcttcaaacttacacggattggaccggatggtggtccttttatcagtgaccgtgcagcagccccaaattttagcttctcattaccaggatgtgaccgtatatctgggcgacaccatcgcgatggagtgtttagccaaaggtaccccagcgccacaaatctcgtggatattccctgatcgtcgagtttggcaaaccgtgagtcctgtcgaggggaggatcactttgcacgagaacaggaccctgtcaatcaaggaagcgtctttctctgacagaggagtttataagtgcgtggcgtctaacgcagccggagcggatagtttggccattcgcctacacgttgccgcactgccccctgtgattcaccaagagaaacttgaaaatatttcgttgcccccaggcctgagcatccacattcactgcaccgctaaggcagcaccccttccttccgtacgatgggtactaggcgacggaacacaaatccgacctagccagtttctgcatgggaatctgttcgtgttccctaatgggacgctgtatatacgtaacctggccccaaaagattctggcaggtatgagtgtgttgcggctaacctggtcggttctgctcgcagaacagtgcagttgaacgtgcagagggctgctgccaacgccaggataaccgggacctcccccaggagaacggatgtcaggtacgggggaacactgaaactggattgtagcgcttctggggatccttggccccgaattctgtggcggctgccttccaagaggatgatcgacgctctgttttctttcgattccaggatcaaagtcttcgccaacggaactctagtggttaagtcagtcaccgacaaagatgctggagactatctgtgtgttgcgcgtaacaaggtaggtgacgactacgttgtgcttaaggttgatgtagtcatgaaacccgcaaagatcgaacacaaagaagaaaacgaccacaaggtcttctatgggggtgatctcaaagtggactgcgtggccacaggcctacccaaccccgagatatcctggtcattacccgacggatcattagttaattcattcatgcaatctgacgactcaggcggacgtactaagcggtatgtggtattcaacaatggcacattatacttcaatgaagtgggaatgagggaggaaggtgactacacctgtttcgccgagaatcaggtgggtaaagatgaaatgagggtgagggtgaaggtagttactgctcccgcaactatcaggaacaagacctatctggccgtgcaagtgccgtacggcgacgtcgtaacagtggcctgtgaggctaagggtgagccaatgccaaaagtgacctggctcagtccaactaataaggtgattccaacttctagcgagaaataccagatctaccaggatgggaccctgttaatccagaaagcacaaagaagtgattccggcaattacacctgtctggtgagaaatagtgcaggcgaagacagaaagacggtgtggattcacgtgaacgtgcagccaccaaaaatcaatggcaaccccaacccgataaccactgtccgcgaaattgccgctggcggaagccggaagttaattgattgcaaggccgagggcattccaacgccaagggtcctctgggcgttcccagagggagtcgtcttacctgccccatattatggtaaccgaatcacagtgcatggaaatgggtccttggacatccgttcactgagaaagtccgatagtgtccagctggtatgtatggccaggaacgagggaggcgaggctcggctgatcctacaactcacagtgctggaaccaatggaaaaacctatctttcatgatccaatatccgaaaagataactgctatggcaggtcataccattagccttaattgtagcgccgcagggacacccaccccaagcctggtctgggtactgcccaatgggactgacctgcaatctggtcaacagctccaaaggttctaccataaggccgacggaatgctgcacatctctggactgagtagcgtggacgccggtgcctatagatgcgtggctaggaacgccgcagggcataccgaaagactagttagtctaaaggttggacttaagcctgaagcaaacaaacagtatcacaacctcgttagcatcattaacggcgaaaccctgaagttgccttgtacccccccaggtgccggacagggtaggttctcttggacgctgcccaacggcatgcacctggaaggccctcagacactagggagggtcagcctcttagataacggcaccctgaccgtgcgggaggcaagcgtattcgaccggggtacatacgtgtgccgaatggaaaccgagtatgggcctagcgtgacctcaattcccgtaatcgtgatcgcctacccccctcggatcacaagtgaacctacacctgtgatatatacccgcccaggtaacacagtcaaattgaactgtatggcgatgggaatccctaaggcggacattacctgggagctgcctgacaagtcccacctgaaggctggcgtgcaagcccgactatatggaaacagatttctccacccgcaggggtccctgacaattcagcatgccacccagcgagatgccggtttctacaaatgcatggccaaaaacattctgggtagcgattctaagacgacttacatccacgttttcta

SEQ ID NO: 10927 - DNA, 3330 bp, Artificial Sequence
  Description of Artificial Sequence: Synthetic coding sequence
atgcggctgcttctcctggtgcctttgctgttggcccctgcaccaggaagctctgcccctaaagtcagacgccagtccgatacatgggggccatggagtcaatggtccccctgcagccgcacctgtggaggcggagtctctttcagagagaggccctgttactcgcagcggagagacggagggtcctcatgcgtgggcccagccaggtcgcaccgatcttgtcggacagaatcttgccccgacggtgccagagacttcagagcagaacagtgcgcggaattcgacggagctgagttccaggggagaagataccggtggctgccatattattcggcgcctaacaagtgcgagctgaattgtatcccaaaaggggaaaatttttactataagcatagggaggccgtggttgatggtacaccctgcgaaccgggaaagagagatgtgtgcgtcgatggcagctgccgggttgtcggctgcgatcatgaattggactcttctaagcaggaagataaatgcctgaggtgcggaggcgatggaacgacctgctacccggtcgccggaacatttgacgcaaatgacctctcacggggatataaccagattctgatagtcccaatgggagcaacatctatcctgatagacgaggctgccgcaagcagaaattttcttgcagttaaaaacgtacggggagagtattacctaaatggtcattggacaatcgaggccgcacgcgcattgccagctgcctctacaatactgcattatgaacgcggagccgaaggtgacctggctccggagagactgcacgcccgtgggcctaccagtgaacctcttgttatcgaactcattagccaagagcctaacccaggagttcactatgaataccacctgcctctgcggcgaccatccccagggttctcctggagtcatggtagctggagtgactgctctgcagaatgtggtggcggacatcagagccgcctggttttttgcactatcgaccatgaggcatacccggatcacatgtgtcagaggcagcctcggcctgctgataggcgctcctgcaatctgcatccctgtccagaaacgaagcgctggaaagctggaccctgggccccatgctctgcaagctgcggcggtggatcacagagtagaagcgtttactgtatctccagcgatggcgcaggcatacaggaggccgtggaagaggcggagtgcgcgggactaccaggcaagcctccagctatacaggcctgtaatttgcagagatgcgccgcatggtcccccgaaccatggggggaatgcagtgtgagttgcggcgtgggagtccgtaaacgtagtgtcacctgtaggggtgagcgaggctctttgttgcataccgccgcttgttccttggaagaccgaccccctctgaccgaaccttgcgttcacgaggattgccctctgctgtccgaccaggcctggcatgttggtacttgggggttatgtagcaaatcttgttcaagcggtacccgtagaagacaagttatctgtgctatcggcccaccctcccactgcggttccctgcagcactctaaacccgtggacgtcgagccttgcaatactcagccatgccatctgccccaagaggtgccttccatgcaggacgtgcatactcctgctagcaatccttggatgccactgggcccacaggagtcacccgctagcgactctagagggcagtggtgggcagcccaggagcacccctcggctcggggtgatcacaggggggagagaggggaccctcgaggggaccaagggactcatctctctgctctggggcctgcacccagcttgcaacagccgccatatcagcaaccactgcgatccgggagcggacctcacgactgccgccattctcctcatggctgctgtcccgacggccacactgcctctctgggccctcagtggcagggatgcccgggagcgccttgccaacagtctcgatacggatgttgtccagatagagtgtccgtggccgagggccctcaccatgcagggtgtactaaatcatatggcggagattcaactgggggaatgccaaggtctcgggcagttgcaagcacggtgcacaacacccaccagccccaggcccagcaaaacgagccatcagaatgcagagggtcccagtttggatgctgctacgacaatgtggccactgcagccggaccacttggggagggttgcgttggccagccaagccacgcttaccccgtaaggtgcctcctgccaagtgctcatggcagctgtgcagattgggctgcacgctggtacttcgtggcctctgtgggccaatgcaatcggttttggtatggaggatgccatggcaatgccaacaacttcgcttccgaacaggagtgcatgtcctcctgccagggctccctacatgggcctcggcgaccacagccaggagcaagcggaaggagtacacacaccgacggcggaggtagcagccctgccggtgagcaggagccctctcaacaccggacaggtgctgccgtgcagcggaagccatggccatcgggcggactttggcgccaggatcagcaaccgggacctggagaagccccacacactcaggccttcggtgaatggccgtggggacaggaactaggctccagggctcccggactcggtggggacgccggatctcctgctcctcccttccactcatcgtcgtatcgaatatccctggctggtgtcgaaccctctctggtccaggcggcattggggcagcttgtgcgcttgagctgttccgacgacactgcccctgaatcacaggctgcctggcagaaagatggccaaccaatctcaagtgacagacaccgactgcaatttgatggaagcctcatcatccacccactccaagcagaggatgcgggaacttactcctgtggcagtactcgtccagggagagactcccagaaaattcagctccggatcatcggaggtgatatggccgtgttaagcgaagccgagctttcaagattcccgcaacccagggatcccgctcaggattttggccaggccggagcagccggacctctgggcgcaatcccatcctctcatcctcagcccgctaaccgactgcgcctcgaccagaatcagcctcgcgtggttgacgcatcccccggtcaacgtatcagaatgacgtgtagggccgaggggttcccccctcctgccattgagtggcagagggatggtcagccagtgagctcccccagtacccatcgaccggcacagggcccttggcagggcctccgtaggcccgcacgggcaggtcaactctag

SEQ ID NO: 10928 - DNA, 405 bp, Artificial Sequence
  Description of Artificial Sequence: Synthetic coding sequence
atgaaatctgtgctactgctcacaacacttcttgtacccgcacatctggttgccgcttggtccaataattacgccgtggattgcccccagcattgtgactcatccgagtgtaagagctcacctcgctgcaagagaacagtattggatgattgcgggtgctgtcgggtatgtgccgcaggacgtggagaaacttgttatcgcactgtttccggtatggacgggatgaaatgcggtccaggcctgaggtgccagcccagcaacggagaggatccgtttggagaggaattcggaatttgtaaggagcacgacatggcctccggagacgggaacatcgtgcgggaggaggtagtgaaggaaaacgcggcaggatctcctgtcatgaggaagtggttaaaccctcggtag

SEQ ID NO: 10929 - DNA, 555 bp, Artificial Sequence
  Description of Artificial Sequence: Synthetic coding sequence
atgaagtctgtgctcctactgaccaccttattggtgcctgctcacctggtggccgcatggtccaacaattacgctgtggactgccctcaacactgcgacagtagcgaatgtaaatctagtcccaggtgtaagagaacggttctggacgactgtggctgttgtagggtgtgcgcggcaggaaggggggagacctgttacagaaccgttagtggaatggacggcatgaaatgcggtcctggtctgagatgtcagcctagcaacggcgaggatccctttggagaggaattcggcatttgcaaggactgcccctacggtacttttggcatggactgccgagaaacatgcaactgtcaatctggaatttgcgacaggggaaccggcaagtgcctgaagttccccttttttcagtacagcgtcaccaagtcgagcaaccggttcgtctccctgacagaacatgacatggcctccggggacggaaacattgttagggaggaggtagtgaaggagaacgccgctggcagccctgtcatgcgcaagtggttgaaccctcgatag

SEQ ID NO: 10930 - DNA, 597 bp, Artificial Sequence
  Description of Artificial Sequence: Synthetic coding sequence
atgccaataccagctagccccttgcatccgcctctcccatccctcttactttacctactgctggagctggcgggagtcacccacgtgttccacgtccagcaaactgaaatgagccagacagtctcaaccggcgagagtatcatactctcctgttccgttcctaacacactgcctaatggccctgtcttgtggttcaaggggaccggcccaaatcgaaagcttatatacaacttcaaacaggggaatttccccagggtgaaggaaataggggatactacgaagccaggcaacactgattttagtacccgtataagggaaattagcctcgccgacgccggtacctattattgcgtgaagttcattaagggccgtgccataaaggaatatcagtccggtcgcggaacccaggtattcgtgacggccgaacagaatcctcgccctcccaaaaacaggcccgcaggacgggctggttcccgcgcacaccatgatgcacatacctgtctctctgcactaccagaaaggaacagcactaattatttcgtccagccatgctgctgcctcaggttgttgggcctgacaggcttgctgtctaaatag

SEQ ID NO: 10931 - DNA, 594 bp, Artificial Sequence
  Description of Artificial Sequence: Synthetic coding sequence
atgcccatccccgctagccccttgcatccgccactcccatctttgttactgtacctcttattggaactcgccggagttacacatgtgtttcacgtgcagcagactgagatgtcccagacagtctcaacgggtgagtccattattttgagttgttcagtgccaaatacactccccaacgggccagtcctgtggtttaaggggactggccctaaccgcaagttgatctataattttaagcaggggaattttcctcgcgtgaaagagataggagataccaccaagcccggtaacacggacttcagcacgagaataagggagatctcgttggccgacgcaggtacatactactgtgtgaagttcatcaagggacgggcaattaaggagtaccagtcagggcgtggaacgcaggtgttcgtgaccgagcagaaccccaggccgcctaagaaccggccagctggaagagcagggtctcgcgctcatcacgatgcacacacgtgcctttccgcactgcctgagcgtaacagtaccaactacttcgtacaaccttgttgctgccttcgcttacttggacttacagggctgctgtccaaatag

SEQ ID NO: 10932 - DNA, 1563 bp, Artificial Sequence
  Description of Artificial Sequence: Synthetic coding sequence
atgaccacagatgataccgaagtgcctgctatgaccctggctcctgggcacgccgcactggagacccaaacgctgtccgccgagacctctagtagagcaagtaccccggctgggcctatccctgaagccgagactaggggggctaagcgaatctcccctgccagagagactaggagtttcacaaagacctcaccgaactttatggtattaattgcaacctctgtggaaacaagcgccgcttcagggtccccagaaggagctggaatgaccacggtgcagacaatcaccgggtccgatccccgtgaggcgatctttgacaccctgtgcacggatgacatctccgaagaggccaagactctcaccatggacatcctgacgttggcccacacatctacagaggcaaaaggcctgtctagcgagtcttctgcctcctctgatggaccccatccagtaatcaccccctcccgtgcttcagaatccagcgctagctctgacggcccacatccagtgatcaccccatccagagcttctgaatcgtcagcttcttcagatggaccacaccctgtgatcactcctagccgggcttccgaatcatcggccagctctgatggtccacacccagtcataactccttcctggtctccagggtctgacgtgaccctgctggctgaagccctcgtgaccgtgacaaacatagaagtaatcaattgcagcataacagaaattgaaaccaccacgagtagcattccaggagcctcagataccgatctcattcccaccgaaggggttaaggctagttctacaagtgatccgcctgccttgcctgatagtaccaataccaagccccacattacggaggtgacagccagtgcagagactctcagtactgccggtaccaccgagagtgctgctcctgacgcgacaatcgggacgccactgcccactaatagtacgatcgagagagaggtcacagctccaggcgcaacaacactcagtggggcactcgccacaggaaatcctctcgaagaaactagtgccctgtccgtagagactccatcatacgtgaaggtgagtggtgctgctcctgtctccattgaggcaggctctgccgtaggaaagactaccagttttgcgggatccagcgcctcctcctacagccccttagaggctgcgttgaaaaacttcaccccaagtgagaccctgacaacggacatcgcaacaaaaggcccattcccgactagcagggaccccctcccttccgttccacctaccaccacaaactccagcaggggcacaaactcaacactggcgaaaattacgacgtccgccaagacgacaatgaaaccaccaacggccacaccgaccaccgcacgcacgcgacccaccacagatgtttccgctggggagaacggaggcttcctgctgctcagactgtctgtggccagtccagaagaccttaccgacccccgagtggcggagcggctgatgcagcagctgcaccgagagcttcatgcccatgctcctcatttccaggtgtctttgctgagggtccgcaggggatag

SEQ ID NO: 10933 - DNA, 600 bp, Artificial Sequence
  Description of Artificial Sequence: Synthetic coding sequence
atgctctggagacagttaatctactggcagctgctggccctattctttctgcccttttgtctatgtcaggacgagtatatggagtccccccagacagggggattgcccccagactgtagcaaatgctgccaccatggaaacaatggaaacaacggtgccacaggccacaagggtgaaaaagggtaccctggcatcccgcctgaactgcagattgcgttcatggctagcctcgcaacacactttagtaaccagaacagcggtatcattttttcctccgttgagacaaacataggtaatttcttcgacgtcatgactggcaggttcggcgctcccgtttcaggagtgtacttttttacattctccatgatgaaacatgaagacgttgaagaggtgtatgtgtatctgatgcataacggaaacactgtcttttcaatgtattcttacgaaatgaaggggaagagcgatacgtccagtaatcatgcagtgttgaagttagctaagggagacgaagtgtggctgagaatgggaaacggggctctgcacggcgatcatcagaggtttagcacatttgcaggattcctgctgttcgaaaccaagtag

SEQ ID NO: 10934 - DNA, 960 bp, Artificial Sequence
  Description of Artificial Sequence: Synthetic coding sequence
atgctatggcgacagctgatttactggcaacttttggctctgttttttctgccattttgtttgtgccaggatgagtatatggaggtctctggcagaacaaacaaagttgtggccaggatcgtccagagccaccagcagacgggacgaagcggctcccggcgagaaaaggtgcgcgaacggtctcatcccaagaccgggaccgtggacaacaatacctccacagaccttaagtcactccgccctgatgagctgcctcaccccgaagtcgacgatttagcacagataaccactttctggggccaatcgcctcagacaggtggcctgccacctgactgctcaaagtgctgccacggcgattattccttccggggataccagggacctcctggccctcccggaccgcctggaatccccggaaaccacggaaacaatggtaacaacggggcaaccggccacgaaggggctaagggggagaagggggacaagggggacctgggcccacgtggcgagagaggtcagcacggcccaaagggagagaagggctaccctgggattccgcctgaattacagattgcttttatggcgagcctagccacccatttttccaaccagaattccggcatcattttctccagtgttgaaacgaacattggcaatttctttgacgtcatgactggcagattcggcgctcctgtctccggtgtttacttttttactttttcaatgatgaagcatgaggacgtggaagaagtgtatgtttatctcatgcataatgggaatacggtcttcagcatgtattcctatgagatgaaaggcaagtctgacacatcgtccaatcatgccgtgctgaagctggcgaagggcgatgaggtctggctgagaatggggaatggcgctctgcacggagatcaccaacgtttttctacttttgccggttttctattattcgaaaccaagtag

SEQ ID NO: 10935 - DNA, 855 bp, Artificial Sequence
  Description of Artificial Sequence: Synthetic coding sequence
atgactaaatcttctctccgcccattgcagaagcagagcccacagaccgggggtctccctcctgattgctccaaatgctgccatggcgactatagctttaggggataccagggtcctcccggacctccaggcccacccggaattccgggtaatcatgggaataacggcaacaatggcgcaaccgggcacgaaggcgcaaaaggagagaagggcgacaagggcgacctgggtccacggggagaacgcggacaacacgggccaaaaggcgaaaagggataccccggaattcctcctgagctgcagatagcctttatggcctccttagccactcacttctcaaaccagaattcaggcattattttcagttcagtagagactaacattggcaatttcttcgacgtcatgacaggacggttcggcgctcccgtgtcgggagtttacttttttaccttctccatgatgaaacatgaggatgtcgaggaggtgtatgtatatctgatgcacaacgggaacactgtatttagcatgtactcctacgaaatgaaagggaaaagcgacacttcttccaatcacgctgttctgaagttagcaaaaggggacgaggtttggctgcgcatgggcaacggagctctccatggggaccaccaaaggttcagcaccttcgccggattcctgctgttcgagactaaatgccacggagagacaccagccggacctagggacagcgcagctgggaaatctaaagcctatctttgtcaggctgagtggatttggccagttcgcaagctgttacccgtgtcctggcccaggtatcagctctttggatttgtccgatggaaggagcaacatatctag

SEQ ID NO: 10936 - DNA, 234 bp, Artificial Sequence
  Description of Artificial Sequence: Synthetic coding sequence
atggccactcggtctgttctccttgccctggtggtgttgaacctgctcttttatgtgcctcccggtcggtcaggccctaatgtttacatccagaagatttttgcctcatgctggcgcctccagggaacgtgccggcctaagtgcctgaaaaatgagcagtatcgaatactctgcgacacaatccacttgtgctgtgtcaacccaaagtacctccccatcctgacaggaaaatag

SEQ ID NO: 10937 - DNA, 237 bp, Artificial Sequence
  Description of Artificial Sequence: Synthetic coding sequence
atgaacttatgcctatctgcactgctcttcttcctggtcatcctgcttccctctggaaaggggatgtttgggaacgacggagtgaaagtcaggacttgcacatcccagaaagcggtttgcttctttggatgtcctccaggctatagatggatcgctttctgtcacaacatcctgagctgttgcaaaaatatgactcggttccaaccaccccaagcaaaggacccttgggtgcactag

SEQ ID NO: 10938 - DNA, 627 bp, Artificial Sequence
  Description of Artificial Sequence: Synthetic coding sequence
atgggggcacaaggagcccaggagagtattaaagccatgtggagagtgccgggaaccactcgacgtcctgtaaccggcgaaagcccgggaatgcatcgccctgaagctatgcttcttctgctcacactggctctgctggggggaccgacttgggctgggaaaatgtacgggccaggcggaggtaagtatttcagcacaacagaagactacgaccatgaaatcaccgggctgagagtgtccgtgggactgctgctggtgaagagcgtgcaagtgaagcttggagattcttgggacgtgaaacttggggctctgggtggaaatacacaagaagttaccttacagcccggtgaatatattaccaaagtgtttgtggccttccaggcctttctgcggggaatggtcatgtacactagcaaagacaggtacttttactttggaaagctggacggccagatttccagtgcgtacccttctcaggaggggcaggtcttagtggggatttacgggcagtatcagttgctcgggatcaagagtatcggattcgaatggaattatccacttgaagaacccacgaccgaaccaccagtgaatctcacctacagcgctaacagtcctgtcgggcgatag

SEQ ID NO: 10939 - DNA, 288 bp, Artificial Sequence
  Description of Artificial Sequence: Synthetic coding sequence
atgaagttcttgctgctagtgctggcagccttgggctttctgactcaggttattcctgcgagcgccggtggctctaaatgcgtttccaacacgcccggttattgccgcacttgttgccattggggggagactgcactgttcatgtgcaatgcgtcacgcaagtgttgcatatcttactcattcctccctaaacccgatctgccccaactgattggcaatcactggcagagcagaagaaggaatactcagaggaaggataaaaagcaacagaccacagttaccagttag

SEQ ID NO: 10940 - DNA, 339 bp, Artificial Sequence
  Description of Artificial Sequence: Synthetic coding sequence
atgttcgtgctactatatgtaactagttttgcgatatgcgctagcggccagcctagaggtaatcagctgaaaggcgagaactactctccacgctacatatgctcaatacctggccttcccggtccccctggccctcccggagccaatgggagccccggtcctcacggccgaattggtctgcctggcagagacggtagagacggaaggaaaggggagaaaggggagaagggaactgccggtctgaggggcaaaactggcccattgggcctggctggcgaaaaaggtgaccagggggagactggcaagaagggtccgatcggacccgaaggtgagaaatag

SEQ ID NO: 10941 - DNA, 300 bp, Artificial Sequence
  Description of Artificial Sequence: Synthetic coding sequence
atgggcctgtttatgattatcgccatcctactgttccaaaagccaactgtcaccgagcagttaaagaagtgttggaataattacgtacagggacattgccgcaaaatttgtcgggtgaatgaagtgccagaagccttgtgcgagaatggccgttattgctgcctgaacatcaaggagctggaggcctgtaagaaaatcaccaagcctcccagacccaagcctgccactcttgcactgactctgcaggactatgtgacaatcatagagaactttccgagtttaaagactcagtccacatag

SEQ ID NO: 10942 - DNA, 336 bp, Artificial Sequence
  Description of Artificial Sequence: Synthetic coding sequence
atgaaaagcctgctatttacactagcagtttttatgctgttggcacagctggtgtcaggtaactggtacgttaaaaaatgcctgaacgatgtgggaatttgtaaaaagaaatgcaagcccgaagaaatgcatgtcaagaatgggtgggctatgtgcggcaagcagcgcgattgttgtgtgcctgccgaccggagggcgaattaccccgtattttgtgtccaaactaagaccacacgcatctccacagttacagctactactgctacgacaaccctcatgatgactacagcctctatgtcatccatggcccctaccccggtatcccccaccggatag

SEQ ID NO: 10943 - DNA, 1698 bp, Artificial Sequence
  Description of Artificial Sequence: Synthetic coding sequence
atggaggattctgattccgcagctaagcaactcggcctggccgaggcggcagcagtagccgcagctgccgctgtcgcggctgcggcagctgctgctgccggaggcgaagccgaggagccagtgttgtcccgcgatgaagactctgaagaggacgctgatagcgaggctgaacgggaaaccccccgagttacagctgtcgccgtaatggccgcagagcccggtcatatggatatgggagccgaagcactgccgggtccggacgaagccgcagccgcagccgctttcgctgaagtcaccactgtgacagtggccaatgtgggagcagccgctgataacgtgtttaccacttcagtggcaaacgctgcctcaatcagtgggcacgtgctgagcggcagaacagctctgcaaatcggcgattcactgaataccgagaaagcaacactgatcgtcgttcacacggacggctctattgtggaaacaaccgggcttaaaggacccgctgctcctctgactcccggaccacagagtcctcctacacctttagcaccagggcaggagaagggcggaaccaagtataattgggacccttccgtgtacgacagcgagctgcctgttaggtgtaggaacatttctggaactctttataagaaccggctcgggagtgggggacggggaaggtgtatcaagcaaggcgaaaattggtacagccccaccgagtttgaagccatggcaggcagggcaagctctaaagactggaaacggtccatccggtatgctggcaggccactgcaatgtctgatccaggacgggatactcaacccacacgccgcaagttgcacctgtgcggcatgctgtgacgacatgacactgagcggtccggtaagattattcgtcccttacaaaagaaggaagaaagaaaatgaactgccaactacccccgtgaaaaaggacagtcctaagaacatcactctcctgcctgcaacggccgcaacaacgtttaccgtgactccttctggccaaatcacgacctccggagcactcacctttgatcgggcaagcactgtagaggccacagctgtgattagcgagagccccgctcaaggagacgttttcgctggggctacagtccaggaagcaagcgtacagcccccttgtcgcgcatcccatcccgaaccacattatccaggttatcaggatagttgccagattgccccattcccagaggctgccctccccacctctcatccaaagattgtgcttacttctcttccagccttagcagtgcccccacctacaccaacaaaagcagctcccccagccctagtaaacggtctggagctgtcagagcctcggtcatggctctatttggaggaaatggtgaactctctgctgaacacagcccagcagctgaaaacgctttttgaacaagccaagcatgccagcacctaccgggaggccgcaacaaatcaggctaaaatacatgccgacgctgaacgcaaagagcaaagctgcgttaactgtgggagggaggctatgtctgaatgcaccggctgtcacaaagtgaactactgttcgaccttctgtcagcgcaaagattggaaggatcaccagcacatctgtggtcagtcagccgctgttactgtgcaagcagacgaggttcacgtggccgaaagcgtgatggaaaaggtgaccgtgtag

SEQ ID NO: 10944 - DNA, 471 bp, Artificial Sequence
  Description of Artificial Sequence: Synthetic coding sequence
atgaatattctcatgctgacctttatcatttgtgggttgctgacacgggtcacgaaaggatcctttgagccccagaaatgctggaagaacaatgtaggccactgccgcagacggtgtcttgacactgaacggtatattctgctgtgcaggaacaaattgtcatgctgtatctccatcatatcccatgagtatacaaggaggcccgcttttcccgtcattcatctggaggacattaccttggattactccgatgtcgacagtttcaccggtagccccgtgtcgatgttgaacgacctaataacatttgacaccactaagttcggcgaaactatgacaccagaaacgaatacccccgaaaccactatgcccccatcagaagctacaactccagaaacaaccatgcccccatctgagaccgcaaccagcgaaacaatgccacctccaagccaaacggctctgacccacaattag

SEQ ID NO: 10945 - DNA, 837 bp, Artificial Sequence
  Description of Artificial Sequence: Synthetic coding sequence
atggggggaccaagggccctgttggccgctctctgggccctggaggccgcagggacagccgctcttcggataggagcatttaacatacaatccttcggtgactctaaagtatccgacccagcttgcggaagtatcattgccaagatcctagcgggatacgatttggctctagtgcaagaagttcgggatcccgatttgtccgccgtttcagctctcatggaacagatcaattcagttagtgaacatgagtactcattcgtgtccagtcaacctcttgggagagaccagtacaaagagatgtatctgtttgtctaccgcaaggatgcagtgagtgttgtggatacctatctatacccggatccagaggacgtgttcagcagagagccctttgtggtgaaattttctgccccaggcacagcccaaaatttagtgctcatccccctgcacgctgcaccacaccaagccgttgcagaaatcgacgcattgtacgacgtgtatctggatgtgattgataagtggggtactgacgacatgctattcctgggcgacttcaatgccgattgtagttacgtcagagctcaggactgggcagccatccgactgcgctctagtgaagtttttaagtggctcattccagactcagcggacaccacggtcggaaacagtgattgtgcttatgacaggatcgttgcctgtggagcccgtcttagaaggtccctgaagccccaaagtgcaaccgtccatgatttccaggaagagttcggcttggaccagacccaggccttggccattagcgatcacttccccgttgaggtgactctgaagttccaccgctag

SEQ ID NO: 10946 - DNA, 3039 bp, Artificial Sequence
  Description of Artificial Sequence: Synthetic coding sequence
atggctgaagcggctctggaggctgtacgctctgagctgagggaatttccagccgctgccagagagttgtgcgtgcccctggccgtcccctacctggataaacctccaacaccactccatttttaccgagactgggtatgtccaaacagaccgtgtattatccgaaatgcgctgcagcattggcccgcactgcagaaatggtcactgccttactttcgggctacagttggttcaactgaggtttctgtggcagtgacacccgacggctatgccgacgctgtcagaggcgatcgctttatgatgcccgcagagagaagactgcctctgtccttcgtactcgatgtactggagggccgtgctcaacacccgggagtcctgtacgtccaaaagcagtgctccaaccttcccagcgagctccctcaacttctacccgacctagagtcccatgttccgtgggcatctgaagcactgggcaagatgcccgatgcagtaaatttctggttgggcgaagcagcagccgttacaagccttcacaaggatcattacgagaacttgtactgcgtggtatccggtgagaagcactttttattccacccgccttccgacagaccgttcattccctatgagctctacactccggctacttaccagctgacggaagagggtaccttcaaagtggtggatgaagaagcgatggaaaaggccgaggtgtctcgcacgtgcctcctcacagtgcgggtactgcaagcccaccgactgcctagtaaggatctggtaaccccgagcgactgctatgttaccctctggttgccaaccgcctgttctcacaggctccaaacccgtacagtcaaaaattcatcgtctccagtgtggaatcagagttttcacttcagaatccaccggcaactgaagaacgtaatggagctgaaggtttttgaccaggatctggtaacaggcgacgaccccgtgcttagcgtgctttttgacgcaggcactcttcgcgcaggggagtttagacgagaatccttctccttgtccccacagggagaaggcagactggaagtggagttcagactgcagtctctggccgaccggggagaatggctcgtgtctaacggagtgctcgtggctcgcgaacttagctgtttgcacgtgcaacttgaggaaacgggtgaccagaagagtagtgaacaccgtgtccaactggtggtgcctggcagttgcgaaggtccccaggaggcatccgtggggaccggaacattcaggtttcactgccccgcttgttgggagcaggagctttccatacgcctccaggacgctcccgaagaacagctgaaggctccactgagcgctcttccatccgggcaggtcgtgcggctagtgttcccaaccagccaggagccactgatgcgtgtcgaacttaagaaggaagccggactcagggagttggctgtccggctggggtttggtccttgtgccgaagaacaggcatttctatcacgtagaaaacaggtagtcgcagcagccttgcgacaggctctgcagttagacggcgacctccaggaggatgagatccctgttgtggctattatggcaactggaggaggcatacgcgctatgacctctctctatggtcagctggctgggttgaaggaactgggcttgctagactgtgtttcctatatcactggcgcatccggatcaacatgggccctggctaatctttatgaggatcccgagtggtcacagaaggaccttgcagggccaaccgagctgctcaaaacacaggtgacaaaaaataagcttggggtgctcgccccaagccagctccagcgctatcggcaggaactcgccgagagggcacggctggggtaccctagttgtttcactaacttgtgggcgctgattaacgaagctttattgcacgatgagcctcacgatcacaagctatccgaccagagagaggccttgtcccatggccaaaaccctcttcctatctactgcgctttgaacactaaaggccagtcactgacaactttcgaattcggcgagtggtgcgaatttagcccatacgaagtcggtttccccaaatatggcgcattcattccttccgagctgtttggctctgagttttttatgggtcaactcatgaaacggctccccgagtcacggatctgctttctggaaggcatttggtctaacctctatgcggcaaacctgcaggactccttatattgggcctctgagccaagtcagttctgggatagatgggtgagaaaccaggctaacctggataaggagcaggtgcctttattgaaaatcgaggaaccaccatcgactgccggtaggattgcggagtttttcaccgacctgctgacatggcggcctcttgcacaggctacccacaatttcctacgtggactgcactttcacaaggattattttcaacacccgcacttctccacctggaaagccaccaccctggatggcctcccaaatcaactgaccccaagcgagccacatctgtgtcttttggacgtcggatacctgatcaatacctcatgtcttccattgctccaacccactcgggatgtagacctaattctctccctggattacaatcttcatggcgcttttcaacagcttcagcttctgggccgattttgtcaggaacagggaatccccttcccccctatctctccaagtcctgaagaacagctgcagcccagagaatgccacacattctcagatccaacctgtcctggagctcctgccgtgcttcattttcctcttgtgtctgactcatttagagaatacagcgcccctggagtgcggcgtactcccgaggaggccgcagccggtgaagtcaacctttccagcagcgacagcccttatcattatactaaagtcacctacagccaagaggacgtggacaagctgctccacctcacacactataatgtatgtaataaccaggagcagctgctcgaggctctgcgacaagctgttcagagacgtcgccagcggcgaccccactag

SEQ ID NO: 10947 - DNA, 1548 bp, Artificial Sequence
  Description of Artificial Sequence: Synthetic coding sequence
atggcctggccatactttctggactgccacaggtactttactcgggaagacgaaggttgttatgaccctctagagaaactccggggaggcctggaagcagatgaagctctcccaagtggactgccgcctactttcatccgtttctcacaccacagttatgcgcaaatggtgcgagtcttgagacgaacagcctctcgatgcgcacacgtggcacggacttatagcatcggtcgcagtttcgacgggagagaattgctcgtgattgagttttcttcccgccctggtcagcatgaattgatggaacctgaggtgaaactgattgggaatatacatggcaatgaagtggcaggccgagaaatgctcatttacctcgcacagtatctgtgttccgagtatttgcttgggaatcccagaattcagcggctgctgaacacaaccaggatacatcttttgccatccatgaatcctgacgggtacgaggtggcagctgctgagggagcgggttacaacggctggacttcaggaagacagaacgcacagaacctcgatttaaatagaaactttccggacttgacttccgagtactaccgcttggccgagacgagaggcgctcgcagcgaccatatccctattccacagcactactggtgggggaaggttgcacccgagaccaaggcaattatgaagtggatgcagacgattcctttcgtgctgagcgcatctctccatggaggagacctcgtggtatcttaccccttcgatttcagcaaacaccctcaggaagagaaaatgtttagcccaacacctgacgagaagatgtttaaacttctgtcacgggcttatgccgatgttcacccaatgatgatggaccggtctgaaaacagatgtggcggaaactttctcaaacggggtagtattatcaacggagcagactggtactccttcacaggaggcatgtcagacttcaactacctacatacgaattgcttcgagattacagtagagctggggtgtgtgaagtttcctcccgaggaagccctctacatactttggcaacacaataaggagtctctgcttaacttcgtagaaaccgtgcatagaggaattaaaggggtggttaccgacaaatttgggaagccagtgaaaaacgccaggattagtgtgaaggggatcaggcacgatatcacgacggcccctgacggggattactggcgcctgttaccgcctggcatccatatcgttattgcacaggctccgggatacgccaaggtgatcaaaaaggtgattattccagccagaatgaaacgcgcagggcgtgttgattttattctccaaccactgggcatgggtccaaaaaacttcattcacggactgcgcaggactggaccccatgacccgttggggggagcgtcctcccttggggaagcaaccgagccagatcctctgcgtgcgagacggcagccctctgccgatggtagtaaaccatggtggtggtcttacttcacctctctatccacacacaggccacgttggctgctgaagtattag

SEQ ID NO: 10948 - DNA, 285 bp, Artificial Sequence
  Description of Artificial Sequence: Synthetic coding sequence
atgcgcactctagctattttggcggcaatcctgcttgtggcactacaagctcaagccgagccactgcaggcacgagccgacgaagtcgcggctgctcccgaacagatagcggctgacatccctgaggtggtggtgagtctggcctgggacgagagcctggcccctaagcatcccggttctcgtaagaacatggcatgctactgtcgcattccagcatgtatagctggtgagaggaggtatgggacttgtatctatcaaggaaggctttgggccttttgttgctag

SEQ ID NO: 10949 - DNA, 420 bp, Artificial Sequence
  Description of Artificial Sequence: Synthetic coding sequence
atggggaatcccggaggagtcggcagcgaacggatgagagttgctcgcaggacgcgtaacgtttgtcgatgtcccagggctgccggacctggcgtacctgagccccgtgccgcacctctgcctttactcgcaatggcacctcccccagcctgccggtcaccaatgtcgccgccacctcctcccctgctgttgctattgctgtcgctcgctttacttggcgcaagggctagagctgaacccgcaggctctgccgtaccagcccaaagcagaccctgtgttgactgccatgcattcgagttcatgcagagagccctgcaggacctgcgcaaaacagcttgttccctcgacgcacggactgagacactgctgttgcaagcagaaaggagggctctttgtgcgtgctggcctgcaggccattag

SEQ ID NO: 10950 - DNA, 471 bp, Artificial Sequence
  Description of Artificial Sequence: Synthetic coding sequence
atggccccagccgttacccgtcttctgttcttgcaactcgtcctgggtcccacactcgtgatggacattaagatgcagattgggagccgcaatttttacacactgagtatcgattaccctcgcgtgaactaccctaaggggtttcggggatattgtaacgggttgatgtcttatatgagaggtaaaatgcagaacagcgactgtcccaagattcactatgtgatacacgctccctggaaagcgatacaaaagttttgcaagtactccgattctttctgcgagaattacaacgaatattgtacactcacccaggattccttaccgattaccgtgtgtagtctttcccaccaacagcctccaacttcctgctattacaattccacactgacaaatcagaaactttacctcctttgcagtcgtaaatacgaagccgatcctatcggcattgcaggcctctactctgggatttag

SEQ ID NO: 10951 - DNA, 444 bp, Artificial Sequence
  Description of Artificial Sequence: Synthetic coding sequence
atgatcattatggtgattatctttttggtgcttctcttctgggagaacgaagtgaacgacgaggctgttatgagtaccctggagcaccttcacgtcgactaccctcagaacgacgtccctgtccccgctagatactgtaaccacatgataatccaacgggtcattcgggaaccagaccatacgtgtaagaaagaacatgtcttcatacacgaacggccaagaaagattaacggtatctgcatctctccaaaaaaggtggcatgtcagaatctaagcgccattttttgctttcagtccgaaacaaagtttaagatgactgtttgtcagctgatagaaggaactaggtatcctgcatgtcgataccattatagcccaacagaaggatttgtgctggtgacttgcgatgatctgaggcctgattcattcctcggttatgtcaagtag

SEQ ID NO: 10952 - DNA, 453 bp, Artificial Sequence
  Description of Artificial Sequence: Synthetic coding sequence
atgagatttatggccggacccgcaggatcacaatccctgggacccctgtgttttcactcctcccctcaggcactgtacacagttctcttaatcgtgcttgttatgatgtcactggtttttgggaaatttgtgccggtgaactgggagccccctcaaccactgccctttcccaagtacctgcgctgctaccgctgtctactcgaaacaaaagaactgggatgtcttctggggagcgacatctgtctaacccccgctggtagttcttgcatcactttgcataagaagaactctagcggctcagacgtaatggtgagcgactgtcgctctaaagagcagatgtctgattgttcgaacacaaggacctccccagtgagtggattttggatcttttctcagtactgcttcctggacttttgcaatgacccacagaaccgcggattgtatactccctag

SEQ ID NO: 10953 - DNA, 2742 bp, Artificial Sequence
  Description of Artificial Sequence: Synthetic coding sequence
atgggccctgaggccctgagttctctgttgctgttgttgctggtcgcgagtggagacgccgatatgaagggacactttgacccggctaagtgccgctatgccctcggcatgcaggaccgcaccattcccgacagtgatattagcgcatctagctcctggtccgactcaactgcagcacgccattctcggttggagtcttccgatggcgatggcgcttggtgccccgctggttccgtgtttcctaaagaagaagaatacttacaggtggacctgcagcggcttcaccttgtggccctcgtcgggactcagggccgacatgctgggggattgggcaaagagttctcccggtcataccgcttaagatactcaagagacggaagacggtggatgggctggaaggacagatggggacaggaggtgatcagcggcaacgaagatcccgaaggggtggtattaaaggacctgggcccacccatggtcgcacgcctcgtccggttctacccgagagcggatcgggtgatgtccgtgtgtttaagagttgagctttacgggtgtctatggcgcgacgggctgctttcttatacagctccagtgggacagactatgtatctgtccgaggctgtatatctgaacgatagcacgtatgatggacacacagtggggggtttgcagtacggaggtctaggacagctggctgatggagtcgtgggcctggatgatttcaggaagtcccaagaattgcgcgtttggccaggctatgattatgttggctggtccaatcacagcttcagctcaggttatgttgagatggagtttgagtttgacaggctcagagctttccaggctatgcaggttcattgcaacaacatgcataccttgggagctaggctcccgggtggagttgagtgtcggttcaggcgtgggccagccatggcttgggagggcgagcccatgcgccataacctgggtggtaacctaggagatccgagggcgagggccgtctccgtcccccttggcggacgggtggccagattcttacagtgtaggtttcttttcgctgggccatggctcctgttttccgagatttcctttattagcgacgttgttaataattccagcccggcactcggaggtacctttcctcccgctccgtggtggcctccgggaccgcctccaactaatttcagctctttggaactcgaaccacggggacagcaacctgtggcgaaggcagaaggatcccctactgctattctgattggctgtctggtcgctataattctcttattactgctcatcattgccctcatgctctggcggttgcattggagaagactgctcagcaaggcagaaaggcgagtgctcgaggaagaacttactgtgcacttgtctgtgcctggagacacaatcctgattaataacaggcctggccctagagaaccaccaccatatcaggagccccgtcctagaggtaacccaccacactccgctccgtgcgtgccgaacggatcggccctcttgctgtccaatccggcataccgcctgttattggcaacttatgcgaggccaccgcgtgggcctggaccaccaacccccgcatgggcgaaacccaccaacacgcaagcatattctggcgactacatggaaccagaaaagcccggagccccactgctacccccacctccgcagaactcagtaccccactacgcagaggccgatattgtgaccctacagggcgtaacagggggaaatacttatgccgttcccgcactgccccctggcgctgtgggagacgggcctcccagggtcgactttccacgctctcgattaaggtttaaagagaaactcggggaaggccagttcggtgaggtccacctgtgtgaggtcgattcccctcaggatttggtgtcactagactttccactgaatgtgcggaaggggcacccactgctggtcgctgtgaaaattctgagacccgatgctaccaagaacgcacggaacgacttcttaaaagaagtaaaaatcatgagccggctgaaagaccccaatattatccgtctcctgggtgtctgtgtccaagacgaccccttgtgcatgatcaccgactacatggaaaacggcgacctgaaccagtttctgtctgcccaccagttagaagacaaagccgcagagggcgcaccgggagatggtcaggccgctcaaggacctactatttcttaccctatgctcctgcacgtcgccgcacagatcgctagtgggatgcgatacctcgctactttgaacttcgtccaccgtgatcttgcaacaagaaattgcctggtgggagaaaacttcacgattaagatagcagacttcggcatgtcccgcaatttatatgcgggagactactacagagtacaggggagagctgttctgccaattagatggatggcctgggagtgcatcctgatgggaaagtttactacagcgtctgacgtgtgggcttttggagtgaccctgtgggaagttctcatgttatgtagagctcagccttttggccaattgacagatgaacaggtgattgagaacgccggagagttctttagggatcagggacgccaggtgtatctctctcgccctcctgcctgcccacagggactgtatgagttaatgctccggtgttggtcaagagaatccgagcagaggccgccattctcccagctgcaccgctttctggccgaggacgcgctgaacacagtctag

SEQ ID NO: 10954 - DNA, 453 bp, Artificial Sequence
  Description of Artificial Sequence: Synthetic coding sequence
atgcggttcatggctggtcccgctgggagccagtccttgggtcccctgtgctttcattcctctccccaagcgttatacactgttctgctcatcgtgctggtaatgatgtcgctggtcttcggaaagtttgtgcccgtcaattgggaacccccacagccactgcccttccccaaatatctcagatgttatcgttgcctgctggagactaaggagctgggctgtctgttggggtctgacatatgtctgaccccagctggcagctcctgtattactctgcataagaaaaattcttccggcagtgacgtgatggtgagtgactgtcggtccaaggagcaaatgtctgactgtagcaatacacgcacttcccccgtctccggtttttggatcttcagccagtattgcttcctcgatttctgcaatgaccctcagaataggggcctctacactccttag

SEQ ID NO: 10955 - DNA, 567 bp, Artificial Sequence
  Description of Artificial Sequence: Synthetic coding sequence
atgtttcatcagatctgggccgcacttctgtacttctacggaataattctaaattccatttaccagtgtcccgaacacagtcagctgactaccctgggcgtcgatggtaaggaattccctgaggtgcaccttggacagtggtatttcatcgccggtgccgcaccaactaaggaggaacttgcaacttttgacccagtggataacattgtcttcaacatggcagcaggctctgctcccatgcaactccatctgcgggcaacaataaggatgaaggacggactgtgcgtgcccaggaaatggatctatcacctgacggagggctctaccgatctcagaaccgaggggcgacccgacatgaaaaccgagctcttctcatcttcctgcccaggcggaatcatgttgaacgaaacaggtcaaggatatcaaagattcctgttatataatcggtccccccatccgccagagaagtgcgttgaggaattcaaatctcttacgtcctgcctcgacagtaaggccttcttacttacccccagaaatcaggaggcctgcgagctgagcaataattag

SEQ ID NO: 10956 - DNA, 2535 bp, Artificial Sequence
  Description of Artificial Sequence: Synthetic coding sequence
atggggccaggagcaccgttcgcccgagtgggttggcctctgcccctgctggtggttatggccgctggtgtggcccctgtttgggcgtcacactcccctcatctgccaaggccacacagccgggtcccaccccacccttcatccgaaaggcgagctgtgtacatcggagccttatttccgatgtccggcggttggcccggtggccaggcttgccagcctgctgtagagatggctctggaggatgtgaatagtcggcgagacattctccctgactatgagttgaaactgatccatcacgactctaagtgcgatccagggcaggcaacaaaatacctttacgaactgctgtataacgaccctatcaagataattcttatgccagggtgttccagtgtgagtacactggtcgctgaggcagctcggatgtggaatctcatcgtgctgagctacggttcttcctctcctgcactaagcaaccgacaacgcttcccgactttttttcgaactcatccaagcgcaacgttacacaaccctaccagagttaagctgttcgaaaagtggggatggaaaaagattgctacaattcagcagaccacggaggttttcactagtacactagatgatctggaggagagggtcaaagaagctggcattgagataacttttcgacaaagctttttcagtgatcctgctgtgccggtaaagaatcttaaaagacaggacgccagaataattgtgggactattctacgagacggaggcacgaaaagttttctgcgaagtatacaaggagagattgtttgggaagaagtatgtctggtttcttatagggtggtatgccgacaactggtttaaaatctatgacccctctatcaattgtacggttgatgaaatgactgaggctgtggaagggcacattactactgagatcgtgatgctgaaccccgctaatacccgatcaatcagcaatatgacctctcaagaattcgtcgaaaagttgaccaaacgcttaaagcgccacccggaggaaactggcggatttcaggaggcccctctggcctatgatgctatatgggccctcgcacttgctttgaataaaacttccggaggcggaggacgatcaggagtccgcttggaggacttcaactacaacaaccaaaccatcaccgatcagatctaccgagccatgaatagctcgagcttcgagggagtttcgggtcacgtcgtatttgacgccagtgggtcaagaatggcctggaccctgatcgaacaactgcagggcggttcctataaaaaaattggatattatgactccacaaaggatgatctgtcctggtctaagacggacaagtggataggcggatcaccccctgccgatcagacccttgtgatcaaaacttttcgatttctgagccaaaagctgtttatttccgtgtccgtgctgagctccctgggcattgtcctcgctgtagtctgcctctccttcaacatatacaactcgcatgtccgatacatccagaattcacagccaaacctcaataacctcaccgcagttggatgctccctggcccttgccgctgtcttccctctggggctggacgggtatcacattgggcgaaaccagttcccatttgtttgtcaggctcgcctatggttgctgggcttaggcttcagccttggctatggttctatgtttaccaaaatctggtgggtgcataccgtattcaccaagaaagaagagaagaaagaatggcggaagactctggaaccatggaagttatatgcgaccgtgggactcctcgttggcatggatgtcctgaccctggccatctggcagatagtggacccacttcataggactatcgaaacattcgccaaagaggagcccaaggaggatatcgacgtgtctatattgcctcagcttgagcattgctcttccagaaagatgaacacttggttggggattttctatggatacaaaggtctgcttcttcttctgggcatcttcttggcctacgaaacgaaaagcgtgagcacggaaaagatcaacgatcaccgcgctgtggggatggccatttacaacgtcgccgtcctgtgcctgattacagccccagtgaccatgatcctctcctcacaacaggacgccgcattcgccttcgcgagccttgcaattgtattctccagttatatcacactcgtcgtgctgttcgtcccaaaaatgcggagattgatcacccggggtgaatggcagtccgaggctcaggataccatgaaaaccggctctagcactaataacaacgaggaagagaaatcccgactgttggagaaagaaaaccgagagttggaaaaaatcatagctgagaaggaggaacgcgtgagtgagctcagacatcagctccagagtcgacagcaacttcggagcagacgccacccacccactcctcccgagcctagcggtggactcccccgtggaccacccgaacctcccgacaggctttcctgcgacggcagcagggtgcatctcctatataaatag

SEQ ID NO: 10957 - DNA, 237 bp, Artificial Sequence
  Description of Artificial Sequence: Synthetic coding sequence
atgggctctgggttgcccctcgtgttgctgctgactctgctcggatccagtcatgggaccggaccagggatgaccctccaactcaagttgaaagagagttttcttaccaactcaagctatgaatcctctttcttagaactgctcgagaaactgtgtctgctgttgcacctcccatccggaacttcagtgaccttgcaccacgccaggagccagcaccatgtggtctgtaacacctag

SEQ ID NO: 10958 - DNA, 2700 bp, Artificial Sequence
  Description of Artificial Sequence: Synthetic coding sequence
atgctgttgctgctgctactggccccactgttcttgcgcccacccggagccggaggggcacaaacaccaaacgccacttcagaaggctgccagatcatccatcccccatgggaaggtggaattcgctatcgaggtctcacgagagaccaggtcaaggcaattaactttctcccagtggattacgaaatagaatacgtttgcagaggggaaagagaggtcgtaggaccaaaagtcagaaagtgcttagctaacgggagctggactgacatggacactcctagccggtgtgtgaacagaaccccacatagcgaaagaagggctgtgtacatcggcgcactgtttcctatgagtggcggttggccgggtggccaggcttgtcagcctgctgtggagatggctttagaagatgtcaatagtcgtcgcgacatactgcctgattatgagctgaaattaattcatcatgacagcaaatgcgaccctgggcaggccaccaagtatctatacgagttactctataacgatccgatcaagatcattctgatgcccggatgctcctccgtcagcaccctcgtggcggaagccgctcgaatgtggaacctgatcgtgctgtcgtacggaagctctagtcctgcgttgtccaaccgacagcgattccctaccttctttcgcacgcacccttccgccaccctgcacaatcctacccgagtgaagctttttgagaaatggggatggaagaagatcgcaaccatccagcagacaacggaggtgtttaccagcaccctggacgacctggaagagagggtgaaagaggcaggcatcgaaattacattcaggcagagcttttttagtgatcccgcagtgccagtgaagaacctcaagagacaggatgcacgcataatcgtgggcctgttttacgaaacagaggcccgtaaggtcttctgtgaagtgtataaagagagactgttcggaaaaaagtatgtgtggtttcttataggctggtacgcggacaactggttcaagatttatgatccctcgatcaattgtaccgtcgacgagatgacggaggcggtcgagggccacattacaacggaaatcgttatgctcaacccagccaacacacggtcaatatctaacatgaccagccaggaatttgtggagaagttgaccaaaagactgaaaagacacccggaagaaaccggtggattccaagaagctcctttggcatatgacgctatttgggctctggctctagccctgaacaaaacttccgggggtggcggacggtctggggtgcggctcgaggattttaattacaataaccagactatcaccgaccaaatctatcgtgccatgaacagctccagcttcgagggcgttagcggccatgttgtatttgatgcgtccggaagcagaatggcatggaccctgatagaacaacttcagggcggttcctataagaagatcggctattacgactctaccaaggatgatctgtcttggagtaagactgacaaatggatcggcggatctcctccggcagaccagacgctcgtgataaaaaccttccggtttctcagtcaaaagctctttatttctgtgtctgtgttgtcaagccttggcatagtgttggccgtggtttgcctgagctttaacatatacaactcacatgtgaggtatatccagaatagtcagcccaacctgaacaatctcacagccgtgggatgcagcttggccctggccgcagtgttccctctgggcctggatggttaccacattgggcgtaatcagttcccttttgtgtgccaggccagactgtggctgctcggactcgggttcagcctgggatacggaagcatgtttacaaagatttggtgggtgcatacagtctttacaaaaaaagaggagaaaaaagagtggcggaagacattagaaccatggaaactgtacgccactgtgggtctgctcgttggaatggatgttctgacactggctatctggcaaatcgtggaccccttacataggaccatcgagacatttgcaaaggaggaacccaaggaggacattgatgtatcaatcctgcctcagttagaacactgtagcagcaggaaaatgaatacctggcttgggatcttttacggctataagggcctgctgctattactaggcattttcctcgcctatgagacgaaaagcgtttccacagagaaaatcaacgaccaccgggctgtgggcatggccatctacaacgtggcggtgttgtgtctgatcaccgctcccgtcacaatgattctaagcagccagcaggacgctgcattcgccttcgcctcgctcgctattgtcttctcctcctacataacacttgtcgtgctgttcgtgccaaagatgagacgactcattacacggggagaatggcagagtgaggcccaagatactatgaaaaccggatctagcaccaacaataatgaagaggaaaaaagcaggctgctggaaaaagagaatcgcgagctggaaaagattatcgctgaaaaggaagaacgcgtgtccgaactgcgtcaccaattgcagtcccggcagcagttgcgatctagacggcatccccctactccacctgaaccttcggggggactgccgcgtggaccgccagaaccacctgatagactgagttgcgatggcagcagagtccacttattgtataagtag

SEQ ID NO: 10959 - DNA, 2886 bp, Artificial Sequence
  Description of Artificial Sequence: Synthetic coding sequence
atgctgctactgctgctgcttgccccactcttcttacgcccacccggagctggcggagcacagacccccaacgccacaagtgaaggctgccagattattcatcctccctgggaggggggaattagatacagagggctaacgagagaccaggtgaaagcaatcaattttcttcccgtggactatgagatagagtatgtgtgtagaggagagagagaagtggtcggccctaaagtcagaaagtgccttgcaaacggctcctggactgacatggacactccatctcggtgtgtacgtatttgttcaaagagttacttaaccctagaaaatggcaaggtgttcctgaccggtggggatctccccgctctggacggagctcgagtcgacttccgctgtgaccccgactttcacctggtgggatcctcccgtagtatttgttcccagggacagtggtctactcctaagcctcactgccaggttaaccggacccctcatagcgagaggcgcgctgtgtatattggggcattgttcccaatgagtggcggatggccaggtggccaggcgtgtcagccggcagtcgagatggcactagaagacgtaaattccaggcgggatattctgcctgactatgagctgaaactcattcaccacgattcgaaatgtgacccagggcaagccaccaaatacctgtacgaattgctttacaatgaccctatcaaaattatcctgatgccaggctgcagtagcgtttctacgctggtggccgaagccgctcgcatgtggaatctaatcgtcctgagctacggatcttccagcccagctctcagcaatcgtcaacgcttcccgacattttttcggactcatccttctgcgactctgcataacccaacccgagttaagttattcgagaagtgggggtggaagaaaatcgcaacgatccagcaaacaaccgaggtatttacctctactctcgatgacctggaggaaagagttaaagaggcgggtatagaaatcacattccggcagtcctttttctccgatcccgcagtcccagttaaaaatttgaagcgacaggatgctcgcatcattgtgggcttgttttacgaaactgaagccagaaaggtattttgcgaagtctacaaggaaagactgttcggcaagaaatatgtgtggttcctgatcggttggtatgccgataattggtttaagatctacgatccgtcaatcaattgcactgtcgacgagatgaccgaagctgttgagggacacatcactacggagattgttatgttgaatcctgctaacacgcgcagcatctctaacatgacctctcaagagttcgtagaaaaactgactaaacgcctgaaaagacaccctgaagagacaggaggttttcaagaagcgcctctcgcctacgacgcaatttgggccctggcgttagctctaaacaaaacatctggtggaggcggtaggagcggggtgaggttggaggattttaactacaacaaccagaccattacagaccagatttaccgagctatgaattctagctcgttcgagggtgtgagcggacatgtggtgttcgatgcctctgggtcacgtatggcctggacactgatcgagcaactccagggcggtagttataaaaaaatcggttactatgacagcactaaggatgatctgagctggagcaagacggacaagtggatagggggatcccctcccgcagaccagacattggttataaagaccttccggtttctgtcccaaaagctcttcatctcggtgtctgtgttgagttccctcggaatcgtattagcagtggtttgcttgagcttcaatatttacaacagtcacgtgcgttatatccagaatagccagcccaatcttaacaatttgactgctgtaggatgtagccttgcgctggccgcagtgtttcccctcggtctcgatggctatcatataggaagaaatcagttcccatttgtgtgccaggccagactctggcttctgggactggggttttctctaggatacggatcgatgttcacgaaaatttggtgggtacacaccgtgttcacaaaaaaagaagagaaaaaggaatggcgcaaaaccctcgagccttggaagctctatgctacagtgggtcttttggtcggcatggatgttcttaccctcgctatctggcagatcgtggatcccttacacagaaccattgaaactttcgccaaggaagagcctaaggaagatattgatgtttctatactaccccagctggaacattgctcctcgcggaaaatgaacacatggttgggcatcttttatggctataaggggctgttattgctgctgggcatctttctcgcgtacgaaaccaaaagcgtaagtacggagaagataaatgaccatcgagcagtcggtatggctatctacaacgttgccgtgctttgtttaatcacggcccctgttactatgatcttgagttctcagcaggacgctgcgttcgcatttgcgagcctcgccattgtgttcagctcttatattactctcgttgttctgtttgttcccaaaatgcgacgcctgatcacccggggagaatggcagtccgaggcccaggacacaatgaagactggttcctcaactaataacaacgaggaagagaagagtcgcctgctcgagaaggagaacagggaactcgaaaaaatcatcgctgagaaggaagagagagtttccgagttaagacaccaactgcaatctcgccagcagctgcggtcccggagacaccccccaacacctcccgagccgtcaggagggctcccgaggggtcctccggaaccacctgacagactctcatgcgatggaagcagggtccatctgctgtacaagtag

SEQ ID NO: 10960 - DNA, 2535 bp, Artificial Sequence
  Description of Artificial Sequence: Synthetic coding sequence
atgggaccaggggctccttttgctcgagtggggtggccactgccactgttggtagtcatggcagcaggggtcgcgcctgtttgggcctcacattccccccatttacctcgcccacattcccgggtcccaccccatccatcttccgagaggagggctgtttacataggtgcactgtttccaatgtccggaggctggcctggcggtcaagcctgccagcctgccgtggaaatggccctcgaagatgtgaactcccgcagagatatcctgcccgactatgagttgaaactgatacatcatgactcaaaatgcgatccagggcaagcgactaagtatctgtacgagttgctgtacaatgatcccattaagattatcctgatgccaggatgctccagtgtgagcaccctggtcgcggaagctgccagaatgtggaacctgatcgtgttgtcctatggttcttcgtcacccgcattgtcgaacaggcagaggttcccaactttttttcggacccacccctctgccacgttgcataaccccacacgtgtcaaactctttgagaagtggggatggaagaagatcgcaactatacagcaaacaaccgaggtgttcacttcaactctggatgacctggaggagcgggtcaaggaagccggtatagaaatcacatttagacaatcctttttttctgacccggcagtgccggtcaaaaatctaaagaggcaggatgcacgcatcatagtgggtctgttctacgagacagaagcaaggaaggtgttctgcgaagtttataaagagaggttgtttgggaagaaatatgtgtggttcctaattgggtggtatgcagacaactggtttaagatttacgacccgtcaatcaattgcacggtggacgaaatgactgaggccgtcgagggccacattaccacagaaatcgttatgctgaatccagctaatacacggtctattagcaacatgacctcccaagagtttgtggaaaagctgaccaagaggctcaagcggcacccggaggagaccggaggatttcaggaggcgccattggcatacgatgcaatctgggctctcgccctcgcgttaaacaaaactagcggtggagggggaagaagcggtgtgcgactcgaagatttcaactacaataatcagacaataaccgatcagatatatagggccatgaacagcagctcatttgagggggtgtctggccatgtggttttcgacgccagtggctctcggatggcctggacactaatcgaacaactccagggtggctcatataagaagatcggttattacgatagcaccaaggacgacctaagctggtcgaagacagacaaatggataggaggatcccctccggctgatcagaccttagtgatcaaaaccttcaggtttctgtcacagaagcttttcattagtgtgagtgtactctcctctctggggattgtgctggccgttgtgtgtttatccttcaatatatacaactctcatgtgaggtatatccaaaattctcaaccaaacttaaataacctcaccgcagtgggatgctctcttgccctggcggctgttttcccacttggcctggacggataccacataggtcgtaaccagtttccttttgtttgtcaggcaagattgtggctgttgggcttgggcttctccctgggatacgggtcgatgtttaccaaaatatggtgggtgcacacagtgttcaccaaaaaggaagaaaagaaagaatggcgcaaaactctggaaccctggaagttgtatgctacggtcgggctcctagtgggcatggatgtgctgacgctggccatctggcagatcgtggacccactccatcggacaatcgaaacatttgcaaaggaagaacctaaagaggacatcgacgtgagtatactccctcagttggagcactgtagcagcaggaagatgaacacctggctgggaatattctacgggtataaaggactattgctgttactgggtatattcttggcttacgaaaccaagagcgtgagcaccgagaagattaacgaccaccgggcagtgggaatggccatatataatgtggccgttctctgcctgattacagcccctgtgaccatgatcttatcttcccaacaggacgcggcattcgcgtttgcaagtctcgcgattgtgttttcctcctatatcacgttagtggtgctgttcgtgccaaaaatgcggcgtctcattactcggggtgagtggcagagtgaggctcaagacactatgaaaacaggcagcagcaccaacaataatgaggaggaaaagtccaggctcttggagaaggagaaccgggaactggagaagatcatcgccgaaaaggaagagcgcgttagcgaactacgacaccagctgcagagccgacagcagttacgttcaagacgccacccacctacgcccccagagccctccggcggtttacctagaggccctcctgaaccacccgatcgtctgagctgcgatgggtctcgtgtccacctgctatataaatag

SEQ ID NO: 10961 - DNA, 2535 bp, Artificial Sequence
  Description of Artificial Sequence: Synthetic coding sequence
atgggcccaggggctccttttgctcgagttggatggccacttccactgctcgtggtcatggcagccggagtagctcccgtctgggcctctcactcacctcacctgcctagaccgcactcacgggtgccacctcatccgagttccgagcgtagggcagtgtacatcggggcactcttcccgatgagcggcggttggcccggagggcaggcctgccaacccgctgtggaaatggccttggaagatgtgaattcacgtcgggacattctgccggattacgaactcaaactcatccaccacgattccaagtgcgatcccggtcaggccaccaaatatctctacgagctactgtataatgatccaattaagatcattctgatgccgggatgtagcagcgtctcaacgttggttgccgaggcagccaggatgtggaatttaattgtactttcctatgggtcttcatcaccagcactgtcaaacagacagaggttcccaacgttcttccgtacacatcccagcgcaacactacacaaccctacaagagtgaaactcttcgagaagtggggttggaaaaagatcgccacaatccagcaaacgacagaagtgttcacctctacattggacgacttggaagagcgggtgaaagaggcaggcattgaaatcacttttagacaatcctttttctccgaccccgctgttcccgttaagaatctaaaaaggcaggacgcgagaattatcgttggcctattttacgagacagaagccagaaaagtgttttgtgaggtctataaggagcgcctgttcgggaaaaagtacgtttggttcctgattggctggtatgccgacaattggttcaagatatatgacccgtccatcaattgtactgtagacgagatgaccgaggcggttgaggggcatatcactactgaaattgtcatgctgaatccagccaatactagatctattagcaacatgacaagccaggaatttgtggagaagctaactaagaggctgaagcgacaccctgaggaaactggcggattccaggaggcccctctggcttacgacgccatttgggcactcgctttagctctaaacaaaacatccggaggcggtgggagatcaggagtgaggctggaggatttcaactacaataaccagacaatcactgaccagatttatcgcgcaatgaatagctcatccttcgagggcgtatcagggcatgtggtgttcgacgccagtgggtcccgaatggcgtggacactgatcgagcagcttcagggcggatcttacaaaaagattggatactatgattcaacaaaagatgacttgagttggagcaaaaccgataagtggattggcggttctccacccgcagaccagaccctggttattaagacgttccgcttcctcagccagaagctcttcattagtgtctctgtattatcatctctgggcatcgtgctggccgtagtctgcctgtcctttaatatttataattctcacgtgagatacatacagaattcccaacccaacctgaataatctgaccgccgttggatgttccctcgccctcgcggcagtcttccccctgggactcgatgggtatcacatcggtcgcaaccagttccccttcgtttgccaagcgagactatggctattaggtctgggcttctccctcggttacggaagtatgttcaccaaaatttggtgggtgcacacggttttcacgaaaaaggaagagaaaaaggaatggcgaaaaacgcttgaaccttggaagttgtatgcgaccgttgggttgctggtgggtatggatgtccttactctggctatttggcagattgtcgaccctctgcacagaactattgagacctttgctaaagaagagcctaaggaggacattgacgtgtcaatcctcccacaacttgagcactgctcatcacgtaagatgaatacctggctgggtatattctacggctacaaaggacttcttttgctacttggaattttcctggcctatgaaaccaaatcagtcagcactgaaaaaataaacgatcatcgcgcagttggcatggccatatacaacgtggccgtattatgcctgattactgcgcctgttactatgatcctgtcctcacaacaagacgctgcatttgccttcgcctctctggctattgtgttctcgtcatatatcactctcgtagtgttgttcgtccccaagatgcgcagactgattacaaggggggagtggcagagtgaagctcaagacactatgaagacaggttcttccacgaataataatgaggaggagaagtctaggttactcgaaaaagaaaatcgagaattggagaagatcattgccgaaaaggaggagagagtcagcgaactacgccaccagctgcaatctcgccagcagctcagatcacgccgtcacccccctactccacccgagcctagcggtggcctgcccaggggccctccagagcccccagatcgcctcagttgcgacggctcacgagtccatctgctgtacaagtag

SEQ ID NO: 10962 - DNA, 2700 bp, Artificial Sequence
  Description of Artificial Sequence: Synthetic coding sequence
atgttactgttactccttctggcaccattgtttctaaggccacccggagccggaggagctcagacgcctaacgccacctctgagggatgccaaatcattcacccaccctgggaaggcggtatcaggtaccggggacttacccgggaccaagtcaaggccatcaattttttgcctgtcgactatgaaatcgagtatgtatgtcgaggagagagagaggtcgtcggcccaaaagtgagaaagtgtctcgctaatgggtcttggacagatatggacactcccagccgctgtgtgaaccgcacccctcattctgaacgacgtgctgtatatattggggctctcttccccatgtctggtggctggcctggcggacaagcctgtcaacctgctgtcgagatggccctggaagatgttaacagtaggagggatatcctgcccgattacgaacttaagctgatccaccacgattccaagtgcgaccctgggcaggcgactaagtatttatacgaattgctctataacgatccaatcaagataatcctgatgccgggatgcagttctgttagcaccttagtggccgaagcagcacgcatgtggaacctgatcgtgttatcctatggatcctcatctcctgcactctccaatcggcagagatttcccacctttttcagaacccatcctagtgcaaccttgcacaatcccacccgtgtgaaactgtttgagaagtgggggtggaagaaaatcgccaccatccagcagaccacggaagtcttcacctctacactggatgatctggaagagagggtgaaggaggctgggattgaaatcacattccgacagtcttttttctctgatccagccgtgcccgtgaagaatctgaagcggcaggatgccaggatcatcgttgggctgttctacgaaacagaggccaggaaggtgttttgcgaggtgtacaaagaacgcttattcggcaaaaagtacgtttggttcctgattgggtggtacgccgataattggttcaaaatctacgatcccagtattaactgtacagtagacgaaatgaccgaggcggttgagggacacattaccactgaaattgtcatgctcaatcccgcaaacactagaagtatctccaacatgacttctcaggagttcgtggagaagcttacgaagcggctgaagcgccacccagaggagaccggtggttttcaagaggcacctttagcctacgatgcaatttgggcgttagctttggccttgaataagaccagcgggggtggaggtagaagcggggtacgcctggaggactttaactataataatcagaccattaccgaccagatatacagagctatgaattcgtctagcttcgagggagtatccggtcatgtggtttttgatgcaagcgggtccagaatggcctggactctcatagagcagctgcagggaggatcttacaagaagatcggctattacgattcaaccaaggatgacttgagctggagtaagacggacaaatggataggcggatctcctccagcggaccaaaccctggtgatcaagacctttcggttcctgagccagaaactgtttattagtgtttccgtgttgtcctccctcgggatcgtgctggctgtcgtgtgtctgtcctttaacatttataacagtcacgtgaggtacattcaaaactctcaacccaatctcaacaatctaaccgcagtggggtgttcgctcgcacttgccgctgtgttcccattaggtctggacggctaccatataggtagaaaccagttcccattcgtctgccaagcccgactgtggctgctgggcctgggtttttctttgggctacggctccatgttcacaaagatatggtgggtccataccgtgtttaccaagaaagaagaaaaaaaagaatggagaaaaactctggagccttggaagctgtacgccactgtggggctgctggtgggaatggatgtcctgactttggcaatctggcagatagttgacccccttcaccgaaccatagagacatttgcaaaagaagagcccaaagaggatattgatgtgtctatcttaccccagctcgagcattgtagctctagaaaaatgaatacctggctcggcatattctatggatataaagggctgcttcttttactcggcattttcctggcgtacgaaacgaagtcggtgagcacggaaaagattaatgatcaccgcgctgtcgggatggccatctataatgttgctgttttgtgcctaatcaccgctcccgtgaccatgatcctgtcatcccagcaagacgccgctttcgcctttgcctctcttgccattgtgttcagcagttacattaccctcgtcgtgctatttgtgccaaaaatgaggaggttaatcactcggggagagtggcagagcgaggcccaggatacaatgaagactgggtctagcacaaacaataatgaggaggagaagagcagactgctagagaaagagaaccgagagctggagaaaatcatagctgaaaaggaagagcgggtgtcggagctccggcatcagctacagtcacgtcagcagctgcggagccggaggcaccctccaactccaccagaaccctctggcggattgcccagaggaccacccgagccgcctgacaggctatcttgcgacggaagccgagttcatctgctgtacaaatag

SEQ ID NO: 10963 - DNA, 2886 bp, Artificial Sequence
  Description of Artificial Sequence: Synthetic coding sequence
atgcttcttctgttactgctggccccactgtttcttcggcctcctggagccggaggcgcacagactccaaacgcaaccagcgaggggtgccaaatcatccaccctccctgggagggcggtattcgctaccgcggacttaccagagaccaggtgaaagcaatcaacttccttcctgtagattatgaaatcgaatatgtttgtcggggtgagcgagaagtggtgggcccaaaggtccgtaagtgcctcgcaaatgggagctggaccgatatggacacgccctcccggtgtgtgaggatttgctctaaatcatatctaacgctggagaatggcaaagtgttcctgactggtggtgatctgcctgccctcgatggggcaagggtggactttcgctgcgatcctgattttcacctggtaggatcctcccgctctatttgctctcagggacagtggtcaacaccaaaaccgcactgccaagtgaatcgaacaccacattctgagagaagagctgtgtacatcggggcactgtttcccatgagcggtggctggccaggcggacaagcctgtcaaccagccgtcgagatggcactggaagacgtgaattcccgaagagatattctcccagactacgagctgaaactgattcaccacgacagcaaatgcgatcccggacaagctactaagtacctttacgaactgctgtataatgacccgatcaaaattatcctgatgcctggttgctccagcgtgtcaactttggtggccgaggcggctcggatgtggaatcttatagtactgtcgtacggcagctccagcccggcattgtctaataggcagcggtttccaacgttcttcagaacacacccaagcgctaccttgcacaaccctacccgcgtgaaactgtttgaaaagtgggggtggaaaaagattgcgacaatacagcagaccacagaagtcttcacaagtaccttggacgatctggaggaacgtgtcaaggaagccggtatagaaataaccttccgtcagtctttttttagtgatcccgctgtgcctgttaagaatcttaagcggcaggacgctcgaataatagtcggcttgttttacgaaacagaggcacggaaggtgttttgtgaagtgtacaaagagagattgtttggtaaaaagtacgtctggttccttataggctggtatgcggataactggtttaagatctacgatccctcgattaattgcaccgtcgatgagatgacggaggccgttgagggtcacatcaccactgaaattgtgatgctcaacccagcaaatactcggagcataagcaacatgacttctcaggagttcgtcgagaaactcactaagagattgaagcggcatccggaagagacgggtggctttcaggaggcccctctggcctatgacgccatttgggctctggcactggcactgaataaaacaagcggaggtggcggtcggtcaggagttcggctggaggacttcaactacaacaaccagactattactgatcaaatatacagagccatgaactcatctagcttcgaaggggtttccggacatgtggtttttgatgctagtgggtccagaatggcatggacactcatcgagcagcttcaggggggatcatacaagaaaattgggtactatgacagtacaaaggatgacctgtcatggagtaagacagataagtggatcggaggtagcccacccgctgatcagacactggtcatcaagacatttagatttttgagtcagaagctgttcatttcagtcagcgttctcagcagtctaggcatcgtcctcgccgtcgtttgtctgtcgttcaatatctacaattcacacgtgagatacatccaaaactcccagcccaatttgaacaatcttactgcagttggatgtagtttggccctggctgccgtttttccattagggttggatggctaccatatcggacgaaatcaattccctttcgtgtgccaagctcgcttatggctgctgggcctgggcttctctttggggtacggctctatgttcacgaagatttggtgggttcataccgtgtttactaagaaagaggaaaaaaaggaatggcggaagactctggaaccctggaaactttatgccactgtggggttgttggttggcatggatgtgctgacgcttgctatttggcagatcgtcgaccctctccatcgaacgatagaaaccttcgccaaggaggaacctaaggaagacatagacgtgagcatcttgccacagttggagcactgctcgagccgaaaaatgaatacctggcttggaatcttttatggctataagggactgctgctgcttttggggatttttctcgcctacgagacaaaaagcgtgtcaactgagaaaatcaatgaccacagggccgtgggtatggccatatataacgtagcagtgttgtgccttataaccgcccctgttacgatgatcttaagctcccagcaagacgccgctttcgcctttgccagcttagcaattgtgttctcttcatatataacattggtcgtgctctttgtgccaaagatgaggcgattgataacgagaggggagtggcagtcagaggctcaggataccatgaaaacaggttcaagtaccaataacaacgaagaagagaagtcgagattgcttgagaaagaaaaccgagagctggaaaaaattatcgccgagaaagaagaacgggtttcagagctgcgtcaccagctgcagtcgcggcagcagctgagatcccgcagacatcctccaacacctccggagccgtcagggggactccccagagggccacccgagccgccagaccggctgtcttgcgacggtagcagagttcatctcctgtataaatag

SEQ ID NO: 10964 - DNA, 2535 bp, Artificial Sequence
  Description of Artificial Sequence: Synthetic coding sequence
atggggccaggggctccattcgcgcgtgttggatggccactgcccctcttagtggtgatggccgcaggggtcgctccagtgtgggctagtcacagccctcacctgcctcgaccacacagtagggtgccaccacacccatcatctgagaggcgcgctgtctatatcggagctctcttccccatgagtggcggttggcctggcggacaggcctgccagcccgcagtcgagatggccctggaagacgttaacagccggagggatattctccctgattatgaattgaagctgattcaccatgattcaaagtgtgatccaggacaggccaccaagtatctctatgagttgctctacaatgacccaattaaaattatcctgatgccgggatgctcctctgtgagcaccctggtcgctgaggccgctaggatgtggaatcttatcgttctctcctatggcagttcctcaccggctcttagcaataggcagcgcttcccaacgttctttcggacccacccatcagcaaccctgcataaccccactagagttaaactcttcgagaaatggggttggaagaaaatcgcaaccatacagcagaccacagaagtcttcacaagtacgcttgacgacctggaggagagggtcaaggaagctggcatagaaattacattccggcaaagcttcttcagcgaccctgccgtcccggtcaaaaacctgaagaggcaggacgctcgcatcatagtggggctcttctatgaaaccgaggcacggaaagttttttgcgaggtgtacaaggagcggctgtttggcaaaaagtatgtgtggttcttgataggctggtatgcagataactggttcaaaatttacgatccaagcatcaattgtacagtcgatgagatgacagaagcagtggaaggacacattacaaccgagatcgtgatgctgaaccctgcaaacaccaggtccattagtaatatgactagccaagaattcgtcgagaagctgactaagcggttgaagcggcacccagaagagaccggcggatttcaagaagctcccctggcttacgacgcgatttgggcccttgccttggcactgaacaagacctctgggggaggaggacgatctggagtacggctggaggactttaactataataatcagaccatcacagaccagatttaccgagccatgaattcttcctcctttgagggcgtttccggccacgttgtttttgacgcctcaggtagtcggatggcctggaccctgatcgagcagctccagggagggtcttataaaaaaatcggctattatgattccaccaaggacgatctttcctggagcaaaacagacaaatggatcggcggatccccgcctgccgatcagactctcgtgattaagacgttcagattcctaagccaaaagctcttcatcagcgtctccgtcctaagctccctcgggatagtgcttgccgtcgtgtgtctctcctttaatatttacaactcccatgtgagatacatacagaacagtcaaccaaacctgaataatctaaccgctgttggatgctcacttgctcttgccgcagtgtttcctctcgggctggatgggtaccatattgggaggaatcagttccccttcgtgtgtcaagctcggctgtggctgctggggctcggcttctctctgggttatggatcaatgttcacaaaaatctggtgggtccacactgtcttcaccaaaaaggaagaaaaaaaagaatggcgtaagacccttgagccatggaaactatatgctacggtgggactgcttgtgggcatggacgttctgactctggccatttggcagattgtggaccccctccaccgtaccatcgagactttcgctaaggaggagcctaaagaggatatcgacgtatcaatattgccgcagttagagcactgctccagcagaaagatgaacacctggctgggcatattctacggatacaagggcctgctgttgctcttgggaatcttccttgcttatgaaacgaagtcagtgagcacagaaaaaatcaatgatcatagagccgtggggatggccatttataacgtcgccgtgctctgcctcatcacggccccagtcacaatgatcctttcttcccagcaggacgcagccttcgctttcgcctctctagctattgtgttttcaagttatatcacacttgtcgtgctttttgtgcctaaaatgcgaaggctgatcactcgaggagagtggcagagtgaagctcaggatactatgaagaccgggagttccactaacaacaacgaggaggagaagagtaggctcctggaaaaagaaaaccgcgagttggaaaaaatcatcgccgagaaagaggagagggtgtccgaactgaggcatcagcttcagtctcgccaacagctgcgcagcagaagacacccaccgacaccgccagagccctccgggggtctacctcgaggccctcctgaacctcctgatcggctctcctgcgacggctcaagagtacacctcctttataagtag

SEQ ID NO: 10965 - DNA, 3090 bp, Artificial Sequence
  Description of Artificial Sequence: Synthetic coding sequence
atgccaccaacaaaatctgtgtctgagccagtaccattcgaaaccgaggcccctagtatgaccatcgtccccacaaccgacatcgaacctgtcacagtaagaacagaggccaccgtcactactctcgctccaaagacgtctcagcgaactagaacccggagaccaaggcccaaacacaaaaccaccccgcgaccagagaccttacagacaaagctggacttcggtcctattacgccgggaacctcctccgcacccacgactactactaagagaacccgccgacctcatcctaagcctaagacaacaccccatcctgaagttccccaaacaaagctggtgcccgctacaattctggaacccgtgctcaggaccgaggcctcgggcaccacagccgtcccagccacgatttttgagcctgtttcccccattaaggaggcacctgggaccaccttcgtccctgtcaccgatctggaacccgttacatttcgcacagaaatcccagcaacgacgctcgcaacaaagaccagcaaacggacgagacctccgaggccccgaccgaaaacaactcctagtccgcaggcacctgaaaccaagccagtccctgccaccgtgcttgaaccagtaaccctaagacccgaggcttctaccacattagcgagcaaaaccagccaacgaacccgcagacctcggctcagaactaagacgacgcccaggcctgaggccccagaaagtaaacccgtccctactgccgagttgaagccggtgacgctgaggacagaaacttgggttaccacccaggcaccaaaaaccagccagcggaccaggcgacctaggcctaagacgaaaaccactcccagccccgaagtgccccagacaaagctggtcccctcaaccgatctggagccaggaacactgcgtactgaggcacctaaaactatggtagtcaccacagtgctcgaaccagatacattccggactaagtttccggagactacccttgctcctaagacccagcggacgagacgccctaggccacgtcccaagacgacttctagccctgaggtgccgcaaaacaagagtgtgtcagtgactggttttgagccggtagtccactcaaccgatgcaccgggaactactttcgcactcacagagctgcagacactgatcttgaagccggtgacatccccatcactggagatgaccgagagtcagcccgtgagcgatgtgctggagtccgtcaccttgtccaccgaatcacctaaggagacaattgcaccagccaagacagattacgtttacccaactgcgaaggccccactgtggccggaggaaccaaaaacagaggtcgtcgaatctataacttacgtgtccgaacccccagagactaccttggagacctcgcctctgccatctcagtccatcacactgcctagccccgatgagccccagacagagcccgcaccgaaacagaccccacgtgctccccctaagccaaaaacttcacccagacctaggattccgcagacccagcctgtaccaaaagtgccccagcgcgttaccgcaaagcccaagacttcaccaagccccgaggtcagttacaccacgcctgcacctaaagacgtcctccttccccacaagccctatcctgaggtttcacagagtgaacctgccccactcgaaacccggggtatcccgtttatcccgatgatcagtccctctccaagccaggaggaacttcagaccacgttggaagaaaccgaccagagcacccaggaaccattcacaaccaaaatacctcgaactacagaactggctaagacgactcaggcaccacataggttttataccacagtgcgcccacgcacatcagacaagccacacatccgtccaggcgtgaagcaagcgccaagacccagcggcgctgatcggaacgtctcggtggacagtacccacccgacaaaaaaaccgggaaccagacgaccgccactccccccacggcctactcaccctcgtagaaagcccttacctcctaataacgttaccgggaaacctggatccgcagggatcataagctcaggcccaatcactacacccccactaagatctacccctaggcccactgggacaccccttgaacgaattgaaaccgacatcaagcaacctaccgtccctgcgtctggagaggagctggagaatattacggacttctctagttcccccacccgcgaaaccgaccctctcggaaaaccgaggtttaagggtccccacgtgcgctacattcagaaaccggataattctccctgttcgataacagactctgtaaagcggttcccaaaagaggaagcgactgaaggaaatgccacctctcctccacagaacccccctaccaacctcactgtcgttactgtcgagggctgtccatccttcgtgatcctggattgggagaaacccctgaatgacacagtgaccgaatatgaggtgatatccagagagaatggatccttttcgggcaaaaacaagtcgatccagatgaccaatcagacatttagcaccgtcgagaacttgaaaccaaatacatcttatgagttccaggtaaagcctaagaatcctcttggggaaggacccgtgtccaatacggtggcctttagcactgagtctgccgaccccagggtgtctgaacctgtgtccgcagggagagacgcaatatggaccgagagacccttcaactccgatagctatagtgaatgtaagggaaaacagtatgtaaaaaggacctggtataagaagtttgtgggcgtacaactatgtaactccctgagatacaagatctatctctcggactctctgacgggcaagttctacaacatcggcgatcagcgcggacatggagaagaccactgccagttcgtggatagtttcctggatgggaggactggtcagcaactcacctccgatcagctgccaattaaagagggctatttcagggctgtgcggcaagaacccgtccagttcggcgagatagggggtcacacccagattaactatgtgcagtggtatgaatgtggtactactatccccggaaaatggtag

SEQ ID NO: 10966 - DNA, 2355 bp, Artificial Sequence
  Description of Artificial Sequence: Synthetic coding sequence
atgacaatcgtgcctaccaccgatatcgaacccgtgacggtacgaaccgaggctacggtcactaccctggccccaaaaacctcccagagaacccgcactcgccgtccaaggcccaagcacaaaactactcccagacccgaaacactgcaaaccaaattggactttggacctatcaccccaggaacctcatctgcacctacaacgacaacaaaacgaactcgtagaccccatcctaaaccaaagaccaccccccaccctgaggtgccccagaccaaactggctcctaaagtgccacaaagaactcatagaccccacccaaaaccaaagaccaccctgtccccagaagagctgcagaccgagctggtccctgttacagacttagagcccgtcacctttagaacggagattcccgcaaccaccctggctacaaaaacatccaaacggactcgccctcctcgcccacgtcctaagaccaccccgtcacctcaggccccagagaccaaaccggtgcccgcaaccgtccttgagccagtgacactaaggcctgaggctagcactacactcgcttccaagacgtcacaaagaacacgccgtccccgattaaggactaaaacaacacccaggcctgaggcacctgagagtaaacctgccccaaagcagactcctcgagctccaccgaagcctaagactagtcctcgacctagaatccctcagacccaaccagtgcctaaggtgcctcagagggtcaccgcgaaacccaaaactagcccgtctccagaagtgtcgtacaccacacctgctccaaaggacgtcctcctccctcataaaccctatcccgaggtgagccagtccgagcccgctcctctcgagacgcgcggtattccatttatacccatgattagcccttctccctcccaggaagagctgcagacaactctagaggagacagaccagagtacccaagaaccctttactactaaaattccacgaaccacagaactcgctaaaaccacacaagccccacataggttctataccaccgtgcgtcctcgaacttcggacaagccacacattagacctgtgttaaaccggaccactactcgccctactaggcctaagccctccgggatgccctcgggcaatggagtggggacaggggtcaagcaagcgccacggcctagcggtgctgaccgtaatgtaagcgtggacagcacacatcccaccaaaaaaccagggaccagaagacctccactaccaccacgcccaacccaccctagaaggaagcctttaccccctaacaacgtcacaggcaaacctggcagtgctggtatcatctctagcggtcctattacaacccccccactgcgatctacccctcggcctactggcacccccctcgagaggattgaaacagatatcaagcagccaacagtgcctgcatcaggtgaagaacttgagaacatcaccgactttagctccagccctacaagggaaacagatcccctcggaaaacctcgattcaaaggccctcacgtgaggtatatccagaagcctgacaattccccatgcagtatcacagatagtgtgaaaaggttccccaaggaggaagctacagagggcaatgctacgagcccgcctcagaaccccccaacaaatttgaccgtggtgaccgtggaaggctgccccagttttgtaatactcgactgggaaaagccgttgaatgacacggttaccgagtacgaagtcatcagccgtgaaaacggaagcttttccggtaagaacaagtccatccagatgaccaatcagacattctcaaccgtagagaatctgaagccaaacactagttatgagtttcaagtcaaaccaaaaaaccctctgggtgaaggcccagtgagcaacaccgtggcattttctaccgagtccgccgatccgagggtaagcgagcctgtgtctgccggtagggatgctatttggaccgaacggccttttaatagcgacagctactccgaatgtaaaggcaagcaatatgtgaagcggacttggtacaagaaattcgtgggggttcagctctgcaacagcctaaggtacaaaatttatctgtccgacagcctcaccggaaagttttacaacattggggaccagcggggacatggtgaagaccattgccagttcgtcgattctttcctggatggtcgtacagggcagcagctaaccagtgaccagctccccatcaaggagggctacttcagggccgtgcggcaggagcctgtccagttcggcgagattggcggtcacactcagattaattacgtacagtggtatgagtgtggcacaacaatcccgggaaagtggtag

SEQ ID NO: 10967 - DNA, 1584 bp, Artificial Sequence
  Description of Artificial Sequence: Synthetic coding sequence
atgctgatgctgttcgtgtttggggtgctactgcacgaggtatctctatctggtcagaacgaggcccctccgaatacgcacagcatcccgggagagccattatataattacgcttcaattcgacttccggaggagcatatcccattctttctccataacaacaggcacatagcgactgtctgcagaaaagatagcctgtgcccgtacaaaaagcaccttgagaagctgaaatactgttgggggtacgagaaaagttgcaagcctgagttccgctttggatacccagtttgctcgtatgtagacatgggctggacagataccctggagtctgccgaggatattttttggaagcaggccgacttcggctatgccagagaaaggctggaagaaatgcacgttctgtgccagcccaaggaaacctctgattcatccttagtgtgcagccggtatcttcagtactgtagagctactaacctgtacctggatcttcgtaatatcaagagaaatcatgatcgattcaaagaagactttttccagagcggcgagattggaggtcactgtaaactagacattcggacgcttacgtcggaaggacaacgaaaatcaccattacagtcctggttcgcagagctccagtcctatacccagttaaatttccgtcctattgaggacgcaaaatgcgatattgtcatagagaagcccacgtacttcatgaagctcgatgccggtgttaacatgtatcatcacttctgtgacttcataaatctctatatcacccagcacgtgaataactccttctctaccgacgtatacatcgttatgtgggatacgtccagttacgggtacggagacttatttagcgacacctggaacgcctttacggactacgacgtgatccatctgaaaacctatgacagcaagagggtgtgcttcaaggaggcagtgttttcactcttgccaagaatgcggtacggtcttttctacaacaccccgctgatcagcggttgccagaatacaggcctctttcgagccttcgcccaacacgtgctccaccggcttaacatcacgcaggaagggccaaaggatggaaaaataagagtgactattttggcaaggtctaccgagtaccgcaagatcctcaaccagaacgaactagtgaacgcactgaagacagtgtcgacgttcgaggtgcagatagtggattataagtaccgggaattaggcttcctcgaccaacttcgtatcactcacaataccgacatttttatcggcatgcacggggctggcctgacacatctcttgttcctcccagattgggcagccgtgttcgaattatataattgcgaggatgaaaggtgttatcttgacctggcgaggctgcggggagtgcattacataacctggagacgccagaacaaggtgttcccacaggacaaggggcatcatccgaccctgggggaacacccaaagttcaccaactactcatttgacgttgaggagtttatgtatctggtgctccaggcagctgatcacgtcctgcaacaccctaaatggcccttcaaaaaaaaacacgacgagctttag

SEQ ID NO: 10968 - DNA, 2004 bp, Artificial Sequence
  Description of Artificial Sequence: Synthetic coding sequence
atgggatctagcagattagccgctctgctccttcctctactgctgattgtgatcgacctgagtgacagcgcagggattgggtttcgacacttgcctcactggaatacccggtgccccttggccagtcacaccgacgatagctttaccggcagttcagcatatatcccatgccgcacgtggtgggccctgttctccactaagccctggtgtgttcgcgtgtggcattgctccaggtgtctgtgtcaacatctgctctctggcggaagcggcctgcagcgcggtctgttccatctcttggtgcagaagagtaagaagtcttctaccttcaagttttatcggagacacaagatgccggcaccagctcagcgcaagctcctcccccgtaggcacttgagtgagaaaagtcaccatatcagtatcccctcgcccgatatctcccacaaggggctgaggagcaaaaggacccagccctcagatcccgagacttgggaatccttaccgagattagatagccagcgccacggcggtccagagttttcattcgacctgctcccagaagcccgagctataagggtgacaataagcagcggcccagaagttagcgtccgtttgtgtcaccagtgggcccttgagtgcgaagagctttctagcccttacgacgtacagaaaatagtgtccgggggtcacaccgtggagttgccctatgagttcctgctgccgtgtctgtgtattgaagctagctatctgcaagaggataccgtgcggagaaagaaatgcccgttccagagctggccagaagcttacggatctgatttttggaagagtgttcatttcaccgactattcgcagcatacgcagatggtgatggcacttaccctgcggtgcccgctcaagttggaagcagctctttgccagagacatgactggcataccttatgtaaagatctgccaaatgctacagcacgagaatctgatggctggtacgttttagagaaagtagacttacatccacaactttgcttcaaatttagttttggtaactcttctcatgtcgagtgcccgcatcaaactggttctctgacttcatggaatgtcagcatggacacgcaagctcagcagctgattttgcacttctcttccagaatgcatgccactttctcagccgcatggagcctgccaggtcttgggcaggacactctggtgcctccagtctacactgtgagtcaggcccgtggatccagccctgtgtccctggacttgatcatacccttccttaggcccggttgctgcgtcctcgtgtggcgatccgacgtccaatttgcatggaaacatttgctatgtcccgacgtgtcttatagacatctgggccttcttatacttgccctgctggctcttctcaccctgctcggcgtagtgctagccctcacctgtaggaggcctcagtctgggcctggacccgctaggcccgtgctgctcttacatgccgcagactctgaagcacagcgcagattggtgggcgcactggctgaactgctacgggctgctctggggggtgggcgagatgtgattgtggacctgtgggaaggaagacacgtcgcaagggtaggccctctaccctggttgtgggctgctagaacaagggttgccagggaacaaggcacagtgcttcttctgtggtccggtgctgacctgcgcccagtgtcagggccagatccgagagctgccccactgctcgccctgctccacgcagcaccacgtccactcctattgctcgcttacttttcgaggttgtgcgctaaaggtgatataccccctcctttacgggcactgcccagatatcgtcttctccgagacctccccaggcttttaagagccctggatgcacggccttttgcagaagcgacaagttggggtagactcggagcacggcaaagacgccaatccagactggaactctgttcccgcctggaacgcgaagcggcaagactggctgatttgggctag

SEQ ID NO: 10969 - DNA, 1101 bp, Artificial Sequence
  Description of Artificial Sequence: Synthetic coding sequence
atgcctatgattagtgtcctgggcaaaatgtttctctggcagagggagggacccggtggcagatggacttgtcagacaagccgacgagtgagttcagacccggcttgggctgttgagtggatagaacttccccgtggtctgagtctctccagtctgggctctgcacgcaccctgagaggatggtcaagatcttctcgcccatccagtgtcgattctcaggacctgcccgaagttaacgtgggagatacagtggccatgctgccaaaatctaggcgtgctttaactatccaagaaatcgctgcattagccaggtcatcgctgcacggaatatcgcaggtggtcaaggaccatgtcacaaaacccacagccatggcccagggccgagttgctcacctgatcgaatggaagggatggtctaaaccatctgacagtccagccgcactagaaagtgccttctcttcctacagtgatctttccgaaggcgagcaggaagcgagatttgcagcgggagtggcagagcaattcgcaattgctgaggctaagttgcgggcttggagttcagttgacggtgaagactcaaccgacgattcttacgacgaggattttgctggaggtatggatactgacatggccggtcaactgccgctcgggcctcacttacaggatctatttaccgggcatcggttttcacgacctgtgagacaaggatctgtggagcccgagtcagactgtagtcagaccgtatcacccgacactttgtgctcctctctgtgctcacttgaagatgggctgcttggttcccctgcaagacttgcctcacagctactgggagacgagctgctgttagccaaactgccacccagtcgagagagtgcctttaggagtctagggcctctggaggcacaagacagcctctataattcccccctgacagaaagctgccttagccccgctgaagaggagcccgcaccttgcaaggactgtcagcccttgtgtccgccactaacaggctcatgggagcgtcagaggcaggcctcagatctggcgtcctcaggagtagtctcgttagacgaggatgaggccgagcccgaagagcagtag

SEQ ID NO: 10970 - DNA, 5171 bp, Artificial Sequence
  Description of Artificial Sequence: Synthetic coding sequence
atgcagttccagctgaccctgttcctccacctcggctggctgtcatacagtaaagcacaggacgactgtaaccggggtgcatgccaccccacaacgggcgacttgctggtgggtaggaacacacaactgatggcatcttccacttgtggtctgtcccgggcacaaaaatattgcatacttagttacttagagggggagcagaaatgttttatctgtgatagtcgcttcccgtacgatccttacgaccagccgaactcccacactattgaaaacgttatcgttagttttgagcccgatagagagaaaaagtggtggcagtctgaaaacggtttggatcatgtgtcaattcggctcgacctcgaagcactgttccgtttctctcacctaatcctgacgttcaaaacattcagacctgcagctatgctggtggagcgttcaacggattatggacacaattggaaagtttttaagtatttcgctaaggactgtgcaacatctttcccaaatatcacttccgggcaggcgcaaggcgtgggcgacattgtctgcgactcaaagtattccgacatcgagcctagcaccggcggtgaagtggtgctcaaggtcctcgatccaagctttgaaattgagaacccatacagcccttatatccaggatttggtgacgttgactaacctgcgcattaacttcaccaagctgcacactctgggcgacgccctccttggtagacgacagaacgactccctggataaatactattacgcactgtacgaaatgatagttagagggagctgcttttgtaatggtcacgctagtgagtgccggccaatgcagaaaatgcgcggagatgtgttttccccacccggtatggtgcatgggcaatgtgtgtgccagcataataccgatggcccaaattgcgaacgttgcaaagacttctttcaggacgcaccttggaggcctgccgctgaccttcaagataatgcttgccggagctgttcctgcaatagccactcctcaaggtgtcacttcgacatgactacttacctggcctcggggggactgagcggtggagtgtgcgaggactgtcagcataatacagaaggccagcattgtgatcggtgcaggccgctcttttaccgcgatcctctgaaaaccatctctgatccctatgcctgtatcccttgcgaatgcgatccagacggcaccatctccggaggcatctgcgtcagtcattcggacccagccctcggcagtgtcgccggtcagtgtctctgcaaggagaatgttgagggcgcaaaatgtgaccagtgtaaacccaatcactatggcctcagcgccacagaccctcttgggtgccagccttgcgactgcaacccactgggatccctgccttttcttacttgcgacgttgataccggccagtgcctctgcctctcttacgttaccggcgcacattgtgaagaatgtaccgtagggtactggggactggggaaccatcttcatggctgttcgccctgtgactgcgatatcggtggggcatatagcaatgtttgtagccctaagaacggccagtgtgagtgccgcccacacgtgaccggccgatcttgttcagagcccgcaccagggtactttttcgctccactcaatttctatctttacgaggctgaagaggcgactactttacaagggctggccccactcggctccgagacctttggacagtcacccgcagtacatgtggttctgggggaaccagtgcccggaaatcccgttacctggacagggccaggtttcgcgagggtcctccctggggctggcctccggttcgctgtgaacaatatacctttccctgtggatttcaccatcgcgattcattatgagacgcagtctgccgctgactggacagtccaaatcgtggtcaacccccctgggggatctgaacattgcattcctaaaaccctccaatctaagcctcagtccttcgcattgccagcagccacccgcatcatgctgttacccacccctatttgcttggaaccggacgtgcagtacagcatcgacgtgtacttctctcagcctctgcagggagagagtcacgcccactcacacgtgttggtggactcattaggcctcatcccgcagattaacagcttggagaatttctgttcaaaacaggatcttgatgagtatcaactgcacaattgcgtggagatcgcctcagccatggggccacaagtcctgccaggcgcttgtgagagactgattatcagtatgtctgccaaactgcatgatggggcagtggcatgtaagtgccatccccaaggtagtgttggttcaagttgtagccggttagggggtcaatgccagtgcaaaccactagtagtgggaaggtgctgtgatagatgctcgaccggttcatacgacctgggccatcatggatgccacccttgccactgtcatccgcagggaagtaaggacactgtgtgtgaccaggtaacaggccagtgtccgtgccacggtgaggtgtcaggaagacgttgtgaccgatgcttggcagggtactttggcttcccttcatgccacccgtgtccctgtaacagattcgcagagttgtgcgacccagagacagggtcctgttttaattgcggcggatttactacagggagaaactgtgagcgttgcattgacggttactatggcaacccatctagcggacagccttgtcgaccttgcctgtgtccagatgatccgtcatccaatcaatacttcgcccattcatgttaccagaacctatggtcttcagatgtaatctgcaactgcctgcaaggatataccggtacgcagtgtggggagtgttcgaccggtttctatgggaatccaaggatatccggagcaccctgccagccatgcgcctgcaacaacaacatcgacgttaccgatccagaatcttgcagcagagtgacaggcgagtgcctgcgctgcctacacaacacccagggcgctaactgccaactgtgcaaacccggtcactatgggtcagctcttaaccagacctgtcgacggtgctcgtgccatgcttcaggtgtgtccccgatggaatgtccccctggcggtggcgcttgtctgtgcgatcccgttactggggcttgtccttgtctccctaacgtgacagggctcgcttgcgacagatgcgccgacgggtactggaacctggtccctgggaggggttgccagagctgtgactgtgatccacgaacaagtcaaagtagtcattgcgatcagctaaccggccaatgcccatgcaaactgggctatggcggaaagagatgcagcgagtgccaagagaattactacggtgacccacctgggaggtgcataccatgcgactgcaatagagcagggactcagaaacccatctgtgatcccgacaccggcatgtgtcgctgcagggagggggtgtctggccagcggtgcgacagatgcgccaggggacacagtcaggaattccccacttgcttacagtgccatctctgcttcgatcagtgggaccacaccatctcttccctcagtaaggccgtccaggggcttatgagactcgctgctaatatggaggataagcgggagaccctcccggtctgcgaggccgatttcaaagatctgcggggaaacgtttcagagatcgagcggatactcaaacatcccgtctttccttccggcaagtttctcaaggtgaaagactaccatgatagcgtccgccgtcagatcatgcaacttaatgaacagctaaaggctgtgtatgagttccaggaccttaaggacactattgagcgagcaaaaaatgaggctgatctgcttctcgaagacttacaggaggagatcgacctgcagagtagtgtgctgaatgcctccattgctgatagcagtgagaacatcaagaaatattaccatatatcctcatcagctgaaaagaagataaatgagacctcttctacaattaacaccagtgccaacacgcggaatgatcttctgacgattttagatacactcacaagcaaaggcaatctcagcttagaaagattaaaacaaatcaagatccccgacattcagattttgaatgagaaggtttgtggcgatcctggtaatgtgccttgtgtgcctctaccctgcgggggagcactgtgtaccggtagaaaaggtcatagaaaatgtcggggtccaggatgtcacgggagtctgaccctgtctacgaacgccctgcagaaggcccaggaggcaaagtctatcattcgcaatctagataagcaggtgcggggtctgaaaaaccagatagaatctattagtgaacaagccgaagttagtaaaaacaatgccctccagctgcgcgagaagctcggcaatattcggaatcaaagcgatagtgaggaggaaaatatcaatttgttcatcaaaaaggtcaagaactttcttctagaggagaatgtccccccagaagacatagagaaggtggctaacggcgtgttggacattcatctgcccatcccctcccagaatcttacagatgaactggtgaaaatccagaaacacatgcaactgtgcgaggattatagaacagatgagaaccggctcaacgaggaagccgatggcgcacagaagctcctcgtgaaggcgaaagctgctgaaaaggccgcaaacatcctgctgaatctggacaaaactctgaaccagctgcaacaggcgcagattactcagggcagggctaatagcacaataactcagctgactgcaaatatcacaaagatcaaaaagaacgtcctgcaagcagagaatcaaactagggaaatgaagtcagagttagagctcgcgaaacaacgctctgggcttgaggatggtcttagtctgctgcagactaaactgcaaagacatcaggatcacgcagtgaacgctaaagtgcaagccgaatctgcccagcatcaagcgggaagcctggagaaggaatttgttgaactgaagaagcaatatgccatccttcagcgaaagaccagcaccacgggcttgaccaaagaaaccttgggtaaggtgaagcagcttaaggacgctgccgagaaactggcaggcgacaccgaggccaagattaggaggatcacaggatgcttccagaattcagctcgata

SEQ ID NO: 10971 - DNA, 5285 bp, Artificial Sequence
  Description of Artificial Sequence: Synthetic coding sequence
atgcaatttcagctcaccctgttcttgcaccttggctggcttagttattcgaaagcccaggatgattgtaatcggggagcctgccatccaacaactggcgaccttttagtaggtcgcaatacccagctgatggcctctagcacgtgtgggctttctagagctcagaagtactgcattctttcctatctggaaggggaacagaaatgcttcatttgtgatagtcggtttccctacgacccctacgaccagccgaattcgcacaccatagaaaacgtgatcgtgagcttcgagccggacagagaaaagaagtggtggcagtcagagaatggtctagaccacgtcagcattcgcctggacctagaggctctctttagattttcacacctgatacttacattcaaaacttttcgtcccgctgccatgctcgtggagcgaagtactgattatgggcataactggaaggtttttaaatacttcgccaaggattgtgctacctccttccctaacattacaagtggccaggcccagggggtgggcgatatcgtttgtgatagtaaatattcagatatcgaaccttccacagggggagaagtggtgctcaaagtacttgacccatcttttgaaatcgagaacccatacagtccttatattcaggatctagtcacactgaccaacctgagaataaactttaccaagcttcatacccttggggacgcactcctgggcagaagacagaacgattccctggataagtactattacgcgttgtatgagatgatagttcgaggtagttgtttctgtaacggccacgcctcggaatgcagacccatgcagaaaatgcgcggagacgtgtttagccctcccggtatggtccacggtcaatgcgtgtgtcaacataatactgacggacctaattgcgaacgttgtaaggattttttccaggacgctccatggagacccgctgccgatctacaggacaacgcatgtagaagttgcagttgcaatagtcatagcagccggtgtcacttcgatatgacaacatacctggcaagtggaggccttagcggaggggtatgtgaggactgtcagcataacaccgaaggtcagcactgtgatcggtgcagacctctgttttaccgcgacccacttaaaacgataagcgacccatatgcgtgtattccatgcgaatgcgaccctgacggaactatatcggggggtatttgtgtgagccattccgatcctgcgttgggatctgtggcgggtcagtgtctctgtaaggagaacgtcgaaggggcaaagtgcgatcagtgcaaacccaaccactacggattatcggctacagacccactgggttgccagccttgcgattgtaatccattgggatcattaccttttctgacgtgcgatgtagacaccggacagtgcttatgcctgtcatacgttaccggcgcacactgtgaggaatgtaccgttggatattgggggctgggtaatcaccttcacggatgcagtccatgcgactgcgacatcggcggagcctatagcaatgtttgctctcccaaaaatggccagtgcgaatgcaggccacatgtgacagggaggtcgtgtagtgagccagcccctggatacttttttgcgccactcaatttctacttgtacgaggcagaggaggcaactaccttacaggggctggccccattgggctctgaaacatttgggcagtctcctgcagtgcacgtggtgctgggagagcccgtgcccggaaacccagtgacctggacaggaccaggattcgctcgcgtgcttcctggtgcaggcctccggtttgccgtgaataacatcccgtttccagtcgatttcacaatcgccatccactatgagacacagtctgcagcggattggacagtccagatagtggtgaatccaccagggggttctgaacactgcattcctaagacattacaatctaagcctcagtcattcgcactgcctgctgccactcgaatcatgttgttgccaacccccatttgtctcgaaccagacgtgcagtactctatcgatgtctacttctcacaacccttacagggtgaatcccacgcccactcccatgttttagttgattctttaggactgattcctcagatcaatagcctcgaaaacttctgctccaagcaggacctggatgagtaccaactccacaattgcgttgaaattgccagcgccatgggccctcaggtactgcccggtgcttgtgaacggctgataatctctatgtccgcgaaacttcacgatggggctgtggcttgcaaatgccatccccagggatctgtggggtcatcttgctcccgtctcggaggacagtgtcagtgcaagcccctggtcgtggggaggtgctgcgatcgctgttccaccggctcctatgatctcggacaccatggttgtcatccctgtcattgtcacccgcagggaagcaaggacacggtctgtgaccaggtcacgggacagtgtccttgccatggagaggtgagtggtcgtcgctgcgacagatgccttgccggatactttggcttcccaagctgccacccttgtccttgcaataggtttgcagagctgtgtgatcccgagaccggttcctgtttcaattgtggcggattcaccacgggccgaaactgtgagcggtgtatcgacgggtattacgggaatcccagcagcggccagccatgtcgcccttgcctgtgtcccgatgacccctcttccaatcaatactttgctcactcttgctaccagaatctctggtccagtgacgtgatttgcaattgcctgcagggatacaccggaactcagtgcggtgaatgttctactgggttctacggaaacccacgaatctccggagcaccgtgccaaccctgcgcttgcaacaataatatcgacgtgaccgacccagaaagctgttcccgcgtcaccggtgaatgcctgaggtgtctgcacaatacacagggagccaactgtcaattatgcaagcctggtcactatggcagcgctttgaaccagacctgtagaagatgttcttgtcacgcctcaggcgttagtcctatggaatgcccccctgggggtggcgcatgcctgtgtgacccggttactggagcgtgcccctgcttgcccaatgtaactgggctggcttgtgaccgatgcgccgacggctattggaatcttgtgccagggagaggctgtcagtcctgtgactgtgaccccaggaccagccagagtagccactgcgatcagctcaccggacagtgtccgtgcaagctcgggtacggcggtaaaaggtgcagcgaatgccaggagaattattacggagatccccctgggcgatgcattccttgtgattgcaatcgggctggcactcagaagccaatttgtgatcccgacactgggatgtgcagatgtcgggagggtgtgagtggtcagaggtgcgaccggtgtgccagggggcacagtcaggagttccctacatgccttcagtgtcacctttgctttgaccagtgggatcacaccatttctagcctcagcaaggcagtgcaaggtctgatgcgcttggccgcaaacatggaggacaaacgagagacactgcctgtttgcgaggccgattttaaagacttgagggggaacgtatctgaaattgagaggatccttaagcaccctgtgttcccttcggggaagtttcttaaggtgaaggactaccacgattctgtgaggcgacagatcatgcagttgaatgaacagttaaaggcagtgtacgaattccaggacctcaaggatacaattgagcgtgccaagaacgaagccgaccttctccttgaggatctgcaagaggagatcgaccttcagtcttccgtactcaatgcctcaatagctgactcctccgagaacatcaaaaaatactatcacatttcatcctcggccgagaaaaagatcaatgaaacatcttcgaccattaatacctcggcgaacacccgaaacgatctgttaactatactcgacaccctgaccagcaagggaaacctgagccttgaacgactgaagcagatcaagatccctgacatacagatacttaacgagaaagtgtgtggcgacccagggaacgtgccctgtgtgccactgccctgcggcggtgccctctgcacaggccgtaagggccatcggaaatgcaggggaccagggtgccacggtagcctgaccctatccaccaatgccctgcaaaaagctcaggaggctaagagcatcatccgaaatcttgacaagcaagtgaggggactcaaaaatcaaatcgaatccatatctgagcaagctgaggtgtcaaaaaacaatgccctgcaacttcgcgagaagctcgggaacattcgtaaccagtcagactccgaggaagagaatattaacctttttattaagaaggtgaaaaacttcctgctggaggaaaatgtgccgccagaggacatcgaaaaggtggctaacggcgtgctggacatccacctgcctattcccagtcagaacctgacggatgagctggtgaagatacagaaacatatgcaactgtgtgaagattatagaactgacgagaatcgccttaacgaagaagcagatggcgctcagaagcttttggtcaaggcaaaggctgccgaaaaggccgctaatattctcctcaacttggataagacattgaaccaactgcagcaggcccagattacccagggacgggctaattccacaatcacccagctcaccgctaatatcacgaagatcaagaagaatgtcctccaggccgaaaaccagacacgtgaaatgaagtccgagcttgagctcgcgaaacagcgtagcggcctggaagacggactgtcgctgctgcagacgaagttgcaaaggcaccaggaccacgctgtcaacgctaaggtacaggcagagagtgctcagcaccaggcaggctcacttgagaaggaattcgttgaactgaaaaaacagtatgctatcctgcagcggaagacatccacaaccgggctgacaaaagagaccctgggaaaggtgaagcagctcaaagacgctgccgagaaattggcgggagataccgaagcgaagatacgcagaattaccgacctggagcgcaagatccaggacctcaatctctcccgccaggcgaaggcggaccagctacgcatcctcgaagaccaagtggtcgccataaaaaatgaaatcgttgaacaggagaaaaagtatgccagatgctactcgta

SEQ ID NO: 10972 - DNA, 1455 bp, Artificial Sequence
  Description of Artificial Sequence: Synthetic coding sequence
atgggggctgaagcactcccaggacctgacgaagccgcagcagccgctgcgtttgccgaagtcactaccgtgactgtggcaaacgtcggtgcagccgcagataacgtcttcactacctccgtagctaatgccgcatctattagtgggcatgttctctcagggaggactgctctgcagattggtgatagcttgaatactgagaaagccacactgattgttgtacacactgatggttctattgttgaaacgaccggtctcaagggccctgcagctccgctcactcctggcccacagagcccgcctactcccctggcgcctggtcaggaaaagggagggaccaaatacaactgggatccctctgtatacgactccgagctgcccgtccggtgcagaaacatcagcggcacgctttataagaacagactcggtagcggtgggagggggcgatgtattaagcagggcgaaaattggtacagcccaacagaatttgaggcgatggctggacgggcttccagcaaagattggaaaagaagtatccgctatgccggacgcccactgcagtgtcttattcaggatggcatactcaacccacatgctgccagctgcacttgtgcagcatgttgtgatgacatgactctaagcggcccagtgcgacttttcgtgccgtacaagcgccgtaaaaaagaaaatgagctgcccactacaccagtgaaaaaggactcccccaaaaacatcactctactccccgctaccgccgcaaccacattcaccgttacgccctctggccaaataaccacatcaggagcactgacctttgaccgtgctagtacggtggaagcgacagcagtcatctcagaatcaccggctcagggggacgtcttcgccggagcaaccgtgcaggaggcgtctgttcaacctccatgccgggcttcacaccctgagccgcactacccaggatatcaggacagctgccaaattgctccctttcccgaagcggcactgcctaccagccatccgaagattgttctcaccagtttgccggctttggcagtgccaccgccaacccctacgaaggccgctccacccgctttagtgaatggactcgaactcagtgagccccgttcctggctttacttggaggaaatggttaactcccttctaaataccgctcagcagctcaaaaccctgttcgaacaagccaagcacgcctccacgtaccgcgaggccgcaacaaatcaggccaagatccacgccgacgctgagcggaaggaacagtcttgtgttaactgtggccgagaagccatgtctgaatgcactggttgccacaaagttaattactgtagtactttctgccaaagaaaaaggtggtctctcactatgctgacgtcactggtgtctatctcatggctgcgggctatcctgccatgccagcctccaaaagtcctgggactatag

SEQ ID NO: 10973 - DNA, 1512 bp, Artificial Sequence
  Description of Artificial Sequence: Synthetic coding sequence
atgtctggagcgttactttggcccttacttccgctacttctactcctgctgtccgcgagggatggagtgagagccgcacagccgcaggctccaggctacctcatcgcggctccaagtgtattccgcgcaggagttgaggaagtcattagtgtgaccatatttaatagtccccgtgaggtcaccgtgcaggcgcagttagtggctcagggtgaacctgtggtgcaatctcagggggctatcttggacaagggaacgatcaagctgaaagtacccactggtctccgtgggcaagcactcctgaaggtatggggtagaggttggcaggccgaagaagggcctctgtttcacaatcagacctcggtgactgtggatggtcgcggagcctctgtgtttatccagacagacaaaccagtatacagaccccagcacagagttttgatctccattttcaccgtaagccccaacctgcgccctgtgaatgagaagctcgaggcctatattctggatcctcgaggttcccgcatgatcgagtggaggcacctcaaacctttctgctgcggtattacaaacatgtccttcccactttccgaccagcccgtcctaggggagtggtttatcttcgtagaaatgcaggggcacgcctacaataagagctttgaagtgcaaaaatatgtgctccctaaattcgaactgctaatcgacccccctcgctatattcaggatctggacgcgtgtgagactggtaccgtccgcgctaggtataccttcgggaagccagtggccggtgccctcatgattaacatgactgtcaacggagtgggctactacagccatgaggtgggccgaccagtgctgagaactacgaaaatcctcggctccagggattttgacatctgcgtgcgggatatgatcccggcagatgtgcctgagcattttcggggtagagtttcaatatgggcgatggtcacttcagtggacggctctcagcaggtggccttcgacgacagcacccctgttcagcgacagcttgtggatataaggtactctaaagatacacgaaaacagtttaagccaggcctggcttatgttgggaaagtagaattgagctacccagatggttctcctgcagagggggtcaccgtgcaaataaaggccgaactaacccctaaggataatatctacacatcagaggtggtctcccagagagggcttgtgggcttcgagattccctctatccctacttccgcccaacatgtgtggctggaggtgttccaggaactcgaggactatgacgtcagtgattcgtttggtgtgagtcgggaagatggcccattctggtgggccggattaaccgcccagcgacggagacgcagtagtgtctttccatggccatgggggatcaccaaggacagtggattcgctttcaccgtgcgtcgtggaaacgggacaggtggggacgatcgaccaagcgaacctgagcctccagctggtaggtggcctttacaccgatag

SEQ ID NO: 10974 - DNA, 144 bp, Artificial Sequence
  Description of Artificial Sequence: Synthetic coding sequence
atgaaactgtgtgtaactgtcctctccctgctagtgttagtggccgcattctgctccctagctctgtccgccccaaaagccagtaagagtgccctgacccctgtttcccctggatcccgaagcacgtgcatgacttggaattag

SEQ ID NO: 10975 - DNA, 861 bp, Artificial Sequence
  Description of Artificial Sequence: Synthetic coding sequence
atggaggtgtatatcaggcacttggaaaaagtgctgagaaggtacgtgcaacgtctgcaatggctgctaagcggacctgttctctgctctcgaacttggtatcgacagtccatggacagaggcgtgatgatgactgccgcttcaggctcaagacggctttttggcactgttctcgaaagcaaagtttgcatattgctcgacacatcaggctcaatgggcccatatctgcagcaggtgaagacagaactggtcctcctcatttgggaacagctgcgtaaatgttgtgattcattcaacctactaagtttcgcggaaagtttccagtcatggcaagataccctagttgaaactacagatgcagcttgtcacgaggctatgcagtgggtgacccatctgcaggcacaggggtccacgtccatcttacaggcattattaaaggcattttcttttcacgacctggagggcttgtaccttctaactgatgggaaacctgataccagctgtagcctggttctgaatgaggtgcagaagttacgcgaaaagagagacgtcaaagtgcacacaatctccttgaactgttctgatagagcagcagtggagtttctacggaagctggccagcttcactggtggcaggtaccactgtccggtcggggaagacactttatctaaaatacatagcctcctgaccaaagggttcataaatgagaaggaccccacactgcctccttttgagggagacgatctgcgcattttggcccaagagataacaaaagctagatccttcctgtggcaggcccagtcttttcgcagtcagctgcagaagaaaaacgatgctgagcctaaggtcacactgtcatag

SEQ ID NO: 10976 - DNA, 3555 bp, Artificial Sequence
  Description of Artificial Sequence: Synthetic coding sequence
atgaaaaaatatcggaagatatcaattggctgctttgccatggccacccagacaagtcatgtgtttcatggccaggagaacatgtttctcgagaatcactgtattcggaggaacactggcagagacagtaaaaagccactgaagcagaagaatatgaatggattgggtcagaattccgataatggcctgctcgtgacacacgtcaaccagacacaggacctcctccggcttcagggctccgagacccaatcatccgactgggaggatagtgaggactggctttctgcccactccctcaagtgtcagaaacttactctggcagacctcatctctcaaggaaccgaggtgctggaggagggaaccaatgtggtgcaaaagatctgcttctcaacacagatcatacggcactttgaatccaagttgtcagacacaatcgaagtgtaccaggagcgcatacaatggttgactgaaaactctaaaaaggcattcgggcttattaagggagcgagagtctcaatcctgatagatgtgtcagccatctcctcaggaccacagaaggaggaatttcagaaggaccttatgagccttatagacgaacagttgagccacaaagaaaaactgttcgtgctgagctttggaacaaacgctggcagcctgtggcccgaccctatggaggtatccgcttcaaccctacaggagctgaaactttgggtgaaaacgctacagcccgatggaggatcaaacctgttgcaggcccttaagaagatttttaccctaaaggggctcgacagccttgtggcgattatgaggtcctgccctgaccagcctagcgagatcctgtctgattacatccagcagagtacgatgggtcgggacctgatcatccacttcattacttatagatgcgacgaccagatgccccctgctgtgttgaaaaacttggcggaggccgtgagaggctactaccattgctattctccaaagatggaacattacacctctcgcgatatggatgaacttctggccgagattcagaaagcacagtccctgctatcccacgtccaggctttacaacactcatctccgtgtgaggccctgacatgtacaatggaggaaattagcacagagatcactaacggtcctctcatcagcctgcttccgaaacccccaaagcatgacgcccctctgactatcgagttcccgaacctggacaaaacatccgccgaatggctgaaagtcaatggcttgaaggctaagaaactgtcgctgtaccaggtactggcccctaatgcgtttagccctgtggaagaattcgtgcccattttgcaaaaaaccgtgtcatcaaccattcacgaaaaggccatgatccagttcgaatggcatgacggaactgtgaagaacatccacgtggatccgccattcctgtataagtaccaacaacaactgtcacgggcaatgcgcatgtatgagaggcgcattgagtggctgagcttggcttcacggcgtatttggggcacagtctgtgagaagcgggtggtggttctccttgacatttcagctaccaattctatgtacatcatccatatccagcattcactgaggctgctcctggaggagcagttgtctaacaaggactgctttaatttgatcgcctttggcagcaccatcgaatcatggcggcctgagatggtcccggtgtcacacaataatctgcagtcagcatggcgctgggctctgaacttgcggtgcagagggtcgcgtaatgtgctgtcggcgctacggaaggctgtggaggtggatttcaaggataaggacaaacatcagtcccaaggaatttatcttttcacaggcggaatccctgaccaagacatgccaactttgtcagcttacatggcggaggcctgtggcggatgcgacctacagctcaacgtgtgccttttttacgtcggtgagcctaaaatggacactacaccgccagccaggtatgcctctcatacagatacagctgctgcttataaggaggtgacaagagccgcaggtggtcggtttcactggtttggagatactggaatctatgaatcggatgacattaacagcatcatgagtgaaatggagaaggccttgaactactctcagaaatgcgctttcctgatggcttcccttaagaatcacagcgggaaggtgctgggaagctccgccctacctaaagaaaaacctaagacactgcagctgagatcccagccaaagaagctgtgtccccctcggcctacagttccgctgggtgctagaatgtcaatcaaggacgaccccgaccgggaaaaaagcccacccttgaagtcactgaagtggcgcccattatcctctagggtcgggatctctcccgctgccgcacaaccaaccaaggaaggtatgatggagcttaggcgcaaaacaaaaagcagagaagcagagacgtctcttttgctgttttataccgagaaaggtaatgatgtgggatccgtgtacaaaaaatatcctcagggaagggggctacggagaacctcaagctctatagatttgcctcgcaaggatactgtgtgctcctcccaggaatgggtggccaagtatgggctgaaaaaacttaagcttgagatatcccgatgtatggggccaaattgcactcatcagaagagcggtcagcgctctgcctccgcaaaacactgttcgattttcccttccgtggagatacacggggtggtgagacacattcaatggaccccgcgagaaatggaagtctacattcgtcacttagaaaaggtgcttcggaggtatgttcagagactccagtggctgctgtctggcagccgccgactctttggaacagtgctggagtcaaaagtgtgcatcctcctggacaccagcggcagcatggggccatacctgcagcaggtaaagaccgagttagtgctcctcatctgggagcagctgcgcaaatgctgtgactccttcaaccttctgagctttgccgaatcattccaaagctggcaggacactctcgtcgagactaccgacgccgcatgccacgaagccatgcagtgggtgacccacttacaggcacaaggtagcacttcaatcttgcaggccctgttaaaggcattttcctttcacgacttagagggtctgtatctgctcacagatggtaagccggacactagttgtagccttgttcttaatgaagtccagaagttgagagaaaaaagagacgtcaaggtccacacaatctctcttaactgttctgaccgagccgcagtagagtttctgcggaagctcgcatctttcacagggggacggtaccactgtcctgtgggagaagacacgctctccaagatccatagtctgctgacgaaggggtttattaatgaaaaggatcccactttgcctcctttcgaaggagacgatttgaggattttggctcaggagattactaaagccaggagtttcttatggcaagcgcaaagcttccggagtcagctccagaagaagaatgacgctgagccaaaggttaccctaagctag

SEQ ID NO: 10977 - DNA, 906 bp, Artificial Sequence
  Description of Artificial Sequence: Synthetic coding sequence
atgcttccactgaccatgaccgtgttgattcttctccttttacctaccggccaggcagctccaaaggacggggtcactcgcccagactccgaggttcaacatcagctgttaccaaaccctttccagccaggacaggagcagttagggctcctgcagagctacttgaagggattaggcaggaccgaagtacagctagaacacttgtctagggaacaggttctgctgtacctgttcgccctccatgattacgatcaaagcggacaattagacgggctcgagcttctgtctatgctgaccgcagccctcgccccaggcgctgccaactcaccaactaccaaccccgtgatactgattgtggacaaggtgcttgagacacaggatcttaacggcgacgggctcatgacacccgctgagctgatcaatttcccaggtgtggcactgcggcatgtggaaccgggagagcccctggccccatcgccccaggaaccacaagcggtagggagacagagtctgttggccaaaagcccattgcggcaggagacacaggaagccccaggtccaagggaagaggccaaagggcaagtggaggccaggcgcgagtcactcgatcctgttcaagaacccggaggtcaggccgaggcagacggtgacgtgcctggtccaagaggcgaggcagaaggccaagctgaagcaaaaggcgacgcccctggcccaaggggggaagctggcggacaggccgaagctgaaggggacgctcccggacccaggggggaagccggaggacaggcagaggctagagaaaacggagaggaggctaaggaactgcccggtgaaaccctagagagtaaaaatacacagaacgacttcgaggtccacatcgttcaagtcgagaatgatgaaatctag

SEQ ID NO: 10978 - DNA, 4722 bp, Artificial Sequence
  Description of Artificial Sequence: Synthetic coding sequence
atgcgggttctagcctgtctgctcgcagcgctagtgggcattcaggccgtggagcggctgcgactagccgacggccctcacgggtgcgccggaagacttgaggtgtggcatggtgggaggtggggaacagtctgcgacgatggctgggatttacgcgacgcagctgttgcctgtagacaactgggctgcgggggtgccctggctgcgcctggaggggctttttttggagagggagccggacccgtctggcttagcgagctggcttgccgtggtaatgaaggacaattgggcctgtgtcaccaccggggttggaaagcacacatttgttcccatgaggaggatgcaggggtggtgtgcgctggccagcgcgtggccaattcgcgtgatgactcaacatcgccgctggatggtgcaccatggccaggccttctgctcgagctgtctcccagcacagaagagccactggtgacacatgctccacgccctgccggaaatccacaaaacgcgtcgagaaaaaaaagtcctaggcccaagcaggcaaagagtactcgtgcccctctgttaactaccggggctccacgccaggagcgcttgcgattggtgagtggaccccatcgctgcgcgggacgcctggaggtatggcacggaggccgatggggaacggtgtgcgatgatggctgggacctgcgggatgccgctgtcgcatgtagagagctaggctgcggcggagcgctggctgcgccaggtggagcaagattcgggcctggagccggaccagtttggatggacgatgtcggctgcggcggtggagagcaggccctgcgggactgcccaagatctccttggggtaggagtaactgcgaccatagtgaggacgctggactggtgtgcaccggtcccgctcccaggctgaggctagccgacggtccccacggctgcgccggacggctggaggtgtggcatggagggaggtgggggagcgtctgtgacgacgcatgggatttgcgggatgcagccgtggcgtgcagggaactgggatgtgggggagctttggccgcaccaggcggtgcatttttcggcgaaggttctggtcctatcatcctcgacgacctaagatgcagggggaacgagacggccctacgattctgcccggcacggccatggggccagcacgattgccatcatcgtgaagacgcaggcgcagtgtgtgatggcatgccactaggatatgttcctccgactgctcccactgatagcaataattccaccccaagagaggctgcctcccggccaccatctactatgacctctcaggccccaggcactgccggagtttcccccccaccggcatcaccaacagtgctgtgggaacccggacctgaagcaggctcccctcagcttcggcttgtcgccggaccctccaaatgcagcgggagattggaggtttggcacgatcagcgatggggtacagtctgcgatgatagctgggacatgcgcgactcagccgtagtctgtagggagctcggttgtggcggtcctcagcagcctgaccccgcagcagggaggttcggctggggtgcaggcccaatctggctagatgacgtgggttgcgttgggaccgaagcctcactgagcgattgtcctgccgctccatgggggaaacataactgtgctcacaatgaggacgttggggttacgtgcaccgggcctcccggtctcgatagtataagtgatcctttcagctggtcttggatacccggtctgggacgcgaccgcgacgcgtggctgcctggggagcttgcaacaaaaccaagtgcgtctgtcaccgcttctgtactggagaagactactactaaggctccaggcaagatgcccaagtccaccaaaaaatgggtgaccaaaaacgccaagagacctactactcaacctcctgtgatgccaaccactaagcactctagagcccagagtcctcccgacctcacatctcaaacaaccgctgccctgactaccgaggccagccggaggcccacatcagaattcacccgccgtcctaccacagaggctcctcagaggtggacgtcacatacaacagccacattgaccccccaggctccccgagaaagaactaccaaaactatggcgatgttaacaacacagggccctcaggaaatgacaagcgagtctactattaagtcaatacctcaggcctctctggagccttccgcggagattccagagggctctcccgaatctcccaaggatcctgccccatccccaagtgtcagcaccacaggggagtccggcctgttccgagtgcgcctggcagacggacctaataggtgtgcgggaagattggaagtttggcatgccggaaggtggggcaccgtctgcgacgacaattgggacctgcgagacgccactgtggcgtgctgggagctcggctgcggtaaagtgcgccctagagtgggaaaaacgcactacggaccaggaactggccctatctggctggacgacatgggctgcaaagggtctgaggcaagcctttctgattgtccgtccggcgcatgggggaagcacaactgcgaccacgaagaggatgttggcctgacctgtaccggatacaccgattatgacgattacccaccctggacgtgggatcctactagtagagaggacctggccaagggtactactaccgccggtgtaccgggacatacgttgccgtggagaaccacccgcagacccggatcctcaagtcctgctattagacgcctgccagataccggatccaaagacggctataagctcccatggacttgggatacgccttccgggcgaggcctggctgagggtaccccgacggcagggaaattaggccctactctgggagcaggcactacacgttcccctgggtctcctccgacattgcgtgtgcacggagatactggaagccctaggaagccctggcccgagagaaggcctcctcggccagcagcgacgcggaccgctccacccactccttcccccggacccagtgcctcacctgggccacccggacctgctcttacctccgactcatcccgcgaattaactccgcactcagccctgacatccgaggcgaccagcgatgctccagatacatccccccctacacccgaccccgcttccaggactaaccccgatttgatattaacgtcccccgattttgccctgtcaacacccgatagtagcgttgtcccagccttgacgcctgagccgagtcctaccccactgcctaccctacctaaagaattgacatcagatccctcaacaccatctgaggtgacaagcctgagccccacttccgagcaggtgcccgagtctgataccacacctgacctggacacgaccccttactcaagtactgtttcagaatattcccgttctcccgatccttcgcctagcccacatccaactacaacgcccgaccccaccatggctcccgatccaatcactacactaaacccaacagtaaccccacatttccccacaaccccccatcctacaacaacaccgcatccaaccacaatcacgcatagcaccatgatccccgatccaactaccactccacagccttttactaccattactcatagtaccatgataccggaccccactaccaccccacaacccttcactacaatgcagccgacaacaacccctcactcaaccactcctcaccctaccacaaccccgcaccctaccaccataacacatagtaccatgattcctgacccgactacaacaccgcagcctttcacaactatgcaacccacaacaatgccacatcccactactaccccacatccaaccactacaccccatccaacaacaactccccatccaacaaccacaccacatccgacgatgactcccgatccaacaactactccttaccccacgacgacacccgatccgacaacaacccctcatccaaccaccccagatccttcatctacccctgtgatcacaaccgtgtccctccccacatcgttgggaaccgagttgagttccccaaccctggctcctacagtaaagccgtctctgcaccctcagttgacttttacagctccggcaccccatacatccacttcacagattcccaccttggagccgtcccccgctttggaatctagtcctagcaggtctagcaccgccactagcatggatcctttgtcaacagaagactttaagccgccaaggtctcagagccctaatctgactccgcctcccacccacacccctcactccgcctctgatctgaccgtgtcacctgaccccctcctctcccctaccgcacaccctcttgaccacccgccattagatcctctgaccctgggcccaacacccggacagtcgcccggaccgcacggaccttgcgtcgcccctacccccccagtgcgcgtgatggcgtgcgagcctcccgcattggttgagctcgtggccgcagtgcgggatgtggggggacagctgcagcggttgacacaggtggtcgaacaagagcggcaggagcgccaagctcttcttctgggcctcacacagttagttgaggccgcacgagggttgggccaactgggggaagcagttaagagactggccgagatggcgtggacaacatcgatgcccgctccaaccacaactactccagaggaggaagaacgtcccctcaggggcgatgtctag

SEQ ID NO: 10979 - DNA, 1911 bp, Artificial Sequence
  Description of Artificial Sequence: Synthetic coding sequence
atgaccacttggagccttcgccgaagacctgctcggacccttggtctccttctcctcgtggtgctgggctttctagtgcttcgcagactcgattggagtactctggttccgctacgcctgaggcacagacagttagggttgcaggcgaagggatggaattttatgcttgaggattctaccttttggatatttggcggaagtattcattatttcagggtgcctcgagagtattggagggaccgcttactgaagatgaaggcctgtggcctaaataccctaaccacatacgtgccatggaatcttcacgagccggagagggggaagttcgacttctcggggaatttggatctcgaggcattcgttttgatggctgccgagataggcctgtgggtcattctgaggcctggaccgtacatctgctccgagatggatctcggcggactgcccagttggctcctgcaagaccccggaatgcgcttgcgcacaacatataagggattcaccgaagccgtagatttgtacttcgaccatctgatgtcccgagtagtgccccttcagtacaagaggggcggtccaatcattgctgttcaagttgagaacgagtacggcagctacaataaggatcctgcttacatgccgtatgtgaaaaaggccctggaggatcgcggaattgttgaactgctactcactagtgataacaaggatgggctgagcaagggtattgtgcagggcgtcctcgccacaatcaacctgcagtcaacccacgaactgcaactccttacaacctttctctttaacgtgcaggggacgcagcctaaaatggtcatggaatattggactgggtggtttgattcctggggcggtccgcacaatatccttgattctagtgaggtgcttaaaaccgtctctgccatagtagatgctggttcaagtattaacctgtacatgtttcacgggggaacgaattttggttttatgaacggcgctatgcactttcatgattacaaatccgatgtcaccagttatgactacgatgcagtgcttacggaggcaggagactatacagcgaaatacatgaaactccgtgatttttttggaagtatctctggcattccattaccaccacctcccgaccttttacctaagatgccatatgaaccgttgactccagttctatacctgagcctctgggacgcattgaagtaccttggggagccaataaagagtgaaaaaccaattaacatggaaaacctgcctgttaatgggggaaatggtcaatcgtttggctatattctgtatgagacaagcattacgagcagcggtatactatccggtcatgttcatgatagaggacaggtctttgtcaacaccgtgtccatcggcttcctggactataagacgactaaaatcgctgtgcccctaatacaaggatataccgttctgcggatccttgtggagaacagaggcagagtgaactacggggagaacatcgatgaccagagaaagggtctgatcggcaacctttatctgaatgatagcccattaaaaaattttcggatttattctttagacatgaagaagtccttcttccaacgctttgggcttgacaaatggagctctctgcccgaaacacccactctacctgctttcttcctgggatccctctccatcagtagcacaccatgtgatactttcttaaagttggaggggtgggaaaaaggcgtcgtattcataaacggccagaacttgggcagatactggaacataggcccacagaaaaccctttatctacccggtccctggctgtcaagcggaataaatcaggttattgtgttcgaggaaaccatggcaggcccagcactccaatttaccgagactccacatctcggcaggaaccaatatatcaaatag

SEQ ID NO: 10980 - DNA, 2037 bp, Artificial Sequence
  Description of Artificial Sequence: Synthetic coding sequence
atgcgaacggtggtgctgaccatgaaggcctcagtcatcgaaatgttcctggtgctgctggtcactggtgttcacagtaacaaggagacagccaagaagattaaacgccctaaatttactgtccctcagattaactgtgacgtcaaggccggaaagatcatcgaccccgagtttatcgtgaaatgccctgccggttgtcaagaccctaagtatcatgtgtacggcactgacgtgtatgcgtcctattcatctgtttgtggagcggctgttcattcaggggtattggacaattccggcggtaaaatactagtgcgaaaagtggctgggcagtcgggatacaagggctcctacagcaacggcgtgcagagtctgagcttgccacggtggcgggagtcattcatcgtccttgagtcgaaaccgaaaaaaggtgttacttacccatctgctctcacctattcatcatccaaatctcccgctgcccaggctggcgaaactaccaaagcttaccaacggcctcccatccccggtaccactgcacagcctgtcaccctgatgcagctccttgcagtgacagtcgccgtagctaccccgaccactttacctcgcccatcaccctccgccgcttctaccacaagcatccccaggccccagagcgtaggacaccgttcccaagaaatggatttgtggagcacggccacctataccagctcacagaaccggccaagagccgaccccggaatacagcggcaggatcctagcggagcagcctttcagaaacctgtgggggctgacgtgtctcttgggctcgtaccaaaagaagaattaagcacgcagagtctggagcctgtgtccttgggggatccaaattgcaagattgatctgagcttcctgatagacggctctacttccatcgggaagaggagatttcgcatccagaaacagctgctggctgatgtggcacaagccctggacatcggccctgcaggaccgcttatgggcgtggtgcagtacggagacaaccccgcaacacatttcaatctaaagacccacacaaatagcagagatctgaaaaccgcaatcgagaagatcacacaacgcggaggtctctccaatgttgggagggcaatttctttcgttaccaaaaatttcttcagtaaggccaatggcaatagatctggagcgcctaatgttgtggtggtgatggtcgacggatggcctactgacaaagtggaagaggcctcaaggttggcccgtgaatcaggcatcaatattttcttcattactattgaaggcgcagctgagaacgagaagcagtatgtcgtggagcctaattttgccaataaggcagtgtgccgaacaaacggcttctactccctgcacgtccagtcatggtttggactgcataaaaccctgcagccgttagtgaaaagggtatgtgacacagaccggctggcctgtagcaaaacgtgcctgaatagcgccgacataggctttgtgatagatggaagctctagcgtaggcacaggaaacttcaggacagtcttgcagttcgtgactaacttaactaaagagtttgagatctcagataccgacaccaggattggagctgttcagtacacatatgagcagaggcttgaattcggttttgataaatattctagcaagcccgatatcctgaatgctatcaaacgcgttgggtactggagtgggggaacctcgactggcgctgccatcaactttgcactagagcagctcttcaagaaatctaagcccaacaaacgcaagcttatgatcctaattacagacgggaggagctacgatgatgtgcggatccccgctatggccgctcacctgaaaggcgtgataacatacgcaatcggtgttgcctgggccgctcaggaagagttggaagttattgcaacacatcctgctcgtgatcatagcttttttgttgatgaattcgataatctgcaccagtatgtgccgagaattattcaaaatatctgcacagaatttaacagccagccccgaaattag

SEQ ID NO: 10981 - DNA, 324 bp, Artificial Sequence
  Description of Artificial Sequence: Synthetic coding sequence
taaactgttgctgcacccagcgtttttattttccctccgagtgacgagcagcttaagtcaggtaccgccagcgtcgtctgtctcctaaataacttttatcctagagaggccaaggtgcagtggaaggttgacaacgccttgcaatctggcaatagccaggaaagcgtcactgagcaagactctaaggactctacgtactccctgagttcgacgctgacactgtcaaaagccgattatgaaaaacacaaagtgtacgcatgcgaggtaacacatcaggggctgtcaagcccggtcactaagtcctttaacaggggcgaatgctag

SEQ ID NO: 10982 - DNA, 366 bp, Artificial Sequence
  Description of Artificial Sequence: Synthetic coding sequence
atggttttgcagacgcaagtatttatcagcctgttactttggatttcaggagcatatggtgacattgttatgactcagtcgcctgattccttagcagtgtcactgggggaacgcgcaactattaattgcaagtctagccaatcggtactgtattcctctaacaataagaactatttagcctggtaccaacagaaacctgggcaaccccctaagctcctgatttactgggccagcactcgcgagagcggcgtgcctgaccgcttttctggaagtggttccgggaccgatttcacgctaactataagctctctgcaggcagaggacgtggccgtttactattgtcaacagtactacagtactccatag

SEQ ID NO: 10983 - DNA, 984 bp, Artificial Sequence
  Description of Artificial Sequence: Synthetic coding sequence
gccagcaccaaggggccaagcgtcttcccactagcaccgtgctctaggagtacatccgagtctacagccgcactggggtgcctcgtgaaagattacttcccagaaccggtaaccgtgtcatggaactccggcgctctgacttctggtgttcacactttccccgctgttctgcaatcatcaggtttgtatagcctgtcatccgttgtcacagtccccagcagctccttggggaccaagacctatacttgcaatgtggatcataaacccagcaatactaaggtcgataagagggtggagagcaagtacggccctccatgccccagctgcccagctccagaatttcttggtggtccttcggtgttcctgtttccacccaagcctaaggataccctcatgatctctagaactccagaggttacctgtgtggtggtggatgtgtcccaagaggatcccgaggtgcagtttaactggtacgtggatggtgtggaggtacataatgctaagacgaagcccagagaagagcaattcaacagtacataccgcgtggtgagcgtactgacagtacttcaccaggattggctgaatggtaaggaatataagtgtaaagtgtctaataaaggactgccaagctccattgagaaaaccatatctaaagcaaagggacagcctcgcgagcctcaagtctatactttgccaccctcccaagaggagatgacaaagaaccaggtgtccctgacatgtcttgtcaaaggtttctatccgtctgatatcgctgtggagtgggagtccaatggccagccagaaaacaactataaaaccacccccccagtgctggatagtgatggctcctttttcttgtatagcaggctgaccgttgacaaatcccgttggcaagaggggaacgtgttttcatgctccgtgatgcacgaagccctgcataaccattatactcagaagtcgctaagcctgagcttgggtaagtag

SEQ ID NO: 10984 - DNA, 981 bp, Artificial Sequence
  Description of Artificial Sequence: Synthetic coding sequence
gccagcacaaaaggtccatccgtcttccctctcgcgccttgcagccgaagcacatctgaaagtaccgcggcactgggctgcctcgttaaagattacttccctgagccagttactgtgtcttggaactctggagccctaacgtctggagtgcacacctttccagctgttcttcagagtagcgggttgtacagcctctcttcagtagtgaccgtgccatctagcaactttggaactcagacctacacttgtaacgtggaccacaagccatccaatacaaaggtggataagaccgtggagagaaaatgctgcgtcgagtgtcccccatgccctgccccacccgtggccggaccgagtgtttttctgtttccccctaaacctaaggatacactgatgatctctaggaccccagaagttacttgcgtggtggtggatgtcagccacgaggaccctgaagtacagtttaactggtatgtggatggcgtggaggtccataacgccaaaaccaagcccagggaagagcaattcaacagtacctttcgagtggtgtccgtgctaacagtggttcatcaggattggttgaatgggaaagagtacaaatgcaaagtgtcaaacaagggtctgcccgctcccatagaaaagacaatttcaaaaacaaaggggcagcccagagaacctcaggtgtacacactgccaccatctcgggaagaaatgacaaagaatcaagtgtctctaacttgtctggtgaaagggttttatccatctgatatttctgtcgagtgggaatccaacgggcaacccgagaacaactacaaaactacgcccccaatgctggactccgatgggagcttttttttgtactccaagctcactgttgataaaagcaggtggcagcaggggaatgtgttttcttgtagcgtgatgcatgaagcattacataaccactacacccaaaagagcctttcactgagtccaggaaaatag

SEQ ID NO: 10985 - DNA, 993 bp, Artificial Sequence
  Description of Artificial Sequence: Synthetic coding sequence
gcttccactaagggcccatcagtgtttccgctggcaccatcatcgaagagtacctcagggggaaccgccgcacttgggtgcttggtgaaagactactttccagagcctgtgacagtttcttggaatagcggcgctctgacttcaggagtccataccttccccgctgtcctgcagagctccgggctgtattctcttagttcagtggtaactgtgcctagctcgagcttgggcacacagacatacatatgcaacgtgaatcacaagccatcaaacacgaaggtggataagaaggttgaacccaaaagttgcgacaagacccacacctgcccaccatgccctgcccctgaactcctaggcggaccgagtgtgtttctcttccctcctaagccaaaggatactctgatgatcagccgcacaccggaggtcacctgcgtcgtcgtggatgtgtctcacgaagacccagaggtaaagttcaactggtacgtggacggagtggaagtccacaatgccaaaactaagccccgtgaggagcaatacaactccacctacagagtggtgtctgttttgactgtcctccaccaggattggctaaatggtaaggagtataaatgcaaagtttcaaataaggccttgcccgctccaatcgagaagacgatctcaaaggccaaaggccagcccagagaaccgcaggtatacactttgcctccttcacgtgacgagctgactaagaatcaggtgtccctgacctgtctcgtgaagggcttttaccccagcgacatcgcagtcgaatgggagagtaacgggcagcctgagaacaactacaaaactactccgcctgtgctggattccgatggaagcttcttcttatactccaagctgacggtagacaaaagccgctggcagcagggcaatgtgttttcctgttctgtcatgcatgaggccctacataatcactacactcagaagtctctgagcctgtcccctggcaagtag

SEQ ID NO: 10986 - DNA, 651 bp, Artificial Sequence
  Description of Artificial Sequence: Synthetic coding sequence
atgggagcagtgatgggcaccttcagcagcctgcagactaagcagagacgccctagcaaagacaagattgaagatgagctggagatgactatggtctgtcacagacccgagggcctggagcaactggaagcacagactaattttacaaaacgggagttacaagttctgtaccgcggatttaaaaacgagtgtccttccggcgttgtgaatgaagacacgtttaagcagatatacgcacagtttttcccgcacggagatgcaagtacatatgcccactatctgtttaacgccttcgacactacgcaaaccgggtcagtgaagttcgaggacttcgtgacggcactgagcatcttactgagaggaacggtgcacgagaaattgaggtggacattcaacctttatgatatcaacaaggatggctacatcaataaggaagagatgatggatatagtgaaggccatctacgatatgatggggaagtatacgtaccccgtcctaaaagaagacacaccccgacagcacgtggacgtgttctttcagaaaatggacaaaaacaaggatgggattgtcacactggacgagttcctcgaaagctgccaggaagatgacaacattatgcgctcgcttcagttgtttcagaatgttatgtag

SEQ ID NO: 10987 - DNA, 762 bp, Artificial Sequence
  Description of Artificial Sequence: Synthetic coding sequence
atggccaggtcattactcctacccctgcagatccttctattgtctctggccctagagacggcgggtgaagaagcacagggggataaaataattgatggagcgccatgtgcacgaggtagccatccttggcaggtggctcttctgtctggaaaccagctgcattgcggaggtgttctcgtgaacgaaagatgggtactcactgccgcacattgtaagatgaacgagtacaccgtacatctgggctctgacactctgggggacagacgagcgcagagaatcaaggcctctaagtctttccggcatcctggctatagtacgcagacgcatgtaaatgacttaatgcttgtgaagctcaactcccaggctaggctgagttcaatggtcaaaaaggtgagactcccaagcaggtgtgagccacccggtacaacctgcactgtgtccggatggggaaccaccacctcacctgatgtcacatttccatctgacttaatgtgtgtggatgtcaagctgatctctcctcaggattgcaccaaggtctataaagacctgttagaaaatagcatgctttgtgcaggcatacccgactcaaagaagaacgcttgcaacggggattcaggagggccacttgtgtgtaggggaactttgcaggggctcgtgagctggggaacctttccatgcggtcaacccaacgatcccggagtgtacacgcaggtctgtaagttcactaaatggattaacgacaccatgaagaagcacaggtag

SEQ ID NO: 10988 - DNA, 468 bp, Artificial Sequence
  Description of Artificial Sequence: Synthetic coding sequence
atgttccagcgattgctgctgctacttctcctgtcaatgggaggaacgtgggccagcaaggagccccttcgcccaagatgtaggcccattaacgcgacattggctgtggaaaaagagggttgcccggtttgtattactgtgaatacaacaatatgtgccggttactgtccaacaatgacccgagttctccagggcgtactcccggctctgccacaggtggtttgcaattatagggacgtcaggtttgaatccatacgcctacctggatgtcctaggggcgtgaatccagtggtctcctacgctgtcgcattgtcatgccagtgcgccctgtgccgacgctcaacgacggattgcgggggaccaaaagatcaccccttgacttgtgacgacccgagattccaagactctagctcatcaaaggcacctccgccaagcctcccaagcccctctcgactgcccggtccctag

SEQ ID NO: 10989 - DNA, 1554 bp, Artificial Sequence
  Description of Artificial Sequence: Synthetic coding sequence
atggctgtaagccgaaaagattggtccgctctaagttccctagcaagacagcgaactctggaagacgaggaagaacaggagcgggagcgccgacgtcgacaccgtaacctgagttctacaacggacgacgaggcccctcgccttagtcagaacggggatcggcaggcttccgcctccgagagactgccgagtgtggaagaagccgaagtgccgaagcccctccccccagctagcaaggatgaggacgaggatatacagtctattctgcgcacccggcaagaacggcgacaaaggagacaggttgtggaggctgcccaagcacccatccaagagcggctggaggctgaggagggcaggaatagcctgtctcccgtccaggctacgcaaaaacccctcgtgagtaagaaagaactcgaaatacctcctagaaggcgtctgtctcgggagcagcgcggtccatgggcgctggaagaagaatctctcgtgggcagggagccagaggagcgcaagaagggcgtgcctgagaagagccccgtactcgagaaatcatctatgcccaagaagacagccccagaaaagtcccttgtctcagacaagactagcatttcagagaaggtcctggcttccgaaaagacatccctgtctgaaaagattgccgtttccgagaagcggaattcttctgagaaaaaatcagtactggagaaaacgtctgtctcagaaaagtccttagcgccagggatggccttgggctctggaaggcggctcgtcagcgaaaaggcttccattttcgagaaagccctggctagtgaaaagagccccaccgctgatgccaaacctgcacctaagcgcgctacagcttccgagcaaccgctggctcaggaaccgcctgcgtcgggtggctcccctgccaccacaaaggaacagcggggaagggcattacccggaaagaacctcccgtccctagccaaacagggcgcttccgacccgcctacagtggcgagcagattaccacctgtaacactacaggtgaagattcccagtaaggaagaggaagcagatatgtccagtcctactcagagaacctactcttcctcattaaagaggagcagcccacgtacgataagcttcagaatgaaaccgaaaaaggaaaatagcgagaccacccttacacgaagcgcttctatgaagcttcccgacaacactgttaaactcggagaaaaactcgaaagatatcacacagcgattaggcggtcagagagcgttaaaagcagaggcctcccttgtactgagctgttcgttgcacctgtgggggttgctagcaaaagacatctttttgaaaaggaactagccggacaaagtagggctgaacccgctagttcgcggaaagaaaatctgcggctttctggagtagtaacgagccgcctgaacctgtggatcagtcgcacccaagaaagtggtgaccaggatccacaggaggcacagaaggccagctcagctacagagcgaacccaatggggacaaaagtctgactcctccttagacgccgaggtctag

SEQ ID NO: 10990 - DNA, 270 bp, Artificial Sequence
  Description of Artificial Sequence: Synthetic coding sequence
atgcaggcctgcatggtgccgggtttggctctctgcctcttgctcgggcctcttgccggtgctaaaccagtgcaggaggaaggagacccttatgccgaactgccggctatgccttactggccattctccaccagcgacttttggaactacgtacaacacttccaagccttgggggcttatccccagattgaggacatggcacgcacgttttttgcacactttcctttaggttctactttgggctttcatgtgccatatcaagaggattag

SEQ ID NO: 10991 - DNA, 1302 bp, Artificial Sequence
  Description of Artificial Sequence: Synthetic coding sequence
atgggcaatgcatgttgggagctgtactgtttagagcatggaatccagcctgacggacaaatgccctcagataaaactatagggggaggggacgactcatttacaacgttcttttgcgagacaggcgctggtaaacacgtgcccagagccgtgttcgttgatctggagccaacagtgatagatgaaattcgcaacgggccttataggcaattatttcatcccgaacagctaattacaggcaaggaggacgccgctaataattatgcccgaggccactacaccatcggtaaagaaatcatagaccccgtgctggatcggatccgaaagctaagcgatcagtgcacagggcttcaaggctttttggtgtttcactcattcggcggtggcacaggcagtggtttcacaagcctgcttatggaacgcctctccgttgactacggcaagaagtcaaaactggaattttctatataccccgctcctcaggtgtcaacagcagtggtagagccctacaactcaatacttacgacacacactacacttgaacattcagattgtgcatttatggtcgacaacgaagccatatatgatatttgtcgtcgcaaccttgacatcgaaagacctacctataccaacttgaaccgcctgatctctcaaatcgtgtcctctattaccgctagtctccgcttcgatggcgctttaaatgtggacttaaccgagttccaaactaatctcgttccctatcccaggattcattttcccctggccacctacgctcccgtgatctcagcagagaaggcgtaccacgaacaactgtctgtggccgaaatcaccaacgcttgtttcgaacccgcaaaccagatggtcaaatgcgatccacggcacggcaagtatatggcttgctgtctgctctaccgcggagatgtggtaccgaaggacgtaaatgcagccatcgctgcaatcaagaccaaacggtcgatccaatttgtggattggtgcccaaccggcttcaaggtgggcatcaactatcagcccccaactgtagtgccaggcggagacctggccaaggtccaaagagctgtctgtatgctctcaaataccactgccattgccgaagcttgggccagactggatcacaagtttgatctgatgtatgccaaacgtgcattcgtccactggtatgtgggcgaggggatggaggaaggtgaattcagcgaggctcgcgaggatatggcggcactcgaaaaagattacgaagaagtcggaattgatagttacgaggacgaggacgagggcgaagagtag

SEQ ID NO: 10992 - DNA, 1965 bp, Artificial Sequence
  Description of Artificial Sequence: Synthetic coding sequence
atggctcccaagaagctgtcttgtctccgctccctactgctcccactcagtcttacactgcttttaccacaggctgatacgcgctctttcgtggtggatcggggacatgatcgatttcttctcgatggcgcacccttccgctatgtgtcaggatcacttcattatttccgggtgcctagggtgttatgggctgatcgtctccttaagatgcgctggtcaggactcaatgcgatccagttctacgtgccgtggaactatcatgagccccagcctggtgtgtacaactttaatggtagtagagatctcatcgcatttctcaacgaggccgctctcgccaacttactggttatcctcagacctggaccatatatttgcgccgaatgggaaatgggaggccttccctcatggctccttagaaagcccgagatccacttacgcacttctgatcctgactttctggccgctgtagattcatggttcaaggtgctactccccaagatttatccctggttgtaccataacggaggcaatattataagcattcaggtggaaaatgagtacggttcttacagggcctgtgacttctcttacatgagacacctggcaggcttgttcagggcactgttgggagagaagatcctgttgttcaccaccgatggaccagaaggtctgaagtgcggctcgctgcggggactgtatactaccgtcgactttggtccggcagataatatgacaaagatcttcaccctactcaggaaatatgaaccgcacggtcctctagttaattcggaatactacacaggatggctggattattggggacagaatcatagtacaaggagcgtgagtgccgtcacaaagggcctggagaacatgttgaaactgggtgcttctgtgaatatgtacatgtttcatgggggtactaatttcggctactggaatggcgcagacaagaagggacgcttcttgccgattactactagttatgactacgatgcgccaatctccgaggcgggagacccgaccccaaagctttttgctctccgcgacgtcatttccaagtttcaggaagttccactgggccctcttccccctccatcacccaagatgatgctcgggcctgtgacccttcaccttgtcgggcacttgttagcgttcttagatctgctctgcccccgagggccaattcactccatactcccgatgacctttgaagcagtcaagcaggaccacgggtttatgctatacagaacctatatgacccacaccatatttgagcctaccccgttctgggtgcctaacaacggagtgcacgaccgggcatacgtgatggttgatggggtttttcagggtgtggtggagcgcaacatgcgagataaactgtttttgactggcaagttaggcagcaagctcgacatactcgtagaaaacatgggcagactgtctttcgggtccaattcgtccgacttcaaaggactgctgaaacctcccattctcgggcagaccattcttacccagtggatgatgtttcctttgaagatcgataatctcgtgaaatggtggtttccattacaactgcctaagtggccctatccccaagccccatccggtccaacattctattccaagacctttcccatcctcggtagtgtcggggatacttttttgtacctccccggatggacaaaaggacaggtttggataaatggcttcaacctgggaaggtactggacgaagcagggcccacagcagaccctttatgttcctcgtttccttctgtttccaagaggtgcgttgaacaaaataacattgctggagctggaagatgttccactacagccacaggtgcaatttctggataaaccaattctgaacagcacctccacactccaccggacccacataaattccctgagcgccgacaccctgagcgcatccgagcctatggaactgagcggccattag

SEQ ID NO: 10993 - DNA, 1173 bp, Artificial Sequence
  Description of Artificial Sequence: Synthetic coding sequence
atgaaatttcagggccctctggcatgtctgctgctggctctctgcttgggctcgggcgaagccggaccccttcagtctggagaagagtctactggcaccaacatcggagaggcactgggacacggactcggggacgctctgtctgagggggtgggaaaagccataggtaaggaggcaggaggtgccgcaggctccaaagtgtcagaagccctggggcaggggacaagggaagccgttggcacaggggtccgccaggtgcctggatttggagtggcagatgccctgggcaatcgagttggcgaggccgctcacgccttagggaacacgggccacgaaattggccgacaagccgaggatgtaatccggcacggcgcagacgctgtacgcggatcctggcagggtgtgcctgggcacaatggggcttgggagacgtctggtggccatggcatctttggctcgcaagggggtctcggcggacagggccaggggaacccaggcggactgggcacaccgtgggtccatggctaccccggaaactcagctggcagcttcggcatgaatccccagggcgctccatggggccaaggagggaatggcggtcctcccaatttcggaacaaatacccagggcgcagttgcccagccgggttatggctccgtgcgtgcctccaatcagaacgagggatgcacaaatcctccaccctcaggctccggcggaggatcatcaaactcaggtggcggtagcggctcacagtcaggtagtagtggatccggttccaatggggataataataatggctcttcatctgggggatcttcctcaggctcaagctccggcggaagcagtggcggaagctctggtggcagctctggcaacagcgggggaagcaggggagatagcggaagcgaaagttcatggggctcgagcaccggttcttcatccggaaaccacgggggttccgggggaggtaacggtcacaaacccggatgtgaaaagcctgggaacgaggcacggggaagtggcgagtctggtattcagggttttagaggacagggggtgtcatcgaatatgagaaacagtgagactagccctggaatgtttaattttgataccttttggaaaaacttcaagagcaagctggggttcattaactgggacgccattaacaagtag

SEQ ID NO: 10994 - DNA, 846 bp, Artificial Sequence
  Description of Artificial Sequence: Synthetic coding sequence
atgggctcccgtggtcagggcctcctgctggcatattgccttctgctagccttcgccagtggactggtgttgagtcgggtgccgcatgtccagggagagcagcaggaatgggagggaacggaggaactccccagcccacccgaccatgccgaacgggctgaagagcagcacgaaaagtatagacccagtcaagaccagggcttgcccgcatctaggtgccttagatgttgcgaccccggaacttctatgtaccctgcgaccgctgtgcctcagataaacatcacgattctgaaaggggagaagggagatcggggagaccgagggctgcagggaaaatacggcaagaccggcagtgctggcgctcggggacacacaggccctaaagggcagaaagggtcgatgggagctccgggagagcggtgtaagtctcactacgccgcattttccgtggggagaaaaaagcctatgcatagcaatcactactatcagaccgttatctttgataccgaatttgtaaatttatacgaccattttaacatgtttacaggcaagttttactgttatgtgcccggactgtacttttttagcctaaacgtgcacacttggaaccagaaggagacctacctccacatcatgaagaacgaggaggaggtcgtaatcctgtttgctcaggtgggggacagaagcatcatgcagtcccaaagtctcatgctggaactccgcgaacaagaccaggtgtgggtacggctttataagggagagcgcgagaatgctattttttctgaagaactagacacgtacattacattcagcggttatctggtgaagcacgccactgaaccctag

SEQ ID NO: 10995 - DNA, 876 bp, Artificial Sequence
  Description of Artificial Sequence: Synthetic coding sequence
gtgttgagtgctagcggccctgggaggaagatgggctcccgaggacagggtctgttgcttgcctattgtctgctgcttgcatttgctagtggcctcgtcttgtctcgtgttccccatgttcaaggcgagcagcaggaatgggagggcacggaagaactgcctagcccacccgaccatgctgagcgggctgaggagcaacacgagaagtatagaccatctcaagaccaagggttgcccgcttcacggtgcttgcgatgttgcgatccaggaacaagcatgtatccagccaccgctgtaccccagattaatattactatcttaaaaggtgaaaaaggcgatcggggagaccggggtttgcagggcaaatatggaaagactggctctgccggtgcaagagggcatactggccctaagggtcagaaagggtcaatgggagccccaggtgagcggtgcaaaagccattacgccgctttcagcgttgggcgaaaaaagcctatgcactccaaccactattaccagacagttatatttgacactgagtttgtaaatctgtacgaccactttaacatgtttactgggaagttctattgctacgtccccggactgtacttctttagcttgaatgttcacacgtggaaccagaaggaaacttatttacatattatgaagaatgaggaagaggtggtgattctgtttgcacaggttggcgacagaagcatcatgcagagccagagtctgatgttagagctgcgagaacaagatcaagtatgggtgagactctacaagggagaacgggagaacgccatcttttccgaagagctagatacatatatcacgttttctggttacttggtgaagcatgccactgagccatag

SEQ ID NO: 10996 - DNA, 1002 bp, Artificial Sequence
  Description of Artificial Sequence: Synthetic coding sequence
atggtctcgaagagccgctggaaactcctggcgatgctggctctcgtcctggtcgtgatggtctggtattcaatttccagagaggatcgatacatcgaacttttttacttccccattcccgagaaaaaggagccctgcctacagggcgaggctgagtcaaaggccagtaagttgtttggcaactacagtagagatcagcccatcttcctccggctggaggactacttctgggtaaaaaccccaagcgcatatgaactgccatacggcacaaagggatctgaggacctccttctcagagttctcgccattacctctagcagcatccccaaaaacattcagtccctaagatgcaggcggtgtgtggtggtcggtaatggtcaccgcctgaggaatagcagtctaggtgacgccataaataagtacgatgttgtgatccgattgaacaacgctccggtcgctgggtatgagggcgatgtgggatctaaaaccacaatgaggctgttttatcccgagagcgcccactttgacccgaaagtggaaaacaatcctgacactttactggtactagtcgccttcaaagccatggacttccattggatcgaaactatcctgagcgacaaaaaacgcgttaggaaggggttctggaaacagccacctttaatctgggatgtgaatcccaagcagatacgaatcctgaatccctttttcatggagattgccgctgacaagctcttaagtttaccgatgcaacagccgaggaaaatcaaacagaagcccaccaccggtctactcgcgataactctcgccctccacctttgcgatctggtgcatattgcaggctttggatatcccgatgcttacaataaaaagcagacaatccactattatgagcagatcaccttaaaaagtatggccggatcagggcacaacgtctcacaggaggcattggccatcaagcggatgctggagatgggagccattaaaaacctcacaagtttctag

SEQ ID NO: 10997 - DNA, 312 bp, Artificial Sequence
  Description of Artificial Sequence: Synthetic coding sequence
atgagcggtaggggcaaggggggaaaaggactggggaagggtggggcaaagcgacaccgcaaggttttacgggacaacattcaaggtatcaccaaaccggctatccggaggctggccagacgtgggggagtcaaacggatctctggcctcatatacgaagagactcgaggtgtactgaaggtgtttctcgaaaacgtcatccgcgacgccgtgacttacactgagcacgcgaagagaaaaacagttacagcgatggatgtggtttacgccctgaagcgtcagggcagaacactttacggtttcgggggatag

SEQ ID NO: 10998 - DNA, 312 bp, Artificial Sequence
  Description of Artificial Sequence: Synthetic coding sequence
atgtctggacgcggaaagggcggtaaaggcctgggaaaggggggagccaaaaggcaccgcaaagtgctccgggacaacatacagggtattacgaagcctgcaattcgacggctggccagacggggaggagtgaagcgcatatctgggttgatttacgaggaaacccgcggagttctaaaagttttcttagagaacgtgattagggacgccgtgacctataccgagcacgctaagagaaagactgtcacagccatggacgtggtatacgccctgaaaaggcagggcagaacactttatggtttcggcggttag

SEQ ID NO: 10999 - DNA, 312 bp, Artificial Sequence
  Description of Artificial Sequence: Synthetic coding sequence
atgtctggtcggggaaaagggggtaaagggctgggaaagggaggcgctaagaggcacagaaaagtgctcagagataatatacagggaatcacaaagcccgctattcggagactggcgcgacgcggaggtgtcaagagaatcagcgggctgatctacgaggagacacgtggcgtactgaaggtgttcttggagaacgtcatcagggacgctgttacgtacacagagcacgctaaacgcaagaccgttacggccatggatgtggtgtatgcattaaaacggcaagggcgtaccctgtacgggtttgggggttag

SEQ ID NO: 11000 - DNA, 312 bp, Artificial Sequence
  Description of Artificial Sequence: Synthetic coding sequence
atgagtggacggggaaaggggggaaagggcctcggcaaaggaggggctaagcgccacagaaaggtgctcagggacaacattcagggaattactaagcccgctatacgacggcttgcaaggcgcggtggggtcaagaggatctccggattgatatatgaagagacgagaggcgtgctcaaggtattcctcgagaatgtaatcagggacgcggtcacttacaccgagcacgccaagcgtaaaacagttacagccatggacgtggtgtatgcactgaaaaggcaaggcaggacactgtacgggttcggcggatag

SEQ ID NO: 11001 - DNA, 2268 bp, Artificial Sequence
  Description of Artificial Sequence: Synthetic coding sequence
atgcccccattcctcctcctggaggctgtgtgcgtctttttgtttagcagggtgcccccttctctgcccctccaagaagtgcacgtttccaaggagactatcgggaaaattagcgctgcttctaaaatgatgtggtgttctgctgcagtagacatcatgtttttgctagacggcagtaactcggttgggaaggggtctttcgaaagaagcaaacatttcgccattacggtatgtgacgggctggatattagcccggagcgagttcgggtcggcgcttttcagttcagctcaaccccccacctggaattccctctcgatagcttctccacccagcaagaggtgaaagccagaattaagagaatggttttcaaaggtggtaggactgagactgagctggccctgaaatacctgctgcatcggggtctacccggaggcagaaatgcaagtgtgcctcagatcttgatcatcgtaacggatgggaagtcacagggcgacgtcgccctcccttcaaagcaactcaaggagcgtggggtcacggtgttcgcagtcggggttaggtttccgaggtgggaggagttgcacgccctagccagcgaacccaggggtcagcacgtcctgctagccgaacaggtagaggacgccactaatggcctatttagtactttgtcctcaagcgcaatttgctcatcagctacccctgactgcagagtggaggcccatccttgtgagcataggacgctggagatggtgcgggaatttgcaggaaatgcaccatgttggaggggcagtcgcaggacactggcagtccttgccgctcactgcccattctactcctggaaaagagtgtttctgacgcacccagcaacatgttatcggaccacttgccctggaccctgtgatagccagccctgccaaaacgggggaacatgcgtcccggaaggactggacgggtatcagtgtctgtgcccgctggcatttgggggtgaagccaattgtgctctaaagctctctctggagtgtagggtcgatctgttgttcctgcttgactccagcgcagggacaacccttgacggatttctgcgcgcaaaagtgtttgtaaagcggttcgtgcgtgctgtattgagtgaagactccagagctagagtgggtgtggcaacgtacagccgcgagctgctggtggctgtgcccgtgggcgagtatcaagacgttcctgatcttgtctggtcgcttgatggcatcccttttcgtggagggccaaccctgactggttctgctctccggcaggccgctgaacgtggcttcggcagtgccaccagaacaggccaggaccgcccacggagggttgtggtgctgctaaccgagagtcacagcgaagatgaggtagcgggtcctgcccgtcatgccagggctagagagctcctgctgctgggagtgggttcagaagccgtgagagcagagctggaagagatcacagggagccctaaacacgttatggtttactccgatcctcaggacctgttcaaccagataccggagctgcagggtaagctgtgctccagacagcgacccggttgtaggacgcaagccctggatttggtctttatgctcgacacttccgcctccgttggccctgagaactttgctcagatgcagtcttttgttcgctcttgcgctttgcagttcgaggtcaatcccgacgtgacgcaagtggggctcgtggtgtacgggtcacaggtacaaacggctttcggactggatacaaaaccaaccagagcagcgatgctccgtgctatatcccaggctccctacctgggcggtgtgggatctgcaggtaccgctcttctgcacatttatgacaaggtgatgacagttcagcggggtgctaggcctggagtcccaaaagccgtggtggttctgactgggggacgcggtgctgaggacgctgcagtcccggctcagaagcttcgaaacaacgggataagcgttctggtggtcggtgttggccctgtcttatctgagggcctgcgtcgactggctggcccacgggactccctgatccacgttgccgcatacgctgacctccgttatcaccaggacgtgcttatcgagtggttgtgtggagaggccaaacagccagtaaacttgtgtaaaccaagcccttgtatgaatgagggcagctgtgtactgcagaatgggtcatacagatgcaaatgccgcgatgggtgggaaggtcctcattgcgagaatagattcctccgcaggccttag

SEQ ID NO: 11002 - DNA, 816 bp, Artificial Sequence
  Description of Artificial Sequence: Synthetic coding sequence
atgataacgggtgtgtttagcatgagactgtggacccctgtcggcgtactcacgagcctggcatattgcttgcaccagcgcagagtggctcttgccgaactgcaggaggccgatggacagtgcccagtcgaccgctctcttctgaaacttaaaatggtgcaggtggtgttccgccatggggctcgctccccactgaagccactcccactggaggagcaggtggaatggaaccctcagctcctggaggtcccaccacaaactcagttcgattacactgtgacaaacctagcagggggtccaaagccatacagcccctatgacagccagtatcatgaaactaccttaaaagggggaatgtttgcaggccagctaacaaaagtgggcatgcagcagatgttcgctctcggtgagcgcttgcgcaaaaattacgtcgaagatatccccttccttagtcccacattcaatccgcaggaggtgttcatcaggagcacaaacatttttcgcaacctggagagcaccagatgtcttctcgccggattgttccaatgccagaaggaagggcctataatcatacatactgatgaggccgattccgaggtgttatacccaaactaccaatcttgttggtcattacgacaaagaacaaggggacgacgccagaccgcgtctctgcagccagggatctctgaagatctgaaaaaggtgaaggatagaatgggaatagatagtagtgataaggtcgatttcttcatcctactggataacgttgccgctgaacaagagaagatgggttcctgtcggttccacggctcttag

SEQ ID NO: 11003 - DNA, 1395 bp, Artificial Sequence
  Description of Artificial Sequence: Synthetic coding sequence
atggagcatagcgtgtgccctagctccgcggtgcatctcattcccgtgagcacccccaaaaacgggatgtctagtaagtcaagaaagagaatcatgccggacccagtcacggagccccctgtgacagatccagtttacgaggccctgctgtactgcaatattccttcagtggccgagcgcagcatggaggggcatgcaccacaccattttaagctggtctccgtgcacgtttttatcagacacggtgatcgataccctctgtatgtaatccctaaaacaaaaagacctgagattgactgtaccctggtggcaaatcgaaaaccttaccatcctaaactagaggcattcatatctcatatgtctaagggctctggcgctagttttgaatccccgctgaactccctaccactttaccctaatcaccccctgtgtgagatgggtgaactgacgcaaactggtgtcgtgcagcacctgcagaacggtcaactgttacgtgacatatacctgaaaaagcacaagctgctgccgaacgactggagcgccgatcagctgtatctcgagaccaccggcaaaagccgaacgctgcaatcaggcctggctctgctgtatgggttcttaccagactttgactggaaaaaaatttatttccggcaccagccaagtgccttattctgctcaggatcatgctattgccctgtgcggaaccagtacttggaaaaggagcaacgacggcaatacctgctgaggttgaaaaacagccagctggaaaaaacatatggagagatggccaaaatcgtggacgtgcccacaaagcagctgcgggctgcaaatccgattgacagcatgctgtgtcatttttgccacaatgtaagctttccttgtacacggaatggctgcgtcgacatggaacattttaaggtaattaaaacccatcagatcgaggatgagagagagcggcgtgagaagaaactgtacttcggatattctcttttgggcgcacatccaattctgaatcaaacgattggcaggatgcagcgggctacagagggcagaaaggaagaactgtttgccttatatagcgcccacgacgtgacgttgtcccctgtcctgagcgctctcggtctctcagaagctcgctttcctcggtttgccgctcgccttatctttgaactttggcaggaccgggaaaagccctctgaacattccgtgcgcattctatacaacggcgttgacgtgacatttcatacgtcattctgccaagatcatcacaaacgatccccgaagcccatgtgccccttggaaaatctggtcagattcgtcaagcgggacatgttcgttgctctgggaggctctggtacaaattattatgacgcatgccatagagaagggttctag

SEQ ID NO: 11004 - DNA, 1443 bp, Artificial Sequence
  Description of Artificial Sequence: Synthetic coding sequence
atgctattccgaaaccgatttctcttattgctggcactggccgctctgttagcgtttgtgagtctgagcctgcagtttttccacctaattccggtatcgacccccaaaaatggtatgagcagcaaatcacgtaaacggatcatgccagaccctgtcacagaaccacccgtcacggatccggtttacgaagctcttttatattgtaatattcctagcgtggccgagagaagcatggaaggtcacgcccctcaccattttaagcttgtttcagtgcatgtgttcatcagacacggcgatcgataccccctgtatgtcatccctaaaacaaagaggcccgagattgattgcacactggtcgctaatcggaagccctaccaccccaagctggaggcttttatctctcatatgtccaagggcagcggcgcaagctttgaaagtcccttgaactctttaccattatacccaaatcatcccctgtgtgaaatgggggagcttacccagacaggcgtcgttcaacacctccagaacggacagctgctccgcgatatatatttaaaaaagcataaactgctgccaaacgattggtctgcagaccaactttacttggaaactaccggcaaaagtcggactcttcagagtggattggctctgctctatggttttctacccgacttcgactggaagaaaatatatttccggcatcaaccaagcgctttgttctgtagcggctcatgctattgtcctgtgcgaaaccagtacctcgagaaggaacagagaaggcagtacctacttcgcctgaagaattctcaacttgagaaaacgtacggagagatggccaaaatagtggacgtacccactaaacagcttcgagccgctaaccctattgattcaatgctgtgccacttttgccataatgtctcttttccttgcacaaggaatggctgtgttgacatggaacatttcaaggtgatcaagactcatcaaatcgaggacgagagggaacggagagaaaaaaaactttatttcggttacagtctgctcggggctcatccgatcctgaaccagaccatcgggagaatgcagagggctacagagggaaggaaagaggagctgtttgcactttatagcgctcatgacgttacacttagccccgttctaagtgcattgggacttagcgaagccaggtttcctagattcgcagcgagactgatcttcgaactctggcaggatagggagaagccgtctgagcactcagttagaattttgtacaatggagtcgatgtgacttttcacacaagcttttgtcaggaccaccataagagatcacctaaaccgatgtgtccacttgaaaatttggtgcgcttcgtgaaacgagacatgttcgttgcactgggcggatctgggaccaattattatgatgcctgtcatcgggaaggcttttag

SEQ ID NO: 11005 - DNA, 1311 bp, Artificial Sequence
  Description of Artificial Sequence: Synthetic coding sequence
atgcagggcaccccgggtggaggaacgaggccaggaccttccccggtcgacagacgcaccctgctggtgttctcttttatactcgccgcagctctggggcagatgaatttcacgggagatcaggtccttagagtgctggcgaaagatgagaaacagctctctctcctcggagacttggagggactcaaacctcagaaggtagacttctggagggggcctgctagaccttccctcccagtggatatgcgcgtcccattttccgaactcaaggatataaaggcctacctggaatcgcacggtctcgcttactcgattatgatcaaggatatacaggtactgctcgacgaagaaaggcaagcgatggcaaaaagccgcagactcgagcggtctactaatagtttctcttactcgtcttatcataccctggaggaaatttactcgtggattgataattttgtaatggagcattctgacatcgtgtcaaagatccagatcgggaatagcttcgaaaatcagagcatcttggtgctgaagttcagtactggagggtctcggcatccagccatatggatagacaccgggattcattctagggagtggatcacacatgcgaccggaatttggacggcaaacaagattgtttctgattacgggaaggaccgggtccttaccgatatccttaacgcgatggacatttttatcgagcttgtgaccaaccccgacggattcgctttcacccatagcatgaacaggttgtggagaaagaacaaatcgatccgcccaggcatcttttgcattggcgtcgatctgaacaggaactggaaaagcggcttcggaggaaacggatccaattctaacccttgctctgaaacttaccacgggccttcacctcagtccgagcctgaggttgccgctattgtcaattttattaccgctcatggaaatttcaaggcactcatttctatccactcctacagtcagatgctcatgtacccatacgggagactgctggagcccgtctccaatcagagggagttatacgatttggcaaaggatgccgtggaggctctctataaggtgcacggaatcgagtacatcttcggaagcatctctaccacactgtacgtagcctcaggaataaccgtagactgggcatacgatagtgggatcaagtacgctttctcgtttgaactcagggacacagggcagtatggcttcctgttacccgctactcagatcatacccaccgctcaggaaacgtggatggccctgaggacgatcatggagcatactctaaatcacccgtattag

SEQ ID NO: 11006 - DNA, 1161 bp, Artificial Sequence
  Description of Artificial Sequence: Synthetic coding sequence
atggcacagtggcattgttctcagcgtactcaggccggaggacacggggtgggagagagattagcgcagtgccaggaccagtcttctcggcacgccgctgaacttcgtgattttaagaataaaatgctgcccttactggaggtggccgaaaaagagagagaagctctgcgcactgaagccgacactatctctggccgagtggaccgtctggaacgcgaagtcgattacctggagactcaaaaccctgcccttccctgtgttgaatttgatgaaaaggtgaccgggggacctggaaccaaaggaaaaggaaggcgcaacgagaaatatgacatggttaccgattgcggatacaccattagccaggttcgctcaatgaaaatcctgaaacggtttggaggaccagccggtctgtggactaaagaccccctggggcagactgagaagatctacgtgctggatgggacacagaatgacaccgcatttgtattcccacggctccgggacttcacgctcgccatggctgcgaggaaagcctcacgagtcagggtcccatttccctgggtgggcacaggtcagttggtgtacggcggtttcctatatttcgcacggcgtccacccggaaggcccggtgggggtggcgagatggaaaatacattgcagctgatcaaatttcacctggcaaaccgtaccgtggtggactccagcgtattcccggctgaaggtctcattccaccctacggcctcaccgcagacacctacatagacttggcggcagatgaggaaggcctttgggccgtatacgccacccgtgaggacgaccgtcacctgtgtttggctaaacttgaccctcaaaccctggacacagagcagcagtgggataccccctgccctagggagaacgcagaagcagcattcgtgatctgtggaaccctgtacgtggtctacaacacgaggccagcttccagggctagaatccagtgttcttttgatgcctcgggaaccctgactccagagcgcgctgctctgccgtatttcccacgcagatacggggcacatgcctctcttagatacaatccgagagaaaggcagctctatgcctgggacgatgggtaccagatcgtgtacaagctcgagatgcgaaaaaaagaagaagaggtgtag

SEQ ID NO: 11007 - DNA, 990 bp, Artificial Sequence
  Description of Artificial Sequence: Synthetic coding sequence
atgcgcccacccccagccctggccttagccggactgtgccttctcgcgctgccggctgctgcagcctcatactttggcctgactggccgagaagtgctcacaccattccccggacttggaaccgcagcggctcctgcgcagggaggagcacacctaaaacagtgcgacctattgaagctcagccgtcggcagaagcaactgtgtcgacgtgaaccaggcctggctgagacattgagagatgcagcacatctcgggctcttggaatgccaattccagttcagacacgagcggtggaattgttcattggagggcaggatgggtttactgaaacgcggattcaaagagacagcattcctttacgccgtgtcttccgctgcacttactcacacccttgctagagcgtgttcagccggaaggatggagcgctgtacatgtgatgacagccctggtttggagtccagacaggcctggcaatggggggtgtgcggcgacaatctgaagtacagcacaaaattcctgtcgaatttcttgggttccaagcggggaaacaaggatctgcgggcacgggcagacgcccataatacccacgtgggcatcaaagctgtcaaatccgggctgagaaccacctgtaagtgccacggagtctcagggagctgcgccgtgagaacttgttggaaacagctcagcccctttagggagacgggccaggtcctgaagcttcgctacgattccgccgtgaaagtgagcagcgcaacgaacgaggcactcggcaggctggagctctgggcccctgctagacaggggtcactgaccaaaggcttagcacctcgctccggagatctagtgtacatggaagactcgccatccttctgccgcccatctaaatattcaccaggaacagcgggatggtctgctgtcgctaggagtcaactgatcacgacgtcaaccagtaggattcaagctatcttgccctcccaactgccggaatag

SEQ ID NO: 11008 - DNA, 579 bp, Artificial Sequence
  Description of Artificial Sequence: Synthetic coding sequence
atgagactggccggtccagaatcttctgttaccgcagcgcctcgagctcgcaagtacaaatgcggtctgccccaaccgtgtcctgaggagcaccttgcattcagggtcgtgtccggggctgcaaatgtgatcgggcctaaaatctgtctcgaggacaagatgctcatgagctcagtgaaagataacgtcggccgaggccttaacatagcacttgtaaacggagtgagtggtgagcttattgaagcacgcgcattcgacatgtgggctggcgatgtgaacgacctgttaaaatttatcaggccgctgcacgagggcactctggtattcgtcgcaagctatgacgatccggctaccaagatgaatgaggagacacgcaagcttttctcagagttgggatcccgcaatgcaaaagagctggcattccgggattcctgggtgttcgtcggagccaagggagtgcagaataaaagcccattcgaacagcacgtgaaaaactctaaacatagcaacaaatatgaaggttggcccgaggccctcgaaatggaagggtgcatcccccgaagatctacagcctcatag

SEQ ID NO: 11009 - DNA, 1053 bp, Artificial Sequence
  Description of Artificial Sequence: Synthetic coding sequence
atgaagtgctccctgcgagtgtggttcctctcagtggcattcctgttggtgtttatcatgtcactgcttttcacatactctcatcacagtatggcaacactcccttatttagactcaggcgcactggacggcacccatagagtcaaattggtgcctggctacgccggacttcagagacttagcaaagaacggttatccggaaagtcctgtgcctgtagacgttgcatgggagacgctggagcttcagactggttcgattctcattttgatggcaacatcagccccgtgtggactcgtgagaacatggatctgccaccggatgtgcagaggtggtggatgatgttgcagccacagtttaagtcccacaatacaaacgaggttctcgagaagctcttccagatcgtgcccggtgagaacccatatagattccgggacccccaccagtgccggcgatgtgccgtggttggcaattccggaaatctgcgcggttcgggatacggccaggatgttgacgggcacaacttcatcatgcgtatgaatcaggccccaacagttggttttgaacaggacgtgggatctaggacaacccaccactttatgtaccccgagtccgctaaaaacctcccggcaaatgtcagctttgttctcgtaccttttaaggtgctggacctcctatggatcgccagcgccttaagcaccgggcagattcgcttcacatacgcccctgtcaagagtttccttcgggtggataaagagaaggttcagatttataaccccgctttttttaagtacatccacgataggtggaccgaacatcacggacggtacccatccaccggcatgctggtcctgttctttgccctgcacgtgtgcgatgaagtaaatgtctatggcttcggcgcagactcacggggaaactggcaccattactgggagaacaataggtacgcaggagaatttcgaaagacaggcgtgcatgatgcagactttgaggcccatatcatagacatgttggcaaaggcctccaagattgaagtgtatcgtggcaattag

SEQ ID NO: 11010 - DNA, 189 bp, Artificial Sequence
  Description of Artificial Sequence: Synthetic coding sequence
atgaaaattcagttgttcttttttattctccatttctgggtgaccatactaccagccagatcgaattttgaaccaaagtaccgctttgagcggtgcgagaaggtccgcggaatctgtaagactttctgcgacgacgtggaatacgactacggatattgtatcaagtggcgcagccaatgttgtgtttag

SEQ ID NO: 11011 - DNA, 738 bp, Artificial Sequence
  Description of Artificial Sequence: Synthetic coding sequence
atgacgctcttcccagtgctgttgtttcttgtggccggtctgctccccagtttccccgcaaatgaagacaaggacccagcatttaccgccctcctaacaactcaaacgcaggtccagcgcgaaattgtgaataaacacaacgaactgcgaagagccgtgtctcctcctgcccgtaacatgctgaaaatggagtggaacaaggaggcagcggcaaatgcccagaaatgggccaaccaatgtaactacagacactccaacccgaaagatcggatgacatcactcaaatgtggagagaacctgtatatgtccagtgctagcagctcatggagtcaggctatccagtcttggtttgatgaatacaacgatttcgactttggcgttggcccaaagacccccaacgcagttgtcggacactacacccaggtcgtgtggtactcgtcgtacctcgtcggatgtggtaacgcctactgcccaaatcagaaagttctgaaatattactacgtttgtcagtactgcccggcagggaactgggccaaccggctttatgtgccctacgagcagggggcaccttgcgcgagctgtccagataattgtgacgacggtctgtgcaccaatggctgcaaatacgaggacctgtactcgaactgcaagtccttaaagctgaccctgacctgtaaacaccagttggtgcgagatagttgtaaagctagctgcaactgctcaaacagtatctactag

SEQ ID NO: 11012 - DNA, 1341 bp, Artificial Sequence
  Description of Artificial Sequence: Synthetic coding sequence
atgctgcaccctgaaactagtccagggagaggacacttactggccgtactgctggcactcttgggtacggcttgggcagaggtctggcctcctcagctccaagagcaggcccctatggctggggctctgaatcgcaaggagtcttttctgctgctaagtcttcacaaccgcctgaggagctgggtgcaaccaccagcagcggacatgcgaaggctagattggtctgactctttggcccagcttgcccaggccagggcggctctatgcggaacaccgaccccctccctcgcctctggactttggcgcacacttcaggtgggatggaacatgcaattactgccggctggactggtgtcctttgttgaagtggtctctctgtggttcgcagagggacaacgatactctcacgcagccggagaatgcgccaggaacgccacctgcactcactacactcagctcgtgtgggccacatcttctcagctcgggtgtgggcgtcatttgtgttctgctggccaggctgccattgaagcattcgtatgcgcctactctccacgcggtaattgggaggtgaatgggaaaactatcgtgccatataagaaaggggcatggtgcagcctgtgcactgcatcagtcagtggatgttttaaagcgtgggaccacgccggtggcctctgcgaggtccctaggaatccatgccggatgtcatgtcagaaccacggcaggctgaacatatctacttgtcactgtcactgcccgcctggctacacaggaaggtattgtcaggtgagatgtagtctacaatgtgtgcacggcagatttcgagaggaagaatgttcctgcgtctgcgacattggctatggcggagctcagtgtgccaccaaagttcacttccccttccatacatgcgatctgaggattgacggagactgtttcatggtcagttcagaggctgatacatactaccgggcacgtatgaaatgtcaacgaaaggggggtgtgctcgcccagatcaagtctcagaaggttcaggatattctggcattctatctgggacggctggaaaccaccaatgaagtgatcgattccgacttcgaaacgagaaatttttggatagggctgacgtataaaacggctaaggactccttccgttgggccaccggcgaacatcaggccttcacttcttttgccttcggtcagccagataatcatgggttcgggaattgtgtcgagctgcaagctagcgctgcctttaactggaatgatcagaggtgcaagacacgcaataggtacatctgccagttcgcacaggaacacatcagccgctgggggccaggcagctag

SEQ ID NO: 11013 - DNA, 585 bp, Artificial Sequence
  Description of Artificial Sequence: Synthetic coding sequence
atgactatgcgacataattggacccccgatctttctcctctctgggtgctgctgctttgtgcccatgtggtgactctgctcgttcgggctacacccgtgagtcaaaccaccactgccgctaccgccagtgtgaggtccactaaagatccttgcccttcacagcccccagtgttccctgccgctaagcagtgccccgctttagaggtcacatggccggaagtggaggttcctttaaatgggactctgtccctcagttgtgtagcctgtagcaggttccctaattttagcatcctctactggcttgggaatggctccttcattgaacacttgccaggccgattgtgggagggcagtacatcccgcgagaggggctctaccggtacccagctttgcaaggctttggtgctggaacagctcacaccagccctgcatagtactaatttctcgtgtgtgctggtcgatccggaacaggtcgtacagaggcatgtggtgctggcccagctctgggcaggactcagagcaacactgcccccaacccaggaagcattgccaagctctcactcatccccccaacagcagggatag

SEQ ID NO: 11014 - DNA, 585 bp, Artificial Sequence
  Description of Artificial Sequence: Synthetic coding sequence
atgactatgagacataattggaccccggatctgtcccccctatgggtcctactgctttgcgcacacgtcgtgactctcctagtaagggcgaccccagtgagtcagacaacaacagcagcaacggcctccgtgcgatcaacaaaagacccctgcccttctcagccccctgtgttccccgctgccaaacagtgccctgctttagaagtcacctggccagaggtggaagtgcctctcaacggtactctttccctttcctgtgtggcctgttctcgctttccaaattttagcatcttgtactggcttggtaacggcagtttcatcgagcacctgcccggtcggctgtgggaggggtctacttcgagggagaggggatcaaccggtacacagctctgtaaagctctggttttagaacagctgacccctgccctgcatagcactaatttcagctgcgtattggtagatccggaacaggtggttcagcgacacgtggttttagcccagctatgggctggattaagagccaccctgccccctactcaagaggccctgccctctagtcatagctccccccagcagcaggggtag

SEQ ID NO: 11015 - DNA, 348 bp, Artificial Sequence
  Description of Artificial Sequence: Synthetic coding sequence
atgaccatgagacataactggacccccgatttgagtcccctttgggtgcttttactgtgtgcccacgtggtgactctgctggtccgtgcaactcccgtcagtcagacaaccacggctgcaaccgcaagcgtccggagcaccaaagacccatgtccaagccagccacccgtgttccccgcagcgaagcagtgccccgcactggaagtgacgtggcccgaagtggaagttcctctcagttgggcagaaggtaatttagcgcctcatcctcggtcacctgctcttcaaccccaacagtccaccgccgctgggttaaggttgtcgacaggccctgcggctgcacagccatag

SEQ ID NO: 11016 - DNA, 528 bp, Artificial Sequence
  Description of Artificial Sequence: Synthetic coding sequence
atgctgccaccaatggcattaccctcagtcagctggatgctactgagttgccttatgttgctttcacaggttcaaggggaagaaccccagcgagagcttccatctgctcgtatccggtgccctaaggggtccaaagcgtatggcagccactgttatgcactctttctttctcccaaatcttggaccgatgcggaccttgcctgccagaagcggccatctggcaatctggtgtccgtcctatccggcgctgaaggcagtttcgtgtcgagtttggtgaagagcattggaaatagctactcatatgtgtggattggtctgcacgatccaacacagggtacagagccgaatggggagggttgggagtggtctagtagcgatgttatgaactactttgcctgggagcgcaaccctagcaccatttccagtcccggacattgcgcaagcctgtctaggagcactgctttcctgcggtggaaggactacaactgtaacgtgcggcttccttatgtttgcaagttcactgactag

SEQ ID NO: 11017 - DNA, 993 bp, Artificial Sequence
  Description of Artificial Sequence: Synthetic coding sequence
atgggcaaattgtgtcttgggccaaccctgtgccctgccgcagccgctgaggagtcccgggatgctgagcccaggcgagagttactctgttctggccgtccttggacctggcgcgcagctgcacgcgtgaccactatgattccatgggtactgctcgcatgtgcactaccctgtgccgcagacccactgttgggggctttcgccagaagggattttagaaaaggtagccctcagctcgtatgcagtctgccaggcccacagggccctcccggaccacctggcgctcctggaccctctgggatgatgggcagaatggggtttcctggcaaggacgggcaagacggccacgatggcgaccgcggtgactctggagaggaaggccctcctggtcgcactgggaatcgcggtaagccgggacccaaaggcaaggctggggctattggacgcgctggaccgcgagggccaaaaggggttaatggaacacccggaaaacatgggacgccaggtaagaagggcccaaaaggaaagaaaggagaaccaggactgcccggaccatgcagttgcggctccggccataccaagtcagctttcagcgtggctgtcactaaatcttacccccgagagagacttccaattaaattcgataagatactgatgaacgagggcggtcactacaatgcctctagtgggaagttcgtgtgtggagtcccagggatatattacttcacatatgatatcacgctggcaaataaacatttggccattggattggtgcacaacggccaatatcgaatccggacatttgatgcaaacactggtaaccatgatgtcgcgtctggaagcactattctcgccctaaaacagggagatgaggtttggttacagatcttttactccgaacaaaacggcctgttctacgacccctactggactgactctcttttcactgggttccttatttatgcagatcaggacgatcccaacgaagtttag

SEQ ID NO: 11018 - DNA, 390 bp, Artificial Sequence
  Description of Artificial Sequence: Synthetic coding sequence
atgcgactcctgctgcttgtacccctcttgcttgcacccgctccgggatcgagtgcccctaaagtgagaagacaaagcgacacctggggcccatggtcccagtggtctccttgtagccgcacttgtgggggaggtgttagcttcagggagaggccttgttattctcagagaagagacggcggtagctcctgtgtaggaccggcacgctcacacaggagttgtcggaccgagagctgtcccgacggcgctagggacttccgggcagaacagtgtgctgaattcgacggcgcagaatttcagggaagacggtatcgctggctcccgtattactctgccccaaataaatgcgaactgaactgtattccgaaagggctcgggttgcagggttag

SEQ ID NO: 11019 - DNA, 1227 bp, Artificial Sequence
  Description of Artificial Sequence: Synthetic coding sequence
atgttctccaatgcaaacagtagaagcaaaatgtggctgctgctgacaatggcctccttgatcagcgtcctggggactacccatggcctgttcggaaagttgcaccctggaagcccagaagtgactatgaatatctctcaaatgattacctattggggataccctaacgaggagtacgaagtggttacagaggacgggtatatcctggaggtaaatagaattccatacggcaagaagaactctggcaatactggacagcgccctgtggtgttcttacagcacggtttacttgctagcgcgaccaattggatttccaacctgcccaacaactcgttagcttttatccttgcagatgctggctatgacgtctggttggggaactcaaggggcaatacatgggcgagaaggaatttgtactattcccctgattccgttgaattttgggctttcagctttgatgagatggctaagtacgatcttccagcaactatcgattttatcgtaaaaaaaaccggccaaaaacagctccactacgtgggacactctcagggaaccaccatagggtttatcgccttctcaaccaacccatcactggccaagaggatcaaaactttctacgcattagcacctgtggccaccgttaaatacactaaaagcctgattaacaaactgcggtttgtcccacagagcctgtttaagtttatttttggcgacaagatcttttatccccataatttctttgaccagtttttagcaacggaggtgtgctcgagagagatgttaaatctgctgtgttcaaatgcactcttcatcatctgtggctttgacagtaagaatttcaatacaagtagactggacgtatatcttagtcataatcccgctggcacaagcgttcagaacatgtttcattggacgcaggctgtgaaaagcggtaaatttcaagcctacgattgggggtcgcccgtccagaacaggatgcactatgaccagagccagccaccttactacaacgtcaccgccatgaacgtacccattgccgtatggaatggcggaaaagatttgctggcagatccacaggatgttgggctgctgctgcccaagctccctaaccttatttatcataaagaaattcccttctacaaccatttggacttcatctgggccatggatgcaccccaggaagtctataatgacattgtgagcatgatatcagaagataagaagtag

SEQ ID NO: 11020 - DNA, 393 bp, Artificial Sequence
  Description of Artificial Sequence: Synthetic coding sequence
atggcatctgatttgatcaggactatactcgccgttgcactcatctccaagttggggactgccgtggacgccgagctgatgcctagtggggctattctgcagaataaacgcgaaaacttacccagagtgtgccatgcccttgcttttttggggatggcaagatgtcaggacctgttcctcgtccggctgcagggttggaaactaggaacgcggttccaggatgggcctagatccaccccccaggaggaaggcggatcccctcaacgcaagaggggcatgcccgtgcagatccactttcttctcaagtcattcctgtcttctccaattaccttcgccttcataagtctagccagaaccgttagtcttgccacagctatctgtaagattgtctag

SEQ ID NO: 11021 - DNA, 393 bp, Artificial Sequence
  Description of Artificial Sequence: Synthetic coding sequence
atggcttcagatctcatcaggacaatcctcgcggtggctctgatttccaagctcgggacagccgtcgatgcggagctcatgccctcaggcgctattctccagaataagagagagaatctccctcgcgtctgccatgcactggctttcctggggatggcccgatgccaggatttgtttctcgtcagacttcaggggtggaagctcgggacacgtttccaggatggcccaagaagcacgccgcaggaggaaggtgggagccctcagcgcaagaggggaatgcccgtccagatccattttcttttgaaaagtttcctgtctagtccaattaccttcgcgttcatttccctggcacggaccgtaagcctggccaccgcgatttgcaagatcgtgtag

SEQ ID NO: 11022 - DNA, 1731 bp, Artificial Sequence
  Description of Artificial Sequence: Synthetic coding sequence
atgatcgtcttcgggtgggctgtgtttttagctagccgctccctcggacagggcctgctactgacacttgaagagcacatagcccacttcctcgggaccggtggggctgcaacaacgatggggaattcatgtatctgcagggacgattcaggaacggatgattccgtggacacacagcagcagcaggccgagaattccgctgtgccgacggctgacacgagatctcagccacgggaccccgttcgacctcccagaaggggcaggggcccacacgagcctcgtaggaagaagcaaaacgtcgacggcctggtgttggataccctggctgtgattcgtactttggtcgacaacgaccaggagcccccatactccatgatcaccttacacgaaatggccgaaacagacgagggatggctggatgtcgtgcagtcgctcatccgcgtgatccctttagaggatcctctgggacccgcagtcattaccctgctgttggacgaatgcccactccccaccaaagatgcgctacagaaactgacagaaatcctgaacctgaatggggaggtggcctgccaggattccagccaccctgctaaacatcgaaacacatcagccgtgctaggttgccttgccgaaaagttagccggtcctgccagcatcggactcttgagtcccggtatacttgagtacttgctgcaatgtctgaaactgcagtcccaccctacggtgatgttgtttgccctaattgcccttgaaaaatttgctcagacatccgagaataagcttaccatttccgagagttctatctccgatagactggtgactttggagtcctgggctaatgaccccgattacctcaagcgccaagtggggttttgtgcccagtggtctcttgataacctcttccttaaggagggccgtcaattgacttatgagaaagtgaacctgagtagtattagggcaatgctcaactctaatgatgtatctgagtatctgaagatttcaccgcacggcctagaggcaagatgcgatgccagcagcttcgagtcagtaagatgtaccttctgcgttgacgccggagtctggtactatgaagtaaccgtcgtcacatctggagtgatgcagattggctgggccacccgagattcaaaattcctcaaccacgagggctatggcattggtgatgatgaatattcttgcgcttacgatggttgcaggcagctgatctggtataatgctcgctccaaacctcacatccatccttgctggaaggagggagacacggtggggttcttgcttgacctcaacgaaaagcaaatgatcttcttcctaaacggaaatcagctgcctccagaaaagcaggtcttcagcagcacagtgtcaggatttttcgcggcagcttcattcatgtcatatcaacaatgtgaattcaatttcggtgccaagcctttcaagtatcccccttcaatgaagttctccaccttcaatgattatgctttcctgacagctgaagagaagatcattctccctaggcaccgccgtcttgctctgcttaagcaagtttctatacgggagaattgctgttctctatgctgtgacgaagtcgccgacacacagcttaagccatgtggacattcggatctgtgtatggattgtgccttgcagctggagacttgccctctctgccgcaaggaaatcgtctctcgtatacgccagattagtcacatctcgtag

SEQ ID NO: 11023 - DNA, 360 bp, Artificial Sequence
  Description of Artificial Sequence: Synthetic coding sequence
atggcgcgacccggtatggagcggtggagggacaggttagcactggttaccggagccagcggcggaatcggcgctgcagtggcaagggccttggtccagcagggtttgaaggtggttggatgtgccaggactgtcgggaacatcgaagagctggccgctgaatgtaagtccgctggataccctggcaccctgatcccttaccgctgtgatttgtctaacgaggaggacattctgtccatgttttccgccatcagaagccagcacagcggagtagatatctgcatcaataatgccggattggctagacctgacacactattgagcggttctacaagtggatggaaggacatgtttaattag

SEQ ID NO: 11024 - DNA, 144 bp, Artificial Sequence
  Description of Artificial Sequence: Synthetic coding sequence
atgcaagtttcaactgctgctctggccgtcttactctgtaccatggctctgtgcaatcaggttctttccgccccacaggctgggaggagtgtgctcacgcctgtcagatccgggagccgaaataccagcgtgacctggagttag

SEQ ID NO: 11025 - DNA, 159 bp, Artificial Sequence
  Description of Artificial Sequence: Synthetic coding sequence
atgcaggtctcaacggccgctctcgccgtgctgttgtgtaccatggccctttgtaaccaggtgctctcagcccctttgagccgaccacgagaggcaggcaggagcgtgcttacacccgtgaggtctggctcacgaaatacctcagttacttggtcttag

SEQ ID NO: 11026 - DNA, 1272 bp, Artificial Sequence
  Description of Artificial Sequence: Synthetic coding sequence
atggaattagagcttatgccattcaatgtcctgttaagaacaacactggacctgttacaagaaaaggaccctgcccatatttttgcggagccagttaatctgagtgaagtgcctgactatctcgagttcattagtaagcccatggattttagtactatgagacggaagcttgaaagccatctatataggactctggaggaattcgaagaggacttcaacctaatcgtgaccaactgtatgaaatataatgcgaaggataccatttttcaccgagcggcagtacgattgagagacctcggcggtgccatcctgagacacgcccgacggcaggccgagaacatcgggtacgatcccgaacggggaacacacctgcctgaatcacccaagctcgaagatttctaccggtttagctgggaagatgtggataatatcctcatcccagaaaatcgggcacatctgtcccctgaggtgcagctgaaagagctcctcgaaaagttagatctcgtgagcgctatgaggtcatcaggagccaggacacgacgcgtgcggctcctcagacgggagatcaatgcacttcgacagaagctcgcccagccgccacccccacagcctccaagccttaataagaccgtgtccaacggggagctaccagctgggccacagggagacgccgctgtgcttgaacaagctcttcaagaggagccagaggatgatggtgatcgagatgacagcaagctacctcctccacctaccctcgagccgacaggacccgcaccttctctgtccgagcaggagtcgcccccagagcctccaacgctgaagcccatcaacgatagtaaacctcctagcaggttcctgaaaccacgcaaggtcgaggaggatgagttactagagaagagtccactgcagctcggcaacgagccgcttcagagactcttgagcgacaacggcatcaatcgtttgtctctcatggccccagataccccagccggaactcctctctccggcgttggcagaaggacgagtgtcctgtttaagaaagctaagaacggagtaaagctccaacggtctcccgatagggtgctggagaatggcgaggaccatggggtggcagggtctcccgcaagccctgctagtattgaagaggagaggcacagtcgcaagcggcctcgtagtagatcctgcagtgagagcgaaggcgagaggtcaccccagcaagaggaggagaccggaatgacaaacgggttcgggaagcaccgcaagagagtctag

SEQ ID NO: 11027 - DNA, 3030 bp, Artificial Sequence
  Description of Artificial Sequence: Synthetic coding sequence
atgggtagcggccgagtccccggactatgcctactggtgctgctagttcacgcacgcgctgcacagtattctaaggcagctcaggacgtggatgaatgtgtggagggaaccgacaactgccatatcgatgcgatctgccagaacaccccacggagttacaaatgcatttgcaaaagcggttatacgggcgacgggaaacattgcaaggacgtggacgagtgcgagcgcgaggacaacgccggatgtgtacacgactgtgttaacataccagggaactacaggtgcacctgttacgacgggttccatctcgctcatgacggccacaattgtcttgatgtggacgaatgtgccgaaggcaacggtggttgccagcagtcttgtgttaatatgatgggcagctacgagtgccattgtcgcgaaggcttcttcttgagcgataatcaacacacctgtatacagcggcctgaagagggcatgaattgtatgaacaaaaatcacggctgcgctcacatatgccgtgagactcctaaggggggtattgcgtgtgaatgtcggccagggtttgaacttaccaaaaaccagagggattgcaagctcacatgtaattatggaaacggcggttgtcagcacacatgtgacgatacggaacagggtcccagatgtggctgccacatcaaatttgtactgcacaccgacggaaagacctgcatcggcgagaggcggttggaacagcacatccctacacaggccgtgtcaaacgagacctgtgccgtcaataacggcggatgtgactcaaagtgccacgatgccgcaacgggtgttcattgtacttgccctgtagggttcatgttgcaacctgaccgtaagacctgtaaagacatcgacgaatgccgacttaataacggtggctgtgatcacatctgtagaaataccgtcggttcattcgaatgttcttgtaaaaaggggtacaagctgctgataaacgaacgcaactgccaggacatcgacgaatgctcatttgatcgcacctgtgatcacatctgcgtgaacacacccggttcctttcagtgtttgtgccacaggggttacctcctgtacgggatcacacattgtggcgacgtcgatgagtgttcaataaatagaggcggatgccgcttcgggtgtattaacacacccggaagctatcagtgcacatgcccagccggacagggaagattacactggaatggcaaggactgcaccgagccgcttaaatgccagggaagccctggggcatccaaagcgatgctcagctgcaatcgttccggaaagaaagacacctgcgctttaacttgcccctctcgggcacgcttcctcccagaatcggaaaacggatttactgtgtcttgcggcacccctagcccgagagcagccccagcgagggccggtcacaacggcaattcaaccaattcaaaccattgtcatgaagcagctgtgctctccataaaacagagggcatcttttaagattaaagacgcaaagtgtcgactgcatctgcggaataaggggaaaaccgaggaagccggaagaatcacaggtccaggtggggctccctgctctgagtgccaagtgacttttatccatctcaagtgcgattcctcccgaaagggcaaaggtcggagggcgaggacaccacctgggaaggaagttacacgtctgacactcgagctggaagccgaggtacgggcagaggaaaccaccgcttcatgcgggctgccatgtctcagacaacggatggagaggcggctgaaggggtccctcaagatgctgaggaaaagtattaatcaagaccggttcttattgcgcctggcgggacttgattatgagctggcccacaaaccaggcttggtagccggagagagagcggaacccatggaatcatgccggccaggacaacatcgcgcagggacaaagtgtgtgagctgtcctcaggggacatattatcacggccaaactgagcagtgtgtaccctgccctgctgggacctttcaagagcgtgagggtcagctgtcttgcgacctgtgtcccggatccgacgcacacggtcctctgggcgcaaccaacgtaaccacgtgcgctgggcaatgtccaccgggtcaacactcggttgacgggttcaagccctgtcagccgtgtcctcgcggaacataccaaccagaagcgggacgcacgttatgctttccttgtgggggtggactcacaaccaagcatgagggcgcaatctcattccaggattgcgacactaaagtgcaatgctctccaggccattactacaacactagcatccatcgttgtatacgttgcgccatgggtagctaccagcccgattttcgtcagaacttttgctctagatgtccagggaacacttcaaccgattttgacgggtccacgtcagttgcacagtgcaagaatagacagtgtggcggagagttgggggagttcacggggtacatcgagtcccccaactacccaggcaactacccagcaggggtcgaatgtatatggaatatcaacccaccccctaagcggaagatactcatcgttgtgcccgaaatttttctgccgagtgaagacgagtgcggggatgtactggttatgcgaaaaaactcatcaccctctagcatcacgacttacgaaacttgtcagacctacgaacggcctattgccttcaccgctcgatctcggaagctgtggattaatttcaaaacgagcgaagcaaatagcgccagaggttttcagattccttatgtcacctacgacgaggattatgagcagttggtggaggacattgtaagagatggtcggctttacgccagtgagaaccaccaagagatccttaaagataaaaaactgattaaggccttctttgaagtattggcacaccctcaaaactattttaaatataccgagaagcacaaagagatgctgccaaaatcgtttattaagcttctgagatcaaaagtgtcttcctttctcaggccttataaatag

SEQ ID NO: 11028 - DNA, 984 bp, Artificial Sequence
  Description of Artificial Sequence: Synthetic coding sequence
atgacagctctagagctcgcacgacgaggcgctcgagtcgtgctggcatgtagatctcaggagagaggcgaagctgctgcattcgatctgcggcaggagtcaggaaacaatgaggtcatcttcatggcgctcgatctagctagcctggctagcgtcagggcattcgcaactgcctttctttcttcagagcccaggctcgacatcctgattcataacgctggcatctcttcttgtgggagaacacgcgaggctttcaacttgctcctgcgggtcaatcacatcgggccatttttactgacccatttgttgctaccctgcctgaaggcatgtgccccatcccgggtggttgtagtggcaagtgctgcacactgtagagggaggctggatttcaagcgacttgacaggccagttgttggatggaggcaagaattacgagcttatgcagacacaaagctcgctaatgtcctattcgcgcgagaattggctaatcagctggaggctacaggtgttacatgctatgccgctcaccctggccctgtgaactccgagctgttcttaagacatgtgcccggatggctgagaccactgctcagaccacttgcttggctcgtgctgcgcgctccaaggggtggtgcccagactcctctgtactgtgctctccaagagggcattgagcctctgtcaggcagatacttcgccaattgccacgtggaggaagtcccaccagcggctcgggatgatcgtgccgcacatcggctgtgggaggcaagcaaaaggctggcaggcctcggtcctggcgaggacgcagagcccgatgaagatcctcagtccgaagactccgaggcaccgtcaagcctatccaccccccaccccgaggaacctacagtgagtcagccctacccatcgccacagtcttcccccgatcttagtaagatgacgcatagaatccaagctaaggtggaaccggaaatccagctctcctag

SEQ ID NO: 11029 - DNA, 1320 bp, Artificial Sequence
  Description of Artificial Sequence: Synthetic coding sequence
atgccagctatcgccgtactggcagccgcagcagctgcctggtgttttctgcaggtggagtcaaggcatttggacgcattagcgggaggcgcaggacccaaccacggaaactttctggataatgaccagtggcttagtaccgtgagtcagtacgatcgcgacaagtactggaaccgattccgtgacgacgactacttccgcaattggaatcccaacaaaccatttgatcaggccctggatccgtccaaggatccctgtctgaaggttaaatgttcacctcacaaggtctgtgtcactcaggactatcagacagccctctgcgtaagtaggaaacaccttctcccgagacagaagaagggaaatgtcgctcagaagcactgggtaggcccatctaatttggtgaaatgtaaaccatgtccagtggcccaatcagccatggtgtgtggctctgatggacactcttacacttccaagtgtaaacttgaatttcatgcgtgctcaaccggaaagtccttagctacactgtgtgacggcccatgtccctgtttacccgagccggaacctcctaaacataaggctgagagaagcgcatgcacagacaaggaactgcggaacctcgccagtcggctgaaagactggtttggcgcactgcacgaggacgccaatagagttatcaaacccactagctcaaatacggcacaaggaagatttgacacctctatcttacctatctgcaaggatagtctgggctggatgtttaacaaactcgacatgaactatgatttgctgttggatccttcggagatcaatgctatttatctggataagtatgagccatgtatcaagccgctgtttaactcctgcgacagttttaaggacggaaagctctccaataatgaatggtgctactgtttccagaaacccggtggattgccttgtcaaaacgaaatgaataggatccaaaagctctctaagggaaagtccctcctgggtgcctttatccctcggtgtaacgaagagggctactacaaggctactcaatgtcacggatccactggacagtgttggtgtgtagacaaatacgggaatgaactcgcaggttctaggaagcaaggcgcagtcagctgtgaggaagaacaggagacttcaggcgacttcgggagcggtgggtcggtggtcctactggatgacttggagtatgagagggagctgggccctaaggacaaagaagggaagctccgggtgcacacaagagctgtaactgaagatgatgaggatgaagacgacgacaaggaagacgaagtaggctacatttggtag

SEQ ID NO: 11030 - DNA, 3687 bp, Artificial Sequence
  Description of Artificial Sequence: Synthetic coding sequence
atgaaaggcgcaagactgtttgtccttctgtccagcctgtggagcggtggcattggcctcaacaacagtaagcactcgtggacaattcctgaggatgggaattcacagaagactatgccaagcgccagtgttcctcctaacaagatccaatcacttcaaatcttaccaacaacacgcgtcatgagcgctgagatcgccactaccccagaagcacgtaccagcgaggatagccttctaaaaagtacccttcccccaagcgagacaagcgctccagctgagggcgtcaggaaccagactcttaccagcactgaaaaagctgagggcgttgtcaagctgcaaaatctcaccctgcccactaacgcttccatcaaatttaaccccggtgccgagagcgtcgtcctttccaactccacactgaaattcctgcagagcttcgccagaaagtcaaacgaacaagccacctcgctaaataccgtcgggggtacaggaggtatcgggggagtcggcggtacaggcggagtgggaaacagggctccacgggaaacctaccttagcagaggtgactcctccagttcacagcgcactgactaccaaaagagtaattttgaaactactcggggaaaaaactggtgcgcttacgtccatactaggttgagccccacagttattcttgataaccaggttacgtacgtgcctggcggaaaaggcccatgcgggtggaccgggggaagttgccctcaacggagccaaaagatctccaacccagtttatcggatgcaacataaaatagtgacaagcttagattggagatgctgccctggatactctgggcctaagtgccagctccgggcacaggagcagcaatctctgatacacactaaccaggccgagtcacacacagcagtggggaggggcgttgcagagcagcagcaacagcagggatgtggcgaccccgaagtgatgcagaagatgaccgatcaggtgaactaccaggcgatgaagttaactctgctccaaaaaaaaatcgataatatctccctgactgtgaacgatgtcagaaatacctattcgagcctggagggcaaagtatctgaggacaaatcaagagagtttcagagtctgctgaaaggcttgaaaagtaagtctatcaatgtgcttataagggacatagtccgcgagcaattcaagattttccagaatgacatgcaggagacggtggcacaattgttcaaaacagtcagcagcctttccgaagatctagagtcaactaggcaaatcattcagaaagtgaatgagtcagtcgtctcaatagctgcccagcaaaagttcgtgttagtacaggaaaatcggccaacccttaccgacatagttgaacttcgtaatcacatcgtgaatgtccgccaggagatgacactaacctgtgagaaaccaattaaggaattagaggtgaaacagactcatctcgaaggggcactggaacaggagcattctcgatctattctgtattacgagtctctcaacaagaccctaagcaagctgaaggaggtgcatgagcagctgttgtcaacggagcaggtttctgatcagaaaaatgcccctgcagctgaatccgtgtctaacaacgtgactgagtatatgtccaccttgcatgaaaatattaaaaaacagtcccttatgatgctgcagatgttcgaagatttacacatccaggagtcgaaaattaacaatctgacagtgagcctggaaatggaaaaggaaagcctccgaggggaatgcgaagacatgctaagtaaatgcagaaatgacttcaagttccagctcaaggacactgaggagaacctacacgtgctgaatcaaacgctcgcggaagtgctgtttcctatggacaataagatggataagatgtcagaacaattgaatgacctcacatacgacatggagatcctgcagccgctcctggagcagggagcttctctgcggcaaacgatgacctatgagcaacccaaagaggcaattgttatccgtaagaaaatagagaatctgacatctgctgtcaatagcctgaatttcataattaaagaattgactaagaggcacaacctgttacggaatgaggtgcagggcagagatgatgcattggaaaggaggattaatgagtacgcacttgaaatggaagatggtttgaacaagactatgactattatcaataacgcaattgactttattcaggataattacgcactcaaagaaactctgtcaacaatcaaggacaacagcgaaatccaccataaatgtacgagcgatatggagaccatcctcaccttcattcctcagttccacagactcaatgacagtattcagacgctagtgaacgacaatcagcggtataactttgtgctgcaggtagctaagacactggcagggatcccacgtgacgaaaagctgaaccagagtaattttcagaaaatgtaccagatgtttaatgagactacctcacaggtgagaaaatatcaacaaaacatgtcccacctcgaagaaaagcttctactgaccaccaaaatatctaaaaattttgagacacgcttacaggatatcgagtctaaggtcactcagacactgattccctactatatttctgtgaaaaaggggagtgtggttacaaacgagagagaccaggcactgcagcttcaggttctcaatagcagatttaaggccctcgaggccaaaagcatccacttgtccataaactttttttccctgaacaagacacttcatgaggtgctgactatgtgccataacgcctcgacttccgtgagcgagctgaatgccaccatccccaaatggataaagcacagtttaccagacattcaactgttacaaaaaggactgacagagttcgtggaacctattatccagatcaagacgcaggcggcattgtcgaatcttacctgctgtatagatcggtccctgccaggctctctcgccaatgtggtgaaaagccagaagcaggtgaagtcattgccaaagaaaattaacgctctcaagaagcccacagttaacttaacaacggtgttgattgggaggacacagagaaatactgacaatatcatatatcctgaagagtactcttcttgcagccgacacccgtgccagaacggagggacttgcatcaatgggagaacatcgttcacttgcgcctgcagacatccattcaccggcgacaattgcaccattaaactcgttgaggaaaatgccctagccccagatttttcgaaagggtcttaccgctacgcaccaatggtggccttttttgcatcccacacttacgggatgaccatccccggacctatcctgttcaataacctggatgtgaactatggcgcaagttatactccacggactggaaagttcaggattccatatttgggtgtgtatgtgttcaaatatacaattgaatctttttctgcacacatctctgggttcttggtcgtcgacggcatagacaagctggcatttgaaagcgaaaacatcaatagtgagattcattgtgatcgcgtgttaaccggcgacgcacttcttgaactcaattatggtcaggaagtctggctgcgactagcgaaagggaccatccctgctaagttcccaccggtcactacgttttccggttatctcctttaccgcacatag

SEQ ID NO: 11031 - DNA, 1596 bp, Artificial Sequence
  Description of Artificial Sequence: Synthetic coding sequence
atgaaaggcgcacggttgttcgtgctgctttctagcctgtggtcagggggtataggactcaacaactctaagcactcttggacaataccagaggacgggaacagccagaagaccatgcctagcgcttctgttcctccaaacaagattcagagtctgcagatcctgccaacaaccagagtgatgtcagcggaaatcgccactactcctgagaaggccgaaggtgttgtgaaacttcagaatctgacgctgccaaccaatgcttctataaagtttaatccaggtgccgaatccgtggtgctttccaatagcacgctcaagtttctgcagtctttcgcgcgtaagtctaacgagcaggccacctctctaaatacggtggggggtaccggaggcatcgggggtgtcgggggaacaggcggtgtgggcaatcgagcaccccgtgaaacctatctctctcggggagactcatcctccagtcagaggaccgattatcagaagtccaactttgagacaacccgcggtaagaattggtgtgcttatgtgcatacacggctgtctcccacagtgattctggacaatcaggtcacctatgtacccggtggcaagggaccctgcggctggactggaggctcctgcccgcagcgatcccagaagatttctaacccagtctatagaatgcaacacaagatcgtcacatctcttgattggcgttgctgtccagggtattccggaccaaaatgtcagcttagagctcaggaacaacagagtctgattcacaccaatcaggccgagtctcacacagcagtgggccgaggagtggccgagcagcagcagcagcagggctgtggcgaccccgaagtaatgcagaaaatgaccgaccaagtcaactatcaagcaatgaagctgacgttgcttcagaaaaaaatcgacaacatttctctgaccgtcaacgacgttcgcaacacgtactcttccttagagggtaaggtgtccgaggataaaagcagggaattccagagtctactgaaggaggaatacagctcatgttcacggcacccctgccagaatggaggtacttgcatcaatggccgtactagcttcacttgcgcatgtcgccatccttttaccggcgataattgcacaatcaagctagttgaggaaaatgccctggctccagacttttccaaaggcagttacaggtacgccccaatggtggccttcttcgcttcccatacgtacggcatgactatccccggtcctatcttattcaataatctggatgtcaattatggggcatcctataccccgaggacaggcaaattccgcatcccatacctaggcgtatacgtgtttaaatacaccatcgaatcctttagtgcccacatttcaggattcttggtggtggacgggatagacaagctcgcgttcgagagcgagaatataaattcagagattcactgcgaccgcgtattgacaggtgatgctttgctcgagttaaactacggtcaggaggtctggctcagactcgctaaaggcactatcccggctaagttcccaccagttactacattttcaggatacctgctttatcggacctag

SEQ ID NO: 11032 - DNA, 942 bp, Artificial Sequence
  Description of Artificial Sequence: Synthetic coding sequence
atgagcgatttactgctgctgggcttgataggcggtttgacactgcttctcttgttgaccctgttagctttcgcaggatattccggtttgctcgccggagtagaggtgagtgcaggtagcccccctattaggaacgtaacagtggcgtataaattccacatgggactgtatggagagacagggagactgtttaccgagagctgctctatctcccctaaacttcgcagcattgccgtttattacgataatccgcacatggtgccgcctgacaagtgcagatgtgcagtgggatccattctgagcgagggcgaagagagccccagcccggagttaattgacctgtaccagaagttcggatttaaagtgttctcatttcccgcaccctcacatgttgtcactgcaaccttcccatatacgacaatcctgagcatctggctggcaacccgccgtgtgcatcccgcactggatacatacattaaggaaaggaaattatgtgcctatcccagactggagatttatcaggaggaccaaatccactttatgtgtcccttggcccgacaaggagacttttacgtgccagagatgaaggagacggagtggaaatggagggggctggtggaggccattgacacacaggtcgatggcactggagcggatacaatgtccgatacctcatccgtttcactcgaagtgtcccccggtagtcgcgagacgtccgccgctacattaagccctggtgccagcagccgcggttgggacgacggagatactcggagcgagcatagctattcggagtctggcgctagcggttcctccttcgaggaactcgacctggaaggagaggggccactgggcgagtcccggcttgaccccggaactgagcccctcggaactactaagtggctgtgggagccgacagctcctgagaaagggaaggagtag

SEQ ID NO: 11033 - DNA, 834 bp, Artificial Sequence
  Description of Artificial Sequence: Synthetic coding sequence
atgtgcacagttgtggatccgagaatagtgcgcaggtatttgctcagacggcaactgggccagggggcatacgggattgtgtggaaggcagtagataggagaacgggagaagttgtggcaatcaagaagatcttcgatgccttccgggacaagacagatgcccagagaacgttccgggagatcaccctgctgcaagaatttggagaccaccccaacatcatcagcctgctcgatgtgatcagagctgaaaacgatcgggatatttacctagttttcgagttcatgggctgccctccttctcctccccctcccaccgcggtgcgcacgttgtcagcagataccgatcttaacgcagtgattcgaaagggcggtctgctgcaggacgtgcacgtcagaagcatcttctaccagcttctccgcgctactcggtttttacattcaggtcatgtcgtgcaccgggaccagaaaccaagcaatgtactgttagacgcaaactgcacggttaagctgtgtgactttgggcttgccagaagtctcggcgatctgcccgagggtccagaggaccaagcggtcacagagtatgtggcgacacgttggtaccgagcgccagaggtgctgctcagttctcaccggtataccctcggggtggacatgtggtccttggggtgcatcctgggggagatgctgcgcggaaggcctctcttccccggaacctcaacattacatcaactggaactcatactggagacaataccacccccttctgaggaagacttactcgctttgggatctggttgtcgggcatcagtactgcatcagttgggctctaggtag

SEQ ID NO: 11034 - DNA, 765 bp, Artificial Sequence
  Description of Artificial Sequence: Synthetic coding sequence
atgtgtaccgtagtagatccccgtatagttcgtagatatctactgaggcggcaattggggcagggcgcatacggcatcgtttggaaggcagtggatcgtcgtaccggggaagtggtcgccattaagaaaatttttgatgccttcagagacaaaacggatgcccagaggactttccgagaaatcacacttctgcaggagttcggcgaccaccccaatatcatctctctgctggatgtcatcagagcagagaacgatcgggatatctacctggtgttcgagttcatggataccgacctgaacgcagttatcaggaagggcggactcctgcaggatgtccatgtgcggtcgatattctaccagctgctgagagcgactcggtttttacatagcggacacgtcgttcatcgggaccaaaaacctagcaatgttctgcttgacgccaactgtacggtgaagctttgtgactttgggctggctcgctctcttggcgaccttcccgaaggccctgaggaccaggccgtgacagaatatgtagccactcgatggtaccgcgctcccgaagtgctgctttcctcgcaccgttatactcttggcgtggacatgtggtccctcgggtgcatacttggagagatgttgcgaggccgaccactcttccccggaactagcaccctgcaccaactggaacttatcctggagactatccccccaccatccgaggaaggagcacaaactgcctgtagatccggaaccggggcttctacatag

SEQ ID NO: 11035 - DNA, 474 bp, Artificial Sequence
  Description of Artificial Sequence: Synthetic coding sequence
atggccctcctcctgtgcttggtatgcctgaccgctgcactggcgcacgggtgtcttcactgtcactcaaatttctcgaagaagttctcattctatcgacatcacgttaactttaagtcgtggtgggtgggtgatattcccgtttctggcgctttgctgaccgactggagcgatgataccatgaaggaactgcacctcgctattccagctaagattacgagagaaaaactagaccaggtcgcgacagccgtctaccagatgatggatcagttgtaccagggcaagatgtacttccccggatatttccccaatgagttgcgtaacatttttagagagcaggtgcatctgatccagaatgctatcattgagaggcacttggcaccagggagctgggggggaggccagctatcccgggagggtccatctcttgcgcctgaaggctcaatgccctccccacggggtgatttaccctag

SEQ ID NO: 11036 - DNA, 699 bp, Artificial Sequence
  Description of Artificial Sequence: Synthetic coding sequence
atggccctcctgctgtgtttggtgtgcctaaccgccgctctcgcccacggctgtctacattgccatagcaattttagcaaaaagtttagcttctatcggcaccatgttaactttaagtcttggtgggttggggatattcctgtatccggagccctgctgacggattggtctgatgatacaatgaaagagctacacttagccattcctgcaaaaattacccgagagaagctggatcaagtcgccacagcagtgtatcagatgatggatcagctttaccaaggcaaaatgtacttcccaggttacttcccaaatgaacttaggaatatctttcgtgaacaggtgcatctgattcaaaacgcgattattgagagtaggatcgattgtcagcatcgctgcgggatcttccagtatgaaacaatttcttgtaataactgcactgacagccacgtggcgtgctttggctataattgtgaaagctcagcccagtggaagtccgctgtgcagggactgctgaattatatcaacaattggcataagcaagatacatcaatgagacccaggtccagtgccttcagttggcctggaactcaccgggcaaccccagcctttctggtgagccctgccctcaggtgcctcgagcctcctcacctagcgaacctgactctggaagacgcagctgagtgtctgaaacaacattag

SEQ ID NO: 11037 - DNA, 396 bp, Artificial Sequence
  Description of Artificial Sequence: Synthetic coding sequence
atggggggtgacggaaggtacgtccttaatggccattgggtggtgtcccccccaggaacatacgaggcagccggtacgcacgtggtctacacccgcgatacgggacctcaggagacactgcaggcagctggtcctacgagtcacgacctattgttacaagtcctcttacaagaaccgaaccccggtattgagtttgagttttggctaccgagagagcggtactctcccttccaagccagggttcaagcgcttggttggcccctgcggcagccccagccccgtggcgtggagccacagccccctgccgctccagccgtgactcccgctcaaactccaactctggctcctgggccaagcgctgggccacctcctcctggacccggtgatccactttag

SEQ ID NO: 11038 - DNA, 447 bp, Artificial Sequence
  Description of Artificial Sequence: Synthetic coding sequence
atggccagaattcccacggctgcccttggttgcattagtttgctgtgcctccagctacctgggtctctgtctagatccttaggaggagatccaaggcccgtgaagcctcgggagcctcccgctcgatccccttccagctcgctacagcctagacacccagcaccgcgtccagttgtatggaaactgcatcgtgccctgcaagcccagaggggtgctggcctcgcacccgtgatgggccagcccctacgcgatggtgggcgtcagcacagtggtccgaggcgccactccggaccacgcagaacccaggcccaactcttaagagtcggatgtgtgctcgggacatgccaggtgcagaatctgtcccatcggctttggcagctgatgggacctgccggacgtcaggactctgcccctgtggacccatccagcccacactcctatgggtag

SEQ ID NO: 11039 - DNA, 447 bp, Artificial Sequence
  Description of Artificial Sequence: Synthetic coding sequence
atggctaggattccaaccgccgcactcgggtgcattagtctgctatgtctccagttgcccggttccctatcaaggagcctgggtggtgaccctcgcccagtgaagcctcgcgaaccaccagccagatccccatctagttcactgcagcctcgccaccccgcaccacgtcccgtggtttggaagcttcacagggccctccaggcccagcgcggagcgggactggctcctgtcatgggccaaccgctgcgagacggtgggcgacagcattcaggtccgagaagacactcaggtcctcgtcgtacccaggcccaactattaagggttggctgcgttctggggacctgtcaggtccaaaatctttcccatcggctttggcaacttatgggcccagcaggccgacaagacagtgcgcctgtggatcccagcagtcctcacagttatggatag

SEQ ID NO: 11040 - DNA, 537 bp, Artificial Sequence
  Description of Artificial Sequence: Synthetic coding sequence
atggaccgcgctgcccgttgctccggcgctagctctctcccactgttgctggccctggcattagggctggtgatccttcactgcgtggttgctgatggcaacagtacacgatcccctgaaaccaacggtctcctctgtggcgacccagaagagaactgcgcagccaccactacccagtccaaaaggaaggggcacttttcccggtgccccaagcagtataaacactactgcattaagggacggtgccgcttcgttgtggcagagcagaccccatcctgcgtgtgcgatgaggggtacatcggcgcacggtgcgagcgggtggacctgttctacctgcggggagatcggggacagattttggtgatttgtctcattgctgtaatggtcgtgtttattattctggtgataggagtctgcacttgttgtcaccccttgagaaagcgcagaaaacggaagaagaaggaggaggagatggagactctcgggaaggacatcacaccaataaacgaggacattgaagagacaaacattgcttag

SEQ ID NO: 11041 - DNA, 1251 bp, Artificial Sequence
  Description of Artificial Sequence: Synthetic coding sequence
atgagtatcagtctaagctcattgatcctgctgcccatctggattaatatggcccagatacagcagggcggacccgatgagaaagagaagacaaccgcgctcaaagacctactgtcccggatcgaccttgacgagctcatgaagaaggacgaaccgcctctggatttccctgacaccctggaggggtttgaatacgccttcaatgaaaagggccaactgagacatataaaaaccggggagccattcgtgttcaactaccgcgaggatttgcatcggtggaaccagaaacgttatgaggcactgggtgaaattattacgaagtatgtgtatgagcttctcgaaaaggactgtaatctcaaaaaagtaagtatcccggtggacgctaccgagtctgaaccaaagagctttatattcatgtcagaggatgcactaaccaacccgcagaaactgatggtgctgatccacggctcaggcgttgtccgagctggacaatgggccagaagattgatcatcaatgaggatctggactcaggtacacagattccattcatcaaacgcgcagtcgctgaaggatacggggtaatcgtgctaaaccccaacgagaactatattgaggttgaaaaaccaaaaatccatgtgcagagttcatccgattctagcgacgagccagccgagaagagagaacgaaaggacaaggtcagtaaagagacaaaaaaacggcgagacttttatgagaagtaccgcaatccccagcgcgagaaagaaatgatgcaattgtacattcgggagaatggctctcccgaagagcatgctatatacgtgtgggatcacttcatcgcccaggctgccgcagaaaacgtgtttttcgtagcccacagttacgggggattggcctttgtggagcttatgatacagagagaggccgacgttaaaaataaagtaaccgccgtggccctcaccgacagcgtccacaacgtctggcatcaggaggccggaaaaacaatacgggaatggatgcgagagaattgctgcaactgggttagtagcagtgaaccactggacacctcagtcgagtccatgctgccagactgccctagagtctccgctggaaccgaccgtcatgagctgacgtcttggaagagtttccccagcatctttaagtttttcaccgaagcctcagaggctaaaacctcctccttgaagcctgccgtgactcggaggagtcacaggatcaagcacgaggaactttag

SEQ ID NO: 11042 - DNA, 840 bp, Artificial Sequence
  Description of Artificial Sequence: Synthetic coding sequence
atgaagataatcatactcttggggttcttgggcgctactctcagcgctccccttataccacagcggttgatgagcgcatctaacagcaacgagctgctgctcaatctgaacaacggccaactcttgccactgcagttacagggccctctcaattcgtggattcctccgttttccgggatcctgcagcaacagcagcaggcacagatccctgggctgtctcagttcagcctgtcagctctcgaccaattcgcagggctgctgccaaaccagatcccactcactggagaggcctcctttgcccagggagcccaagctggacaagtggaccctctccagttgcagacacctccacaaacccagcctggtcctagtcacgtgatgccctacgtctttagcttcaaaatgccccaagagcaaggacaaatgttccagtactatccggtgtatatggtgctaccgtgggaacaaccgcagcagaccgtgcccaggagccctcagcagacccggcagcagcaatacgaggagcagatccctttctatgcacagtttggttatatacctcagctggcagaacccgctatctcagggggtcaacagcagctcgcctttgacccacagctggggacagcacctgaaattgccgtgatgtctacaggcgaggagataccttacctacagaaagaagctatcaactttcggcatgactctgccggagtcttcatgccatccacgtctccgaagccaagcactactaacgtgtttacgtcagccgtagaccaaacaatcactcccgaactcccagaggagaaggacaagacggatagtttaagagaaccttag

SEQ ID NO: 11043 - DNA, 444 bp, Artificial Sequence
  Description of Artificial Sequence: Synthetic coding sequence
atggggcctgaagcactgagctcattgttattgctgcttctcgtcgcttcaggcgatgcagacatgaagggccacttcgaccccgcaaaatgcagatacgccttgggcatgcaggatcggacaatcccggactccgacatatcagctagctccagctggagtgactcaaccgcagccaggcatagtaggctggagtcatcagacggagacggtgcctggtgcccagctgggtccgtgttcccaaaggaggaagagtacctccaagtcgatcttcagcggcttcacttggtggctctagtggggacccagggcagacacgccggaggtttgggaaaggaattctctcggtcgtaccggttgcggtactcacgggacggtagaagatggatgggctggaaggatagatgggggcaggaagtcatcagtggtaacgaagacccatag

SEQ ID NO: 11044 - DNA, 618 bp, Artificial Sequence
  Description of Artificial Sequence: Synthetic coding sequence
atgggtggcccagtccgcgagccagccctgtccgtggctctctggctgagttggggtgccgctctcggagcagtggcatgtgcgatggctctgctgacgcagcagacggagctccagtcactacgaagggaagtcagtcggttacaggggacgggcggtcccagccaaaacggcgaaggctatccatggcagagcctccctgaacagcacagtgtgttgcacctagtaccaattaacgctacctctaaggacgattccgatgtgaccgaggttatgtggcaaccggctttacggaggggacgcggtctgcaggcccagggctacggcgtcaggatccaggacgccggtgtgtacttgctgtactcacaggtgctgtttcaggatgtcacattcaccatgggacaggtcgtgagccgggagggtcagggaagacaggagaccctgtttaggtgcatccgctctatgccgtcccatccagatagagcatacaactcatgctattcagctggagtgtttcacctccaccaaggcgacatactgagcgtgatcatccctcgtgccagggctaagctcaacctgtctccccacggtacttttttggggttcgtgaagttgtag

SEQ ID NO: 11045 - DNA, 744 bp, Artificial Sequence
  Description of Artificial Sequence: Synthetic coding sequence
atgcccgcatctagcccatttctcctcgctcctaaagggcctcctggaaatatggggggtcctgttagggaaccagctctgagtgtcgccctgtggttaagctggggcgctgcgctcggcgcagtcgcctgcgctatggccctactgacccaacagacggaattacaatcactgcgccgagaggtgagcaggctgcagggcacgggaggtccttctcaaaacggcgaaggatatccctggcagtccctgcccgaacagtcgtcagatgcactcgaagcttgggagaacggcgaacgcagcaggaagcgaagagccgtcttaacccagaaacagaaaaaacagcactccgttcttcacttggtgcctattaacgcaaccagcaaggatgacagtgacgtcacggaggtgatgtggcagccagcgctcagaagggggcgtgggctgcaagctcagggctatggcgttagaatccaggacgccggtgtgtacctcctgtatagccaggtgctgttccaggacgtaacctttaccatgggccaggtcgtgagccgagagggccagggacggcaagagaccctgtttaggtgcatacgcagcatgccctcacacccagacagagcctataactcgtgctatagtgccggagtgttccatcttcaccagggcgacatattgagcgtgattatccctagagcccgagcaaagctgaatctgtcaccccacgggacatttctgggcctttag

SEQ ID NO: 11046 - DNA, 39 bp, Artificial Sequence
  Description of Artificial Sequence: Synthetic coding sequence
atggggaagagcgagtctttacagagcctccagagatag

SEQ ID NO: 11047 - DNA, 4266 bp, Artificial Sequence
  Description of Artificial Sequence: Synthetic coding sequence
atgatgctcccacagaattcgtggcacatcgacttcgggaggtgttgttgccaccaaaatctctttagcgccgtggttacttgcatcctgctactaaattcttgtttccttatatccagctttaacggcacagacctggagttgcggctcgtgaatggcgatggcccttgcagcggcacggtcgaggttaagtttcagggtcagtgggggaccgtctgtgacgatggttggaacacaaccgccagtacagtggtctgtaagcagctcggatgccctttttcgttcgccatgttccggttcggccaggctgtgactcgacacggaaagatttggcttgatgatgtctcctgttatggaaatgagtctgctctgtgggagtgtcagcaccgagagtggggctcacacaattgctaccacggagaagacgtgggcgtgaactgttacggcgaggcaaatctcgggctcagactagtggacgggaacaattcatgttctggaagagtggaggtaaaattccaagaacgttggggtaccatatgcgacgatggctggaacttaaacaccgctgcggttgtttgcaggcaacttggatgtccatcttcttttatcagtagtggggtcgtgaactcccctgcagtccttcgaccgatctggctagacgacattctttgccaggggaatgaactggcactgtggaactgcaggcaccggggatggggaaatcacgattgtagtcataacgaagacgtaacactgacatgttatgattcctccgacctagaactacgactggtaggtggaacgaacaggtgcatgggccgagttgaactgaagatacaaggcagatgggggactgtgtgccaccacaaatggaataacgctgctgccgatgttgtgtgtaagcagcttggctgtggcacggctttacattttgctggcttgccccatctgcagtccggctcagatgttgtgtggctggacggggtgtcatgtagcggcaacgagagctttctctgggattgcaggcattctggaactgttaattttgactgtctccaccagaacgacgtgagtgtgatctgctccgatggagccgacctcgagctgcgccttgctgatggctcaaacaactgctctggaagagtggaagttagaatccacgagcagtggtggacaatttgtgatcaaaattggaagaacgagcaagccctggtggtctgcaagcagctcggatgcccattttccgtgttcgggtcaaggcgggctaaaccgtccaatgaggctagagacatctggatcaactcaatctcttgcactgggaatgaatccgccttatgggactgcacttacgacgggaaggcgaagcgaacttgctttcggaggtcagacgctggtgtgatctgttccgacaaggcggatcttgatcttagactggttggcgctcattccccatgctacggacgcttggaagtgaaatatcagggagaatggggcactgtctgtcacgacagatggagcacccgaaacgccgctgtggtgtgtaaacagctggggtgcggcaaaccgctgcatgtgttcgggatgacctactttaaggaggctagtggccctatttggctggatgatgtttcttgcattggcaacgaaagtaatatctgggattgtgagcattctgggtggggcaagcacaattgtgtccaccgagaggacgtcattgtcacatgctccggcgacgccacatggggcctgcggctcgtgggcggatctaaccgctgctccggacgactcgaagtctactttcagggtaggtggggtactgtgtgcgacgacggctggaactccaaagctgccgctgtggtttgcagtcagctggactgtccttctagcatcatcggtatgggactgggcaacgcttccaccgggtacgggaaaatttggctcgacgacgtcagctgtgatggtgacgaaagcgacctgtggtcttgccggaactccggatggggcaacaacgattgttcccatagtgaggatgtcggcgtgatatgctccgatgccagcgacatggagctgaggctcgttggcggttcttccagatgtgccggaaaggtggaagtcaatgtgcagggagccgtggggattttatgtgccaatggatgggggatgaatatcgccgaggtggtgtgcagacagctggagtgcggtagcgcaatccgggttagccgggagccccacttcaccgaaaggacactacatattttaatgtctaattccggatgtaccgggggtgaagcctctttgtgggattgcatcagatgggagtggaaacaaaccgcctgtcacttaaacatggaggcctctcttatctgctccgcacaccggcaacctcggctggttggagcggatatgccgtgctccggacgagtagaggtcaaacatgcagacacctggaggagtgtctgtgactccgattttagcctgcacgccgctaatgtgctttgtcgtgaattaaactgtggcgacgcgatcagtctaagtgtcggagaccattttgggaagggtaatggtctgacctgggccgagaaatttcagtgtgagggctcagaaacccacctggctctgtgtcccattgtgcagcatcccgaggatacctgcatccactccagagaggttggtgtggtctgctcaaggtatacagatgtgagactagtcaatggcaagtcccaatgtgacggccaggtcgaaattaacgtcttaggccactggggctccctctgtgacacgcattgggatccagaggacgctcgcgtcttgtgcaggcagctgtcttgcggtacagccctttcaaccactggagggaagtacattggggagaggagtgtaagggtctggggccaccgcttccactgtctcggtaatgaatcgctgctggacaactgccagatgacagtgctgggcgcacctccgtgtatacacgggaatacagtttctgtcatctgtactggctcactcacccagcccctgttcccatgtctggccaacgtttcagatccttacttatcagccgtacccgaggggagtgcactgatctgccttgaggataagagattgagacttgtcgacggagactctcgctgtgcaggcagagttgaaatataccatgacggcttttggggaacaatttgtgacgatggctgggacctctcggacgcccatgtggtttgtcagaagttggggtgcggagtcgcattcaacgcaactgtgtcggctcacttcggcgagggaagcggcccaatctggctggatgatctgaattgtactgggatggaatcccatttgtggcagtgtccatcccgaggttggggccagcacgattgccggcacaaggaggacgcaggtgtcatctgctctgagtttacagccctgcgcctttatagcgagaccgagacagagagctgcgctggcaggcttgaggtgttctataacggcacttggggtagtgtagggaggagaaacatcactactgcaatcgctggaattgtctgtcgccagctaggctgcggagaaaacggagtcgtgtctctggccccattatcgaaaacgggatccggctttatgtgggtcgatgacatccagtgtcccaagacacatatctcaatatggcagtgcctcagcgcaccttgggagcggcgtattagctctcctgctgaggagacctggataacctgcgaggaccggatcagagtgcgtggaggggatacagaatgctcaggtagagtcgagatctggcatgctggctcttggggaacagtgtgcgacgatagctgggatcttgcggaagccgaagtggtgtgtcagcagctcgggtgcggctccgccctagcagccttacgggatgcctcttttggtcaggggacaggcactatctggctggatgatatgcgctgcaaaggcaacgaatcgttcctgtgggattgtcacgccaaaccgtgggggcagtccgactgcggccataaggaggatgctggcgtgcggtgtagcggacaaagcctgaaatccttgaatgcaagttccggacatcttgccctaattctgtcctcaatcttcggtctcttactgctggttctgtttatcctgttcttgacctggtgtcgggtgcagaagcaaaaacatctacccctgcgggacgatactcccaaccacggatgtgaagacgcatcagacacctccctcctgggagtcctcccagcctctgaggcaacaaagtag

SEQ ID NO: 11048 - DNA, 1410 bp, Artificial Sequence
  Description of Artificial Sequence: Synthetic coding sequence
atgattacagaaggggcacaagcaccacgcctcttactgccccctttgctgctcttactgactctaccagcgacaggcagtgaccctgtcctttgctttactcaatacgaggaatcaagtggaaagtgtaaggggctcctgggcggtggcgtgagtgtggaggactgctgtctgaatacagccttcgcataccagaaaaggagcgggggactttgtcagccatgcagaagcccaagatggtccctctggtccacttgggctccatgcagtgttacctgcagcgagggttcccagttgcggtatcggcgttgcgtgggatggaatggccagtgcagtggtaaagttgcgcctgggacactggagtggcagctgcaggcctgcgaggaccagcagtgctgtcccgaaatgggtggctggtcgggctgggggccttgggagccttgttcagtgacgtgttctaagggaacgagaactcgccgaagagcttgtaaccaccctgctcccaagtgcgggggtcactgccccggtcaggcacaggagtccgaggcctgtgacacccaacaagtctgtcctacgcacggggcatgggctacatggggaccttggaccccttgctccgcttcttgtcatggtggccctcatgaacctaaggagacccgaagcagaaagtgcagtgccccagaaccgagtcagaagccacctggaaaaccttgcccaggcctggcctatgaacaaagacgttgtactgggcttcccccttgcccggtggccggaggttggggtccatggggcccagtgtccccttgccccgtcacctgtggcttaggacagacaatggaacagaggacgtgtaatcaccctgtgccacaacacgggggaccattttgcgcaggtgatgccacgagaacgcacatttgcaatacggccgtcccatgtccggtcgatggagagtgggatagttggggggagtggagcccctgcatcagacgcaatatgaagagcatcagctgtcaggagattccaggtcaacagagtcggggacgcacgtgtagggggaggaaattcgatggacaccgttgcgctggccagcagcaggacattaggcactgctacagcatccaacactgcccccttaaaggcagttggtccgaatggagcacgtggggtttatgcatgcctccttgtggacctaaccctacgcgtgctaggcagcgtctgtgtacacccctcttgcccaagtacccccctacagtaagtatggtggagggccagggcgagaaaaatgtgacattttggggcagaccactccctcgctgtgaagaactgcaagggcaaaagctcgtcgtggaagagaaacggccatgcctgcacgtccccgcttgcaaggatcccgaggaggaggaattatag

SEQ ID NO: 11049 - DNA, 837 bp, Artificial Sequence
  Description of Artificial Sequence: Synthetic coding sequence
atgcagtggcttcgcgtgagagaatctccaggcgaagcgaccgggcatcgagtgaccatggggactgctgctttgggcccagtatgggcagctctgttactgtttctgctcatgtgcgagattcccatggtggagctgacctttgaccgagccgtcgcctcaggctgtcagaggtgttgcgactctgaggacccacttgatccagctcacgtaagcagcgcaagttccagcggcaggccacacgccttgccagaaatcagaccctatattaacattaccattctcaaaggagataagggcgatccaggccctatgggcctgcctggatatatgggacgggaagggcctcagggagaacctggaccgcagggcagtaaaggagataaaggcgagatgggctcacctggcgcaccttgtcagaagagatttttcgcattcagtgtgggtaggaaaaccgccctgcactccggtgaggattttcagactctcttgttcgaaagagtctttgttaatctggatggatgtttcgacatggcaactgggcagtttgctgcaccactccggggaatctattttttttcattaaacgtgcattcctggaattacaaagagacttatgtacatataatgcataatcagaaagaagccgtaattctgtacgcgcaaccgtcagagcggagcattatgcagtcgcagtctgtaatgctcgatctagcatacggcgacagggtctgggtccggctgttcaagagacaaagagagaatgctatttatagcaatgacttcgatacttatattaccttcagtgggcaccttattaaggccgaagacgattag

SEQ ID NO: 11050 - DNA, 1128 bp, Artificial Sequence
  Description of Artificial Sequence: Synthetic coding sequence
atggaatttgaaattacctttcgcccagattctggtgacggcgtcctactctactcctacgacaccggaagcaaagatttcctgtcaataaatctggccggaggacatgtggagtttagattcgactgtgggtccggcacaggtgtcctgaggtctgaagatcccctcactcttggcaattggcatgagctgagagtgagcaggactgccaagaatggcattctgcaggtggacaaacaaaagattgtggaaggtatggccgaggggggatttacccagatcaagtgcaatactgatatatttatcgggggagtacccaactacgatgatgttaaaaagaatagcggggtattaaaacccttcagcggtagcatacagaagattatcctgaacgaccgtacaatacatgtgaagcacgactttacatcaggtgtgaacgtcgaaaatgcggcacacccctgtgtgcgtgctccatgtgctcatggcggaagctgtcgacctaggaaggaaggctacgattgcgactgtccactcggctttgagggtttgcactgccagaaagccatcatcgaggccatagagatcccacagttcataggccgtagttatttgacgtatgacaacccagatatcctgaaacgggtctccgggtcacgctcgaatgtgtttatgcgcttcaagactactgccaaggacgggcttctgctgtggcggggtgattcacccatgcgccctaatagtgactttatttcccttggtttgcgtgatggcgctctggttttcagctacaacctgggtagcggcgtagcttccattatggtaaacggatcattcaatgacggtcgctggcatcgagtgaaggctgtgagagacgggcagtccggcaagatcacagtggatgattacggggctcgtacgggcaagagtccaggcatgatgaggcaattgaacattaatggtgctctgtatgtggggggtatgaaggagatcgcactgcacactaatcgccaatatatgcgcggactggtgggatgtatctcccactttaccttatcaacggactaccacatcagcctagttgaggatgccgtcgacggaaagaatatcaatacatgcggagcaaagtag

SEQ ID NO: 11051 - DNA, 459 bp, Artificial Sequence
  Description of Artificial Sequence: Synthetic coding sequence
atgcggtttaaaactactgccaaggacgggcttctcctgtggcggggtgattcaccaatgcggcctaacagcgattttatcagcttgggcctgagggacggagccttggtctttagttataatctcgggtcaggcgttgctagtatcatggtcaacggatcctttaacgacggcaggtggcatagagtcaaagctgttagagatggccagtccggcaaaatcaccgtggatgactacggtgcacgcactggcaaatcacctgggatgatgcgtcagttgaacattaacggagcactctacgtcggtggcatgaaagaaattgcattacatacaaatagacagtatatgcgcggattagtggggtgtatctcgcactttaccctgagtactgactatcacatcagtctggtggaggacgctgttgacggtaaaaacatcaacacctgtggtgccaagtag

SEQ ID NO: 11052 - DNA, 1050 bp, Artificial Sequence
  Description of Artificial Sequence: Synthetic coding sequence
atgaccgctttaccgggtccactttggctgctgggtctggccctctgcgccctgggtggtggtggacccggactccggccaccgcctggctgtcctcagcgtcgcctgggggcaagggaaagaagagatgttcaacgtgaaatactggctgttctgggactaccgggaagacctcggccaagggcgcctcctgcagctagtcgcctgccagcttccgcaccacttttcatgcttgacttgtaccatgcaatggccggtgatgatgatgaggatggtgcaccagctgagagacggttgggacgggctgaccttgtgatgagttttgtcaatatggtcgagcgtgaccgcgctctgggacatcaggagccacactggaaagagttccgttttgatctgacacagatccctgccggagaagccgtgactgcggcagagttccggatctacaaggtgcccagcattcacctacttaatcgcaccctgcacgtgtcaatgtttcaggtcgtgcaggagcagtcaaatagagagtccgacttgttcttcttggatctacagacgctgagggcaggtgacgagggatggcttgtgctggacgtcaccgcagccagcgactgctggctgctgaaaaggcacaaggatctgggcctccggctgtacgtggaaaccgaagacggagagacttggactggatggggttggactaaggattcccgcctacagatgtggaagctgcggttgtctaggactccctgggtgctgagcttgcatgctcctggcccagcccaagcgccagccgaacggcctctgctgtgtctgttgcagggacattgtccagcatccccaagcccaatccgcacccccagggccgtgaggcctctccgcagacggcagcccaagaagtccaacgaactgccccaggcaaataggctcccaggaatcttcgacgacgtccatggctcccacgggaggcaggtgtgccgtcggcacgagctgtacgtgagctttcaagacctggggtggctcgttattgctgatagtagctgtttctag

SEQ ID NO: 11053 - DNA, 1617 bp, Artificial Sequence
  Description of Artificial Sequence: Synthetic coding sequence
atgagtttctcggcgacgattctgttctctcctccaagcggctccgaggccagatgctgctgctgcgcctgtaagtctgaaactaatggagggaacaccggatcccaggggggaaatcctcccccaagtacaccaataaccgtaactggacatggacttgctgttcagtcctcagaacaattgctgcatgtgatctatcagcgcgtggacaaggcagtaggcttagcagaagctgccctgggcctggccagagccaacaatgaactactcaaacgtctgcaggaggaagttggtgatctgcgacaaggcaaggtaagcatcccagacgaggacggcgagagtagggctcactcctcaccccctgaggaaccgggtccactgaaggagagccctggggaagccttcaaggcgctgagcgctgttgaggaagaatgcgactcggtagggtcgggggtgcaggtggtcatcgaggagcttcgccagcttggtgcggcttccgtgggaccaggtcctctgggtttccctgcaacccaaagagacatgcgactgcctgggtgtactctcgcggcttccgaggccgcaccacttctgaacccactggtggacgactatgtcgcatccgagggcgctgttcagcgagttctggtgcccgcatatgccaagcagctgtctccagctactcagctcgctatccagcgcgctacacctgaaacgggcccagagaatggcactaaactcccccctccgaggcctgaagacatgctgaatgcggctgccgctctggactccgctctagaggagagcggcccaggaagcacaggggaactaagacactctctcgggctgacggtgtccccgtgccgcaccagaggtagtggacagaagaacagccgcagaaagcgggacctggtcctctctaaactggtccacaatgtgcacaaccatattactaacgataaacgattcaacggctccgaatcgatcaagagctcttggaatatcagtgtggtaaagtttcttctcgaaaaattgaagcaagagctggtcacgagcccccacaactataccgacaaggaactgaaaggggcttgcgtggcatatttcctgacaaaaaggcgtgaatatcgaaactctttaaatccatttaaaggccttaaggagaaggaagaaaagaaactcaggtcacggagataccgcctgtttgccaaccggtcgagcattatgcgccatttcgggcctgaggaccagaggctgtggaatgatgtaaccgaagaactcatgtccgatgaagaagactcactgaacgaaccaggagtttgggtagcgcgacctccacgattcagagcccagaggctgaccgaactgtgttatcacctggatgctaactcgaagcatgggactaaagctaacagagtgtacggtcccccatctgaccgtctgccgagtgccgaagcacaattgctgccccctgagctgtataaccccaacttccaggaggaagaagacgaaggtggcgatgagaatgcgccagggagcccaagctttgatcagcctcacaaaacctgttgccctgacctcaattcatttattgagataaaagtggaaaaagatgagtag

SEQ ID NO: 11054 - DNA, 630 bp, Artificial Sequence
  Description of Artificial Sequence: Synthetic coding sequence
atgagcttctctgcaacaatcctgttttcccccccatctggaagcgaagcccgttgttgttgctgtgcttgtaaaagcgagacaaacggcggtaacaccgggagccaaggcggaaacccccctccgagcacccctattactgtcaccggacatggcctggcggtgcagtcttccgagcagttgctccatgtgatctatcagcgcgtcgataaggcggtgggcctagcagaggcagctctaggactggcccgagcaaacaatgaacttctcaagcggctgcaggaggaagtaggggatttaagacaaggcaaagtctccattcccgacgaggacggagaatccagagcgcactcatcgccccctgaggagcctgggccactgaaagagagcccaggcgaagcgttcaaggcactgtcggctgtggaggaggagtgtgattctgttggcagcggggtccaagtggtgattgaggaactgcggcagctaggtgcagcctcggtcggacctggccctctgggctttcccgcaacccagcgtgacatgcgactgcccggttgtacgcttgccgcatctgaagcagcgccattgctaaatcctctggtcgacgattatgtcgcctcagaaggatag

SEQ ID NO: 11055 - DNA, 1617 bp, Artificial Sequence
  Description of Artificial Sequence: Synthetic coding sequence
atgtccttctccgcgactattttatttagtccacccagtggaagcgaggccaggtgctgttgctgtgcatgtaagtcggagactaacgggggaaacaccggatctcagggcggtaatccacccccttcaactcctatcactgtgaccggacatggtctggctgtccaatcttctgagcagctcttacatgttatttatcaacgcgtagacaaagcagttgggctagctgaagctgcactggggctggccagggctaataacgaacttctaaagagactgcaggaggaggtgggggatctaaggcaaggcaaggtgagtataccagacgaagatggagaatctcgggcacatagttcgccaccagaagagccagggcctctgaaagaatctcctggggaggcctttaaggctctttcggcagtcgaagaggagtgcgattccgtgggctctggcgttcaggtggtgattgaagaactcagacagctgggggcagctagcgtcggcccaggtccattaggcttcccagctactcagagggacatgagattacctgggtgcactctggctgccagtgaggcagcaccactccttaacccgctggtcgacgattatgtggcatccgaaggggcagtacagagggttcttgtgccagcctacgccaagcagctttctccggctactcagcttgccattcagcgggctaccccagaaactggccctgagaacgggacgaagctgccgccacctcgaccggaagacatgttaaacgctgcagctgctctggattcagctctcgaggagagcggcccaggctccacaggagaattgcgacacagcctggggctgactgtgtctccatgtcgcacacggggtagcggtcagaagaactctaggcgcaagagggatctggtgttgagcaagcttgtgcacaacgtgcacaaccatatcaccaacgacaaacgatttaatggctcggagagcattaagagcagttggaatatcagcgtggttaaattcttgctggagaagttaaaacaagagctggtgaccagcccgcataattacaccgataaggagctgaaaggggcatgcgtcgcttacttcctcacgaaacgcagggagtaccgtaatagtttgaacccctttaagggactgaaagagaaagaagaaaaaaagctcagatctaggcgctaccgcctattcgctaacagatccagcatcatgaggcattttggaccagaagatcagcgcctctggaacgatgttacagaggaactcatgtccgacgaggaagattcactcaacgagcccggagtatgggtggctagacctccccgtttcagggcgcagcgcctcacagagttgtgctatcacctcgacgccaactctaagcacgggaccaaggctaatcgggtgtatggcccaccatccgatagattaccttccgctgaggctcagcttttgcctcctgagctgtacaacccaaatttccaggaggaggaggacgaaggaggagatgagaatgcgcctggttctcccagctttgatcagcctcacaagacctgctgccccgatctgaactctttcattgagatcaaggtggaaaaagatgagtag

SEQ ID NO: 11056 - DNA, 1524 bp, Artificial Sequence
  Description of Artificial Sequence: Synthetic coding sequence
atgtgcaccaagactatcccagtgctgtggggttgttttctcctatggaatctctacgtatcatcatctcagacaatctatcctggtattaaggcccgtataactcaacgagctttggactacggggtccaggccggaatgaagatgatcgagcagatgctaaaggagaaaaaattgcctgacctatcaggtagcgaatctttggagtttctgaaggtcgactatgttaactataacttttctaacatcaagatctccgcatttagtttcccaaatacatctttggccttcgtgccaggcgtaggcatcaaggcactgacaaatcacggaactgctaacatcagtacagattggggctttgaatcacctctgttccaggacactggtggcgctgatcttttcctctccggggtgtactttaccggaattatcatcttaactcgaaatgattttggacacccaactttgaagcttcaggattgttacgctcagctgtcccacgctcacgtgagcttttcaggtgaactttctgtgctgtataacagcttcgcagagcccatggagaagcccatcttgaagaatctcaacgaaatgctctgtcccatcatcgctagtgaggtcaaggctctcaatgctaacttaagtacgttggaggttctgacgaagatcgataactatacgctcctagactactcgttgatctcctctccagaaatcactgaaaactacctggacttgaatttgaagggcgttttttaccccttggagaatctcaccgacccacccttctctccagtgccctttgtgctgcctgagcgttctaactccatgctgtacatcggaatcgctgagtatttttttaagtcagccagcttcgcccactttacagccggagttttcaacgtcaccttgtccacggaagagatatccaaccacttcgtgcagaattctcagggactgggcaacgtgctgagccggatcgccgaaatttatatcctgtcccagccctttatggtacggatcatggctacagagcctccaataataaaccttcagccagggaatttcacactggatatccctgcaagcattatgatgctgacacagccaaagaattccacagtggaaacaatcgtgtctatggactttgtggccagcacatccgtcggtcttgtgatcttgggacagcgcctcgtctgcagtctgtctctcaatcgcttcagactcgcgctgcccgagtccaatagaagcaacatagaagtcttacggtttgaaaatattctgtcaagcatcttacacttcggcgttctaccgctggcaaatgctaagcttcagcaagggtttcccctcagcaacccccacaaattcctgttcgtaaactcagatatcgaggtcctcgagggcttcctgctgattagcacagacttaaagtacgaaaccagttcaaagcaacagccttcttttcatgtatgggaaggccttaacctgatttctcgccagtggcgtggtaaaagcgccccttag

SEQ ID NO: 11057 - DNA, 753 bp, Artificial Sequence
  Description of Artificial Sequence: Synthetic coding sequence
atggcaagtgaacgactgccgaaccgccctgcttgtctgctggtcgctagcggggctgccgagggggtttcagcgcagagctttctgcactgcttcaccatggcttcgacagccttcaatctgcaagtggcaaccccaggcggaaaagcgatggagttcgtggatgtcactgagtcaaacgcaaggtgggttcaggattttcgcttaaaagcgtacgcttctcctgctaaactggaatcaattgatggagcacgttatcacgccttgctgataccctcttgtccgggtgcactgactgacttggcaagcagcggttcattggccaggatccttcaacactttcattccgagagcaagccaatatgtgccgtgggccacggcgtcgctgccctttgttgcgctacgaacgaagacagatcttgggtcttcgactcctattcactgactgggccttccgtgtgcgaattggttcgcgcacccggatttgctcgcctccctttggtggtagaggatttcgtaaaggattccggcgcatgtttttccggggctgcggctagctgccctaaagccgatcggcactggcagcatttccctgttgaggaaatcttcctggcgtgtggcttcaaggtggcgggactcggggctgccccaggatgggggagaggaggcaagcaagaagataggcctcccgaggaacagagacgcgctggggaagattttcctatatatcaatgcgtctttatttatccctag

SEQ ID NO: 11058 - DNA, 1386 bp, Artificial Sequence
  Description of Artificial Sequence: Synthetic coding sequence
atgagcttagacattcagagccttgatatccagtgcgaagaactgtctgatgcacgctgggcagagctgctgcctttactacagcagtgtcaagtcgtgaggctggatgattgcgggctcactgaagctagatgtaaggacatttcctcagcactgagggtgaacccagctctggctgagctcaatttgcggtcgaacgagctgggcgatgtcggggtccactgcgtgctccaaggcctccagaccccgtcctgcaagatccagaagctttcccttcagaattgttgccttacaggcgctggatgcggggtgctctcatccactcttcggactcttcctacactacaagagctgcacctgtccgataatctgctgggagacgccggactgcagctgctctgtgagggcctgctggatcctcagtgcagacttgaaaagttgcaactggagtattgcagtctttcagctgcctcctgtgaaccactggcgtctgtgttgcgcgctaagcctgacttcaaagaactgacagtcagcaacaacgatatcaacgaagcaggcgttagagttctgtgccagggtctgaaggatagcccatgtcagctggaagctcttaagctcgagtcatgtggggtgacttccgataactgcagagatctctgcggaatagtggcctcaaaggcgtccttgcgtgaactggctctggggagcaataagttaggggacgtgggcatggcagagctttgcccaggtctgttgcatccgtccagccgtttgaggaccctctggatctgggagtgcggcatcacagccaaaggctgtggggacttgtgtagggttctgcgggcaaaggagagcttgaaggagttgtcactggctggcaacgagctgggagatgagggagccaggttgctgtgcgagaccctgctggaacctggttgccagctggaatcactctgggtcaaaagctgctcctttactgccgcttgttgttctcatttttcctctgtgcttgctcagaaccgattcctgctggagctgcaaatatctaataacaggttggaagatgcaggggtacgggagttgtgccagggcctgggacaaccgggtagtgttcttcgagttctgtggctggctgactgtgacgtgtcagattccagttgctccagcctagcggcaactctgctcgccaatcatagccttcgggaactcgacctgagcaacaactgtctcggagacgcaggcatcctgcaactagtcgaaagcgtgagacagcccggatgcctcttggagcagttggtgctatatgacatatattggagcgaggaaatggaagaccgcctgcaggcgttggagaaagacaaaccttccctgagagtgatttcttag

SEQ ID NO: 11059 - DNA, 1386 bp, Artificial Sequence
  Description of Artificial Sequence: Synthetic coding sequence
atgagtcttgatattcagagcctggatatacagtgtgaggagctgtcggatgctagatgggcagaactcctccctttgttgcaacagtgtcaggtggtgagactggatgactgcggactcactgaggctaggtgtaaggatatctcctcggcactgcgggtcaaccctgctctggccgaactcaatctgaggagcaacgaactcggggacgttggagtgcactgtgtgttgcaaggactccagacgccctcctgtaaaatccagaagctgagcctacaaaattgctgtctgactggagccggttgcggggtgctatcctccacccttaggactctccccaccttgcaggagttgcacctctctgataacttactgggagacgccggtctacagctgctgtgcgagggcctgctggatccccagtgcaggctggaaaagctgcagcttgaatactgttctctatccgcagcctcatgcgagccactagccagcgtgttgagggctaaacccgactttaaggaactgactgtcagcaataatgatatcaacgaggctggggtgagagtgctgtgtcaaggcctgaaggatagtccctgtcagttagaggccctgaagctggaatcatgtggagtgacctccgacaactgcagggatctgtgtgggatagtggccagcaaagccagtctgcgcgagctggccctggggagcaacaagctgggcgacgtcggtatggccgagctctgccctggccttctgcaccctagttctcggcttaggacattatggatttgggaatgtggaattactgcaaaagggtgtggggatctttgtagagtgctgagagctaaggagagcttgaaagaactgtctctggccggaaacgagctgggggacgaaggcgcacgtctcctgtgtgagacgctactggagccgggttgccagctggagtcgctttgggtgaagtcctgcagcttcaccgctgcctgctgcagtcattttagctccgttctggcacaaaacagatttctcctcgagcttcagatatcgaataatcgccttgaagacgccggtgtccgtgagctgtgccagggtctggggcagccaggcagcgtgttacgcgtactctggcttgcagactgtgatgtctctgacagcagctgtagtagtctggccgcaacacttttagccaaccattccttgagagaattagacctgtctaataattgcctcggcgatgctggcatcctgcagctggtcgagtctgttcgacagcctggctgtctcctcgagcaactggtcctgtatgatatctactggtctgaagaaatggaggaccgcctgcaggctctggaaaaagacaaaccctctcttcgtgttatcagctag

SEQ ID NO: 11060 - DNA, 1386 bp, Artificial Sequence
  Description of Artificial Sequence: Synthetic coding sequence
atgagtctcgacatccagtcgctagacatccagtgcgaggaacttagcgatgcgagatgggccgagctcctgcccctactgcaacaatgccaggtcgtgcggttagatgattgtggattgaccgaagccagatgtaaggatatcagttccgctctccgagtgaatccggctttggcagagttaaatctccgaagtaacgagctcggggacgttggggtccactgtgtcctccaagggctgcagaccccttcctgtaaaatacagaaactgtccctgcagaattgttgcctcaccggggcaggctgtggcgtgctttcttccacccttcgcacactcccaacccttcaggagctgcacctgagcgataacctgctgggggacgctggacttcagcttctttgcgaaggcttactcgatccacagtgtagattggaaaagctccagctggaatattgtagcctgagcgcggcatcttgcgaacccctggctagcgtgctcagagccaagcccgatttcaaggaacttactgtctccaacaatgacattaacgaagcgggagtcagagtgctgtgtcaagggcttaaggacagtccatgccagttggaagcgctaaaattagagagttgtggagtgacatcagacaactgtagggatttgtgtggcatcgttgcttctaaagctagtctgagagaactggctttaggaagtaacaaactcggggatgtcggtatggctgaactctgtcctggcctattgcacccctcttccagactccgcacgttgtggatttgggagtgcggcataactgcaaagggttgcggagacctgtgccgagtgcttagggctaaagaatctctgaaagagctctccctggcgggaaatgagctcggcgacgagggcgctcggctcctgtgcgaaaccttgctggaacctgggtgtcagctggaaagcttatgggtcaagagttgtagctttacagccgcttgctgcagtcacttctcatctgtgctcgcccagaacagattcctgctggagttgcagataagtaataaccggcttgaggacgcaggcgtgcgcgaactgtgccaggggctgggacagccaggtagcgttcttcgcgtactgtggcttgcggactgcgacgtgtccgactctagttgcagcagtctggcggctacccttctcgccaaccattctttgcgcgagctggatctgtcaaataattgcctcggtgacgccggaattctgcagcttgtggagagcgtgcggcagccaggatgcttgctagaacagcttgtactatatgatatttactggagcgaggagatggaggatcggctgcaagcactggaaaaagacaagcccagccttcgagtgatttcttag

SEQ ID NO: 11061 - DNA, 1452 bp, Artificial Sequence
  Description of Artificial Sequence: Synthetic coding sequence
atgattacagcacattgcagcctggatcttcttggctctgtagctgtactttgcgtgtgtgacctgtccccagcacaatgtgatataaactgttgttgcgatcctgattgtagctccgtcgatttctccgttttctccgcctgcagtgtccccgtggtcacaggagatagccagttttgctcgcagaaagctgtgatctactccttgaactttaccgccaaccctcctcagagggttttcgagctggtagaccagatcaacccctcaattttttgtatccatatcacaaactataagcctgccctgtctttcattaaccctgaggtgccagatgaaaacaattttgacacactgatgaagaccagcgacggattcaccctcaatgccgagtcctatgtcagcttcacaaccaagctggatatcccaacagctgccaagtacgaatatggagtgcccttacagacaagcgattctttccttagattcccctcctccttgacatcctccttgtgcaccgataacaatcctgccgcttttctggtgaatcaggctgtgaagtgcactcgcaaaataaacctggagcagtgcgaagaaatagaagccctctccatggcgttttatagctcccccgagatactacgagtgcccgatagcagaaagaaggtgcccatcactgtgcagtccatcgtaatccagtcgcttaataaaaccctgactaggagggaggacactgacgtcttgcaacctacactggtgaacgctgggcattttagcttgtgcgttaatgtggtcttagaagtaaagtatagcctgacttataccgatgctggcgaggtaacaaaggctgatctgtcatttgtgctagggacggtaagttcagtcgtggtgcctctccagcaaaagttcgagattcattttctccaggagaatacacagccggtgcccctttctggtaaccccggttacgtcgttggcctccctctggctgccggtttccaacctcataagactggtgctctgccttgccagctggtggctcaaaaggtgaaatctctcctgtggggtcaggggttccccgattatgttgccccattcggaaattcccaggcgcaggacatgctagactgggtgcccatacacttcataacgcagagctttaacaggaaacatttcgttctgcaggacagctgccagttgccaggcgcactcgtgatcgaagtgaagtggacaaaatacggaagtctgttgaatccacaagccaagatagtaaatgtgacagcgaaccttatatcctcctcattcccagaggcaaatagtggcaatgagcggaccatattgatttcaacagccgtcacattcgtggatgtgtccgctcccgcagaggctggatttcgggctccccctgctatcaatgctcgactgccttttaacttcttctttcccttcgtgtag

SEQ ID NO: 11062 - DNA, 1596 bp, Artificial Sequence
  Description of Artificial Sequence: Synthetic coding sequence
atgtgtcaactcctggagagcactgtcatacaacctcaaggcgattctcccgttgcagtcctgtgcgtttgcgatctgtcccccgctcaatgtgacatcaattgctgctgtgaccctgattgttcatctgtcgattttagcgtgttcagcgcatgtagcgttccagttgtgactggtgactctcagttctgtagtcaaaaagctgtgatctactctctgaatttcaccgcaaatccccctcagagagtgttcgaactcgtggatcaaattaatccttccattttctgtattcacatcacaaactacaagcctgccctctctttcattaaccccgaagtgcctgacgagaataatttcgataccctgatgaaaacttccgatggcttcacccttaatgccgaatcatacgtttcattcaccacaaagctcgatatccccaccgcagccaagtatgagtatggcgtgccactgcagacctccgattccttcttgcgcttcccgtcctctcttacttccagcttatgcaccgacaataatccagcagccttccttgtaaatcaagctgtcaagtgtacacgcaaaatcaacctagagcagtgcgaagaaattgaagctctgtctatggcgttttattctagccccgagatcctgcgggttcctgattcacggaaaaaggtgccaatcaccgtgcaatccatcgttatccagagtttaaataaaaccctgaccaggcgagaggatactgacgtcttgcagccgactttggtgaatgcgggacattttagtctttgcgtaaacgtggttttggaagtaaagtactctcttacctacacagatgcaggagaggtgacaaaagccgatttaagctttgtgctggggaccgttagttcagttgtggtgcctttgcagcagaagttcgagattcactttctccaggaaaatacgcagcctgtgcctttatcaggaaatccaggctacgttgtgggactgcccttggctgcagggttccagccgcataaaatgtccggcatcatacagacaaccaatcgatatggccaactcaccatactgcatagtaccaccgagcaagactgtcttgctcttgagggcgtgcgaactcctgtactcttcggctacactatgcagtctggatgcaaactgcgactgaccggggcactcccctgccagcttgttgcccagaaggtaaagtccctgttatggggccagggatttccagattacgtggctccattcggaaactcccaggcacaagacatgctagattgggtgcccatacacttcattacacagtctttcaataggaaagactcatgccagcttcctggcgctctggtcattgaggtcaaatggaccaagtatggatcactgttaaatcctcaagctaaaattgtgaacgtaacagctaaccttattagctcgtccttccccgaagccaatagcggtaacgaacgcactatattgatctcaaccgccgtcacctttgtggacgtcagcgcccctgcagaggctggctttagggccccaccagccataaatgcaagacttcccttcaattttttcttccctttcgtatag

SEQ ID NO: 11063 - DNA, 1722 bp, Artificial Sequence
  Description of Artificial Sequence: Synthetic coding sequence
atgagaccaagaggactgccgccactactggtagtcttgttaggttgttgggctagcgtgagcgcacaaaccgatgccacccccgctgtcactaccgaggggctcaatagtactgaggcggcacttgccacctttggcacttttccctctacaagaccccctggcacacctcgggctccaggccctagttccgggcctagacccacccctgttactgatgtggccgtcttgtgcgtgtgtgacctgagtcctgcccagtgcgatataaattgttgttgtgaccccgattgttcaagtgtggacttctccgtgttcagcgcctgctctgtgccagtggtgacaggggactctcagttctgcagtcagaaggctgtgatctactcattgaactttacagcaaacccaccacagagagtgttcgagctcgtggatcaaataaatcccagcatattttgcatacacatcaccaattataagccagccctgagcttcatcaatcctgaagtccctgacgaaaataatttcgatacgctcatgaagacctccgacggattcacgctgaacgccgagagttacgtaagctttaccacgaagctggacatccctaccgccgctaagtatgagtacggagtgcccctacagaccagtgattcattcctgcgatttccatcctctctgacgtcctccctgtgcacggataacaaccccgctggccaggcctattggtttacacctgtgatccccgctctttgggaggccgaggccagaggttcactggaggtccccgactcccgcaagaaagtgcccatcacggtgcaatccatcgttatccagagcctgaacaaaacactgactcgcagggaggacaccgacgtgctacagccaacgctagtgaatgccggtcatttcagcctgtgtgtgaacgtcgtcctagaagttaaatactctcttacttatacagacgctggcgaagttaccaaagcagacctctcttttgtcttaggcaccgtatcttctgttgtggtgcccctacagcaaaaatttgaaatccacttcctccaagaaaacacacaacctgttccactgtcaggcaatcccggttacgtagttggattacccctggctgccggatttcagccgcacaagggcagcggtatcattcagacaacaaataggtacggtcagctaacaatactacacagtactactgagcaggactgtctagctctcgagggtgtgcggacaccagtgctgtttggctacactatgcagagtggatgtaagctgaggctgaccggtgccctgccttgccagctggttgctcaaaaagtgaagagtttattgtgggggcagggcttcccagattacgtggcccctttcggaaattcacaggcacaggatatgcttgactgggtgcccatccatttcattacacaaagtttcaatcgaaaggattcatgccaattgccgggtgctctggtcatcgaggtcaagtggacaaagtacgggagcttactcaacccgcaagccaagatcgtgaacgtgacagcgaatctgatatctagctctttccctgaggccaatagcggcaacgaaagaactattctcatcagcaccgctgtcacgttcgtggacgtctcggcgcctgcagaggccggattcagagcgccacccgcaattaacgctcgccttccctttaactttttctttccttttgtctag

SEQ ID NO: 11064 - DNA, 1230 bp, Artificial Sequence
  Description of Artificial Sequence: Synthetic coding sequence
atgaaaacatccgatggtttcactctgaatgccgagtcgtatgtttccttcaccacaaagctggatattccaaccgctgctaagtatgagtacggagtgccgctccagacttccgattcatttctcagattcccaagcagtcttacctcaagtctgtgtacagacaataatccagctgctttcctggttaatcaggctgtcaagtgcacccggaaaattaatttggagcagtgcgaagagatcgaagctctgtcaatggccttttacagctcgcccgagatcctccgcgtgcctgattctaggaaaaaagtgcccattaccgtgcagtccatcgtgatccagtctcttaataagactctaaccagaagagaagatacagacgttctccagccaactttggtcaatgcagggcacttcagcctgtgcgtcaatgttgtgctggaggtcaagtactcgctgacctacacagatgccggagaggttacaaaagccgacctcagctttgtcctgggcaccgtctcaagtgtggtcgttcctcttcaacaaaagttcgaaattcattttctccaggaaaacacacaacccgtacccttaagcggcaacccaggttacgtggtcggattaccactggctgcagggttccagccccacaaagggagtggaatcattcagacaacaaacaggtacggacagctcacaattctacatagcacaactgaacaagattgtttggccctggagggagtgcggacaccagtgctcttcggatatacgatgcagtctggctgcaagctcaggctgacaggggctcttccctgtcaattggtggcccaaaaggttaaatccctcctgtggggacaaggcttcccagattacgtcgcacccttcggaaatagccaagcccaggacatgctcgactgggttcctatccattttatcactcaaagttttaatcggaaagacagttgtcagctaccgggagctttggtcattgaggttaaatggactaaatacggatccctcctgaatccgcaggccaagattgttaacgtcacagcaaatctgatcagctcttcgtttccagaggccaacagcggaaacgagcggactatcttgatctcaaccgcagtgacttttgtagacgtatctgccccagcagaggcagggttcagggcaccgcctgctataaacgcacggctgccattcaacttcttctttccttttgtatag

SEQ ID NO: 11065 - DNA, 1779 bp, Artificial Sequence
  Description of Artificial Sequence: Synthetic coding sequence
atgcggccaaggggattaccacccctcctggtggtattactgggctgttgggcctccgtctctgcccagacagatgctactcctgctgtgaccaccgagggactaaatagcaccgaggctgccttggcaacctttggtacttttccctctacaagaccacccggaactcctcgcgctcctggtccttcttcggggcctcgcccaacccctgttaccgatgtggcagtactgtgcgtatgtgatctcagtccagcccaatgcgacataaactgttgctgtgatcctgattgctcttcggtggattttagtgtattctccgcctgcagcgtgcctgtcgttacaggcgattctcagttttgttcccagaaggccgtgatttattcgctaaactttacagcaaatccacctcagcgcgtgtttgagctggtagatcagatcaacccctctattttttgtatccacattaccaactataagccggcattgtctttcataaaccccgaagtccctgacgaaaacaacttcgatactctaatgaaaacctccgacgggttcaccctaaatgctgaaagctatgtgtctttcaccacaaaactcgacattcccactgccgctaaatacgagtatggcgtgcccctccagacctcggattcattcctgaggttcccttcaagtctgacgtcctcactctgtactgacaataaccccgcagcgttcctcgtaaaccaagccgtgaaatgcacacggaaaattaatcttgaacagtgcgaggagattgaagccctgtctatggcattctactctagcccggagattctaagagttccggactcgcgcaagaaagtgcccatcaccgtccaatcaatcgtcatccagtcactgaataaaacgctcaccaggcgtgaggacacagacgtcctccagccaactttagtgaatgctggacactttagtctatgcgtgaatgtcgtgctcgaggttaagtatagtctgacctacacggacgctggcgaggtgacaaaggccgacttatcatttgtgctgggtacggtgagcagcgtcgtggttcccctccaacagaagttcgaaatccactttctgcaggagaacactcagcccgttcctctgtccgggaaccccggttacgtggttggactgcccctcgccgctggcttccagcctcataagggctcgggaatcatccagactactaaccggtacggtcaacttacaatcctccattcaactaccgaacaggactgtctcgccctggagggagtgcggactcctgtgcttttcggctataccatgcagtcaggctgcaaattgagactgacaggggctctgccctgccagcttgtggcccaaaaggtgaaaagtctcctctggggccaggggtttcccgactacgtagccccattcggaaattctcaagcacaagacatgctggattgggtgcccatccattttatcacacagagcttcaatagaaagcattttgtgctacaggacagctgtcaactgcctggtgcattggtgatcgaggtaaaatggaccaaatacgggtccctcctgaaccctcaagccaagattgtaaacgtcaccgccaacctgatatccagtagtttccccgaggccaattctggcaacgaacgaaccatcttaatcagtaccgccgtgacgtttgtagacgtgtcagcccctgcagaagcgggtttccgtgccccacccgcaattaacgccaggctgccttttaatttcttttttccctttgtatag

SEQ ID NO: 11066 - DNA, 552 bp, Artificial Sequence
  Description of Artificial Sequence: Synthetic coding sequence
atgatttttttgttgctcatgctgagtctggaactgcagctccaccagattgccgcactttttaccgtgacagtacctaaggagttatacattatcgaacacgggagcaacgtgacgctcgagtgtaattttgataccggaagccacgtgaacctaggggcaatcactgcgagccttcagaaagtggagaatgacacaagccctcacagggagagggcgaccttgctggaagagcagctgcctctaggcaaggcctcatttcacatcccccaggtgcaagtgcgcgatgaggggcagtaccagtgcataattatttatggcgtggcctgggactataaatatttgacgctgaaagtgaaaggtcagatggagccgcgtacgcacccgacgtggctgctccacatatttattccgttctgcattatcgcattcatatttattgccaccgtaattgctctccgcaagcagctctgtcagaagctgtatagctcaaaggataccaccaagagacccgtcactactactaagcgtgaggtgaactccgccatttag

SEQ ID NO: 11067 - DNA, 822 bp, Artificial Sequence
  Description of Artificial Sequence: Synthetic coding sequence
atgatctttttgctgcttatgctgagtcttgagttacagttacatcagattgccgctttgttcacagtgactgtgcccaaagaactgtacatcattgaacatggctcaaatgtcacactggaatgcaattttgataccggttcacatgtgaatctgggcgctattacagctagtttgcagaaggtcgagaatgatacttcccctcacagggagagagccacactgctcgaagagcaactgcctctcggaaaggcctctttccacatcccacaggtgcaagttagggacgaggggcagtaccagtgtattatcatttacggcgttgcatgggattacaagtatctgaccctgaaggttaaggcatcataccgcaagatcaacactcacattctgaaggtgcccgagaccgacgaggtcgaattaacatgccaggccaccggatatcccctggctgaagtatcatggcctaacgtctccgtacctgccaataccagccactcaaggacaccagaggggctgtatcaggttacatccgtgcttaggctgaagcctcctcctggccgtaacttttcctgtgtgttttggaacacgcacgtgcgcgagctcactctagcctcgatagatctgcaaagtcagatggagccacgcactcatcctacatggttactgcatatctttattcccttttgcatcatcgcctttatcttcattgccactgtaattgccttgcggaagcagctctgccaaaaattgtattcttctaaggatacgactaaacgccctgtaactacaaccaaacgagaagtcaatagtgcaatatag

SEQ ID NO: 11068 - DNA, 372 bp, Artificial Sequence
  Description of Artificial Sequence: Synthetic coding sequence
ctgggggatcgtaggggcagaagctccggggcacgcgctgctgcagtgggatcgacaggggagcgcttagagatggaagaagatatactccagctccaggctgaagccacggccgaggtgctcggtgaagttgcgcaggcacagaaggtgcttcgggactcggtccaaaggctggaggtacagctgcggagtgcgtggctgggaccagcctaccgagagttcgaggtcttgaaagcacacgcagacaagcagtcgcacatcttgtgggcgctcacaggccatgtgcagagacaaagacgggagatggttgcgcaacagcacagattacgccagatccaagagcgcctgcacacggcagcgctgccagcctag

SEQ ID NO: 11069 - DNA, 345 bp, Artificial Sequence
  Description of Artificial Sequence: Synthetic coding sequence
atggcctccttcaagttggcagactctgtctgggaggattctttatccaagcgccaaaggaatcagggtcgcatgaagaccttacccgtgctggtactgtcgctgacccttctgaccgtcttttctgaaacttcgccaattcttacagaaaaacaagcgaagcagctgttgcgcagccgccgtcaagatcgcccttccaaacctggcttcccagatgaacctatgagagaatatatgcatcacttgctggcattagaacatcgcgctgaagagcagtttctggagcactggctcaacccccactgtaaaccacactgtgatcgcaatcgcatccatcccgtctag

SEQ ID NO: 11070 - DNA, 345 bp, Artificial Sequence
  Description of Artificial Sequence: Synthetic coding sequence
atggccagcttcaaactagctgactctgtgtgggaggactcactgagcaagaggcagagaaaccagggaaggatgaagacattacctgtgttggtgctgtccctgacgctgctgacggtgttctccgaaacatctcctatactgactgaaaaacaggccaagcagcttctgcggtcccgcaggcaggatcggccttctaaaccaggtttccccgacgaacctatgcgggaatatatgcatcacctacttgcccttgaacaccgcgctgaggaacagtttctggagcactggctgaacccccattgcaagccacactgcgacagaaacagaatccaccccgtgtag

SEQ ID NO: 11071 - DNA, 444 bp, Artificial Sequence
  Description of Artificial Sequence: Synthetic coding sequence
atggccctccagaggacccactccctccttcttcttctcctgctgaccctcctcgggctggggctggtgcaaccgagctatggacaggacgggatgtatcagcgatttctgcgacaacatgtacatccagaggaaaccggcggttcagatcgttactgtaatctaatgatgcagcggagaaagatgactctgtatcactgcaagcgattcaacaccttcattcacgaggacatatggaatattaggtctatttgcagcaccacaaatatccagtgcaagaatggcaagatgaattgccacgagggagtcgtcaaagtgacagactgccgggatacaggcagctccagagctcccaattgtcgctaccgggctattgcttccaccaggagggtggttattgcatgcgagggcaacccccaggttccggtgcactttgatggttag

SEQ ID NO: 11072 - DNA, 1302 bp, Artificial Sequence
  Description of Artificial Sequence: Synthetic coding sequence
atggagccgcagctcggcccagaggctgctgctctcagaccgggatggcttgctctgctcttgtgggtgtccgcgttgtcttgtagctttagcctgcccgcatcctctctctcctccttggtgcctcaggtgaggaccagctataacttcggaaggaccttcctgggacttgataagtgcaacgcctgcatcgggacaagcatttgtaaaaaattctttaaggaagaaatccggagcgacaactggctggcaagccacctgggactgccccctgattcccttctatcgtatcctgccaattattccgacgattcgaagatttggcggccagttgaaatcttccggctggtcagcaaataccagaacgaaatatcagacaggcggatttgcgcaagcgcaagcgcacccaagacctgcagcatcgagcgggttctgaggaagacggagcgcttccagaaatggctgcaagcaaagaggctaactcccgacctggtgcaagggctggccagcccgctgctgaggtgcccatcccagaggctgttggacagagtggtgaggcggtacgccgaggtcgctgacgccggatcaatttttatggaccactttacggatagagataaactccgccttctttataccctcgctgttaatagtcatcccatcctgctccagattttcccgggagcggaaggatggcccttgcccaagtatttgggtagctgcgggagatttctggtaagcacatcaactcgaccactccaggagttttacgatgccccacctgatcaggccgctgacttggcctaccagctgcttggcgtgctggagtccctgcggtcaaatgatctaaattactttttctattttacacatattgacgcaggtatgtttggggtgttcaataatgggcacttgttcatacgagacgcctctgccgtgggagttatcgacaagcaagaagggagtcaggaggcaaatcgcgctggcgaaaacaaggacatcttctcctgtcttgtgtctggctgtcaagctcagttgccttcttgtgagtcaattagtgaaaaacagtctttagtgcttgtgtgtcagaagctgctccctcgacttctgcaaggtcggttcccatctccagtacaggacgatatagacagtatacttgtgcagtgcggcgattcgatccggccagaccctgaggtgctgggtgccgctagccagcttaaggatatcctccgacccttgaggacatgtgatagcagattcgcctaccgctatcccgattgcaagtataatgacaagttttag

SEQ ID NO: 11073 - DNA, 600 bp, Artificial Sequence
  Description of Artificial Sequence: Synthetic coding sequence
atggaaacatttccactgttacttctttccctgggactcgtgttagccgaggcctccgaaagtactatgaagatcatcaaagaggagttcactgacgaagagatgcaatacgatatggccaaatccggccaagagaaacagaccattgagatactgatgaaccctattctgctcgtgaagaacacgagtctgtccatgagtaaagacgatatgtcctccacgctgctgacatttcgcagcctgcactataacgaccctaagggaaactcctctggtaacgataaggagtgttgcaacgatatgacagtctggcgaaaggtgtcagaagctaatggatcgtgtaagtggagtaacaatttcattcgaagcagcacagaggtgatgagacgggtgcatcgggctcccagctgcaagttcgtgcagaatcctggtatttcttgctgtgaatcgctggagttggagaatacagtgtgtcagtttactacagggaaacagtttcctaggtgccagtaccactccgtgacatcccttgagaaaattcttacggtgcttactggacacagtctgatgagttggttagtgtgtggaagtaaattgtag

SEQ ID NO: 11074 - DNA, 600 bp, Artificial Sequence
  Description of Artificial Sequence: Synthetic coding sequence
atggaaaccttcccattactgctcctctccctgggtctcgtcctggctgaggcctctgagtctaccatgaaaatcatcaaggaagaattcacagatgaggaaatgcagtacgacatggcaaaatccggccaagaaaagcagactattgagattctcatgaatccaatcctgttagtgaagaatactagcttgtctatgagcaaggatgatatgtcgtccacgctgctaacctttcggagcctccactacaatgaccctaaggggaactcaagcggtaacgataaagagtgctgtaacgatatgacagtttggaggaaagtaagtgaggccaacgggtcgtgcaaatggtccaacaactttatcaggtcatctacagaggtcatgagacgcgttcatcgggctccatcttgcaagttcgtgcagaaccccggaatcagctgctgtgaatctctagagttggagaatacagtgtgccagtttaccaccggtaagcaattccctaggtgtcagtatcactcggtgacttctttggaaaaaattttgacagtcctgactggccattccctgatgtcgtggctggtgtgcggttctaagctctag

SEQ ID NO: 11075 - DNA, 291 bp, Artificial Sequence
  Description of Artificial Sequence: Synthetic coding sequence
atgctcccctgtctggccctgctcttgttgatggagctgagtgtgtgtactgtcgccggagacggcggtgaagagcagacactgtcgaccgaggccgagacgtgggagggggctggccctagcattcagctgcagctccaggaagtcaagactggtaaagcttcccagttcttcggactcatgggtaagcgggttggcgcttaccagctagaacacacatttcaggggctgctgggcaagaggtctttattcactgaggggcgtgaggatgaggcccaaggtagtgagtag

SEQ ID NO: 11076 - DNA, 981 bp, Artificial Sequence
  Description of Artificial Sequence: Synthetic coding sequence
atgactggcttatgcgggtactctgcacctgacatgcgcggactgcgtctcattatgatcccagtggagctcctgctttgctatctcctgctgcaccccgtcgacgctacaagttacggtaagcagaccaatgtactaatgcattttcctttgtccctggagtctcagaccccatcttctgatcccctatcctgtcagttcctccacccaaaatcactcccgggattcagccatatggctccactacctaaatttcttgtgtctctagctctgagaaatgctctggaggaggccggttgtcaagcagacgtgtgggccctgcagctgcagctgtaccggcaagggggagtgaacgcaacacaagtgctcatccagcacctgagaggcctgcagaagggacgcagcacggaacgtaatgtgagtgtagaggccctggctagcgctctccagttgcttgccagggagcagcaaagtaccggccgagtaggtcgctcattgcccactgaggattgcgaaaatgaaaaagagcaagccgtgcataatgtggtgcagctgctaccaggagtcgggacgttttacaacttaggaacagcattgtactacgctacgcaaaactgcttgggtaaagctagggagcggggaagagacggcgctatcgacttgggctatgatctcctgatgactatggccggaatgtccgggggacctatgggcttggccatctctgcggctctgaagcccgctctgcggtctggggtgcagcagcttattcagtactatcaagatcagaaggatgctaacatctctcagcccgagactacgaaggaggggctccgtgccatttctgatgtgagtgacctggaggagacaaccacactggccagcttcatctctgaggtcgtgtcctccgctccctactggggctgggctatcatcaaaagctatgatctggacccgggtgccggtagccttgaaatctag

SEQ ID NO: 11077 - DNA, 1476 bp, Artificial Sequence
  Description of Artificial Sequence: Synthetic coding sequence
atgagatggattctgtgttggtcgcttactctatgcctgatggcccagactgccctgggtgcgctccataccaagcgccctcaggttgtcactaagtacggcaccctgcagggtaaacagatgcatgttggcaagacccccatccaagtatttctgggcgtgccattcagtaggcctcctctcgggatccttaggtttgccccaccagaacctcccgagccctggaagggaatccgcgacgcaactacataccccccagggtgcctgcaggaatcgtggggccagcttgccagcatgtacgtctctacccgcgaacgatacaagtggttacggttcagtgaagactgtctctatctgaatgtttacgctcctgccagagctccaggcgacccccaactgcccgtgatggtgtggtttccaggcggagcttttatcgtcggcgctgcaagctcatacgaggggagcgatttggctgcgagggagaaggtggtcctcgtcttcctgcaacacaggctgggcattttcggatttctatcaacagatgactctcatgctcggggaaattggggtctcctggatcaaatggcggcactgcgctgggtgcaggagaatatcgcagctttcgggggagatcccggaaacgtaacgctcttcggtcagagcgctggagctatgagcatatcaggattgatgatgtctcccctggcttcaggcctgttccacagggcaatttctcagagtgggaccgctctctttaggctcttcatcacttccaatccactgaaagtcgcaaagaaggtcgcccacctggccggatgcaatcataacagcacacagatcctcgtaaattgcctccgcgctctgagtgggaccaaggtgatgagagtctcaaacaagatgcgttttctccagctgaattttcaaagggacccggaggagataatctggtccatgtctccggtcgtagatggggtcgtcattcccgatgatccactagtactgctgacacaaggaaaagtttccagcgtgccctatctacttggcgttaataatctggaatttaattggttactcccttataatataacaaaagaacaggtgcctcttgtcgtggaggagtacttggataacgtgaatgaacacgattggaaaatgctgcgcaacaggatgatggatattgttcaggatgccacctttgtctatgcaaccctgcagaccgcccactaccacaggggcctcagtatgggcaaggagaaggcattaagccttcagatgatgaagtactgggcaaatttcgccagaactggtaacccgaacgacggtaatctgccatgttggcctcggtataataaggatgagaagtacctgcaactggacttcacaacccgggtgggaatgaaactgaaagagaagaaaatggctttttggatgagcctctatcagtctcagcgtccagagaaacaacgacagttctag

SEQ ID NO: 11078 - DNA, 285 bp, Artificial Sequence
  Description of Artificial Sequence: Synthetic coding sequence
atggctgcctttccacataaaatcattttcttcctggtctgttcgactcttacccatgtcgcctttagcggcatcttcaataagagagacttcacgaggtggccaaaacctcggtgtaagatgtacatccccttggacccggactataacgcagactgccctaatgtgactgctcctgtctgtgccagcaacgggcacaccttccagaatgagtgctttttctgtgtagaacaaagggagtttcattatcgcattaagtttgagaagtatggcaagtgcgactag

SEQ ID NO: 11079 - DNA, 402 bp, Artificial Sequence
  Description of Artificial Sequence: Synthetic coding sequence
atgagacagcggctcttgcccagcgtgacaagtctgctcctagtagcactcctttttcccggaagctcccaagcccgtcacgtaaaccactcggccactgaagctcttggagaactgcgtgagagagctcctggtcaggggaccaacggcttccagctgctgaggcatgcagtgaagagggacttattgccaccacggacgcctccttatcaaggggacgtgccaccaggtatccggaacacaatctgccatatgcagcagggcatctgccgtctgtttttctgccactctggtgaaaaaaagcgggatatctgcagcgatccatggaacaggtgctgcgtgagcaacactgatgaagaaggaaaggagaagccagaaatggatggcaggagtgggatctag

SEQ ID NO: 11080 - DNA, 564 bp, Artificial Sequence
  Description of Artificial Sequence: Synthetic coding sequence
atgggttgttgcggctgctcaggcggttgcggatctggctgcggagggtgtggcagtggttgtggtggttgcggtagcagttgttgcgtgcctatttgttgctgtaagcccgtctgttgctgcgtgccagcatgttcttgctcaagttgcggaagctgtggaggatcgaaggggggaaggggaagctgcggaggaagtaaaggcgactgcggcagctgcggtggttctaaagggggttgcggttcatgcggctgctcacagtgtagctgctataagccttgctgttgcagcagcggttgtggtagctcgtgttgccagtcttcatgctgcaagccatgttgctcacagtctagttgttgtaagccttgcagttgctcctccggctgcggctcatcctgttgccagtccagttgctgtaaaccctgctgctctcagagttcgtgttgcaagccttgttgttgtagttcaggatgcggcagctcatgctgccagtcatcctgttgtaagccttgctgctctcaaagctcatgttgtgttcctatctgttgtcagtgcaaaatttag

SEQ ID NO: 11081 - DNA, 564 bp, Artificial Sequence
  Description of Artificial Sequence: Synthetic coding sequence
atgcggcctctggcaggagcgccagtccccaaacgtcagaagtgcgatcattggaccccgtgcccaagcgacacatacgcctatcgcctgttgtctggaggtgggagatctaaatatgcaaaaatatgctttgaagacaacttgctgatgggggaacagcttgggaatgtcgctagaggtatcaacattgcaatagtgaattacgtcacaggaaacgtcactgcaactcggtgttttgacatgtacgagggcgataattcaggacctatgactaagtttatccagtctgccgcacccaagagcttgctattcatggtaacgtatgacgacggatcaaccaggctcaacaacgacgcaaagaacgccatagaggccttaggtagcaaagaaatcaggaatatgaaattccgcagctcatgggtctttatcgccgcaaaaggactggagctcccttctgagatccagcgtgaaaaaatcaatcattcggacgctaaaaataaccggtattccgggtggccggcagaaattcaaattgaaggatgtattcctaaggagagaagttag

SEQ ID NO: 11082 - DNA, 249 bp, Artificial Sequence
  Description of Artificial Sequence: Synthetic coding sequence
atgaagatcttgtgcatctttctgactttcgtgtttacagtgtcttgtgggccaagtgtccctcagaagaagacaagagaagtagccgagcgaaagcgagaatgccagctggttagaggcgcatgcaagccagaatgtaattcttgggagtacgtatactattattgtaatgtgaatccatgctgtgccgtctgggaataccagaagcctatcatcaacaaaattacatcgaaactacatcagaaatag

SEQ ID NO: 11083 - DNA, 186 bp, Artificial Sequence
  Description of Artificial Sequence: Synthetic coding sequence
atgaagattcacgtgtttctgttcgtgcttttctttttccttgttccgattgctactagggtgaagtgtgccgtgaaggacacttacagctgtttcattatgcgcggaaagtgtcgtcacgagtgtcacgatttcgaaaagcccatcgggttctgcaccaagttgaacgctaactgctatatgtag

SEQ ID NO: 11084 - DNA, 1056 bp, Artificial Sequence
  Description of Artificial Sequence: Synthetic coding sequence
atgggtaatttgttcatgttgtgggctgccctgggaatttgttgtgcagcatttagcgccagcgcatggtctgtgaacaacttcctgattacagggccaaaggcctaccttacttacacaacctcagtcgcacttggagcccaaagcggaatcgaagagtgcaagtttcagtttgcttgggagcggtggaattgtccagagaatgctttgcagctgagcactcataatagacttcgcagcgctacacgggaaacctcttttattcacgccatttcatcggctggcgtgatgtatattattacaaaaaattgtagcatgggagacttcgaaaactgcggctgcgatggttcgaacaatgggaagacagggggacacgggtggatttggggcggatgcagtgataatgtagagttcggcgaaaggatctccaagctcttcgtcgattctcttgagaaaggaaaagatgccagggcgcttatgaatctacataacaatagggcaggacggctggccgttagggccaccatgaaaaggacttgcaagtgccacggaatctcaggtagctgtagtattcagacctgttggctgcagttagcagaatttcgcgagatgggagactacttgaaagctaagtatgatcaggctcttaagatagagatggacaaaagacagctgcgcgcaggaaacagcgcggaagggcattgggtccccgcagaagcctttctgccctccgctgaagctgagttaatttttcttgaggagagcccagactactgtacatgtaactcatctcttggcatttacggaacagaaggtcgcgagtgcctccaaaactcccataatacaagcagatgggagcgccgatcatgcggacgcctttgcaccgaatgtgggctccaggttgaggagagaaagaccgaagtcatttcatcctgcaactgtaaattccaatggtgttgtactgtgaaatgtgaccaatgccgccatgtcgtcagtaaatactactgcgctaggagccctggctcagcgcagtccttgggaaagggaagcgcttag

SEQ ID NO: 11085 - DNA, 1446 bp, Artificial Sequence
  Description of Artificial Sequence: Synthetic coding sequence
atgcagtccagattgctcttgctgggcgcacccggtggtcacggcggtcctgcatccaggcggatgcgtctgcttctgaggcaagtcgtgcaacgaaggcccggaggagatcgccagcggcctgaggtccgcttactgcacgctgggagtggggctgataccggcgacacagtaaacattggcgatgtcagctacaagcttaagataccaaagaaccctgaattggtgccacagaactacatctccgattctttagctcagagtgtggtacaacatctcagatggataatgcagaaagacctgctgggccaggacgttttcctgatcggtcctcctggtcctctccgacggagtatcgcaatgcagtacctggagcttacaaagcgcgaagtcgagtatattgccctgagccgcgacacaactgagacagacctgaagcagagaagggagattagggctggaactgccttttatatcgatcagtgcgcggtgagggccgctacagaagggcgaaccctaattctggaagggctcgagaaggccgagcgtaatgtgctgcccgtgctcaacaacctgcttgagaatcgggagatgcagctggaagacgggcgatttttaatgagtgctgagcggtacgataagctgttgagggatcacactaaaaaggagctggacagctggaaaatcgttcgtgtctcagaaaactttcgcgttatcgccctgggcttgcccgtgccccgatacagcggcaacccattagaccccccacttcggagtagattccaagccagggacatctactaccttcccttcaaggaccagctaaaactgctgtactcaatcggcgctaacgtcagcgctgaaaaggtcagccaactcctgtccttcgcgacaacactctgctcacaagagtcatcaactctcggcctcccagacttccccctcgactccctggccgctgctgttcaaatcctagacagtttccctatgatgcccatcaagcacgctatccagtggttgtatccgtattctatactgcttggccacgaaggaaaaatggccgtggaaggtgtactgaaacggtttgagctgcaagattctgggtcttcactcctgccaaaagagattgttaaggttgagaagatgatggaaaatcatgtgtcccaggcgagcgtgaccattagaattgccgataaagaagtaaccattaaagtgccagcaggaactcggctgctgtctcagccttgtgcgtccgaccggttcatccagaccctcagtcataaacagctacaagccgagatgatgcaatcccatatggtgaaagacatttgcctcattggtggaaaagggtgtggcaagactgtgatcgccaagaattttgcggataccctgggatataacatcgaacccatcatgctgtaccagcataaggttccccacatttag

SEQ ID NO: 11086 - DNA, 786 bp, Artificial Sequence
  Description of Artificial Sequence: Synthetic coding sequence
atggcctccctcgcggtgtctaactggccgaaacccatgcccctcatcccttgcctctcgtggagcaccgcctccggagtcttcacaactggagtgctcagcaaatcaatcaattggcgggaactggaaaagcagtactatacacagactgtctatgaggaagaaatcattcacatgcttgaatattgtggtacagactcttttaagatgggacaagaattcgtcaagcacttcacctcctcagccgataagctcactaatctgaacctcgtgagccgaactctcaatcttgatatatcaaaccaggtcgtatcccaaaagccagcggactgccacaacagctccaagacatcagtcagtgcaacatccgagggactgctgttgcaggacacctcgaaaatgaaaagattcaaccagactctgtctaccaataagagtggctacacttctcgaaacccccagtcttaccacctactgtcaaaagaacagtcaagaaattcccttaggaaggagtctcttatttttatgaagggggttatggacgaatgtacccacgttgccaacttctcagtgccggtagatccatctcttatcatagtcgtccaagccaaggaggatgcctatatccccaggacaggcgtgagaagtctgcaggaaatttggccaggatgcgaaatacggtaccttgaagggggtcatatctccgcctacctgttcaagcagggattgttcaggcaggccatctacgatgctttcgatcggtttctgcacaagtatgccaactag

SEQ ID NO: 11087 - DNA, 1245 bp, Artificial Sequence
  Description of Artificial Sequence: Synthetic coding sequence
atgggcgtgagtaagctggacatcctctacagacgcttattattgacgaagcttttcattaggggatgggggcgtccggaagacctcaaacgactgtttgaattccgcaagatgataggtaaccgggaacgatgccagaacctggtgtcatccgactatcccgtgcatatcgataaaattgaagagcagtctgactgtaaaatcctggacggccacttcgttagccccatggcgcactatgtcccagacatcatgccaatcgagtcagttatcgcacgattccagttcattgtgcctaaagagtggaatagcaagtatcggccagtttgcatacacctggctggaactggcgaccatcattactggcgtcgaaggaccttaatggccaggcccatgatcaaagaagcccgaatggcttccttgctcttagaaaacccctactacggttgtagaaagcctaaagatcaagtacgctccagcctgaaaaatgtaagtgacctgttcgtgatgggtggagctctggtattagagtccgcggcactactccactggctcgagagggaagggtatggccctcttggaatgaccggaatctccatggggggacatatggccagtctcgccgtatccaactggccaaagccaatgcctctgattccctgcctctcttggtccacagcctccggggtctttacaacaaccgactccttcaagatggggcaggagtttgtaaagcacttcacatcatccgccgataagctgaccaacctaaatctggtgagcaggacattgaatctggacattagcaatcaggtggtgagtcagaaaccagccgattgtcacaatagctctaagaccagcgtgagtgccacttctgaaggactccttcttcaagatacctcaaagatgaaacggtttaaccaaaccctatccaccaataagagtggctatacttccaggaacccccagtcttaccacctgctgagcaaggaacaaagccggaattctttgagaaaagagtctctgatcttcatgaagggagtcatggacgagtgtacacacgtcgccaacttttctgtgcccgtggaccccagtctgatcattgtggtccaggccaaggaagacgcttacatcccacggaccggggttagatctctgcaagagatatggcctggatgtgagatccgttatctggaggggggtcacatatccgcttacctgttcaagcagggccttttccggtag

SEQ ID NO: 11088 - DNA, 747 bp, Artificial Sequence
  Description of Artificial Sequence: Synthetic coding sequence
atgaagctcacctttttcttaggactcttagctctcattagctgctttaccccctccgaaagtcagcgattctcgcgccgaccctacctacctggccagcttccccctcctcccctatatagacccagatgggtaccgccttcccctcctcccccttacgattcaagactgaatagccctcttagcttgccgttcgtcccagggagggtaccccctagctcgttctctcggttttcacaggccgtgatactgagtcagctcttccccctcgagtctattcgacaaccaaggctgttccctgggtacccgaacctgcactttccactgcgcccatactacgtgggaccgataaggatcctcaagcccccatttccacctatccctttctttttggccatttacctgcccatcagcaaccctgagccgcagataaacataacgactgcagacactacaatcacaactaatcccccaacaacggccactgcgaccaccagcacatcaacgaagccaactatgacaatctctagctctacggtacccatttccagtacacccgagccggcaacctcaattagtgccgcaacccccgcagcatcgaccgagaatactacccaaatccttgcaaataggccacataccgtcctgttaaatgctaccgtgcaggtgacaaccagtaaccagactattttgtcgagtcccgcattcaagtccttctggcagaagttatttgcaatttttggctag

SEQ ID NO: 11089 - DNA, 231 bp, Artificial Sequence
  Description of Artificial Sequence: Synthetic coding sequence
atgggtgcggctatctcccagggcgcattgatcgcaatcgtttgtaatgggctcgtcggattcctgctgctgttactttgggttatcctctgttgggcttgccatagccggagcgctgatgtcgactccctgtccgagtcctctccaaattcgagtcctggcccatgccccgaaaaagcccctccacctcagaagccatcacacgaaggcagctacttgctgcagccttag

SEQ ID NO: 11090 - DNA, 1536 bp, Artificial Sequence
  Description of Artificial Sequence: Synthetic coding sequence
atgctcgtcgatggcccatcagagaggccagcactgtgctttttgctgctggcagtggcaatgagtttttttggaagcgccctcagtatcgatgagactcgggctcacctgctcctcaaggagaagatgatgagactaggcggacgcctcgtgctgaatacaaaagaggaactcgctaacgaacgtctgatgacgttgaaaatcgctgaaatgaaggaagccatgagaactctgatatttccgccatccatgcatttcttccaggctaaacacctgatagagcggtcacaggtgttcaatatcctcagaatgatgcctaagggggctgctttgcatcttcacgatattggcatcgtgaccatggattggctggtgagaaacgtgacctatcgacctcactgtcacatctgctttaccccccgtggtataatgcagtttaggtttgcccaccccaccccaaggccatctgagaagtgctctaaatggatcctgctcgaggattacaggaagagagttcaaaacgtgacggagttcgatgatagtcttcttcggaacttcactctagtcacacaacatccagaagtcatctataccaatcagaacgtggtgtggtctaaatttgaaacgattttctttaccatttccgggttgattcattacgccccagtctttcgggattacgtattccgttccatgcaggaattctacgaggacaatgtcctgtatatggagatccgggcacgactgttacctgtctacgaactgtcaggagaacaccatgacgaagagtggtccgttaaaacttaccaggaagtcgctcagaagttcgttgaaacacatccggaattcatcggaatcaaaattatctactctgatcatcggagcaaggacgttgccgtcatcgccgaaagcattcgcatggctatgggcctccgaattaagttcccaacagtcgtcgcaggctttgatctggtcggacatgaggacaccggtcactccctccacgactacaaggaggctctcatgatcccagcaaaggacggcgtcaaactcccatacttcttccacgccggagagacagattggcaggggacctccatagataggaatatcctggacgccctgatgctgaatacaactaggatcgggcacggttttgccctcagcaagcaccccgctgttcgaacctactcctggaaaaaggacatccccatcgaagtctgtcccatatctaatcaggtgctgaaattggttagtgacctgcggaaccacccagttgctacactgatggcaaccggccaccccatggtcatctcatctgatgatccagctatgttcggagcaaaagggctttcttacgatttctacgaagtgttcatgggcatagggggaatgaaggccgacctgcggacactcaaacagctagccatgaattcgatcaaatactctaccttactggagagcgagaagaacactttcatggaaatctggaaaaagagatgggataagttcatcgcagacgtcgccaccaagtag

SEQ ID NO: 11091 - DNA, 1536 bp, Artificial Sequence
  Description of Artificial Sequence: Synthetic coding sequence
atgctggtcgatggtccctcggagcgtcccgctttatgttttcttcttctggctgttgccatgtccttcttcggaagcgctctgagcattgatgagactagggcgcacctcctcttgaaagaaaaaatgatgcgtctcggcggtcggttggtgctgaataccaaagaagaacttgcaaatgaacgtctaatgactctgaagatcgccgagatgaaagaggctatgagaactctgattttcccaccgtccatgcactttttccaggctaaacacttaattgagcgatctcaggtgttcaatattctccggatgatgcctaaaggggcagctctgcatctgcacgacattgggatcgtaactatggactggctggtacggaacgtcacgtatcgccctcactgccacatttgcttcacacctagaggaataatgcaatttcgtttcgcccaccctactcccaggccaagtgaaaagtgttcaaagtggatcctgctcgaagactaccgcaaaagggtgcagaacgttaccgagtttgatgactcgttgcttcgtaacttcacactggtgactcagcaccctgaagtgatctataccaatcagaacgtagtgtggtcgaaattcgagacaatattctttaccataagcggccttatccactatgccccagtctttcgtgactatgtttttaggagtatgcaggagttctatgaggataacgtgctgtacatggagatccgcgcacgcttgctaccggtgtacgagctgtctggagagcatcacgatgaggagtggtcagtgaagacctatcaggaggtggcccagaaattcgtggagactcatccagagtttatcggcatcaaaattatctactccgatcacagatctaaggatgtggccgtcattgctgagagcattcggatggcaatgggtttgagaatcaaatttcccactgtggtagcgggatttgatcttgtgggacatgaagacactggccatagcctccatgattataaggaggctttgatgattccagccaaggatggcgtgaaactcccatacttcttccatgccggtgaaactgactggcagggtacaagcatcgataggaacatccttgatgctctgatgctgaacaccacccgaatcgggcacggctttgccctttccaaacaccctgccgtgagaacctactcatggaaaaaagatatccccatcgaggtctgtccaatatcaaaccaggtacttaagctcgtgtccgacctacggaatcaccccgtcgccacgttgatggccacagggcatcctatggttatttcctcagacgatccagccatgtttggtgcaaagggtcttagctatgatttctatgaggtttttatgggcataggtgggatgaaagccgatctgcggactctgaaacagctcgccatgaactctattaagtactcaaccctcctcgagtctgagaaaaacacgttcatggagatctggaagaaaaggtgggacaagtttatagcagatgtggctaccaaatag

SEQ ID NO: 11092 - DNA, 240 bp, Artificial Sequence
  Description of Artificial Sequence: Synthetic coding sequence
atgaagctgcactccctgatcagtgttctgttgttgtttgtgaccctcatcccgaaagggaaaaccggggttatccctggccaaaaacagtgtatcgctctgaagggcgtctgtcgagacaagctgtgttccacgctggacgatacaatcggaatctgcaacgagggtaaaaagtgctgtcggaggtggtggatcctggagccttatccaactcccgtcccaaagggcaagagcccctag

SEQ ID NO: 11093 - DNA, 351 bp, Artificial Sequence
  Description of Artificial Sequence: Synthetic coding sequence
atggctgccggaagtgccccaatgcagctccacctgagagccacaataagaatgaaggatggcttatgtgttccgaggaagtggatttatcatcttactgagggctccacagacctgcgaaccgaaggcaggcctgatatgaaaactgagctcttcagcagctcatgccctggtggtatcatgttgaatgagaccgggcaggggtaccagagattcctgctgtacaacaggtccccgcaccctccagagaagtgtgtggaggagttcaagagcctgacttcctgtttggatagtaaagccttcctacttacccctagaaatcaggaggcgtgtgagctgagcaataactag

SEQ ID NO: 11094 - DNA, 543 bp, Artificial Sequence
  Description of Artificial Sequence: Synthetic coding sequence
caggtgatccccattaactctggagacttgttcgtgcacccactgtggaacagaagctgtgtcgcctgtggcaacgatatagccctgatcaagctttccaggagcgcccagctgggcgacgctgttcaactggccagcctccctccagcaggagatatactcccaaacgagacaccatgctacataaccggctgggggcgattgtataccaatggaccactacccgacaaactgcaggaagccctcctccctgtagtggattacgagcattgttcgcgctggaattggtggggcagcagcgtgaagaagactatggtgtgtgctgggggtgacatccggtctggatgtaacggggacagcggaggccctctgaattgcccaactgaggatgggggttggcaggtgcacggagtcaccagctttgttagtgcgtttgggtgtaacacacgcaggaagcccaccgtgtttactcgcgtctcagccttcatcgattggatagaagagaagctgcagggaaacaaggcaccagaatctaggacttag

SEQ ID NO: 11095 - DNA, 1215 bp, Artificial Sequence
  Description of Artificial Sequence: Synthetic coding sequence
atgcctccattcttaattacactatttttgtttcattcgtgttgccttcgcgctaatgggcacctccgggaggggatgactctgctcaagacagagtttgccctccatctataccagtcagtagcagcctgcaggaacgagaccaacttcgttatctctcctgccggagtcagcttgccccttgaaatcttacagtttggcgctgaagggagcactgggcaacaactcgccgacgcactcggctacactgtacatgataagagagtgaaggattttctccacgcggtgtatgccactctgcccaccagctcccagggcacggaaatggagttggcttgtagcctgttcgttcaagttggtactccactctcaccctgtttcgtcgagcatgtgagctggtgggcaaactcctctctggaaccggctgatctcagcgaaccaaactccaccgcaatacagacaagcgagggcgcttctcgggagactgccggtggcggaccatctgagggcccaggaggttggccatgggaacaggtttctgccgcattcgctcagctggtgttagtgagcacaatgagcttccaaggcacttggcgcaagcgcttttccagcactgacacccagatcctcccctttacctgtgcttacggcctggtcctgcaggtcccgatgatgcaccagacgaccgaggtgaattatgggcagttccaagacactgcaggtcatcaagtgggtgtgctggagcttccatacctgggttccgccgtctcattatttctggtccttcctcgggataaggatacaccactctcccacattgagcctcatctaaccgctagtacgatccacttgtggaccacttccctgcgcagagctcgcatggatgtgtttcttcccagatttagaattcagaatcagtttaatctgaaatccattctcaattcttggggtgttacagatttgtttgatcctctgaaggctaaccttaaggggatttccgggcaggacgggttctatgttagcgaagccatccataaagcaaaaattgaggtcctcgaagagggtacgaaagcttccggcgcaaccgcgctgttattgttgaagaggagtcgaatccccatcttcaaggcggatcgacctttcatatacttcctgcgcgagccaaacaccggtttcgtgttctccatcggcagagtgtctaacccactggactag

SEQ ID NO: 11096 - DNA, 444 bp, Artificial Sequence
  Description of Artificial Sequence: Synthetic coding sequence
atgggtcctgaggcactgagcagtctgctcctcctgctcctggttgcatccggagacgccgacatgaagggtcacttcgatcccgcaaagtgtaggtacgcgttagggatgcaggatcgaacaataccagactccgatatcagcgccagcagcagttggagcgacagcaccgctgcccgtcactcccgattagaatcatcggacggcgacggggcatggtgcccagctggtagcgtgttccctaaggaggaggaatacttgcaggtcgacctacagcggctgcacctggtagccctggtcggcactcagggcagacatgcgggaggcctggggaaagaattcagcagatcttatcggttgcggtactcaagagacggaaggaggtggatgggttggaaggacaggtgggggcaggaggtgatctcaggtaacgaggatccttag

SEQ ID NO: 11097 - DNA, 2631 bp, Artificial Sequence
  Description of Artificial Sequence: Synthetic coding sequence
atgggccctgaggcactgtctagtcttctgctgcttttgctggtagctagtggagatgcagacatgaagggccacttcgatcctgcaaaatgtaggtatgccctgggaatgcaggacagaaccatccctgattcggacatatcagcgagcagtagttggtcagacagcactgccgcacgacactcgagacttgagagcagcgacggcgacggagcctggtgccctgcaggttctgtctttcccaaggaagaggaatacctgcaggtggaccttcaacgtctgcacttagtcgcactggtcgggactcagggcaggcacgccggaggtctaggaaaagagtttagtcggtcttatcgtctgaggtactcgcgggatggccgtcgctggatggggtggaaggacagatggggacaggaagttatcagtggaaatgaggatccggagggagtggtcctgaaagacctcggacctcccatggtagctaggctggtccgattttatcccagggctgaccgggtgatgagcgtgtgcctccgcgtagagttgtatggctgcctgtggcgggatggactcctaagctataccgcacctgtgggacagacaatgtatttaagcgaagcggtgtatctgaatgacagtacttacgatggacataccgttggcggtctgcaatacggaggcttggggcagctcgccgacggggtggtcggcctggacgatttcagaaagtcacaggagttaagagtgtggccaggatacgattacgtaggatggagcaaccattccttcagctctgggtatgtggaaatggagttcgagtttgaccgactgcgggcttttcaggctatgcaggtccattgtaataacatgcacacactgggagctagactgcccggaggggtggagtgtcggttccgccgagggccagctatggcctgggaaggggagcctatgcggcataatctcggcggtaacctcggtgaccctagagccagagccgtttctgtgcccctaggcggtagagttgccaggttcctccagtgtcggttcctctttgcaggcccttggctgttgttcagtgagatcagcttcatctccgatgtggttaataactcctcgccagccctgggcggaactttccctccagccccatggtggcctcctggccctcccccaactaatttttcttcactagagttagagccacggggacagcagccagtggccaaggccgagggtagtcctacggcaatactaatcgggtgcctcgtggccataatcctcctgttgctcttgattatcgcccttatgctctggagacttcattggaggcggctgttatctaaagccgagcgccgtgtgctggaggaggagctgaccgtccatctctctgtccctggtgacacaatcctcattaacaacaggcccggacccagagaacctccaccttatcaggaacccagaccgagaggtaatcctccgcattccgccccttgtgtcccaaatggcagcgcatacagcggcgactatatggagcctgaaaaacccggagcaccactcctacctccgcctccccaaaattccgtcccccactatgcagaggccgacatcgttacgctgcagggagtgacagggggaaatacatatgctgtccctgccctgccacccggagcagtgggcgatggcccacccagagtggatttccccagaagtaggctgaggtttaaagagaagctcggagagggccagttcggtgaagtacatctgtgcgaggtcgacagtccccaggacctagttagtcttgacttcccactgaatgtgaggaaggggcacccacttttggtggcagtgaaaattctgcgaccagatgctacaaaaaacgcacggaatgacttcctcaaagaagtcaagatcatgagccggctcaaggacccaaatatcatccgcctccttggtgtgtgcgtccaagatgaccccctgtgtatgattaccgactatatggaaaacggagacttgaatcaatttttaagtgcccatcagctggaggataaagccgctgaaggggcacccggagatggccaagctgcgcagggtcccactatatcctatccaatgctactgcatgtggccgctcagattgcttctggcatgagatatttggcgacactgaactttgtgcacagagatctggcaacccgtaactgtctcgttggcgagaattttactattaagatcgcggattttggaatgtcccggaatttgtacgccggagactactatagggtccaggggagagccgtgctgcctatcaggtggatggcctgggaatgtatactcatgggcaagtttaccacagcaagcgacgtgtgggcttttggagtgacactgtgggaggtgctgatgctgtgccgggctcagccgttcggccagcttactgacgagcaggtgattgaaaacgccggagagttttttcgtgaccagggacggcaagtgtacctgtcacgccctccagcttgcccccaaggcctgtatgagctgatgttacggtgttggtcaagggagtcagaacaacgaccaccattttcacagcttcacagattcctggctgaggacgcattgaataccgtctag

SEQ ID NO: 11098 - DNA, 2631 bp, Artificial Sequence
  Description of Artificial Sequence: Synthetic coding sequence
atgggaccagaagctttaagcagtttgctcttgctgctactcgtggcctcaggcgatgctgacatgaaggggcacttcgatccagctaagtgccgctatgctctgggcatgcaggatcggacaataccagattccgatatttcagcctctagcagttggagcgacagcactgccgctaggcactccagattagaatcctccgatggagatggagcctggtgtcccgcagggagtgtgtttcccaaagaggaggaataccttcaggtggatctccaacggctgcacttagtggctcttgttgggacacagggacgccatgcaggtggacttggcaaggaatttagccggagttacaggctgagatattctagggacggccgacgctggatgggctggaaagatagatggggacaggaggtgatctcaggtaatgaggaccctgaaggcgttgtcctcaaagatctggggcctccaatggtggcccgtctggtccgtttttaccctcgagctgatagggtgatgtccgtgtgcctgagggtagagctctatggatgcctctggcgtgatggcttgttatcctatacagctcccgtcgggcagacgatgtacttgtccgaggctgtctacctgaacgattcaacatatgacggtcatactgtggggggtctccagtacgggggtctgggtcagctggcagacggcgttgttgggttggatgacttccgcaagtctcaagaactaagagtgtggccgggatacgattatgttggttggtccaaccatagttttagctccgggtatgtggagatggaattcgagtttgatagactgcgggcattccaggcaatgcaggtgcactgtaacaacatgcacacacttggcgctcgtctccccggaggcgtggaatgcagatttagacgaggaccagcaatggcctgggagggcgagcctatgaggcacaacctaggcggtaacctgggcgatcctagggcccgtgcggtctcagtaccactcggcggtcgtgtggcacgcttcttacagtgccgctttctgtttgccggaccgtggcttttattctccgagatttccttcatttccgacgttgttaataattcaagtcctgcactggggggaacattccccccagccccatggtggccacctggacctccacctacaaacttttcctccctggaactagagccgagggggcagcaaccagtcgccaaagccgaggggtctcccaccgctatccttattgggtgtcttgtagctataatcctactgctcctgttgattatcgcccttatgctgtggcggctgcactggagaagactgttgtcgaaagccgaacgacgtgtactggaagaggaattgacagtgcacctctccgtgcccggagacacgatcttaatcaacaatcgtcctggccctagagagccgcctccctatcaagagccacggccacgaggtaatccaccccattctgctccatgcgtgccaaatgggtcggcatattctggcgattatatggagcctgagaagcctggcgcacccttactaccccctccccctcaaaactcagtaccacattatgccgaggctgacattgttaccctccagggcgtcactgggggaaacacctacgcggtgccagcccttccgccaggcgcagttggagatggtcccccaagggtcgactttccaagatcccggcttcggttcaaagaaaagttaggcgaaggccagtttggggaggtgcacctttgtgaggtcgacagccctcaagatctagtgtcccttgattttccattgaacgtgaggaagggccaccctctgctggtagctgttaagatccttcgcccagacgccactaaaaacgctcgaaatgactttctgaaagaggttaagattatgtccagactgaaggaccctaatatcatcagactactgggagtgtgtgttcaagacgatccattgtgcatgattaccgattacatggagaatggcgacttaaatcagttcctgtctgcccaccagcttgaggataaagccgctgaaggcgcaccaggggacggacaggctgctcagggccctactatatcttatccaatgctcctccatgtcgccgcacagatcgcgtccggtatgaggtacctagccactctgaacttcgtacacagagacttggcaacccgcaactgcttagtgggagagaatttcacgattaagatagccgactttgggatgtcaaggaatctgtacgccggagactactacagggtgcagggcagggccgttcttcctatccgctggatggcttgggagtgcatactgatgggcaaattcactacagcctccgacgtgtgggcttttggggtaactttatgggaggtgctcatgttatgccgcgctcaacccttcggacaactcaccgatgaacaggttattgaaaatgctggcgagttcttccgcgaccaaggcagacaggtatatctgtcccgccctccagcatgccctcagggactgtacgagctcatgctccggtgctggagtcgagaatccgaacaaagacctccattctcacagctacaccgcttcctggccgaggatgctctcaatactgtgtag

SEQ ID NO: 11099 - DNA, 2742 bp, Artificial Sequence
  Description of Artificial Sequence: Synthetic coding sequence
atgggcccagaggccctatccagtcttctgctcctgcttctcgtggccagcggcgatgccgatatgaaaggacacttcgatccagctaagtgtcgctatgccctaggcatgcaggaccgcaccataccagattctgacatttccgcgtctagtagttggtcagatagtactgccgctaggcactccaggctagagtcctctgacggcgacggggcatggtgccctgccggttctgtgttccctaaagaggaggaatatctgcaggtggatttacagagactgcaccttgtcgccctggtcgggacccaggggaggcatgccggaggattggggaaggagttcagcaggagctatagactaaggtatagcagggacggcagacggtggatggggtggaaggacagatggggccaggaggtgattagcgggaatgaggatccagaaggcgtcgtcctcaaagatttaggacctcccatggttgccagactcgttcgcttttacccacgtgccgatagggtgatgagcgtctgcctgagggtagaactgtacggctgtctctggcgggacggactactgtcatacacggcaccagtgggtcaaaccatgtacctgtccgaagctgtctatttaaatgacagtacttacgacggccatacagtgggagggctgcagtatggcggactcggacagctggctgatggcgtcgtcggccttgatgactttcggaaaagccaggagctgagagtctggcctggctacgattatgtcggctggtcgaatcactctttctcttctggctatgttgagatggagttcgaatttgacagactgagagcgtttcaagctatgcaggtccactgcaacaatatgcataccttaggtgcgagattgccgggtggtgtggagtgcagatttaggagaggcccagctatggcctgggaaggagagccgatgcggcacaatctaggagggaatctgggggatccccgagcaagggcagtgtctgtgccattgggcggtagggtggctcgcttcctacagtgcaggttcctgttcgctggtccctggctcctgttctcggagatttctttcatttctgacgtggtgaataattctagccccgcactgggcggtacatttccgcctgcaccttggtggccaccgggaccacccccaaccaacttcagtagcctcgaactggagcccagggggcagcaacccgtggccaaggcggaaggcagccctaccgctatactgatcggttgccttgtggccatcattttgctcctcctgttgattatcgcactcatgctctggcgcctacactggcgaaggctgttaagtaaagcggagcgccgagtgttggaagaagagttgacagttcatctgtctgtgcctggagacaccatcctgattaacaaccggcctgggccacgcgagccacccccatatcaagaaccgaggccacgtgggaaccctccacactcagcaccgtgtgtgcctaacggcagtgcactcttgctgtcgaaccctgcatatagactcttacttgctacgtatgccaggcccccacggggacccggaccacctaccccggcatgggcgaaaccgacgaacacccaggcttacagtggagattatatggagcccgagaagccaggcgctccactgctgcccccaccacctcagaacagcgtgccccactacgcagaggccgacattgtgaccttgcaaggcgtaactgggggtaacacctacgccgtgcctgccctacctcccggagctgtaggtgacggcccacctcgggttgactttcctcgcagccgtctgcgtttcaaggagaaactgggtgaaggacagttcggcgaggtgcatctgtgcgaagtggactccccccaggatttggtaagcctcgattttcccctgaacgtccgtaagggccaccccctgttggttgcggttaaaatcctgcgccctgacgccaccaaaaatgctcgcaatgacttcctgaaagaagtgaagattatgtctcgcctcaaggatccgaatattatccgccttctgggcgtctgcgtgcaggacgatcctctatgtatgattacagactatatggaaaacggtgatcttaatcagtttctgtctgctcaccagctggaggacaaagccgctgagggcgcacctggggacggacaggccgcacaggggcctacaatctcctatcctatgctcctccacgtagccgctcagattgccagcggcatgcgatatttggcaacattaaatttcgtccacagggacctcgccacgaggaattgtctggtcggcgagaatttcaccattaagatagccgattttggcatgtcacggaacctctatgcaggcgattactatcgagtacaaggccgagcagtgctcccaatccgctggatggcctgggagtgcattctgatgggtaagttcaccactgcctcagatgtgtgggccttcggagtaacgctttgggaggtgctaatgctctgtcgggcacaaccatttgggcagcttacagatgagcaggtgatcgagaatgccggagaattcttcagggaccaaggcaggcaagtttacctgtcccgcccaccagcatgccctcagggactgtacgaattgatgctaagatgctggtctcgcgaatcggaacagcgccctccatttagccagctgcacaggtttcttgccgaagatgccctcaacactgtatag

SEQ ID NO: 11100 - DNA, 444 bp, Artificial Sequence
  Description of Artificial Sequence: Synthetic coding sequence
atgggcccagaagccctcagctctcttctgctgctcttgctggtggcctccggggacgctgatatgaaaggccacttcgacccagccaagtgtagatacgcactcggcatgcaggaccgtacgatacccgacagcgacatttctgcgtcaagttcatggagtgattccaccgccgcacgccattcccgtctagaatcttcagacggcgacggggcttggtgtccagccggatcggtgttccctaaggaggaagaatatctgcaggtcgacctgcaaagactacaccttgtcgctctggtggggacccagggacggcacgccggagggctgggcaaagaattttcacgctcctacagactgagatactctcgtgacgggagacggtggatgggctggaaagacagatggggccaggaggttataagcggaaatgaagacccgtag

SEQ ID NO: 11101 - DNA, 2631 bp, Artificial Sequence
  Description of Artificial Sequence: Synthetic coding sequence
atgggtcctgaagctcttagttccctgttacttttactgttggttgctagcggcgatgcggatatgaagggccactttgatcctgcaaagtgtagatatgcattgggcatgcaggatcgtaccattccagactcagatataagcgcatcgtcaagctggagtgactcgaccgccgcacggcattctcgactggagtccagtgacggggacggcgcttggtgccccgctggatcagtattcccaaaggaagaagagtatctgcaagtcgatcttcagcgtctccatctggtggccctcgtcgggacccagggcagacacgccggaggccttggcaaagagttctcacggagctatcgactgagatacagtagggatggtcgacgctggatgggttggaaagaccggtgggggcaagaggtgatctcagggaatgaggatcctgagggcgtcgttctgaaagacctgggcccacctatggtcgccagacttgttagattttatcccagggcagatagggtcatgtccgtgtgcctgagggtggagctgtacgggtgtttgtggcgagatggtcttctctcttatactgccccagtggggcagactatgtatctgtctgaggccgtatatcttaatgactctacttacgatgggcataccgtgggtgggcttcagtacggaggcctgggacaactcgccgacggggtcgtgggcctagatgactttcggaagtcccaggagctaagggtatggccagggtatgattacgtcgggtggagcaaccattcattttcttccgggtacgtcgagatggaattcgagtttgatagactccgcgcattccaagccatgcaagtgcattgtaacaatatgcacactcttggcgctcgcttaccaggtggagttgaatgtagattccggagaggccctgcgatggcttgggagggagaaccaatgagacacaatctggggggaaatcttggcgacccccgagcgagagctgtgtccgtgcccctgggtggtcgcgtcgctcggttcctgcaatgtaggttcctgtttgccggaccttggcttctgtttagtgagatttccttcatcagtgacgttgtcaacaacagctcaccagctcttggaggcacgttccccccagccccttggtggccacccggtcccccacccactaacttttctagcctcgaacttgagccacggggacagcaacctgtagccaaggcggaagggtctcccacagctatcctcatcggctgcctagtggcgatcatcttgttattgctgcttatcattgctctcatgctgtggcgactccactggcgaagactcctgtcaaaggctgaacgtagagttcttgaagaagagttgacggtacacctgtctgtgcccggtgacacaattctgatcaacaataggccaggccctagagaacccccaccctatcaggaacccagacctagagggaacccccctcactccgctccatgcgttcccaatggcagcgcctatagcggtgattatatggagcctgagaaaccgggtgctcctctattaccaccgcctccacaaaactccgtcccacattatgcggaagctgacatcgttaccctgcaaggggtgactgggggtaatacatatgctgtacccgctcttcctcccggagcagtcggcgacggccctcctcgcgtggatttccccaggtccagactgaggttcaaagagaaacttggggaagggcagtttggcgaagtacacctttgcgaagttgactcccctcaggacctggtaagtctcgacttcccgctgaacgtccggaaaggccatcctctcctggtggctgtaaaaattctgcgaccggacgccactaagaacgctcgcaatgactttctgaaggaggtgaaaatcatgtctcgcttgaaggatcccaacataattcgactcctgggagtctgcgttcaagacgacccactgtgcatgatcaccgattatatggaaaatggagatctcaaccagttcctaagcgcacatcagctcgaagacaaagccgctgaaggcgctcccggagacggccaggctgcccagggccctactatttcctacccgatgttgttgcacgtcgcagcccaaatcgcatccggaatgcgttaccttgcaactctaaacttcgtgcaccgggacctggctaccagaaactgtctagtcggggaaaactttaccatcaaaattgccgactttggcatgagcagaaatctctatgcgggagattactaccgggtgcagggtcgtgccgtcctgcccatacggtggatggcatgggagtgcatccttatggggaagttcacaactgctagcgatgtttgggctttcggggtgaccctctgggaggtgttgatgttgtgtcgagctcagccctttggccagttgaccgatgaacaggtgatcgagaacgccggtgaattcttcagagaccagggcagacaagtgtacctcagccggcctccagcatgtcctcagggcctctatgagctgatgctgcgttgttggtcaagagaaagcgagcagcgcccaccatttagccagctccaccgatttctggccgaggacgccctgaacactgtctag

SEQ ID NO: 11102 - DNA, 2631 bp, Artificial Sequence
  Description of Artificial Sequence: Synthetic coding sequence
atgggacctgaagcactcagcagcttactcctgctgctgctggtggcaagcggggacgcagatatgaagggccactttgatcctgccaaatgccgatacgctctgggaatgcaggaccgtaccatcccggactccgatattagtgctagttcttcttggtctgattcgactgcggctcgacattcccgacttgaatcttccgacggtgacggtgcctggtgtcccgctggcagcgtattccccaaggaggaggagtacctgcaagtcgatcttcaaaggctccatcttgtggctttggttggtacgcagggtcggcatgctggcggactggggaaggaatttagccggagttatcggcttcgttatagcagagacggacggcgatggatgggttggaaggatagatggggtcaggaagtgatttctggaaatgaggatcccgagggggtggtattaaaagacttaggtcccccaatggtcgccagactcgtgaggttctaccctcgagcagatcgtgtgatgtccgtatgtcttagggtggaactctatgggtgcctgtggcgggatggcctccttagctacaccgcccctgtgggccagaccatgtacctgtctgaagctgtttacctcaatgattccacctatgacggccatactgtaggcggactgcagtacggtggcctgggccagctggccgatggcgttgtgggcctggacgatttccggaaatctcaggagttgagagtctggccgggatacgactacgtcggctggtcaaaccattccttttcatcgggctacgtggagatggaattcgaattcgatcggctccgcgcttttcaggcgatgcaagtgcactgcaacaacatgcacaccctgggagctaggctcccagggggtgttgagtgtcgtttcaggaggggcccagcgatggcttgggaaggggagcccatgaggcacaacctgggcggaaatttaggagaccccagagcaagagctgttagcgtacctctggggggtcgcgtggccaggttcctgcagtgcagatttctcttcgctggcccatggcttctcttctcggaaattagttttatttcagacgttgtgaacaatagctctcctgccttaggaggaacgttccctcccgcaccatggtggccacctggccctcctcccaccaacttcagttccctcgagctcgaaccacgtggtcagcaacccgtcgccaaggcagaaggtagtccaaccgcaatactgataggctgcttagtcgccatcatcctcctgcttctgctaattatcgcccttatgttgtggcgattacactggcggagattactttctaaggccgagcgccgagtccttgaagaggaactaacagtacatctgagcgtgcccggagacaccattctgatcaataacaggccaggtcccagagaaccacccccttaccaggagccacggcctcgcggtaacccaccgcattctgcaccttgcgtacccaatggaagcgcttacagcggggactacatggaaccagaaaagccaggcgcaccgctgctgccacctccgcctcaaaatagtgttccacactacgctgaggccgacattgtcactcttcaaggcgtgacggggggaaacacttatgctgtgcctgcactgcccccaggtgctgtgggcgacggccctccaagggtcgatttccctcgctcacgactgagattcaaagagaaacttggggaagggcaatttggggaggtgcacctttgcgaggttgattcgccccaggaccttgtgtccctcgattttcccttgaatgttcgtaaaggccatcccctcttggtagccgttaagatcctaagacccgatgcaactaaaaatgcccgtaacgacttccttaaggaagtgaagatcatgtcacggctgaaggatcctaatatcatacggttattaggggtctgcgtacaggatgaccccctgtgtatgatcacagactacatggaaaacggcgatttgaatcagtttctcagtgctcaccagttagaggataaggctgctgagggagcccctggagatggccaggcggctcaaggaccaactatctcctaccccatgctgctgcacgtggcggcacagatcgccagcggcatgcgttatctggcaaccctgaacttcgtgcatagagatctcgcaactcggaattgcctcgtgggtgaaaactttacaatcaaaattgcagacttcggcatgagcaggaatttatacgctggcgattactatagagtgcaggggagggctgtacttccgatccggtggatggcgtgggaatgtatcttgatgggtaagtttacaacggcctccgatgtgtgggccttcggggttactttatgggaggtgttgatgctgtgtcgagcccaaccattcgggcagctgacagatgaacaggtgatcgagaacgccggtgagttctttcgggatcaggggaggcaggtgtatctgtcacggccaccagcatgcccgcaaggcctgtacgagctcatgctccggtgttggagtcgcgaaagtgagcagcgaccaccattctcacagctgcatcgatttctagcggaggatgcattgaatacagtatag

SEQ ID NO: 11103 - DNA, 2631 bp, Artificial Sequence
  Description of Artificial Sequence: Synthetic coding sequence
atggggccagaagctctctccagccttttgttgctcctgctggtggcctcaggggatgccgatatgaaaggacacttcgatcctgcaaagtgtagatatgctctgggcatgcaggaccgcacgattcctgactcagacataagcgccagcagcagttggagcgacagcacagcagccagacacagccgcttggaatctagcgacggggatggcgcttggtgccctgctgggagtgtcttccctaaagaggaagaatacctgcaggtggacctgcagagattacacctggtcgcactcgtgggaacgcagggccgacacgccggaggactcgggaaggagttcagccgttcttacaggctgcgctactctagggacgggaggcgctggatgggatggaaagaccggtgggggcaggaagtgatcagtggcaacgaggacccagagggggttgtgctgaaggatctgggaccccctatggtcgcaaggctggtccgcttttaccccagagcggaccgcgtcatgtccgtatgtctgagagtggaactttacggctgtctctggagagatggcttattgtcatacaccgcccctgtaggccagaccatgtatctatcagaagccgtgtatctaaatgattctacatacgacggacacacagtagggggattacaatacggcggactaggccaactggccgacggggtagttggactcgacgactttaggaagtcgcaagagctgcgcgtgtggcctggctacgactacgtaggctggtctaaccactcgttctcatcaggatacgtcgaaatggaattcgagttcgatcggctgagagctttccaggctatgcaggtgcattgtaacaacatgcacactcttggtgccaggctgcctggtggagttgaatgtaggttccggagaggtccagcaatggcctgggaaggagagccgatgcggcataatctgggagggaatctcggcgacccccgagcacgggcagtgtccgttcccctaggagggcgagtcgctaggttccttcagtgtagatttttattcgcaggaccgtggctcctgtttagcgaaatttcgttcatatccgatgtggtgaacaactcctctcccgctcttggcggaaccttcccgccagcaccttggtggccccctggtccccctccaactaatttcagtagtcttgagctggaacctcgaggccaacagcccgtggcgaaagctgaggggtccccaactgctatactcattggatgtctggtggcaataattctcttacttctgctgatcatagctctgatgctgtggagattacactggcggagattattatccaaagctgagagacgcgtcctcgaggaggaactcacagtgcacctcagtgtccccggagacaccatcctaattaacaatcgaccaggcccacgagaacccccaccgtaccaggaaccccgtcctcggggaaatccaccacactccgccccatgcgtcccgaacgggtccgcttactctggagattatatggaaccggaaaaaccgggtgcacctctgctacctccgcctccccagaatagcgtgccccactatgccgaggccgacatcgtgacactccagggtgtgaccggcggaaacacatacgccgtgcccgcactcccacccggagctgtcggcgacggtcctccccgagtcgattttccacggtcccggctgcgatttaaggagaaactgggcgaaggccagttcggtgaagtgcatctctgcgaggttgactccccacaggatcttgtgagtctcgatttccctctgaatgtgcggaagggccaccctctgttggtagcagtgaaaatcctgcggccagatgcaacgaagaacgcccgaaacgacttcctgaaggaagtgaagattatgtcacgcctgaaagaccccaatattataaggctgctaggcgtctgcgtgcaggacgatcccctctgtatgatcacagattacatggagaacggggacctaaatcagtttctgtcagcacaccagctcgaggacaaggcagctgaaggcgctcctggcgacgggcaagccgcacagggtcccaccatctcgtatcctatgttactccatgtagcggcacagatcgcttctgggatgcggtacctagcgaccctaaacttcgtgcacagggatctcgccacccggaactgcctggtgggagaaaatttcacaataaaaatagctgacttcggcatgtctagaaatctgtatgcaggagactactacagagtgcaagggcgagcagtcctgcccatccgatggatggcgtgggagtgtatcctaatgggtaagtttaccaccgcttctgacgtatgggcgttcggagtgaccctgtgggaggtcctcatgctctgcagggcacagccgtttggccagctgacagatgaacaggtgatcgagaacgcgggagagtttttccgggatcagggcaggcaggtgtacctgtcccgaccacccgcttgtcctcagggcctgtacgagctgatgcttcgctgctggtctcgagaatctgagcaaaggccacctttttcacagctgcaccggtttctagcagaagatgccctcaacacagtttag

SEQ ID NO: 11104 - DNA, 2742 bp, Artificial Sequence
  Description of Artificial Sequence: Synthetic coding sequence
atgggacctgaagcactgtctagtcttctgctgctgttgcttgtggccagcggcgacgccgatatgaaggggcacttcgaccctgcaaaatgcaggtacgccctgggcatgcaggatcgaactatcccagattctgatatttctgccagctcttcatggagcgattctactgccgctcgccattcaagacttgagagctccgacggggatggagcttggtgtccggctggctccgtgtttcccaaagaagaagaatacctccaggtggaccttcaacgacttcaccttgtggctcttgtaggaacacaaggaaggcacgctggcggtttgggaaaagagttttcccgaagctaccgcctgcgctattctcgagacgggcgacgttggatgggatggaaggatcggtggggacaggaggtgatcagcggaaatgaggatcctgaaggagtggtccttaaggacctgggtcctcccatggttgcccgtctggtgaggttctatccacgcgctgatagagtgatgtcagtctgcttgagagtggagctgtacggctgcctttggagagatgggctgctatcctacacagcccctgttggacagaccatgtatctttccgaagctgtgtatctaaatgattcaacatatgatggccatacagtcggtggcttgcagtatggtgggcttggtcagctagcagatggtgtagtaggactggatgattttcggaagtctcaggaattgagggtatggccaggatacgattacgtggggtggtcgaatcactcattctcatctggttacgtggagatggaatttgagttcgataggttacgcgcatttcaagccatgcaggtacactgcaacaatatgcataccctcggagctcgtctacctggaggagtggaatgccgctttcgacgcggtcctgccatggcatgggagggagaacccatgaggcacaatctgggagggaacttgggcgaccctagggccagagcagtgtccgtccctctcggagggcgagtagccagatttttgcagtgtcgcttcctgttcgccggaccctggctgctgttctcagagatttcttttatctcagatgtcgtcaataattcctctccagcgcttggaggaacttttcctccagccccatggtggcctccaggaccgccacctacaaacttcagcagcctggagctcgaacccagaggccagcagcctgttgcgaaggcagaaggctctcccaccgctattctgatcgggtgtctggtcgcgattatcctgctgctactgctgatcatagcgttaatgttgtggcgtctccattggcgaaggctcctgagtaaggctgagcgtagggtgttagaggaggagctgacagtccacctttccgtgcccggagatacaatcctcatcaataatcggccaggacctcgcgagccccctccctatcaggagcccaggccaagagggaacccacctcactctgccccttgcgtccccaacggcagcgctttactacttagtaatccagcttataggctcttactcgccacctatgctcgacctcctaggggaccgggaccccctacacctgcctgggccaaaccaaccaacactcaggcctatagcggcgactatatggaacccgaaaaaccaggcgctccgctcctgccacctcccccacagaactcagtgccacactatgccgaggccgatatcgtgactctacagggcgttaccgggggtaatacctacgctgtacctgccctcccccctggagcggtgggagatggcccacccagggtcgacttccctaggtcaaggttgaggttcaaggaaaagcttggcgagggccagttcggcgaggtgcacctttgcgaggtcgacagcccacaggacttggtcagtctggacttccctctgaacgttaggaaaggacaccctctgctggtggccgtgaagatattaagaccggatgctacaaaaaacgccagaaatgacttcttaaaagaggttaaaatcatgagcaggcttaaggaccctaacattattcgactcttaggagtgtgcgtgcaggatgaccccctttgtatgatcacggattacatggagaacggagacttgaaccaatttctgtcagcccatcagttggaggataaggccgctgagggcgcacccggtgatggccaggcagcccagggacccactataagttatcctatgctcctgcacgtggcagctcaaatcgcctcggggatgcgctacctggctacattgaattttgttcatagagatctagccaccagaaactgtctggtaggagagaatttcacaataaagattgctgatttcggcatgtctaggaatctctacgccggagactattaccgggtgcagggcagagccgtgctccccataagatggatggcctgggagtgtatccttatgggcaaattcactacagccagtgacgtgtgggccttcggcgtaacactgtgggaagttctgatgctgtgccgcgctcaacctttcgggcaactcacagacgaacaggtgatcgaaaatgcaggagagttcttcagggatcagggcaggcaagtctatttgtccaggcccccagcttgcccccaggggctgtatgagttgatgttgagatgctggtctcgcgagtctgaacagcgacctcctttctcccagttgcaccgcttcctagcggaggatgccttgaataccgtgtag

SEQ ID NO: 11105 - DNA, 2742 bp, Artificial Sequence
  Description of Artificial Sequence: Synthetic coding sequence
atggggcctgaggcgttgtcatctctgttactgctcctgctggttgcctcaggggatgccgatatgaaaggccatttcgaccctgccaaatgcaggtatgcactcggtatgcaagatcgaactatacctgactccgatatatcagctagctcctcttggtccgactccaccgctgctcgccattctaggctggaaagcagcgatggcgacggcgcttggtgtccagctgggtcggtcttcccaaaggaggaggagtacctgcaagtcgacctccaaagattacacctagtggcgttggtcggcacccaggggagacacgccggtggtctgggtaaggagttctctcgttcctatcgtcttcggtacagcagagatggcaggagatggatgggatggaaagaccggtggggtcaagaggtgatctccgggaatgaagaccccgagggggtggtactgaaagacttaggccctccaatggtggcacgcctcgtcagattttacccgagggcagatagggtcatgtctgtgtgtctcagagttgagctatatggctgcctctggagggatgggttgctctcatacacagcgccagttggccagacgatgtacttgtcagaggctgtgtacctgaacgattctacatacgatggccacactgtgggcggtctccagtatgggggactggggcagctggcagacggtgtggtcggcctagatgatttccggaagtcccaagaactccgtgtgtggcctggatacgattacgtgggatggtcaaaccattctttctcgtcgggctacgttgagatggagttcgagtttgatcggctacgcgcttttcaggccatgcaggtgcattgtaataacatgcacacactgggggctcgactgcctggcggtgtggagtgccgcttcagaagggggccagccatggcttgggagggcgaacccatgaggcacaacctagggggaaatctaggcgacccacgggcaagagccgtgtccgtgcccctgggtggcagagtggccaggtttctacaatgccgttttctttttgctggcccatggttgctattctctgagatttcattcattagcgatgtggtgaataattcaagcccggctctgggcggaacgtttcctcccgctccatggtggccccctggcccaccaccaacaaatttttcaagtctagagttggaaccgagaggacagcaacctgtggccaaagcagaaggatctcctacagccatattgatcggttgcctggtcgccatcatactgcttctgcttttgatcatcgccctgatgttatggcgattgcactggcgcaggctgttgtctaaggctgagaggcgtgtcctggaagaggagctcactgtgcatctctccgtgccaggtgacacaatccttattaataataggccgggaccgagggagccgccaccttatcaggagccccgtcccaggggaaacccgccacattctgctccctgcgtgccgaatgggtctgcactgctgctctccaatccggcatacagattgctgctggcaacctacgcaagaccaccccgaggcccaggtcctccgactcctgcttgggccaaaccgactaatacacaagcatatagtggtgattacatggaacccgagaagcctggagcccctctgttgccacctccccctcagaattctgtaccacactatgctgaagctgatattgtgaccctgcagggcgtaactgggggtaatacatacgccgtgcctgccctgcctccaggcgcagtgggcgatggaccgcctagggtggacttcccacgctcccgactccgatttaaagaaaagctgggggaaggtcagttcggcgaagtgcacctatgcgaagtagattcacctcaggatttggtgtccctcgatttccccctgaatgtgaggaagggccatcctttactggtggcagtcaagattctcaggccagatgccacaaaaaatgctagaaatgacttcctcaaagaagtgaagatcatgagtcgattgaaagatccaaacattatcagattgctgggggtttgtgttcaggatgatcctctgtgcatgattaccgattacatggaaaacggggaccttaaccagtttttgagtgcacaccaactcgaagacaaagccgctgaaggtgccccaggcgacgggcaggccgcacaaggtccaactatcagctatcctatgttacttcacgtggccgctcagatcgcgtccgggatgaggtacttggctacactcaacttcgtccatagagacctggccactcgcaactgcctggtcggagaaaattttaccattaagattgctgacttcggtatgagcagaaacctctatgcgggtgactattatcgggtccagggaagagccgtactgcccatccgctggatggcttgggaatgtatcttgatgggtaaattcactacagctagcgatgtatgggctttcggggtgactctgtgggaggtgctcatgctgtgcagagctcaaccatttggacagctcaccgatgaacaggtgatcgagaatgctggtgaattttttcgcgaccagggtcgacaagtatatttgtcaagacctccagcgtgcccccaggggctgtacgaactgatgttgcggtgctggtcacgggagagtgaacagaggcccccatttagccaattgcatcgcttcctggccgaggacgccctcaataccgtgtag

SEQ ID NO: 11106 - DNA, 309 bp, Artificial Sequence
  Description of Artificial Sequence: Synthetic coding sequence
atgtccgtgatgaagccatgcctgatgacaatcgctatcctaatgattctggcccagaagacccccggtgggctgttccggtctcataatggcaagagccgggaaccatggaacccttgcgagttatatcaagggatgtgccgcaacgcctgccgagagtacgaaattcagtatcttacatgtcccaatgaccagaaatgttgtctcaagctgagtgtgaaaattacttcgagtaagaacgtgaaagaagactacgattccaatagtaatctgtctgtgactaattccagttcttattctcacatctag

SEQ ID NO: 11107 - DNA, 267 bp, Artificial Sequence
  Description of Artificial Sequence: Synthetic coding sequence
atgctgcccgaccacttctcgcccctgagcggggatatcaaactgagcgtgctggcactcgtggttttagtggtgttagctcagacagctccagacggctggatccggagatgttattacggcactggaaggtgccgaaagtcatgtaaggagatcgaacggaagaaggagaagtgcggcgaaaagcatatatgctgtgtacctaaggagaaggacaagctatctcacatacacgatcagaaagagacctcggaactctatatttag

SEQ ID NO: 11108 - DNA, 1401 bp, Artificial Sequence
  Description of Artificial Sequence: Synthetic coding sequence
atgaaaccaccactgctggtgttcatagtgtgtctcttatggctcaaagactcacattgtgcccctacttggaaggacaagaccgccatcagcgagaatctgaaaagcttcagtgaggtgggagagatcgatgccgatgaggaggtgaaaaaagccttaactgggatcaagcaaatgaaaatcatgatggagcggaaagaaaaagaacatacaaatctgatgtctacgctgaaaaaatgtcgcgaggaaaaacaggaagcactgaagctgctcaacgaagtgcaggagcatctcgaggaggaggaacggctttgtagagagagcctggccgactcctggggcgagtgtcgatcttgtctcgaaaataattgtatgcgtatatatacaacttgtcagccctcctggtcctccgtgaagaataaaattgagaggttcttccgtaaaatctatcaattcctgttcccttttcacgaggataacgaaaaggacctcccaatctcagaaaaattaattgaggaagatgcccagctgacccagatggaggacgtattcagtcaactgaccgtggacgtgaattcactttttaaccggtcatttaacgtatttcgccaaatgcagcaggagttcgaccagacttttcagtcacacttcattagtgacactgacctgaccgaaccatatttctttcctgcgttcagtaaggagcccatgacaaaggccgacctcgaacagtgttgggatattcctaacttttttcaactgttctgtaatttctccgtgagtatttatgagtcagtgagtgaaaccattacaaagatgttaaaagcaatcgaagacttaccgaagcaggacaaagcccctgatcatggcggtctcatatcaaagatgctcccaggacaggaccggggtctgtgcggcgaactcgaccagaacttgtcccgttgcttcaaattccatgagaaatgtcagaagtgccaagcccacctgtcagaggactgtcccgacgtacctgccctgcacacagagctagatgaggccattcggctggtaaatgtcagcaatcagcaatatggccagatcctgcagatgacccgcaagcatctggaggacacggcgtatctggtggagaaaatgagaggccaattcggctgggtttccgaactagctaaccaggccccagaaactgaaatcatcttcaactctattcaggttgtacccaggattcacgagggtaacatttccaagcaggatgagaccatgatgaccgatctgagcatcctgccctccagcaactttacgcttaaaatcccactggaggaaagtgccgaatccagtaacttcatcggctacgtggtggcgaaagcattacagcatttcaaggaacattttaagacatggtag

SEQ ID NO: 11109 - DNA, 207 bp, Artificial Sequence
  Description of Artificial Sequence: Synthetic coding sequence
atgaagctgtgtgttactgtgctctccttgttggtcctggtcgccgctttttgtagtctggccctctcagcgccaacgaaatccagcgaatggaaactacagggggtttgtttccagtgttgtagcggcaaagacccaatccatcagtcttgccctacctggaccatggtccggcagaggaaaatgccaaccacaggcaaaggctag

SEQ ID NO: 11110 - DNA, 420 bp, Artificial Sequence
  Description of Artificial Sequence: Synthetic coding sequence
atgtacaaacttgcttcttgctgtcttctctttataggtttcctgaaccctctgctgagcctccccctgcttgactcaagagaaatcagttttcaattgtccgccccacacgaggacgcgaggcttactccagaggagctggaacgagcatctttactccaaattctgccagaaatgctcggagctgagcgtggagacattctccgtaaggctgacagttccaccaatatcttcaaccctagaggcaatttgcgaaaatttcaagacttctcaggacaagaccctaacatcctcttgtcacacctgctagcaagaatctggaagccttataagaagcagagaagaaagttgcgacaggatcttaggctgtggaagaaagaacctggtctacgaattttcaagaattatgtttatatttag

SEQ ID NO: 11111 - DNA, 1974 bp, Artificial Sequence
  Description of Artificial Sequence: Synthetic coding sequence
atgagaacagtggtgttgacaatgaaagccagcgttatagagatgttcttggtgctactggtaactggcgtgcactccaacaaagaaacggctaaaaaaatcaagaggcctaaattcaccgtcccccaaataaactgtgatgtcaaggccggtaagataattgacccagaatttatcgtgaagtgccctgccggttgccaagacccaaagtaccatgtttatggtactgacgtttatgcaagctacagcagcgtgtgcggggcagccgtccattcaggcgttctggataatagcgggggtaaaattttggtacggaaagtggcaggccagtcaggctataagggttcttatagtaatggggtacaaagcctgagcctgccgagatggcgcgaatccttcattgtcctggagtccaaacccaagaagggggtcacgtatcccagcgcacttacctacagcagcagcaaatccccagccgctcaggctggagagaccacaaaagcctaccagagaccacccatccctgggactacagcccagcccgtgacgctgatgcagctgcttgctgtgactgttgctgtggccactcccacaactctacctcgtccctccccttcagccgctagcacgacctctatccccaggcctcagtctgtgggacatagaagtcaggagatggacctgtggagcaccgccacctatacctcatctcagaatcgacccagggctgaccccggaatccagaggcaggacccaagtggggctgcttttcagaagccagtgggcgctgatgtatctttggactgcaagatagaccttagtttcctcattgacggaagtacgtccataggcaaaaggcgatttcgcatccagaagcagctcctggctgatgttgcacaggccctggacattggaccagctggtcccctcatgggcgtggttcaatacggtgataacccagccacacactttaatcttaagactcataccaactctcgcgatctgaaaacagccattgaaaagataacccaaagaggaggactcagcaacgtcggccgtgctataagttttgttaccaagaattttttctctaaggcaaatggaaatcgctctggcgctccaaacgtggtggtggtgatggtagatggctggccaaccgacaaggtggaggaggccagcaggttggcacgggaatcaggaataaatatattctttataacaatagagggagccgctgagaatgaaaagcagtatgtggtggagccgaatttcgctaacaaagcagtatgccgaacaaatggcttttactccctacacgttcagtcgtggtttggccttcacaagacattgcagcccctggttaagagggtgtgtgataccgatcggcttgcctgctccaaaacgtgtctgaacagcgccgatattggatttgtgatcgatgggtcttcttccgtaggcaccgggaatttccgtaccgtcttacagtttgtcacgaacctgacaaaggagtttgagatatcagacactgatactaggatcggcgcagtgcagtatacttatgaacagcggttagagttcggtttcgacaagtatagtagcaagcctgatattctaaatgcaataaaaagggtgggatactggtccggcggaacatccaccggagccgcaatcaactttgcactcgagcagctattcaagaagtctaagccaaataaacgtaaactgatgatcctgatcactgatggaagatcttacgatgacgtccgcattcccgctatggctgcccacctgaaaggcgtgatcacttatgccattggagtggcctgggccgctcaagaggaacttgaagtcatcgccactcacccagccagggaccacagctttttcgtggacgagtttgacaacctacatcagtacgtcccacgtataatccagaacatatgtactgagtttaacagtcagccaaggaactag

SEQ ID NO: 11112 - DNA, 3975 bp, Artificial Sequence
  Description of Artificial Sequence: Synthetic coding sequence
atgcgtcatggtgtcgcctgggctctgcttgtggcagccgctctcggccttggagccaggggagtccggggtgcagtagcactcgctgacttctaccccttcggcgcagaaagaggggacgcagttactcctaaacaggacgatggcggatctgggctgcgccctctgtctgtacccttcccctttttcggagccgagcatagtggtttatatgtcaacaataatgggataatcagctttctcaaagaggtgtctcaattcactcctgtcgctttcccaatagcgaaagatcgttgcgtggtggctgccttctgggcagacgtggataaccggcgtgcgggtgatgtgtattacagagaagccacggatccggcaatgctccgcagggcgacagaggacgtcaggcattattttccagaactcctggacttcaacgcgacatgggtgttcgtggctacttggtacagagtgacgtttttcggtggctcatcctcatctcctgtgaataccttccagactgttctcatcactgacggcaagctaagcttcactatctttaactacgagtctatcgtttggacaacaggaacacatgctagctccggtggcaacgccaccggcctgggagggattgccgcacaggctggctttaatgccggagatggtcagcgctatttttccatacctggctcgcgaactgcagatatggctgaagttgaaactacgactaacgtgggagtgccgggtcggtgggcctttcgcatagatgatgcccaggtccgcgtgggcggatgcggccacactacatcagtttgcctagccctcagaccatgtcttaacggcggaaaatgcatcgacgattgcgtgaccgggaatccaagctacacttgctcttgcttatccgggtttacaggcagacgctgtcatctggatgttaacgagtgcgcctcccagccatgccagaacgggggaacctgtacacatggtatcaacagctttaggtgccaatgccctgcgggttttgggggaccgacatgtgaaactgctcaatcgccgtgcgatactaaagaatgtcaacacggcggacagtgtcaggtggaaaacggaagcgcagtctgtgtgtgccaggccggatatactggcgctgcatgcgagatggacgtcgacgactgtagccccgatccatgtctgaatggcggttcatgtgtagacctcgtaggcaattacacatgcctttgcgccgagccatttaagggtctgcgttgtgaaaccggggatcacccagtgccagatgcctgtctgagcgctccatgccacaacggcggaacatgcgtggatgccgatcagggttacgtctgtgagtgccctgaaggattcatgggactggattgtagggaacgtgttcccgacgattgtgaatgtaggaacgggggaaggtgtctgggcgctaataccaccctgtgtcagtgccctctcggcttctttggtctcctgtgcgagtttgagatcaccgccatgccatgcaacatgaatacccagtgtcctgacggagggtattgtatggagcacgggggaagctacctttgtgtgtgccacactgaccataacgctagccactcgctgccgtcaccctgtgattccgatccatgcttcaatggcggatcatgcgatgcccacgatgatagctacacttgcgagtgtcctcggggtttccacggtaaacattgcgaaaaggcccgaccccatttgtgctcttccggcccttgccgaaatgggggtacatgtaaggaagcaggcggtgagtaccactgttcgtgtccatacagatttaccggaaggcattgcgaaataggcaaaccggattcttgtgcctctggtccctgtcacaacgggggaacatgcttccactacattgggaaatataaatgcgactgccctcctgggttctcaggtagacactgtgaaatcgcgccttctccttgctttagatcaccgtgcgtgaacgggggtacatgcgaagaccgcgatactgacttcttctgtcactgtcaggcagggtatatggggaggcgttgtcaggccgaggtggactgcggaccacccgaggaggtgaagcacgccaccctgcgattcaatggaactagacttggagcagtagctttgtacgcctgcgataggggctattcgctcagtgccccatctagaattagagtgtgtcagcctcacggagtctggtctgaaccgccacagtgcttggagatcgatgaatgtcggtcccagccctgtctacatggcggatcatgccaggacagagtagcaggatatctgtgcttgtgcagtaccgggtatgaaggcgcacactgtgaacttgaacgagacgaatgccgggctcatccctgccggaacggcggatcctgtcggaacctgcccggtgcctatgtttgtagatgtcctgcaggatttgtgggtgtgcattgcgagacggaggtagatgcctgtgactctagtccttgccagcacggcggaaggtgcgaatctgggggtggcgcatatctttgtgtctgtcccgagtctttttttgggtatcactgtgaaactgtcagcgacccatgtttcagctctccatgtggcggacggggttactgcttagcaagcaatggtagccatagctgcacctgcaaggtgggttatacaggcgaggactgcgcgaaggagctcttcccccctaccgcactcaagatggagcgggtggaggagtccggcgtgtccatcagttggaaccccccaaatgggcctgcagctaggcagatgctggatggctacgccgttacgtatgttagctctgacgggtcctaccgtagaaccgactttgtcgacagaactagatccagtcatcagctgcaggccctcgcagctggacgcgcttataatatctccgttttcagcgtcaagcggaattctaacaacaaaaatgatatctcaagacccgctgttttgttagcccgaacaagacccagaccagtcgaaggatttgaggtcaccaatgtgacggcgtcaactattagtgttcagtgggcattgcatagaatacggcacgctaccgtgtctggcgtccgcgtgagtatccgccaccccgaggctctccgcgaccaagccacagacgtagatagaagtgtggaccgcttcacattccgtgccttactgccagggaagaggtacacaatccagctgacgaccctgtcaggattacgtggagaagagcacccgacagaaagcctggctacggcgccaacacacgtctggacgagaccactccccccagcgaatctgaccgcagccagggtgaccgctacttccgcacatgtcgtgtgggacgcacctactcctgggagcctgctggaggcttacgtgatcaacgtgacaacatcacagagtactaagtctagatatgtacctaatgggaagctcgccagttacacagtgcgagacttgcttccgggtcgcagataccagctaagcgttatagctgtgcaatctactgagctggggcctcagcactcagaacccgctcacctgtacatcattaccagccccagggacggggctgatcggcgatggcatcagggaggacaccatccaagggtgctgaagaacaggccaccccctgcgcgattgcccgaactgaggctgctgaatgaccacagcgcgcctgagacccctactcagccgcctcggttctccgagctagtagacgggagaggtagggtaagtgccaggtttggcggttctccatctaaggctgccaccgtacgttctcaacccacagcctccgcccagcttgaaaacatggaggaggcccctaagagggtgtcgttagccctccagcttcctgaacatgggtctaaggacattggctctgagtcagctgcactggtcggaacactcggcctcactgattgtagtcagggcccttag

SEQ ID NO: 11113 - DNA, 732 bp, Artificial Sequence
  Description of Artificial Sequence: Synthetic coding sequence
atgggcatatttttggtttatgttggttttgtgtttttttcagttctgtatgtgcaacaggggctgtcctcgcaagccaaatttaccgagttccccaggaacgtcacagcaacagagggacagaatgtagagatgagctgcgcctttcagtccgggtcggcatcggtgtatctggagatacagtggtggttcctccgcggtcccgaagacttagacccaggtgcagagggcgctggcgctcaagtggagcttttacccgatcgcgatcctgactccgacgggacgaaaatctcaaccgtaaaggtgcaaggcaatgacatatcccataaactgcagatatctaaagtgaggaagaaggacgaggggctttacgaatgtcgcgtcactgacgctaattacggcgagctgcaagaacataaggcccaagcctacttaaaggtgaacgctaattcccacgcccgacggatgcaggcctttgaagccagtccaatgtggctccaagatatgaagccgcgtaaaaatgtgagcgcagccattccgtcctccatccacggttcggccaaccagcgaacacatagcaccagttcccctcaggtggtggccaagatccctaaacagtcaccacagtcaggcatggagactcacttcgagccctttattctccccctgaccaacgcaccacagaaaggacagagctatcgcgtcgacagatttatgaacggcgacttctag

SEQ ID NO: 11114 - DNA, 1218 bp, Artificial Sequence
  Description of Artificial Sequence: Synthetic coding sequence
atgtggtatgtatcgaccaggggcgttgccccacgagtgaatttcgaaggggctcttttcagcggctacgcgcctgacggtggtctttttatgccagaagagctcccgcaattggatagggggacactctgccaatggtctaccttgagctatcctggcttggtcaaggagctgtgtgccctgttcatcggttctgaattgctccctaaggacgaactgaacgatctgattgacagagcattctcccggttccgacatcgcgaagtggttcatctgtccagactaagaaatgggctgaatgttttggaactgtggcacggggtaacatatgccttcaaagacttatccctttcatgtacaacacaattcctccagtattttttagagaagcgggaaaagcatgtcactgtggtggtcggaacttcaggtgatacgggttcagcggcaatagaatctgtgcaaggagcaaaaaacatggatattatagtgctgctcccaaaaggccattgtaccaaaatccaggagttgcaaatgacaaccgtgctgaaacagaatgtccatgtgtttggcgtggaaggcaactctgatgagctggatgaacctatcaaaaccgtgtttgcagatgtggctttcgtgaaaaagcataacctcatgtcccttaattccatcaattggagtcgggtcctggtccagatggcccatcacttttttgcctacttccaatgtactcctagtctggacactcaccccctgcccctcgtcgaggtagtggtgccgactggagccgcagggaacctggccgctggctatatagcacagaagatcgggctgccaatccgtcttgtggtcgcagttaatcggaacgacatcatccatcggactgtccagcagggtgacttttctctgtccgaggcggttaagtccaccctggcatctgctatggatatccaggtgccatataacatggaacgggtgttctggcttctaagtggctctgatagccaggtgacccgggctctcatggagcagtttgaacgcacccagtcagtgaaccttccgaaggaattacattcgaaatgggaacgccaggattatgaaaaaatggctgttatggaatgcgatggctgttgcgtggaactgtgccttggaaactgtggcccacgcagggggagcgtcaccgatatccccggaaccgccatggtgagaggcggtggatag

SEQ ID NO: 11115 - DNA, 573 bp, Artificial Sequence
  Description of Artificial Sequence: Synthetic coding sequence
atgagaactgtggtgctgactatgaaggctagtgtcattgaaatgttcttggtccttcttgtaactggcgtgcactctaacaaagagaccgcaaagaaaattaaaagaccaaagtttacagtgccccagattaactgtgacgttaaggcaggcaaaatcatcgatcctgagtttatcgttaagtgtcccgctggttgtcaggaccctaagtaccacgtatatggtaccgacgtgtacgcctcttatagctctgtgtgtggggctgctgttcacagcggtgtattggacaattccggtggcaaaatcctggtgaggaaggttgccggacagtcaggatataagggttcctacagcaatggtgtgcaaagtctgtccttaccaagatggcgggagtcttttattgtactcgaatccaagcccaaaaaaggggtcacctatcctagcgcactgacatactctagctcaaaatccccagccgctcaagcagacctgtggagtactgctacctacacaagcagccagaatagaccgagagcagaccccgtgcagagacagccgtgctactctttgtag

SEQ ID NO: 11116 - DNA, 399 bp, Artificial Sequence
  Description of Artificial Sequence: Synthetic coding sequence
atggccccaagtcctcgcacaggcagtagacaggatgcaaccgctctcccgtctatgtctagcacgttctgggcatttatgatcctcgcttccttgctgattgcgtattgtagtcagctggctgctggcacgtgtgagatcgtgactctggaccgagatagctcccaaccacggcgaacaatcgccagacaaactgccagatgtgcgtgccgcaaaggacagatagctggcacaacaagggccaggccggcatgcgtggatgcgagaataattaagaccaagcagtggtgcgacatgcttccatgcctggaaggtgaaggctgcgatttactgatcaacaggtctggctggacatgcacccagcctgggggacgcattaagactaccaccgtcagctag

SEQ ID NO: 11117 - DNA, 957 bp, Artificial Sequence
  Description of Artificial Sequence: Synthetic coding sequence
atgctcccactcacgatgaccgtattgattctgttgctgctacctacagggcaagctgctcccaaggatggcgtgaccagaccagacagtgaggtccagcaccaactgctgcccaacccatttcaacccggacaggagcagctgggccttttacagtcctaccttaagggactgggcagaacggaggtgcaattggagcacctatcaagagagcaggttttattatatctattcgctctgcatgattatgatcagtctggccaattggacgggcttgagctgttgtcaatgctgactgccgcactggcgcctggcgctgctaattctccgaccaccaaccccgtcatactgatcgtggataaagtgctggagactcaggacctgaatggtgacggcttgatgacaccggctgagcttattaactttccgggtgtggctctacgtcacgtagaaccaggcgagccactggcgccttcgccacaggagcctcaagcagtcgggagacagagccttctggcaaagtcgcctctgagacaagaaactcaggaggcccctgggccaagagaggaagcaaagggacaagtggaagcacgcagagagagcctcgatcccgttcaagaacctggcggtcaggcagaagcggacggtgacgtacccggacccagaggcgaagcagaggggcaggctgaggccaaaggagacgcgccaggaccacggggtgaggccggagggcaggccgaggctgaaggcgatgccccaggacctaggggagaagctggtgggcaggctgaggctgagggcgacgctcctggaccaaggggagaggcagggggacaggctgaggcccgagagaacggagaagaagccaaagagttaccaggggagaccttggagtcaaagaacacccagaatgatttcgaagtgcacattgtccaggtggaaaatgatgaaatttag

SEQ ID NO: 11118 - DNA, 399 bp, Artificial Sequence
  Description of Artificial Sequence: Synthetic coding sequence
atgttgcctttaacgatgacggtgctgattctactcttattgccgaccggccaggcagcacccaaggacggcgtgacccgtcccgattcagaagtacagcaccagctgctgcccaacccatttcagccagggcaggaacagctaggattactgcagtcttacctgaagggcttaggcaggactgaagttcagctggaacacttatctcgtgagcaggttctcctctacttattcgcactgcacgattatgatcagtccggccagctagatggactggagcttctgtcgatgctgacagcagcactcgcacctggcgctgctaattccccgactacaaatccgggaaacctggacgcacggctggacggaggtgaaaaggcaatgcagccacagtggtag

SEQ ID NO: 11119 - DNA, 732 bp, Artificial Sequence
  Description of Artificial Sequence: Synthetic coding sequence
atgctcctctcattattgggtgcctgcgccgtggtcggaccattccacggcccagagtgggagcctgtgcaggggctgctgtcacagaatcatagctgtcgggacccacagtgctgcggaaacctgctagttctgtgtctgttcctggtgtggcaggtgcgccactgttggcaccaggtgacaaggacccggtttagtacgcggaatgtcataaaggtgccgctgcagaagcgcgctgtcccatcaatgaggtgcgagaccgtcttcaaactgacacccgagttcttttccccaggaaagtccagagggctggactcccaacagtgcgcgcaacgtcaaagatgggggtacaggcgctcattgcaggagtcttgggcccaaaacctgctgtctccccagcacccgtgccccggaccaccttccggcgtgcacactcacagtgaaccgattttctgcactaccagcatctcaaacacatgtctattaccccagaacagtagctggaaagcttggcaggtcccctggtgtctgcatgatgggcagaccaggcccgctctcgatatgtgccaagagatggagcagcttctacttcattcccaggagcgcctcgtgagcttggagcccgtgatttccgtgcgctctcgaccaacaagcatgaccctcacgacgagtctccccaatctccttagcgccgaaaggctacagttttgcccacagcgcgcaccggcttag

SEQ ID NO: 11120 - DNA, 2505 bp, Artificial Sequence
  Description of Artificial Sequence: Synthetic coding sequence
atgaaacacaccctggcactgctggcaccactacttggactgggattgggcttggccctgtcccagttggctgctggtgcgacagactgtaaattccttggccctgccgagcatttaactttcacacccgctgccagggccagatggctggcccctcgcgtgcgggcaccaggactcctggactccctatatggtacagtacgacgatttctttctgttgtccagttaaacccgttcccctcggaattagtcaaggcccttctgaacgagctcgcgtcagtcaaagttaacgaagtagttaggtacgaagcagggtacgtggtgtgcgcagtgatcgcaggcctgtaccttctgttagtaccaaccgccggactgtgtttttgctgctgccggtgccataggcggtgcggcggacgtgttaaaaccgagcataaggcgctggcatgcgaacgcgctgccctcatggtcttcctcctattgaccacattgctgttactcattggtgtcgtttgtgcttttgtcacaaatcaacggacccacgaacagatgggtccgtccattgaggcaatgcctgagactctgctgtccctgtggggcctcgtgtctgacgtcccccaggagctgcaggccgtggcacaacagttcagtctgcctcaggagcaggtgtctgaggagctcgacggggtcggagtctccattggatcagctatacacacacagttgcgatcttccgtctacccgcttctggctgcagtggggtcccttggccaggttcttcaggtctctgtgcatcatctgcagactcttaatgctacggttgtggaattacaagctgggcagcaggatttggagcccgctataagagagcacagagacaggctcctagaactactgcaggaggcgaggtgtcagggggactgcgccggagcgctgagttgggcgcgtaccctcgaactgggggcagacttctctcaggttccctcagttgaccacgtactgcaccagctcaagggagttcccgaggccaatttctctagtatggttcaggaggagaactcgactttcaatgctttacctgcactcgccgcaatgcaaactagctccgtggttcaagaactcaaaaaggcagtggctcagcagcccgaaggtgtgcggacactagccgaagggtttccaggcttggaagccgcttctcggtgggcccaggccctccaggaggtcgaggagagttcacgcccttacctgcaggaggtgcagcgctatgaaacttatagatggattgtcggatgtgtcctgtgttctgtggtgctgttcgtggtgttgtgtaacctgctggggctgaatttgggcatatgggggttatctgcccgtgacgatccctcccaccccgaagccaagggcgaggcgggagcacggtttctaatggcaggcgttgggctgagcttcctgtttgccgcacctctgattctgctggtgtttgctacatttctggttggtggtaatgtccagaccctggtctgccagtcctgggaaaacggcgagctgtttgagttcgcagacactccgggtaatctgcctcctagcatgaacctgtcccagcttctgggattaagaaaaaatatctcaattcaccaggcctatcaacaatgtaaggagggggctgctctgtggactgtgctgcagctcaacgatagctacgatctggaagaacacttggatataaaccagtatactaacaaattgagacaggaactgcagtccctgaaagttgacacacaatccctggacctgctgtctagcgccgctcgacgcgacttagaggccctacagtcttcgggattgcagcgcatccattatcccgatttcctggtgcagatccagcggccagtggttaagactagcatggaacagctcgcgcaggagctccagggactggcacaggcgcaggacaattcagttctgggacagaggcttcaagaagaggcacaggggctccggaacctgcatcaagagaaggtggtgccacagcagtctttggtcgcaaaactgaatctgtccgttagagcgctggagagctctgcacctaacctgcagcttgagactagtgacgttttggcaaatgtaacatacctgaaaggggagctgcctgcttgggcagccaggattctgcgtaatgtttccgaatgttttctggccagggaaatgggatacttttcccagtatgtggcttgggtcagggaggaggtgacacagagaattgccacttgccaacccctctccggcgctctcgataattcccgtgtgattctgtgtgatatgatggctgatccctggaacgctttctggttctgcttggcatggtgtactttttttcttataccttcaatcatttttgccgtgaagacttccaagtattttcgcccaatccggaaacgtctctcgtcgacatcatccgaagagacccagctgtttcatatccctcgagttacctctttgaagctctag

SEQ ID NO: 11121 - DNA, 1185 bp, Artificial Sequence
  Description of Artificial Sequence: Synthetic coding sequence
atgtggcgctgcccactcggtcttctgctgctcctgccccttgcaggtcatttggcactgggcgctcagcaggggagaggcagaagggaactggcacccggactccacctgcgcggaatcagagacgcgggtgggagatattgccaagaacaggatctttgctgtcgcggaagggccgatgattgtgcactaccttatctaggggcaatatgctactgtgaccttttttgtaaccgtactgtgagcgactgctgccccttcccccctatccaaggctgcatgcacggtggcaggatttatcccgtcctggggacgtattgggataattgtaaccggtgtacatgtcaggagaaccggcaatggcagtgtgaccaggaaccctgtctcgtggatccagacatgatcaaggccatcaaccagggcaactacgggtggcaggcgggaaatcattccgccttttggggcatgacgctggatgaaggcatccggtatcggcttgggactatccgaccctcctcaagcgttatgaacatgcatgagatttacacggtcctcaatcctggcgaggtcctacccaccgccttcgaagccagtgagaagtggccaaatttaatccatgaaccactggaccagggcaactgcgcgggatcctgggccttttcaaccgctgctgttgcgagcgaccgggtttctatccacagtttgggccatatgactcccgtattgtctccgcagaacctcctgtcctgcgacacacaccagcagcaagggtgtcgtgggggacgccttgacggcgcatggtggttcttaagacggagaggagtggtgtcagaccattgctaccctttctcagggcgtgaacgtgacgaagccggaccagccccaccctgcatgatgcacagtagggccatgggccgaggcaagcgacaggcaaccgcccattgtccaaactcatatgtaaataacaatgatatctaccaagtgacaccggtctaccgcctcggtagcaatgataaggagataatgaaggaactgatggagaatggacccgtccaggctcttatggaggtccatgaggatttcttcctctacaagggcggtatctatagccatacaccggtgtctcttggtcgcccagaaagatacagaaggcacggtacccacagcgtcaaaatcaccggatag

SEQ ID NO: 11122 - DNA, 303 bp, Artificial Sequence
  Description of Artificial Sequence: Synthetic coding sequence
atggcagcagccctggcccttgttgccggtgtcctgagtggcgcagttttaccactttggtccgcccttccccagtacaaaaagaagatcaccgaccggtgttttcatcactccgagtgttactcaggctgctgtctgatggacttagatagcggcggagcgttctgtgccccacgcgctcgaattaccatgatctgtttgccacaaaccaagggagcgacaaatatcatctgcccttgtcggatggggctgacttgtatttcaaaggatcttatgtgtagtcgacgatgccatatgatctag

SEQ ID NO: 11123 - DNA, 978 bp, Artificial Sequence
  Description of Artificial Sequence: Synthetic coding sequence
atgcgcctgccaaggcgtgccgctttgggattgttgcccctgcttttgctgctgccacccgctcccgaggccgctaagaaacccacaccttgtcacaggtgtaggggattagtcgacaaattcaaccaaggcatggttgacacagccaagaaaaatttcggcggaggcaatacagcctgggaagaaaagactttgagcaagtacgaaagctcagagatccgactgctagaaatattagaggggttgtgtgaatccagcgactttgaatgtaatcagatgctggaagctcaggaggagcacctcgaggcctggtggcttcagctcaagagtgaataccctgatctattcgagtggttttgtgttaaaaccctgaaggtgtgttgcagccccggaacatatgggccagattgcctggcctgtcaggggggttcccagcgcccttgcagcggcaacgggcactgctctggtgacggctcacgccagggcgatgggagctgtcgttgccacatgggctatcaggggccactgtgtacagattgcatggacgggtatttctcaagtttgcggaatgagactcattcaatctgcaccgcatgtgatgaaagctgcaagacttgtagcgggctgaccaaccgggattgtggggagtgcgaggttggatgggtcctggatgagggggcttgcgtagagtgtgattcctcctgcgtgggctgtaccggagaagggcctgggaactgcaaggagtgtatttctggctacgcgagagagcatggccagtgcgcagatgtggacgaatgcagtttggctgagaagacttgtgtccgtaagaatgaaaattgctataacacacctggttcctatgtgtgtgtatgccctgatggcttcgaagaaaccgaagacgcctgcgtgccgccagcagaagccgaggcgacagagggcgagtcgcctactcagctgccaagccgggaagacttgtag

SEQ ID NO: 11124 - DNA, 459 bp, Artificial Sequence
  Description of Artificial Sequence: Synthetic coding sequence
atgcgcggtcccggacatcctctgttgctgggcttactgctggtgctgggcgctgccggacggggtagaggcggagctgagccgagagaacctgcagacggccaggcgttattgcgcttggtggtggaactggtccaggagttgagaaaacatcactctgcggagcataaaggcttgcaactacttggcagggattgcgcactcgggcgagccgaggcagcaggactgggcccatctcccgagcaaagagtagaaatcgttcctcgagatctgcgcatgaaggataagtttcttaaacacttaacaggacctctttacttctcccctaagtgtagtaaacactttcaccgcctgtaccacaatacccgggactgcaccatcccggcttattataagagatgcgcgagactgctgacaagacttgcggtgtcgcctgtgtgtatggaggacaaacagtag

SEQ ID NO: 11125 - DNA, 411 bp, Artificial Sequence
  Description of Artificial Sequence: Synthetic coding sequence
atggcaagaacaaagcagactgccagaaagagcacaggtggtaaggcgcctcggaagcagctggctaccaaagcggctaggaagtcggctccggcaaccggaggagtgaaaaagcctcatcggtaccgccctgggactgtagctctgcgcgagattcgaagatatcagaagtcaaccgagctgctgattagaaagctgcctttccaaaggctcgtacgggagatcgcgcaagatttcaagaccgacctaagatttcagtcaagcgcagtcatggctctgcaggaagcaagcgaggcatacctggtgggacttttcgaggacaccaacctgtgtgcaatacatgccaaaagagtgaccatcatgcccaaagatatacagctggcccgaaggattcgaggcgagagggcctag

SEQ ID NO: 11126 - DNA, 1209 bp, Artificial Sequence
  Description of Artificial Sequence: Synthetic coding sequence
atgagactccctagaagagccgcactggggttgctgcccttgctgctcctactccccccagctcccgaggctgccaaaaaacctactccctgtcacagatgtcgcggtcttgtagacaagtttaaccagggtatggtcgacacagccaagaaaaacttcggcggtggaaatactgcgtgggaggagaagactctgtcaaagtacgagagctcagagatccgtctgttagaaatcctcgagggcctctgtgaaagttccgattttgagtgtaaccagatgttagaggctcaggaggagcacctggaagcatggtggctgcaactcaaatccgaataccccgacctttttgaatggttttgcgttaaaactcttaaggtatgctgcagccccggaacctacgggccagattgtttagcctgtcagggcggatcccaacgaccatgcagcggaaatgggcactgcagcggggatggttccagacagggggacgggagttgcaggtgccacatgggctaccaggggcctctgtgcaccgactgcatggacggttactttagctctttgcggaatgagacacattccatctgtactgtcaggaccggactttcggattcttatcccccatgctgcctgtcactcggatgctggcggggtgtggggcacgcctggattcgcggaagaaacactcacacacagccagggtattctagccgggtgtggatcgctgctttcagccccgcatgtgacgagagttgcaaaacttgtagcggccttacaaaccgagattgtggcgagtgcgaggtcggctgggtgctggacgaaggagcctgcgtggacgtggacgaatgcgctgccgagcctccaccttgttctgcggctcaattttgtaaaaatgccaacggaagttatacttgcgaagagtgtgatagcagctgcgtggggtgtactggggagggtcccggaaattgcaaggagtgtatcagcggatacgcaagagagcacggccaatgtgccgacgtagatgaatgtagcttggccgagaaaacttgcgttaggaagaatgagaactgttacaacacccctggttcatatgtctgcgtgtgtcccgatgggttcgaagaaaccgaggatgcgtgtgtgcccccagccgaagcggaggccaccgaaggagagtctccgacccagctccctagtcgggaagacctctag

SEQ ID NO: 11127 - DNA, 633 bp, Artificial Sequence
  Description of Artificial Sequence: Synthetic coding sequence
atgtctgcagggaagatgatgcgcactctcatcaccactcacccgctcccactgttactgctaccccaacaactgttacagctggtccaattccaggaggtagacaccgattttgattttcctgaggaagacaaaaaggaggagttcgaggagtgcctggagaaattctttagcaccggaccagcacggcctccaaccaaggagaaggtgaaaagaagggtgctcatcgaacccggaatgccgctgaatcacatcgaatattgcaatcatgaaatcatggggaagaacgtgtactacaaacatcggtgggtggccgaacactactttctgctcatgcagtacgacgagttgcaaaagatctgctacaacagatttgtgccttgcaagaacggcatccggaagtgcaacagaagtaaagggctggttgagggcgtctactgcaacctcacagaggccttcgagattccagcatgtaagtacgaatccctttaccgcaaaggctacgtgctcataacctgctcatggcaaaacgagatgcaaaagaggatcccacatacgataaatgatctggtggaaccgcctgaacaccggagttttctatcagaggacggcgtcttcgttatttccccatag

SEQ ID NO: 11128 - DNA, 585 bp, Artificial Sequence
  Description of Artificial Sequence: Synthetic coding sequence
atgactatgaggcacaactggactcccgatctctcccctctctgggtgttgttgttgtgcgcgcacgtcgtcacattgctcgtgcgcgctacccccgtgtcccagacaacaaccgccgcaacagcctcagtccggagcacaaaggacccttgcccttcacagcccccagtattcccggcagctaaacagtgcccagctctggaagtgacttggcccgaagtagaggtgcctctgaacggcaccttatctttatcctgtgtcgcctgcagccggtttcctaacttctccatactgtactggctcggtaacggctcatttatagaacatctgcccggtcgactgtgggagggcagcacatctcgtgaaaggggaagtacgggcacccagctttgtaaggcactcgtgttggagcagttgactccagccctgcatagcactaacttctcctgcgttctcgtggatccagagcaggtggtgcaacgccatgtagtgctagcccaactctgggccggtctaagagcgacactccccccaacacaggaagcgctgccctcatcgcacagctcaccacagcaacaggggtag

SEQ ID NO: 11129 - DNA, 4059 bp, Artificial Sequence
  Description of Artificial Sequence: Synthetic coding sequence
atgcgccatggagtcgcctgggcccttcttgtcgccgcagccctgggactgggagcacggggagtacgcggagccgtggccctggccgatttctatccctttggggcagaacggggagatgcagttacaccaaaacaggatgacggtggaagcggccttcggccactgagcgtcccctttcctttttttggagcggaacattccggactttatgtaaacaataacggcatcatttcctttcttaaagaggtttctcagttcacacccgtggccttccctattgccaaagatagatgcgtggtggccgctttctgggcagatgtggacaatcgtagggcaggcgacgtatattatcgcgaggcaactgatccggctatgctccgcagagctacagaggatgttagacactactttcctgagctgctggactttaacgctacctgggtgttcgtggctacatggtacagggttacattctttggtggaagcagcagtagcccagtgaatacttttcagacagtgttgattacagatggcaagctgagttttaccattttcaactacgagtccatcgtgtggactactggaacccatgcgagctcagggggtaatgccaccggtctcgggggaattgcagcccaggcaggattcaatgcaggggatggacagcgctacttctcaatcccagggtccagaaccgccgacatggccgaagtcgaaactaccacaaacgtaggtgtcccaggaagatgggcattccggatcgatgatgctcaggtgagggtgggaggatgcggccatacaacttctgtttgcctagctcttcgcccatgtttaaacgggggtaaatgcatcgatgactgtgtaactggaaacccctcctatacttgttcctgtttgagcggttttacgggacgcagatgccatcttgacgtcaacgagtgtgcaagtcagccttgccagaacggtgggacctgcacacatggcataaactcattcagatgtcagtgcccagccggttttgggggacccacatgcgaaactgcgcaatccccatgtgataccaaagaatgccagcacggtgggcagtgtcaggtagaaaacggatcggccgtgtgcgtgtgtcaagcaggctatactggcgcagcttgtgagatggacgttgatgattgtagtccagatccttgcctcaatggcggttcatgcgtggatctcgtgggcaactacacctgcctctgtgctgaacctttcaaaggcctacgctgcgagaccggtgaccacccagtgccagatgcttgtctttctgcgccttgtcacaatgggggaacatgtgtggatgcggatcagggttacgtttgcgagtgtccagaaggcttcatggggctggactgtcgagaacgggtacctgacgactgtgagtgcagaaacggtggtcggtgtttgggagcaaacactacgctctgccaatgccccttaggctttttcgggctcctctgcgaatttgaaattaccgcgatgccgtgcaacatgaatacccagtgccccgacggtgggtattgtatggaacatggcggaagttacttgtgcgtgtgccacacagatcacaacgcaagccatagtctgcccagcccctgcgactctgacccatgcttcaatggagggtcctgtgacgcacatgacgattcctacacatgtgaatgcccgaggggattccacggcaagcactgtgaaaaggctagacctcatctgtgtagttcgggtccctgtcggaacggaggtacctgtaaggaggccggaggggagtatcattgttcttgcccatacagatttaccgggcgtcactgcgaaattggaaagcccgatagttgcgctagcggcccatgccataacgggggaacctgttttcactacatcgggaaatacaaatgcgattgccccccagggttcagcggacgacactgcgagattgcaccctcgccttgcttccgttccccctgtgttaatggcggaacttgtgaagaccgggacactgactttttctgccactgccaggccggttacatgggcaggcggtgccaagccgaagtggattgcgggcctccagaggaggtgaagcacgcaacgttgcgcttcaatggcacacgcctgggagccgtggccttatacgcttgcgacaggggatacagcctgtccgctcccagccggatcagagtttgtcagccacacggggtatggagtgagcccccacagtgccttgagattgatgaatgccggagtcaaccctgtctgcatggagggtcatgccaggacagggtcgcaggatatttgtgtctgtgttccaccggatacgagggtgcccactgcgaactcgaacgcgatgagtgtcgtgcgcacccctgcagaaacggaggtagttgtagaaatcttcctggcgcttacgtctgtagatgcccagcgggatttgtcggcgtgcattgtgagacagaagtggacgcatgtgatagttccccctgtcagcatggcggaaggtgtgagtcaggaggaggagcctacctctgtgtgtgtccagaatcttttttcggctaccactgtgaaaccgtttccgatccgtgtttctccagcccttgtggaggacgtggctattgcttggccagtaacggttcacactcctgcacctgcaaggtcggttacacaggagaggattgtgccaaggagctgttccctcccaccgcattaaagatggagcgcgtggaagagtcgggcgtctctatctcctggaatcccccaaacgggccagcagcgagacaaatgttggatggatacgccgtgacatatgtttcaagcgatggaagctaccgaagaaccgacttcgttgatagaacccggagttctcaccaactgcaggccctggcggcaggcagggcttacaatatctctgtgttttctgtgaaacggaactccaacaataaaaatgatatttcccggccagccgttttgctggccaggactcgcccaagaccagtagaaggatttgaggttaccaacgttacagccagcaccatctcagtacagtgggctctgcatcggattagacatgcaaccgtcagcggtgtcagagtgtcaatacggcaccccgaggcactgcgggatcaggccaccgatgtggatcgcagtgtcgataggttcacctttcgcgctctgttacctggtaagaggtacacaatccagttgaccaccctgagcggcctgcggggtgaagaacatcccaccgagtctctggccaccgcccctacgcatgtgtggacgcgacctctgccacccgcaaatctgactgccgcacgggtcacggctacctccgcccacgtcgtctgggacgcaccaacccccggttccttgctcgaggcctatgtgataaacgtaactacctcacagtcgaccaagagcagatatgtacccaatggaaagctggcctcatacacagtgcgggatctactgccaggccgtaggtatcagctgtctgtcatcgccgttcaatcaactgaactgggcccacaacactctgaaccagctcatctttacattataacctcacccagggacggcgctgaccgcaggtggcaccagggtggacaccatcccagagttctgaagaaccggcctccgcctgccagactacctgaacttcgcctgctgaatgatcactctgctcccgaaaccccgacccagccacccagattttctgagcttgtggacggtaggggcagggtttcagcgaggttcggcggtagtccttccaaagctgcgaccgtacggagccatgtcccaggcaattgctctgaaaacccttgtcagaatgggggtacatgtgtccccggagccgacgctcatagctgtgattgcggacccggttttaaaggccgtaggtgcgagctggcttgcatcaaggtgtccaggccctgtacgcgcctgttttctgaaactaaagctttcccggtgtgggagggaggcgtgtgccaccatgtcaaacagagcaaatcccagacgctggaaaaaagctag

SEQ ID NO: 11130 - DNA, 957 bp, Artificial Sequence
  Description of Artificial Sequence: Synthetic coding sequence
atgttacctctaaccatgacagtgctcatattgctgctgctaccaacaggccaggcagcacctaaagatggggtcactagaccagattcagaagttcaacaccaattgctccctaacccttttcagccaggtcaagaacagctggggctcctacagtcctatttgaaagggctcggccgtaccgaggtgcagttggaacacctaagcagggaacaagttctgctctatctcttcgccctgcatgactacgatcagtccggccaactcgatgggctcgaattgctgtcgatgctcacagccgcactggcgccaggagctgccaatagtcccactacaaatccagtgatactgatcgtggacaaggtgctggaaacccaggatctgaacggcgatggccttatgacaccggcagagctcattaattttcctggagtggctttgagacatgtagaacccggagagccgttagcccctagcccacaggaacctcaggccgttggacggcaaagtctcctggcgaagagccctcttagacaagaaactcaggaggcccctggccctagagaagaggctaaaggccaggtggaggctagacgcgaaagcctggatcccgtacaagaaccgggtggccaggcagaggccgacggggacgtgccagggcctagaggtgaggcagagggtcaggccgaggcaaagggagacgcgcctggtcccaggggggaggccggtggccaggccgaggccgagggggatgcgccaggccctcgcggtgaagcaggcggacaggctgaagccgaaggagacgctccaggacccagaggtgaagctgggggacaggcggaggctcgggagaatggtgaggaggccaaggagctacccggtgaaaccttggagagcaaaaatacccaaaatgacttcgaggtgcacattgtccaggtggagaacgatgaaatatag

SEQ ID NO: 11131 - DNA, 816 bp, Artificial Sequence
  Description of Artificial Sequence: Synthetic coding sequence
atgcaggctgcttgttggtacgtgttgtttttgctccagcctacagtttacctcgtaacctgcgccaatcttacaaatggaggtaagagcgaacttctgaaatccggaagtagcaagtcaacgcttaaacacatctggaccgagtcctccaaggatttgtccatcagcaggttgctgtcccagacgttccgagggaaggaaaatgacaccgatctcgatctgagatacgataccccagaaccctacagcgaacaggatctctgggattggctgcgaaactcaacagatttacaagagcctcggcctagggccaaacgtcgcccaatcgtgaagaccggaaaatttaagaaaatgttcgggtggggtgactttcactcaaacatcaaaactgtgaaactgaatttacttatcacaggcaaaattgttgaccacggaaatggaactttctccgtatacttccgccacaactcaacgggacagggcaatgtttcagtgagcttagtccccccaactaaaattgtggaatttgacctggcccagcagaccgtcattgatgccaaagatagtaaatcttttaactgcaggatcgagtacgagaaggtggacaaggcaactaaaaacacgctgtgtaactacgatccttcaaaaacgtgttaccaagagcagacccagtcacatgtctcttggctttgttctaagccattcaaggtcatttgtatatacatttcattttacagcaccgattacaagctggttcagaaggtatgccctgactataactaccactccgacacaccctatttccctagcggatag

SEQ ID NO: 11132 - DNA, 999 bp, Artificial Sequence
  Description of Artificial Sequence: Synthetic coding sequence
atgctgttgttggccgcagcattcctggtggcattcgtgttactactctacatggtgtcgccgttgatcagccccaagcctctcgcactgcctggagcccacgtggtcgttaccgggggtagctctggaatcggtaagtgcatcgccattgaatgttacaaacagggtgcttttatcacactggtggccaggaacgaggacaaactgctgcaggcgaagaaagaaattgagatgcactccattaacgataagcaggttgtgctatgtatatccgtggatgtaagccaggactacaaccaagtggaaaatgtcattaaacaggcccaggagaagcttggccctgttgacatgctggtcaactgtgccggtatggcggtctctggcaagttcgaagacctggaagtatcgacctttgagagactgatgagcataaactacctaggttctgtttacccgagccgtgcagtaattacgacaatgaaggagcgcagagtggggaggatcgtgtttgtgtctagtcaagccggacagcttggcttgttcgggtttaccgcttactctgcttctaaatttgcaatccgaggtctagccgaagctctccagatggaggtgaagccttataatgtttacatcacggtggcctatcctcctgatactgacacgcccggatttgcagaggagaaccggacaaagccacttgaaacccgcctgatttcggagacaacctctgtatgcaaacccgagcaagtggctaagcaaatcgtgaaggacgcaattcagggaaattttaactcgtccttgggctcagatggctatatgctgagcgctctcacctgtgggatggctccagtcacttccattacggagggcctacagcaggtcgtgacaatggggctcttccggactatagccctgttttaccttgggtcctttgattctattgttcgcagatgcatgatgcagagagaaaaatcagagaatgcggacaagaccgcttag

SEQ ID NO: 11133 - DNA, 1497 bp, Artificial Sequence
  Description of Artificial Sequence: Synthetic coding sequence
atgagctttagtgcaaccattctgttctcacctccgtctgggtcggaggccagatgctgctgttgcgcctgcaagtcagagactaatgggggtaataccggttctcaaggcggaaaccctcctccgtccactcccattacagtgacaggacatggactggccgtccagtcctccgaacagctcctgcatgtgatttatcaaagagtggataaggcagtgggtctggccgaggccgcactgggactggccagagccaacaatgaactgctgaaaagactccaggaagaagtgggtgatctcagacaggggaaggtttcaattcctgatgaggacggggaatcaagggcgcattctagtccccctgaggaaccaggccctctgaaggagagccctggtgaggcctttaaagcgcttagcgcggtggaggaggagtgcgactctgtcggtagcggggttcaggtcgtcatcgaggaactgcggcagctgggagcagcttctgtagggcctggccctctcggctttcctgcaacccagcgcgatatgagactgccaggttgtaccctcgccgcttcagaggccgcacctttactgaatccgctggtggacgactatgtcgcaagcgaaggcgctgtacagagagtgttggtgcccgcttacgcaaagcagctgtcacccgctacacagctcgctattcagcgcgcaacccccgagaccggcccagaaaatgggactaaactgccgcctccgcgaccggaagatatgttaaatgctgctgccgctttagatagtgcactcgaggagagtggccctgggagcactggcgaactgaggcattcgctgggtctcaccgtctccccatgtcgcacccgaggctccgggcaaaaaaactctcgtagaaagcgggatttagtcctgtcaaaactagttcataatgtgcacaaccatatcaccaatgacaagagatttaatggcagcgagtcgattaagtcatcctggaacattagtgtcgtgaagtttttgctcgagaaacttaagcaggagctggtaacatccccgcataactacaccgacaaggagctgaaaggggcatgcgtagcttattttctgacaaaaagaagagaatatagaaattccttaaacccatttaagggtttaaaagagaaagaagagaagaaactgaggagccgacggtatcgtctgttcgctaataggtcctccatcatgaggcacttcggccctgaagatcagaggctgtggaatgacgttaccgaagagctcatgtcggatgaggaggattctctgaacgaacccgaccggttaccatcggctgaggcccagctcctgccccctgagttatacaaccccaattttcaagaagaagaggacgaaggcggtgacgaaaacgcgcctgggagcccctcttttgatcagccccataagacatgttgccccgacctgaattcgtttattgagatcaaggttgagaaggacgagtag

SEQ ID NO: 11134 - DNA, 966 bp, Artificial Sequence
  Description of Artificial Sequence: Synthetic coding sequence
atgaggctcccgagacgggctgccctggggctgctgccgctgcttcttctgcttccccctgctccagaagccgcaaagaagcccaccccatgccaccggtgtaggggtttagtggataagtttaatcagggtatggtggatacagctaagaaaaactttggcggaggaaataccgcttgggaggaaaaaactctctcaaagtatgaatcctcagaaatacggttgctagagattctggagggactctgcgaaagcagcgactttgagtgtaatcaaatgctggaagcccaggaggagcacctggaggcatggtggctccagctgaagagcgaataccctgatctgttcgaatggttctgtgtgaaaaccttgaaggtctgctgctcccccggaacctacggacctgactgcctggcctgccagggtggatcccagagaccttgtagcggtaacggtcactgctctggcgacggctctaggcagggcgatggaagctgccggtgtcacatgggataccagggacctctgtgcacggattgtatggatgggtacttttctagcctgagaaatgagacccatagtatctgcacagcctgtgacgaatcctgcaaaacttgttcaggactgactaatagagactgcggcgaatgtgaagtgggttgggtgctggatgaaggagcatgtgtggacgtggacgagtgcgccgctgagccacctccatgttctgcggcacagttttgtaaaaatgccaacggcagttatacgtgtgaggatgtcgacgagtgtagcctggcggaaaagacatgtgtccggaagaacgaaaattgctacaacaccccagggagttatgtgtgcgtctgtcctgatgggttcgaagagaccgaggacgcctgtgtgcccccagcagaggccgaggctactgagggagaatcccctactcaactgccctcccgcgaggacctgtag

SEQ ID NO: 11135 - DNA, 711 bp, Artificial Sequence
  Description of Artificial Sequence: Synthetic coding sequence
atgatgggaatctttctggtctacgtgggcttcgtgttcttctctgtgctctatgtgcagcagggcctttcatcacaagcaaaattcaccgagttccctcgcaacgtgaccgccactgagggccagaatgtggaaatgtcctgcgcctttcagagcggatcagcgtctgtttatctggagatacaatggtggtttctgcgcggtcccgaagatttagatcccggagctgagggggctggagctcaggtggagctcctcccagatcgggaccctgatagtgacggaacaaagattagtacagtgaaagtgcagggcaacgacatttcacataagttacaaatctcaaaagtgcgcaagaaggatgaggggctgtacgagtgtcgggtgaccgacgctaactatggggaacttcaggaacataaggcccaggcctatcttaaggtgaacgccaacagccacgctcgcagaatgcaggcgttcgaggcaagccctatgtggctccaggacatgaagcctcgaaaaaacgtctccgctgctattccgagttcaatccatggtagcgcaaatcagcgcactcatagcactagctccccacaagtagtcgccaaaattcccaagcagtctcctcagtctggtgccaggatagccacctctcatggcctgagcgtactgctattggtgtgcggctttgtcaagggggcactcctgtag

SEQ ID NO: 11136 - DNA, 273 bp, Artificial Sequence
  Description of Artificial Sequence: Synthetic coding sequence
atgaacatgaagcccgcaacagcttccgcacttctgctgctgctgctgggattagcatggacccagggctcacacggctggggagcagacgcttccagcctccaaaagcgcgctggacgggatgaccagaattacaactataatcaacatgcataccccaccgcctatggcggaaaatacagcgtaaagaccccagcgaaagggggagtttctccatcttccagtgcatcacgggtccagcccggattgttgcagtgggtgaagttttggtag

SEQ ID NO: 11137 - DNA, 360 bp, Artificial Sequence
  Description of Artificial Sequence: Synthetic coding sequence
atgccagctgtcttcatgctggcttcaagttcggctttgcagtgcggacgaggggtccctaggttcccacggactgaggtcggtgcagggcattccgttaatgaggagacaaaggctgagaaagtgggaaatcagacatccgtgattccagctacatcccgtcaggccgctcttggcacttcttggacacagagaaggactcaaccgctccaagagaggtcccactggcatcccaggggtaacaacgcatcaggaatgggaggccacaggatgttccctggcccactgcgtggcccagccgctcaggttttggagaatgagtgtggttccctgggtcgagccgctgagggcagatcgtag

SEQ ID NO: 11138 - DNA, 639 bp, Artificial Sequence
  Description of Artificial Sequence: Synthetic coding sequence
atgctttcttctgtggtgttctggggtctgatagcactcatcggtacctcacgcggaagttatcctttttctcactccatgaagccacatcttcatcccaggctgtaccacgggtgctacggtgatatcatgaccatgaagaccagcggtgcgacatgtgatgctaactccgtgatgaattgtggcattcgcggatcagagatgtttgctgagatggatttgcgcgctattaaaccatatcaaaccctaattaaggaggtcgggcaacgacattgcgtggatcctgcagtgatcgcggctattatttcaagagaatcacacggaggtagcgtgctgcaggacggctgggaccaccgtggtctaaaattcggactgatgcagctggataagcagacctatcacccggtcggtgcctgggactcaaaggagcatctgtcccaagccacaggtattttgacagaacgaatcaaggcaattcagaaaaaatttccaacttggtcagtcgcccaacatctcaaaggcggactgtctgctttcaaatctgggattgaagctatagccacccccagtgacattgacaatgactttgtaaatgatatcattgcaagggctaaattttataaaagacagtctttctag

SEQ ID NO: 11139 - DNA, 387 bp, Artificial Sequence
  Description of Artificial Sequence: Synthetic coding sequence
atgcgggtggccaggcgcactagaaacgtctgtaggtgccccagggccgcaggcccaggggtcccggaaccccgtgccgctccccttccattgctggcaatggcaccccctccagcttgtcgatcccccatgtctcctcctcctcctccacttttgctactcctgctatcgctggctttgctcggagctagagcaagggcggagcccgctggatctgccgtgccagcacagtccaggccctgcgttgactgtcacgcattcgaatttatgcagagagccctgcaagatttgaggaagacagcgtgctctcttgatgctagaacagaaactctgctcctccaggccgagcgcagagccctatgcgcatgctggcctgccggacactag

SEQ ID NO: 11140 - DNA, 399 bp, Artificial Sequence
  Description of Artificial Sequence: Synthetic coding sequence
atggggccaagggtcctgcagcctccattactgctccttctgttggccctccttttagctgcactgccctgcggggcagaggaagcgtcaccattgaggcccgctcaggtgactctgagtccacccccagccgttactaacggctctcaaccaggggcaccccacaattcaacacacacccgccctcctggcgcttcaggttccgctctcacgaggtcgttttacgtgatcctgggcttctgtgggcttaccgccctttacttcctgattcgggcttttagactcaagaaaccccaacgtcgccgatacgggctgctggccaatacagaggatccaacagaaatggcaagcctggattcggatgaagagaccgtgtttgaatccagaaatctgcgctag

SEQ ID NO: 11141 - DNA, 585 bp, Artificial Sequence
  Description of Artificial Sequence: Synthetic coding sequence
atgagcgcgctatggctgctccttggtttactggcactcatggacctgagcgagtcctccaattggggatgttatgggaacattcaatccctggacactccaggagcttcttgcgggatcggacggaggcatgggctaaattactgtggcgtgagagctagtgaaagactggctgaaattgacatgccttacctcctcaagtatcagcctatgatgcagactattggacagaagtactgtatggaccctgccgtcatcgccggagttctctcccgtaagagccctggcgataagattctcgtgaacatgggtgatagaaccagtatggtccaggaccccggatctcaggctcctacctcttggatctccgaaagtcaggtgtcccaaacaacagaggtcctcaccacgaggatcaaggagatacaaaggaggttcccaacttggactccagaccagtacctcaggggaggcctatgcgcatacagcggcggagccggttatgtgaggtccagccaggatctgtcgtgtgacttttgtaacgatgtcctggccagggcaaaatacctcaaaaggcacgggttttag

SEQ ID NO: 11142 - DNA, 441 bp, Artificial Sequence
  Description of Artificial Sequence: Synthetic coding sequence
atggtcatcaccatttactatgatgtgaaggtacgctttattgtgagagggtgcggacaatacatttcttaccgttgccaggaaaaacggaacacctactttgcagagtattggtatcaggcgcagtgctgccagtatgactactgcaacagctggtcatccccacagctgcagtcatccctgcctgaacctcatgatcgtcctctggctctgcccctgtccgacagccagatccagtggttctatcaagccctgaatctgtccctccctctacccaactttcatgccggaaccgagccagacggcctggatcctatggtgacgctctctctcaatttgggcctatctttcgccgagcttcggagaatgtatctcttcctgaatagcagtggtctcctagtgctgccacaggctggtctgcttaccccacaccccagctag

SEQ ID NO: 11143 - DNA, 234 bp, Artificial Sequence
  Description of Artificial Sequence: Synthetic coding sequence
atgggtagtagtggccttctctccctccttgttttgtttgttctcctggccaacgtgcaggggccaggtctcacggactggctctttcccaggcggtgtcccaagattcgggaggaatgcgaattccaggaacgggacgtctgtacaaaagatcgacaatgccaagataataaaaaatgttgcgttttctcctgtggaaaaaagtgcctcgacttgaaacaagggaaacaatag

SEQ ID NO: 11144 - DNA, 444 bp, Artificial Sequence
  Description of Artificial Sequence: Synthetic coding sequence
atgggccaagaggtgcatggcagctgctgggctctgggcgctggtggcggacagcgccagtgggtcggccgtagcatgccccctttagcccctcaactgtgtcgcgcagtgtttttagtgcccattctgctcttgctgcaggtgaaacccctgaacgggtcccccggaccaaaggacgggagtcagacggaaaagactcctagtgctgaccagaaccaggaacaatttgaagaacatttcgtggctagctccgtgggcgagatgtggcaagtagtggatatggctcagcaggaagaagaccagtcatctaagacagctgctgtacacaagcatagctttcacctgtccttttgcttctcattagcctctgtaatggtgttttctggaggcccattgagacgcacctttcccaatattcaactatgcttcatgttaacgcattag

SEQ ID NO: 11145 - DNA, 1695 bp, Artificial Sequence
  Description of Artificial Sequence: Synthetic coding sequence
atggcaccgaaaaaactctcctgtttacggagtctcttgctccctctttcactgaccctgttactgccccaggcggacacccggagcttcgttgttgatcggggacacgatcggttcctgctcgacggagccccttttcggtatgtgtcaggatccttacactatttccgtgtaccacgcgtgttgtgggccgacaggctgttgaaaatgcgctggagtgggctgaacgccatccagttttatgttccctggaactatcacgaaccacagccgggtgtgtataatttcaatgggtctcgggaccttatcgcctttctcaatgaagcagccctggctaatctgctggttatactccggccaggcccttacatttgtgccgagtgggaaatgggaggactgccctcatggctgcttcgcaaacctgaaatccacctcagaacaagtgatcctgctgataatatgactaagatttttaccttgctccgcaagtacgagccccatggccctctggttaattccgaatattacaccggatggctcgactactgggggcagaatcactccactcggagcgtatctgccgtgactaaaggcctggagaacatgcttaaacttggcgctagtgtgaacatgtacatgttccacggtggcaccaactttggctactggaacggggctgataaaaagggacgatttctgcctataaccacatcgtatgactatgacgctccgatttccgaagccggagatccaactcccaagctgtttgccttgcgagacgtgattagcaagttccaggaagtgccattaggtcccctcccacccccaagtccaaaaatgatgctgggcccagttactctgcacctggtgggccatctcctggccttccttgacctgctctgccctaggggtcccatacacagtatccttccaatgacatttgaggccgtgaaacaggaccacggcttcatgctgtaccgcacttatatgacacacactatcttcgagcctacacctttctgggttcctaacaacggcgtgcatgatagagcctacgtgatggtggatggcgtctttcagggtgtggtcgaacgtaatatgcgcgacaagctcttcctgaccgggaagctcggatccaaactcgacatcttggtggagaacatgggcaggctgagtttcggcagcaattccagcgatttcaaaggactgttgaagccccctatactgggacagactattctgacccagtggatgatgttccccctgaagatagataacttggtaaagtggtggtttcccctccagctgcccaagtggccctatccgcaggctccatcggggccaacattctacagtaaaacttttcccatcctcggatccgttggcgacacctttctatacctgccaggttggactaagggccaggtgtggattaacggattcaatttgggaaggtattggactaaacaggggccacagcagaccttatacgtgcccaggttcctactgtttcccagaggcgcactcaacaagatcacccttctagaactggaagatgtgccactgcagccccaggtccaattcctggacaagccgatactgaacagtaccagtacgttgcaccgtacacacattaatagtttatccgccgataccctgagcgccagtgagcccatggaattgtccggtcattag

SEQ ID NO: 11146 - DNA, 423 bp, Artificial Sequence
  Description of Artificial Sequence: Synthetic coding sequence
atgtttttcacaatctccagaaagaacatgagtcagaaactgagcctgctcctcctggtgtttggtcttatctggggactcatgttattacactatactttccagcagccccgacaccaatcctccgtgaagctgagagaacagattttagacctttccaagaggtatgtgaaagccttggctgaggagaacaaaaacaccgttgatgtggagaatggcgctagcatggctggctatgcagacttgaagcgcacaattgccgttctgctcgatgacatcctacaaaggctagtcaagctggagaataaagtcgattatatcgtggtgaatggctctgccgcaaacaccacaaacggaacatctggcaatctggttccggtaacgaccaataagcgtacgaatgtttctgggagtataagatag

SEQ ID NO: 11147 - DNA, 528 bp, Artificial Sequence
  Description of Artificial Sequence: Synthetic coding sequence
atgctccctcccatggcactcccttcggtgtcctggatgctcctctcatgcctgatgctgctcagccaggtccagggcgaggagccacaacgggagttgcctagtgctaggatcaggtgtcccaaaggctctaaagcctatggtagccactgttatgctctgtttctatcccccaagagctggaccgatgccgatctggcctgtcagaaacggccaagcgggaacctagtgtctgtgctgtcaggcgctgaaggctcctttgtctcctccttggttaaatctatcggcaatagctactcatacgtctggataggtctgcatgaccctacacagggaacagagcctaacggggaggggtgggaatggtcttcgtccgacgtcatgaactattttgcctgggaaaggaacccttcaactatatcgagtcccggacactgcgcatccctgagtcgttctactgcctttctccgctggaaggactacaattgcaacgtcaggctcccatacgtgtgtaagttcaccgattag

SEQ ID NO: 11148 - DNA, 381 bp, Artificial Sequence
  Description of Artificial Sequence: Synthetic coding sequence
atgcatttgtcacagctccttgcttgtgccctgttgctcactctgctgagtttgaggcctagtgaggccaaaccaggtgctccccctaaggttccgcgaactcctcctgctgaagaactggccgagcctcaggcagccggaggtggacagaaaaagggcgacaaagccccagggggagggggagcaaacctgaaaggtgaccggtccaggttgcttcgagatttgcgggttgataccaagtctcgcgctgcctgggccaggcttcttcaggaacaccctaatgctaggaagtacaagggagctaacaagaaaggtctgtcaaaggggtgctttggcctcaagttggaccggatcgggtccatgtcgggcctgggctgttag

SEQ ID NO: 11149 - DNA, 288 bp, Artificial Sequence
  Description of Artificial Sequence: Synthetic coding sequence
atggcccctccccctgcctgcaggagccctatgtcgcctccacccccacctctactcttactactcctaagtctggctctgctcggagcccgagcaagagccgagcctgcaggtagcgcggtgccagctcagtcacgcccatgtgtcgattgtcatgcctttgagttcatgcagagggctcttcaggatttgcggaaaaccgcgtgcagcctcgatgctaggaccgaaacgctgctgctacaagccgagaggcgcgctctttgcgcttgctggcctgcaggccactag

SEQ ID NO: 11150 - DNA, 423 bp, Artificial Sequence
  Description of Artificial Sequence: Synthetic coding sequence
atgttttttacaatcagtcggaagaatatgagtcagaaactgtcactgttgctcctggtgttcgggctgatctggggcctgatgttgctgcattatacctttcaacagccacgtcaccagagctccgtcaaactccgggaacaaatcctcgaccttagtaagagatacgtcaaagcattggccgaagagaacaagaacaccgtggacgtagaaaacggcgcaagtatggcagggtatgcagacctcaaacgaacaatagccgttctcctcgacgacatactgcagagactggttaagctggagaacaaggttgactatatcgtggttaatggctccgctgctaatactaccaatggaacatctgggaacctcgtgccggtcaccactaataagcggactaatgtatcaggatcaattcggtag

SEQ ID NO: 11151 - DNA, 291 bp, Artificial Sequence
  Description of Artificial Sequence: Synthetic coding sequence
atggagcataaggaggtggtcctcctgctactgctgtttctcaaatccggacagggagagcccctggacgattacgttaacacgcagggcccttctctgttttccgtaacaaagaagcagctgggggcagggagtcgcgaggaatgcgcggctaaatgtgaagaggataaagaatttacctgcagggcttttcagtatcactccaaggagcagcagtgtgtgatcatggctgaaaatcggaagtcttcaatcatcatccggatgagagacgccgttttgttcgagaaatag

SEQ ID NO: 11152 - DNA, 678 bp, Artificial Sequence
  Description of Artificial Sequence: Synthetic coding sequence
taagctgatctgccatcctgttggggcgctggtccatgttacaccgggcacaaagtcggcgctcttagacgcgacacagtcatttgctgttgtaggcacggtgattattctacaccctgcctcttcacaccaggcaagccatccaggaatcccagtccctggaagaggactttgtggactctgtcagcgccatgggctggacctgcgggatggaccggagaggaacagaatgctactaaaactgggctcatcacaaggcgcccacggccattgcgacgtaggccccatcctgctcccgcaagcccgcttcctgaaataatcagaggcaacattcccaggatgttaggtaaattcgtgcccgtaaattgggagccgcctcaaccgctgccctttcccaagtacctgcggtgttatcggtgcctgctggaaaccaaagagctgggttgcctgctgggttcagatatttgtctaacacctgccggtagctcatgcataaccctccataagaaaaacagcagcggcagcgatgtgatggtcagtgactgtagaagtaaggaacagatgtccgactgctcaaatacgaggacatcacctgttagcgggttttggatcttcagtcagtattgctttttagatttctgcaacgatccacagaatcgaggattatacacaccctag

SEQ ID NO: 11153 - DNA, 684 bp, Artificial Sequence
  Description of Artificial Sequence: Synthetic coding sequence
atgggtgctgtgatgggcacttttagctccctgcagaccaaacagagacggcctagcaaggatattgcttggtggtactaccaatatcagcgggataagattgaagacgagctagaaatgacaatggtgtgtcaccgccctgaggggttggagcagctggaagcacagacaaacttcacaaagagggagctacaagtactttatagaggtttcaagaatgaatgccccagcggcgtggtcaacgaagatacatttaaacaaatttatgcacagttctttccccacggagatgcatctacctatgcccactatctctttaacgcctttgacaccactcagactggatctgttaaatttgaggacttcgtaactgccttgtctatcctgctgcggggaacagtacacgagaagctacgctggacgttcaacctgtacgatatcaacaaagatggttatataaacaaggaggaaatgatggatattgttaaagccatttacgatatgatgggtaaatacacatatcccgtcctcaaagaggacacaccccgacagcacgtggacgtattcttccagaaaatggacaaaaacaaagacggtatcgtgacattggatgaattcctggagtcctgccaggaagacgataatataatgcggagcctgcagttattccagaacgtgatgtag

SEQ ID NO: 11154 - DNA, 546 bp, Artificial Sequence
  Description of Artificial Sequence: Synthetic coding sequence
atgcaagtgaacttcgttagctacgtgcagctaacgtctagagcgctcccaagcctcaccgatagtaagggatccctggtggtggtaagctccctcctgggtagagtgcccacttccttcagcacgccttatagcgcggcaaaatttgcactggatgggttttttgggtccctgcggagagaattggacgtccaggatgtgaatgtggcgataacaatgtgcgtgcttggtctgcgggaccgggcaagtgcggcagaggcggttcggtcttcgacttcccgcccacgacaaccagaacacagaggcgtgccccttcagtctcagacagcgatgtttctccccccaacagtgcccggagccaggacacttactgagacacccctccgcggatggccccagccaaaaatgaaatccagccgacagaagagtaagacagagaagaatgatgggcatttagagcccgtgactgcctgggaagttcaggtcccaagggtcaggcgtctctgcagaggcctggcccgtcctcatctgtttggccacgattag

SEQ ID NO: 11155 - DNA, 423 bp, Artificial Sequence
  Description of Artificial Sequence: Synthetic coding sequence
atgtcagacttgctccttctgggactgatcggcggactcactcttctgctgctcctgacattactggcattcgctggatactcgggcctccttgcaggcgtggaagtcagcgccggatcacctcccattcgcaatgtcactgtggcttataagtttcacatgggcctgtacggtgaaactgggcgtttattcacagagtcatgcagtattagtccaaaactgcggtcaatcgccgtgtactacgacaacccgcacatggttccacctgacaaatgtcgctgcgccgtaggctcaatcctcagtgaaggggaggaaagcccatccccagagcttatcgatctgtaccaaaagtttgggttcaaagtcttcagctttcccgcaccaagccacgtggtcaccgcaacttttccatatactacatag

SEQ ID NO: 11156 - DNA, 177 bp, Artificial Sequence
  Description of Artificial Sequence: Synthetic coding sequence
atgggccctgaggccctctcatcgcttttgctactgctactcgttgcaagtggcgacgccgacatgaagggtcattttgaccccgcaaaatgtaggtacgcgctgggcatgcaggacaggaccatccccgattccgacatctccgcctcctcatcctggagtgactcaaccgcgtag

SEQ ID NO: 11157 - DNA, 2742 bp, Artificial Sequence
  Description of Artificial Sequence: Synthetic coding sequence
atgggacctgaagccctcagcagtctgttactcttgctgctggtggcctctggcgacgcggacatgaaggggcacttcgatcccgcaaagtgtagatatgccctgggtatgcaggatcggaccatccccgatagcgacatctccgcttcgtcaagctggagtgacagtacagctgccaggcacagccggctagagtctagcgatggcgacggcgcttggtgccccgctggctccgtgtttcctaaagaggaggaatatcttcaggtcgacctacagaggttgcacctggtcgctctggtgggcacccagggcaggcatgctgggggattagggaaagaatttagccggagctacaggctgcgttatagcagagacggacgcaggtggatgggatggaaggaccggtggggccaggaagtcataagcggtaacgaggatcccgagggggtggttctgaaagatctcggacccccaatggtagcgcgactcgttcggttctaccccagggccgaccgcgttatgtcagtttgtcttagggtcgagttatatgggtgtttgtggcgcgacgggctgctgagctacacagcacccgtgggccagactatgtacctgtctgaagctgtctatcttaacgactccacctatgacgggcataccgtaggcggacttcagtacggaggcctaggccagcttgctgatggcgtcgtgggcctggatgattttcgcaaatcacaagaactgcgcgtgtggccgggatacgactacgtcggctggagcaatcacagcttctcatctgggtacgtcgagatggagttcgagttcgatcgactgcgtgctttccaagcaatgcaggttcattgcaataatatgcacactctgggcgcacgacttccaggtggggtggaatgcagattccgtaggggcccagctatggcttgggaaggggaacccatgcgccacaatctgggaggcaatttgggcgatcctcgggctagagctgtttctgttcccctgggtggtagagttgcaaggtttcttcaatgccgtttcctgttcgcgggtccctggctcttattctccgagataagctttattagtgacgtggtcaataacagcagcccagccctgggtgggacttttcccccagccccttggtggcctcccggtccccctcctaccaattttagttctctggagctcgagcccagggggcagcagcccgtggccaaggcagaaggcagcccaacagcaattctaattggttgcctggttgccatcattctgctcctgctactaatcatagctttaatgctgtggcgcttacattggcggcgactcctgtcaaaagccgaacgcagagtgcttgaggaggaactgactgtacacctgtctgtccctggagacaccattctcatcaataacagacctggcccacgagagccccctccctaccaagaaccacggccaaggggcaatcctccccatagcgcaccatgtgtacccaatggttccgctttgctgttatcaaatcctgcctaccgcctgctcctggccacctacgcacgaccccctcgcggtcccggtcccccaacacccgcatgggccaaacctaccaatactcaggcttactctggcgactatatggagccagaaaaacctggagccccacttctgccgcctccaccgcagaatagcgtgccccactacgccgaagccgacatcgtgaccctccagggcgtgactggcggaaatacgtacgcggtgcctgctttaccaccgggagcggtgggggacgggcctcccagggtggattttccccgttcgaggttaagattcaaagagaaactgggcgaggggcagttcggcgaggtgcatctttgcgaggtggactctccacaagatctggtctctctcgactttcccctgaacgtccgcaagggccaccccctgctggtggcagtgaagatacttcggcctgacgctactaaaaacgctcgtaatgattttcttaaagaggtgaagattatgtcacggctgaaggacccaaatataatccgccttctcggagtgtgcgttcaggatgaccctctttgcatgatcaccgactatatggagaacggcgatctcaaccagtttttgagcgcgcaccagctcgaagacaaagctgccgaaggagcgccaggcgacggacaggcagctcaaggcccaacgattagttacccgatgctgcttcacgttgccgcacagattgccagcgggatgcgctatttagccactttgaattttgtccatagggacctggcaactcggaactgccttgtaggcgaaaattttacgatcaagatagctgactttggcatgagccggaatctgtacgctggtgattactatcgtgtgcagggcagagccgtcctgcctattcgctggatggcatgggagtgtattcttatgggtaaatttaccacggcttccgacgtgtgggctttcggcgtgactctgtgggaggtgctcatgttgtgccgggctcagccttttgggcagctgactgacgagcaagtaatcgaaaacgctggtgaattcttccgtgaccagggtcggcaggtatacctatcgaggccgcctgcatgtccccaggggctctatgagctgatgctccgctgctggagccgggagtcagagcagcgccctccattttcacagcttcacaggtttctcgccgaggacgccctgaatacggtctag

SEQ ID NO: 11158 - DNA, 1146 bp, Artificial Sequence
  Description of Artificial Sequence: Synthetic coding sequence
atgcgactgttggcgtggctgatttttttagccaattggggcggagccagggctgagcctgggaaattttggcatattgctgacctgcatctggatcccgactataaagtatccaaagatccttttcaggtctgcccaagcgcaggtagtcagccagtccccgacgcgggaccttggggtgactatctgtgcgatagcccctgggcacttataaactcatcaatctacgccatgaaggaaatcgagcctgaacccgattttatattgtggaccggcgacgatacaccacacgtcccagatgaaaagcttggcgaggctgccgtgctggagatagtcgagcgtcttaccaaactgatacgtgaggtgttccccggagctttttactgtgagaaactgcccggtccaagtggcgctggcagaatagtggtactcaataccaacctttactatacatccaatgccctcacagctgatatggcggatcccggtcagcaatttcagtggcttgaagacgtgctaacagacgcctctaaagcaggggatatggtatatattgtgggacacgtgccaccaggtttctttgaaaagacccagaacaaagcctggttccgtgaaggttttaatgagaaatacctcaaagtggtgagaaagcatcaccgggtgatcgcaggccagttcttcgggcatcatcacactgattccttcagaatgttgtatgatgacgcaggcgttcccataagtgccatgtttatcacacccggtgtcaccccatggaagacaacattaccaggggtcgtcaacggagccaataacccagccattcgagtcttcgaatacgacagggccacattatcattgaaggacatggtaacctatttcatgaacttgtcccaggctaacgcccagggaactcctaggtgggagctggagtaccagagcacactgcaaagatattatgtttataactccgtttcctacagcgccggtgtttgtgatgaagcttgtagcatgcagcatgtttgtgcaatgcgccaagtggacattgatgcttatactacatgtctgtacgcaagcgggaccacaccagtgccccagttgcctctgttgcttatggccttactgggtctgtgcactcttgtactctag

SEQ ID NO: 11159 - DNA, 456 bp, Artificial Sequence
  Description of Artificial Sequence: Synthetic coding sequence
atgagggtggcaggagctgccaagctcgtggttgcagtcgcagtgttcctgctaacattctacgtcatcagccaggtttttgagatcaaaatggatgcctccctcggaaatctttttgccaggtctgctttggatacggcagccagatccaccaagcccccacggtacaagtgcggcatcagcaaagcatgccctgaaaagcatttcgcttttaaaatggcgagcggcgctgcaaacgttgtcgggccaaaaatttgcttggaagataatgtactgatgtccggggtcaaaaacaatgtggggaggggcatcaacgttgcactcgcgaacggaaagaccggagaggtgctcgacaccaagtactttgacatgtggggaggggacgttgccccatttatagagttcctcaaagctattcaggacggcactatcgtcctcatgggtacctacgattag

SEQ ID NO: 11160 - DNA, 936 bp, Artificial Sequence
  Description of Artificial Sequence: Synthetic coding sequence
taggcaccgtctccctgtagccattttaactgcggatctcaggtgacagacggcggtactataaaacagaagatattcacctttgacgccatgttctctaccaattatagccacatggaaaactatagaaagagagaagatttggtctaccagtcaaccgtgcggctgcctgaagttcggatcagtgacaatggcccttacgaatgccacgttggtatttacgaccgtgctacacgagagaaggtggtgcttgctagcgggaatattttcctgaatgtgatggctcccccaacttctatcgaggtagtggccgcagacaccccagcgcctttttcacgataccaggcacagaacttcacccttgtctgtattgtgagcggtggaaagccagcacctatggtgtactttaaacgggacggagagcctatcgacgccgttcctctgtcagaaccccctgccgcatcctctggaccactgcaggactcccgcccttttcgttctctgctgcatcgcgacctcgacgatacgaagatgcagaagtccctgtccctgctcgacgcagagaataggggcggtcgcccatataccgagcggccaagtagggggctcacaccagaccccaacatactgctgcagcctactactgagaacatacccgagactgtagtctcccgcgaattcccccgatgggtgcactcagccgaaccaacatatttcctgcgtcattctcgtacgcctagcagtgacggcacagttgaagtgcgcgcactgctcacctggacgttgaatccacaaatcgacaacgaggcattattcagctgtgaggttaaacacccggctttgtccatgcctatgcaagccgaggtgacactggtggcccctaaaggtccgaaaattgtgatgacgcccagcagagccagggttggggatacatag

SEQ ID NO: 11161 - DNA, 978 bp, Artificial Sequence
  Description of Artificial Sequence: Synthetic coding sequence
atgcaggggcgtgtcgccggtagctgcgccccactggggttgttgcttgtctgcctgcaccttcccggactgtttgcccgatccatcggcgtggtggaggaaaaagttagccagaatctcgggaccaatctgccgcagctgggccagccaagcagcaccggccctagcaatagcgaacacccacagccggcactggacccaagaagcaacgatctggctcgcgtgcccttgaagctgtctgttcccgcttccgatggattcccccctgccggagggagtgccgtgcagcggtggcccccttcctgggggctccctgcgatggattcttggccgcctgaggatccctggcagatgatggccgctgctgccgaagatagactcggcgaggccctgcctgaggaacttagttatttgtcttcagccgcagcattggcacctggctccggccctcttccgggagaaagctctcccgacgcaaccggtctcagcccgaaagccagcttgctccaccaggactctgagagcagacggctgcctcggtcaaactccctaggcgcaggtggtaagatcctgtcccagaggcccccttggtcacttattcacagagtgctgccggatcacccctggggaacccttaacccatccgtttcttgggggggaggcggtccaggaacgggatgggggacccggcctatgccccaccccgaaggaatctgggggattaataaccagccccctggcaccagctggggaaacattaaccgatatccaggcggatcgtggggcaacataaatcgatacccaggtggatcttggggcaatattaatcgctacccaggtggcagctggggaaatatccacttgtatcccggaatcaacaatccttttccgccaggggtgctccggcctccagggagctcctggaacataccagccggattcccaaacccccctagtcccaggctgcagtgggggtag

SEQ ID NO: 11162 - DNA, 957 bp, Artificial Sequence
  Description of Artificial Sequence: Synthetic coding sequence
atggggctgcacctccggccttacagagtcgggctgctacccgacgggttgttgtttttgttgctgctcctcatgctcctcgccgatcctgcccttcccgcaggtagacacccaccagtcgtccttggctggttcacgacaaagcaccctggcccaccctcctttctgatggtctggatgtacgtgagtcttgctcttggacgccctagccactggtcaagttggactcccgcaaaagccgcatgggtgccgattagcaccccctggtggcgagcactgtgggctggtgctactcacggcgtcagaatgagcgaggggctgcccatgaccggagcagagccccagagacagccacaggcctggaaggataagtacatcagagcctttgtcagcctgggtgctccatggggcggtgtggctaagaccctacgcgttctggcgtcaggcgacaacaatagaattcccgtcatcgggcctctgaaaatcagagagcaacagcgatcggctgtttcaactagctggcttttaccatacaattacacatggtcaccggagaaggtgttcgtgcagactccgacaataaactatacactgagagactatcgtaaatttttccaggatataggatttgaggatggctggctcatgagacaggatacggaaggcttggtagaggcaaccatgccccctggtgtgcagctgcactgcctgtatggaaccggcgtcccgacccctgatagcttttattacgagtcatttccagaccgtgacccaaagatttgtttcggggacggggacggaacagtcaatcttaagtcggcactccaatgtcaagcctggcagagccgacaggaacaccaggtgctgcttcaagagctgccgggaagcgaacatattgagatgctggctaatgccactaccctggcctatctgaaacgtgtgctgctcggaccttag

SEQ ID NO: 11163 - DNA, 1575 bp, Artificial Sequence
  Description of Artificial Sequence: Synthetic coding sequence
tacgccctgcgcgaccgccaggggaatgcaattggggtgaccgcttgtgacatcgatggagacgggagggaggagatctactttctgaacaccaacaacgccttttcaggagttgcaacttacaccgataagttgtttaaattcaggaacaaccgctgggaggacattctctcggatgaggtgaacgtggcaagaggcgtggcgtccctgtttgcgggacgcagtgtcgcttgtgttgatagaaagggcagcgggaggtattccatttacattgctaattacgcttatgggaacgtgggcccagacgctctgatcgagatggaccccgaagctagcgacctgagcaggggaatcctcgcattgcgggacgttgctgccgaggctggcgtgtcgaaatatacgggcggaagaggagtgtctgtgggccctatcctgagctcctcagcgtccgacatattctgcgataacgagaacgggcctaattttctatttcacaacagaggtgatggaacctttgtcgacgcggctgctagcgctggtgtcgacgatccccatcagcacgggagaggggtcgccttggctgacttcaatcgggacggcaaggtggatatcgtgtacgggaactggaatggcccacatcgactttatttacaaatgtccacacacggcaaggtccgattcagagatatagcgagtccgaaatttagcatgccttcccctgtgagaaccgtcatcacagcagacttcgataacgatcaggaactggaaatcttcttcaataacatcgcctatagatccagcagtgccaatagacttttcagggtgatccgtagggaacacggagaccctctgatagaggaactaaacccaggggatgcgctcgagcctgaaggcaggggcaccggcggagttgtgactgactttgacggggacggaatgttggatctgatcttgtcacacggggaatctatggctcaacccctatcagtgtttcggggaaatcaagggtttaacaataattggctgagagttgtgcccaggacaaggtttggagcattcgccaggggtgccaaagtcgtactgtacactaagaagtccggcgcacatcttagaataattgacggcggatcaggctatctctgtgagatggaaccggttgcacatttcggattaggtaaagatgaagcctcaagcgttgaggtgacctggcccgacggaaagatggtatctcgcaatgtggcaagcggagagatgaactcggtactcgagatcctttatcccagggacgaagatacacttcaggacccagcacccctggaaactcctatgaatgcctcttccagtcattcctgtgcactggagacgtctccctacgtgtccaccccgatggaagcgacaggagcagggcctacacgatccgccgtgggagctacctctccaacccgtatggcgcagcccgcatggggacttagtgccagccacagggcccctgcacctccccctcctccattactgcttcccctcccactgctgctgccactccttgaactgccgctgctgcacaggtcatcttag

SEQ ID NO: 11164 - DNA, 636 bp, Artificial Sequence
  Description of Artificial Sequence: Synthetic coding sequence
atggtgagcaggatggtgtccactatgttatcaggcttactcttttggctggcatccgggtggacccccgcttttgcatatagccctcggacccctgatcgggtaagcgaggccgatatccagaggctgctgcacggcgttatggagcagcttggtattgcacggccacgagttgagtaccccgctcaccaggccatgaatctggttggccctcaatctattgagggcggagctcacgaggggctccagcacctcgggccatttggaaacattccaaatattgtggcagaactgactggggataacattcccaaagactttagtgaggaccaaggctatcctgacccacccaacccttgtcccgttgggaaaaccgatgatggctgcctggaaaatactcctgacactgctgagtttagtagggaattccagttgcaccagcacctctttgacccagagcacgactaccccggactgggcaaatggaataagaagttgctgtacgagaagatgaagggcggagaaagacgcaagaggaggtccgtaaacccgtacttgcagggtcagcgccttgacaacgtggtggctaagaagtcagttccccacttttcagatgaagataaagatcctgagtag

SEQ ID NO: 11165 - DNA, 465 bp, Artificial Sequence
  Description of Artificial Sequence: Synthetic coding sequence
atggctttaggtgtgcccatctctgtatacctcctttttaacgccatgactgcattaacagaagaggcagctgtcacggtcacgccaccgatcactgcccaacaggggaattggacagtcaacaaaacagaggccgacaacatcgagggtccaattgccctgaagttctcccatctatgcctggaagatcataatagctactgcatcaatggcgcttgcgccttccaccacgaattggaaaaggccatttgtagatgttttacagggtacaccggcgagcgttgtgaacacttgaccttaaccagctacgccgtggactcctacgaaaaatacattgccattggtattggcgtgggccttttacttagcggcttcctggtgatattttactgttatatacgtaagaggtgtttaaagctgaaatccccttataatgtgtgctctggcgaaagacgccctctctag

SEQ ID NO: 11166 - DNA, 1446 bp, Artificial Sequence
  Description of Artificial Sequence: Synthetic coding sequence
atgggcaaactgcgccctggacgtgtcgagtggctggcctctggacacaccgagcgcccacacctgttccagaacctgctcctgtttctgtgggcccttctgaactgtggccttggagtgagcgcgcaggggcctggcgagtggaccccgtgggtgtcgtggaccagatgcagtagcagttgtggccgtggcgtgagtgttagaagcaggagatgcctccggctaccaggcgaggagccctgctggggcgactcacacgagtatcgactttgtcaactgccagactgccctcctggagctgtcccattccgggatctgcagtgcgccctgtataatggtaggccagtgttagggacacagaagacctaccagtgggttcccttccatggcgcaccaaatcagtgtgacctgaattgtctcgctgagggccacgcattctatcacagttttggcagagtcctggacggcaccgcatgcagccctggcgcacagggcgtatgcgtggccggaagatgcttgagtgccggttgtgacggcctgctcggatccggcgcactggaagataggtgtgggcgttgcggaggggctaacgactcttgcctgttcgtccaaagggtattccgagatgccggtgcattcgccggatactggaacgtgacgcttattcctgaaggagctcggcatataagggtcgaacatcgctctcggaatcaccttgcccttatgggcggagacggacggtacgtgctgaatgggcattgggtcgtttctccccctggtacctacgaggctgcaggtacccacgtggtgtatacccgcgatacgggaccgcaggagacattacaggctgctgggccaacctcccatgacctcctactacaggtacttctgcaggagccaaacccgggaattgagttcgagttctggctcccccgtgagcggtactcaccttttcaggcccgagtgcaagctctgggctggcctctaagacaacctcaaccgcgaggggttgaaccacaaccccctgccgcaccagcggtcaccccagcacagaccccgaccttggctccagatccctgccccccatgccctgacacccgcggacgggctcaccggttgctccactactgtggcagcgacttcgttttccaagctagggtcctcggccaccatcaccaggcacaagagaccaggtatgaagttcgcattcagcttgtttataaaaaccgttccccccttagggcccgagaatatgtttgggcacctgggcactgtccctgtcctatgcttgcccctcaccgcgattacctcatggcagtgcaacgcctggtgagccctgacggtacccaagaccaacttttgttgccccacgcaggatacgccagaccctggtccccagctgaagactcaaggatcagattaacagctcggcgttgccccggatag

SEQ ID NO: 11167 - DNA, 627 bp, Artificial Sequence
  Description of Artificial Sequence: Synthetic coding sequence
atggccgatatgcagaatcttgtggaacgtttggagcgagctgttggacgtctcgaagccgtgagtcacacatctgatatgcataggggctatgctgacagcccttctaaggctggagccgctccatacgtgcaggcattcgattctctactggctggaccagtggctgagtatctcaaaatctccaaagagatcggtggcgacgtgcagaagcacgcggaaatggtccacacaggcctgaagttagagcgggctctcctggtgaccgcctcacagtgccagcagcccgcagaaaacaaactgtcagatctgctggcacccatttccgagcaaatcaaagaagtgatcactttcagggagaagaacaggggttcaaagctgttcaaccatttgagcgccgtttccgaaagcatccaggccctgggatgggtagcaatggcccctaaaccaggcccatatgtgaaggagatgaacgatgccgctatgttctatacaaatagggtcctgaaagagtacaaggatgttgataaaaaacacgtggactgggtcaaggcttacctttcgatctggaccgagctgcaggcttacatcaaggaattccacacaactggccttgcctggtcctag

SEQ ID NO: 11168 - DNA, 1482 bp, Artificial Sequence
  Description of Artificial Sequence: Synthetic coding sequence
tctgaggccgtctacttaaatgactctacttatgatggccacacagtgggagggttgcagtatgggggtctgggtcaactcgccgatggggttgtgggactggacgactttcgcaagagccaggagttgagagtctggcctggttatgattacgtcgggtggtccaatcactcattctcctccggctacgtggagatggagtttgagttcgataggcttcgagctttccaggcaatgcaagttcattgtaacaacatgcacactttaggcgctcggttacctggcggagtcgaatgcaggttccgacgcggtccagccatggcatgggaaggtgagcccatgagacacaatcttggtggtaatctgggcgatccgagggcgagagctgtgtctgtcccactgggcggtagggttgcccgttttctacagtgtcgttttctatttgcgggaccctggctcctgttcagcgaaatctcttttattagcgacgtggtcaataacagctccccggcacttggaggtacttttcccccagcaccgtggtggccaccagggccacctccgaccaactttagttccctagaattggaacctcgaggacaacagcctgtcgctaaggccgaggggtcaccgactgccatcctgatagggtgtctggtggcaatcatcctcttgctactcttgattattgccttgatgttgtggcggctgcactggaggcggctgctgtccaaggtgttggaatcccaccctagaaccaggtcacccggattggttggcattaggcccactcctctgcctgtgtctcctatggccttacgctgctgctctccaatacagccaactgcttcgttttggccactaacacccgtaccactggaggcccgagctccacctcatcctcctggtcctaaccctcctaccccacgtggagtgaccggcggtaacacttatgctgtccctgccctgccccctggagccgtgggggacggcccacctagggtggattttccgcgttcaaggttgcgcttcaaggaaaaattaggtgagggccagtttggcgaagtccatctgtgtgaggtggactcacctcaggatctggtaagtctggattttccccttaacgttcggaaaggccaccctctgcttgtagccgtgaagatactcagacctgacgccactaagaacgctaggaacgactttctgaaggaagtgaagatcatgagccggctgaaagaccctaatatcatcagactgcttggggtctgcgtacaagatgacccattatgtatgatcacggactacatggagaacggcgacctgaatcagttcctaagcgctcatcagctcgaggataaagccgcagagggggcacccggagatggacaagccgcacaaggtcccaccatctcttatccaatgttgctgcatgtggctgcacaaattgcctctggaatgcgttatctggctacacttaactag

SEQ ID NO: 11169 - DNA, 2319 bp, Artificial Sequence
  Description of Artificial Sequence: Synthetic coding sequence
atgcaatttcaactcacactcttccttcacttgggctggcttagctattcaaaggcccaagacgactgcaatagaggagcctgccatccaactacaggagatctgctggtagggcgtaatacacagttgatggcatcttccacctgtggcctgtcaagagcccagaaatactgcattctgtcatatctcgagggtgaacagaaatgcttcatttgtgatagtcgctttccatacgacccgtatgatcagcctaacagtcatacaatagaaaatgtgattgtgagcttcgagccagatagagagaagaagtggtggcaaagcgagaacggcctggatcacgtgagcatcagattggatcttgaggctctcttccggttcagccatctgatcctgaccttcaagacctttaggccagcagccatgctcgtggaacggagtacagattacgggcataattggaaagtgttcaagtactttgctaaggattgtgcgacatcttttcctaatattacaagcggtcaggcccagggcgtgggcgacattgtttgcgatagcaagtatagtgatatcgaacctagcactggcggtgaggtggttctgaaagtcttagacccttcctttgagatcgagaatccctactcaccttacattcaggacttggtgaccttaactaatctcagaatcaatttcaccaaattgcatacccttggtgatgccttattaggtagaagacagaatgactctctggataaatactattatgctctctatgagatgattgtcagaggaagctgtttctgtaacgggcatgcttctgaatgtcgacctatgcagaagatgagaggcgatgtttttagtccgcctggcatggtgcatggacagtgcgtctgccagcacaacaccgacgggcctaactgcgaaagatgcaaggattttttccaagacgctccatggaggccagctgcagacctccaggacaacgcttgccggtcttgtagctgtaactctcatagctcccgttgccacttcgatatgaccacctacttggcctccgggggacttagcggaggcgtctgtgaggattgtcaacataacactgaaggccagcattgcgacagatgcaggccactcttttaccgcgacccactcaagactatttctgacccgtacgcttgcattccctgcgaatgcgacccagatggcacgatctcagggggaatctgtgtatctcacagtgaccctgcactggggtcggtcgccggacagtgtctgtgtaaagaaaacgtagagggcgctaagtgtgatcaatgtaagcctaaccattacgggctctccgccacagatcctctgggctgccagccatgtgattgcaacccgctgggatccctgccgttcctgacatgcgacgtcgacacagggcagtgcctgtgtctgtcttatgtcacaggcgctcactgcgaagagtgcaccgtcggctattggggtttggggaaccacctgcatggctgtagtccgtgtgattgtgatatcggcggagcctactccaatgtgtgcagtccaaaaaatgggcagtgcgaatgtcgcccacacgtcaccggcaggtcctgtagcgaacctgccccaggttactttttcgcccctcttaatttctacttatatgaagccgaggaagccaccaccctccaaggattggcccctctgggaagcgaaacgttcggccagtctccagcggtacacgtagttctcggcgaaccggtacctggcaatccagttacatggactggtcctggattcgccagggttctgcctggcgcagggctgcggttcgctgttaataacatcccgttcccagtcgacttcactatagcgattcactacgagacccagagcgcagcagactggaccgtccaaatcgtcgtcaatccacccggtgggtccgaacactgcatccctaaaaccctgcaatcgaaaccacagtcatttgccctgccggctgcaacgcgtatcatgctcttgccaacgcctatctgcttggaacccgacgtgcagtatagtattgacgtctacttcagtcagcccctgcagggggagtcacatgctcacagccacgtcctcgtagacagtgccgcagtgcagtggcataatttaggcagccttcagcccccacctcccgaatgcaaacagttctcctgtttctcattccccagctcctgggactatcgccacccaccccctcaccttgctaacttttgtatctttagtcgcgacggggtgtcgccacattggcctggctggtcccaaactcccgatctccggtag

SEQ ID NO: 11170 - DNA, 1371 bp, Artificial Sequence
  Description of Artificial Sequence: Synthetic coding sequence
atgggacgcgcaggagcggcagcggtcatcccgggactggcgctcctatgggccgtggggttggggagcgcagcacccagcccgcacctgcggctttcatttcaggagttgcaggcctggcatggcttgcaaactttttccctggagcgtacttgttgctatcaagcactgctcgtagacgaagaacgaggaagactgttcgtgggtgctgagaatcatgttgccagcctcaacctcgataacatttcgaaaagggccaaaaagttggcgtggcctgctccggtggagtggcgggaggaatgcaactgggcgggtaaagatatcggcactgaatgtatgaattttgttaagcttttgcatgcttataacagaacacacctcctggcctgtgggacaggcgcattccaccctacatgtgccttcgtggaggttggtcaccgggcagaggaacctgtgcttcgtctggacccaggtcgcatagaggacggtaaggggaaatctccatacgatccacgccaccgggctgcctccgtactggtcggggaagagctgtattctggagtggccgcagacttgatgggtcgcgattttacgatttttcgatccctgggtcagcgaccctcactacgtacagagccccatgatagtcggtggctcaacgaacctaaattcgtgaaagtcttttggataccagaatctgaaaatcccgacgacgataagatctatttcttctttagagagactgcggtggaggctgctccagctctcgggagactgtctgtgagcagagtgggacagatctgtcgcaacgacgtgggagggcagagatcattggttaacaagtggaccacatttctgaaagcccgactagtgtgttccgtccccggtgtcgaaggcgatacccactttgatcagctccaggatgtgttcttactgagttcccgagatcatcgaacgcccctgctctacgctgtctttagcactagcagctcgatatttcaggggagcgccgtttgcgtctactctatgaacgacgtgaggagagccttcctcggaccatttgcccataaagaggggccaatgcatcagtgggtttcgtaccaaggtcgggtgccttacccgagacaagcctgcgcacccgctcgcccactggcaccgtctgtgccacctaggaccagccagacaatgtcctcatcgctgcggggaacaacacctagctgtactaccctgtcatgtcccctgggtggggctctcttctcttacaagctcgagcctatcacccccagcctgaaacttcctcggacgggcttgcagcctctgacagatacgatgacaagcagcagcctcgcgcagactctagcgagatgttag

SEQ ID NO: 11171 - DNA, 333 bp, Artificial Sequence
  Description of Artificial Sequence: Synthetic coding sequence
ctcttcatgctccataagatcgtgcaggtgtacaactccgacgtgatcgataagcaatccgcatccatgacctcagataatgccgacgataaagcagtgattatacttgttcccgtgcgcctcggaggagagaggactaatacagactatcttgagttcgtgaagggtatccttagtctcgagtactgcgtgggaatcataggaggaaaaccaaagcaatcttactactttgctggattccaggacgactctttaatctatatggaccctcattactgccagagctttgtcgacgtgagtattaaggacttccctctagaagtcatactgtag

SEQ ID NO: 11172 - DNA, 420 bp, Artificial Sequence
  Description of Artificial Sequence: Synthetic coding sequence
atgggacccgaggccctgagctccctcttactgctgctgcttgtagcgagcggggacgccgacatgaagggacattttgacccggctaagtgtaggtacgctctggggatgcaggacagaacaatccccgattccgacattagcgcctcaagctcgtggagtgattcgacggccgcacgacatagccgtctggagtcgagcgatggagatggtgcctggtgccccgcagggtctgtgttcccgaaggaggaggaatatttgcaagttgatctacagcgcctacacttagtggccctcgtgggtacccagggtcggcatgcgggaggtcttgggaaggaattttcaagaagctaccgcctcagatactctcgggacgggaggagatggatggggtggaaggaccgctggggacaggaatag

SEQ ID NO: 11173 - DNA, 570 bp, Artificial Sequence
  Description of Artificial Sequence: Synthetic coding sequence
atgctgggaatcacctcgtgcagtgatcagcaggccaaggaaggggaggggctggagggcagctcaaccggctccagctccggcaatcacggcggttccgggggtggcaacggtcacaagccaggatgtgagaagcccggaaacgaggcacgcggaagcggagagtcaggaattcagaatagtgaaaccagcccaggcatgtttaacttcgacactttttggaagaacttcaaaagcaagcttggtttcatcaattgggacgcaataaacaagaaccaggtgcccccaccatccaccagggctctcttgtactttagccgcctctgggaggacttcaagcagaatacccccttccttaactggaaggctattatcgaaggagcagacgcaagctcattacagaagagagcgggacgggatgatcagaactataactataatcagcacgcctatcccaccgcctatgggggaaagtatagcgtgaaaacccctgccaaagggggagtttctccctccagctccgcaagccgggtgcagccagggctcttgcagtgggtgaagttctggtag

SEQ ID NO: 11174 - DNA, 438 bp, Artificial Sequence
  Description of Artificial Sequence: Synthetic coding sequence
atggccgatatgcagaatctagtcgagcgcttggaacgggctgtcgggcgtctggaggccgtctcacacactagtgatatgcaccgcggttacgctgattctccatccaaagctggcgcagccccttacgtgcaagcctatataaaggaattccataccaccggactagcctggagcaaaacaggacctgtcgccaaggaactctctggtcttccttcaggcccttcagctggatcttgtccccctccaccacccccttgccccccacccccacccgtatctaccattagttgctcttacgagtcagcgtctagatcttcgctgtttgcacagatcaatcagggcgaatctatcacccacgctttaaagcatgtcagtgatgatatgaaaacccacaaaaatccggcattgaaggcccagagcgggcctgttcggtag

SEQ ID NO: 11175 - DNA, 264 bp, Artificial Sequence
  Description of Artificial Sequence: Synthetic coding sequence
tgtaagcgaaagccgtacctgctgccaagtattagagagggcgctcgtttgggcatacaggagtgtgggagtcagtttcggcatgagcggtggaactgtatgataactgctgctgcaacaacagcccctatgggggcaagccctttgttcggatacgagttgtcctcaggctgccgccaggtggacgtgtctcggttgccgctaccgagatcgtttcgccttctgtgctgcgagaacatgcttgagaatcatgtgtttttttag

SEQ ID NO: 11176 - DNA, 2535 bp, Artificial Sequence
  Description of Artificial Sequence: Synthetic coding sequence
atggggcctggggcacctttcgccagagttgggtggccattaccgctcttggtcgtgatggccgcaggcgtggctcctgtatgggccagccatagtccgcatcttcctaggcctcatagccgggttccgcctcacccttcctccgagcgccgagccgtgtatattggagccctcttccccatgtccggcggatggccgggaggacaagcgtgtcagcccgcagtggaaatggccctggaagatgtcaattctcgaagagacattctgcccgactatgagcttaaactgatccaccacgactcaaaatgtgatcccggacaggcaacaaagtatttgtacgaactcctgtataatgatcccattaagattattctgatgccgggttgcagcagtgtctccacacttgtggccgaggccgctaggatgtggaaccttatcgtcttatcctacggatccagcagtccggcactgagcaacaggcagcgcttcccaaccttcttcagaacccacccatctgcaactttacacaacccgacaagagttaaactgttcgaaaaatggggctggaagaagattgcaacgatccagcagactactgaagtcttcacaagtacactcgacgacttagaagaacgcgtgaaagaagctgggatagagattacctttagacagtccttcttctctgaccctgctgtgcctgtgaagaacctaaaaagacaagacgcaaggatcattgtcggcttgttttatgaaactgaggcccgaaaggtgttttgcgaggtatataaggaacggctgtttggaaaaaagtatgtgtggtttctgattgggtggtatgcggataattggtttaaaatatatgacccttccatcaactgcacggtggacgagatgacggaagccgtcgagggccacatcactaccgaaattgtcatgctcaatccagcgaatactcgctcgattagcaacatgacgagtcaggagttcgtggagaaacttactaagaggcttaagcgacaccctgaagaaaccgggggttttcaggaggctccgctcgcatacgatgccatctgggcactggcccttgcactgaataagacctcagggggaggcggacggagcggcgtgcggctcgaagacttcaactacaataaccagacgatcactgaccagatctaccgtgccatgaacagcagctcctttgagggagtctccggacacgtggtgttcgacgccagtggaagtcgcatggcgtggactctcattgagcagctccagggaggatcatacaagaagatcgggtactatgatagcacaaaggatgacttatcctggtccaagaccgataagtggatcgggggttcgccccctgccgaccagaccctggtgatcaaaacgttccgcttcctctctcagaagctctttatatccgtgagcgtgctgtcatcactggggatagtgctggccgtggtctgtcttagttttaacatctataacagtcatgtgcggtacatccagaacagccagccaaacttaaataatctgaccgccgtgggatgctcattggccttggccgctgtattccctttggggctggacggataccatattgggagaaaccagtttccttttgtttgccaggccagactgtggcttctgggcctcggcttctcactggggtacggctctatgttcaccaagatttggtgggtgcataccgtgtttaccaaaaaggaggagaagaaggagtggcgcaaaactttagaaccctggaagctgtatgccacggtagggttgctagtaggaatggatgtacttactctggccatttggcagattgttgatcccctccacagaactattgagaccttcgcaaaggaagaacccaaggaagacattgacgtgtccatcctgccccagctggaacattgttcctcacggaaaatgaatacctggctcgggatcttctatggctacaaaggactcctgttactcctcgggattttccttgcttatgagaccaaaagcgtcagcactgaaaaaattaacgatcacagggccgttggcatggctatctataatgtggccgtgttatgcctcatcacagcacctgtgaccatgatactgtcatcccagcaagacgctgctttcgcgttcgctagtctcgcaatcgtgttctcaagctatataaccctggtggtgctgttcgttccaaaaatgcggcgactgatcactagaggcgagtggcaatccgaagcccaggacacaatgaaaaccggctcctctacaaataacaacgaagaggagaagtcaagacttctcgaaaaggagaatagagaacttgagaaaattatcgccgagaaggaagaaagagttagcgagctccggcaccagttgcagagccgtcagcaactgcgcagccggaggcatccaccaacccccccagagcctagcgggggactgcccagaggtccccctgagccaccagacagactctcatgcgatggctctcgcgttcacctgctctacaaatag

SEQ ID NO: 11177 - DNA, 2631 bp, Artificial Sequence
  Description of Artificial Sequence: Synthetic coding sequence
atgggaccagaggcactttcgagcctgctgctcctgctgcttgtggcttcaggcgatgctgatatgaaaggtcactttgaccctgcaaaatgccggtacgctctcggaatgcaggacaggaccataccggactctgacatttctgccagctcgtcctggtctgactcaaccgcggctaggcactcccggctggaaagctccgacggtgatggtgcctggtgccccgcaggtagcgtctttcctaaggaggaagaatacctacaagtcgaccttcaaaggctgcacctcgtggcacttgtagggacacaaggaaggcatgctggaggtctcggtaaggagttttccagatcttatcgactgaggtatagtagagacggaagacgttggatggggtggaaggaccgctggggccaggaagtgatctcagggaatgaggatcccgagggcgtcgtactgaaggacctgggtccacctatggtcgcccgtctggtcagattttacccaagggctgacagggtcatgagtgtgtgtctgcgcgtagaactgtacgggtgtctgtggcgcgacggcctgttatcttacactgcacctgttgggcagactatgtatctatctgaagctgtgtacctgaatgattccacatacgacggtcacaccgtcggtggactgcaatacgggggtttgggccagctggcagacggtgtggtcgggctcgatgactttaggaagagtcaagagctcagggtttggccaggctatgattacgtgggttggtctaaccattcttttagcagtggttatgttgaaatggagtttgaatttgaccgactgagagcctttcaggctatgcaggtacactgtaacaatatgcataccctgggtgcaagactaccaggaggcgttgaatgtagattcagaaggggtcccgctatggcctgggaaggggaacccatgcgacataatctaggcggaaacctcggcgacccaagagctagagccgtatccgtaccattgggtggaagggtggccagatttctgcagtgccgattcttgtttgccggtccatggctgctgttcagtgagatttcatttatttcggacgtcgtgaacaattcaagtcctgctttgggaggtacattcccccctgcaccgtggtggccgcctggacctcccccaacgaacttcagctcgctcgagctggagcctcgtggacaacagcctgttgccaaggcagaggggtcaccaacggccatccttatcggttgtctggtcgctataattcttctgctcctgctgattattgcactcatgctgtggaggctccactggcggcgtctgctttccaaagcggaacgccgtgttttggaggaggagctgactgtccacctgagtgtcccgggagacactatcttaattaataataggcccggacccagagaaccccctccataccaagagccgcgaccaagaggaaaccctccacactcagccccatgcgtgcccaatgggtccgcctattcaggagattacatggaacccgagaagccgggagcccctctgttgcctcctccgccacagaactcagtgcctcactatgccgaggctgacatcgtcaccctacagggcgtgactgggggtaacacgtatgcagttcctgcgctgccgcctggcgcagtgggtgatgggcctccgagggttgattttcctcggtcccgtctgaggtttaaagaaaaactgggagaggggcagttcggcgaggttcacctgtgcgaggtcgattctcctcaggatttggtcagcctcgatttccctctgaatgtgcgaaaaggtcaccccctgctagttgccgtcaaaatcctgaggccagacgctaccaaaaacgccagaaacgacttcttgaaggaggtgaaaatcatgtcccggctcaaagatcctaacataatccggctccttggtgtgtgcgtgcaggatgatcctctgtgtatgatcacagactatatggaaaacggcgatttaaaccagtttctgtccgctcaccagctggaggataaggccgcagagggtgcacctggtgacggacaggcagcacaaggacctaccatcagttacccaatgctgctgcacgtggccgcacagattgccagtgggatgaggtacctggccactctcaattttgtacacagggacctggcaaccaggaattgcctggtgggagaaaatttcactattaaaattgccgacttcggaatgagtcgaaacttgtacgctggtgattactatcgggtccagggcagagctgtattacccatcaggtggatggcctgggaatgcatcctcatggggaaattcacaactgcatcagacgtgtgggcatttggtgtcacactgtgggaagttcttatgctctgtagggcacagccattcggacagttgaccgacgaacaggtgatcgagaacgctggcgaattcttccgggaccagggaaggcaggtatatctgagtcggcctcccgcatgtcctcagggcctatacgagttaatgctgaggtgctggtctcgggaatcggagcagcgacctccatttagccaattgcaccggtttctggccgaggacgcattgaacacggtttag

SEQ ID NO: 11178 - DNA, 942 bp, Artificial Sequence
  Description of Artificial Sequence: Synthetic coding sequence
atgtccgatctgctccttttgggtcttatcggtggcctaactctgttgttgcttctgactctgctcgccttcgctggatacagcggtttactggccggagtggaggtgagcgccggtagccctcccatccggaatgtcacagtggcttataagtttcatatgggtttgtacggagagactggtcgattgtttaccgaaagctgttcaatcagcccaaagctgcggtctatcgcagtgtactatgacaatccgcacatggtgccaccagacaagtgtaggtgcgccgtgggatctatcttgagcgaaggggaggagagtccctcacccgagctgatcgacctttatcagaagttcggttttaaggtgttctcattcccagcaccctcgcatgtcgttactgccacttttccttacacgactattctgtcgatctggctggcaacccggagagtacaccccgctctggatacatacatcaaagagcgaaaactgtgtgcttacccacgcttagagatttaccaagaggaccaaatccatttcatgtgtccattggctcgtcagggtgatttctacgtgccagagatgaaggaaaccgaatggaaatggcgcggtcttgtggaggctatcgatacacaggtagacggcaccggagcagacacaatgtctgatacctcatcagtgtctctagaagtcagtcccggttctcgagaaaccagcgccgctacactctcccccggtgctagctctcgcggttgggatgacggggatacccgcagcgagcactcttactccgagagcggagcgagcgggtcctccttcgaagagttggatctcgagggcgagggtcctctgggggagagccggttagatcctggcactgagccacttgggaccaccaaatggctgtgggaacctaccgcccctgaaaagggaaaggagtag

SEQ ID NO: 11179 - DNA, 843 bp, Artificial Sequence
  Description of Artificial Sequence: Synthetic coding sequence
atgaagacctttacgtggacgcttggggtgcttttttttctacttgttgatacaggccattgccgcggtgggcaatttaaaattaagaagatcaatcaaagaagatacccgagaacgatcaaggacatgatcactcggatggacctggagaatctgaaggacgttctgagcagacagaaacgagagatcgatgtcctgcaactggtcgttgatgtggacggcaatatcgtgaatgaggtgaaactgctgcggaaggaaagtcgcaatatgaattcaagggtaacacagctgtacatgcagttattgcatgagatcattcgcaagcgcgataattccttagagctgtcacagttggaaaataaaattttgaatgtcactaccgagatgctgaagatggccacccgctaccgcgaactggaggtgaagtacgctagtctcacagacctagtgaataatcagtccgttatgattacactcctggaggagcagtgccttcgcattttctctcggcaggacactcacgtcagccccccactggtgcaggtggtcccccaacatataccgaactcgcagcagtataccccaggcctgctcgggggaaatgagatccaaagggatcccggatatccaagggacttgatgccaccccctgatctggctaccagccccaccaagtctccttttaaaatcccacctgtgacctttattaacgaaggacctttcaaggattgtcagcaggcgaaagaggccggtcactccgtgaacgggattttctgggcagaatatagggggggatcctattcgctgcgagctgtacagatgatgatcaagcctattgattag

SEQ ID NO: 11180 - DNA, 522 bp, Artificial Sequence
  Description of Artificial Sequence: Synthetic coding sequence
atgcactggaagatgcttctgctgctgttgctgtattacaatgcagaggccagcatgtgtcataggtggagcagggctgtgctctttcccgctgcacacagacccaaaaggagtagttctcttcccctcaatccagtgctgcagaccagcctggaagaagtggagctcctctacgagttcctgctggcagagctggagatctcccctgatctgcagatatctatcaaggacgaggagttagctagcttacggaaagcgagcgactttaggaccgtttgcaataatgtaattccaaaaagcattccggacattcgcaggctgtctgcttcactttccagtcacccgggaatactcaagaaggaggacttcgagagaacagtcctgaccctggcttacactgcttaccgcactgccctgtcccatggccatcagaaggacatttgggcccaaagcctggttagcctgtttcaagcactcaggcacgatctgatgcgctcctcccagccaggggtacccccttag

SEQ ID NO: 11181 - DNA, 309 bp, Artificial Sequence
  Description of Artificial Sequence: Synthetic coding sequence
atggagcggggagccggagcaaaattgcttcctttgctgctgcttttacgcgctaccggctttacatgtgctcagacagacggtcgcaacggttatacagccgtcattgaagtaacttcgggcggtccctggggggactgggcgtggcctgagatgtgtcccgacggtttcttcgcttccgggttttctctgaaagtcgaaccaccacagggtatccccggtgacgataccgcactgaacggtattaggctgcactgcgcaagaggtaatgtgcttggaaacacacatgtgctcggtagaatggagtag

SEQ ID NO: 11182 - DNA, 351 bp, Artificial Sequence
  Description of Artificial Sequence: Synthetic coding sequence
atggccgctggtagcgctccgatgcagttgcacctccgcgcaacaatccgtatgaaagacgggttatgtgtgccccgaaagtggatctaccatctcacggaaggaagtacagacttacggaccgaaggtaggcccgatatgaagactgagctgtttagcagctcctgccccggtgggattatgctcaacgagacaggacagggttatcaacgtttcttgctctacaacaggtcaccccacccacccgaaaagtgcgtggaggagtttaaatcgctaacatcgtgcctagattccaaagcctttctgctaacacctagaaatcaggaagcctgcgagctgtcaaacaactag

SEQ ID NO: 11183 - DNA, 1137 bp, Artificial Sequence
  Description of Artificial Sequence: Synthetic coding sequence
tgatactctggcgactatatggaacctgagaagccaggggcacccctgctgcccccaccgccacagaattcagttccacactatgccgaggccgatatcgtgacactgcaaggagttaccggcggtaacacttatgcggttcccgctttaccccctggagctgttggcgacgggccaccacgagtggacttcccccgaagcaggttgcgtttcaaggaaaaactgggcgagggacaatttggggaggtgcacctgtgtgaggtagatagccctcaggatctcgtgtctctggacttccccctcaacgtccgcaagggacacccattgcttgtagctgtcaagatcctgcgaccagatgcaaccaaaaatgcaagtttttccctcttctcccggaatgattttctgaaagaggtaaaaatcatgagccgcttgaaagatcccaatattattagactgttgggggtgtgcgtgcaggatgaccccctatgcatgatcacagactacatggagaacggagatttgaaccaattcctgagtgcacatcagctcgaggacaaggccgctgagggcgcacctggtgacggccaagccgctcagggaccaacaatttcctacccaatgctacttcacgtggcggcacaaatcgcctctggtatgaggtacctggccacgctgaacttcgtgcacagggatttggccactagaaattgtcttgtgggagaaaacttcactattaaaatagcagatttcggaatgtcccgtaatctatacgccggtgattactacagggtgcaagggagagctgtgttgcctatcagatggatggcatgggagtgcattttgatgggcaagtttactacagcatcagacgtgtgggccttcggcgtcacattgtgggaagtgctcatgctgtgcagggcccagccatttggccagctgaccgacgagcaagtgatcgaaaatgcaggcgagttctttagggaccaaggaaggcaagtttacctcagtagaccccctgcatgcccccaggggttgtatgaactgatgctgcgatgttggagccgggagagtgagcagcggcctcccttcagtcagctccatcgcttcctggccgaggatgccctgaacacagtatag

SEQ ID NO: 11184 - DNA, 942 bp, Artificial Sequence
  Description of Artificial Sequence: Synthetic coding sequence
atgagtgacctgctgcttctggggctgatcggcggtcttaccttgctgctcctactcacattgctcgccttcgccggatattctggattacttgccggtgtggaggtgtcagccggatctcctcctattcggaacgtgacggtggcatataaatttcatatggggctttatggtgagacgggcagactcttcacagaatcttgcagtatctctccaaaactgagatctattgccgtgtactatgataatccacatatggttcccccagataagtgtcgctgcgccgtgggctctatcctgtccgagggcgaagaatcccccagccccgaactcattgatttatatcagaaattcggcttcaaggtcttctcctttcctgctccgagccacgtggtgactgctacgtttccatacactactattctgagtatttggctggctactagaagggtacatcccgctctcgatacgtacatcaaagagaggaaattatgtgcctatcctaggctggagatctaccaggaggatcaaattcattttatgtgccccctggcacgtcaaggcgacttttacgttcctgaaatgaaggagactgagtggaagtggcggggacttgtagaagctatcgacacccaggtggacggaacgggggcagacactatgtctgatacctcctctgtgagtctagaggtgtctccagggtcacgcgaaacgagtgccgcaactctgagccccggagctagctcaaggggctgggatgacggcgatacccggagcgagcattcctacagcgaatctggggcaagtgggagcagtttcgaagagttggatctggaaggggaggggccactgggggaatcccgcttggatccgggtactgagcccctgggtaccaccaagtggctttgggagcccaccgcccctgagaagggcaaggaatag

SEQ ID NO: 11185 - DNA, 420 bp, Artificial Sequence
  Description of Artificial Sequence: Synthetic coding sequence
atgggtccggaggccctgagtagcctgctgttactgctgcttgtggcctccggggacgcggatatgaagggccattttgatccagctaagtgccgttatgcactgggtatgcaggacaggactattcctgattctgacatctctgccagctctagctggtctgatagcactgctgccaggcatagtagacttgaatctagcgatggcgacggtgcatggtgtccggcaggcagtgtgttccccaaagaagaggagtatctgcaggtggatctccagagactgcacttagtcgctctcgtcgggacgcaaggacggcatgccggagggctggggaaagaatttagtcggtcctatcgcctccggtatagccgagatgggaggaggtggatgggatggaaggatcgatggggccaggagtag

SEQ ID NO: 11186 - DNA, 342 bp, Artificial Sequence
  Description of Artificial Sequence: Synthetic coding sequence
atggacaacgtacagccaaaaataaagcaccgaccattctgcttttccgtaaagggacacgtcaaaatgttgagattggctctgaccgtgacaagcatgactttttttatcatagcccaggcccctgagccttacattgtcattactggatttgaggtcactgtgatcctattctttattctgctctatgtgctgcggttggacaggctgatgaagtggctgttctggcccctcttagatatcatcaactcactggtgacaaccgtcttcatgctgatagtatccgtactggcccttataccagagactacaactctcacggttggaggtgggctattctag

SEQ ID NO: 11187 - DNA, 465 bp, Artificial Sequence
  Description of Artificial Sequence: Synthetic coding sequence
atgttcggttggggggactttcatagcaacatcaagaccgtcaaacttaatctactgatcaccggcaagatcgtagaccacggcaacggcacattctccgtctattttcggcacaatagcaccggtcagggcaacgtttccgtatccctcgtgcctccaaccaaaatcgtggagttcgatctagcacagcagaccgtgatcgatgctaaggattctaagtcctttaattgcaggatcgagtacgagaaagtggacaaggccaccaaaaacacactctgcaactacgatccgtccaagacatgttaccaggaacagacacagagtcatgtatcctggctctgtagcaagccattcaaagtcatctgtatttacatcagtttctacagcacagactacaaactcgtgcaaaaggtatgcccagattacaattaccatagcgatactccatatttcccatccggctag

SEQ ID NO: 11188 - DNA, 531 bp, Artificial Sequence
  Description of Artificial Sequence: Synthetic coding sequence
atggccgacatgcagaatctggtggaaaggctggagcgggctgtgggtcgccttgaggctgtgtcccacacctcagatatgcatcgaggatacgctgattcgccctcaaaagctggtgcagcaccctacgttcaggcatttgatagtctgctggccggtccagtggccgaataccttaaaatctctaaggagattggcggagacgtccagaagcacgccgagatggttcatacaggcctgaaactggaacgcgcattgcttgtgactgcgagccagtgtcagcaacccgctgagaacaagctttctgacctgctggcaccaatctctgaacaaataaaggaggttatcacttttagagaaaaaaataggggatctaagctctttaatcacctctctgctgtgagcgaatccatccaagccctggggtgggtcgccatggcacccaaacccggtccgtacgtcaaggagatgaatgacgccgcaatgttttacaccaatcgagtgctaaaagagtacaaggatgtcgattag

SEQ ID NO: 11189 - DNA, 2535 bp, Artificial Sequence
  Description of Artificial Sequence: Synthetic coding sequence
atgggcccaggagccccatttgcccgtgtcggctggcccctgcccctgctggtggtgatggcagccggagtggctcccgtgtgggccagtcatagtccacacctacccaggccccactctcgagtcccgcctcatccatcgagtgaaaggagggcagtctatatcggtgctctctttcctatgtccggcggttggcctgggggtcaggcatgccaaccagcagtcgaaatggctttagaggacgttaacagcaggcgggatattctgcccgattacgaactcaaactgatccatcacgacagcaaatgcgatccgggtcaagcaacgaaatacctgtatgagcttctatacaatgaccccatcaagatcattctgatgcccggatgcagcagcgtatccacgctagttgcagaagctgcgagaatgtggaacctgatcgttctcagctatggatcatcttccccagcactgtctaaccgccagagattccctacgttttttcgcactcacccctcggccactctgcacaacccaacccgagtcaaactgttcgaaaagtggggttggaagaaaatcgccaccatccagcagaccacagaagtgttcacaagtactcttgacgatttggaggaaagggtcaaagaggccggaatcgagattacattcagacagagtttcttctctgatcctgcagtgccggtgaagaacttaaagcggcaggatgcacggatcattgtgggactcttctatgagaccgaagcacgcaaagttttctgtgaggtctacaaggaacgcctcttcggtaaaaaatatgtgtggtttctgattggctggtatgcggataattggttcaaaatttatgatccttccatcaactgtactgtcgacgagatgaccgaggccgtggagggtcacattactacggagatagtgatgctgaatcctgcgaatacccgctcaatcagcaatatgacctcacaagaatttgtggaaaaattgacaaaacggctgaagcgtcatcccgaagagacaggtggctttcaagaggcgcctctcgcctatgatgccatctgggctctggccttggccctgaataagacatccgggggaggaggcagaagtggcgtccggcttgaggattttaattataacaaccagaccatcacagatcagatctatagggccatgaactcctcctcctttgagggggtctctggtcatgtcgtcttcgatgcttctggatctcggatggcctggactctgatcgagcaactccaggggggatcctacaagaaaattggttactatgattccacgaaggatgatttgagttggagcaaaactgataagtggattggcggttcacctcccgctgaccagacgttagtcattaagacgttcagattcctgtcgcagaagttattcatttccgttagcgttttgagttccctaggaatcgtgctcgcagtggtgtgcttatcattcaacatttacaacagccatgttagatacatacaaaacagccagcccaatctaaacaacctcacagcagtgggttgtagcctggccctggctgctgtctttcctctcggcttagatgggtatcacatagggagaaatcagttcccattcgtctgtcaggccagattgtggcttctgggtttagggttctctctcggctatgggtccatgttcacgaagatctggtgggtgcataccgttttcactaaaaaagaggagaaaaaggaatggaggaaaacactggagccatggaagctctacgccacagtggggctgctggtcggcatggatgtcctcacacttgccatttggcagattgtggaccctctccatcggaccattgaaacttttgcgaaggaggagccaaaggaggacattgacgtgtctattctgccccagctcgagcattgctcttccaggaagatgaacacctggctcggcatattctacggctataaggggcttctgcttttattgggaatattcctcgcctatgaaactaaatccgtatctacagagaagatcaatgaccaccgcgctgttggcatggccatctacaacgtcgctgttctgtgtctgattacagctccagtgactatgatcttgagcagccagcaggacgctgccttcgcgttcgcctcattggccattgtcttctcgtcttatattacattggttgttctatttgtccctaagatgcgacgtctgatcactcggggagagtggcagtccgaagcccaggatacaatgaaaacagggagcagcaccaataacaacgaagaggagaagagccgtctgttggagaaggagaatagagaactcgagaagatcatcgccgaaaaagaagagcgcgtgtccgagttgaggcatcagttacagagccggcagcagctcaggtcgaggcggcacccaccgaccccacccgaaccgtctgggggacttccaagagggccaccagagccacccgatcggcttagttgtgatggcagcagggtgcacctgctctacaaatag

SEQ ID NO: 11190 - DNA, 2055 bp, Artificial Sequence
  Description of Artificial Sequence: Synthetic coding sequence
tgacctcgcagcagcacacacgtcccactggtgttacctctgctagtgttgctgctgctggctcctgcacggcaggctgccgcacaacggtgcccgcaggcctgtatttgtgataactctcggcgtcatgtcgcttgccgttaccagaacttaaccgaagtgcctgatgctatccctgagctgactcaaagactcgaccttcagggaaatctgctgaaggtgatcccagccgctgcttttcagggagttccgcatcttactcacctcgatcttcggcattgcgaggtcgaattagtggctgaaggagcattccgcggtttggggcgtctcttgttgttaaacctcgcctcgaatcacctgcgcgagctgcctcaagaagctctggatggattgggttccctgaggaggctagagctcgagggtaacgccttggaggagttgcgccctgggactttcggggctctgggcgctcttgccacacttaatctagcacacaatgctttagtctaccttcctgctatggcttttcagggcctgctgagagtgagatggctcaggctctcgcataacgcccttagtgtcttagcacctgaggccctggctgggctgcccgcattacgccgactgtcgctacaccataacgagctgcaggccctgccaggccctgttctttcccaggcacgcggtcttgcacgcctagagctcggtcacaatccactcacctacgcgggtgaagaagacggtctggccctcccaggcctgagggaactccttctggacgggggagccctgcaagccctgggcccaagggcctttgcccattgtccacgcctgcatacactggacttacgtggaaatcagctcgatacattgcctcctctgcagggccctggccagctccggaggctgaggctccagggcaacccattgtggtgtggttgccaggctaggccattgctcgaatggctggcgagggctcgggtgagatccgacggagcctgccaggggcctcggcgattgaggggagaggccctggatgctctacggccttgggatctaagatgtcctggagacgcggctcaggaagaggaagagctggaggagcgggcagtcgccggaccaagagctccgcctcggggaccccctcggggaccaggcgaagaacgtgcagttgcgccatgcccaagggcctgcgtctgtgtacctgaatctcgacattcctcttgcgaaggttgcgggctccaggctgtccccagggggttcccttccgacacccagctgctagaccttcggagaaaccactttcccagcgtgcctcgagctgcttttcctgggttgggtcacctggtaagtttgcacttgcagcactgcgggatcgccgagctggaagccggagctctggccggactggggagactgatctatctgtacctatctgacaaccagttggccggtctgagcgccgctgctcttgagggcgcaccacgactggggtacctttacctcgaacgcaatcggtttcttcaggtacctggcgcagcactgcgcgctctccccagtctgttctcattacacttgcaggacaatgctgtcgatcgactggcacccggagacctcggccgtactagggcccttcgctgggtgtacttaagtggaaataggattactgaagttagtctgggcgctctcggcccagccagagaacttgaaaaactgcatctggatcgtaatcagttacgagaggtcccaactggagccttggaggggttgcccgcactgctggaacttcaactctccggcaacccgttgagggccctgagagatggagccttccaaccagtgggtaggtcattacagcacctgtttctaaatagctcgggtctggagcagatttgcccaggcgcattttcaggtctgggacctggtttgcagagcctgcatctgcaaaagaaccagctcagggccctgcccgctctaccaagtgccaggaggacccccatcaaaggccgacagtgcggggcagacaaagtggggaaagagaagggcagattatag

SEQ ID NO: 11191 - DNA, 2259 bp, Artificial Sequence
  Description of Artificial Sequence: Synthetic coding sequence
atggcgagacacctactcttgcctctggtcatgctcgtgattagtcccatcccaggagccttccaggattctgctctgtctcctacacaggaggagccggaggacctggactgcggacgtcccgaacccagcgctagaatagtgggaggttcaaatgcacagccgggaacatggccatggcaagtctcactgcaccatggtggaggacatatctgcggaggcagtcttatagccccaagttgggttctgtcggcagcacactgtttcatgactaatgggacccttgaaccagccgctgagtggagtgtgcttttgggggttcacagccaagacggccctctcgacggcgctcacactagagcagtcgccgcaatagtagtgcctgccaactattcccaggtggagttgggcgcagacttagctttgctgaggttggcttcaccagcgtccctgggcccagccgtgtggcccgtgtgtctgcccagagcatcgcacagatttgtccacgggactgcttgctgggccacagggtggggagatgtccaggaagctgatccactgcctctgccctgggtgctccaggaagtggagctgcggttgttgggggaagccacatgccaatgcctctactcgcagcctggccctttcaacctgaccctgcagattttgccaggcatgttgtgtgctggctaccccgaaggaagacgcgacacatgccagggcgactccggcggtcctctggtgtgcgaggaaggaggacggtggtttcaggcgggtattacctcgttcgggttcgggtgcggacgaaggaatcgacccggagtcttcactgcggtagcgacttacgaggcatggattagggagcaggtgatgggcagcgaaccaggtccagcgtttcctacacagccccaaaagacccagtccgatccccaggagcctcgggaggagaattgtacgatcgccctgccagagtgtggaaaggctccaagaccaggtgcctggccttgggaagcacaggtaatggtgcccggatccaggccatgtcatggagccctggtaagcgagtcctgggttctcgcaccagcctcctgcttccttgaccctaatagttcagattcccctccgagggatctagacgcttggagagtgctcttgccctcgcgccctagggcggagcgtgtagccagactagtgcagcacgagaacgcgtcttgggacaacgccagcgacctggcactgctccaattgagaacgccagtaaacctctccgccgctagccggccagtctgccttccacaccctgaacactactttctccctggcagccggtgtaggttggcgcgatggggcaggggcgagccagcgctagggccaggtgccttactcgaagccgagcttctgggcggttggtggtgccactgtttgtacggcaggcaaggagccgctgtgcctctgcccggtgatccgccacacgccttgtgcccagcttaccaagagaaggaagaagtgggaagttgctggaacgatagccggtggtcactgttgtgccaagaagagggtacgtggtttctggcaggtatcagggatttcccgtcaggctgtctgagacccagggctttcttcccactgcaaactcacggaccttggatttcacatgttacgagaggagcctacctcgaggaccaattggcatgggattggggcccagatggcgaagagaccgaaacccagacttgccctcctcacactgagcatggtgcttgtggtctaaggctcgaagcagcccctgttggcgtgttgtggccctggcttgctgaggtacatgtcgcgggagacagagtatgtacaggaattctgctggcccctgggtgggttctcgctgcaactcactgcgtgctgaggcctggaagcaccacagtaccgtacatcgaggtctacctaggtagagcaggtgcatcatccctcccacagggccatcagatgacatccgcacctccccttctatgccaaatgaccgagggctcgtggatcctcgtgggaatggccgtgcagggatcacgagaattgtttgccgcaattgggcctgaggaagcctggatcagccagaccgttggcgaagccaactttctcccccctagcggttcaccacactggcccactggcggatccaatctttgcccccctgagctggctaaagccagcggctcgccccatgctgtttactttctgcttctcctgacgttgctgatacagagctag

SEQ ID NO: 11192 - DNA, 453 bp, Artificial Sequence
  Description of Artificial Sequence: Synthetic coding sequence
atgcgctttatggcgggtccagcgggaagccagtcactggggccactctgttttcactcttcaccacaggccctctacaccgtattgctgattgtactggttatgatgtcactagtgtttggcaaatttgttcctgtgaactgggagcctccccagccattgccatttcccaagtatctgagatgttacaggtgtctgctggaaactaaggaattgggctgccttctcggctccgatatttgtttaacccctgccggttcgtcttgtattactctgcacaaaaagaactcctcgggtagcgacgtgatggtgagtgactgtaggtccaaggagcaaatgtctgactgctcaaataccagaacctcaccagtatccggcttctggattttcagtcagtattgttttttggatttttgcaacgacccccaaaaccgcggtctatacacaccctag

SEQ ID NO: 11193 - DNA, 1161 bp, Artificial Sequence
  Description of Artificial Sequence: Synthetic coding sequence
atgaagttccaggggcctcttgcctgcctgctgctcgccctttgtctgggctcaggcgaggccggacccttacaaagcggggaagagtccacaggcaccaacatcggagaagcgctgggacatggcctgggcgacgcactgagtgagggagttggaaaagctatcgggaaggaggcgggaggagctgccggtagtaaggtgagtgaggccctcggccagggaacccgcgaagcggtcgggactggtgtgcgacaggttccaggcttcggcgtggccgacgccctggggaatcgagttggcgaggcagcccatgccctgggaaacactggccacgaaattgggcgacaggccgaggacgtcatccggcatggcgcagacgccgttcgcggatcttggcagggagtccccggacataacggcgcatgggaaacatctggcggtcacgggatcttcggttctcagggtgggttgggaggacagggccaggggaatcccggaggactggggacaccttgggtgcacggttatccagggaactctgccggatcatttgggatgaatccccagggggctccgtgggggcaggggggtaacgggggtcctcccaattttggcaccaacacacagggcgctgtcgcgcagcccggatacggaagtgttagagcctctaatcagaatgagggctgtaccaatcctcccccatctggttctgggggtggaagtagcaacagcggcggaggatccggtagccagtcaggctcatcagggagtgggtcaaatggggacaacaataacggctctagctcgggaggcagttcaagcggctcatcctccgggggaagctccggtgggtcaagtggcggatcatctggtaactctggtggctctcggggagactcaggtagtgagagctcttggggctccagtacgggctctagtagtgggaaccatgggggaagtggcggaggcaatggacataagccagggtgcgagaagccaggaaatgaagccagggggtctggagagtcagggatccagaatagcgagacatccccgggtatgtttaatttcgatacgttctggaagaattttaagtccaaactcggatttattaactgggatgccatcaacaaagaccagcggagtagtagaataccttag

SEQ ID NO: 11194 - DNA, 1995 bp, Artificial Sequence
  Description of Artificial Sequence: Synthetic coding sequence
atgaaaaccggactgttctttttgtgtttactgggtaccgcagccgctatacccaccaacgcacgtttgctgagtgatcattccaagccaactgctgagaccgtggccccagataacacagcaatcccttccctgagagctgaagctgaggaaaatgaaaaggaaacggctgtttcaaccgaggacgattcacaccataaggcggagaagagctctgttctaaagtccaaagaagagtcccacgaacagtcagctgagcagggtaagtcctcctcccaagagctcggcctgaaggatcaggaggactctgatggccatctctcagtgaatcttgaatatgctccaaccgaaggcaccctggatatcaaggaggacatgtctgagccccaggagaagaaactgtccgagaacacagacttcctggcgccaggggtgtctagctttaccgatagcaaccagcaggagagcatcactaaacgggaggagaaccaggagcaacctcgcaattactctcatcaccagctgaatcgctcctccaagcatagccaaggactgagagaccagggcaaccaggaacaagacccaaacatctctaacggtgaggaagaagaggaaaaagagcccggtgaggtgggcacccacaacgacaatcaggaacggaaaaccgagttaccgcgtgaacacgccaattcaaagcaagaggaggataacacacagagcgacgatatcctggaagaatctgatcaacccactcaagtctcaaagatgcaggaggacgagtttgaccaggggaaccaggaacaggaggacaacagtaatgcagaaatggaagaagaaaacgcgtctaacgtgaacaagcacatccaggagaccgagtggcagagccaggaaggcaaaacaggtttggaggccattagcaaccacaaggaaacggaggagaagacagtctccgaagccttgctcatggaaccgacagatgacggtaacacaacgcccagaaatcacggcgtggatgacgatggtgatgatgatggcgacgatggcggaacagacggccctcgtcactctgcctctgacgactatttcattccttctcaggccttcttggaggctgagcgggcacaatccatagcatatcaccttaaaatagaggagcaacgcgagaaggtgcatgagaatgagaacatcggcactaccgaacctggggaacatcaggaagccaaaaaagcggagaattctagcaatgaggaggaaacttcaagcgagggcaacatgcgagtccacgcagttgatagctgcatgagttttcagtgtaaaaggggccacatctgcaaggccgatcagcaaggaaaacctcactgcgtgtgtcaggaccctgtgacctgtccaccaaccaaaccgcttgaccaagtatgcggcaccgacaatcagacatacgccagtagctgtcatctcttcgcaaccaaatgtcggctggagggaactaaaaaggggcatcagttacagctggattacttcggtgcgtgtaaaagcatccccacatgtaccgatttcgaagtgatacaatttcctctccgcatgcgagattggttgaaaaatattttaatgcagctgtacgaagccaactccgagcatgccggatacctaaacgagaagcagcgaaataaggtcaagaagatttatctggatgagaagcgattactcgccggagaccatcctattgatctcctgctacgtgattttaagaagaactatcacatgtatgtttaccctgtgcattggcagttctctgagcttgatcagcatcctatggaccgcgtactgacccacagcgaactggctccgttgcgtgcgagtctggtccccatggagcactgcatcactagattctttgaagagtgcgatccgaataaggacaagcatataacgctgaaggagtggggccattgctttgggatcaaggaggaggacattgacgaaaatctcctgttctag

SEQ ID NO: 11195 - DNA, 420 bp, Artificial Sequence
  Description of Artificial Sequence: Synthetic coding sequence
atggggcctgaggctctcagttccctgcttctcttactgttagtggcttccggcgacgcagacatgaaaggacacttcgatcccgcaaaatgccgctacgcccttggcatgcaggacaggaccatcccggactctgacataagtgcctcatcttcttggagcgacagtacagctgcacgccactcccggttagagagctcggatggcgacggcgcttggtgccctgctggctcagtgtttcctaaggaagaagaatatttacaggtagatcttcaacgcctgcaccttgtggcccttgtgggtacccagggcaggcacgcgggtggactcggcaaggaattctctcgatcatatcggctgcggtatagtcgggacggtcggagatggatgggctggaaggaccgctggggccaggaatag

SEQ ID NO: 11196 - DNA, 285 bp, Artificial Sequence
  Description of Artificial Sequence: Synthetic coding sequence
atgcaacactctttggttttcttctttgcggtgattctgcacctgtcacatttactgcaccttgacgcatctatccacccattccggctgccatttagcagtaagcctttcctcctgatccctatgagcaacactacgctgcctcatactgcctggcccttgtcatttctgcatcagacagtgtcaacactgaaagcagtggctgtgacccattctctctggcacctgcaaatcccggtggactgccaagcctgcaatcgtaagagtaagaaaatttattgttag

SEQ ID NO: 11197 - DNA, 699 bp, Artificial Sequence
  Description of Artificial Sequence: Synthetic coding sequence
atgctgccaaagtctaggagagcgctgactattcaggagatagctgccttagccagatcatccctccacggcatttctcaggtcgtgaaagatcatgttacaaagcccaccgcaatggcacagggcagggtcgcacacctgatcgagtggaaggggtggtcaaaaccatctgattcaccagctgcactagaaagcgcgtttagctcttacagcgatctgtctgagggggaacaggaagctagatttgccgctggagtggcagagcagttcgcaatcgcagaggcaaaattacgcgcttggtccagcgtggatggcgaggatagcacggatgactcatatgacgaggactttgcgggagggatggatacggacatggctgggcagttgccactgggccctcacctgcaggacctgtttacagggcacaggttttccagacctgtgcggcagggatcggtggagcctgagtccgactgtagccagaccgtatcaccagatacgttgtgttcctcgctctgcagtttagaagacggcctgctcggcagcccagcacggctggcatcccagctacttggggatgaactgctgttggccaagttgcccccaagccgcgaaagcgcttttcgctcgctggggcctctcgaagcccaggattccctttataatagtccgctgaccgaaagctgtctgagtccatag

SEQ ID NO: 11198 - DNA, 2631 bp, Artificial Sequence
  Description of Artificial Sequence: Synthetic coding sequence
atgggccctgaagctctgtcgagtctcctactgctgctgctcgtcgcttcaggggacgccgatatgaaaggacactttgatcctgctaagtgccgctacgccctggggatgcaagacagaaccatacccgacagcgatatttccgcatcttcttcttggtccgacagtaccgcagctcgacactcaaggctcgaatctagtgacggtgatggcgcatggtgtcccgcaggttctgtattccctaaggaagaggaatatctgcaagtagatctacagaggttacatcttgtagcacttgttggaactcagggacgccacgctgggggattaggcaaagagttcagcagaagctacagactacgctacagccgcgatgggcgtcggtggatgggctggaaggatcggtggggacaagaggtgatttctgggaatgaagaccccgaaggagtggtactaaaggacctgggacccccaatggttgctcggttggttagattctaccctcgagctgatagggtgatgtctgtgtgtctgagggtcgagctgtatggctgtttgtggagagacgggcttctgtcctatactgcgccagttggccagactatgtacctgtccgaagccgtttatctcaacgactccacgtatgacggtcataccgtcgggggtctccagtacgggggactgggacagttagccgacggcgttgtaggtctcgacgatttcagaaagagtcaggagttgagagtgtggccagggtacgactatgtcggctggtctaaccactccttctcctccggttacgtcgagatggaatttgaattcgaccgattgcgggcatttcaggcaatgcaggtacactgtaacaatatgcacaccctgggcgcaagactccccggaggggtggaatgccgttttagaagaggcccagctatggcgtgggagggcgagccgatgcggcacaatcttggcggtaaccttggagacccacgtgccagggcagttagcgtgccactggggggtcgcgtggctcgcttcctacagtgcaggttcctattcgcaggtccatggctgcttttttcagaaataagtttcatttcagacgtcgtaaacaatagttccccagctctgggcggaacgtttccgccagccccttggtggccgcctggacctcccccaacaaactttagctcgctagagttggaaccccgaggtcagcagccggttgctaaagctgaaggctctccgacagccattctcattggttgtctggtagccatcatcctgctcctcttgctgattatcgcactcatgctttggcgcctgcactggcgcaggctgctcagtaaagcagagcgcagagtacttgaggaagaattgaccgtacatctgtccgtgccgggagacaccatcctgattaacaatcgcccaggcccacgggagcctcccccataccaggagcccagaccgcgtgggaatccccctcattccgcaccatgtgttcccaatggttctgcatacagcggtgactatatggagccagagaagccaggcgctcctttacttccgcctccccctcagaactctgtcccacactacgccgaagccgacatcgttacactgcaaggcgttaccggcggaaatacctacgccgtcccagctctccctcctggagctgtcggagacggccctcccagagtggactttcctcggtcgcggctgcggttcaaagaaaagctgggcgaagggcaattcggtgaggtgcatttgtgtgaggtggatagccctcaagacctggtatccctcgactttccgcttaacgtgaggaaaggccatccattactcgtggccgtcaaaatcctgaggcccgacgctactaaaaacgctcgcaacgacttcctgaaagaagttaagattatgagccgattgaaggatcccaatattataagattgctgggagtatgcgtgcaagatgacccactgtgcatgatcaccgactacatggagaatggcgacctgaatcaatttctgagtgctcatcagctggaggataaggcagctgagggggctcccggagatggacaagcggctcagggccctacaattagctatcccatgctgctacatgttgccgctcaaatcgcttcgggcatgagatacctagcaactcttaactttgtgcaccgggacctggcgactcgcaactgcctagtaggtgagaacttcaccatcaagatcgccgacttcggaatgagcagaaatctctatgccggtgattactaccgagtgcaggggagggccgtcctccctatcagatggatggcttgggaatgtatcctgatgggtaagtttacgaccgcttcggacgtgtgggcctttggcgtcaccctgtgggaggttctcatgctctgtagggcacagccgtttgggcaattaaccgatgagcaggtcatcgaaaatgcaggcgagttcttccgcgatcagggtcgccaggtctacttgtcaagacccccagcctgcccccagggtctatacgagctcatgcttaggtgctggtcccgggagagcgaacagcgccctcccttttcccagctacatagatttttggccgaggatgccctgaacaccgtgtag

SEQ ID NO: 11199 - DNA, 165 bp, Artificial Sequence
  Description of Artificial Sequence: Synthetic coding sequence
atgtgtagagagacagcaggatatggctggttgctggcgagcacagagttactctccttgctagaacccctgagcccccagctgctcaaagaacacatctcctgtacgtcacaagtcgccgcaggggcaaaagtgacaccggattccgccgtttgggcgccttag

SEQ ID NO: 11200 - DNA, 2256 bp, Artificial Sequence
  Description of Artificial Sequence: Synthetic coding sequence
atggcgtttcgcacaatctgcgtcctggtgggggtgttcatttgctctatttgtgtgaaagggtccagtcaaccacaagccagggtttaccttactttcgacgaactccgggaaacaaagacttcagagtacttttctctgtcacaccatccactggactatcggatcctcctcatggatgaggaccaggatcggatttacgtaggaagtaaggatcatattttgtccctaaacattaacaatattagccaagaggccctctcagtcttttggccagcttccaccatcaaagtggaggagtgtaagatggccggtaaagatcccactcacgggtgtgggaattttgtgcgtgtgattcagacatttaatcggacacatctttacgtgtgcgggtccggcgctttcagccccgtatgcacctatctgaatcgagggaggcggagcgaggaccaggtgtttatgatcgatagcaagtgcgaatctgggaagggtcgttgctcattcaatcccaatgtcaatacagtctccgtcatgatcaatgaggagctttttagtggcatgtatattgatttcatgggtactgacgcagccatcttccgatccctcactaaacgcaacgccgtcaggactgaccagcacaactctaagtggctgtcggagccgatgttcgtagatgcacacgtcatcccagatggcaccgaccccaatgacgccaaggtctacttctttttcaaggagaaacttaccgacaataacagatcaaccaagcagattcactccatgattgctcggatttgtccaaacgatacagggggtctgaggtccctggtcaacaaatggaccaccttcttgaaagctaggctcgtatgtagcgtcactgacgaggatggcccagagacacatttcgacgagctcgaggatgtttttctcttggagaccgacaacccacgcaccacattggtctacggaatctttacaaccagctcatccgtcttcaagggaagtgctgtgtgtgtctaccatctgagtgacatccaaaccgtgtttaatggcccattcgcccacaaggagggccctaaccatcaattaattagctaccagggcagaattccatatccaaggcctgggacctgtccaggtggtgctttcactccgaacatgcgaaccactaaagagttccccgacgatgtggtcacattcatccgcaaccaccccttgatgtataattcaatctaccctatccataaacggcctctcattgtcaggatagggactgactataagtatacaaaaatagctgtcgatcgggtgaacgccgcagatggtagataccacgtgttgttcctgggaacagaccgaggaacagtccaaaaagtggtcgttctgcctaccaataattccgtcagcggggagcttatcctggaggagctggaggtatttaaaaatcatgcacccattaccaccatgaagattagcagcaaaaaacagcagctgtacgtgtcctccaacgagggggtttctcaagtgagtctccacagatgtcatatttatggtactgcctgtgctgactgctgcttggccagagatccttattgcgcgtgggatggccatagctgttccagattctaccccactggtaagagaagatctcgcaggcaggacgttcgacacgggaatccattgactcagtgtagggggtttaacctgaaggcctacaggaacgctgcagaaattgtccagtacggagttaagaataacaccactttcctggaatgcgcgccaaaaagccctcaagctagcatcaagtggcttttgcagaaggataaagatcggaggaaggaagtcaagttaaacgagcgcatcatagcgacttcccagggtctgctcatccggtctgtccagggttctgatcagggactgtaccactgtatcgcaaccgagaacagctttaaacagacaattgcaaaaattaacttcaaagtactggacagtgagatggtggcggttgttactgacaaatggtcaccttggacttgggcctcctccgttcgagccctgccattccacccgaaggatatcatgggtgccttctctcattctgagatgcaaatgatcaaccagtattgtaaagataccaggcagcagcaccaacagggagatgaaagccagaagatgcggggagattatggaaaactcaaagccctcatcaatagccgcaagtcccgtaacagacgtaaccagctgccagagtcgtag

SEQ ID NO: 11201 - DNA, 630 bp, Artificial Sequence
  Description of Artificial Sequence: Synthetic coding sequence
atggggcctgaggcactgtcttccctcctgctgctgctactggtggcttcgggcgacgccgatatgaaaggacacttcgacccagcaaaatgccggtatgccttaggtatgcaagatcgaaccatccctgatagcgacatctcagcgtcttctagctggtccgactccaccgccgcaagacacagtaggttggaatcttctgacggggacggggcatggtgtccagccggtagtgtattccccaaggaagaagagtatcttcaagtcgacctgcagaggttacatctcgtcgcccttgtggggacgcagggacgccacgcaggcggtttggggaaagagttctcccggtcatacaggctcaggtacagtagggacggcaggcgatggatggggtggaaagatcgatggggccaggaggtgatcagcggaaatgaagaccccgagggggtcgtgctgaaagacctggggcctcccatggtggctaggctggtcagattttaccctagggctgacagggttatgtcagtatgtcttcgtgtggagctgtatgggtgtctgtggagagacggcctgctttcctatacggctcccgtgggacaaacgatgtatctgtccgaggcagtgtattag

SEQ ID NO: 11202 - DNA, 315 bp, Artificial Sequence
  Description of Artificial Sequence: Synthetic coding sequence
atgtccgacctgcttttgctaggactcattggcggactcactcttctcttgcttcttacactgttggcgttcgccggatattccgggcttctggctggtgtagaagtatctgctggttcaccacctatcagaaatgtgaccgtcgcttacaaattccatatgggactgtacggagagacgggacggctgttcaccgagtcatgttctatctctccgaaactacggtccatcgcggtgtactacgacaatccccacatggtgccccctgacaagtgccgatgcgccgtgggatccatcctgtctgaaggtgagtag

SEQ ID NO: 11203 - DNA, 2631 bp, Artificial Sequence
  Description of Artificial Sequence: Synthetic coding sequence
atggggccagaggcgctctcgtctctgttattgctgctgctggtcgcttcaggggatgctgacatgaaggggcactttgacccagccaagtgcaggtatgccctgggtatgcaggacagaactattcctgattcagatatctctgcctcttcgtcctggtcagatagtacagctgccaggcacagccgattagaatcttctgatggagacggggcttggtgccctgccggttcagtgtttccgaaggaggaagagtatctgcaggtggatctgcagcggctgcacctggtggcccttgtcggcacacaaggcagacatgccggagggctgggcaaagaattttcgcgatcgtaccggctgcgatatagtcgggatggacgtagatggatgggctggaaagacaggtggggacaggaggtgattagcggcaacgaggatcctgagggggtggtgctcaaagacctcggcccaccgatggtggccagactcgtacgcttttaccccagagccgatcgcgtgatgagtgtgtgcttaagagtcgagctctacggatgtctgtggcgggacggcctgttatcctacaccgctccggtagggcagactatgtacctgtccgaggcagtatacctgaatgattcaacttacgatggacataccgtagggggactacaatacggaggcttggggcagcttgccgatggcgtggtaggactggacgatttccggaaaagccaggaactgcgcgtctggccaggctatgattatgtcggctggtcaaatcactcctttagtagcgggtacgtagaaatggagtttgagttcgacagactgagagctttccaggcaatgcaggtgcactgtaacaacatgcacacccttggcgctcggctgccgggtggcgttgaatgccgatttagacgtgggcctgccatggcttgggaaggggagcccatgcgccacaacctggggggtaacctgggagacccacgtgctcgtgccgtttctgtcccgctggggggtagggtcgcccgattcctgcaatgccgatttttattcgctggtccgtggttactattcagtgaaatctcctttattagcgacgtggttaataactctagtcctgccctcggcggtaccttccctcccgcaccgtggtggccacccggaccgcctcccacaaatttctcatccctggaactagaacccagggggcagcaacccgtggccaaagcagaggggtcccccacagctattctgataggctgtctcgttgctatcatactgctactattgctcatcatcgccctgatgttatggcgcttgcactggagaagactcctgtcaaaagctgaacgcagggtgctggaggaggagctgactgtccaccttagcgttccgggagacactatactgatcaataacagacctggacccagggagcctcccccatatcaggagcccagaccaagaggcaacccccctcatagcgctccttgcgtcccaaacggttctgcctactcaggggactacatggaaccagagaaacctggcgctccactactaccccctcccccacagaactccgtgccacattacgccgaggcagacatcgttacactgcagggcgtcacaggtggaaacacatacgccgtccccgcattgccacccggtgcggtgggggatggtccgcctcgtgtagatttcccacgctctagattaagatttaaggagaaactcggtgaaggtcagtttggggaggtgcacctgtgtgaggtggactctccccaggatcttgtaagcttggacttccctttgaatgttcgcaaggggcatcccctgctcgtggccgtcaagatacttcgccctgatgctacaaaaaacgcaagaaacgacttcctcaaggaggtgaaaattatgagtcggctgaaagacccaaatatcattaggctcttaggagtgtgtgttcaggacgaccctctgtgtatgattactgattatatggaaaatggcgacctgaatcaattcctcagcgcgcaccagttggaagacaaggccgctgaaggggctcccggtgatggacaagcggctcagggcccaactatcagttaccctatgctactgcacgtagctgctcagatagcctccggcatgcgctatctagctacactgaatttcgtgcatagggatctggctaccaggaattgtctcgttggcgaaaactttacaataaagatcgccgacttcggaatgtcgcgcaatctgtacgccggagactactatcgagtccaaggtcgggctgttctgcctattagatggatggcatgggagtgtatcctgatggggaagtttaccactgcctctgatgtctgggcgtttggcgtgacattatgggaggtcctgatgttatgccgggctcagccctttggccagctgactgacgaacaggtgattgagaatgccggagaatttttccgcgaccagggcaggcaggtctatttatcccgtcctccagcctgtccccagggactgtatgagcttatgctgcgctgctggagtagggaatcagagcagagacctcctttttcgcaactccacagattcttggcggaggacgcactgaacacggtgtag

SEQ ID NO: 11204 - DNA, 1053 bp, Artificial Sequence
  Description of Artificial Sequence: Synthetic coding sequence
atggaagccttcgcactcggaccggctagacgaggcagaagacggacccgcgcagcagggagcctgctgtctcgcgcagcgattcttctgtttatttctgcgttcctcgtcagggtgcccagttccgtgggtcatctggtgcgcctcccacgcgcattcaggctcactaaagacagcgttaagatcgtgggatccacatccttcccggtgaaggcctacgttatgttacaccagaagtcgccccacgtattgtgcgtgacacagcaactccggaacgctgagctaatcgacccatcgttccaatggtacggccctaaggggaaagtggtgtcagagaacagaaccgcacagattacctccacgggaagtctcgtctttcagaattttgaagaatctatgagtggcatctacacctgctttctcgagtataaaccgaccgtggaggaaatagtgaagagactccagctcaagtacgcgatatatgcctatcgggagcctcattactactatcagttcactgccagataccatgctgcaccctgcaatagcatatataatatttcttttgagaaaaagttattacaaattctatccaagctgttgctggatctcagctgcgagatctcattacttaaatcagaatgtcaccgtgtcaagatgcaaagagccggactgcaaaacgagttgtttttcgccttttccgtcagctcacttgataccgagaagggcccaaagaggtgtaccgaccacaattgcgaaccatacaagcggttattcaaagctaagaatctgattgagcggttcttcaaccagcaggtggagatcctgggacgcagagccgagcagctcccgcaaatctattacattgaggggacactgcagatggtgtggataaatcggtgcttcccagggtacggtatgaacgtacagcagcaccccaaatgtcccgaatgctgcgtgatttgttctcctgggagttataatcctagagatggaatacattgtctgcagtgcaattcttcgctggtgtacggtgcaaaaacatgcctgtag

SEQ ID NO: 11205 - DNA, 1392 bp, Artificial Sequence
  Description of Artificial Sequence: Synthetic coding sequence
taactagccctggtgctctgtacggtggattcacggccaccagctcagcttgctctgtcccatgccggaagactgttagcatcatctacggccgcttcagtcccaaatacactgagactggagctgcgcggtccacagcccagggatgagggtttttatagctgtagtgctagaagtcctttgggccaggccaacaccagtctggaactgcggctagaaggggtgagagtgatcctcgcaccagaagctgccgtgccagaaggcgcacctataacagtgacctgcgccgaccccgctgcacatgctccgactttgtacacttggtatcacaacggaaggtggcttcaggagggaccagccgcttccctgtcattcttggtggcgaccagagcgcacgcgggtgcatacagctgtcaggcacaggacgctcaaggcactagatcctccaggcccgcagcgctgcaagtattgtatgccccacaggacgctgtgctgagttcctttcgcgattcgcgcgctcgcagcatggccgtgattcagtgcacagtggatagcgagccgccagccgagttggctctgtcgcacgatggaaaggtgttagcgacctcctccggagtacactccctggcctcgggaactggccacgtacaagtggcacggaacgccctgcgcctgcaggtccaggacgtgccagccggagatgacacttatgtttgcacagcccagaacctgcttggcagtataagcaccatcggcagactacaggtcgagggggcaagggtggtggcagaacctggcctggatgtgcccgagggggcagctcttaacctgtcgtgtcgattacttggagggccaggccctgtgggcaacagtacattcgcttggttctggaatgatcggcgactgcatgccgagcctgtgcctactttggcttttacacatgtagcacgcgctcaagcaggcatgtatcattgtctcgctgagttgccgacaggcgcagcagccagcgcccctgtgatgctacgggtgctctatcctcccaaaacaccaaccatgatggtttttgtggaaccagaaggcggtctccggggtatactggattgccgagtcgactctgagcccctagcgtctctgacacttcacttggggagtcgcctggttgctagtagccagccccaaggggcacccgcagaaccccacatccatgttctggctagccccaacgccttgagagtcgatatcgaggccctccggccaagtgaccaaggagagtatatttgctctgccagtaacgtgctggggtctgcgagtacatctacttatttcggtgtgagaggagaaggaagaggtttgcatctgccgggacacagcgcacagaaaccctccagttag

SEQ ID NO: 11206 - DNA, 1398 bp, Artificial Sequence
  Description of Artificial Sequence: Synthetic coding sequence
atgaagtttcaggggcctctggcctgcctactcctggccctctgcctgggcagcggggaagctgggcctctgcaatcaggtgaagagtcaactgggactaacatcggcgaagctctcggacacggcctgggtgacgccctgagcgagggggttggcaaggccatcggcaaagaagcgggaggcgcagctggctccaaggtaagcgaagcactggggcaggggacaagggaggccgtagggacaggagtccgacaagtgccagggttcggcgtggccgacgctttgggaaatcgggtgggtgaggccgctcacgccctaggcaacactgggcacgagataggcaggcaagccgaggatgttattcggcatggcgctgacgccgtgagaggctcctggcagggcgtgccaggccacaatggagcctgggaaaccagcgggggacacgggatttttggaagtcaggggggattgggcggacagggccaggggaacccaggcggtttgggtactccgtgggttcacggatatcccggaaattcggctggcagctttggcatgaatcctcaaggagccccttggggacaggggggaaatggcggtcctccaaattttgggaccaacacacagggcgctgtggcccagccgggatacgggagtgtacgtgcaagcaaccaaaacgaaggctgtactaaccccccaccttccggaagcgggggaggttcttcaaactccggcggatcgtcaactgggtccagttccggcaaccacggaggttccgggggagggaacgggcacaaacctgggtgtgagaaaccaggcaacgaggcacgtggaagcggggagtccggtatccaggggttcaggggacagggggtgagttcaaatatgagagaaatatcgaaagagggtaaccggctgctaggcggatctggcgataactaccgcggacaaggcagctcatggggttctggcggaggcgacgccgtgggaggcgtcaacacagtaaacagcgaaacctccccagggatgttcaactttgacaccttttggaagaactttaagtccaaactaggctttattaactgggatgccatcaacaaaaatcaagtccctccaccctcaactcgagcactgctctacttctcacgcctgtgggaagatttcaagcagaacaccccctttttaaattggaaagcaatcatagaaggggctgatgcgtcttcactgcaaaagcgggcaggacgggacgatcaaaactacaattacaaccagcacgcctaccctacagcatatggaggcaaatactctgtgaaaactcctgccaagggaggggtatcaccttctagttccgcttcccgcgtgcaaccgggactacttcagtgggtcaagttttggtag

SEQ ID NO: 11207 - DNA, 2700 bp, Artificial Sequence
  Description of Artificial Sequence: Synthetic coding sequence
atgctgttgctgcttctcctcgctcccctgttccttagaccaccaggggctggtggggctcagacacctaatgccacctctgaaggctgccaaattatccatccaccctgggagggtggcatccggtaccggggactcacacgggatcaggtgaaagccatcaactttctgccagtagactacgagattgagtatgtgtgcagaggagaaagagaagtggtgggccctaaagtccgaaagtgccttgcaaatggctcctggacagatatggataccccctcccgctgcgtgaataggacccctcatagcgaacgcagagctgtctatatcggggctctctttcctatgagcggtggctggcccggaggacaggcgtgccagcctgcagtagaaatggccctagaggacgtcaattcacgcagagacattctgcccgattacgagctgaagctcatccaccacgactctaaatgtgacccagggcaggcaacgaagtatttatacgagctgctctataatgaccccattaagattattcttatgcccggatgctcctcggtatctacactggtcgccgaggccgctagaatgtggaacctgattgtgctttcttacgggagctcctctccggcactctctaatcggcagcgttttccaactttctttaggacgcaccccagcgccaccctccataatccaacacgcgtcaagctctttgagaaatgggggtggaagaagatagctacaattcagcaaaccacagaggtgttcacaagcactctggatgacctggaggaacgcgtgaaggaggcaggcattgagatcacctttagacagagttttttttctgacccagcagtgccggtgaagaacctcaagcgccaggatgcacggatcatcgtgggactcttctacgaaactgaggcacgcaaagtattctgcgaagtttacaaagagcggctgttcggcaaaaaatacgtttggtttctgatcggctggtatgctgacaattggtttaaaatctacgatccgtccatcaactgtacagtggatgaaatgaccgaagccgtggaagggcacattacgaccgagatagtgatgctgaacccagcaaacaccagatctatctcaaacatgaccagccaagagttcgtggaaaaactgaccaagcggctgaagaggcatcccgaggaaaccggtgggttccaggaggcacctctggcttacgacgccatctgggcactggcactggctttgaacaagaccagcggtggcggtggaaggagcggtgtcaggcttgaagactttaattataataaccagactattaccgatcagatttatcgcgcaatgaactccagctcttttgaaggcgtcagcggccatgtggtatttgatgcttccggatcgcgcatggcatggactctaattgagcagcttcaggggggaagctataaaaagattggatactacgactccaccaaagacgacctgagttggagcaagacggataagtggatcgggggaagtccccctgcggatcaaacattagtgataaagacgtttagattcctgtcgcaaaagctgtttattagcgtatcagtcctgtcctcattgggaatcgttctggcggtagtctgcctatcctttaatatctacaacagccacgtccggtacattcagaacagccagcccaatctgaataaccttacggccgtgggatgtagtctagcactagcggcagtctttcccctcggcttggatggataccacattggtagaaaccaatttccttttgtgtgccaggcccgtctttggctcttgggattagggttttccctcgggtatggcagtatgtttaccaaaatttggtgggtccatactgtgtttactaagaaggaagaaaagaaagagtggcggaagaccttagagccctggaagctctacgccacggtcggtctgctagtgggtatggatgtgctaactctggccatatggcagatcgtggatcctcttcataggacaatcgaaacattcgctaaggaagagcctaaggaagatattgacgtttctattcttcctcagcttgagcattgctccagtaggaaaatgaacacgtggcttggcatcttctatggctacaagggcctgctcctcctcttggggatcttccttgcatacgagacgaaatccgtatccaccgagaagattaatgaccatcgggctgtgggtatggctatctataacgtggccgtcttatgtctgataacagcacctgtgacaatgatcctcagctcacagcaggacgcagcttttgccttcgcaagccttgctatcgtgtttagtagttacattaccctcgtggtcctgtttgtgccaaagatgcggcgactgatcacacggggagagtggcagtcagaggcccaggacacaatgaagacaggaagttccacgaacaacaacgaggaagaaaaatcacgattattggagaaggaaaatcgcgaactcgagaagattatagctgaaaaggaggagcgtgtgtccgaactacgtcaccagctccagtcgcgtcaacagctgcggtctcgcagacatcccccaaccccgcctgagcctagtggcggactgccccgagggcctccggagccaccggaccgccttagttgcgatgggtctcgcgtgcatctgctgtacaagtag

SEQ ID NO: 11208 - DNA, 381 bp, Artificial Sequence
  Description of Artificial Sequence: Synthetic coding sequence
atgtggtacgtgagcaccaggggcgtagcaccccgagtgaatttcgagggggcactcttttcggggtacgccccagacgggggactcttcatgccagaggaattgccccagttagacagagggaccctgtgtcagtggtcaacgctttcatatccaggcctggttaaggaactgtgtgcgctattcattggctctgagctattgcctaaggatgaactgaatgacctgattgatcgtgctttcagtcgatttagacaccgggaggtggtacacctgtcaagactcagaaacggcctgaacgtgctggaactttggcacggggtcacctatgccttcaaggacctgtctctgtcctgtaccactcagttccttcagtattag

SEQ ID NO: 11209 - DNA, 147 bp, Artificial Sequence
  Description of Artificial Sequence: Synthetic coding sequence
atgccacctttcttaatcacactgtttttatttcatagctgttgcctgcgggcaaacggtcacctcagggagggcatgaccctgctcaaaactgagtttgcgttgcacctttatcagagcgtggccgcttgtagaaatgaaacctag

SEQ ID NO: 11210 - DNA, 390 bp, Artificial Sequence
  Description of Artificial Sequence: Synthetic coding sequence
atggctgctggctctgctcccatgcagttgcacctgagagcgactattaggatgaaggatggcctctgcgttccccgtaagtggatctatcacctgacagaaggatcaacagatctgaggacggagggccgtcctgacatgaagaccgagctgttttcttcctcatgtcccggaggaatcatgcttaacgagaccgggcagggatatcaacgcttcctgctctataatagatctccacaccctcctgagaagtgtgtggaagaattcaagtccctgacaagttgcctggatagtaaggcctttctgttaactcctcgtaaccagggcaaaggacttaagagtcacaagacagggctgggtttaactaagtcttcgggcgtgaccgggtag

SEQ ID NO: 11211 - DNA, 462 bp, Artificial Sequence
  Description of Artificial Sequence: Synthetic coding sequence
atgactatccacatacttatccttctcttgttgctcgctttcagcgcacagggggatctggacaccgctgcacggaggggccagcaccaggttcctcagcatcggggacacgtgtgctatctgggcgtatgcaggactcataggctggccgaaattatttattggatccgttgcttgcaccagggcgctctcggcgaggggcagccgcgagcccctggtcccctgcagctgtgggcaccccctgtggccagaggtggcagtccggctagatttcccggtttccgccctgcagctagaggccttgctcagtgtcccgctcggtgggtcacctctggaaccgcacgccctctactcggattttcactgcccatctgcatgctggagctactgctgcacatcagcagccctttgacccccgcacctgagaccgtgttcccgtcaccttctccaggctgtgattag

SEQ ID NO: 11212 - DNA, 450 bp, Artificial Sequence
  Description of Artificial Sequence: Synthetic coding sequence
atgggatggctaacacgtatagtctgtctattttggggagtcctgctgactgccagggctaactaccagaacggcaagaataatgtacctcgactcaagctcagttacaaggaaatgctggagtccaacaacgttatcacctttaatggactcgccaatagttcttcataccacacattcctgctggatgaagagaggtccagattgtacgtcggtgccaaggaccatatcttctccttcgatttggttaatattaaggattttcagaagatcgtgtggccggtatcatatactcgacgagacgaatgtaaatgggcaggaaaggacatccttaaagagtgtgcaaatttcataaaagtgcttaaggcgtataaccaaactcatctctacgcatgtggcacgggcgctttccaccctatctgcacctacattgaaattgggcaccactag

SEQ ID NO: 11213 - DNA, 543 bp, Artificial Sequence
  Description of Artificial Sequence: Synthetic coding sequence
atggccgacatgcagaaccttgtggagagacttgagcgggctgttggcagattggaggccgtctcgcatacatcagacatgcacagagggtatgccgattctccgagtaaagcaggagcggctccttacgtgcaggcctttgacagcttgctcgccggaccagtcgcggagtacctgaagatcagcaaagaaattggaggtgacgtgcagaagcacgccgagatggtccacacaggcctgaagctggaacgagcgttgctcgttacagcttctcagtgccaacagccagcagagaacaaactcagcgatctgcttgccccaatcagcgaacaaataaaagaagtgatcacattccgtgagaaaaaccgtgggagcaaactgtttaaccatctgtcagccgtctcagagtctatacaggcactcgggtgggtggctatggcccctaaacctggaccgtatgtgaaggaaatgaatgacgctgccatgttttataccaacagggtgctgaaggaatacaaggatgtagacaagaaacacgtctag

SEQ ID NO: 11214 - DNA, 630 bp, Artificial Sequence
  Description of Artificial Sequence: Synthetic coding sequence
atgggccctgaagccctaagctcccttctgctactcctgctggtggcctccggtgatgctgacatgaaagggcacttcgacccagcaaaatgcagatatgcacttggcatgcaggatcgcaccattcctgactctgatatctcagctagttcgtcctggtctgatagtacggctgccagacacagtcgcctcgaatcgtccgacggggatggggcatggtgtcctgctggttctgtctttccaaaagaagaggaatatctccaggtggatctacagcggctacacctagttgctctcgttggaacacaaggcaggcacgcgggtggactagggaaagagttttcccgaagctaccgactgcgctacagtagagacggacgcagatggatggggtggaaagataggtggggacaggaagtgatatccgggaatgaggatccagaaggagtggtgcttaaagacctgggcccacctatggttgcgcgattggtacggttttatccccgtgctgatagagttatgtctgtttgcctccgcgtggagctttacgggtgcctctggcgggacggtctgctgtcatataccgccccagtggggcaaactatgtacctgtccgaagcagtgtactag

SEQ ID NO: 11215 - DNA, 630 bp, Artificial Sequence
  Description of Artificial Sequence: Synthetic coding sequence
atgggtcccgaagcattaagctcccttctactgttgctgctcgtggcttccggggacgcagacatgaaggggcacttcgacccggcaaagtgccggtacgccttggggatgcaggaccgaacaatcccggattctgatatctcagcctcatcttcttggagtgactcaactgcagccagacactccagactggaaagctctgacggcgatggcgcatggtgtccagcaggcagtgtcttccccaaagaggaagagtacctccaggtggacctgcagcggctccaccttgtcgcgttagtgggaacccagggcagacatgcaggtggactgggcaaagagttttcaaggagttataggctcaggtacagtcgtgatggcaggcgctggatgggatggaaggatagatggggacaagaagtcataagtggcaatgaggatccagagggtgtggtcctgaaggacttaggcccacctatggtagcacgattggtcagattctaccccagggcggatcgggttatgagcgtctgcctccgagtggaactatacggctgtttatggcgggacggtctccttagttacaccgctccagttggacagaccatgtatctgtctgaggcggtttactag

SEQ ID NO: 11216 - DNA, 2631 bp, Artificial Sequence
  Description of Artificial Sequence: Synthetic coding sequence
atgggaccagaagctctgagcagtctcctgctgctgctattggtggccagtggagatgcggacatgaaaggccacttcgacccggctaaatgtagatatgccttgggcatgcaggatcggacgatccctgattcggacatttcagccagcagctcttggtcggacagcacagctgccaggcatagccgactggaatcaagtgatggagacggagcctggtgtccagctgggagcgtgtttcccaaagaggaggaataccttcaggttgacctgcagcgtctgcatcttgtggcactggtgggaacccagggacggcacgctggcggtcttggcaaagagttttctcgatcttaccgccttaggtacagcagggacgggaggcgctggatggggtggaaggacagatggggccaggaggttatcagtggtaatgaagatccagagggcgtggtgttgaaggacttgggtcccccaatggtggcaagactggtcagattttaccccagagccgaccgggtgatgagcgtgtgcctccgagtggagctgtatgggtgcctgtggcgtgatgggttattgagctacactgccccagtggggcagaccatgtacctgtcagaggccgtgtatctgaatgatagtacttacgacgggcatactgtcggaggactgcagtacggagggctgggccagctggctgatggcgttgttggtttggatgattttcggaaaagccaagagctaagagtgtggcccggatatgactatgtgggctggagtaatcatagcttctccagcgggtacgttgaaatggagttcgaattcgatcgtttgagagcctttcaggccatgcaggtacactgtaataacatgcatacgctgggcgcacgtctccctggtggggtcgaatgtcgctttaggcgcggacctgcgatggcttgggaaggcgagccgatgaggcacaacctgggagggaacctgggcgatccgcgtgccagggccgtctctgtgcctctgggtggtagggtggccagattccttcagtgcagattcctcttcgcaggaccctggttactcttttctgagatatcatttatcagcgatgtggtgaataacagttctccagcccttggaggaacctttcctcccgctccttggtggccaccagggccaccacctacgaacttctctagcctcgaattagagccacggggtcagcagccggtcgccaaggccgagggctcaccaactgccatacttatagggtgtctggtcgcaattatactcttactgctgttgatcatcgccctgatgctgtggagactgcactggcgcagacttttgagcaaagctgagcggagagtgttggaagaagagctgacggtccacctttccgttccgggagacacaattctgattaataaccgccctggtcccagagaacctcccccttaccaggaacccagaccaagggggaacccacctcactcagcaccttgcgttccaaacggctctgcatactcgggagattacatggaacccgagaaacccggagccccactgctgccacccccacctcagaatagcgtgcctcattacgctgaggccgatattgtgacccttcagggggttacaggcggtaatacttacgccgtgcctgccctacccccaggagccgtgggggatggaccccctcgtgtggactttccaaggagccgtcttaggtttaaggagaagttgggcgagggccaatttggagaagtgcatctgtgcgaggtcgattcacctcaagatctggtatcactcgacttccctttaaacgtccgcaagggccacccactgctggtggcggtgaagattctgcgtcccgatgcaaccaagaacgctagaaacgacttcctgaaggaggttaagattatgtcccggctgaaagatccaaatataatccgcctgcttggagtttgcgtgcaagacgatcccctgtgcatgataaccgactatatggaaaatggtgacctgaatcagttcctgtctgcccatcaactcgaggataaagctgctgagggcgctccaggagatggacaggctgcgcaggggccaacaatatcttaccctatgttgcttcatgttgccgcacagattgcctcagggatgagatacttagccactctgaacttcgtgcatagagacttggccacccgcaattgcttggttggagaaaattttaccattaaaatcgccgactttggcatgtccagaaacctttacgctggagattactatcgcgtgcaaggcagggccgtcttacctatccggtggatggcttgggagtgtatcctgatgggaaaatttacaactgccagcgatgtgtgggccttcggggtcacactgtgggaggtgctgatgctgtgccgcgcacagccatttgggcaactgactgacgaacaggtgatcgagaacgcaggggagttcttccgggatcagggccgacaggtgtacctgtctaggccccctgcctgcccccaagggctgtacgagctgatgctcaggtgctggtctcgggagtccgaacagagaccacccttcagtcaattgcatcggtttctggcggaggacgcattgaacactgtgtag

SEQ ID NO: 11217 - DNA, 2103 bp, Artificial Sequence
  Description of Artificial Sequence: Synthetic coding sequence
atgttggcacccttcttattgctactgactcactcacgatccccactctcctttcgcccttgcagccacgtacccggtgccctcatagcccagaagcctatgggatcttcgagacttgcagcccttcttctgccccttctgttaatcgtgattgatctgagtgactccgccggtatcggctttcgtcacctgccacactggaacactcgatgcccactggcttctcatacagacgatagctttacgggcagctcggcatacattccttgtcggacttggtgggcactgtttagtacaaagccctggtgcgtgcgagtgtggcactgttcgagatgtctctgccaacatttattgagcggtggctctggtctacagagggggctctttcatctgctggtgcagaagtccaaaaagtcctctacttttaagttttaccgccgtcataagatgccagcccctgctcagagaaagttgttgccacgtcgacacctgtcagagaaatctcatcatatcagcatcccatcacctgacattagccataaaggactgagatcaaagcggacacaacctagcgaccccgagacatgggaaagtctgccgagactggactcacaacggcatgggggacccgagtttagcttcgatctcctgcctgaggcacgcgctatccgggtgaccatttccagtggacctgaagtgtcggtgagactctgccatcagtgggctctagagtgtgaggagctgagcagcccttacgatgttcaaaagattgtatccggcggacatacagtcgagttgccctatgagttcctgctaccttgcttgtgcattgaagcatcatatctccaggaggacacagtgcgacgaaagaaatgtccttttcagtcttggcccgaagcatacggtagcgatttctggaagagcgtacacttcacagattactcccagcacacacagatggtgatggctctcaccctgcgatgtcctcttaagttagaggccgctctctgccaaagacacgattggcacaccctgtgtaaagacctccctaatgcgactgccagggagagcgatggttggtacgtcttggaaaaggtagacctgcatccccaactgtgttttaagttcagctttggaaattcttcacacgtggaatgcccacaccagaccggctctcttacatcctggaatgtgtcaatggacacccaggctcagcagctcatactgcatttctcaagccgcatgcacgctacctttagcgcggcatggtctctgcctggtctgggccaagatacccttgtgccaccggtctataccgtctctcaagcaaggggtagctctcctgtgtcccttgacttgattatccccttccttagaccagggtgttgtgtgttggtgtggaggagtgatgtgcagtttgcatggaagcatctgctatgccccgacgtgtcgtaccgtcacctgggcctactgatcctagccctgttggccctgctcacactcttgggagtagtgctggctctgacttgcaggcgcccacagtcagggccaggacccgcacggccagtgctgcttcttcacgcagctgacagtgaagcacaacggaggctcgtgggcgctctggctgaactcctgcgggcagcgctcgggggtgggagagatgttattgtggatctttgggagggcagacacgtcgctcgtgtcggccctctgccctggctatgggctgccagaaccagggtggctcgagagcaggggaccgtgcttttactatggtcaggtgccgatctgagaccagtctcagggccagatccccgagccgctccactgctcgcattgctgcacgctgccccacgaccattgctgctactagcctatttcagtcgtttatgtgccaagggcgacattcccccacctttgcgggctctgccacgatatcgccttttacgggatcttcccaggctgttacgagctctggacgcacgcccatttgccgaggccacatcttggggtcggctcggagctcgtcaaaggcgtcagtcacgtctggaattgtgtagtcgattagagagagaggctgctcgactagcagatctgggatag

SEQ ID NO: 11218 - DNA, 1194 bp, Artificial Sequence
  Description of Artificial Sequence: Synthetic coding sequence
atgcgcagtcttctgttgctctccgccttttgtctccttgaagcggcacttgccgcagaagtgaaaaagcctgctgcagctgccgctcccggaacagcagagaagctctccccaaaggcagccacactagcagagcgatctgcagggctcgctttcagtctgtaccaggctatggcaaaggaccaggcagtagaaaatatcctggtctctccggttgtagtggcctcatccctgggtcttgtgagcctggggggtaaagcgacaacggccagccaggctaaggccgtgctgagcgctgaacagctccggaatgtgacctggaagttaggtagccgactttatggaccctcatcggtgtccttcgccgacgatttcgtacgctctagtaagcaacactacaattgcgaacatagtaaaataaattttagagataagagatctgccctgcaatctatcaacgaatgggcggctcagacgaccgatggaaagctgccagaagtgaccaaggatgtggaacgtactgatggtgctttgcttgtgaacgctatgttctttaagccccattgggatgagaagtttcaccataaaatggtggataaccgaggtttcatggtgacacggtcctatactgttggcgttatgatgatgcataggactggcttgtataattattacgacgatgaaaaagaaaaacttcagatcgtcgagatgcccctcgcccacaaactttcaagcttgattattttaatgccccaccacgtcgagcctctggagcgtctggaaaagttgcttactaaagagcaattaaagatctggatggggaaaatgcagaagaaagcagtggcaattagtctgcccaagggagtagtggaagtcactcacgatctgcaaaagcatttggcgggacttggactcaccgaggccattgacaaaaataaggctgacttgagccggatgagtggcaaaaaggatctctatctggcctccgttttccatgcgaccgcattcgaactggatacagacgggaatccctttgaccaggatatttatgggcgtgaggaattacgctccccaaaactattttacgctgaccacccctttatctttttggtaagagacacccaatcagggtccctactgttcattggccgtctcgtccgtcccaaaggtgataaaatgagggatgaattgtag

SEQ ID NO: 11219 - DNA, 612 bp, Artificial Sequence
  Description of Artificial Sequence: Synthetic coding sequence
atggccgacatgcaaaacctcgtggagcggctggagcgtgccgtggggagacttgaagccgtatcccacacctcagatatgcaccggggttacgccgattcaccaagcaaggcaggggctgccccttatgtgcaggcatttgactccctgctcgcaggcccagtggccgaataccttaaaatttcgaaggagataggcggtgatgtgcaaaaacacgctgaaatggtgcataccggcctgaagctcgagagagctctactggtcaccgccagccagtgccagcagccagctgagaataaactgtctgacctcctggccccaatctcggagcagatcaaggaggttattacatttcgcgagaaaaatcggggatctaagctattcaatcatctctcggccgtatccgagtcaatccaagccctgggctgggttgctatggcgcctaaacctgggccatacgtgaaggaaatgaacgacgcagctatgttctacacgaacagggtgctgaaggagtataaggacgttgacaagaagcacgtagattgggttaaagcatatctcagcatctggacagagttacaggcctacatcaaggagttccacactacttag

SEQ ID NO: 11220 - DNA, 1293 bp, Artificial Sequence
  Description of Artificial Sequence: Synthetic coding sequence
atgagaaaactaatgaaacaggttcaagaacagtgtcctaatatcacaaggatttattctatcggtaagtcataccagggactcaaattgtacgtgatggaaatgtccgataaaccgggagagcatgagctaggtgagccggaggtcagatatgtggccggaatgcacggtaatgaggcgttgggacgagagctgctcctcctgctgatgcagtttttgtgccacgaatttttacggggtaatccacgcgttactcggcttttgagtgaaatgcggattcatctcctgcccagcatgaatccagacggctacgaaattgcataccaccggggtagtgagctggtgggctgggccgagggcagatggaataaccagagtatcgatctcaatcacaattttgccgacctgaacactcctctgtgggaagcccaagatgatgggaaggtgccccacatcgtacctaatcatcacttgcctctccccacctattacaccttgccaaatgctaccgttgctcccgaaacccgtgcagttatcaaatggatgaaaaggatcccttttgtactaagcgcaaacctgcacggtggagagctagtggtctcctacccatttgatatgacgagaacaccctgggcagctcgggaactcacacccacgccagacgatgcagtgttcagatggctgtcaactgtctacgccggatccaatttagccatgcaggacacctctcgtcgtccctgccacagccaggacttctccgttcacgggaatattattaacggcgctgattggcacactgtaccaggctccatgaacgacttcagctaccttcataccaattgttttgaagtcacggtggagttgagctgtgataaattcccacacgagaatgagctcccacaagaatgggagaataataaagacgcgctcctgacctatctcgaacaggtcagaatgggtatcgctggagtcgtgcgcgacaaagataccgagctcgggatcgcggatgcagtgatcgcagtcgacggtattaaccacgacgtgactacagcctgggggggagactactggaggctgttaactcccggtgactacatggtcaccgcaagcgcggaagggtaccacagcgttacacgcaactgtagggttacttttgaggaggggcctttcccctgcaacttcgtcttgaccaaaacaccaaaacagagattgcgggaattgctcgcagccggagctaaggtgccacctgacctaaggcggcgactggaacggttacgcggacagaaagattag

SEQ ID NO: 11221 - DNA, 1680 bp, Artificial Sequence
  Description of Artificial Sequence: Synthetic coding sequence
atgtggacaaacttcttcaagttgcgcctgttctgctgtttactcgctgtgttgatggttgttgtgctcgtcataaacgtgacccaagttgaatacctcgaccacgagaccgtgtcggccacatttatcgatagctccggccaattcgtgtcaagtcaggtgactggtatttctcggaacccctactgcgggtacgaccaacagactttatcctcccaagaacggatggaggaagactcactgctggccgctcttcacaggcaggtgcctgacgtcgggccagtaccctttgtaaagagcacggatccttcctccagttatttcgtcattctgaatagcgcagccttttttaaagtaggctctcagctggaagtgctagtgcacgtgcaggattttcagcgcaaaccaaagaagtacgggggagactacctgcaggcaagaattcattcgctgaagttgcaggccggagccgtggggagagtcgtcgattaccagaacggattttataaggtcttctttactctcctgtggcctggcaaagtgaaggtgtccgtgtccctggtgcatcccagtgaaggtattcgtgtgcttcagcgactgcaggaggataagcctgaccgggtctatttcaaatctctcttcagatcagggcgtatttccgaaaccacggaatgcaacgtctgtttgcccggaaaccttcctctgtgtaacttcacagatttgtacactggagagccgtggttttgcttcaaaccgaaaaagctaccttgcagttctcggattacccatttcaagggcggatatctcaaggggctcctgacggccgcagaaagcgcctttttccagtccggagtaaacataaaaatgccagtgaacagctccggcccagactgggtgacagtcattccaaggcgcattaaagagaccaatagtctcgagctctcgcagggatccggaacctttcctagtgggtactactacaaggatcaatggcggcctcggaagtttaagatgcggcaattcaacgacccagataatattaccgagtgtctgcagaggaaggtggtacatctcttcggagattccactatcaggcaatggttcgagtacttgactacattcgtgccagaccttgtggaattcaaccttggatcacctaaaaacgtgggacccttcttggcagtggatcagaaacataacatactgctgaaatacaggtgtcacggccctccaattagatttaccacagtgttctcgaacgagctccactatgtagcaaatgaactgaatggcatcgtggggggtaagaatactgtagtggcaattgccgtgtggtcacacttctctaccttccctctggaggtttatattagacgactgcggaatatcagacgagctgtagtgagattgctggatcggtcgcccaagaccgtggttgtgattcgcaccgcgaacgctcaggaactcggacccgaggtgtcgctctttaatagcgactggtacaatttccagctggacactatactacggagaatgttttcaggcgttggtgtatatctcgtggacgcttgggagatgaccctggctcattaccttcctcacaagctgcacccagacgaggtgatagtgaagaaccagttagatatgtttctgagctttgtctgtcccctcgaaacttag

SEQ ID NO: 11222 - DNA, 8199 bp, Artificial Sequence
  Description of Artificial Sequence: Synthetic coding sequence
atggaacagacggattgcaaaccttaccagcctctgcccaaggtgaagcacgagatggacttggcatacacctcctcatccgatgagtcagaggacggcaggaagcccagacagtcttacaactcgcgcgagaccctgcacgaatacaaccaggagttacggatgaactacaattctcagtcacgcaagcgcaaggaggtggagaaaagcacacaagagatggaattctgcgaaacgagccatactctatgttcaggataccagaccgacatgcatagcgtgtcaagacacgggtatcagctggaaatgggatccgatgtggatactgagacagaaggtgctgcaagccctgaccatgccttaaggatgtggattagggggatgaaaagcgagcatagctcctgtttaagtagtcgtgcaaactccgcactgtcactgaccgataccgaccatgagcgcaagtcagacggggagaacggatttaaattcagccctgtgtgctgtgatatggaggcgcaggctggctccacacaagatgtgcagtcgagtccacataaccaattcacctttaggccccttccccctccccctccgccacctcacgcctgtacctgtgccaggaaaccgcctccagcggcagactctctgcaacggaggtctatgaccactagatctcaaccctcccccgctgccccagctcctccgacttcaacccaagatagcgtccacttgcacaactcatgggtcctgaattcaaacatccccttagagacaagacattttctctttaagcacggatccggcagttctgccatttttagcgccgcttctcagaactaccccctcacttcaaacacagtgtacagcccacctccccgtcctctaccaagaagcactttctctaggccggcattcacctttaacaagccttacagatgttgtaactggaagtgcactgccctatctgcgacagcaattacagtgacgctagccttgctgcttgcgtacgtaatcgctgtacacctgtttggactgacgtggcagcttcaaccagtcgagggcgagctgtatgccaacggggtgtcaaaaggcaacagagggacagaaagcatggataccacgtacagtcctatcgggggaaaggtttcagacaaaagtgaaaaaaaggtgttccagaaggggagagcaatcgacacaggggaggtggacatcggtgcacaggtaatgcagaccatccctcctggtctcttttggcgattccagattaccatccaccacccaatttacctcaagttcaacataagtctcgctaaggactccctgctgggcatctacggaaggcgcaatattccaccgactcacacgcagttcgattttgtaaagctgatggatgggaagcaacttgtaaagcaagacagcaaggggtctgatgatacacagcatagcccgaggaacctgatactcacgagcttacaggagacagggttcatcgagtatatggatcagggcccttggtaccttgctttctacaatgatggtaagaaaatggagcaggttttcgtcctcactaccgcaattgaaattatggacgattgttcgacgaattgtaacgggaacggcgagtgcatcagtggtcattgtcattgcttccccggttttctcggcccagattgtgctcgtgactcctgccctgtgctgtgcggaggtaatggggaatacgagaagggccattgcgtctgccgtcatggctggaaaggtcctgagtgcgatgtgccagaagaacagtgcatcgatccgacctgcttcggccatggcacatgtattatgggtgtctgcatctgcgtgccgggatataaaggagagatatgtgaagaagaggattgtcttgatccaatgtgctctaaccacggcatctgcgtcaagggagagtgccactgctcaactggttgggggggtgtaaattgtgagacgcccctgcccgtatgtcaagagcagtgtagcggtcacgggaccttcctgctggacgccggtgtgtgtagctgcgacccaaagtggacgggtagtgactgcagtaccgaattgtgtactatggaatgtggatcccacggggtctgtagccgtggaatctgtcagtgtgaggagggatgggttgggcctacgtgcgaggagcgctcttgtcacagtcactgtaccgagcacggccaatgtaaggacggaaaatgtgaatgtagtcccggttgggagggagaccactgcaccattgcccattacctcgatgcggttcgcgacggctgcccaggactgtgttttggcaacggacgctgtaccctcgatcagaacggttggcactgcgtgtgccaggtgggctggtccggtactggatgcaatgttgtcatggagatgctgtgcggcgacaacctcgacaacgacggcgacgggctgactgactgcgtggatccagactgttgccagcagtctaattgttatattagtcccttatgtcagggctctcccgacccactggatttaattcaacaatcccaaactctgttcagccagcacacctctaggctgttctacgataggattaagtttctgataggtaaagattccacacatgtaattcctcccgaggtcagtttcgactctcggagagcttgtgttattagaggccaggtcgtagcaattgacggaactcccctggtcggagtcaacgtgagtttcctgcaccattcagactacggatttacaatctctcgccaggatgggagctttgacctggtggcaattggcggtatttccgtgattttgatcttcgaccgcagccctttcctcccggagaagcggactctgtggctaccctggaaccaattcatcgttgtcgaaaaagttacgatgcaacgggtggtctctgatccgccttcttgcgacattagtaattttataagcccaaaccccatcgtactgcctagccctctcacgtccttcggcggttcgtgtccagaaagaggcacaattgttcccgagttgcaggtggtccaggaggagataccaattccatctagtttcgtgaggttgagttacctgagttctaggacgccaggatacaagaccctcttgcggatcttgttgacacattctactatccccgtcggcatgattaaagttcaccttaccgtcgctgtagagggcagattgactcagaaatggtttcctgctgccatcaacctggtgtatacattcgcatggaacaagaccgatatttatggacagaaggtgtggggcttagctgaggcgctggtaagcgtcgggtatgagtacgagacctgtccagactttatactctgggaacaacgcacggtcgtgttacaaggatttgagatggacgcaagcaaccttggagggtggagtctaaataagcatcatatactgaatccacagtcgggcatcattcacaagggcaacggcgagaacatgttcatctctcaacagccccctgtcattagcacgattatggggaatggccaccagagatcagttgcttgtactaactgcaatggcccagcccataacaataaactctttgcaccagtggcgcttgcaagtggcccagatgggtctgtgtacgttggggactttaactttgtccggaggatattcccatctgggaatagcgtatccattctggagctgagaaatcgtgacacaagacattccaccagtccagcacataagtactatctagctatggatcctgtgtctgagagtttgtacctttccgacactaacaccaggaaagtctataaattgaagagtttggttgagaccaaggacctgtcaaagaacttcgaagtggtagccggtaccggggaccagtgcttgccgttcgaccagagtcattgtggtgacggcggtagagcttctgaagcttctctgaattcaccaagaggcattactgtcgacaggcatggttttatatactttgtggatggcaccatgattcgcaaaatagatgaaaacgctgtgataactactgtcattggatcaaatggccttacgagcactcaacctctgtcttgcgactcggggatggacataactcaagtcaggctggagtggccaactgatttagccgtaaatcctatggacaacagcttgtatgtcctggataataacatagtattgcaaatctcagagaaccggagagtgcgcatcatcgccggacgccctatccactgccaggtcccagggatcgatcactttcttgtttccaaagtcgcaatccatagcacactggagtcggcccgagcaatctcggtaagccactctggccttttattcatcgccgagaccgacgagcggaaagttaatcgcattcagcaggtgaccactaatggtgagatttatatcattgccggagcccctaccgactgtgactgtaaaatcgaccccaactgtgactgcttttcaggggacggtggctatgccaaggatgccaagatgaaggccccaagctcccttgctgtgtcccctgatggcaccctctatgtcgccgacctggggaatgtccggatccggactatctctcggaaccaggcacacctaaacgacatgaatatctacgagattgcttcaccagcagatcaggagttataccagttcactgtgaacggcactcacctccacacgttgaacctgataacaagagattacgtttataattttacttataatagcgagggggatcttggggctatcacctcttcaaacgggaacagtgtgcatattagacgagacgctggcggaatgcctctgtggctcgtggtgccaggagggcaggtctattggctcactatctcctccaacggggtcctaaagcgtgttagcgcccagggatataacctagctctcatgacgtatccaggaaatactggcctgttggccacgaaatccaatgagaatggttggacgactgtctatgagtatgatccagaaggacacttaacgaatgcaacattcccgacaggagaggtgtcgagttttcactctgacctggagaaacttactaaggttgaactcgatacaagtaatcgtgagaacgtcctaatgtccaccaaccttactgctacttcaactatctacatcctcaaacaggagaatacccagtctacgtacagagtgaatcccgacgggtccctcagagtaacgtttgcctccggcatggaaatcgggctgagctcagagccgcacattttggccggtgcagttaaccctacactggggaaatgcaacatcagcctgccaggagaacacaatgctaatctgatcgaatggagacagcgcaaggagcagaacaaaggaaacgtgagtgcgtttgagcgaagactccgcgcacacaatagaaatctgctgagtatcgacttcgaccacatcacccggacaggtaaaatttatgacgaccaccggaagttcaccttgcggattctctacgaccagactggaagaccaatactgtggtcacccgtttctcggtacaacgaggtgaatatcacctactcaccaagcggcctcgttacctttatccaaagaggtacttggaatgagaagatggagtatgatcagtccggaaagatcatatctcgaacttgggcggatggaaagatttggagctacacatacttggagaaaagcgttatgctgttgctgcattctcagaggaggtacatctttgagtatgatcagccagactgccttctgtcggttactatgccgtctatggtgcggcatagtcttcagaccatgctgtccgtgggctactatcgcaacatttataccccacccgactccagtactagttttattcaggattatagtcgggatgggaggctactgcagacactgcatctcgggacgggaagacgtgtattgtataagtatacaaaacaggcaaggttatccgaggtcctctatgacaccacccaggtaactttgacttatgaggaatctagcggagttataaaaacaatccacctcatgcacgacggcttcatatgcaccattagatatcgccaaactggcccacttatcggtcgccagattttccgcttttctgaagagggtctagttaatgcccgattcgactattcctataataatttcagggtgacctctatgcaggccgtgatcaatgagacacctctacctattgacctctataggtacgtggacgtatccggacgcacagaacaatttgggaaattctctgtgattaattacgacctcaaccaggtgatcaccacaaccgtcatgaagcacactaaaattttcagtgccaatggccaagtgatcgaggtccagtatgagatccttaaagcaattgcctattggatgacaatccagtacgacaacgtgggcagaatggtgatttgcgacatccgagttggggtggatgcaaacataaccaggtacttctacgaatatgatgctgatggccaactgcagacggtatccgtcaatgataagacacagtggcgctacagttacgatctgaacggaaacattaaccttttatcacacggcaagtccgccaggctgacacccctccggtacgatttgcgtgacagaatcacgcgtctgggagagattcagtacaaaatggacgaagatggattcctgcggcagaggggcaatgatattttcgaatataattccaatggcctactgcagaaagcctacaataaggcatctgggtggacagtacaatactactatgacggactgggtcgccgagtcgcgtcaaaatcaagcttggggcagcatctacagttcttctatgctgacctgactaatccaatccgggtgacacatctctacaatcacacttctagcgagattacttcgctgtactacgatttgcaaggccacctgatagctatggaactgagttcgggggaagaatactacgtggcgtgtgataatacaggcacccccctggccgtcttcagcagcagggggcaggttattaaagaaatcctttacacgccatatggggacatctatcacgatacctaccctgatttccaggtgattatcggcttccatggcggtctatatgactttctgacaaagctggtgcacctggggcagcgcgactatgacgtggtggctggtcggtggactactcccaaccatcacatctggaaacagcttaatctgctgcccaaaccctttaatctgtactcctttgagaataactaccctgtgggtaaaatccaagacgttgcaaagtacactactgatatcagaagttggttggagttgttcgggttccagttgcacaatgttcttccgggatttccaaagccagagctggagaatctggagctgacctatgaactgctcagactccaaacaaagacccaggaatgggaccccggaaagacgattctgggaattcagtgcgaacttcagaagcagctgcggaatttcataagcctggaccagttgcctatgactccaaggtacaacgacggcaggtgcctggaagggggaaaacagcctcgctttgctgctgtccctagcgtgttcggtaagggcattaaatttgctattaaggacgggatagtgactgccgatatcatcggtgtcgccaacgaggactcccggaggctggccgcaatcctgaataatgcccattacctagagaatctccacttcactatcgaaggaagagacacccactacttcatcaaactgggatctctcgaggaggacctggtgctgatagggaatactggagggagacgtatcctcgaaaatggcgtgaacgtgacggtgtctcaaatgacttcagtacttaatgggaggacacgcaggttcgcggacattcagctgcagcatggggcactgtgcttcaatatcaggtacggcacgactgtagaggaggaaaaaaaccacgtactcgagattgcacgccagcgagcagtagcccaggcatggaccaaagaacagaggcgcctgcaggaaggcgaggaaggcatccgcgcatggacagagggagaaaagcaacagctgctgtccactggcagggtccaggggtatgacggctattttgtgttgagcgtagagcaatacctggagttaagcgacagcgctaacaacatccactttatgcgacagagcgaaatcggcagaagatag

SEQ ID NO: 11223 - DNA, 264 bp, Artificial Sequence
  Description of Artificial Sequence: Synthetic coding sequence
atgaaagtgctgctgctgaccggcctgggcgcactgtttttcgcttattattgggatgacaattttgaccctgcctctctacagggggcacgggtgctgctcactggcgctaatgccggagtaggggaagaacttgcttaccactatgcgcgactcggcagccatctggtactcacagctcatactgaggccctgctccaaaaagcacgctggctgaccctcgtcgtttctacacttggcggaaggggaaagtggatcacatag

SEQ ID NO: 11224 - DNA, 1233 bp, Artificial Sequence
  Description of Artificial Sequence: Synthetic coding sequence
atgcgcgcttgtatttcgctcgtgctagctgtattgtgtggcttagcctgggctggtaaaatcgagagctgcgccagcaggtgtaacgaaaagtttaatagggacgctgcatgtcagtgcgatcggcgttgtttgtggcatgggaattgctgtgaggattatgagcacttgtgtacagaggaccataaagagagcgagcccttgcctcagctggaggaagaaacagaagaggcgctggctagcaacctgtatagtgcccctacaagctgtcaaggtagatgctatgaagcttttgacaaacaccatcagtgtcattgcaatgccagatgccaggagtttggtaactgctgtaaggattttgagtccctctgtagcgaccatgaagtatcacatagctctgatgccattaccaaagaagagatccagagcatttcagagaaaatctacagagccgatacaaataaagcccaaaaggaagatattgtgttgaacagtcaaaactgcatctccccatccgagactcggaaccaagtggataggtgccctaaacccctattcacttacgtcaatgaaaagcttttctccaaaccaacatacgctgcatttatcaatctgttgaacaattaccagcgtgcaacggggcatggggaacatttctccgcccaggagctggccgaacaggacgcttttctgagagagattatgaagaccgccgtgatgaaggaactctatagctttttacatcatcagaatcgttacgggtcggagcaagagttcgtggacgatctcaaaaatatgtggtttgggttgtacagccgtggcaatgaagagggggatagcagcggcttcgagcatgtgttcagtggtgaggtgaagaagggaaaggtgactgggtttcacaattggatcaggttctatcttgaggagaaggagggtctagtggactactactcccacatctacgatggaccttgggatagttatcctgatgtcctggccatgcagtttaactgggatggctattacaaggaggtaggatctgctttcatagggagttcacccgagttcgagtttgccttgtacagcctctgtttcatcgccagaccaggcaaagtgtgtcaattatccctggggggttatccactcgcggttcgtacatatacctgggacaaaagtacctatggcaatggaaagaagtacatcgcaaccgcgtacatcgttagtagcacctag

SEQ ID NO: 11225 - DNA, 351 bp, Artificial Sequence
  Description of Artificial Sequence: Synthetic coding sequence
atggccgcaggatccgccccaatgcaattgcatctccgcgcaaccatccgaatgaaggatggtctgtgtgtgccaagaaagtggatctatcacttgactgagggatcgaccgacctacgcacagagggacggcctgacatgaaaactgaactgttttcaagcagttgccccggtggcatcatgctgaatgagaccggtcaaggctaccagagatttctcctatacaaccgttcgcctcatcctcccgaaaagtgcgtggaggagtttaagtcattaacgagctgcttggactctaaggcgttcctcctgacgccaaggaatcaagaagcatgcgaactgagcaacaactag

SEQ ID NO: 11226 - DNA, 1200 bp, Artificial Sequence
  Description of Artificial Sequence: Synthetic coding sequence
atgtccgcccgaggcaggtgggaagggggaggacgacgcgcttgtaggggctcactcggactggccagagcacagggggctgagcgagtaaccagctctgaacaacggcctgctatggccagcttaggcctgctgttactgctccttttaaccgctttgccacccttatggtcctcatccctcccaggactggatacagcggagtccaaggcaactatcgcggatctgattctctccgctctcgaacgggctacagtattcctggagcagagactccccgaaattaacctggatgggatggtgggtgtgcgcgtccttgaggagcagttaaagtccgttcgtgaaaaatgggcccaggaacccttgcttcagccactctctctccgggttggtatgctcggcgaaaaattggaagctgcgatccagcgatctctccactacctgaaactttcagatcccaagtacctccgggagtttcagttgacactgcagcctgggttttggaaactcccacacgcctggattcacaccgatgcttctctggtatacccaacgttcgggcctcaggacagctttagcgaagagcgctctgacgtttgtctggttcagttgttgggtacagggaccgattcgagtgaaccatgtggtctatctgatctttgccgctctctgatgacaaaaccagggtgttccggctactgcttatcccatcagcttctgtttttcctgtgggccagaatgagggggtgcactcagggccctctgcagcagtcacaggattatattaaccttttttgcgccaacatgatggacctgaaccgcagggctgaagccatagggtatgcatacccaactagagacatctttatggagaacattatgttttgcggaatgggaggtttcagcgacttttataaactgaggtggctggaagccatcctctcctggcagaaacagcaggaggggtgttttggcgagccagatgctgaggacgaggaactgtctaaagctattcagtaccagcagcacttcagcagaagggtgaagagacgagaaaagcagtttccggacggctgtagctcacacaacactgctacagccgttgccgctctgggtggatttttatacatcctggctgagtaccctccagccaatagggagccgcatccaagcacacccccaccaccaagctccaggtag

SEQ ID NO: 11227 - DNA, 510 bp, Artificial Sequence
  Description of Artificial Sequence: Synthetic coding sequence
atgctgagttcggtggtgttctggggcttgatagctctcattgggacttcccgtgggtcttacccgttttcccactctatgaaacctcatttgcaccctcgcctgtaccacgggtgttacggcgacataatgacaatgaagacgagtggggctacttgcgacgccaattcagttatgaattgcggcatcagaggctcggagatgttcgctgaaatggacttgcgcgctatcaaaccctaccaaactctgatcaaagaggtgggacaacgccactgtgtggatccagctgtgattgccgcaataatcagcagagaatcccatggagggagcgtactgcaagatggctgggatcatcggggtcttaaatttggcttaatgcaactggataagcagacgtaccatcctgtgggggcatgggacagcaaggagcacctgtcccaagccaccgggatcctgactgaaaggatcaaagcaatccagaagaagttccctacttggagcgtggcttag

SEQ ID NO: 11228 - DNA, 300 bp, Artificial Sequence
  Description of Artificial Sequence: Synthetic coding sequence
atggaacgtattagcgcttttttcagtagcatatgggacaccatcctgaccaaacaccaggaagggatttacaataccatttgccttggagtcttgttaggtttgcctttgctggtgattatcaccctgctcttcatttgctgccactgttgctggagccccccaggcaaaagaggacagcaacccgaaaagaacaagaagaagaagaaaaaaaagaaaaaaaaagatgaagaggatctgtggatttcagcccagccaaaattgttgcagatggagaagcgtccctcactcccagtttag

SEQ ID NO: 11229 - DNA, 468 bp, Artificial Sequence
  Description of Artificial Sequence: Synthetic coding sequence
atgactagtctcaagtgcggagaaaatttgtacatgtcatcagcctcctctagctggtctcaggccatccagtcctggttcgatgagtacaatgactttgactttggagtggggcctaagaccccaaacgccgtcgttggacactacacgcaagtggtgtggtacagcagctaccttgtggggtgtggcaatgcctattgcccaaatcagaaggtgttgaagtactactatgtgtgccagtattgtcctgctggcaattgggccaacagactgtatgtgccttacgaacagggcgctccctgtgccagctgccccgataattgcgatgatgggctgtgcacaaacgggtgtaagtatgaagatctgtactctaattgcaaatcgctcaagttgactcttacctgtaagcaccagcttgtacgggactcatgcaaggccagctgcaactgttctaacagcatatactag

SEQ ID NO: 11230 - DNA, 2886 bp, Artificial Sequence
  Description of Artificial Sequence: Synthetic coding sequence
atgttgttgctgctactgctcgctcccctctttctccggcctcctggcgctgggggagcccaaactccgaatgccacatcggaggggtgtcagatcatccatcctccatgggaagggggtatcaggtataggggactaacccgtgaccaggttaaagccatcaattttctaccggtcgattacgaaatcgagtacgtgtgtcgaggggaaagggaggtagtgggccctaaggtaagaaagtgcctcgccaacgggagctggaccgatatggacacaccatctagatgtgtgagaatctgcagtaagagctatctgaccctcgagaacgggaaggtgttcctgaccggcggagacctgccagctttggatggagcaagggtggattttagatgcgatcctgatttccatctcgtggggtcctctaggtctatctgtagccagggccagtggagtacaccgaagccccattgccaggtgaaccgaacaccccacagcgaacgccgtgccgtctacatcggggctctgttccccatgtcgggcggttggccagggggtcaggcctgtcaacctgccgtggaaatggcattagaggacgtaaactccaggagagatatactccccgattacgagctaaaactaatacaccacgactccaaatgcgaccccggacaggccactaagtatttgtatgagctcttatataacgatcctatcaaaatcatcctcatgcctggatgttcaagcgtatctaccctcgtcgccgaggccgctaggatgtggaacctcattgtacttagctatggcagctcatcccccgcattgtcaaatcggcagaggtttcctacctttttccgcacgcatccttccgcgacactgcacaaccctacccgtgtgaagctctttgagaaatgggggtggaagaagatcgcaacaattcagcagacaaccgaggtgttcacctctacgttggacgatcttgaagaacgcgtcaaggaggcaggcatagagatcactttcagacagagctttttctctgatcccgcagtacctgtgaagaacctcaagcgccaggacgccaggattatcgtaggcttgttctacgagacagaagcacggaaagtcttctgtgaagtctataaagaacgcctcttcggcaaaaagtatgtatggtttttaatcgggtggtacgcggataattggtttaagatctatgatccatcgataaattgtactgtggatgaaatgactgaggctgtggagggacacatcacaaccgaaattgtcatgctgaaccccgctaatacccgatctatatctaacatgacaagtcaggaatttgtagagaagctaacgaagcggctcaagcggcatccagaagagactggtgggtttcaggaagcccctctcgcttacgatgcaatttgggccctggcactcgcgctaaataaaacttcaggcggtggaggacgtagcggtgttagactggaagacttcaactacaacaaccagactattactgatcagatttaccgggctatgaattcatcctcattcgagggggtgtcaggccacgttgtctttgacgcaagcggttcgcgcatggcctggacactgatagagcagctgcagggtgggagctacaaaaaaatcggttactacgacagcaccaaagacgacctgtcctggtccaagacagataaatggattgggggaagcccaccggcagatcagaccctcgtgatcaaaacctttaggttcttgagccagaagctcttcatttctgtttctgtgctgtcaagcctgggcatcgtgctcgccgtggtctgtctctcctttaacatctacaatagtcacgtcagatacatccagaatagtcaacccaatctgaacaatctgacagctgtaggttgttcccttgctctggccgcagtgtttcctctagggctagatggataccacatcgggcgtaaccagttcccctttgtctgtcaggctagactgtggctgctgggactgggattctctctggggtacggctcgatgttcactaagatctggtgggtccatacagtcttcacaaaaaaagaagagaagaaagaatggagaaaaactttagagccatggaaactgtacgcaacagtcggcctacttgtcggtatggatgttctgacactcgccatttggcagattgtggatccactgcacagaactatcgaaacatttgcaaaagaggagcctaaggaagacattgatgtcagcatacttccccagctcgagcactgtagcagtcggaagatgaatacttggctgggtatcttctacggatataaagggctcctgttgctactaggcatcttcctcgcttatgaaacaaaaagcgtcagtacggaaaagattaacgatcatagagccgtggggatggccatatataatgtcgccgtcttgtgcctgataacagccccagtgaccatgatcttgtcctcgcagcaggacgctgcttttgcattcgcctccctcgccattgtttttagttcctatatcaccctcgttgtgttgttcgtgcccaaaatgcgacggcttatcaccagaggcgaatggcaatcagaagctcaggacaccatgaagactggatcttcaaccaataataacgaagaggagaagtcacggctgctggagaaggaaaaccgagagctggaaaagattatcgccgaaaaggaagaaagggtgagcgaacttcgacatcaattgcagtcaagacagcagcttcgctcacggcgacatccaccgaccccgcctgagccgagtggtgggctccctcggggtccacctgaaccccctgaccggctatcttgcgatggatcacgggtccatctgctctacaaatag

SEQ ID NO: 11231 - DNA, 444 bp, Artificial Sequence
  Description of Artificial Sequence: Synthetic coding sequence
atggccggaccctggacatttactctcctttgcgggttgctggccgcaaccctcatccaagccactctgtctccaactgccgtgcttatccttggaccgaaagttatcaaggaaaagctgactcaggaactgaaagaccataatgccacgtccatcctacagcagctgcccctgctttccgcaatgagagagaagcccgctggaggaatccccgtcctcgggtccctggtgaatactgtgcttaagcacataatttggcttaaagtgatcacagccaatatactgcagcttcaggttaaaccctcagctaacgatcaggagcttctggtgaagattcctttagacatggtcgccggatttaacacccctctcgtaaaaacgattgtggagtttcatatgactactgaagcccaggctactattagaatggataccagcgcctag

SEQ ID NO: 11232 - DNA, 948 bp, Artificial Sequence
  Description of Artificial Sequence: Synthetic coding sequence
atgaaggtgctcctgttgacaggactgggcgctttgttcttcgcctattactgggatgacaactttgacccagcctctttgcagggtgctcgggtattgttaacgggagctaatgctggcgtaggagaggaactggcctaccactacgccaggctgggtagccacctggtcctgactgcacacacggaagccctgctgcagaaagtcgtgggcaactgcagaaagctgggggctccaaaggtgttttacatcgcggctgacatggcatcacccgaagctccagagtctgtagtacagttcgctctggataaactgggtggtttagattatctggtgcttaaccacatcggaggagccccagccggtaccagagccagaagccctcaggcaacacggtggctgatgcaggtgaattttgtgtcttatgtacagttgacttccagggcactcccctctttgactgactccaaaggttcgctggtcgtggtctccagcttgctggggcgagtgccgacttccttcagcaccccatattccgccgctaagtttgcattggacggcttcttcggaagtttgagaagagaattggatgtgcaggatgtgaacgtggctattaccatgtgcgtcctcggtctcagggacagagcctcagccgcagaagctgttcggagcagcacttcccgacctaggcagcccgagcacagaggagttcctctgcagtctcagactgctatgttccttccaccgactgtacccggagctaggaccttgacggagacacccctccgcggatggccccagcccaagatgaaatcatcacggcagaagagcaaaaccgagaagaacgacggccatctggagccggtcacggcctgggaggtgcaggtgcctagagttcgccgactgtgccggggactggctcgtcctcatctgttcggccatgactag

SEQ ID NO: 11233 - DNA, 285 bp, Artificial Sequence
  Description of Artificial Sequence: Synthetic coding sequence
atgcagcacagtctggtcttcttcttcgccgtgatccttcatctgtcacacctcctccaccttgatgcttctattcatcccttccggttgcccttttctagcaagcctttcctactgattcccatgtctaacacaaccctaccccacacagcttggcctctgagttttctacaccagaccgtgagcaccttgaaagctgtggccgttacccacagcctgtggcacctccaaattccagtcgactgtcaggcctgtaatagaaagtcgaaaaagatctactgttag

SEQ ID NO: 11234 - DNA, 783 bp, Artificial Sequence
  Description of Artificial Sequence: Synthetic coding sequence
atggaaaaatttaacaccatcagcgtgtccaagtgcaataaggagaccgttgccatgaaggagaagtgtaagttcggaatgacatccacaatccctagtggacatgtgtggcggaacacatggaaccctgttagttgcagcctcgctaccgtcaagatgaaggaatgtctgagaggaaaattaatctatctgatgggcgatagcactatcaggcagtggatggaatatttcaaagctagcattaacactctgaaatccgttgatcttcatgagagcgggaaactccagcatcagttggccgtggacctggaccgaaacattaatatccaatggcagaagtattgttatccattgatcggcagcatgacctactcagtcaaggagatggagtatttgacaagagcaatagatagaaccggaggcgaaaaaaataccgtgatagtcatttctctcggacaacactttcgaccattccccatcgatgtatttatccgaagggcgctgaacgttcacaaggccatccagcacctgctgctgcgaagccccgacaccatggtcatcatcaaaacagaaaacatccgtgagatgtataatgacgcggagaggttcagcgacttccacggttatatccagtatttaatcataaaagatatctttcaggaccttagtgtttcaatcatcgacgcttgggacattaccattgcatacggaacaaacaacgttcatcctccgcaacatgtcgtaggtaatcagatcaatatccttttgaattatatctgttag

SEQ ID NO: 11235 - DNA, 1644 bp, Artificial Sequence
  Description of Artificial Sequence: Synthetic coding sequence
atgtcctccaacacgatgcttcagaagacattgctgatccttattagcttctccgttgtcacttggatgatctttataatcagccagaacttcaccaagctgtggtccgccctcaacctgagtatcagcgtgcactactggaacaattcggcaaaatccctcttccctaagacctcccttattcccctcaaaccactgactgaaactgagctgcgtattaaggaaataatcgaaaagcttgatcagcagataccccctcgcccttttacccatgttaacacaaccactagtgccacacactctaccgcgactattctgaatcctcgggacacctactgtcgcggagaccagttagatattctattggaggttcgggaccaccttggccagagaaaacaatatggaggcgacttcctacgagccagaatgtcatctcctgcgctgaccgcaggtgcgagcggcaaagtgatggacttcaacaatgggacctaccttgtctcctttacactgttctgggaaggacaggtgtcactaagtctgctgctgatccacccttccgagggcgcttccgccctttggagagcaaggaaccagggctacgataagataatattcaagggaaaatttgtgaacggtactagtcacgtttttacagagtgcggcctgactttaaacagcaatgcagaactgtgcgagtacttggacgatcgcgatcaggaggcgttctattgcatgaaacctcagcatatgccctgcgaggctctcacctacatgaccacccgcaaccgagaagtgtcctacctgactgataaggagaatagtctattccaccgcagtaaggttggtgtcgaaatgatgaaagataggaagcacattgacgtgaccaactgtaacaagagggagaagattgaggagacttgtcaggtcgggatgaagccacctgtgcctgggggatacactctgcagggtaaatggataaccacattctgtaaccaagtgcagctggacactatcaaaatcaatgggtgtctgaagggcaagctcatctacttattgggcgactctaccctgcgccaatggatttactacttccccaaagtggtaaagactttgaagtttttcgatctgcatgagaccgggattttcaaaaagcatctgttgctggacgccgagcggcatactcagattcagtggaaaaaacattcctatccctttgttacttttcaactctacagtttgattgaccacgattacataccacgcgaaattgacaggctgtctggtgacaagaacaccgccatcgtgattacattcggacagcattttagaccctttccgatagatatttttatcaggcgtgccatcggagtgcaaaaagccatcgagaggttgttccttaggtcccccgctactaaagtgattatcaagactgagaatatacgggagatgcacattgaaactgagaggtttggcgactttcacggctacattcactacttgattatgaaagatatctttaaggatctgaacgtgggaatcattgacgcttgggatatgactatcgcatacgggactgataccattcaccctcctgaccacgtcatcggaaaccagatcaacatgttcttaaattatatttgctag

SEQ ID NO: 11236 - DNA, 399 bp, Artificial Sequence
  Description of Artificial Sequence: Synthetic coding sequence
atgctaatgttattcgtgtttggtgtcctcttgcatgaggtgtccttaagtgggcagaacgaagccccaccaaacacacattctatccctggtgagccgctctacaattatgcttcaatccgtttgccggaggaacacattcctttttttttgcacaacaatcggcacattgccaccgtctgccggaaggacagtctgtgtccctacaagaaacatctggaaaaactgaagtattgctggggctacgagaaatcctgtaagcctgaattccgcttcgggtacccggtctgcagctacgtggacatgggctggaccgacaccctcgagtcagcggaggacatattctggaagcaagccgattttgggtatgcaagggaaaggctcgaggagatgcattag

SEQ ID NO: 11237 - DNA, 861 bp, Artificial Sequence
  Description of Artificial Sequence: Synthetic coding sequence
atgggctccgccctatttgttaaaaaagagctgcagctacaggcaaattttctggggaacgtgaaaagactatatgaagccgaagtgttcagtaccgacttttctaaccccagcattgctcaagcccgtataaactcgcatgtcaagaagaagactcaggggaaggtggttgacataatccagggcctagatctccttactgcaatggtgttggtaaaccatatcttttttaaggcgaagtgggagaagcctttccatcctgagtacacgcgcaagaattttccatttcttgtcggcgaacaggtgacagtgcatgttccaatgatgcatcagaaggagcaatttgcattcggggtcgacactgaactgaattgttttgttctgcagatggactataaaggagatgcggttgccttcttcgtactgccttctaaaggcaagatgcggcagttggagcaagcactgagcgctaggactctgcgcaagtggtcacactctctacagaaacgctggattgaggttttcatcccccgtttttcaattagcgccagctataacctggaaaccatcctccccaagatgggaattcagaacgtgtttgacaagaatgccgatttttcaggcatcgccaagcgagactctctccaggtttccaaggctacacataaggccgtcttggacgtttcggaggagggaactgaagccacagccgcaacaaccacaaaattcatcgtgcggagtaaggacggaccaagctatttcactgtctccttcaaccggacctttctgatgatgattaccaacaaggccaccgacggaatactgttcttgggaaaggtagagaaccctaccaaaagctag

SEQ ID NO: 11238 - DNA, 60 bp, Artificial Sequence
  Description of Artificial Sequence: Synthetic coding sequence
atggggtggctgacgcgcattgtgtgcctgttctggggtgttctgctgactgcccgatag

SEQ ID NO: 11239 - DNA, 1197 bp, Artificial Sequence
  Description of Artificial Sequence: Synthetic coding sequence
atgaagtttcaaggccctctagcatgcctgcttctggcactttgcctgggatctggagaagctgggccacttcagtccggcgaagagagcacagggacaaatatcggggaagccctggggcacggactcggcgacgcactctctgaaggggttggcaaagctataggaaaagaagctggaggcgctgctggaagtaaagtatccgaggccctggggcaggggactcgagaagcggtagggacgggtgtgagacaggtgccaggcttcggcgtcgccgatgctttgggcaatagggtgggggaggcagcacacgcactgggcaacaccggccatgagatcggtcgtcaggccgaagacgtgatccgacatggcgcagatgcggttcgcggttcctggcagggggtcccgggtcacaacggcgcttgggaaacttccggcggacacgggattttcggatcccaaggaggccttggtggacagggacaaggtaacccagggggactggggaccccttgggttcatggctatcccggtaatagcgccggatcctttggtatgaacccacagggagccccttggggccaaggaggtaatggcggaccacccaactttggaacgaatacacagggagctgttgctcagcctggctatgggagtgtgcgggctagtaatcagaacgaaggttgcaccaacccgcctccaagcggatctggaggcggttcctcaaacagcggcggagggagtggctcccagagtggatcttctgggagcggaagcaatggtgacaataacaacggcagcagctcagggggatcttcttctgggtcctcatcagggggatcctccggcggtagctctggcggatcctccggaaatagcggtggtagtagaggtgattccgggtccgagagcagttggggcagctcaacaggatcttcttcaggtaaccacggcggaagcggaggaggtaacggccataaaccaggatgtgaaaaacctggcaatgaggctaggggatctggcgaaagtgggatacagggctttagaggtcagggtgtgagctcaaacatgagaaattcagagacgtctcctggcatgtttaatttcgacacattctggaaaaactttaaatccaagctgggcttcattaactgggacgctattaataaagaccaaaggtccagccgaatcccttag

SEQ ID NO: 11240 - DNA, 81 bp, Artificial Sequence
  Description of Artificial Sequence: Synthetic coding sequence
atggctccaaaaaagttgagttgcctcaggtcgcttctcctgcccctgtccctgacattgctgctcccacaggccgattag

SEQ ID NO: 11241 - DNA, 696 bp, Artificial Sequence
  Description of Artificial Sequence: Synthetic coding sequence
atggctcagctgtttctcccccttcttgctgccctggtcctggctcaggctccagccgcactggctgatgtgctcgaaggcgattcaagtggaatctacagatgtgaagtgcagcacggtatagacgattccagcgatgcagtggaggtgaaagtgaagggcgtggtattcctgtatagagaaggtagtgccagatacgccttcagcttctctggtgcacaggaggcttgtgcaagaatcggggctcatatcgccactcctgagcagctctacgccgcttacttgggaggttatgaacagtgcgatgccggatggcttagcgatcagaccgttagatatcccattcagacacctagggaggcctgttatggcgacatggacggcttcccgggtgtgcgcaactacggtgtagtggaccccgacgacctgtatgacgtttactgttacgctgaggacctcaatggagagttgtttctgggagaccctcctgagaagttaaccctcgaagaagcccgagcttattgccaagagagaggggctgaaatagcgactaccggccaactttacgcagcctgggatggtggtctggatcactgctccccaggttggcttgcggatggttctgtgcgttatcctatcgttaccccgtcacaacggtgcggtggcggtctccctggtgtgaaaacattattctag

SEQ ID NO: 11242 - DNA, 600 bp, Artificial Sequence
  Description of Artificial Sequence: Synthetic coding sequence
atggacgagctgctgcctctgatccccgttctagaacaatacaagacagacgctaagctgattacacagttcaaagaggagatcaggaacctatctgctgtgcttaccgggatacaagaagaaatcggcgcatatgactacgaggaactgcatcagcgggtgctgtctctcgagacgaggctcagagactgtatgaaaaaactgacctgcggcaagctgatgaaaattactgggcctgtcaccgttaaaacttctggaaccaggtttggggcatggatgactgacccgcttgcatccgagaaaaacaatcgcgtgtggtatatggactcttacaccaataataagattgtcagagaatacaaatccattgctgattttgttagcggcgcagaatctaggacctataacctcccctttaagtgggctggtacaaatcatgtggtctacaacggctcactgtattttaataagtatcagtctaacatcataattaaatactcattcgacatgggtcgcgttctggcccagagaagtctggagtacgctgggttccataacgtgacccccacgcacggagtggactcactaacttctacctag

SEQ ID NO: 11243 - DNA, 609 bp, Artificial Sequence
  Description of Artificial Sequence: Synthetic coding sequence
atggccgatatgcagaacctagttgagaggctggagcgggctgtgggcaggttggaggcagtatcccacacaagcgacatgcacagggggtacgcagatagtcccagtaaggctggggctgctccctacgtgcaggcgttcgatagcctgctggcagggcctgtcgccgaatacttaaaaatatctaaggaaattgggggagatgtccagaaacacgccgagatggtccacacaggtctgaagctggaacgcgctctcctcgtgacagctagtcagtgtcagcagcccgcagaaaataaactgtccgacctcctggcgcctatttccgagcagataaaagaggtaatcacattccgggagaaaaacaggggcagtaaactttttaatcacctgagcgctgtgagcgaatctatccaggcactaggctgggtcgcgatggcccctaaacccggtccttatgttaaagaaatgaatgatgccgcaatgttttatacaaacagagtgttgaaggagtacaaagacgtcgataagaagcacgtcgattgggtgaaagcttacttgagcatctggactgagctgcaggcttacatcaaagaattccatacctag

SEQ ID NO: 11244 - DNA, 2886 bp, Artificial Sequence
  Description of Artificial Sequence: Synthetic coding sequence
atgctcttactattgctgctggcaccgctttttctgagacccccaggagctggcggagcgcagactcccaatgctacctcagagggatgtcagattattcacccaccctgggaaggcggaatcagatacaggggccttactagagaccaagtaaaggccatcaatttcctgcctgtagactatgagatcgagtatgtgtgcaggggggagagggaggtggtgggcccaaaagtgcggaagtgtctagccaacggatcatggaccgatatggacactccgtctcgctgcgtgaggatctgcagcaagagctatctgactcttgaaaacggtaaggtgttcctcaccggcggagatttgcctgctttggacggagccagagtggacttccgatgcgatcctgactttcatcttgtaggatcctcgcggtccatctgcagtcaagggcagtggagcacacccaagccccactgccaggtgaacaggactccacatagcgaacggagagcggtctatatcggggcactgtttcctatgtccgggggatggcctggtggacaagcctgtcagcccgcagtcgagatggcgctggaggatgtaaacagcaggcgcgacatcctccccgattacgagttgaagctgatccatcacgacagtaaatgcgatcctggacaggcgacgaaatatctttatgaactgctatacaacgacccgataaagattatcctgatgcccggatgttcatcagtgtccactttggtcgcagaggcagcacgcatgtggaacctcattgtcttgagctacggctcctcctccccggctctgtctaatcgacaaaggttccctactttttttcgcacacacccatctgcaacccttcacaaccctacaagagtcaaactctttgagaagtggggttggaaaaagatcgctaccatccagcagaccaccgaggtgtttacctctacgctcgatgacttagaggaacgcgttaaggaggccggaatcgagatcacatttcggcagagtttcttcagcgaccctgctgttcctgttaaaaacttaaaacgccaggacgcaaggataatagtgggactgttttacgagactgaagcacgaaaagtgttttgtgaagtatataaagaacggctgttcggcaaaaagtatgtgtggttcctcatcgggtggtacgccgataattggtttaagatctatgacccatccatcaattgtaccgtggatgagatgactgaggccgttgagggccacataaccacggagattgttatgttaaaccccgcaaatactagatccatcagcaacatgacaagtcaggagttcgtggagaaattgaccaagcgattaaaacgccaccccgaagagactggaggtttccaagaggccccactggcgtatgacgctatatgggcattagcactcgccttgaacaaaacctccggcggtgggggtcgaagcggcgtcaggctcgaggattttaattataacaatcaaaccatcactgatcagatctatagggctatgaactcttccagctttgaaggtgtgtcaggtcacgtggtgttcgatgcgtccgggtcccggatggcatggactctaattgagcaactacagggagggtcctataaaaagatagggtattatgattccacaaaggatgacctgtcctggagtaagacagataaatggatcggagggagtcctcccgcagatcagacactcgtgatcaagactttccgctttctgagtcaaaagctttttataagtgtctctgttttatcatcactgggcatagtcctcgcggtggtgtgtctgtcgttcaacatttataattcacacgtgagatatattcagaattcccaacctaatcttaacaacctgactgcagtcggatgtagcctagcattggccgctgtctttccactgggcttagatggctaccacatcggtagaaaccaattccctttcgtttgtcaggctcgactgtggctgctgggcctgggattttctctgggctatggatctatgtttaccaaaatttggtgggtacacacagtatttactaagaaggaggagaaaaaggagtggcgtaaaaccctagagccctggaagctctacgccaccgtgggcctgttggttggaatggacgtgctgaccctggcaatatggcaaattgtggacccactgcataggaccatagagacttttgccaaagaggagcctaaggaagatattgacgtctcaatcctgcctcagctggagcattgttctagcagaaagatgaacacctggctaggcatcttctacggttacaagggactgttgctgctgctcggcatattcctggcatatgaaactaagtctgttagtacagagaagatcaatgaccacagggcagtggggatggcgatttataacgttgccgttctgtgcctgatcaccgcccctgttaccatgatcctaagcagccagcaggacgccgctttcgcttttgcctcccttgccattgttttctctagttacataacgctggtggtcctcttcgtcccaaagatgagaagactaattacacgcggtgagtggcagagtgaagctcaggatacaatgaaaaccggctccagcaccaacaacaacgaggaggagaaaagcagactgctcgaaaaggaaaaccgagaactcgaaaagataatagcggaaaaagaagagagggttagcgaactcaggcaccaactgcagagtaggcaacagctgaggtccagacgtcacccccctaccccccctgagccctccggcggtctccccagaggtccaccggaacctccggacagattatcatgcgacggctcgcgggtgcatcttctgtacaaatag

SEQ ID NO: 11245 - DNA, 351 bp, Artificial Sequence
  Description of Artificial Sequence: Synthetic coding sequence
atggccgctggctcggccccaatgcagctgcatctccgggctaccatccgcatgaaggacggactctgtgtgccccgaaagtggatatatcatttaacagaaggcagcaccgacctcaggaccgagggcagacccgatatgaagaccgagttgttttcttcttcctgtcctggcggtataatgctcaacgaaactggccaggggtaccaacgtttcctcttgtacaatcggtccccacaccccccagagaagtgcgtggaagagttcaagagcctaacctcctgtcttgactctaaagccttcctgttaaccccacgcaatcaggaagcatgcgagctgtccaacaattag

SEQ ID NO: 11246 - DNA, 2334 bp, Artificial Sequence
  Description of Artificial Sequence: Synthetic coding sequence
atggctgcagcgggactggtcgctgttgccgctgctgctgaatactcagggacagttgcttctggtggtaatctgccaggcgtgcattgcggccctagcagtggcgcaggtcctggctttggaccagggagttggagtcggtccttagatcgggctcttgaagaagctgcagtcaccggcgtcctgtccctgtctggtcggaaactccgggagttcccgagaggagccgcaaaccacgatctgaccgatacaactcgcgctgatttatcccgaaatagactgagcgagatacctattgaagcttgtcattttgtttctttggagaacttgaatctgtatcagaattgtatacgatatatcccagaggcaatacttaatctgcaggccctcacatttcttaacatcagcagaaatcagctcagcactctgccggtccatctttgcaatcttcccctcaaggttttgatcgcctcaaacaataaattagtgagtctacccgaagagatcgggcacttaaggcatttgatggaattggacgtgtcatgcaacgagattcagacaatcccaagtcagattggaaacctggaggctttgcgggacttgaatgtgcggaggaatcacctcgtccatttgccagaagagctggctgagttgccactgatcaggctagatttcagctgcaacaaaataacgactatcccagtttgctatagaaacctcagacacctccaaaccatcaccctggataacaaccccctgcagtccccgcctgctcagatttgtattaagggcaaagtgcacatctttaaatacctaaatatacaagcctgtaaaatagctccagatctgccggattatgacagaagacctttaggattcggaagctgccacgaggaactgtattcaagtagaccgtatggggcacttgattctggctttaactcagtggactccggagataagcgctggtcaggaaatgaaccaacagacgagttttctgatctgccactccgggtcgcagagatcaccaaggagcagcgcctgcgccgtgagagccagtaccaagaaaatcgcggttccttggtagtgacgaatgggggagtagagcacgacttggatcagatcgattatatagacagctgcacagctgaggaggaggaagcagaggtgaggcaacccaaagggccagatccagatagcctttctagccagtttatggcttacattgagcagcggagaatttcgcatgaagggtcacccgtcaagcccgtggcaattagggagtttcagaagacagaggatatgcggagatatctgcaccagaatagggtgcctgctgaaccctcgagcctcttaagcctctctgcctcccacaaccagcttagtcacacagacctggagctgcaccaacgtcgagagcagctcgtggaacgcacacgcagggaggcacagctggccgctctacagtatgaggaggaaaaaattcggacaaagcagatccagcgggacgcggtgctcgattttgtcaagcagaaggcatctcagagcccccagaaacagcatcctctgctggatggcgtggacggggaatgcccatttccgagtcgtaggtcacaacacaccgatgactctgcgctgtgcatgagtttaagcggcctgaaccaggtgggatgcgccgctacccttccacacagcagtgcatttacccctcttaaaagcgacgaccgtcccaacgccctgctgagctctcccgcaaccgagactgtgcatcacagccccgcatactcattccccgctgccatccaacgtaatcagccccagcgacccgagagtttcttgtttagagctggcgtgcgggcagaaacaaataagggtcacgcttctcccctacctccatctgctgcgcctactaccgatagcaccgactctattacgggacagaactcgcgccaacgggaggaagagttggagctcatcgaccagctgcgcaaacacatcgaatatcgactgaaggtgtccttaccatgcgatctgggcgctgcgctgacagacggagtcgtgctgtgtcacctggcgaaccacgtcagaccgcgatctgtaccatctatccacgtgccatcccctgcggtgccaaaattaaccatggccaagtgcaggcgcaatgtggaaaactttctggaggcatgccgtaagatcggagtgccccaggagcagttgtgcctgccccttcacattctggaagagaagggcctgtcacaggtcgcagtaaccgtacaggctctgctggagctagctcctccaaagcagcaacaacatcagctgagtgccgtctag

SEQ ID NO: 11247 - DNA, 834 bp, Artificial Sequence
  Description of Artificial Sequence: Synthetic coding sequence
atgcttcatcctgaaacgagcccaggacggggacatctgctggcagtgttgcttgccctactgggtaccacctgggccgaggtgtggcccccacagctacaggaacaagccccaatggctggggctttaaatcgcaaggaaagctttcttcttttaagccttcataacagactccgatcctgggtccaaccccctgctgctgatatgaggcgcctgttagtctgggccacttcatctcagctggggtgtgggcgtcatctgtgcagcgccggacagactgccatcgaggctttcgtttgcgcttactccccaggaggtaactgggaagtcaacggcaaaaccatcattccctacaagaagggggcttggtgctccctttgtactgccagtgttagcggctgcttcaaagcctgggaccacgctgggggactgtgcgaggttccccgaaacccttgtcggatgtcttgccagaatcacggccgtctgaatatatccacatgtcattgccactgtcctcctgggtacacaggacgatactgtcagggtcacctgcctaattcaaatatgccgcactcggccatgggaacaaagcccaagaccccaggcgtacccgctataggatcactggtgcgctgcagtctgcagtgtgtgcatggcagatttagagaggaagaatgttcctgtgtttgcgatatcggatacggtggagcacaatgcgcctctgagtcctgcccaagagccccaaaagagcccgcaccccttaagactcccctccagtggggcatatcatcccaggagccagctgtatgcttgtcattccagcttattcagtag

SEQ ID NO: 11248 - DNA, 456 bp, Artificial Sequence
  Description of Artificial Sequence: Synthetic coding sequence
atgtctgacctgttactgctgggtctgataggcggacttacactactgctgctgttgacattgttagcctttgctgggtacagtggactgctcgctggcgttgaagtgtcagccggatcccctcccatccggaatgtcacagtggcatataaattccacatggggctttacggggaaacaggacggctgtttaccgagtcatgttcaattagcccaaagctgcgtagcatcgcagtgtactatgacaatccgcacatggtcccaccagacaagtgtaggtgcgctgtggggagcatactaagcgagggggaagagtcaccttctcccgagctcatagacctatatcaaaaattcgggttcaaagtttttagtttccccgcaccatcccacgtcgtgaccgcgaccttcccttacactacgatcttgtccatctggctggctacacgaagggtatag

SEQ ID NO: 11249 - DNA, 390 bp, Artificial Sequence
  Description of Artificial Sequence: Synthetic coding sequence
atggccgctggaagcgcgccaatgcagctgcacctgagggcaactatccgaatgaaggatgggctgtgtgtcccacggaagtggatttatcacctgacagaaggttcgacagacttacggaccgaaggcaggcccgatatgaagactgaactgttttcatccagttgccctggcggaatcatgctgaacgagacagggcaggggtaccagcgcttcttgctttacaatagatccccccaccccccagaaaaatgtgtggaggaattcaaatcgctgaccagttgcctggattcgaaggcgttcctcctcactccgaggaatcaggggaaaggcctgaagagccataagacagggctcggtctgaccaagtcgtcgggcgtgacaggatag

SEQ ID NO: 11250 - DNA, 390 bp, Artificial Sequence
  Description of Artificial Sequence: Synthetic coding sequence
atggcagcagggagcgcaccaatgcagctgcatctgagagcaaccatcaggatgaaagacggcctgtgtgtcccgcgaaaatggatatatcaccttaccgaaggcagcaccgacctgcggaccgaaggccgacctgatatgaagacagagctcttctcgagctcttgcccaggaggcatcatgttgaacgaaacaggacagggctaccaaagatttctgctctacaatcgctcaccccaccctcccgagaagtgcgtcgaagaattcaagagcctgaccagttgcctcgatagtaaagcttttctactgacccctagaaatcaggggaaaggccttaaaagtcacaaaactggcctcggactgaccaaaagttcgggggtcacaggctag

SEQ ID NO: 11251 - DNA, 891 bp, Artificial Sequence
  Description of Artificial Sequence: Synthetic coding sequence
atggaggctctgctactgggtgccggactgctgcttggggcttatgtccttgtctactataatctggtcaaggcacccccatgtggcggtatgggaaatcttcgcggaaggacagcggtggtgactggaatctcctcttgcggacggacaagggaagcatttaatctgttgctcagagtgaaccacataggcccattcctattaactcacctcctgctgccgtgcctgaaagcttgcgcccctagtcgagttgtagtggtggcctctgccgcacattgtaggggcaggctggacttcaagcggctggatcggcctgtcgttggttggaggcaagaactgcgtgcctatgcggacacaaaactggccaatgtcctgttcgctagagaactggccaatcagctcgaagccactggggttacctgttacgccgcacatcctgggccagtgaattctgagttgttcctgagacacgtcccgggatggctgcgacctctcttgcgaccacttgcctggctggtgctgcgcgctccgcgagggggtgcccagactccactgtactgcgccttgcaagaaggcattgaacctctgtctggtcgctattttgcgaactgtcacgtcgaggaggtcccaccagctgccagagacgacagagctgcccacaggctgtgggaggcctccaagaggctggcagggctgggacctggggaagatgccgaaccggacgaggacccacaatccgaagattcagaagccccaagttcactgtcaactcctcatcctgaagagccaacagtctcacagccttatccttcaccacagtcaagccccgacctgagcaaaatgacacaccgtattcaggcaaaagttgagccagagattcagctgtcctag

SEQ ID NO: 11252 - DNA, 567 bp, Artificial Sequence
  Description of Artificial Sequence: Synthetic coding sequence
atgttccaccaaatctgggcagccctgctgtatttttacggaattatcctgaattcgatttatcagtgccctgagcacagccagctcactacgcttggtgtcgacggaaaggaattcccggaggtccatctaggccagtggtactttatagccggagccgcaccaaccaaggaggagctggccactttcgacccagtcgacaatatcgttttcaacatggcggcagggtccgccccaatgcaactccatctccgagctactatcaggatgaaggacgggctgtgcgtgccgcgtaagtggatctaccatctgactgagggcagtacggatcttcggactgagggccgtccggatatgaaaaccgagttgttcagtagctcttgccccggtggaataatgctgaacgagactggccagggttatcaacgctttctcctgtacaacaggtcaccacatcctccagaaaagtgtgtcgaagaattcaagtctctgacgagctgtcttgacagcaaggccttcctcctgaccccccgaaatcaagaagcctgcgagctgagcaacaactag

SEQ ID NO: 11253 - DNA, 978 bp, Artificial Sequence
  Description of Artificial Sequence: Synthetic coding sequence
atgcagggcagagtggctggatcttgcgctcctctgggtctccttctggtctgtcttcatttgcccggactcttcgcccgaagcataggcgtggtcgaggaaaaagtgagccaaaacttaggcaccaacctcccacagcttggccagccatcaagcaccggtcccagcaactctgaacacccccaacctgcactggatccaaggtccaacgatctggccagagtgccattgaaactgtctgtcccagcctcagatgggttcccccctgccggaggatctgcagtgcagcgctggcccccttcctggggcctgcccgctatggactcctggcctccagaggacccatggcagatgatggcagccgctgcagaggataggctgggtgaggcactccccgaagaactctcttacctgtcatccgctgccgctctggccccagggtccggccctctgcccggtgaatcaagtccagatgcgactgggttgagccccaaagccagcctcctgcatcaggactcagaaagccggaggctgcctcgaagcaattctcttggtgcaggaggaaagatactcagccagaggcctccgtggtcactgatccaccgggtgctgcccgatcacccctgggggaccctgaaccctagcgtgagctggggtggcggaggacctggtaccggctggggcactaggccaatgccccaccctgaaggtatttggggtattaataaccagccacctgggacgagctggggaaatatcaaccgttaccccggaggcagctggggaaatatcaacagataccctggtgggtcttggggaaatattaacagataccccggaggctcttggggcaacatacacttgtaccccggtattaacaatccatttccgccaggggtactgaggccacctggatccagctggaatatccctgcaggcttcccaaacccgccatctcccagacttcagtggggatag

SEQ ID NO: 11254 - DNA, 2631 bp, Artificial Sequence
  Description of Artificial Sequence: Synthetic coding sequence
atggggccagaggccctgagttctctcctgctgctgttgctcgtggcctctggcgatgcagatatgaaagggcatttcgacccggctaagtgcagatacgcactgggcatgcaggatcgaactataccggactccgatataagtgcctcctcttcctggtccgactcaaccgccgcacggcattcgcggctggagtcttctgatggtgacggcgcttggtgccctgcaggatcggtatttccaaaggaggaggagtacctccaagttgatctgcaacggttacacttggttgctttggtaggtacccaggggaggcacgccggaggtcttgggaaagaattctccagatcgtatcgcttgcgatactccagagatggtcgtaggtggatgggatggaaggatagatggggtcaggaagtcatttctgggaatgaagacccagaaggagtggtgctgaaggaccttggtccaccgatggttgctagactggtgcggttctacccccgtgctgatcgggtcatgtccgtgtgtctaagggtggaattatacggctgcctatggcgcgatggtctcttgagctacaccgctccagtggggcaaacaatgtatctctcagaggctgtctatttaaacgacagcacatatgatggtcacaccgttgggggactgcagtacgggggactggggcagttggcagatggcgtcgttggcctggacgactttcggaaatctcaagaactgagggtgtggcctggctacgattatgttggctggagtaaccattctttctcgtctggatacgtagaaatggaattcgagttcgatcggttgcgggcattccaggctatgcaggtccattgcaataacatgcatacactgggtgccagactgcctggaggcgttgaatgtcggtttcgacgcggtccagccatggcgtgggagggagagcccatgagacacaatctgggtggtaatttgggcgatcccagagctagggccgtgtccgtacccttgggcggacgggtggctcggtttttgcaatgccgcttcctcttcgccggtccctggcttcttttcagcgaaattagcttcatttccgatgtggtcaataattcttcacctgctctcggcggtactttcccgcctgccccatggtggccccctgggcctccccctactaatttttcgtccctggagctcgaacccaggggccagcagcccgtggctaaagccgaggggtcacctacggctatactcatcggatgtctggttgccatcattttgttactgctgttaattatcgcattgatgctctggcgcttacattggaggagactgctcagcaaggcggagaggcgcgttctggaagaggaactgaccgttcacctttccgtacctggggacacaatcctgatcaacaacagacctggtcctagggagcctcccccataccaggaacctcgaccacgtggcaatcccccacactcggccccatgcgtcccaaatggttctgcctactccggcgattatatggagcccgaaaagccgggtgcacccctcctaccacccccaccccagaacagcgtacctcactatgccgaggccgatattgtcacactacaaggtgtcaccggagggaacacttacgccgtcccagctctgcctcctggtgccgtgggcgacggaccgccacgcgtcgattttcctagaagtaggttgagatttaaggaaaagctgggcgaaggacaatttggcgaagttcatttgtgcgaggtggactcccctcaggatctggtgagtctagatttccctttgaatgtgaggaaaggacatccactgctggtcgctgtgaagatcttaagacctgatgccaccaaaaatgcacgcaatgactttctgaaggaggtcaaaatcatgagcagactgaaagaccccaatatcattcggctgctgggggtgtgcgtgcaggacgatcccctgtgcatgatcactgactacatggagaacggcgacctgaatcagttcctgagcgcccatcagcttgaggacaaagctgccgagggggcaccaggtgacggacaagccgctcagggcccaacgatatcttaccctatgctcctgcatgtggccgctcagattgcttcaggtatgaggtacctggccacactcaattttgtccacagggacctggccactcgcaattgtctggttggagagaatttcactataaagatcgcagactttggaatgtcccggaatctctatgctggtgactactacagagttcaaggaagggccgtcttgcccataagatggatggcctgggagtgtatcttaatgggcaagttcaccacagccagtgatgtttgggctttcggggtcaccctttgggaggtgcttatgctgtgtagagcccagccattcggccagctgacagatgaacaggtgatcgaaaacgccggtgagttctttcgggaccaggggaggcaggtttaccttagccgaccccctgcctgccctcagggactgtacgagctgatgctccgctgctggagccgggagtccgagcagaggccccctttctcacagctgcataggttcctcgccgaggatgctcttaacactgtttag

SEQ ID NO: 11255 - DNA, 1482 bp, Artificial Sequence
  Description of Artificial Sequence: Synthetic coding sequence
atggccctcctagcagggggactgtccagagggctcgggtcccaccctgccgctgccggaagggacgctgtagtttttgtatggttattgctgagcacctggtgcactgcacctgcccgagctattcaagtgaccgtgtcaaacccctatcatgtagtcattctgtttcagccggtgaccttgccctgtacgtaccagatgacatccactcccactcagccaattgtgatatggaagtataagagcttttgccgggatcgcattgctgacgcgttctctcctgcaagtgtggacaatcagctgaacgcgcaattggccgctggtaacccgggttacaacccgtatgtggagtgccaggatagcgttcgtaccgtccgcgtggtggctacaaaacagggtaatgccgtaacactcggcgattactatcaagggagacgtatcactataacaggcatgtatgccgcaggaaaagccgctacatctggagtccctagcatctacgctccctccacttacgcccatctcagtcccgcaaaaactcccccaccacctgccatgatccctatgggacccgcatacaacggataccccggtggctacccaggtgatgtcgaccggtcatcctctgccggtggccagggcagttatgtccctctgctcagagatacggattcctccgtggcttctgaggtacgtagtgggtaccgcattcaggcttcccagcaggatgactctatgcgggtcctctattacatggaaaaggagttagcaaattttgatccatcaaggccagggccaccctctggtagggttgagcgtgccatgtctgaggttacctccttacatgaagacgactggagatcacgaccatcaagggggcctgcccttacacctattagggacgaggagtgggggggtcacagccctcgatcccctcgaggctgggaccaggaacccgctcgcgagcaggccggaggaggatggcgggctaggcgcccaagagcaaggtctgtggacgctttagatgatttgactcccccttccacagcagaatctggcagtcgaagccctaccagcaatggcggaagaagtagagcttatatgccacctcggagccgtagtcgagatgacctctacgatcaggacgatagtcgcgacttcccgaggtctcgagacccacactatgatgactttagaagcagagagagaccgccagcggatcctcggtcacaccatcatcggacaagggaccctagggacaatggaagccgaagcggtgacctgccgtacgatggaagactcctggaggaagccgttcgaaaaaaggggagcgaggaacggcgacgccctcataaagaggaagaggaggaggcttactatccccctgcccctcccccatactccgaaacagactcccaggcctctcgcgaacggaggttgaagaagaatctcgccctttctcgcgaaagtctagttgtctag

SEQ ID NO: 11256 - DNA, 1788 bp, Artificial Sequence
  Description of Artificial Sequence: Synthetic coding sequence
atggattttctcttggccctggtcctcgtgtcttccctgtacttacaggcggctgccgagtttgatggtcgttggcctcgccagatagtaagttcaattggactgtgccggtatgggggaaggattgactgttgttgggggtgggctcggcagtcatggggtcaatgccagcctgtctgccaaccccgatgcaagcatggagagtgtattggacccaataaatgcaagtgccatcccggatacgctggcaaaacctgcaatcaggacgaacacatccctgcccctctggatcagggctctgagcaacctttattccagccactggaccatcaggcgacatcgttgccgtctagggaccttaacgaatgcggcttaaaacctcggccatgcaagcacagatgcatgaatacatacgggtcttataagtgctactgtctcaacgggtacatgcttatgcctgacggaagctgctccagcgccctgacttgttctatggctaactgccagtacggctgcgacgtggttaaaggacagatccgctgccaatgtccgtccccaggcctgcagctagcacccgatggtaggacttgtgtggatgtcgacgagtgcgctacaggtagagcgtcatgtccacgttttaggcagtgcgtgaacacgttcggctcatacatctgtaaatgccacaaaggctttgacctcatgtacatcggtggtaagtaccagtgccacgatatagatgagtgttcattggggcaatatcagtgttcatcattcgctcggtgttacaacatccggggtagctacaaatgtaagtgtaaagaaggataccaaggagatggattgacttgcgtgtacatccctaaagtgatgatcgagccctcaggcccaatccacgtccctaaaggaaatggcactattctgaagggcgacactggaaacaacaattggataccagatgtcggcagtacctggtggcctccgaagaccccatacattccccctatcatcaccaacaggcccacctctaagccgactacccgccctacaccgaagccaacacccatcccaacacctccaccccctccccctctcccaaccgaactgcggactcctttgccccctactactcctgaacgccctaccaccggccttaccacaatcgcacctgctgcttccacgccccctggcggaatcactgtcgacaaccgggttcagacagacccgcagaaaccgaggggcgacgtgtttatcccccgtcagccaagtaatgatcttttcgagatctttgagatcgaacgcggagtgagtgctgacgacgaggcaaaagatgaccccggtgtactcgtccattcatgcaatttcgatcacggactgtgcgggtggattagggagaaggataacgatctccattgggagccgatacgcgaccccgctggcggacagtaccttacagtctccgcagccaaggcccctggcggtaaggcagccagacttgtgctgccacttggcagacttatgcacagcggtgacttatgtctatccttccggcacaaggtaaccggcctgcacagtgggaccctgcaggtttttgttcggaagcatggggcacatggagccgcactgtggggccgaaatggtggccatgggtggaggcaaacacagataacgctgagaggcgcagatattaagagcgtggtctttaagggagagaaaaggaggggccatacaggagaaattggtcttgatgacgtttccttgaagaaaggccattgctccgaggaaagatag

SEQ ID NO: 11257 - DNA, 210 bp, Artificial Sequence
  Description of Artificial Sequence: Synthetic coding sequence
atgaaaaatcaggataagaagaatggggcagccaaacaaagtaacccgaagagttcgccgggacagccagaggcgggaagcttcgactctctggatctggagaaagtctccctgggcagagccctggcaggacggagcgaattagggatcagctgcctggaacaaggcacttggcggatgttcctccgcggtatgatgtgctggagctag

SEQ ID NO: 11258 - DNA, 483 bp, Artificial Sequence
  Description of Artificial Sequence: Synthetic coding sequence
atggccagagactacgatcacttattcaaattattgatcatcggggactccggggtaggaaaatcctctctcctgctcaggttcgccgacaacacgttttcaggttcgtatataaccacaattggagtcgacttcaaaatccgcaccgtagaaatcaacggggagaaagtcaagctgcagatctgggacacagccggtcaggaacgcttccggaccatcacatcgacagcagagacagctctgcgaagtctgccccaaccagaagctcatggaggcagtagcggtgattcccttagtttcgtgccccttttcaaggaattttccccatgcttttgtattggcaggtgccatagacactttctccccagaccaccgagggtccctcgacgctgctggacctcacctccattccctaccggagccccttcctcacccgctaaagcgccagggcctggtgaggacgcagctcggcgagctgattag

SEQ ID NO: 11259 - DNA, 360 bp, Artificial Sequence
  Description of Artificial Sequence: Synthetic coding sequence
atgaacaagattcttagttcaacagtttgcttcggactcctcaccctgctctcagtgctgagctttttgcagtcagtacacggacggccttatcttacacagggaaatgaaatctttccagacaaaaaatacaccaatcgcgaagagctcctgctcgcgctgttgaataagaatttcgacttccagcggcctttcaatacagatctcgcactccccaataagctggaggaacttaatcaactggaaaagcttaaggagcagctggtggaagagaaagactctgagacgtcatacgctgtggatggattattttcttctcacccgtctaaacgcgcttgtttctggaaatattgtgtgtag

SEQ ID NO: 11260 - DNA, 2514 bp, Artificial Sequence
  Description of Artificial Sequence: Synthetic coding sequence
atgttcaaatgctggtctgtggtcctcgtgctcggattcatttttctggagtccgaggggagaccaacaaaagaggggggttacggattgaagagttaccaacccctgatgaggctccgacacaaggaaaagaaccaggaaagctcccgcgtcaagggattcatgattcaggatggaccttttgggtcgtgtgagaacaaatactgtggccttgggaggcattgtgtcacaagtagggaaactggccaggccgaatgtgcctgcatggacttatgcaagcgccactacaagccagtatgtgggagcgatggagagttttacgagaaccactgcgaagttcacagagcagcctgtctcaaaaaacagaaaatcacgatagtgcataatgaggattgtttcttcaaaggcgataagtgcaagactacagagtactccaagatgaagaacatgctgctggaccttcagaaccagaagtatataatgcaggagaatgagaatcccaacggggacgacatcagtcggaaaaagctccttgttgatcagatgttcaagtattttgacgcagatagcaacggactcgtagacatcaacgagctgactcaagtcatcaagcaggaggagttagggaaagatttgttcgactgcacactttacgtgctattaaaatacgatgactttaacgccgacaaacacctggctctggaggagttctaccgggcttttcaggtgatccagctgtcccttccagaagaccaaaaactgtccatcaccgcagcaaccgtggggcagagtgctgtactgtcttgtgcgatccagggcacacttaggccgcctattatctggaagaggaataacatcatactcaacaatttggacctggaggacattaacgactttggagatgacggaagcctgtatattaccaaggtaactacaacccatgttggtaactatacttgctatgccgacgggtatgagcaggtttatcaaacacatatattccaggtcaatgtgcccccagtgattagggtgtatcccgagtcccaggccagggagccgggagtcaccgcttctttacgctgccacgccgagggaataccaaaaccacaactgggatggctgaaaaacggcatcgacatcaccccaaagcttagcaaacaattaacactccaggcaaatggcagcgaggttcatattagcaacgtgaggtatgaagatacaggcgcatatacatgtattgcgaagaacgaagccggtgtggacgaagacatcagctcactcttcgtggaggacagcgcgcgaaagactcgtctcggaatcgggaatatgttttatgtgttttatgaggacggcataaaggtaatccaaccaatcgagtgcgagttccagagacatattaaaccaagtgaaaagctcctggggtttcaagacgaggtgtgtccgaaagccgaaggcgatgaggttcaaagatgcgtgtgggcatctgccgtcaatgtgaaagataaattcatctatgtcgcccagccaacactggatcgcgtgctaatcgtcgacgtgcaaagccagaaagtggtgcaggctgtcagtacggaccctgttcccgtgaaactccattatgataaatcccatgatcaggtgtgggtcctcagctgggggaccttggagaagaccagcccaaccttgcaggtcatcactttggctagtggtaatgtgcctcaccacacgatccacacccagcccgtaggcaagcagtttgatcgggtggatgacttcttcattccaacaaccacactgatcattactcatatgcgctttgggtttattctgcataaggatgaagccgcattgcagaagatcgatctggagaccatgagttacatcaaaaccattaaccttaaggactacaagtgcgtccctcagagtctggcttacacgcacttggggggttactacttcatcggttgcaagccagactcaactggagcagtatcgccccaggtgatggtggatggagtaaccgactctgtgattgggtttaattccgacgtgactggaacaccctatgtgagtcccgacggtcactatctggtcagtataaatgatgtcaagggcctagtaagagttcaatatattaccataagaggagagatccaagaagctttcgacatttacactaacctccacatctctgacctcgctttccagccaagtttcaccgaagcacatcaatataacatatatggttcgtcaagcacccagacagacgtgctgttcgtagagctgtccagcggaaaggtcaagatgattaagtccctaaaggagccactcaaagctgaagagtggccctggaatcgtaaaaaccggcagattcaggactccggactgttcggccaatatttgatgacaccctctaaggatagcctcttcatactcgacggtaggctcaataagctaaactgtgaaattacagaggtggagaagggcaatactgtgatctgggtaggggacgcctag

SEQ ID NO: 11261 - DNA, 648 bp, Artificial Sequence
  Description of Artificial Sequence: Synthetic coding sequence
atggccgatatgcaaaatctcgtcgaaagattggagagggccgtggggagattagaagctgtttcccacaccagcgatatgcacagaggatacgccgacagtccgtcaaaggcaggtgcggctccctatgttcaagcatttgacagcctgctggccggtccagttgcagaatacttaaaaattagcaaggaaatcgggggtgacgttcagaagcacgccgagatggtacacaccggcctcaaattagagagagcattgctggtcacagcctctcagtgccagcagcctgctgagaacaagctatctgatttactagctccaatttcagagcaaattaaagaagtgattacgttcagagagaagaaccgcggtagtaaactattcaatcatctctctgcagtttctgaaagtatccaggccctaggttgggtggcaatggcccctaaacccggaccctatgtgaaggaaatgaacgacgcggctatgttttatactaatcgggtccttaaagaatacaaagatgtcgacaagaagcacgtggattgggtgaaagcctatttgagtatttggacggagttgcaagcatacatcaaagagtttcacaccaccggcttggcttggagtaaaactggaccagttgccaaatag

SEQ ID NO: 11262 - DNA, 3837 bp, Artificial Sequence
  Description of Artificial Sequence: Synthetic coding sequence
atgcgtctcctcctgttggtgccacttttgctggcaccagctccagggtcgagcgcccctaaagttaggagacagagcgatacatggggaccctggtctcagtggagcccgtgttccagaacctgcggaggaggggtcagtttcagagagcgaccatgctacagccagcgaagagacggtggaagcagttgcgtggggccagcacgtagccacagaagctgcaggacagaaagctgccctgacggagccagggattttcgggcagagcagtgtgcagagttcgatggtgctgagtttcagggtcgcaggtaccgttggctgccatattatagtgcgcctaataaatgcgagctcaattgcattcctaaaggcgaaaatttctattataagcacagagaagctgtagtggacggcacgccctgcgaacctgggaaaagagatgtgtgtgtggacgggagttgccgcgtggtggggtgcgaccacgagcttgatagttctaagcaagaagataagtgtcttcgatgtggcggtgacggcaccacgtgttacccagtcgcaggaaccttcgacgccaatgacttgtctcgtggttacaaccaaatcctcatcgtacccatgggcgcaacgagtattcttattgatgaggcagccgcatcccgcaatttccttgcggtgaagaacgtgcgtggagaatactatctgaatggacactggaccatcgaggccgctagagctttgcctgctgcctctaccattttgcattatgagcgaggtgccgagggggacctggccccagagagactgcatgcacgaggtccgaccagcgagcccctggtgatcgaacttatctcccaggagccaaaccccggagtacactacgaatatcacctgcctctgcgtcgccctagccccggattctcctggagccacggtagctggtctgactgctccgcggaatgcggtgggggacaccagtcacggctagtgttctgtacaatcgatcacgaggcctaccccgatcacatgtgtcagagacaaccccgtcctgctgatcgccgtagttgcaacctccacccgtgtcccgagactaaacgatggaaggcgggtccttgggcaccgtgtagcgcatcatgtggagggggttcccagagtcgctcagtgtattgcatctcttcagatggagcagggattcaggaggcagtcgaggaggctgagtgcgccggtctccccggtaagcccccagctatacaggcatgcaacctacaacgctgcgccgcatggtcccctgaaccgtggggcgaatgctctgttagttgcggagtcggcgtgaggaagaggtcggtaacgtgccggggtgagcggggaagcttactgcacacagccgcatgttcactcgaagatagaccaccactcactgagccatgcgtgcacgaggactgcccactgctgagcgatcaggcatggcatgttggcacgtggggcctctgctctaaatcctgcagctccggtacgcggaggcgtcaagttatctgcgcaatcggtccgcctagccactgtggtagcctccaacattccaaaccagtcgatgttgagccctgcaacacccagccatgccatctcccacaggaggttccttcgatgcaggatgtccatacccccgcttccaacccatggatgccactgggtcctcaagagagtcctgcgtcggactccagagggcagtggtgggccgcacaagagcatccgagtgccaggggggatcacagaggcgaaagaggagatccacggggtgatcaaggcacgcatctgagcgccctggggccagccccatctctccaacagcctccttaccagcagccactgcggtctggcagtggtcctcatgattgtaggcattcccctcacggatgttgtcccgacggccatactgcgtcactcggaccgcagtggcaaggatgccccggtgcaccctgccagcagtcccgatacggttgctgccccgatcgtgtgagtgtcgcagagggccctcatcacgccggatgtacaaaatcctacggtggggatagcacagggggaatgccacggtcacgggctgtggcttcaacggtgcacaatactcaccaaccacaagcccagcaaaacgaaccctccgagtgccgaggcagtcagttcggttgttgctacgacaacgtggcaacagccgcagggccactgggagagggttgcgtggggcaaccatcccacgcgtaccctgttagatgcctgctgcctagtgctcacgggtcttgcgctgactgggccgcaaggtggtacttcgttgccagcgtgggccagtgcaacagattttggtacggcggatgccacggtaacgccaataatttcgcatcggagcaggagtgcatgagcagttgccagggaagcctacacggccctcggcgtcctcagcccggtgcgtcaggacgaagcactcacaccgatggtggcggatcctctccggcaggcgagcaggagccgtcacaacaccggacaggagccgctgttcagcggaagccatggccatctggcggactctggcgccaagaccagcagccaggacccggagaagcccctcacactcaagcctttggggaatggccatgggggcaggaactgggtagccgtgctccaggactggggggtgatgctgggtccccagctccaccttttcacagctcctcttacaggatttccctggcgggagtcgagccctctttggtgcaagcggcattagggcaactcgtgaggctgtcatgttcggatgatacagctccagagtcgcaggcagcatggcagaaggacggccaacctatctcatctgataggcatagacttcagttcgacggcagcctgatcattcatcctttgcaggcagaggatgcgggaacctacagctgcgggtcaacccgcccaggtagagacagtcaaaaaatacaactgcggatcatcggcggtgatatggccgtgttatccgaggctgaactcagtcgctttccccagcccagggaccctgcccaagattttggccaagctggagccgctgggcctctaggggcaataccctcaagtcacccgcaaccagccaataggctccgcttggaccagaatcaaccacgggtggtagacgcctcacccggtcagcggattaggatgacttgcagagcggagggttttcccccaccggcaattgagtggcagcgcgatggacagcccgtatcttcacctcgccatcagctccaaccagatggatcactcgtcattagccgtgtggctgtcgaggacggcggtttttatacctgtgtcgcttttaacggacaggaccgcgatcaaaggtgggtgcagttgcgcgtcctcggcgagttaaccatctctggacttcctccaacggtcactgtccccgaaggcgacaccgcgagacttctttgcgtggtggcaggcgaaagtgtcaacattcgatggtcccggaatgggctccctgttcaggcagacggccatagggttcatcagagccccgatggaacactcctgatctacaatctgagggctcgagacgagggatcgtatacttgttccgcttatcaggggagccaggcagtgagtcggtcaaccgaggtaaaagtggtcagtcctgcgccaacagcacagcctcgcgaccccggacgagactgcgtagatcagccagaactcgccaactgcgatctgatcttgcaggcacagctctgcggtaacgagtactactcctcgttttgctgcgcaagctgctctcgctttcagccacacgcccaacccatctggcagtag

SEQ ID NO: 11263 - DNA, 546 bp, Artificial Sequence
  Description of Artificial Sequence: Synthetic coding sequence
tgaaaagggcatgcctccccacttcccccatccgctgctccaacaacagattcaacggactctatcacagggcagaattctcgtcagcgagaggaagaactcgaactgatcgatcaattaaggaagcatatcgagtatcgactgaaagtgtcactaccatgcgacctaggggcagccctgacagatggcgtagtgctctgtcacctcgccaatcacgtcaggcccagaagcgtcccatccatccatgtgccgagcccggctgttcccaagctgaccatggccaagtgcagacgcaacgtggagaactttcttgaggcctgtcggaaaattggtgtgccccaggataacttatgtagcccttcagatatcctccagttgaacctcagtgtcaagagaactgtggaaactctattgtcactcggcgcacatagtgaggaatcttccttcgtctgcctgtcgctgcagctcctcgggttcgtggccttctattgtacagtgatgttaacactttgcgtgttgtattactggctctttcccgctcgttag

SEQ ID NO: 11264 - DNA, 804 bp, Artificial Sequence
  Description of Artificial Sequence: Synthetic coding sequence
atgggacccgaagctcttagctcattactattgcttctgctggtcgccagtggggatgctgatatgaaagggcactttgatccagccaaatgccgctacgcgctggggatgcaagaccgaacgattccggactcagatatctccgccagctcgagctggtccgactccaccgctgcacgacacagcagactggagagctccgacggcgatggggcttggtgtccggcaggaagtgtgtttccaaaggaagaggagtaccttcaagtcgatctgcagagacttcatcttgtagcactagtagggacccagggaaggcatgctggcggactgggcaaggagttttcacgctcgtacagattgcggtactcacgggacggacggaggtggatgggatggaaagaccggtggggacaggaggtgattagtgggaatgaggatcccgagggggtggtccttaaagacctcggaccgcctatggtcgccaggctggtgcggttctaccctagagctgaccgtgtgatgtctgtctgtctccgtgtcgagctctatggctgcctgtggcgggacgggttacttagctacaccgctcccgtggggcaaactatgtacctctccgaagccgtctatttgaatgactccacctacgatgggcataccgttggtggcctgcagtatgggggtcttggccagctggccgatggcgtagtaggacttgatgattttcggaaatcccaggagttgcgcgtgtggcctggatacgactacgtaggctggagtaatcacagcttttctagcggttactag

SEQ ID NO: 11265 - DNA, 345 bp, Artificial Sequence
  Description of Artificial Sequence: Synthetic coding sequence
atggcacctaagaagctgtcctgcctccgatcattgttacttcctcttagtctgacactgctattgccacaagctgatacccgcagttttgtggtggaccggggacacgatcgcttcctgctcgacggcgctccgttccggtacgtctctggttcgctgcattatttcagagtccctagggtgttatgggctgaccggcttctcaagatgagatggtcaggtttgaacgctatccagttctacgttccctggaattaccacgagcctcagcctggagtgtacaattttaacggaagtcgcgacctgatcgcctttctgaacgaggccgctcttgccaacttatag

SEQ ID NO: 11266 - DNA, 507 bp, Artificial Sequence
  Description of Artificial Sequence: Synthetic coding sequence
gccccacggatggagatgtttcagggcctgctccttttgctgctcctgagcatgggcggaacgtgggctagcaaggagcctctgcgcccaaggtgccgccctatcaatgcaactcttgccgtagagaaggaggggtgcccagtctgcataactgtcaatactactatttgtgcaggatactgccccacaatgacccgcgtcctgcagggagtgctgccagctttgccacaggtggtgtgtaattacagggatgttcggtttgaatcgatccgtttacccggttgtccccgaggcgttaatcccgtggtatcttacgctgtcgcactgtcttgtcaatgtgccctctgccggagaagcacaactgactgcggaggtcccaaagaccacccgctcacctgtgatgacccaaggttccaggatagttctagttctaaagccccaccaccatccttgccaagcccctccaggctccccggaccttccgacacccctatacttccccagtag

SEQ ID NO: 11267 - DNA, 1203 bp, Artificial Sequence
  Description of Artificial Sequence: Synthetic coding sequence
atggagacacaggagctccgcggagcactggctctcctgttactgtgcttcttcacttctgcatcccaggatttgcaagtaatcgacctcctaacggtcggggaatcccggcagatggtggccgtggctgaaaaaataaggactgcactgctgaccgcgggtgacatttacctcctgtcaacctttcggctgcctccaaagcagggaggcgtgctgtttggtctgtacagccgccaggacaacacaaggtggctcgaagcaagtgtcgtcggcaagattaacaaagttacaaatgcgcttcactcaatcctcggtgaaggcaacgtcccagatcccaagcatcattacggggtcagtggcttccacgaacaacgtagccactgttcccccaacccctgtttcagaggggtggattgcatggaggtatatgaataccccggatacaggtgtggtccatgtccccctggcctccagggcaacgggactcattgtagcgacatcaacgaatgcgcccatgcggacccttgcttcccgggttctagctgcatcaacaccatgcctgggttccattgcgaggcttgcccaagagggtataaaggtacacaggtgtctggcgtgggaatcgactacgctcgcgctagcaaacaggtgtgtaatgatatcgacgagtgtaatgacggcaacaacggaggttgtgatcccaacagtatctgtaccaatacagtgggctctttcaaatgtgggccttgtagactgggtttcctcggcaaccagtcgcagggatgcctgcccgcaaggacgtgtcactcaccagcgcacagtccttgccacatccacgctcactgcctgttcgaaaggaatggcgctgtctcctgccagtgcaacgttggttgggcgggaaacggcaacgtgtgcgggacggacaccgacattgatggttatccagatcaagccctgccatgtatggataacaacaaacactgtaaacaggacaattgtctcttaacacctaacagcggtcaggaagacgccgataatgatggagtgggcgatcaatgcgatgacgacgccgacggcgacggtataaagaacgtggaggcttccccgatggactggacgattgccctcaagtctcccacacactaccggcagactggaatgaggaccggatgggaaatgctggcgacggcagccttgaaatag

SEQ ID NO: 11268 - DNA, 618 bp, Artificial Sequence
  Description of Artificial Sequence: Synthetic coding sequence
atgatgcgcactctgatcacaacccaccccctgcctctcctcctgctcccccagcaactgctgcagctggtgcaattccaggaagtggatacggatttcgactttcctgaagaggacaaaaaagaagaattcgaggaatgtctcgagaaatttttttccacaggcccagcacgtccaccaactaaagaaaaagtaaagcggagggttctgattgaacctggtatgcctttaaatcacatcgagtactgcaaccatgagattatgggaaaaaacgtgtactacaaacatcgctgggtggcagagcattattttctgcttatgcagtatgacgagctacaaaagatctgttataaccggttcgtcccctgtaagaacggaattcgcaagtgcaaccgcagtaagggcctcgtcgagggtgtttattgtaatctgactgaggcattcgagattcccgcatgtaaatacgagtctctctatcgcaaaggctacgtgctcatcacttgctcatggcagaacgagatgcaaaaaaggatcccacatacaattaatgacctggtggagcctccggagcaccggtcctttctctccgaagacggggtatttgtgattagcccatag

SEQ ID NO: 11269 - DNA, 177 bp, Artificial Sequence
  Description of Artificial Sequence: Synthetic coding sequence
atggacctgttgcagtttctggcttttttgttcgtgctgctgttaagtggaatgggtgccaccgggacactccggactagtctggatccaagtttagagatctacaagaaaatgtttgaggtgaagaggcgggaacaactgcttgcgctgaagaacttagctcagttaaacgattag

SEQ ID NO: 11270 - DNA, 450 bp, Artificial Sequence
  Description of Artificial Sequence: Synthetic coding sequence
atgaaggtgattgctattttaactctgcttttattttgcagccctacacacagttccttttggcagttccagcgacgcgtgaagcacatcactgggaggtccgcctttttctcctactatggctatgggtgctactgcgggcttggggacaagggaattcccgtcgatgacaccgaccgccattcacctagttcccccagcccatacgagaagctgaaggagttctcttgtcagcctgttttaaattcttatcagttccatatcgtgaacggagccgttgtatgtggctgtaccctcgggcctggggctagttgtcactgccggctgaaggcttgcgagtgtgacaagcagagcgttcattgtttcaaagaatccctaccaacatatgagaagaacttcaaacagttctcctcacaaccccgttgtgggaggcacaagccgtggtgctag

SEQ ID NO: 11271 - DNA, 237 bp, Artificial Sequence
  Description of Artificial Sequence: Synthetic coding sequence
atggggagcgggctgcccctggtgttactcctgacacttctgggtagctcccacggaacgggcccaggaatgaccctacagctgaagctgaaggagtcatttctgactaacagttcttacgagtcatccttcctggagcttctcgagaaactgtgcctcctgctccatcttccgtctggaaccagtgtcacactgcaccacgccaggagtcagcaccacgtcgtctgtaatacttag

SEQ ID NO: 11272 - DNA, 1461 bp, Artificial Sequence
  Description of Artificial Sequence: Synthetic coding sequence
atgattagcccgtctccttctcaggaggaactgcagactacgctggaggagactgatcagagcacccaggagccattcacaaccaaaatacctagaacgacggagctagcaaagacgacacaggccccacaccggttctacacaacagtgcggcctagaactagcgacaaaccccacattcgcccagtgcttaaccgaacaacaactcgtccgaccagacccaagccaagtggcatgccgtcaggaaacggcgtggggacaggcgtcaagcaggcaccccgacctagtggcgcagatagaaatgtgagtgtggattctacccacccgactaagaagcctggaaccagacggcctccactaccccctagacctacgcatcctcgcaggaaaccactgcctcctaacaacgttaccggaaagcctggctctgccggaatcatcagcagcggtccaatcacaacccctcctttaaggtcgacaccccgtcctaccggcacccccctggagagaattgagacagatataaaacaacccacagtcccagcgtccggcgaggaattagagaacatcactgacttctcatcttcaccaacccgggaaacagatccactgggaaagcccagatttaaaggaccacatgtacgctatatacagaaaccagataatagcccgtgtagtatcaccgactccgtgaaacgcttccctaaagaggaggctacagaggggaacgctacttcgccaccccagaatcccccaactaaccttactgttgtcacggtggaggggtgtccttcgttcgtgatcctggattgggaaaagcctctgaacgatactgtgactgaatacgaagtgattagcagagagaacggttcattctccggcaagaacaaaagtatccagatgaccaatcagaccttctccacagtagagaacctcaaacctaataccagttatgaatttcaggtgaaacccaagaatccactgggcgaaggtccggtttctaatacagtcgctttctccactgagtccgccgaccccagggttagcgaaccagtgtctgccggacgtgacgccatctggacagaacgcccttttaacagtgactcttactccgaatgtaagggaaagcagtacgtgaagcgcacatggtataagaagttcgtgggcgtacagctgtgcaactcgctgcgctacaagatctacctgtctgattcattaaccgggaagttctacaatattggcgaccagcgcggacatggagaagatcactgccaatttgtagatagttttttagacggacgcacgggtcagcaactgactagtgatcagctgcctatcaaggagggctattttagagctgtgcggcaggagccagtacagttcggcgaaattggtggccatactcagataaactacgtccagtggtacgagtgcggaactaccattccaggtaagtggtag

SEQ ID NO: 11273 - DNA, 243 bp, Artificial Sequence
  Description of Artificial Sequence: Synthetic coding sequence
tagaatggacccgtcctctggtttaaaggaaccgggccaaatcggaaactgatttacaattttaaacaggagcagaaccctaggccaccaaaaaatcggccagcgggaagagccggatcacgggctcaccatgacgctcacacttgcctgtcagcgctgcctgagaggaattcaacgaactattttgtccagccctgttgctgtctccggcttctcgggctcactgggctgctgagcaagtag

SEQ ID NO: 11274 - DNA, 1341 bp, Artificial Sequence
  Description of Artificial Sequence: Synthetic coding sequence
atgctgcaccccgaaaccagtccgggtcgcggacatctgctcgccgtcctgctggctctgcttggtacaacatgggccgaggtttggcctccgcaattgcaggaacaggctcctatggccggtgctctaaaccgtaaagagtcgtttctccttcttagtctgcacaacaggctccggagctgggtgcagccgcctgctgctgatatgaggcgcctggactggagcgacagcctcgcccagctagctcaggcgcgtgctgccttatgcgggattccgactccaagcctggcctccggactgtggcgcaccttacaggtgggctggaatatgcagctgctgccggcaggccttgcttcatttgtggaggttgtgtcactatggttcgcagagggtcagcgatattctcacgccgctggtgagtgtgctcgcaatgctacatgcacacattacacacagctagtctgggccacttcctcacagttaggatgtgggcgtcacctgtgctctgccggacagaccgccatcgaggccttcgtgtgtgcgtatagcccccgaggcaactgggaggtaaacggaaagacaattatcccatataaaaaaggcgcttggtgcagcttgtgtactgctagcgtgtctggctgtttcaaagcttgggaccatgccggaggcctgtgtgaggtgccacggaatccctgccggatgtcatgccagaaccatggccgacttaatataagcacatgtcattgccattgccctccagggtacacagggagatactgccaggtaaggtgttcgctccaatgcgtccacgggagatttcgcgaggaggagtgctcctgcgtatgtgatattggttatggaggtgcccagtgtgccacaaaagtgcactttccttttcacacgtgcgacctgagaatcgatggggattgcttcatggtgagcagcgaggctgacacgtactaccgagcacgaatgaaatgtcagaggaaggggggagtgttggcgcagattaagtctcaaaaagtgcaggatatactcgctttttatctcgggcgattagagacaactaacgaggtcatcgatagcgacttcgagacaagaaatttttggattggactgacttataagaccgccaaggattctttccgatgggctaccggtgagcatcaggcctttacgtctttcgctttcggacagcctgacaatcacggcttcgggaattgcgtggagctgcaggcctctgctgcctttaattggaacgaccagcggtgcaagaccagaaataggtacatatgtcagtttgcccaggagcatatctctaggtggggcccaggttcttag

SEQ ID NO: 11275 - DNA, 432 bp, Artificial Sequence
  Description of Artificial Sequence: Synthetic coding sequence
atgcaggcagcgtgttggtacgtcctctttcttttgcaaccaacggtctacttggtgacgtgcgctaacctgacaaatggtggaaagagtgagctcttgaagagcggaagctctaaatcgactctcaaacacatctggactgaatcgtctaaggatctgtccataagcaggcttctgtctcagaccttcagggggaaggaaaacgatacggatctcgacctgcggtacgacacacccgaaccctactcagaacaggatctttgggactggctgcgaaactctacagatctgcaggagcctaggccccgagcgaaaagaaggcccattgtgaagacagggaagttcaaaaaaatgttcggatggggcgattttcacagcaacatcaagaccgtgaaattgaatctgctcataacgggtaagattgttgattag

SEQ ID NO: 11276 - DNA, 783 bp, Artificial Sequence
  Description of Artificial Sequence: Synthetic coding sequence
atgcaaggagagcccttcgcttgcctgacccatcaggaacctctgcccaagatgtttaagctactctcgagagcgtacgcagacgtccaccctatgatgatggatagatccgaaaatcggtgcggcggtaactttttgaaacgtggctcaattattaatggagctgattggtattcttttactggaggtatgagtgattttaattatctgcacactaattgtttcgaaattacagtcgagctggggtgtgtgaaattcccacctgaagaggctctctatatcctctggcaacataacaaggagtccctacttaactttgtggagacggtacatcgcggtattaaaggtgttgtcaccgataagtttgggaagccggtgaaaaacgctagaatctcagtgaaaggaataagacatgatatcaccactgcgcctgacggcgactactggagactgctgccgcctggcatccacatcgttatagcccaagcacctgggtacgccaaggtgattaagaaagtgataatacccgctcggatgaagcgggctggtagggtagactttattctgcagccactggggatggggcctaaaaattttattcacggtctgcggaggacgggtccacacgatccactaggtggcgctagctcgctcggggaggccactgagcctgatccattgagggcgagacgccagccctcagccgacggtagtaagccatggtggtggtcctatttcacatccctttccacacaccgtccacgatggcttctgaaatattag

SEQ ID NO: 11277 - DNA, 882 bp, Artificial Sequence
  Description of Artificial Sequence: Synthetic coding sequence
atgtctagtgggggtggcagcaggggcctcttagcttggctgttactgcttcagccatggccagggcagaattgggccggaatggctgcccctcgactcccgtctcctctcctttcagaggagggcggtgagaatccagaggcatcacccgctcctggtcctgaagctggaccaccactcaacctctttacctcatttcccggagatagcttattgtgtggcagaactcccttgaggattgtgggcggagtagacgcagaggagggaaggtggccatggcaagtatcagtacggaccaaaggacgtcacatctgtggcggtaccctggtgaccgctacctgggttctgacagccggtcactgtatcagttctagatttcactacagcgtgaaaatgggagaccgttctgtgtacaacgaaaacacaagcgtagtggtttctgtccaacgcgctttcgtacaccctaaattcagtactgttactacaatccgaaacgatctagcgcttcttcagctgcagcatcctgtgaattttactagcaatatacagccaatttgcatcccccaggaaaacttccaggtggaaggcaggactcgctgttgggtgacgggttggggcaagactcccgaaagggagaagctggcatcagagatccttcaggatgtcgaccagtatatcatgtgttacgaggagtgtaacaaaatcattcaaaaggctctgagctcaacaaaggatgtgatcataaagggaatggtgtgcggatataaagaacaaggtaaagatagctgccagggagattctggaggtagactggcatgcgaatacaatgacacatgggttcaagtaggaattgtctcctggggcattggctgtggcagatag

SEQ ID NO: 11278 - DNA, 870 bp, Artificial Sequence
  Description of Artificial Sequence: Synthetic coding sequence
atgtttgtgctgctgtacgtcacaagcttcgccatttgtgccagcgggcagccgcgtgggaaccaattgaagggtgaaaattactcaccacgctacatctgcagtattccgggactgcctggcccacctggtccacccggtgctaacgggtctcccggacctcacggaagaatcggcctcccgggtcgcgatgggcgtgacgggcgtaagggagaaaagggcgaaaaaggcaccgccggtctgaggggtaagacgggccctctgggcctggctggggagaaaggagaccaaggcgaaactggaaagaagggtcccatcggaccggaaggcgagaagggtgaggtgggtccaattggacccccaggtcccaagggtgaccgaggcgaacaaggggatcctgggcttcccggtgtgtgtaggtgcggcagtatcgtactgaagtcagctttcagtgtgggtatcactacaagctaccctgaggagcgactccccatcatcttcaataaggtgctttttaatgaaggagagcattacaatcccgcaacaggaaaattcatttgcgcatttcccggaatctattacttctcgtatgacatcactctggcaaataaacacctagccattggcttggtgcataatgggcagtataggataaagacattcgatgcaaacaccggcaatcatgatgtggcctcgggtagcacggtaatttacctacagcccgaggacgaggtctggttagaaattttttttactgatcaaaacggactgttctctgacccaggttgggccgattcgctcttttccgggttcttgttatatgttgatactgattatctcgactccatctcggaggatgacgagctgtag

SEQ ID NO: 11279 - DNA, 2742 bp, Artificial Sequence
  Description of Artificial Sequence: Synthetic coding sequence
atgggccctgaagctctgtctagcctccttttgctcctcctggtcgcaagtggggacgctgatatgaagggtcatttcgaccccgctaagtgcagatatgccctcgggatgcaggaccgcaccatcccagactctgatatatctgctagctcctcctggtctgactctaccgctgcgagacactcgaggcttgaaagctctgatggcgatggcgcttggtgcccggcaggtagtgtctttcccaaggaggaggagtatctgcaggttgacctgcagagactgcatctagttgccctggtggggactcaggggaggcacgcaggcggtctggggaaggaatttagccggtcgtatcgcttgcgctattctagggatggtcgaagatggatggggtggaaggacaggtggggccaagaagtgatcagcgggaatgaggaccctgagggtgtggtacttaaggatctggggcctcctatggtggcaagactggttaggttttaccccagagcagatcgggtgatgtctgtatgtctaagggttgagctgtacggatgtctatggcgggacggtctgttatcctacacagctcctgttggccagacgatgtacctctcggaggctgtttacctaaatgattctacgtacgacggacacactgtgggtggcttgcagtatggtggactgggacagctggctgatggagttgtggggctagatgactttcgcaagagtcaggagctgcgcgtgtggcctgggtatgactacgtgggctggtcgaaccattcctttagctctggatacgttgagatggagttcgaattcgataggttgcgagcatttcaagccatgcaggtacactgcaacaacatgcacaccttaggtgcccgactgcccggaggtgtggagtgcaggtttcggagagggcctgcgatggcgtgggagggcgaacccatgagacacaatctcggtggaaatttgggggatcccagagcaagggctgtctcagtgccactgggaggcagggtcgctaggttcctgcaatgtcggttcctcttcgccggaccctggttgctgttctcggaaattagcttcattagcgacgtggtcaataactcatcacccgctcttggtggaacattcccacccgctccatggtggcctcccggacccccacccacaaacttctcaagcctggaactggagccccgaggtcagcagccagttgctaaagctgaaggttcccccacagcgatattgattggttgtctggttgcaatcattctcctgctcctgctgataattgcgctgatgctgtggcggctacactggcggaggcttctgtcaaaggccgagcggcgtgtcctggaagaagaacttaccgtccacttatctgtccccggagataccatcttgatcaataacaggcccggtccgagagaaccgcctccataccaggagccacggcctcgaggcaaccctcctcattctgctccatgtgttcctaatggtagcgccctgttgctctccaaccccgcttatcgcctgctgctggctacttacgcccgaccccctagaggtcctggtcccccaacgccagcgtgggccaagccgacaaacacccaggcctactccggagactacatggagcctgagaagccaggtgcacccttactgcctcctccccctcagaactcagtgcctcactatgctgaagcagatattgtaacactgcagggggttacaggaggcaatacgtacgctgtgcccgctttaccccctggggctgtgggagacggccctccacgtgtcgatttccccagatctaggctgagattcaaggagaaacttggcgagggccagtttggagaggttcacctgtgtgaggtggatagtccccaggatctggtgagcctggatttcccgcttaacgtgcgcaaaggccaccctctactggtggctgtgaagatcctccggcctgatgcgaccaagaatgcacgcaatgattttctaaaggaagtcaagatcatgagccgcctgaaggaccctaatataatcagactgctgggagtttgtgttcaggacgatccactgtgcatgatcactgattatatggagaatggtgacctgaatcaattccttagtgcccatcagttggaggacaaggccgctgagggggcaccaggagatgggcaggcggcacagggccctaccatttcttatcctatgcttctgcacgtcgctgcacaaatcgcctcgggcatgcggtaccttgctactctgaactttgtccacagggacttagcaacccgcaactgcttagtgggagagaactttactattaagatagcagactttggaatgtcccggaacctgtacgccggagattattacagggtgcaaggaagggccgtgctgcctatccgctggatggcgtgggaatgtattctgatgggaaagtttacaaccgccagtgacgtgtgggctttcggagttaccctctgggaagtcctgatgctgtgccgcgctcagccttttgggcagttgacagatgaacaggtgatcgagaatgcaggcgagttctttagggaccaaggtagacaggtgtacctgtcacgccctccggcatgcccccagggcctgtatgagctcatgcttcgctgttggtctagggaatcggagcagagaccccctttctcccagttgcatcgattcctggctgaggacgcactgaacactgtttag

SEQ ID NO: 11280 - DNA, 1089 bp, Artificial Sequence
  Description of Artificial Sequence: Synthetic coding sequence
atgcggaccctgttcaatctcctgtggcttgctcttgcctgctcccctgtgcacactaccctctccaaaagcgacgccaagaaagcagcatctaagacactgttggaaaagagccagttttcagacaaacccgtgcaagataggggtcttgtggtgacagacctaaaagcggagagtgtcgtcctcgaacaccgctcttactgctctgcgaaagcacgggatagacatttcgccggtgacgtcttgggctatgtcacgccttggaattcccacgggtacgatgttacaaaagtctttggctccaagttcactcagatttcacctgtttggcttcagctgaaacgtcgaggccgtgaaatgttcgaggtgactggcctgcacgatgttgatcagggatggatgagagcagtgcgaaagcacgccaagggactgcacatcgtcccacgtctgctttttgaagactggacctacgacgacttccgcaatgtcctggacagcgaagacgaaatcgaagagctcagtaaaacggtcgtgcaggtggccaagaaccagcacttcgacgggttcgtggtggaggtgtggaatcaattactgtctcagaaacgcgtgactgatcagctgggcatgtttacacacaaagagttcgaacagcttgcacctgttttggatggattctcactgatgacatacgactactcaactgcccaccagccagggcctaacgccccactcagctgggtccgtgcatgcgttcaagtcctggacccaaagagcaagtggagatctaaaatactgcttgggctcaacttctacggtatggactacgctactagcaaggacgccagggagccagttgttggcgctagatacattcagaccctgaaagaccatcgccctagaatggtctgggacagccaggcatctgagcacttttttgagtacaaaaaatctcggtccgggcgacatgtggtgttctatccaactctgaagtcgctgcaggttaggctggaactcgcaagagagctcggggttggggtgagtatctgggaactagggcaagggctcgattatttttacgatctgctgtag

SEQ ID NO: 11281 - DNA, 1350 bp, Artificial Sequence
  Description of Artificial Sequence: Synthetic coding sequence
atgaagtttcaagggccattggcatgtcttctgctggcactctgtctcggcagcggcgaagccggtccactgcaatccggggaagaaagtacaggaacaaacatcggggaagctctcggccacggtttgggtgacgcactgagcgagggtgtgggcaaagcaataggaaaagaagccggaggtgcggcaggctctaaggttagcgaagccctggggcaagggactcgggaagccgtggggactggggtccggcaggtgccaggcttcggcgtggcagatgcacttggtaaccgggtgggggaagctgcccacgctctgggaaatacaggccatgaaatcggaagacaggctgaagatgtcataagacacggcgctgacgccgtgcgcggaagctggcagggagtacctgggcacaacggcgcttgggagacgtcggggggtcatggcatcttcggttcccaaggcggtctagggggacaaggacaggggaatcctggtggcctgggcaccccctgggtacacgggtatccaggaaacagtgcaggaagtttcggaatgaacccccaaggcgcaccatggggacagggcggtaacgggggaccacccaactttggcacgaatacccagggcgcagtggcccagccagggtatggatccgtcagagcctccaatcagaacgaaggatgcaccaatccaccaccttcagggtcaggaggaggctctagtaattctggcggatcaagcacgggaagctcaagtggcaaccacgggggttcaggtgggggtaacggacacaagcctgggtgtgaaaagcctggcaacgaggcacggggatcaggagaatctggcatccagggccagggcagcagctggggatcaggaggaggagatgcggtgggcggagtgaacacggttaacagtgaaacaagtccaggtatgttcaacttcgataccttttggaagaactttaagagcaaactgggtttcatcaattgggacgcaataaacaagaaccaggtcccccctccctccacgcgtgccctgttatacttcagtcgcctgtgggaagacttcaaacaaaacacccccttcctcaactggaaagctatcatcgagggagccgatgcttctagccttcagaagagagctggtcgcgatgaccagcccggagctggatggcaggaggtcgccgcagtgacatctaaaaattataactataatcagcatgcgtacccaacagcctatggcggaaaatacagtgtgaagactcctgcaaaaggcggtgtatcacctagcagctccgcctcccgcgtgcaacctggtctgttacagtgggtgaagttctggtag

SEQ ID NO: 11282 - DNA, 735 bp, Artificial Sequence
  Description of Artificial Sequence: Synthetic coding sequence
atgtggggggctcccctaccaagacgtcctgtttgggatgtccggtcagcttccgccggaccccagccttgtcttggcggaaaaatgaagctcaatctcgttcagattttcttcatgcttttgatgttactgctgggcctgggcatggggttaggcctggggctgcatatggctaccgccgtgttagaagaaagcgatcaacccctaaatgagttctggtcctcagatagccaggacaaggccgaggccaccgaagagggggatggaacacaaaccaccgaaacattggtactctcgaacaaggaagtcgtccaacctggctggccagaagaccccatcctcggcgaggacgaagtcggcggaaataagatgttgcgggcaagcgccttattccagagtaacaaggactacttgcggctggatcagaccgaccgcgagtgtaatgatatgatggcacacaagatgaaggagcctagccaatcatgtattgctcagtacgcctttatacacgaggatcttaacacagtcaaagctgtatgcaactcccccgttatcgcgtgcgagctgaagggcggtaaatgtcacaagtcatcccggcctttcgacctcacactctgcgaactttcccaaccagaccaggtcacgccaaattgcaactatttaacctcggttataaaaaaacatattattataacatgcaatgatatgaaaagacagttaccaacaggccagtag

SEQ ID NO: 11283 - DNA, 1728 bp, Artificial Sequence
  Description of Artificial Sequence: Synthetic coding sequence
atggcatcctggttgagaagaaaattgaggggtaaacgtaggccggtgattgcgttctgtctcctgatgattctatcagctatggctgttacccgctttcccccacagcgtccctccgccggacccgatcctggtccgatggaaccacagggggtgactggtgctccagctacgcatatccgccaagccctgagcagcagccggcgtcagagagcaaggaacatgggcttttggcgtagccgtgcgctgccgagaaactcaatattggtctgcgccgaggaacagggtcatcgcgcaagagtcgatcggagccgggagagtcctgggggagatttaagacatcctggacgcgttcgaagggacatcactctgtccggccaccctaggttatccacccagcacgtggtgctcttgagagaagacgaggtcggcgacccaggaactaaagacctcggccatccccagcacgggtcacctatccaggagactcaatcagaagtggtgactctggtgtccccactccctggctctgatatggctgccctgcctgcttggagagctacctccgggctgacgctgtggccccatacggctgagggacgcgatcttctgggtgcggaaaatagagccctgacaggcggtcagcaggccgaagacccaacactggccagtggcgctcaccagtggcctggatctgtggaaaagctgcagggctctgtgtggtgtgatgccgaaactctgctgtcaagcagcaggactggcggacaggccccaccgtggcttactgatcatgatgttcaaatgctgaggttactggctcagggcgaggtggtcgataaggcaagggtgccagctcacggacaggtcctgcaggttggcttctctacagaagccgcactccaggatctgagcagccccaggctcagtcagttatgtagccaggggttgtgtggccttataaaaagaccgggagacttgccggaagtattgagcttccacgtggatcgggtgcttggacttaggcgcagcttgccggctgttgcaaggcggtttcactcaccgctcctaccatacaggtataccgacgggggagccaggccggtaatttggtgggctccggatgtccagcatctttctgaccccgacgaagatcaaaactccctggctcttggctggctgcagtatcaagccctccttgcacattcctgtaattggcccggacaggctccctgtcctggcattcatcataccgaatgggcaaggctggcactcttcgacttcctgctgcaagtgcatgaccgccttgaccggtactgttgcggattcgagccagagccatctgacccctgtgtcgaggaaaggcttagggaaaagtgccaaaatcctgccgagttgcgccttgtccatatcctggtgcgctctagtgacccgagtcatttggtttacattgacaacgctggcaacctccagcatccggaagataagcttaatttccggctgctggagggcattgacggatttccagaaagtgctgtcaaggtactggcctcaggttgcctacagaacatgctgctgaagtctcttcagatggatccagttttttgggaatcccagggcggtgcacaaggactgaagcaggtgctgcaaacccttgagcagcgcggacaggtgctgctgggccatattcagaagcataatctgaccttatttcgtgatgaagatccctag

SEQ ID NO: 11284 - DNA, 390 bp, Artificial Sequence
  Description of Artificial Sequence: Synthetic coding sequence
atggcggctggatctgcaccaatgcagcttcatctgagggctaccattaggatgaaggacgggctgtgtgtgccaaggaaatggatataccacctgacagagggctctacagacctacgcactgaaggcaggcctgacatgaaaacggagttgttctctagctcttgtccaggtggtatcatgttgaatgaaaccgggcaggggtatcagagatttcttctgtataataggtcccctcacccacctgagaagtgtgtcgaagaatttaagagcctgaccagctgtcttgactccaaggcctttctgctcaccccgaggaatcagggcaaaggtttaaagtctcacaagaccggactgggattaactaaaagctccggcgttacagggtag

SEQ ID NO: 11285 - DNA, 567 bp, Artificial Sequence
  Description of Artificial Sequence: Synthetic coding sequence
atgtttcaccagatttgggccgctctgctctacttctacggtatcatcctgaacagtatctatcagtgtccagagcactcacagctgactactttgggtgttgacggtaaagagtttccagaggtacacttgggacaatggtattttatagctggggcagccccaactaaagaagagctggccacattcgatcccgtcgataacatcgtgttcaacatggcagcaggcagtgctcctatgcagcttcacttgcgggctactattagaatgaaggacggcctgtgtgtacccaggaaatggatctatcaccttactgaaggctctacggacctccgcacggaaggtcgacccgacatgaagaccgagttgttcagctcaagctgccccggtggcataatgctgaacgagacagggcagggctatcagagatttctgttgtacaatcgatccccccatccacctgagaagtgcgtggaggaatttaagtccctgacgtcctgcctggactccaaggcgtttctgctgactcccaggaaccaggaagcttgtgaactcagcaacaattag

SEQ ID NO: 11286 - DNA, 2676 bp, Artificial Sequence
  Description of Artificial Sequence: Synthetic coding sequence
atgctgcccacagaggtgccccagtcacacccaggcccatcggctcttcttcttttacaactgctcctgcctcctacaagcgcattcttccctaatatatggagtttgctggccgctccaggctcaattacacaccaggacctcaccgaagaagctgcccttaatgtgaccttacagctgtttctggaacagccgcctccaggcagaccccctctgaggctagaggatttccttggccgaactttgctagccgatgatctgtttgcggcttactttgggcctgggtcttctcgccgatttcgtgccgctcttggtgaggttagtcgagccaatgccgcacaggatttcctccccacctccagaaatgatcctgaccttcatttcgacgccgagagattgggccaagggagggctcgcctggtaggcgcactgagggaaacagtagttgcggcacgggcacttgaccacacccttgctcgacagaggttgggggctgcccttcatgctctgcaagacttttattcacactctaattgggtagagctcggagagcagcagccccacccacacctgctttggccgagacaagagctacagaacctggcccaagtggcagacccaacttgttcggattgtgaggagttgagttgcccacgtaattggttaggcttcacgctgctgaccagtggttatttcggtacacaccctcccaagccgccaggcaaatgctcacatggaggccattttgatagaagctcttcccaacctcccagagggggaattaataaagattcaacatctcccggattcagcccacatcatatgctgcacctgcaagctgcaaaactggccctgctggcgagtatccaagcattcagccttttacgcagccgtctgggagacagggatttctcacgcctgctggacattactccagctagctccttgtccttcgtcttggatacaaccgggtcaatgggggaagagatcaatgctgccaaaatacaggcgaggcatctggtcgagcaaaggcggggatcgccaatggagcccgttcactacgtcttggttccattccacgaccccggttttggccctgtattcaccacgtctgaccctgattctttctggcaacagctgaacgagatccatgcactgggaggaggcgatgaacctgagatgtgtctgtcagcgcttcagctcgccctgctgcatacaccacccctgagcgacattttcgtgtttacagacgcatcccccaaagacgcctttctgacgaaccaagtcgagtcactgacccaggagcgcaggtgtcgagtcacattcctcgttacagaggacacgagccgcgttcaaggccgtgctcggcgtgaaattttgtcccccctgaggtttgagccctacaaagccgtggctcttgcctccggaggtgaggttatcttcacaaaagaccagcacatcagggatgtggctgctatcgtcggagagagcatggcagccctggttactctgcccctcgaccctcccgttgtggtgccaggccagccgctggtgttttccgtggatggtctccttcaaaaaattacagtacgtatccacggagatatcagctcattttggattaagaatcctgctggggtaagtcagggccaggaagagggtggtggccctctcgggcacacccgaagatttggccagttctggatggtgaccatggacgaccccccacaaacgggaacctgggaaatacaagtcaccgcagaggatacacccggtgtacgagtccaagcccagacgtctttggatttcttattccacttcggaattcctatggaggacggcccacaccctggcctgtatcctttaacgcagccggttgccggtctacagactcagctgttggtggaggttacaggccttggaagccgcgctaaccccggtgatccccagccacacttctcccatgtgatcctgcggggagttcctgagggagcggagcttggacaagtgcctttagaacctgttggccctcctgaacgaggcctcctcgcagcctcactctctccaacactgctaagcacacccagacctttcagtctggaactgattggacaggatgctgccggtaggcggcttcatagggccgctcctcagccttcaacagtcgtgccggtgctgctcgagctatccggtccctctggctttctcgctcccggatctaaagtgcccctgagcctccgtatagcatccttctcaggaccccaggatctcgatctccggacgttcgttaaccccagcttctcactgaccagcaatttgtctcgagcccacctggagctgaatgagtcggcctggggtaggctgtggctggaggtgcccgactccgctgctcccgactcagtggtaatggtgactgtgacggcagggggacgggaagctaatccggttcctcctacccatgcattcttgaggctgctagtgagtgccccagcccctcaggaccgccacactacgcctacaggttcctctgatcccattcttacaaccgctactcctgcattcagtcccttcactctggtaactcagggacgcgcaggtgctggtctggcagcaggatccccctggtgggggaccgtcggcggtgtcctgctgctactgggcttagccagctggtag

SEQ ID NO: 11287 - DNA, 2742 bp, Artificial Sequence
  Description of Artificial Sequence: Synthetic coding sequence
atgggcccagaagctctgtctagcctgctgcttctgctgctcgtagctagtggagatgcagacatgaagggccacttcgacccggctaagtgtcgctatgccttgggaatgcaggacagaacgattcccgatagcgacataagtgcgagctcctcatggtccgactctaccgccgctaggcatagccgtttggagtcgtccgatggagatggagcctggtgtcctgccggtagcgtgtttcccaaagaggaggagtacttgcaagttgaccttcagcgactccacttagtcgctttagtaggcacgcaaggcaggcatgccggaggacttggcaaggagtttagtagaagctatagattgagatacagcagagatgggaggcgttggatggggtggaaggatagatggggacaggaggtgatctccgggaacgaggacccagagggcgttgtactgaaagatctcggtcccccaatggtggccaggctcgtcagattctaccctcgggctgaccgggtcatgagcgtgtgcctacgagtcgagctatacggctgtctatggagagacggattgctgtcatataccgcccctgtgggacagaccatgtatctaagcgaggccgtgtatctcaacgatagcacctatgatggtcataccgtaggcggattacaatacggagggctgggacagctcgccgacggagtggtgggcctcgacgatttccggaaatcccaggaactaagggtgtggccgggatatgactatgtcggatggtcaaaccactcctttagcagcgggtatgtcgaaatggaattcgagttcgacagactgcgcgcttttcaggcaatgcaggtgcattgcaacaacatgcacactctgggcgctaggttacccggtggtgtggagtgcagattcagaaggggaccagccatggcctgggagggggagcctatgcgtcacaacctcgggggaaacttaggggacccacgtgctagagctgtgtcggttcccttaggaggacgggtcgcaaggttcttgcagtgccggttcctgttcgcaggcccttggctcctgttctccgagattagcttcatcagcgacgtggtgaacaactcatcccccgcactcggtgggacatttccacccgcaccatggtggccacccggtcctccgcctacaaatttcagtagtctggagctggaacctagaggccagcagcctgttgcaaaagctgagggctctcccactgccatcctgatcggctgtcttgtggcaattatcctcctgcttctactaatcatcgccctgatgctgtggcggctccattggaggcgactcttgagcaaggctgagagacgcgtgctggaggaagagttaacagtgcatctgtctgtgcccggagacaccatcttgattaacaataggccagggcctcgggagcctccaccttaccaggaaccacgacctagaggaaatcccccacattcggcaccatgcgtgcccaatggcagcgcgctgctcttaagcaaccccgcatatcggcttctgttagccacttatgcgcgacctcctagagggccaggacctccaaccccggcttgggccaagcctacgaacacacaagcttattctggtgactacatggagcctgagaagccaggcgctcctctcctccccccacctccacagaattctgtcccacactatgccgaagcggacattgtcactctacaaggggttacaggaggtaatacatatgctgtccccgcattaccccctggcgctgtgggcgatggaccacctagagttgatttcccacgatcgcgcctccgattcaaggagaaattgggtgagggccagtttggcgaagtccacctgtgtgaagtggactcacctcaagacctcgtgagcctggactttcccctgaatgtcaggaaaggccatccccttctggtggccgtaaaaattcttcggccagatgccaccaagaacgcccgtaacgatttcctgaaggaggtgaaaatcatgtcccgactcaaagatcccaatatcattcgcctacttggggtgtgtgtccaggatgaccccctgtgtatgattaccgactacatggaaaacggcgatctcaaccaattcctttccgcccatcagctggaggataaggcagctgaaggtgcgcctggggatggccaagcagcgcaagggccaacaatcagctatcccatgttgctccatgttgctgcccagatagccagtggaatgagatacctggcaaccttgaatttcgttcaccgggatttggcgacacgcaattgtctcgtgggtgagaatttcaccatcaaaatcgccgacttcggaatgtctagaaacctgtacgcgggagactattatcgggtgcagggtagagccgtgctcccaatccggtggatggcttgggagtgcattcttatgggtaaatttactactgcaagtgacgtttgggcttttggggtgactctgtgggaagtgctcatgctgtgtcgcgcacagccgttcggccaacttacagatgagcaagtcattgaaaacgcgggtgaatttttcagggaccagggccgacaggtatatctgtcacggcctcccgcatgtccacagggcctttacgagttgatgctcaggtgctggtctcgcgagtctgaacagcgccctccatttagccagctgcacaggtttcttgcggaggacgctctgaataccgtttag

SEQ ID NO: 11288 - DNA, 453 bp, Artificial Sequence
  Description of Artificial Sequence: Synthetic coding sequence
atgcggtttatggccggacccgctgggagccagagtttgggccctctgtgctttcactcaagcccccaggcgctttatactgtactgctcatcgtgctggttatgatgagtttagtgttcggaaagttcgtgcccgtgaactgggagccaccacagcctctaccctttcctaaataccttcgctgttatagatgcctcttggaaacgaaggagctggggtgcttactcggaagcgacatttgcctgacacctgccggttccagttgtattacactgcacaaaaaaaacagcagcggctctgacgttatggtttccgactgccggtcaaaagagcagatgtctgactgctcaaataccaggacgtccccagtgtccggtttttggatattttcacagtactgttttctggacttttgcaacgatcctcagaacaggggactctacacaccttag

SEQ ID NO: 11289 - DNA, 192 bp, Artificial Sequence
  Description of Artificial Sequence: Synthetic coding sequence
atggggcctgaggctctgtccagccttctcttactgttactggtggcatccggggatgcagatatgaagggacacttcgacccagcaaaatgccgctatgccttgggcatgcaggataggactatcccagattccgacatttcagcgtcaagctcctggagtgattccaccgcagccagacactcccgttag

SEQ ID NO: 11290 - DNA, 1212 bp, Artificial Sequence
  Description of Artificial Sequence: Synthetic coding sequence
atgcaggggacccccggaggaggaacacgccctgggcctagtcccgtcgaccggagaacattactcgtgttctcctttatcctcgccgcagctctcggtcaaatgaactttactggtgaccaggtgcttcgtgttctcgccaaggacgagaagcagctgagtctgctcggagacttagagggtctcaaacctcagaaagtggatttctggcgaggacccgctaggcccagcctgcctgttgatatgcgcgtcccgttttccgaactgaaggacattaaagcttacctcgagagccacggcctggcatactccataatgatcaaggacattcaagtgctcctggacgaggaacgtcaagccatggcaaagtcccgccgtcttgagaggtcaactaatagctttagttacagcagctatcatacattggaagagatctactcttggatcgataactttgtgatggaacactcagatatcgtgtctaagatccagatcggtaatagcttcgagaatcagtctatattggttctgaagttctcaaccggtggctctagacatccagccatctggatcgacacgggcattcactctagagagtggattacacacgctacaggcatttggaccgctaacaaaatagtcagtgattatggcaaagaccgggtgcttaccgatatattaaatgcaatggacatcttcatcgagctagttaccaaccccgatgggttcgccttcacacactcgatgaatcgtctctggagaaagaataaatctattaggcccggtatcttctgcatcggagtggatttaaatcggaattggaagtcaggcttcggaggaaacggttcaaactcgaacccctgttccgaaacgtatcacggcccatcaccacaaagcgagccagaggtagcagctattgttaacttcatcactgctcatggtaattttaaagccctgatctctattcattcgtacagccagatgcttatgtatccctacggtaggctcttggagcctgtcagcaaccagagagagctgatgtggcctgtgggctcaccttccaccggccctatgacagtggctagcagcaccccttctgccttaagtagcgggaccttgggatctatggcctcatgctgccgtccccatcgttcgtcgcccaggccgagaagacgaggctggagattcgggccttcctggtcaaccccgtag

SEQ ID NO: 11291 - DNA, 1542 bp, Artificial Sequence
  Description of Artificial Sequence: Synthetic coding sequence
atggcacccgcacgcacaatggcccgagcacggctggccccagccggtattccagccgtggcgctgtggcttctgtgcaccctcggtctccaggggacccaagctggtccacccccagcccctccaggactgccggctggagccgactgcctcaactcatttacagccggtgtccctgggttcgtgttagacaccaatgctagcgtgtctaacggtgcaaccttcctggagtcgcccacggtaaggcgcggatgggattgcgtcagagcatgttgtacgacgcagaattgcaatcttgcgctggtggaattgcagcctgaccgcggagaagatgcgatagctgcatgcttcctgatcaattgtttgtatgagcagaactttgtatgcaaatttgcacctagagaagggttcattaattatctgactcgcgaagtgtataggtcatatcggcagctgcgtactcaggggttcgggggtagtggaatacctaaggcttgggcgggaatagacctgaaagtgcagccgcaagagccgctggtgttgaaggacgttgaaaatacagattggcgactgctccgtggagacactgacgtcagagtggaacggaaggatccaaaccaggttgagctgtggggtcttaaagaaggcacttatttgttccagctcactgtgacatcttccgaccatccagaggacactgccaatgtcaccgttacagtgctgtcaaccaaacaaactgaggactattgcttggcttcgaataaggtcggcaggtgccggggttcgtttccacggtggtactacgaccccactgaacagatctgtaagagcttcgtctacgggggatgtctcgggaataagaataattacctgcgcgaagaagagtgtatactcgcctgccggggagtgcaggggccttctatggagagacgacaccctgtttgttccggaacatgtcagcccacacagttccggtgttctaacggatgctgtatcgactctttcttagagtgcgacgacaccccaaattgccccgacgctagtgacgaggccgcatgtgaaaagtatacatctggctttgacgagctacagaggatacacttccctagtgacaaggggcattgcgtcgacttgcccgacaccggcctctgcaaggaaagcatccccaggtggtattacaacccgttctccgaacattgtgcacgttttacttatggagggtgctacggaaacaagaataatttcgaggaggagcaacagtgccttgaaagttgcagaggcataagtaagaaggacgtgttcgggctacgacgggagattcctattccttccacggggagtgtggaaatggcggtggctgtcttcctagtgatttgtatagtggtcgttgtagccatcctgggctactgtttcttcaagaaccagcgtaaggactttcacggccatcaccatcacccgcctccgactcctgcctcctccaccgttagcactacagaggatacggagcatttggtctacaatcacactaccaggcccctgtag

SEQ ID NO: 11292 - DNA, 798 bp, Artificial Sequence
  Description of Artificial Sequence: Synthetic coding sequence
atggcaccttggtcacatcccagtgcacagttgcagcctgtgggaggggatgccgtctctcccgcactgatggtgttgctgtgtctcggcttgtccctgggccctcgcacacacgtgcaagcgggaaatctgagcaaagcaacattatgggctgaacccggatctgtgatcagtagggggaactctgtgaccatcagatgccagggtactcttgaggcacaagaataccggctcgttaaagaaggaagccccgaaccttgggacacccagaatccactcgaaccaaagaataaggccagattctcgattccttcgatgaccgaacatcatgccggtcgctatagatgctattactactcccccgcaggctggtctgaaccttccgatcctttagagttagttgtgaccgggttctacaataaaccaaccctgtcagcacttccaagtccagtagtgacctcaggagaaaatgtgaccctgcagtgtggatcacgccttaggtttgatcggtttattcttacagaagagggggatcacaagctatcttggactctcgattcgcaactgactccctccgggcagttccaagccctgtttccggttggtccggtcacgccaagtcatcggtggatgctcagatgttatggatctagaaggcatatcctgcaggtctggtctgagccttctgacttgctggagatcccagtgtctggcgaggaggccacagtcttcagttctaccatccaaggaagtcagaccgggtgcggcgagttgtacagacaagggagtccgtgctag

SEQ ID NO: 11293 - DNA, 795 bp, Artificial Sequence
  Description of Artificial Sequence: Synthetic coding sequence
atggaaaagcccattctgaaaaacctcaatgaaatgctgtgtcctatcatcgccagcgaggtgaaggccctgaacgcaaatctcagcaccttggaagttcttacaaagatcgacaattacactctattagattattcactcatctcttctcccgagatcactgagaactatcttgacctgaatcttaagggggttttttaccccttggaaaacctgacagaccctcctttctcaccagtaccttttgtactgcctgagaggagtaacagtatgctgtatatcggcatcgctgaatatttcttcaagagtgccagctttgctcatttcacagccggagtgttcaacgtgaccctctccacagaagagatcagcaatcacttcgtccaaaactcccagggtcttggcaacgtgctgtcccgcgtcgctagtacctcagtggggctggtaattctcggccagcgcctagtgtgctcgctgtctctcaaccgctttaggttagccctgcctgagagtaatagatcgaacattgaagtgctacgtttcgagaatattctgtcatccatcttgcatttcggcgtgctccctctggcaaacgccaaactccagcagggcttcccgctgagtaacccacacaaattcctcttcgtaaattctgatattgaagttctggagggtttcctattgatctctacggatcttaagtacgagaccagctcaaaacagcaaccctcctttcatgtgtgggaggggctgaacctaataagtcgacaatggagaggcaaatctgcaccctag

SEQ ID NO: 11294 - DNA, 117 bp, Artificial Sequence
  Description of Artificial Sequence: Synthetic coding sequence
atgaacaagatattgtcatccactgtctgtttcggtctcctgactctgctatcggttctgtcttttcttcagagcgtacacggaaggccttacctgacccagggtaatgagatatag

SEQ ID NO: 11295 - DNA, 567 bp, Artificial Sequence
  Description of Artificial Sequence: Synthetic coding sequence
atgtttcatcaaatctgggctgccctgctgtacttttacggcattattctaaactcgatctatcagtgccccgagcatagccagttgacgaccttgggcgtagacggcaaggaatttccagaagttcacctgggacagtggtacttcatcgccggagctgcgcctactaaggaagagctcgcaacattcgatcctgtcgacaatatagtgtttaacatggctgccggatccgcaccaatgcagcttcatcttagagccaccattaggatgaaagatggtctgtgtgttcctcgaaaatggatttatcatctcacggagggcagtactgatttgcgtacagaaggtcgtccagatatgaagactgaactgttttctagttcttgccctggaggcattatgcttaatgagacgggacagggatatcaacgatttcttctttataatcgctcaccccaccctccagaaaaatgcgtggaggaattcaagagcctcacaagttgtctggatagcaaggcgttcttgctgacacctcgcaatcaggaggcttgcgagttaagtaataattag

SEQ ID NO: 11296 - DNA, 600 bp, Artificial Sequence
  Description of Artificial Sequence: Synthetic coding sequence
atggaaaccttccctctgctccttctgagcttggggttggtgcttgccgaagctagcgagagtacgatgaaaattatcaaggaggaattcacagacgaagagatgcagtacgatatggcgaagagcggacaggagaaacagacaatagagatactgatgaaccccatccttctcgtgaagaatacaagcctgtccatgtccaaagatgacatgtcatctactcttctgacgtttcgctcactgcattacaacgaccctaaggggaactcttcaggcaacgataaggaatgttgcaacgatatgacagtatggaggaaggtgagtgaggctaacggatcgtgtaagtggtcgaataattttatccgatcgtcaaccgaggtcatgcggagggtgcaccgcgcaccctcctgcaagtttgtgcaaaatccaggaatatcatgttgtgagtccctggagctggagaatactgtttgccagtttaccaccggaaagcaattccctcggtgccagtatcactctgtcacatcactggaaaaaatattgactgtccttactgggcacagcctgatgagctggctcgtctgcggttccaagttgtag

SEQ ID NO: 11297 - DNA, 30 bp, Artificial Sequence
  Description of Artificial Sequence: Synthetic coding sequence
atggcaccgaagaaactgtcctgcctttag

SEQ ID NO: 11298 - DNA, 831 bp, Artificial Sequence
  Description of Artificial Sequence: Synthetic coding sequence
atggcgcctagtccattacaaaggctgcattgcggcccatctcccagcccacgtcctactgaagtccctcgcggtaccgtgtccgtgtcttgtcgatacctgaagaactccctgcacgtcttcgtttccggcggtgccataggaacctcctctccagcgctgctcgagtgtcaggaaggtgttggcccagcgcgaccgagtctgctggttccacctccccctcggccaaggcgactggacctcgctaggacactgcccgctgaacggactgactcccagtcgttgtatatcgtctatattgcactccccggaaggaccccccgtccagctcttgctttcgctttcctgatgcctgcttgttgtaatcgtccatcccctcgaccttcacctgcccatctgactgcctccagcgtgcttcgaagacagagacacgtactggccgcaagcgctgcgagtccttgccaatggtctggactgcgggtcgcccatagcctgcgacaggtggtgtccctgtgtcccaggtgcacaggctcctgccccttttctggcgcatgtgctagttcattgccatctcccctcagttgccctcattcacacagcgggtcttgggggacatggagccaaggacgaccctgctcaagtaccgaggtggccggtcttgcattgtggccaacagatttcctcagctgccttttggacgcctcagaattacagacacaaggtagccacggcttttcttttaccccgaccgggttcagcagcaataggaaggtgggtgtcggttcttgtcgggatggcgcagggaggggggcaatgggcggtctcttctag

SEQ ID NO: 11299 - DNA, 678 bp, Artificial Sequence
  Description of Artificial Sequence: Synthetic coding sequence
tgagcagaccttccaagttgctggggcgctggcccatgttacaccggccataaagtgggagcattaagaagggacacagtaatttgttgctgcagacatggcgactacagcacaccttgtctgtttactccgggaaagccctctcgaaacccgtcaccctggaaacgtaccctgtggaccctgagcgccccatgggctggtccggctggatggaccggcgaagagcaaaatgctactaagaccggtcttatcacccgcagaccacgacccctacgccgtcgcccacaccccgcacccgcaagtcccctgccagaaattattagaggcaacatccctcgtatgctcggtaagttcgtgcccgtgaattgggagcctcctcagcccctgcctttcccaaagtacctcagatgttatagatgcttacttgaaactaaggagctgggatgcttgttgggcagcgatatttgcctgacaccggctggctccagctgcatcactctacacaagaagaattcctcgggtagtgacgtcatggttagtgattgcaggtccaaggagcagatgtccgattgtagcaatactagaacttcacctgtcagcgggttctggattttttctcagtattgtttcctggacttctgcaatgatccacagaacagagggctctataccccgtag

SEQ ID NO: 11300 - DNA, 534 bp, Artificial Sequence
  Description of Artificial Sequence: Synthetic coding sequence
atggttcctgctgcaggggctctcctgtgggtgctgcttcttaacctggggcctcgcgctgctggagcccaaggattaacacaaacccctacagaaatgcaaagagttagtcttcggttcggcggaccaatgacgaggagctaccggtctaccgcacggacaggcttacccagaaaaacccggatcatactcgaggatgaaaatgacgctatggcggacgccgatcgcctggccggtcccgctgcggcagaactgctggccgctaccgtgagcaccggcttctcgaggtcctccgcaattaacgaggaagacggtagttctgaagaaggtgtagtcattaacgcgggtaaagacagtacctcaagagagctgcctagcgccacacctaacactgcaggaagcagcagtactcgttttatcgcgaactctcaagaaccggaaataaggctcacttcttccttgcctcgcagtcctggtaggtctactgaggatctacctccctgccatttactccgcatatgtgggtggtgttag

SEQ ID NO: 11301 - DNA, 912 bp, Artificial Sequence
  Description of Artificial Sequence: Synthetic coding sequence
atgctccatcccgaaacaagtcccggaaggggacacctccttgcagtgctgttggccctgctaggtaccgcgtgggccgaagtctggccccctcagcttcaggaacaggctccgatggctggggctctcaatcgcaaggagtcttttctgctcctgtcccttcacaacagactgcgatcatgggtgcaaccaccagccgctgatatgcgcaggttggactggtcggactctttagctcagctggcccaggctcgagccgctctatgtggcattccaacaccttcgctcgcatccggcctatggcgcacccttcaggtggggtggaacatgcagctgctgccagccggactggcctcatttgtggaggtggtgtctctttggtttgcagagggccagaggtactctcacgcggctggcgagtgtgcacgcaacgcaacctgcacccactacacgcagctcgtgtgggcaacgtcctcacagctgggatgcggccgtcacctttgttctgctggtcaggctgcaatcgaggcattcgtatgtgcctacagtcccagaggaaattgggaagtgaacgggaaaaccattgtgccatataagaagggtgcctggtgctctctgtgtacggcatccgtaagtgggtgcttcaaggcttgggaccacgccggtggcctgtgcgaagtgccacgcaatccatgtcgaatgtcttgccaaaatcacggcaggctcaacatctccacttgccattgtcattgcccaccagggtacacgggcaggtattgtcaggttaggtgttcgttgcagtgtgtgcacggacggttccgtgaagaggaatgttcctgtgtttgtgacatcggatatggggagcctagtgtgccccctaggtgcatatttcctagcacaccagttacttag

SEQ ID NO: 11302 - DNA, 1482 bp, Artificial Sequence
  Description of Artificial Sequence: Synthetic coding sequence
agcgaggcagtgtacctgaatgacagtacatatgatggccatacagtgggtggtttacagtatggcggtctgggacagctggccgacggcgttgtgggcctcgacgactttcgtaagagtcaggaacttcgcgtgtggccgggatatgactatgtagggtggtcaaatcattctttctcttcaggctatgtcgagatggagtttgaatttgacagattgcgcgcttttcaggctatgcaggtgcattgcaacaatatgcataccctgggtgcccgtttgcccggaggcgttgagtgtcgctttcggagaggaccggcaatggcctgggaaggtgagcccatgaggcacaatttaggcggaaatttgggcgatcccagggcgcgtgctgtcagtgtgccgttaggaggccgagtggcccgatttctccaatgtaggttccttttcgccggtccgtggctcctgttctctgagatctctttcataagtgatgtggtcaacaattcgtcgcccgctctcggaggtactttcccccctgcaccgtggtggcctccagggcctcctcccaccaatttcagctctctggaattagaaccccgaggacagcagcctgtggccaaagccgagggatcccccacagcaatcttgattggatgcctggtggctatcatcttattgctcctgctcataatcgccctgatgctgtggcggctgcattggcgacggctcctgtctaaggtgctggaatcacaccccagaacgagaagtccagggctggtgggcattcggcctacccccctcccagtttcccctatggctctacggtgctgtagccccattcaacctacagccagcttctggccgctgaccccagtgcccctggaagcaagagcacctcctcacccacctggacctaacccccctacgcctcgcggtgtgactgggggtaatacgtacgctgtgcccgctcttccacccggtgcggtgggggacggacctccgcgagtggacttcccacgatcccggctcaggttcaaggagaagctaggggagggccaatttggagaagtgcacctgtgtgaggttgactctccgcaagacctggtatcactggactttcccttaaatgtgaggaagggacacccactgctcgtggccgtgaagattttgcggcctgatgcaactaagaacgccaggaacgacttcttaaaggaggtaaaaattatgagccggctgaaagacccaaacattatcagactgttaggcgtatgcgtccaggacgatccactctgcatgattaccgactatatggagaacggtgacctgaaccaatttctctctgctcatcagctcgaggacaaagccgcagagggggcaccaggagatggacaggccgctcaaggccctacgatctcataccctatgctcctgcacgtggccgctcagatcgcgtcaggaatgcggtacttagctactctgaactag

SEQ ID NO: 11303 - DNA, 807 bp, Artificial Sequence
  Description of Artificial Sequence: Synthetic coding sequence
atgaagcagatcctgcatccagcactcgagacgacagacccgtgctccaccggatttgtgttccccgctatgacgttatttccagtactgttgtttttggttgcgggactgctgccctccttccccgcaaatgaggataaagatccggctttcactgccctgttgacaacccagacgcaggtgcaaagggaaatcgtgaacaaacacaacgagctgagacgggctgtctcccccccagccagaaacatgttgaaaatggaatggaataaggaagctgccgctaatgcgcagaaatgggccaaccagtgtaattatcgccattcgaacccaaaagaccgcatgaccagtctgaaatgtggtgaaaacctctacatgtcctctgcctcctcaagctggtctcaggctatccagtcctggttcgacgaatataacgatttcgactttggagtgggcccaaaaacccccaacgcggtagttggacactacacacaagtagtctggtacagctcttatctggtgggctgcggcaacgcttattgccccaaccaaaaagtgctgaaatactattatgtttgtcagtactgtcccgcagggaactgggccaaccggctgtacgtgccctatgagcagggtgctccatgcgcgagctgccccgataattgcgacgatggactgtgcactaatggatgcaaatatgaggatctctactcgaactgtaagtctttgaagctgacgctcacttgcaagcaccagctcgtgagagatagttgcaaggcgagttgcaactgtagtaatagtatttattag

SEQ ID NO: 11304 - DNA, 372 bp, Artificial Sequence
  Description of Artificial Sequence: Synthetic coding sequence
atgctccctaagagccgcagggctctcaccattcaggaaatagctgccctggcccgatcttctttgcacggtataagccaggtagtgaaagatcacgttacaaagcctactgcgatggcgcagggtagagtggcccatctgatagagtggaagggctggtccaaaccatcagacagcccagccgcactggaatccgccttcagttcatattcagatctaagtgaaggcgagcaggaggcccgattcgcagctggagtggcggaacaatttgccattgcagaggccaagctgagggcttggagctcagtggatggcgaagattccacagatgattcgtacgacgaggacttcgcagggggtatggacacgtag

SEQ ID NO: 11305 - DNA, 726 bp, Artificial Sequence
  Description of Artificial Sequence: Synthetic coding sequence
atgggtgccgtcatgggcacattctcaagcctgcaaacaaagcagcggagacctagcaaggataaaatcgaagacgaactcgagatgaccatggtttgtcacaggccagaaggactcgaacagctggaggcacagaccaacttcaccaagagggagcttcaggtcctttaccggggattcaaaaatgaatgcccatccggcgtggtcaacgaggatacttttaagcagatctatgcacaattctttccacatggggctctgccttgccttgagggctccccttgtgtagagttcctacctccatcccctgctctgctgttctgcctggttgatgcttccacttatgcccattatctatttaacgcttttgacacgacacagactggaagcgtgaagtttgaggacttcgtgaccgctctgtccattctgctgcgaggcactgtccacgagaagctcagatggacatttaacctgtacgacattaacaaggacggctacattaacaaagaagaaatgatggacatcgtgaaggctatttacgacatgatgggtaaatacacttatcctgttctcaaagaggacactccacggcagcacgtggacgttttttttcagaaaatggacaagaacaaggatggcatcgtcactctggatgaatttctggaatcatgtcaggaagacgacaatatcatgaggagcctgcaattgttccaaaacgtcatgtag

SEQ ID NO: 11306 - DNA, 630 bp, Artificial Sequence
  Description of Artificial Sequence: Synthetic coding sequence
atgggccctgaggcgctttcctcgttattgctcctcctgctggtcgctagtggggacgcggacatgaaaggtcattttgaccccgcaaagtgcaggtacgcactgggaatgcaagatcgcactatccccgactctgatatcagcgcatcgagcagctggagtgatagcacggcagctcgccatagccgattggaatcttccgacggtgatggcgcatggtgtccagcagggagcgtcttccctaaggaagaagaatacctccaggtcgacttacaacgtctgcatcttgtggctttggtggggactcagggccgtcatgcaggcggattaggtaaagagtttagtcgaagttacaggttgcgctactcccgagacgggaggaggtggatggggtggaaagacagatgggggcaggaagtaatttctggcaatgaagacccagaaggggtggtgctgaaggatctgggaccaccgatggtggctcgacttgtgcgcttttaccctagagcggatagggtgatgtcagtctgtctgagagtggagctctatggatgtctctggcgggatggcttgctgagttacacagcccctgtcgggcagaccatgtatctctccgaggcagtgtattag

SEQ ID NO: 11307 - DNA, 312 bp, Artificial Sequence
  Description of Artificial Sequence: Synthetic coding sequence
atgaggcagcgtctcttgcctagcgtgacgtcacttcttttggtagcccttctcttccctggcagttcacaggcacgccatgtcaatcatagtgcaactgaggccctgggcgagctgagggagagagcgcctggccaaggcaccaacggatttcagctgttgcgccatgcggtgaagagagatctccttcccccaagaacccccccataccaggtgcatatcagccatcaggaggcacgcggacccagcttcaagatctgcgtcggattccttgggccacgctgggccaggggatgctcgaccggcaactag

SEQ ID NO: 11308 - DNA, 426 bp, Artificial Sequence
  Description of Artificial Sequence: Synthetic coding sequence
atgaaaacagggctcttttttttgtgcttactcggaacagctgctgccattcctactaacgccaggcttttgtccgaccacagcaagccaaccgcagagactgtggcccctgacaacaccgcgataccaagcctgcgagcggaagctgaggaaaacgagaaagaaacagctgtgagcacagaggatgattcgcaccacaaggccgagaagtcatcagtgttgaaatcaaaggaggagtcccacgagcagtctgccgaacaaggtaagagttcctctcaagagctcgggttaaaggatcaggaagatagcgacggtcatttgtccgttaacctggagtatgctccaaccgagggaactcttgatataaaggaagatatgtcagagcctcaagagaaaaagctgagcgagaataccgacttcttatag

SEQ ID NO: 11309 - DNA, 642 bp, Artificial Sequence
  Description of Artificial Sequence: Synthetic coding sequence
atgcgtctcgcaggacccctaagaatcgttgtgctggtcgtgtccgtgggagtgacctggatagtagtttctatcctcctcgggggacccggaagtggcttccccagaattcagcagctgttcacaagcccagagtcgtccgttaccgccgcacccagggcaaggaagtataaatgcggcctgccacaaccttgccccgaagagcacttagcctttagggtcgtgagtggggcagctaatgtgatagggccaaagatctgcttggaagataagatgctgatgtcctctgttaaggacaatgtaggacgtggtctcaatatcgcactggtaaatgacgtgaatgatctgcttaaatttatccgacccctgcacgagggaacactggtcttcgttgctagttacgatgaccctgctaccaagatgaatgaagaaacgagaaaactcttcagcgagctgggctcccgcaatgccaaggaactggctttcagggactcatgggtgtttgtgggggctaagggggtgcagaataagagtccttttgaacaacacgtgaagaacagtaaacatagtaacaaatacgaaggatggccagaggctctggagatggaggggtgcattccgaggagatccacggcatcttag

SEQ ID NO: 11310 - DNA, 2700 bp, Artificial Sequence
  Description of Artificial Sequence: Synthetic coding sequence
atgcttttgcttttactgcttgcccctctatttttaaggcctcccggagcagggggtgcacagacgcctaacgccacttcggagggttgtcaaatcattcaccccccatgggagggcggaattcgctacaggggacttacaagagatcaggtcaaagccattaacttcctgccagtggactatgaaattgagtacgtgtgtaggggtgagagagaagttgtgggacctaaagtacgcaaatgtctcgccaacggatcctggaccgacatggacaccccatctagatgcgtgaacaggacccctcactccgagcgcagggctgtgtacatcggagccctattcccgatgtctggcggttggcctggaggccaagcttgtcagccggctgtcgaaatggccctggaagatgtgaacagcaggcgcgatatcctcccagattacgagctgaaactgattcaccatgattcaaaatgtgatccaggtcaggctacaaaatatctgtatgagctgctctacaatgaccccatcaagatcattttaatgcctggctgttcttccgtctctaccttggtggcagaagccgctagaatgtggaatctgatcgtactgtcatacggctcatcatctcccgctctgtctaaccgccaaaggttccctactttttttcgcacacacccgtctgccaccctgcataatcccacacgagttaaactgttcgagaaatggggctggaagaagattgccacaatccagcagactaccgaagtctttactagcacactggatgacttagaagagagagtgaaggaggcaggaatcgaaatcaccttccgtcagagctttttttccgaccctgccgtacctgtaaaaaatctgaaacggcaagacgcccgaattattgttggattattctacgaaacagaagcacggaaagtcttctgcgaggtctataaggaacgcctattcggcaagaagtacgtgtggttcctgattggttggtacgctgataattggttcaaaatttatgacccttcgatcaactgcacagtcgatgagatgaccgaagccgtcgagggtcatatcactacagaaatagtaatgctgaaccccgcaaatactcggtcgatctcgaacatgaccagccaggagtttgtggagaagctgactaagcggctgaaacggcaccctgaggaaaccggaggattccaggaggctcctctcgcctacgacgctatttgggcactcgcgctcgcgctgaataaaacttctggagggggtggtcggtcaggcgtccggctagaagactttaattataacaaccaaacgattactgaccagatatacagggctatgaactcaagtagcttcgagggggtcagcggacatgtcgtgtttgacgccagtgggtcccgaatggcctggacactgatagagcagctgcagggtgggagctacaaaaaaataggatattacgatagcaccaaagatgacctctcctggagtaagaccgacaagtggatcgggggttctcctcccgcagaccaaacactggtcatcaaaaccttcaggttcctttcacagaagttatttataagcgtgtctgtgctttcctccctcggaattgtactcgccgtcgtatgtctttctttcaacatatataacagtcacgtgcgatatattcaaaactcccaacccaatctgaataacctgacagccgtgggatgtagtttggccctcgcagccgtgtttccgttgggactggatgggtatcacatcggtcgcaatcaatttccattcgtctgccaggccaggctctggctccttgggcttggcttttcacttggatatggcagcatgtttaccaaaatttggtgggtacacactgtgtttaccaagaaggaagaaaaaaaggaatggcgaaagacgctggaaccttggaaactctacgctacagtaggcttgctggtcggtatggatgtgttgactctggcgatttggcaaatcgtggacccactgcaccgcactattgagacatttgccaaagaggagcctaaagaggatatcgacgtttccattctacctcagctcgaacactgctcttctagaaaaatgaatacttggctggggatcttttatgggtataaaggcctgttgctgctcctggggattttcctggcttacgagacgaagtctgtaagcacagaaaagattaatgaccatcgggctgttgggatggccatttataacgtggccgtgctctgtctgatcaccgctccagttaccatgatcttatccagtcaacaggacgcggctttcgcctttgcctcacttgccatcgtcttctcatcatacataacactggtggtgttatttgtgcctaagatgaggaggctaatcacacgcggtgaatggcaaagcgaggctcaggacaccatgaaaacaggatcaagcactaacaataacgaggaggaaaaaagcaggctgcttgagaaggagaacagggagttagagaagatcattgcggagaaagaggagagagtcagcgaacttcgacatcaactgcagtctcgacagcagctgaggagccgacggcatccccctaccccacccgaaccgtcagggggattaccaaggggtccccctgaaccccctgaccggctttcttgtgatggctcacgtgtgcacttgctgtacaagtag

SEQ ID NO: 11311 - DNA, 192 bp, Artificial Sequence
  Description of Artificial Sequence: Synthetic coding sequence
atggggccagaggccttatcttctttgctgctgctgcttttagtggcctctggggacgccgacatgaagggccattttgacccagctaaatgccgatacgcccttgggatgcaggataggacgatacccgattccgatatttctgcctccagctcctggagtgactctaccgcagcccgacattcaagatag

SEQ ID NO: 11312 - DNA, 489 bp, Artificial Sequence
  Description of Artificial Sequence: Synthetic coding sequence
gacgaggacagatacactacatgctggccaaagacatggttggcgaaggactgcccggcattaagaatcattagcgtggaatatgacactagcttaagcgactggcgggcacggtgccctatggagcgcaagtcaatagctttccgctccaacgaattgcttcgtaaattgcgtgccgctggggttggggacagacccgtggtgtggatctcccatagcatggggggtttactggttaaaaaaatgctactggaggcttccaccaagcccgagatgtcaacagtgatcaacaatactcgaggtattattttctatagtgtcccgcaccatggttcccgactggccgagtatagcgtcaacattcggtacctgttgtttcccagtctcgaggtcaaggagctgtccaagggtaacacattctgccataaaggaaactgggggtatattaacatctcctacactgaaaagaaaaagaagtttcttccttag

SEQ ID NO: 11313 - DNA, 1083 bp, Artificial Sequence
  Description of Artificial Sequence: Synthetic coding sequence
atgcccgaattggttgtgacagccctccttgccccatctcgattatctctcaagctcctgagagccttcatgtggagcttggtattcagcgtggcgttggtggccgctgcagtgtatggctgcatagccttgacccatgttctgtgtagacccaggcggggatgttgcggccgtcgcagatctgcatccccagcctgtctctccgatcccagcctcggtgagcatggcttcctcaatctgaagtcgagcgggttacgcctgcattacgttagcgcgggtcggggtaatggcccattaatgctctttctccatggattcccagagaattggttttcatggcgttatcagctgcgcgagttccagtcccgctttcacgtggtggcggtggatctccgcggttatggcccttccgacgctccccgtgacgtcgactgctatactatcgacctactccttgtcgacattaaagatgtgatattgggcttaggctattcgaagtgtatcttagttgcccacgattggggggcattgcttgcatggcatttttcaatctattaccctagcctggttgagaggatggtagtggtctctggagctccaatgagtgtttatcaggattacagcctccatcatatcagccagttctttaggagtcattacatgtttcttttccaattgccctggctccccgaaaagttactgtctatgagcgattttcagattctgaaaaccaccctcacgcacagaaagacagggataccctgccttactccaagcgaattggaggcttttttatataacttttctcaacccggaggcctgaccggcccactgaactattatcgcaatttattccgcaactttccgttggagccacaggagctgactacacctactctgctcctgtggggcgagaaagacacttaccttgagctgggactcgtggaagccattggatctaggttcgtgcccggaagacttgaggcacatatcctccctgggatcggccattggatcccccaaagcaacccacaggaaatgcatcagtatatgtgggccttcctccaagacctgctggactag

SEQ ID NO: 11314 - DNA, 678 bp, Artificial Sequence
  Description of Artificial Sequence: Synthetic coding sequence
taggccgacttgcctagctgctggggtgcaggcccatgctataccggccacaaggtgggagccttacggagagacaccgttatatgttgttgcagacacggggactacagcaccccctgtctgttcacaccagggaagccttctcgcaacccatcgccctggaagaggacactttggactttgtcggccccttgggcaggacccgcagggtggacaggggaagaacagaacgctactaagacagggctgatcacccggcgtcctagaccactccgccgacgaccccaccctgctccggcttcaccactgcccgaaatcatccgcggtaatataccacggatgcttgggaagtttgtacccgttaactgggagccccctcagccacttccattccccaagtacctgaggtgctacaggtgtctgttagaaacaaaggagttggggtgtctgctggggtccgatatctgcctcacacccgctgggtcaagttgtataactctacataagaagaattcttcaggctctgatgtgatggtctcagactgtaggagcaaggaacagatgagcgactgttcaaacacccggacaagtccagttagcggattctggatcttttctcaatattgttttctggatttctgcaatgatccccagaatcgcggtctatacaccccctag

SEQ ID NO: 11315 - DNA, 192 bp, Artificial Sequence
  Description of Artificial Sequence: Synthetic coding sequence
atgaagcacgtcctcaacctatacctgttgggcgtggtgcttactctcctcagtatatttgtccgggttatggagagtttggaggggctgttagaatcgccttccccagggacgagctggactacaaggagccaactggctaatactgaacccacaaaaggactgcccgatcatccgtccaggtcaatgtag

SEQ ID NO: 11316 - DNA, 5235 bp, Artificial Sequence
  Description of Artificial Sequence: Synthetic coding sequence
atgcgcctgctctggggccttatctgggccagttctttttttacgctcagtttacagaagccacgtctgctgttattttccccctcagtcgttcatctcggtgtgccattgtctgtcggtgtgcagctgcaggacgtaccccgaggccaggttgtcaaaggcagtgtgttcttgaggaatcccagccggaacaacgttccgtgcagccctaaggtcgacttcacattaagctcagaacgcgacttcgccctgctgtcacttcaggtccctctcaaggatgctaagagttgcggactgcatcagttgctccggggacctgaggtacaactggtagcccacagtccttggctgaaagactcattaagtcggactactaacatccagggtatcaatctgctctttagctcaaggagagggcatctgttccttcagactgaccaacccatctataatcctggccaaagggtacgataccgagtttttgccctcgaccagaagatgcggccatcaacggacactatcacggtaatggttgagaattcccatgggctgagggttagaaaaaaggaagtttacatgcctagttccatcttccaggatgatttcgtgattcctgacatctccgagcccggtacctggaagatcagcgccaggttttcggacggccttgaatctaactcatctacccagttcgaagtgaaaaaatatgtcttaccaaacttcgaggtcaagatcacgcccggaaaaccttacattctaacagtcccaggacacctcgacgagatgcagctagacatacaagcacggtacatttacggtaaacctgtccagggcgtcgcctatgtcaggttcggtttgctagatgaagatggcaagaaaaccttctttcggggattggagtcacagaccaaacttgtcaatggccagtcacacatttccttgagcaaggccgagtttcaggatgcattggagaaactcaatatgggtatcaccgacctacaagggctcaggctttacgtcgcagcagccattattgagtacccaggtggagagatggaagaggccgaactcacctcctggtattttgtgtcttcaccatttagtctggaccttagtaagactaagagacatttagtgcccggtgccccattcttactacaagcactcgtgcgtgagatgtctggcagtcccgcatctgggattccggtgaaggtaagcgctactgtgtcctctcccggaagcgtgcctgaggtccaggacatacagcagaataccgatggcagcggacaggtttcgattccgatcattataccgcagactatatccgagttgcagctctccgtttctgctggctcaccccacccagcaatcgccagactaacggtggctgccccacccagcgggggtcctgggttcctgagtattgagaggccagattcccgacctcccagggttggggataccctcaaccttaacctgcgagcggttggttctggcgcaacgtttagccactattactatatgatcctttcaaggggtcagattgtattcatgaatcgagagcccaaacgcactttaacctctgtgtccgtcttcgtggaccatcatcttgctcctagcttctacttcgttgctttttactaccacggcgatcaccctgtggccaacagcctgagggtggacgtgcaggcaggggcatgcgaagggaagctggaacttagcgtggacggagccaagcagtatagaaatggcgagagtgtgaagctgcatttagagacggactccctagctctggttgcgctgggcgctctcgacaccgctctctacgcagccggatccaaatcccacaaacctttgaatatgggcaaggtcttcgaggccatgaatagttatgacctcggttgcggccctggtggcggagactctgcgttgcaggtttttcaggccgcagggttggcttttagcgacggtgatcaatggacgttgtctaggaaacggctgagttgcccaaaagagaagaccacgcgaaaaaagaggaacgttaactttcagaaggccataaatgagaaactgggacagtatgcttctccgactgccaagaggtgttgtcaggacggggtgacacggttaccaatgatgaggtcatgtgaacagagggccgctcgtgttcaacagccagactgccgcgagccatttctttcgtgctgccagttcgctgaaagcctgcgcaaaaagtcgcgggataaggggcaagcgggactccagcgcgcactggagattctgcaggaagaagatttgattgatgaggacgatatcccagtcaggagtttcttcccggaaaattggctgtggcgcgtggaaacggtggaccgatttcaaatcctgactttgtggctgccggattcactaacaacctgggagattcacgggctcagtctgtctaaaacgaaaggattatgtgtggccacacctgtgcagctgagggtgttcagagagtttcacctgcatctgagactgcctatgagtgtccgtaggttcgagcagttagagctgcgccctgtcctctacaactatctcgacaaaaacctgaccgtgtccgttcatgtaagccccgtggaaggactatgcctggccggaggtgggggactggctcagcaggtgctggttcccgcagggagcgcaaggcccgtggccttctcggttgtaccgacagccgctgctgcggtgtcccttaaggtggtggcacgcggatccttcgaattcccagttggggacgcagtgagtaaggtgctccaaatcgagaaagagggcgctatccaccgagaggaactggtctatgaacttaaccccctggatcataggggtcgaactcttgagataccaggaaatagtgacccaaacatgatccccgacggggattttaactcttatgtccgcgtcacagccagtgatccattagacacattaggctctgaaggagccctcagcccgggaggcgttgcatccctgttgcgactccccaggggatgcggagagcagacaatgatctatctagcaccaacacttgcggcaagcagatatttggacaagacagagcaatggagcaccctcccaccggaaactaaggatcacgcagtggatctgattcaaaaaggttacatgcggattcagcaattccggaaggccgatggctcatacgccgcttggttatcccggggaagctccacttggcttaccgcttttgttttgaaggtactctccctggcccaggaacaagtcggcggatctcctgaaaagcttcaggaaacatctaattggttactttctcaacagcaggccgacggtagcttccaagatctgtcgccagttattcaccgcagcatgcaggggggactggtcggcaacgatgagaccgtggccctgaccgcgttcgtgactatcgccctgcaccacggcctggcggtattccaggacgagggggcagagcctctgaaacagagagtggaagccagcatctcaaaggcttcaagcttccttggcgaaaaagctagtgccggtctactgggcgctcatgctgccgctatcacagcctacgcactgactctgacaaaagctcctgcagacctccgaggggtggcacataataatcttatggccatggcccaggagactggggataacctgtattggggcagtgttacaggctctcagtcaaatgccgtaagcccgactcccgctcccagaaatccatccgacccaatgccacaggcaccagccctgtggatagagaccacagcctacgccctgctgcatctcctactgcacgagggcaaggcagaaatggctgatcaggcagcagcttggttgactaggcaggggagcttccaagggggtttcaggtcaacccaggacacagtaatagctttggatgccctgtcggcctattggatagcctcccacacaacggaggagcggggactgaacgtcactctaagcagtacaggtagaaacgggttcaaatctcacgcgcttcagctgaataaccgccagatcaggggactggaggaagagctgcagttcagcctgggatctaaaataaatgtgaaagtcgggggaaattctaaagggacacttaaggtcttaagaacttacaacgtcctcgacatgaaaaacacaacctgtcaggatctgcagattgaagtgaccgtcaagggacacgtggagtacacaatggaggccaacgaggactacgaagattatgagtacgacgagctaccagccaaggacgaccccgacgctccactgcagccagtcacgcccctacagctgtttgagggcagacggaacaggagacgtcgcgaggcacctaaggtggtggaggaacaggagagccgcgtccattatactgtctgcatttggcggaacggaaaggttgggttaagcggcatggccatcgcagatgttacattactcagcggcttccacgccctgcgggctgacttagagaaactgactagtttatcagatagatacgtctctcattttgaaaccgaggggcctcatgtgctgctctactttgatagcgttccaaccagcagagagtgcgtggggtttgaggcagtgcaagaagttccagtgggtctggtacaaccagcatcagctaccctctacgactattataacccagaacgcaggtgtagcgtattctacggcgctccatctaagagtcgcttgctggctaccctgtgttcggccgaggtgtgccagtgcgctgaaggtaagtgtcctagacagcggagagctctcgaaaggggcctccaggacgaagatggctacagaatgaaattcgcctgctattatccgagagtggagtatgggttccaagttaaagtgctgagggaggatagtagagccgctttcagactgttcgaaacaaagatcacccaggttctgcactttaccaaggacgttaaggctgccgctaatcagatgcgaaattttttggtacgcgcatcatgtcgcttaagactggagcccggaaaggaatatctgatcatgggactggatggagcaacatatgaccttgaggggcacccacagtacctgctcgactccaattcgtggatagaagagatgccatcagaaagattatgtagatctactcgccagcgagcggcttgtgcacagctcaacgattttcttcaagagtacggcacccagggatgccaggtctat

SEQ ID NO: 11317 - DNA, 792 bp, Artificial Sequence
  Description of Artificial Sequence: Synthetic coding sequence
atggcggacatgcagaacctggttgaacgtctcgagagggctgttggcagactggaggccgttagccatacatccgatatgcacagagggtatgccgactctcctagcaaaggtgctgctccttacgttcaggcatttgatagtttgctagcagggccagtggcagagtatctcaaaatttcgaaggaaataggtggagatgtgcagaagcacgctgagatggtacatactggcttaaaactcgaacgagccctgttagtgacagctagccagtgtcaacagcctgcagaaaataagctgtcagatctgctcgctcccatctcagagcaaatcaaggaagtgataacgtttcgtgagaagaatcgcggatctaagctgttcaatcacctctcagcagtctctgaaagtatacaggccctgggctgggttgcgatggcacccaaacctggcccttacgtgaaggaaatgaacgacgcagccatgttttacaccaatagagtgctgaaagaatacaaggacgtggacaagaagcatgtggactgggtgaaagcgtatctgagcatttggacggagttgcaggcctatattaaggaatttcatacaacagggctcgcgtggagcaagaccgggccagtggctaaggagctgtcagggttaccttctggtcctagcgccggaagctgccccccacctccaccaccttgccccccaccgcctcccgtaagcacaataagttgctcctatgagtctgcctcaaggtcctctctgttcgcgcagataaatcaggggtag

SEQ ID NO: 11318 - DNA, 501 bp, Artificial Sequence
  Description of Artificial Sequence: Synthetic coding sequence
atgggcccagaggccctgtcgtcgctgcttctccttctgctggttgcgagcggcgacgctgacatgaagggccattttgatccggcaaagtgtcgctacgctctcggtatgcaggacagaacaattcctgacagcgacatatccgcatcttcttcttggagcgactccacagcagcaagacatagccggcttgaatccagtgacggggatggtgcttggtgccccgctggcagcgtttttcccaaagaggaagaatatctccaggtggatttacagagactgcacttagttgccctggtgggcacgcaggggagacatgcgggaggcttgggcaaagagttttctaggagttacagactgcggtattcgcgagatggccgtcggtggatggggtggaaggaccgatggggtcaagaagtcatctccggaaatgaggaccccgaaggggtggttctgaaggacctgggaccgcctatggtggccagactggtcagattttag

SEQ ID NO: 11319 - DNA, 2349 bp, Artificial Sequence
  Description of Artificial Sequence: Synthetic coding sequence
tctatcctgagggttgaagccgttgatgccgattgcagccctcagttctctcagatatgtagttatgaaatcataacgccggacgttcctttcaccgtggacaaagatgggtatatcaaaaacactgaaaaattaaactatgggaaagaacaccagtacaaactgactgtcacagcatatgactgcgggaagaagcgggcaacggaagatgtcttagtgaaaatctccatcaagccaacctgcacaccaggctggcaggggtggaataacaggattgaatacgagcctggaaccggggctttggctgtgttccctaatattcatctagaaacctgtgatgagccagtggcctctgtgcaagcaacagtcgagcttgaaactagccacattgggaagggctgtgacagggacacctattccgagaagtctcttcaccggctgtgcggggctgctgcaggcacggcagaacttcttccctcccccagcgggagcctgaactggacaatgggcctccccactgacaatgggcacgattctgatcaagtgtttgaatttaatgggactcaggccgtgcggattcccgatggcgtcgtgtccgtgagccctaaggagcctttcaccatcagcgtgtggatgcggcatgggccatttggaaggaaaaaagagacaatactgtgcagctctgacaagactgacatgaatcgtcaccactatagcttgtatgttcatggatgccgtttgatcttcctgttccgccaggaccccagtgaggagaagaagtacaggcctgctgagtttcattggaagctgaaccaagtctgcgacgaggagtggcaccactacgttttgaacgtcgaattccctagtgtcactttatatgtcgacggaacctctcatgaaccattcagcgtgacagaggactatccgctgcatccctctaagattgaaacacagttagtcgttggggcttgttggcagggcggagatcttcatatgacacagttcttcagagggaatctggccggattaaccctgcgttctggaaaactagctgacaagaaagttatcgactgcctttatacctgcaaggaaggcttggatctgcaggttttggaggattccggcagaggggtacagatccaagctcatccatctcagttggtgcttacattggaaggtgaagatctgggggagttagacaaggctatgcagcacatttcctacctcaatagccgccaattccctaccccaggcatcagacgtctcaagattacatccaccatcaaatgctttaacgaagcaacctgtatttctgttcctcccgtcgatggttacgttatggtcctccaacccgaagagcctaagattagtcttagcggcgtgcatcactttgctcgagccgctagcgagtttgagtcaagcgaaggagttttcctattccctgagcttagaatcatctctactattaccagagaagtcgaacccgagggtgacggcgcagaggatccgaccgtacaggagagcctcgtgagcgaggaaattgttcacgacctggatacctgcgaggtgactgtggagggcgaagagctcaatcacgaacaagagtctttagaggtggacatggcacggctgcagcagaaaggtatcgaagttagcagctcagagctgggcatgacattcaccggagtggacacgatggcctcctacgaggaggtactgcatttactgaggtaccgcaattggcacgcgaggtcgctactggaccgcaagtttaagctgatctgttccgagctcaacgggcgatacattagtaacgagttcaaagttgaagtcaatgtgattcatactgcgaaccctatggagcacgccaatcatatggccgcacagccgcagtttgtccatcccgagcatcgctcttttgtagacttgagcgggcataacttagccaacccccacccatttgccgtggtgcccagtacggccacggtggttattgtcgtttgtgtctccttcctagtgtttatgatcatcctgggcgtcttcagaattagggctgctcatcggcgtaccatgcgggaccaggacaccggcaaggagaatgaaatggattgggacgattctgccctaactatcaccgtcaaccctatggagacctatgaggatcagcattcctcagaggaagaagaagaagaagaggaagaagaggaatctgaagacggagaggaagaggacgacattacgagcgcagagtctgagtctagcgaagaggaggagggcgagcagggggacccccagaacgcgaccaggcagcagcaactcgagtgggatgacagtaccttaagctactag

SEQ ID NO: 11320 - DNA, 531 bp, Artificial Sequence
  Description of Artificial Sequence: Synthetic coding sequence
atggctaggcgacattgcttttcctactggttgctggtgtgttggttagtagtgactgtggctgaggccttatctaccttttacttgcaacaacacatcaatctgcatatggataaaaagcgctatctgcgccttttggagattcacaaaatcatgcggacactcccaactgctcgatcgctgcattctcccttacatctacccaggggcgttcgtagccaaggcccatcgccaagtcagcgacatccgggagtccctagcattttctttcacgagggacctgaaagtatactggggtttcagactgacctaagctctctgcagggagtgactacggtgttccatagttcccattttattggccataccgtgacattgttgattggaatatcccctgaggaagattctagagaggaggcacatctacggaaagcggaacgcgaagagaagccaaagcacacagaggccaagaagtctctgagcttccgaaagaaacagcaaaaggacttctgctttatcttcaggaattag

SEQ ID NO: 11321 - DNA, 1182 bp, Artificial Sequence
  Description of Artificial Sequence: Synthetic coding sequence
atgcgcaccttgtttaatctgttgtggcttgcgttggcctgcagtccggtccacaccactctctcaaagtcagacgccaaaaaggcagcgtcgaagacattgctggagaaatcccaattctctgacaaacctgttcaagaccgcggacttgtcgttacggacctaaaggctgagagcgttgtcttagagcataggagctactgcagtgcaaaagcccgagacaggcacttcgctggtgacgtgctgggctacgtaaccccctggaacagtcacggatatgacgtaactaaggtctttggaagtaaattcacgcagatctcacccgtctggcttcagctgaagaggcggggacgggagatgttcgaagttactggcctgcacgacgtggatcaaggatggatgcgcgctgttcgcaagcacgctaagggactgcacatcgtcccacggttgctgtttgaggactggacctacgatgatttcagaaacgtcctcgactcagaagatgagatcgaggagctaagcaagactgtcgtgcaagtggccaaaaaccagcattttgatggattcgtcgttgaggtttggaatcaactgctgtcccagaagagggttggtttaatccacatgctgactcatcttgccgaagccctgcatcaggcaagattactcgcactccttgtgatcccacctgccattacaccaggcactgatcagctgggcatgttcacgcacaaggagttcgagcaactagcaccagtgctcgatggcttcagcctcatgacgtatgactactctactgctcaccaacccggtcccaacgccccactcagctgggtgcgagcatgtgtgcaggtgttggatcccaaaagcaaatggcgttcaaaaattttgttagggctcaacttctatggtatggactacgccacgagcaaggacgctcgggagcctgtcgtgggagctcggtacattcagacactgaaagatcaccgcccacgcatggtgtgggattcccaggcttcagagcacttctttgaatacaagaaatccaggtccggacgacacgtcgtgttctatccgacactcaagtctctgcaggtgcgactggaactcgcacgagaactcggagtaggcgtgagcatttgggagctgggacaaggtctggattatttctacgacctgctttag

SEQ ID NO: 11322 - DNA, 324 bp, Artificial Sequence
  Description of Artificial Sequence: Synthetic coding sequence
atgctgccgtgtctcgcccttctgctactgatggagctgagtgtctgcactgtggccggagatggaggcgaggagcagaccctgagcacggaggcggagacttgggagggagctggtccatctatccagttgcagctgcaggaggtgaagacaggtaaggcgtcccaattcttcgggcttatgggtaagcgagtcggtggaaggcctttgattcagccacgcagaaagaaagcttatcaattggagcacaccttccagggcctcctcggcaagagatcactgtttaccgagggcagggaggatgaggcccaggggtctgaatag

SEQ ID NO: 11323 - DNA, 1086 bp, Artificial Sequence
  Description of Artificial Sequence: Synthetic coding sequence
atgggaattatccagtccatcttggcgacatctagagactgttatagcttcaagaagaagcccattcccaaaaaacctactatgttggccctggcgaagatcctgcttataagtaccctattttactctctcctctctggtagccatggcaaagagaaccaagacattaatactacccagaatatcgctgaggtgtttaagaccatggagaacaagcccataagtctggaaagcgaagcaaatctgaattccgataaagagaacatcaccacatcaaatctgaaggccagtcatagtccaccactcaacctgccaaataattctcacggcatcacagacttcagcagcaactcttcggcagaacattccctgggcagtctgaaacccacttctaccatatcaacctcaccccctctgattcacagcttcgtgtctaaggtgccctggaatgcaccaatagccgatgaggatctactgcccatatctgcccaccccaatgccacccccgctctgtcatccgaaaacttcacatggtcactggtgaatgacacagtgaaaaccccagataattcttcaatcaccgtcagcattttaagctccgaacctacatcccccagcgtgacccccctgatcgtggagccaagtggttggctaacgaccaactccgactctttcactgggtttaccccttaccaggagaagaccaccctccagcctactctgaaattcactaacaactctaaattgtttccaaatacctccgatccgcagaaagagaatcgcaataccgggatcgtgttcggggcaatcctgggcgcaatcctaggggtgtccctgctcacactcgtcggctacctcctgtgtggcaaacgcaaaacagattctttttcacatagacggctgtacgatgatcgcaatgagccagttcttagactcgataacgccccagagccatacgatgtctcatttggaaactccagctattacaaccccactctgaacgatagtgccatgcctgaatccgaagaaaatgctcgagacggaatccctatggatgacatccctcctctgcggacatctgtttag

SEQ ID NO: 11324 - DNA, 279 bp, Artificial Sequence
  Description of Artificial Sequence: Synthetic coding sequence
atgcgaggtcctggtcatcccctcctccttgggttgctcctcgtgttggggccatctccagagcagcgagtggagatcgtgccaagggatctgcggatgaaggataagtttctgaagcacctgacaggtccgttgtatttttcgcctaagtgtagtaagcacttccatcggttataccacaatactcgggattgcaccatccctgcatactataaacgctgcgcacgactgctgaccagacttgctgtaagcccggtttgcatggaggataagcaatag

SEQ ID NO: 11325 - DNA, 1125 bp, Artificial Sequence
  Description of Artificial Sequence: Synthetic coding sequence
tgacgcgtgcgcagagggccattacccgctgatagacctcgcgctctggggcctgccagaaggtgctcacgtcatcctcacccggctccctttcgagtttgctccgaaggggctgcacatcgattgcggaggccggagcgcttgcccctaccctcccgtgcacttcgcccacggcctgcccatactccaattctgggacccgctcctcgtgcctgccctggcgctccccgagcctctgacagccctacctgcgctgctgctgctgcaactgcctggccaaggacccgggcagtggaacgcaagggatgtcaggttgctgccgcagccggagtgcgcggtactggctgcccatcccgcgctgaccttgagaaagacagctggaacgacaccaaagaggacgtgttcgtccatcagactgccattaagaagaacaatcctaggaaatacttgcgaagtgttggggacggcgagactgtagagttcgacgtagtggaaggtgagaagggagccgaggccgctaatgtgacaggcccagggggtgttcctgtgcaaggctctaaatatgcagcagaccgaaatcattataggaggtatcctcggaggagagggccacctaggaactaccagcagaattaccagaacagtgaaagcggggagaagaatgagggatccgagagcgcaccagaaggccaagcccagcagcggcgtccgtatcgacgtcggagattcccgccatactacatgagacgcccttatgggcgacgccctcagtattcaaacccgccagtccagggagaggtaatggagggcgcagacaaccagggagccggtgaacagggacgacccgtgagacagaacatgtaccgaggctatagacctcgatttcgcagggggccacctagacaacgacagcctagagaggacggaaacgaggaggacaaggagaatcaaggtgacgagactcagggtcagcagccacctcaaagaaggtatcggcgaaatttcaactacagacggagaaggcccgaaaaccctaaaccacaggacggtaaggaaactaaggccgcagaccctccggcagaaaattcaagcgcccctgaggctgagcaggggggtgccgagtag

SEQ ID NO: 11326 - DNA, 420 bp, Artificial Sequence
  Description of Artificial Sequence: Synthetic coding sequence
atggccttgcgcatgctttgggccggacaggccaaggggattctggggggttggggcatcatttgtcttgtcatgagcttactgctgcagcatcccggagtctacagcaaatgttactttcaagcccaggcaccttgtcactatgaaggcaagtatttcactctaggcgaatcctggctgagaaaggattgcttccattgcacctgcctccacccagtgggtgtgggatgttgcgacaccagccagcacccgatcgacttcccagcaggctgtgaagtaaggcaagaggccggaacctgccaattttccttagtccagaagtccgatcctcggctcccatgtaagggcggaggaccagacccggagtgggggagcgcaaacactcctgttcctggagcccctgctccacactcatcatag

SEQ ID NO: 11327 - DNA, 462 bp, Artificial Sequence
  Description of Artificial Sequence: Synthetic coding sequence
cattactgcaaggagggttattatcgggacatgggcaaacccattacccataggaaagcgtgtaaggcatgtgactgtcaccctgtgggagctgctggtaaaacatgcaatcagacaaccgggcagtgtccatgtaaggacggggtcacaggcataacatgtaatagatgtgccaaaggttaccagcaaagtagaagtcctattgcgccttgtatcaaaattccagtggctccacctaccaccgcagcctcctctgttgaggagcccgaggccgctcgacagcctaacacctttcaggctgaaggtctgtctttgttacccggtgctgctgaaaaggaaggagccaggtgttgggggtacagaagacgactgggacaccgggtcgcccaggccgaatgccgtggtcccaggtcctgggcatggggacggatcacaagcagcttttcttttgccagtaactag

SEQ ID NO: 11328 - DNA, 213 bp, Artificial Sequence
  Description of Artificial Sequence: Synthetic coding sequence
atgctggtgctgttcttacttggcacagtttttcttctctgtccctactggggagagcttcatgatccaataaagggacagtccatgtatcactattcaaagctgtcatgcatgacctcctgcgaggatataaacttcttaggctttacaaagcgcgtggagctgatttgttgtgatcactctaattattgcaacttgcccgagggcgtgtag

SEQ ID NO: 11329 - DNA, 567 bp, Artificial Sequence
  Description of Artificial Sequence: Synthetic coding sequence
atgttccatcagatttgggccgctctgttgtatttctacggtattatcttaaactccatctaccagtgtcctgagcactcccagctgaccacattgggtgtcgatggcaaggaattccccgaagtgcacctcgggcagtggtattttatcgccggtgctgccccaaccaaggaagagctggctacctttgaccccgtggacaatatcgtcttcaatatggctgctggctctgcccctatgcagctacacttgagagctacgattcgtatgaaggacggactgtgtgtcccccgaaagtggatctaccacctgaccgagggttcaaccgacctgaggactgaaggtcgcccagacatgaagacagagctgttctcgtcaagttgccccggtggcatcatgctcaatgaaaccggtcagggataccaacgcttcttgctctacaacaggtcgcctcacccgccagagaagtgcgttgaagagtttaagagcctgacctcatgccttgacagtaaggccttcctgctgacccccagaaatcaagaagcttgtgagctgtctaataattag

SEQ ID NO: 11330 - DNA, 2316 bp, Artificial Sequence
  Description of Artificial Sequence: Synthetic coding sequence
atgggatggttaaccaggattgtgtgcttattttggggtgtcctcctgacagccagggcaaactaccagaatggcaaaaataatgtccctcggctgaaattaagctacaaggagatgctcgagtcgaataatgtgattaccttcaatggactggccaacagttcatcataccacacctttctactggacgaggagagatctcgcctgtatgttggggctaaagaccatatttttagttttgacctggtgaacataaaagactttcagaagatcgtatggccggtatcgtacactaggcgtgacgaatgcaagtgggccggaaaggacatcctgaaagagtgcgccaactttattaaagttctgaaggcatataaccagacacatctttacgcatgcggaacaggcgcattccaccctatctgtacctatatcgagatcggtcaccatccagaggacaacattttcaagcttgagaacagtcacttcgagaatggccgaggcaaaagtccctatgatccaaagcttctgaccgcgtcgctgctaatcgatggagaattgtactcagggaccgccgctgatttcatgggcagagattttgccatcttcaggactttgggccaccaccaccctataaggactgagcagcatgattctagatggctgaacgatcctaaattcatatctgcccatttaatatctgaatccgacaatccagaggacgataaggtgtacttcttcttcagagagaacgccatcgatggagaacactccggtaaagcaacacacgctaggatcgggcaaatctgcaagaatgattttggcggacaccggagcctggtaaataaatggacaaccttcttaaaggcgcgactgatctgctcagtgcccggacctaatggaattgacacacacttcgacgagctgcaggatgttttcttaatgaatttcaaggaccctaaaaacccagtggtttacggagtcttcacgacatcatctaatatatttaaaggatctgccgtctgcatgtatagtatgagcgacgttcggagggtctttcttggaccatacgctcaccgggacggcccaaactaccagtgggtgccttaccagggcagagttccctatcctaggcccggaacctgcccaagcaaaactttcggcggtttcgactcaaccaaagatctccccgacgacgtcatcacattcgcgagaagccaccctgcaatgtataaccctgtgttcccgatgaacaatcggcctatcgtcatcaagaccgacgtaaactatcaattcacacaaattgtggttgacagagtcgacgcagaggacggccagtatgatgtgatgttcatcggaaccgatgttggaaccgtgctgaaggttgtctcgatacctaaggaaacctggtatgatctcgaagaggtgctcctcgaggagatgaccgtatttcgagagcctaccgcaatcagcgctatggagctctctacgaagcagcagcagttgtatatcggcagcactgccggtgtagcacagctacccttacatcgctgcgacatatatggcaaagcctgcgcagaatgttgcttggctcgagacccctattgtgcctgggatgggtccgcatgcagcagatacttcccaactgccaagaggagaactcgtcgacaggacatcaggaatggagaccctctgactcattgctcggatctccaccatgacaaccaccatggacattcgcctgaagaacgaattatttatggagttgaaaatagttccactttcttagaatgttcccctaagagtcagagagctttggtttactggcaattccagcggcgaaacgaagaacgaaaagaggagattcgagtggacgatcatattattaggaccgaccaaggcctcttgctgcgaagcttacaacagaaggactctggaaattatctttgtcatgcggtggagcatggatttatccagacgctgctgaaggtaaccctggaagtaatcgatactgaacacctggaggagttactgcacaaagacgatgacggagacggaagcaagacgaaggagatgagcaattcaatgactccctctcagaaggtttggtacagagattttatgcagctcattaaccatccaaacctcaataccatggatgagttctgtgaacaggtctggaaaagagacaggaaacaacggcgtcagcgcccagggcacacaccgggaaactctaataagtggaaacatctgcaggagaacaagaaaggtcggaatcgtcggactcacgaatttgaaagagcccctagatctgtctag

SEQ ID NO: 11331 - DNA, 1014 bp, Artificial Sequence
  Description of Artificial Sequence: Synthetic coding sequence
atggcaagacccatgatcaaagaggcacgcatggcaagcttgctgctggagaatccttactatggctgtcgaaagcccaaagaccaagtgcggtcctcgctgaaaaacgtgtctgacttgttcgttatggggggagctctggtgttggagtcagcagctttgctccactggctggagcgggaaggctatggcccactggggatgacgggtatttctatgggcggacatatggcttccttggcagtctcgaattggccaaaacccatgccactgatcccttgtctgtcttggtcaactgcgtccggggtattcacaacgggagtactgtccaagtctatcaactggagggagctggagaagcagtactatacgcagaccgtctacgaggaagagatcatacacatgctggaatattgtgggaccgactcttttaaaatgggccaggagttcgtgaaacacttcacctcttcagccgataaactcacaaaccttaatcttgtctccagaactttgaatttagatatcagcaaccaggtggtgagtcagaaaccagcggattgccacaatagtagtaaaacaagcgtgagcgccaccagcgaaggccttctgcttcaagacactagtaaaatgaagcgctttaaccagaccctgtcaaccaataaatcaggctacacaagccgcaatccacagagctatcaccttctgtccaaggagcagtctcgcaattccctgcgcaaggagtcgctcattttcatgaaaggagtgatggacgagtgtactcacgtggccaatttctccgtacctgttgacccatcccttattatcgtagtgcaggccaaggaagacgcctacattccaagaaccggcgtccgatcactacaggaaatttggcctggttgcgaaatcaggtatctcgaaggcggacacatctccgcgtatctgttcaagcagggactattcaggcaagccatctacgacgccttcgatcgctttctgcacaagtatgcgaattag

SEQ ID NO: 11332 - DNA, 462 bp, Artificial Sequence
  Description of Artificial Sequence: Synthetic coding sequence
atgggtccagaagcactaagctcacttttgctgctcctgctggtcgcaagcggcgatgctgacatgaaaggacattttgacccagccaagtgtcggtatgccctgggcatgcaggaccggactatacctgactctgatatctctgctagtagcagctggagtgattccaccgccgctagacactctaggctggagtcgtcagacggagacggtgcctggtgtcctgctggcagcgtgtttcccaaagaggaagagtatctgcaagtggacctgcagcgcctgcacctggtggcactcgtcggcactcagggcaggcatgccggtgggttggggaaggaattctcccggtcttataggttgaggtatagtagagatggaagacgatggatggggtggaaagatcgctgggggcaggaggttatctctggaaacgaggaccctgaaggagtggtgctgaagtag

SEQ ID NO: 11333 - DNA, 345 bp, Artificial Sequence
  Description of Artificial Sequence: Synthetic coding sequence
atggacaagtccctccttctcgagctacccatcctgttgtgttgtttccgagcattgagtggctccttgagcatgcggaacgacgctgttatagagattgtgcagtgcaggatgtgtcacttgcagtttcccggagagaagtgttcacggggaaggggaatttgtactgcaacgaccgaagaagcctgtatggttggcagaatgtttaaacgcgatggcaatccttggctcacatttatgggctgtctcaaaaactgcgcagatgtgaaaggaatacgctggagcgtgtacctggtgaacttcagatgttgtaggtctcacgatctctgcaacgaggacctctag

SEQ ID NO: 11334 - DNA, 630 bp, Artificial Sequence
  Description of Artificial Sequence: Synthetic coding sequence
atgggtcccgaggctttgagcagcctgttgctactgctgctggtagcctctggggacgctgatatgaaggggcattttgatcccgctaaatgtcgttatgccctcgggatgcaggaccggacaatccctgactctgacatctccgcgtcaagctcctggagtgactctacggcggctcgccactctagacttgaatccagcgacggggacggcgcttggtgtcctgccggatctgtctttcccaaggaggaggagtatctgcaggtggatctgcaaaggttacatctggtcgccctggtaggcactcagggtcgccacgcgggaggactgggtaaagagttcagcaggtcgtacaggctgcgctactcacgggacggccgtcggtggatgggatggaaggaccggtggggtcaggaggtaatctcggggaatgaggaccctgagggtgtcgttctcaaggatttgggacctcctatggtcgcccgacttgtcaggttttatcccagagctgatcgcgtgatgtccgtgtgtctcagggtagagttgtatgggtgcctctggagggacggacttctgtcgtatactgccccagtcgggcaaaccatgtacttatccgaggcagtgtactag

SEQ ID NO: 11335 - DNA, 639 bp, Artificial Sequence
  Description of Artificial Sequence: Synthetic coding sequence
gactttgggtactgtccccgtgtgtactgcgagaaccagcccatgctccctatcggagttcttgtgatggtagggttcacagtgggcaaagtgcccgtgcccgatatcaggacttgccacttttgcctggtagaggacccctcagtcggatgcatatccgggtctgagaagtgtacaatcagctctagtagcctgtgcatggtgattactatttactacgacgttaaagttagatttattgtccgtggctgtgggcagtacatcagttaccgatgccaagaaaagaggaatacttacttcgctgagtactggtaccaggcgcagtgctgccagtacgactattgcaactcctggtccagccctcagttgcaaagttcactccctgagccccacgatagacccctggcactgcctctgtcagactcacagattcagtggttttaccaggcgctcaacttgagcctgcctctccctaactttcatgccggtacggaacccgatggcctggacccaatggtaaccctcagcctcaatttagggctatctttcgcggagctgcgaaggatgtatctattcctgaattcctccggcttgcttgtcttaccacaggccggtcttctgaccccccacccttcgtag

SEQ ID NO: 11336 - DNA, 240 bp, Artificial Sequence
  Description of Artificial Sequence: Synthetic coding sequence
atgaaactgcactctctaattagtgtattgcttctctttgtgacgttaatcccaaaaggcaagactggcgtgatccctgggcaaaagcagtgcattgcactgaagggagtctgtcgcgacaagctgtgttcaactctggacgataccatcggtatttgcaatgagggaaagaaatgctgtcggagatggtggatcctggagccttaccctacccccgtgccgaagggcaagtccccctag

SEQ ID NO: 11337 - DNA, 1620 bp, Artificial Sequence
  Description of Artificial Sequence: Synthetic coding sequence
atgtccgagccccaggagaaaaagctgtctgagaacacggatttccttgcccctggcgtctccagttttactgattcgaaccagcaggagtctatcacaaaacgggaagagaaccaggagcaaccaaggaattactcacatcatcagttgaatcggagttccaagcacagccagggcttaagagaccaggggaatcaggaacaggacccaaatatcagtaacggcgaggaggaggaggaaaaagagcccggagaagtgggtacccacaacgacaatcaggagcggaaaacggaactgcccagggagcacgctaactcgaaacaagaggaggacaacacacagtccgacgatatattggaggagagtgaccagcccacccaagtgagcaagatgcaagaggacgagttcgatcagggcaaccaggaacaggaagacaactccaatgcagaaatggaggaggaaaacgcttccaatgtgaacaagcacatccaagagactgaatggcaaagccaagaaggaaagaccgggcttgaggccatctcaaatcacaaggagaccgaggaaaaaacggtgtcagaagcccttctcatggagcccaccgacgacggaaacaccacaccgaggaaccacggcgtggatgacgacggggatgacgacggagatgatggaggtacagatggtcctcgacacagcgcatccgacgattactttatcccatctcaggctttcctcgaggcagagcgtgctcaatctatcgcatatcacctgaaaatcgaagaacagagggaaaaggtccacgaaaacgagaatatcggtaccaccgaacccggagagcatcaggaggccaaaaaggcagaaaattcttccaatgaggaagaaacatcctccgagggcaatatgcgagtgcatgctgtcgatagttgtatgagtttccaatgtaagcgaggccatatctgcaaagcagatcagcagggcaaaccccattgcgtttgccaggatccagtcacgtgcccccctacgaaacctctcgaccaagtctgcggaaccgataatcagacttacgcctcttcatgtcatctgttcgccacaaaatgcagactggaaggcacaaaaaaaggtcaccagctgcagcttgactacttcggggcttgcaaaagcattcccacctgcacagattttgaagtcatccagttccctttgaggatgcgagactggctgaagaatattctgatgcaactctacgaagccaacagcgagcacgctggttacttgaatgaaaagcaacgaaataaagtaaaaaagatctatctggacgagaaaaggctgctggccggtgaccatccgatcgacctgctgctccgggatttcaagaagaactaccacatgtacgtgtaccctgtgcattggcagttttctgagctggaccagcacccaatggaccgggttcttacccacagcgaactggcgcctctgcgtgccagcctcgtccctatggaacactgcataaccaggttctttgaagaatgtgatcctaacaaagataaacacattactcttaaggagtggggacactgtttcggaattaaagaagaagacatcgacgagaacttgttgttctag

SEQ ID NO: 11338 - DNA, 2535 bp, Artificial Sequence
  Description of Artificial Sequence: Synthetic coding sequence
atggggccaggcgctcctttcgcacgggtagggtggccgctgcccttgttagtggtgatggcggcaggcgtggccccagtctgggcctcccactctcctcacttgcccaggccacactccagagtgccccctcacccctccagcgaacggagggcagtgtatatcggagcattattccctatgagcggaggttggcccggagggcaggcctgtcaaccagccgtggagatggctctcgaagatgtgaattctcgcagggatatcctgcccgactatgagctcaaactgattcaccacgatagcaagtgcgatccgggtcaggctaccaagtatctctacgagcttctgtataatgaccccataaagatcatattgatgccaggatgttcgtctgtgagtacactggtcgccgaggcagccaggatgtggaatctgattgtgctgtcctacgggtcatcctcaccagccttgagtaaccgccagcgcttcccaacgttttttagaactcatccttccgcaactctgcacaaccccacccgagtcaagctgtttgagaagtggggctggaaaaagatcgcgaccattcagcagacaacagaggtcttcacatctaccctagatgatctcgaggaaagggtgaaggaagcaggaattgaaatcaccttcaggcagagttttttttcggaccccgcagtgcccgtaaagaacttgaagcggcaggatgcccgaattatcgtgggcctattttacgagaccgaagccaggaaggtgttctgcgaggtgtacaaagaaaggttatttggcaaaaaatatgtgtggttcttgattggatggtatgccgataattggtttaagatatacgacccctctattaactgcactgtggatgagatgactgaagccgtagaaggccacatcaccacagagatagtgatgctgaaccccgctaatacacgctcaatctccaatatgacctcgcaggagttcgtggaaaaactgacgaaacggcttaagcgacatcctgaggagactggcggattccaagaagcaccactggcttacgatgctatttgggccttggccctggccctaaacaagacctcagggggagggggacggtccggagtcagactggaagacttcaactataataaccagacaatcaccgaccagatatatcgcgctatgaatagcagcagctttgaaggagttagtggacacgtggtgtttgatgccagtggctctagaatggcatggacgcttatagagcagctccaaggtgggagctataagaagatcggttactacgactcaacaaaggatgacctaagctggagcaagacagacaaatggattggtggaagccccccagccgatcaaaccctggtaataaaaacgtttcgattcctttcacagaaattatttataagcgtgagcgtgttatcgagtctgggcattgtcctagccgtcgtgtgcctctcgttcaatatatataattcccacgtccggtacatccagaacagccagccaaacctgaataatctcacagctgtggggtgctccctggcattggccgcagtttttcccctgggcctggacggataccacatcgggaggaaccagtttcctttcgtgtgtcaggcccgtctctggctcttggggctgggattttctctggggtacggcagcatgtttaccaagatatggtgggttcacaccgtattcacaaagaaagaggaaaagaaggaatggaggaagacactagagccttggaaattatacgctaccgtcggactgctcgttgggatggatgtgctgaccctagctatctggcagatcgtcgaccccctgcataggaccatagagacctttgctaaagaggaaccaaaagaggatatagacgtgtctatcctaccacaactggagcattgcagctcccggaagatgaacacgtggctgggcatattctacggctataaggggctactcttgctccttggaatatttctcgcctatgaaactaaaagcgtgagcacggagaagatcaatgaccaccgcgctgtgggcatggctatctacaacgtggccgtgctgtgcttgattaccgccccagtgaccatgatcctgtcttctcagcaggacgccgctttcgcctttgcctcgttggccatcgtgttcagctcttatataactttagtcgttctgtttgtcccgaaaatgaggagactcatcactagaggcgagtggcagagtgaagcgcaggacacaatgaagacaggcagctccacaaacaataacgaagaagaaaagtctcgattgctggagaaggagaaccgggagctggagaaaataatagccgagaaggaagaaagagtgtcagaactgagacatcaactacagagcagacaacagctccgctcccggagacatccacctacgccacccgaaccgtccggcggtttgcccagaggacctccggaacccccagatagacttagttgcgatggcagtcgagtgcacctgctgtataaatag

SEQ ID NO: 11339 - DNA, 993 bp, Artificial Sequence
  Description of Artificial Sequence: Synthetic coding sequence
atgcagctgttcctcctgttgtgcctagtgctcctctcgccgcagggagcctcactgcacaggcaccatcctcgggagatgaagaagagggtggaggatctccacgtcggcgctacagtggctcctagctcgagaagggacttcactttcgacctgctcggaaatgctctattcacagacctggtcgtggacttacaggatactttcgtgagcgccatgaagacactctatcttgccgatacttttccaaccaactttagggactccgccggagctatgaagcagatcaacgattacgtggcaaaacagaccaaaggaaagatcgtggatctcctgaagaatttagactctaatgctgtcgtcatcatggtgaactacatcttctttaaagccaagtgggagacaagttttaaccacaagggcactcaggagcaagatttttatgtgactagcgagaccgtcgttcgggtccccatgatgtcacgcgaggatcagtatcactacctcctggacaggaatctttcatgtagagtagtgggagttccttatcagggaaatgccaccgccctgtttatcctcccaagcgagggaaagatgcagcaggtcgagaatggactgagcgaaaagacgctgcgcaaatggctgaaaatgtttaagaaacgacagcttgagctgtacctgccaaagttttctatcgagggtagctatcagttggaaaaagtcttgcccagtttgggaatttcgaacgtctttacatcacatgcggatctatctggcatatccaaccactccaatatccaggtcagcgagatggtccataaagcagtggtggaggttgacgaatccggaactcgtgccgcagccgctaccggtaccatctttacctttaggtctgctagacttaattcccaaagactcgtgtttaacaggccattcctaatgtttatcgtcgataacaatattctgttcctgggaaaagttaatcgcccttag

SEQ ID NO: 11340 - DNA, 2676 bp, Artificial Sequence
  Description of Artificial Sequence: Synthetic coding sequence
atgttgcccacggaagtgccacagtcccacccagggccaagcgcactcctccttctgcagttgcttttgcccccaacatcagcattcttccctaacatctggagtcttctggcagcccctggcagtataacgcatcaggatctcacagaggaagccgctctgaatgtaacactgcagctcttccttgagcagccacccccaggcaggccacctcttaggttggaggatttcctgggaagaactctcctcgccgatgatctattcgctgcctattttgggcctgggtccagccggagatttagggcggctcttggggaggtctcccgagcgaatgctgcccaggattttttacctacctcgagaaatgaccccgatctgcattttgatgccgaacgactcggacaaggccgagcccgattggtgggtgctctgagggagaccgttgtggccgctcgcgctctagatcatacactcgccagacagagactcggggctgctctccacgctctgcaagatttttacagccacagtaactgggtggaactgggtgaacagcagccccatcctcatctgctgtggcctcgacaggagctccagaacctggcccaagttgcagatcctacgtgctctgactgtgaagaactctcctgcccacgtaactggctgggctttaccctcctcactagcggctattttggtacacaccccccaaaacctcccggaaagtgctctcatggagggcactttgacaggtctagctcacagccacctagaggcggtattaataaagactcaacctcacccggtttctcaccacaccatatgctgcatctgcaagctgccaaactggcacttctcgcatccatacaggccttctctcttctccgctctcggcttggcgatcgcgactttagtagactgctggacatcacgcccgcatctagtctgagttttgtgctggataccacaggaagcatgggtgaggagatcaatgctgctaagattcaggcgagacatttggtggagcaacgacgaggcagccctatggaaccagtccattacgtcctcgtaccgttccacgatcctgggtttgggcctgtcttcaccacaagcgaccctgacagcttctggcaacagctgaatgagatacacgccctaggtgggggagatgagcctgaaatgtgcctgtccgcactgcagttggctctgctgcacacccctcccttgtccgacatcttcgtctttactgatgccagccctaaagatgcctttctgacaaatcaagtggaatccctcactcaggaaagacgatgtcgcgttacgttcctggtcactgaagatactagccgggtccaaggtcgtgctagaagagagatccttagccccctccgctttgaaccatataaagcagtagcgttggcaagtggcggagaagtcatctttacgaaggatcagcacataagggatgttgcggctatagttggcgagagcatggcagcgcttgtcactctgccccttgatccacccgtggtggtccctggccagccactcgtgttcagcgtggacgggctactgcaaaagatcaccgttcggatccacggcgatatctcctctttctggatcaagaatccagctggagtaagccaagggcaggaagaaggaggtggtcctctggggcatacgaggcgatttggccagttctggatggtgacgatggatgaccctccccagaccgggacatgggagattcaggtgaccgctgaggacaccccaggtgtgagggtccaggctcagacgagcctcgattttctttttcacttcggtattccaatggaggacggccctcaccccggtctgtaccctttaacgcagccggtagctggtctccagacgcagctgctggtggaggtgactggcttgggttcacgagctaatccgggtgaccctcagccacatttcagtcatgttatcctgagaggggtgccagaaggcgctgagctgggtcaggtaccattggaacctgtggggcctcccgagagagggctgctggctgcttccctgtcaccaacccttctatccacaccaaggcctttcagcctggagctgattggacaggatgcagcaggacggcgattacatagggcggcaccacagccaagcacggtcgtgcccgtactacttgaactatcgggtccctctgggttcctcgctccgggaagcaaggtgcctttgtcacttcgaatcgcctctttttctgggcctcaggaccttgacctccgtacatttgtgaatcctagtttttctctgacatctaaccttagtagagctcatttggagctcaatgagagcgcgtggggcagactttggcttgaggtgcctgactccgcagcccctgacagcgtggttatggtcactgttactgccggagggcgtgaagccaacccagttcccccaacacacgctttcttgagactgcttgtgtccgctcctgcacctcaggaccgacacaccacacctactggctcaagcgatcccatactgaccacagccacccctgctttttcaccctttaccttggtcacacagggaagggcaggcgcaggcctagctgcgggaagtccatggtgggggacagtcgggggagtgttactgctgttagggctagcttcttggtag

SEQ ID NO: 11341 - DNA, 708 bp, Artificial Sequence
  Description of Artificial Sequence: Synthetic coding sequence
atgaagtatgtattctatctcggggtactggccggaacttttttttttgctgacagcagcgttcagaaggaagatcccgcaccgtatcttgtatacttaaagagtcactttaacccttgtgtgggcgtcctgatcaaaccctcctgggttttggctccagcacattgttacctccccaaccttaaagtgatgctggggaacttcaagtctagggtgcgcgacggaaccgagcagactattaaccccattcagatcgtgcgatattggaattactcccattctgcaccacaggatgatcttatgctgatcaagctggcgaagcccgctatgctgaatccaaaagtgcaacctctgactctagccaccactaatgtcaggccaggcaccgtctgcctccttagtggactggactggtcacaagagaactcagggagacaccccgatcttcgtcagaacctcgaagcaccggtgatgtccgaccgagaatgccaaaagactgaacaggggaaaagccaccgcaatagcctttgtgtgaagttcgtgaaggtattctcaagaatattcggtgaggtcgcagtcgctacggtgatctgtaaagacaaacttcagggcatcgaagtgggacattttatgggcggagatgtgggcatttacaccaacgtgtataagtatgtgagctggatcgagaataccgccaaggataagtag

SEQ ID NO: 11342 - DNA, 1386 bp, Artificial Sequence
  Description of Artificial Sequence: Synthetic coding sequence
atgtccctggacatccagagtctggacattcagtgtgaggaactgtcagacgcaaggtgggccgagctactccccctcttacagcagtgccaggtcgttaggctcgatgattgcgggctcacggaggccaggtgtaaggacataagttctgcacttcgagtaaaccccgcactggcagaattaaacctgcgcagcaatgaattaggcgatgtgggcgtacactgtgttcttcagggcctacagacaccatcttgcaaaattcaaaagctaagcctgcagaattgctgtctgactggtgctggatgtggagtactaagctcgaccctccgcacccttcccacactccaggagctacacctgtcagataatctcctgggcgatgccggactccaactgctttgcgagggcctgctggatcctcagtgccgattggagaaacttcaacttgaatactgtagcttatccgccgcaagttgcgagcctctcgcgtcggttttgcgcgcaaagccagacttcaaggaacttactgtgtcaaacaacgacatcaatgaggccggagttagagttctctgtcagggactcaaagacagtccgtgccaactggaagcactgaagctagagtcctgtggagtaactagcgacaactgccgcgatctgtgtggaattgtcgcttcaaaagcttcactgagagaactggcccttggcagcaacaagctgggggacgtgggcatggcggaattgtgccccggactactccacccgtcatccagattaaggaccctctggatttgggagtgtggcatcacagccaaaggctgcggagatctgtgccgggtattacgggctaaagagtcccttaaagaactctcattagcaggtaacgagttgggggacgaaggtgcgaggttgctttgtgaaacgctgttggagcccggttgccagctcgaaagcctgtgggtcaagtcctgctcctttactgccgcttgctgtagtcacttcagttcggttctggcacagaatcggttcctgctggagctgcaaatctcaaacaatcgattggaggatgccggagtgagggagttgtgtcaaggcttggggcagcctgggtccgtcctccgcgtcctgtggctggcggattgcgacgtgagcgatagcagctgttccagtcttgccgcaacactcctggcaaatcactcactgcgcgaactagatctgagcaataattgcttgggtgacgccggaattctccaactggtggagagcgtgcggcaaccaggctgcctgttggagcagctcgtcctgtacgacatttattggagcgaagaaatggaggacaggctacaggctctcgaaaaagacaagcccagcctgcgtgtcatcagctag

SEQ ID NO: 11343 - DNA, 2676 bp, Artificial Sequence
  Description of Artificial Sequence: Synthetic coding sequence
atgctgcccaccgaagttcctcagtcccaccccggtccaagcgctctgctgctgcttcagctcctgctgccccctacttccgctttcttcccgaatatctggtccctgctggctgctcccggttccatcacccaccaggatctcactgaagaagccgcactcaatgtcactctgcagctgttccttgagcagcccccacctggtcggcctccactgaggttggaggattttctaggccgaaccctgctcgctgacgacctgtttgccgcttacttcgggcctggctcgtctcgcaggtttagagccgcactgggagaggtgtcacgggctaatgcagcccaggactttcttcctacatccagaaatgatcctgatctgcactttgacgccgaaaggcttggtcaaggccgagcaagactcgtcggcgcactgagagagacagtggtggcagcaagagctctagatcacactctagccagacagcgtctcggagcagctctgcacgctcttcaggacttttattcacattccaattgggtggagctgggcgaacagcagccgcatccacaccttctctggccccgacaggaacttcaaaaccttgctcaggtggcggatcctacatgttcggattgcgaggagctaagttgcccgaggaattggctaggatttactctcctcaccagtgggtacttcggcacccaccccccaaagccacccggaaaatgcagccatgggggtcacttcgatagatcttcatcacagccccctaggggaggcatcaacaaggactccactagtccagggttctcccctcatcatatgctacacttgcaggcggcaaagctggctctcctcgccagcattcaggcgttctccctactccggagtcgtttaggtgatagggacttttctcggctactagatattaccccagccagctcactgtctttcgttctggatacaaccggatctatgggtgaagaaattaacgccgcaaaaattcaggcgagacacctggttgaacagcggagggggagcccaatggaaccagttcactatgtccttgtgcctttccatgaccctgggttcgggccagtgtttacaacaagcgacccagattccttttggcagcagctgaacgagatccatgccctaggtggcggagatgagcctgagatgtgtctgtccgcactgcaattggccttactgcacaccccgcctctgagcgatattttcgtgttcacggacgcatcacctaaggatgcctttctgacaaaccaagttgaatctctgactcaggagcgccgatgcagagtgacttttttggtcaccgaggatacctcgcgggtgcaagggcgtgcacgtcgcgagattctgtctcctctgcgcttcgaaccctataaagccgttgccctggcatccgggggtgaggtcatattcacaaaggatcagcatatccgagacgtggcagcgatcgtgggggaaagcatggcggcactggttactctgcctctggaccctcctgtcgttgtaccaggacaacccctggttttctcagttgacgggctgctccagaagatcacagtccgcatccacggcgatatctcatccttttggatcaaaaatccggcaggggtcagccaaggacaggaggaggggggaggacccctgggccacacaagaaggttcggccagttttggatggtgaccatggacgaccctccgcagacaggcacatgggagattcaggtgacagccgaggacaccccaggcgttcgggttcaggcccagacctcactggacttcttatttcattttggcatacccatggaggacggtcctcaccccggtctttaccccctaacccagcccgttgccggattgcagacacaactactagtggaagttaccggcttgggtagcagggctaaccctggcgatccacaacctcatttttcccacgtcatcctccggggagtgcctgagggggctgagctcgggcaagtacctctggaacccgtgggccctcccgaacgtggactccttgcagcctcactgtcgcccaccctgctatccacccctcgaccattctcactggaactcatcgggcaggacgccgcagggaggcgcctgcacagggcagcacctcagccatccacggtcgtccccgtcctgttggaactgagcggtccctccggcttcctggcccctgggtctaaggttcccctgtcgctgcgcattgcctcgttcagtggccctcaagatctggacctgaggacttttgtaaacccttctttctcactgacaagtaatctctccagagcccacctcgagctgaacgagtctgcctggggaagactctggctcgaggtccccgactctgccgcacccgacagcgtggttatggtgactgttactgccggtggtcgggaagccaaccccgttcctcccacacacgcattccttcggctactcgtgtccgcccctgcccctcaggacaggcacaccacccccactgggagttctgacccgatccttactacagccacacctgccttctccccatttactttggtgacgcaggggagagccggtgcaggtctcgcagcaggcagcccctggtggggcaccgtcggtggggtgctgctgctactgggtttggcgtcctggtag

SEQ ID NO: 11344 - DNA, 501 bp, Artificial Sequence
  Description of Artificial Sequence: Synthetic coding sequence
atgggacccgaggccttgtcctcgctcctgcttctcttgttagtggcgtccggtgacgctgacatgaagggccactttgatccggcaaagtgcagatatgccctgggaatgcaggatcgaaccatccccgacagcgatatatctgcctcctcatcgtggtctgactctaccgcagcaaggcactcccgcctcgaatcttctgacggcgacggagcctggtgtcctgctgggagtgtatttcctaaggaggaagagtatctccaagttgacctgcaacgcctgcatctggtggcgttggtcggcacacaggggaggcacgcaggtggtttgggcaaggagttttcaagaagttaccgtctcagatatagtagagatggacgacgctggatggggtggaaagatcggtggggacaggaggtgataagtgggaacgaggatcccgagggagtggtactgaaagacctcggacctccaatggttgcgcgtctcgtcaggttctag

SEQ ID NO: 11345 - DNA, 420 bp, Artificial Sequence
  Description of Artificial Sequence: Synthetic coding sequence
atgcaggcagcctgttggtacgtgctgttcttacttcagccaactgtttacctggttacttgcgcgaacctgaccaatggtggaaaaagcgaactcctcaagtccggaagcagcaagagcactttaaaacatatttggacagaatcttccaaggatctatctatcagtcggctcctatcccaaactttccgtggaaaggagaacgacaccgacctcgatttaaggtatgatactcctgagccatactccgagcaagacctgtgggactggctacgcaactcaacggatctgcaggagccacgtccaagggccaagcgccgtcctatcgttaagacaggaaagtttaagaagatgttcggatggggtgatttccattccaatattaagaccgtgaagctcaacctgctaataacgggatag

SEQ ID NO: 11346 - DNA, 2412 bp, Artificial Sequence
  Description of Artificial Sequence: Synthetic coding sequence
atggccgcagcaggcctggtggccgttgctgccgcagcagagtattccggtaccgttgctagtggcggaaatctgcctggagtccactgtggtcccagcagcggtgcaggcccaggatttggaccgggtagctggtctaggtccctagatcgggctctggaggaagccgctgtgactggggtcttatcactatcgggcagaaagctgagggagtttcccagaggggcagccaatcacgacctaaccgacaccactcgggcagacttgtcaagaaacaggctctccgaaatcccaattgaggcgtgccatttcgtgtcccttgagaatctcaacttgtaccaaaactgtataagatacattcctgaggccattctgaacctgcaggccttaaccttcctgaacattagccgtaatcagctgagtacactccccgtgcacctctgtaatttgcctcttaaagtactgatagccagcaataataagctcgtgtcgctccctgaggagattggccacctgaggcatctcatggaactggatgtgtcctgcaacgagatccagactatcccgtcacagataggaaatctggaggcactgagagaccttaacgtccgtcgcaaccatctggtgcacctacctgaagagctggccgagttgccactgatcaggctggacttctcatgcaacaaaattaccactattcctgtttgttacaggaaccttcggcacttgcaaacaattactctggataacaaccccctacagagcccccctgctcaaatctgtatcaaaggtaaagtgcacattttcaagtacttaaatatacaggcatgcaagattgctccagacctgcccgactatgacagacgtcctttagggttcgggtcatgtcatgaagaactttactcctcccgcccatatggagccttggacagcgggttcaacagcgtggactccggcgacaagcggtggagtggcaatgaacccaccgatgaattcagtgacttacctcttcgcgttgctgaaattactaaagaacaaagacttcgcagagaatctcagtaccaggagaacagagggtccctggtggtgacgaatggaggggtggagcacgatctggatcagatcgattatatcgacagctgcacagctgaggaggaggaggctgaagtccgtcagcctaaaggcccagatccggactctctttcatcccagtttatggcctatatcgaacaacgtaggatttcccatgagggcagcccagtaaagcccgttgctattagagaatttcagaaaaccgaggacatgaggcggtatctccatcagaacagggtccccgctgaaccaagctcacttctgtcactctctgcaagccacaaccagctgagtcatactgatctggaattgcaccaacgtagagaacagctggtggaaaggacaagaagggaggcgcaactggcggctctccaatatgaggaagaaaaaattaggacgaagcagattcaacgcgatgccgtcctggatttcgtcaaacagaaagcctcgcagtctccccaaaagcagcaccctttgctggatggcgtagatggggaatgtcctttcccttcccgaagatcccaacacactgacgacagcgccctctgtatgtctctgtcaggactcaatcaggtcggttgtgccgcaacgctgcctcactcctctgcctttacccccctgaagtccgacgatcggcctaacgctctcctgtcatcgcccgctacggagacagttcatcatagtccggcttacagctttcccgctgccatccaacgaaatcaaccccagaggccggagtcttttctgtttcgagcaggtgttagagctgaaaccaataaaggacatgcctcacctctcccaccaagcgcagctcctacaactgacagcacagattccataaccggccagaactctcgccagcgcgaggaggagcttgaattgattgaccagttgaggaaacatatcgagtaccgattaaaggtctctttaccctgcgatttgggtgccgcactgaccgatggcgttgtcctgtgtcatctcgccaaccatgtgaggccacgctccgtcccatctattcacgtgccctcgccagcagtgcctaagctcacaatggccaaatgccggagaaacgtggaaaactttctggaagcatgccgcaaaattggggtgccccaggataatctctgtagcccctctgacattcttcagctcaatttgagcgtgaagcggaccgtcgaaaccctactctcattgggcgcacatagtgaggaatcgtcctttgtgtgcctttctctgcagctactcggatttgtcgccttctactgcaccgttatgttgaccctttgtgtgctgtattactggcttttccctgctaggtag

SEQ ID NO: 11347 - DNA, 633 bp, Artificial Sequence
  Description of Artificial Sequence: Synthetic coding sequence
atgtataaggctcggcctccagccggaagcggcggacccggtgccgaacccccagcaatggccgcaccccgaggcagggccgctccgtggaccacagccctcctgcttctgcttgccagccaagtgctctccccaggaagttgcgctgatgaagaggaggtgccagaagaatgggtcctgctacatgttgtgcaggggcagattggagctgggaactattcatatctgcgactgaaccacgaggggaaaatcgtcctccgaatgcggtctttgaagggcgatgccgatctgtatgtgtctgcaagtagcctgcatcccagtttcgacgattatgagctgcagagcgcaacttgtggcccagacgctgtgtccattcctgcacattttcgcagaccagtgggcatcggagtgtatgggcacccatcacacttggaatctgaatttgagatgaaagtgtactacgatggtactgtcgaacaacaccccttcggcgaagccgcatatccagcggacggagcagatgcgggtcagaaacacgccggtgccccagaagacgccagtcaggaggaggagtccgtgctgtggaccatactgatcagtatactgaagcttgtcctagaaattttgttctag

SEQ ID NO: 11348 - DNA, 486 bp, Artificial Sequence
  Description of Artificial Sequence: Synthetic coding sequence
taatgtccgaccgagataattgcatttggcgacagactggaggaattccgcagtatcaataccgaggtggtagcatgcagcgtggactcccagttcacacaccttgcatggatcaacacacctaggagacagggaggactaggacctattagaatcccgctcctgtcagacctcacacaccagatctccaaggactatggagtttacttggaagactcgggccacaccctgaggggcctcttcatcatagatgacaaagggatcttgagacaaattacactgaatgatctccccgttggaagatccgtcgacgagacactgcgcctggtgcaggccttccagtataccgacaaacatggggaggtatgccccgctgggtggaaaccgggtagcgagaccatcaagccagaagacaccatgaaagcctggtggcccagggagagttacaatcctagaagcagttggaaagcagaagtgtttcgctag

SEQ ID NO: 11349 - DNA, 2886 bp, Artificial Sequence
  Description of Artificial Sequence: Synthetic coding sequence
atgctgctcctcctcttgctggcccctctgttcctgaggcccccaggcgcaggaggcgctcaaacgcccaacgccacttctgaaggatgccagatcatccaccctccgtgggaggggggtatccgatatagaggcctgaccagggaccaggtcaaagcgatcaatttccttcctgtagattacgaaattgagtatgtgtgccggggagagagggaagtggtgggcccaaaagtcaggaagtgtctggccaatggcagttggactgatatggacactccatctcgctgcgtgcggatttgctccaagtcttacctcacactggagaatggcaaagtgttccttaccgggggagatcttcccgcactcgatggagctcgtgttgacttccggtgcgatcctgatttccatctcgtgggctcaagccggagcatttgctcccagggacagtggagcacgccaaagccccactgtcaggtcaaccgtacccctcattccgaaagacgggcagtatatattggcgctcttttccctatgtcaggaggatggccagggggtcaggcctgtcagcccgctgtagagatggcattagaagatgtaaacagtcggagggacatcctgcccgattatgagctaaaattgatacatcacgattccaagtgtgacccaggccaggccaccaagtacctgtatgaactcctatataacgaccctatcaagatcatcctgatgcccggatgctctagtgtgtctaccctcgtcgcggaggctgcaagaatgtggaatttgattgtgctgagttatggctctagctcacccgcactgtcaaataggcagagattcccaactttttttaggacgcatccctccgctactctgcacaaccccacccgggtaaagcttttcgaaaagtgggggtggaaaaaaatcgctaccatccaacagaccaccgaggtgttcacctctacgctcgatgacttggaggaaagagtgaaggaagcagggatcgagatcaccttccgccagtcatttttttccgatcccgcagtacctgtgaaaaatctgaaaaggcaggatgctcgcattatagtcggcctgttttatgagaccgaggccagaaaagtcttttgtgaggtgtacaaggaaaggctcttcggtaagaaatacgtttggtttttaattggctggtatgcagataattggtttaaaatatatgacccaagcatcaattgtactgttgacgagatgactgaggccgtggaggggcacattaccacagagatagttatgttgaatcccgctaacacaagaagtattagtaacatgacttcccaggagttcgtagaaaaactaaccaagagactcaagcgccatcctgaagagacggggggtttccaggaggctcctttggcctatgacgctatttgggctctcgcgctcgcgttaaacaaaacaagcggaggcggaggcagatccggagtgcggcttgaagatttcaactataataaccagacaattacggatcaaatctacagagcgatgaactccagttcatttgagggcgtaagcggacacgtggtttttgatgccagcgggtctcgaatggcttggaccttgattgagcagcttcaggggggaagttacaagaaaatcggctattatgattctacaaaggatgatctgagctggtctaaaactgacaagtggataggaggaagccccccagccgatcagacactggtcatcaaaaccttccggttcctgagtcagaaattgttcatctctgtcagtgtgctctcatctttgggcattgtgctggctgtggtatgtctctccttcaatatatacaatagtcacgtgcggtatatccagaatagccagcccaatctcaataatcttaccgccgtgggctgttctttagctctggccgctgtgttcccactggggctcgacggctaccatatcggtcgcaaccaattcccattcgtgtgtcaggctagactctggttactgggcctcggttttagcttaggctacggttccatgttcactaaaatctggtgggtgcatactgtgttcacaaagaaagaggaaaaaaaggagtggagaaagaccctcgaaccctggaagctatatgcaacagtggggctcctcgtgggcatggacgtgttgaccctggctatttggcagatcgtggatcctttgcacagaacgatcgagacttttgccaaggaagagccgaaggaagacatagacgttagcatccttcctcagctggaacattgcagtagccggaaaatgaacacttggttgggaattttttatggctacaaggggctgctgttactcttgggcatattcctggcttatgaaactaagagcgtctctaccgagaagatcaacgaccatcgggctgtcgggatggccatctataacgtggcagtgttgtgcctgattaccgccccagtcactatgatcctgtcttcccagcaggatgccgcattcgcttttgcttctctggcaatagtcttttcgtcctacatcacgttggtagtcctcttcgtccccaagatgcgacgcctgattacaagaggagagtggcaatccgaggcacaagacaccatgaaaactggaagcagtaccaacaataatgaggaggagaagtctcgcctgctggagaaagagaaccgcgagctagaaaagatcattgccgagaaagaagagcgagtctccgaattaagacatcaactacagagcaggcagcagctcagaagccgcagacaccctccaaccccacctgaaccctcaggagggctaccgagagggcctcctgaacccccagaccgactgtcctgcgatggctcacgggtccaccttctgtataagtag

SEQ ID NO: 11350 - DNA, 2853 bp, Artificial Sequence
  Description of Artificial Sequence: Synthetic coding sequence
atgacttggcgcatgggacctcgttttacgatgctgctcgccatgtggctcgtttgtggctccgagccccatcctcacgctactatacgcggaagtcacggaggcagaaaggttcccctggtatcgcccgactcaagccgcccagctcgattcctgagacacaccgggaggagccgagggatcgagcggtctaccctggaggagcccaatctgcagccgcttcagaggcgtcggtccgtcccagtgcttaggttggccagaccgaccgaacccccagcacgctctgatatcaacggcgcagctgtccgacccgagcagcgccctgctgcacgtggatccccgcgagaaatgatcagggatgaagggagcagtgcacgatcaaggatgctgaggttcccatctggatccagctctcccaatattctggccagctttgcaggaaaaaacagggtgtgggtgataagcgctcctcatgccagtgaaggatactatcggctgatgatgagcctgctaaaagatgatgtgtattgcgagctggctgaaagacacatccagcagatagtattgttccatcaagctggagaggagggcggaaaagtcaggcgcatcacctctgagggccagattctggagcagcctctcgaccctagcctcatcccgaaactaatgagcttcctcaagcttgaaaagggtaaattcgggatggtgctcctcaagaaaacgcttcaggtcgaagaaagatatccctaccctgtccgactggaggcaatgtatgaggtcattgatcagggacctatcaggcgtattgagaaaatacgacagaagggcttcgtgcaaaaatgcaaagcctccggcgtggaagggcaggtggttgctgaaggaaatgacggtgggggtggtgctggccgtcctagccttggctctgagaaaaagaaagaagatccacgcagggctcaagttccaccaacacgcgaatctcgagtgaaggtgctgcgtaagttagctgctaccgcgccagcactgcctcaaccgccttccacaccccgagccaccaccctcccccctgccccagccaccacagtaacccggtctacttcccgggctgtaaccgtcgctgccaggcctatgactacgacagccttccctactacccaacgaccctggactccttctccctcacaccgcccacctaccacaaccgaagtgattacagctcggagaccctccgtgtcagagaatttgtatccccctagccgtaaggaccagcacagggagagaccccagaccacccgaaggccatcaaaggcaacctccctggaaagctttacgaatgcaccccctactaccatcagcgagccatccacgcgcgcagctggcccaggacgatttagggataaccggatggatagaagggagcacggtcaccgagaccccaacgtggtgccaggtccacccaaaccagcaaaggaaaagccaccgaagaagaaagcccaggacaagatcctgagcaacgagtatgaagaaaagtacgatctgagccgcccaactgcgtcccaactggaagacgagttacaggtggggaacgtgcctctgaaaaaggctaaagaaagcaaaaaacacgaaaaactcgaaaaacccgaaaaagagaagaagaagaaaatgaaaaatgaaaatgcggacaaactgctgaagtccgagaaacaaatgaaaaagagcgagaaaaagtcaaaacaggaaaaggagaagtcaaagaaaaagaagggcggtaaaaccgaacaggatgggtaccagaaacctaccaataagcactttacccaatccccaaagaaaagcgtcgcagatctgcttggctcttttgaggggaagagacgcctgttactaatcaccgctcctaaggccgaaaataatatgtatgttcagcagcgcgacgagtatctcgaatcgttttgcaaaatggctacccgcaagatttccgtcattacgatatttggacccgtgaacaattcgacaatgaaaattgatcattttcagctcgacaatgaaaagcctatgcgggtggtggatgatgaagacctggtggaccaacgactcatctccgagctgcgcaaagagtatgggatgacctataacgactttttcatggtgctaaccgacgtggacctgcgagtcaagcaatattacgaagtcccgatcactatgaagagcgtcttcgatttaatagatactttccagtcacgtatcaaggatatggaaaagcaaaagaaagaaggcatagtatgcaaggaggacaaaaaacagtcacttgagaattttctctctagatttcggtggcgtcggaggcttctggtcatctctgcacctaatgacgaggactgggcctactcacagcaactgtccgctctaagcgggcaagcctgtaacttcggcctgcgacacattacaattctgaaactactcggggtcggcgaggaagtcggaggggtgctcgaactgtttcccattaacggaagcagcgttgtcgaaagggaagatgtgcccgcacacctggtaaaagatatccgcaactattttcaagtcagcccagaatacttctccatgttactggttggaaaagatggaaatgtgaagtcgtggtaccctagcccaatgtggagtatggttattgtctatgacctgattgattccatgcagctcagacgtcaggaaatggcaatccagcagtccttgggtatgcggtgtcccgaggatgaatacgccggatacggttaccattcctatcatcagggctatcaggacggataccaagacgactaccggcaccacgagtcctaccatcacggctatccctactag

SEQ ID NO: 11351 - DNA, 351 bp, Artificial Sequence
  Description of Artificial Sequence: Synthetic coding sequence
atggcggctggaagcgcccctatgcagctgcatctgcgcgcaaccatacgaatgaaggatggcctgtgtgtgccacgaaaatggatctatcacctgacagagggcagcacagatctccgtaccgaggggcgacctgatatgaagaccgagttgttcagttcctcatgcccgggagggatcatgctgaatgagaccggccaagggtaccagcgtttcctgttgtacaacaggtccccgcacccccctgagaagtgtgtagaagagtttaagagcctcacgtcctgtctggactcaaaagcttttttgctaaccccgaggaaccaggaagcttgtgaactctccaacaactag

SEQ ID NO: 11352 - DNA, 1251 bp, Artificial Sequence
  Description of Artificial Sequence: Synthetic coding sequence
atgaaattccaggggcctctggcttgtctgttgctggccctatgcctcggctcaggggaagcaggcccactccagtctggcgaagagtccacgggcacaaatatcggtgaagcactgggccatggccttggcgacgcgttatcggagggtgtcggaaaagcaattggcaaagaagcaggtggagctgccggaagcaaagtcagcgaggccctgggtcaggggacacgggaagccgttgggacaggcgtccgccaggtcccagggtttggggtggccgacgccctgggcaaccgtgttggggaggccgctcacgcattgggaaacactggccacgagattggcagacaggccgaggatgtcatccgtcacggtgccgatgccgtgaggggttcttggcagggggtccccggtcacaatggggcatgggaaacaagcggagggcacggcatctttggcagccaggggggtctgggcggacaaggacagggtaatcccggaggattgggtactccttgggttcatggatatcccggtaattccgcgggatctttcggaatgaacccccagggtgccccatgggggcaagggggtaatggaggccctccaaattttggaactaacacccagggtgccgttgcacagccaggttatggatccgtccgggctagcaatcaaaacgagggctgtacgaacccgccaccttccgggtcgggcggaggctcatcgaactccggtgggggatcaggctctcagagtggcagtagtggcagcggcagtaacggcgacaacaataacggctcctctagtggaggcagtagttctggtagcagctctggaggatcttccggcggatctagtgggggtagtagcgggaatagcggtgggagcaggggcgactcaggcagcgagagcagttggggctcctccacaggctccagttctggcaatcacggagggtcagggggagggaacgggcataagccaggctgcgaaaagccgggtaacgaggcacgtgggtcaggggagtccggaatacagggctttcggggacagggggtatcctcaaacatgagagaaatctctaaagaaggtaatagactgttaggaggaagcggggataactatcgtaatagtgagacctcacctggaatgtttaattttgataccttttggaagaattttaaaagcaagttgggcttcattaattgggacgccattaacaaggatcagaggtcaagccgaataccttag

SEQ ID NO: 11353 - DNA, 933 bp, Artificial Sequence
  Description of Artificial Sequence: Synthetic coding sequence
atggtcgataaagacacggagagggacattgagatgaaacgtcagctgagacggttgagagaactacacctgtattctacctggaagaagtatcaagaagcaatgaagactagcctgggggtaccccagtgtgagcgcgacgagggatcgctgggcaaacctctgtgtccacctgagatactgagcgagaccctgcccggaagtgtgaaaaaaagagtgtgctttccctctgaggatcacctcgaggaatttatcgcagagcacctgccagaagcgtccaaccagtccttgctgactgttgcccacgcagacgccggtacacaaacaaatggggaccttgaggacctggaagaacacgggccaggccaaacggtctcagaggaggcaaccgaggtgcacacaatggagggcgaccccgatacgctcgcagaatttcttatccgcgacgtgctccaggagctctcttcgtataacggggaagaagaagatcctgaagaggtaaagacgagtctcggagttccgcagcgcggagacttggaggacctggaggaacatgttcctggccagacagtgtctgaagaggccaccggcgtgcacatgatgcaagttgatccggcaacactggcgaaatcagatctggaggacctggaggagcatgtgccagaacagactgtatccgaggaggctacgggtgtccacatgatgcaagtggatcctgccactctagccaagcagctcgaagacagcacaatcacagggtcacatcagcaaatgtcagcctcacccagctctgctcccgctgaggaggcaaccgagaagaccaaggttgaagaggaagtcaaaactcgcaaaccaaagaagaagaccaggaagccctccaagaagtcacgctggaatgtattaaaatgctgggacatcttcaacattttctag

SEQ ID NO: 11354 - DNA, 150 bp, Artificial Sequence
  Description of Artificial Sequence: Synthetic coding sequence
atggctcctcccagcgttcctctcgttctgctccttgttctcttgcttagcctggccgaaaccccagccagcgctccagctcaccgctccagtacttttccaaaatgggttactaagaccgaacgcggacgccaacccctgagaagttag

SEQ ID NO: 11355 - DNA, 978 bp, Artificial Sequence
  Description of Artificial Sequence: Synthetic coding sequence
atgcaaggaagggttgccggaagctgtgccccacttgggctgctgctcgtgtgtttacatttgcccggactgtttgctcggtcaatcggtgtcgtcgaggaaaaggtttcacagaacctcggcacgaatctaccccagcttggccagccctcatcgactggaccctccaattctgaacatcctcagcctgccctggatcccagatctaatgacctcgcccgagttcccttaaaactctccgtgcccgctagtgacggttttccgccagccggtggatcggctgtgcagcggtggccaccctcttggggtttgcccgctatggacagctggcccccagaagacccgtggcagatgatggccgctgcagccgaagacagattgggcgaggcgctaccagaggaactgtcatatctctcttcagcagcagcactcgcgccaggaagcggaccacttcccggagaaagcagcccggatgcaacgggcctctcgcctaaagctagcctgttgcaccaggacagtgaaagtagacgcctgccaagaagcaatagccttggcgctgggggtaaaatcctgtctcagcgcccaccatggtctctgattcaccgcgtgctcccagaccatccctggggcaccttaaacccaagtgtcagctggggcggaggtggcccaggcaccggatggggaacacggccaatgcctcatcccgagggcatctgggggattaacaaccagcccccaggcacctcatggggcaatataaataggtaccctgggggtagttggggaaacatcaaccggtacccgggaggatcgtggggaaacattaacaggtatccaggaggttcctggggtaacatacacttataccccggaattaacaatccttttccgcctggcgtgctgcggccacccggatcctcttggaatatcccagcgggttttcccaatcccccaagccctagactgcaatggggatag

SEQ ID NO: 11356 - DNA, 390 bp, Artificial Sequence
  Description of Artificial Sequence: Synthetic coding sequence
atggctgcaggatccgctcccatgcagctgcacttgcgggctacgatccgaatgaaggatggactttgcgtccctcggaagtggatatatcacctgactgaaggttctaccgacctgcggacagagggacgtcccgatatgaaaaccgaacttttcagctcctcttgccctggcggtattatgctgaacgaaacaggccagggctatcagagattcttgctgtacaaccgctctccacatccccctgagaaatgtgtggaagagttcaaatctctcacatcctgcctcgattccaaggcttttctgttgacaccgaggaatcagggtaaggggctgaaaagtcataaaactgggctgggactaacaaagtcatctggagttacaggatag

SEQ ID NO: 11357 - DNA, 1056 bp, Artificial Sequence
  Description of Artificial Sequence: Synthetic coding sequence
atggcagggatacctggactgctgttcctgttgttcttcttgctctgcgcggtaggccaggtgtcaccatattcagcaccatggaagcccacctggcccgcttatcgcctccccgtggttctcccgcagagtacgctcaatcttgcaaagcagtacctgagctacgagactttgtacgccaatggcagccgcactgagacacaggtgggcatttacattttgtcctcctccggggacggcgctcagcaccgggacagcggaagctctggaaaaagcaggcggaagcggcagatctatggttatgattctcgcttctccatctttggaaaggacttcttgctgaattaccccttttctacttcggtgaaactgagcaccggctgcaccgggacgctggtggctgaaaaacacgtcctgacagctgctcactgtattcacgacggcaagacttatgttaagggaacacagaaacttagagtcgggttcctaaagcccaagttcaaggatgggggtcggggagcaaacgattcaacgtctgccatgcccgagcagatgaaattccagtggatcagagtgaagcgcacccacgtgcccaaaggttggattaaagggaacgcaaatgacattggaatggactatgactatgccctcttggaactcaagaaaccacataagcggaagtttatgaagatcggagtgtcccctccagcaaagcagttgcctggaggtcggattcatttttctggctacgataacgatcgccctggcaatctggtgtaccggttttgtgatgtcaaggacgagacttacgatctcttgtatcagcagtgcgatgcccaacctggggcaagcgggtctggcgtgtacgtaagaatgtggaagagacagcaacagaagtgggagaggaaaattattggaatttttagcggacaccagtgggtggacatgaacggctccccccaggacttcaatgtggcggtgagaattacccctcttaaatatgcccaaatctgttattggatcaaagggaactatctagactgtcgtgaaggttag

SEQ ID NO: 11358 - DNA, 345 bp, Artificial Sequence
  Description of Artificial Sequence: Synthetic coding sequence
atggagaggggcgctggagcaaagctgcttccactcctgctgttactcagagccactggattcacatgtgctcaaacggacggacgaaatgggtacaccgcggtgatcgaggttacatcgggtggaccttggggggactgggcctggcctgaaatgtgccccgatgggttttttgcaagtggcttttccctgaaagtcgagccaccacagggcatacccggagacgataccgcactgaacgggattcggttgcactgcgctcggggaaacgtgctgggtaatacccatgttgtggagtctcagtctgggcgttggggagctggagtcgaagatcccttggggtag

SEQ ID NO: 11359 - DNA, 825 bp, Artificial Sequence
  Description of Artificial Sequence: Synthetic coding sequence
atgtggaggtgccctctggggctcctactgttgctgcccctggccggacacctcgcccttggggctcagcaaggtaggggcaggagggaactggcccctggtctccatctgagaggaatcagggatgctggtggcagatattgccaggaacaggatttgtgctgccgcggaagggctgatgactgcgccttaccatacctgggtgcgatctgctactgtgacttattctgtaaccgcacagtttcagactgttgtcccgacttctgggatttctgtctgggtgtccccccacctttcccgccaatacaggggtgcatgcatggaggcaggatttaccctgtgcttggaacatactgggacaattgtaaccggtggcctccgttagaatgttgggatctgctgcctccggctctgccaggccctgtgtgggcggctctaggggcaaaggaagaaatggcaggcaaggataggacagtttactgccctctgttgatgaaggctctgggtgccagagtgggcgagtgtcccggatgccagagcccgcagagaatgttaccggagagttctagagtgctactaccacggtgtgccgagggtgagcaacctggggttcaaaggggcaaaggcagaatgcgaaaagcattccccgctctccagacgccacttgctctcccatctagtgctcccgcaagccctggggctggaaagccttctcacactggctcttggttgcctctacggctgctaaagagacagcactggagatgggagccatggaccgcttgtaaagaggctgtgcaacacctagttatcacagaactgtag

SEQ ID NO: 11360 - DNA, 438 bp, Artificial Sequence
  Description of Artificial Sequence: Synthetic coding sequence
atggcgcagctattcttgccactcctggccgcactcgtcctggctcaggcccctgccgcactggccgatgtactagaaggcgattcaagcgaggaccgggcattccgggtgcggatcgctggcgacgcccctctacagggtgtgctcggcggagcactcactatcccctgccacgtgcattacttgcgccctccaccgagtcggagggccgtactgggcagtccccgtgtgaaatggacattcctgtccagaggacgtgaggctgaagtcttggtggccagaggggttagagtaaaggtaaacgaagcttatcgatttcgcgtagccctgccggcataccccgcatcccttacagacgtgagcctggcactgagtgaactgcggcctaatgattctggaatatatagatgcgaagtacagcatggaatcgatgactag

SEQ ID NO: 11361 - DNA, 567 bp, Artificial Sequence
  Description of Artificial Sequence: Synthetic coding sequence
atgttccaccaaatatgggcagccttgctgtatttttatggaatcatcttaaactcaatttatcagtgcccggaacatagccagttaacgaccctgggcgtggatgggaaagagttccctgaggttcacttggggcagtggtactttattgctggagcagctcccacgaaagaggagctggccacctttgatccagtagacaatattgtattcaatatggccgcaggatccgcacccatgcagctgcacctgcgcgctaccatccggatgaaagacggcctgtgtgtgcccagaaagtggatttaccatctgaccgaaggctcaaccgacctccgcaccgaagggagaccggatatgaaaaccgaactctttagctcatcctgcccaggtggcatcatgctgaacgaaaccggccaggggtaccagcggttcctgctctacaaccgtagcccgcaccctcccgaaaaatgcgtcgaggaatttaaaagtctgacatcgtgtttggattctaaagcctttctacttaccccacgtaatcaagaagcatgcgaattgtcaaataattag

SEQ ID NO: 11362 - DNA, 558 bp, Artificial Sequence
  Description of Artificial Sequence: Synthetic coding sequence
atgggacctgccggatgcgcctttaccttacttctgctcctcggtatatctgaccgggactatcacagcgcactacaggaggccgaagtacctatcatagaccggcaggcctgtgagcagctgtataaccctatcggtatctttctgcctgccctcgagcccgttatcaaggaagataagatatgcgcaggcgatacacagaatatgaaggattcttgcaagggggattctggcggaccacttagctgtcacatagacggggtgtggatccaaaccggcgtggttagctggggattagaatgtggcaagagtctgcccggtgtgtatacaaacgtcatttactatcagaaatggatcaatgccaccattagccgtgccaataatctggatttctcagactttctcttcccaatagtacttctgtccctggcattactgagaccctcatgtgccttcgggccaaataccatccatcgggttggaacagtcgccgaagccgtcgcgtgcatacagggctgggaggaaaatgcatggagattttctcccaggggaagatag

SEQ ID NO: 11363 - DNA, 1653 bp, Artificial Sequence
  Description of Artificial Sequence: Synthetic coding sequence
ccggctccggcatctaggaagcttcttccacggagacacctctctgaaaagtcccaccacattagcatcccctctcccgatattagtcacaagggactgcgaagtaagcgcacacagccgtctgaccctgaaacctgggaatcattacccagattggattcccagagacatgggggacctgagttctccttcgatctgctcccagaagccagggcaatccgcgtgacgatttcctctggacctgaggtgagcgtgcgcctctgccatcaatgggcattggaatgcgaggagctctcatctccctacgacgtacagaagatcgtgtcaggcggacataccgttgagctcccttacgaatttctcctcccctgtctgtgcattgaagcctcataccttcaggaagatacggttaggcgcaagaagtgcccctttcaatcttggccagaggcatatggatccgacttctggaagtctgtccacttcacagattattcccaacatacccagatggtcatggccctgaccctccgttgccctttgaagttagaagccgctctttgccagcggcacgactggcatactctctgtaaggaccttcccaatgcaacagcacgggaaagtgacgggtggtacgtgctggaaaaggtggatctgcacccacagctgtgttttaagttcagtttcggcaactctagtcatgtggagtgtccacaccaaactggctcgttgacttcttggaacgtgtccatggatacacaggcccagcagctcatcttgcactttagcagtagaatgcatgccactttctccgccgcatggagcctgcccggtctgggacaggatactctggtgcctcccgtgtacacagtgagccaggctaggggttcttcaccggtatccctggatttgataatcccatttcttcgtccaggatgctgtgtgctcgtgtggcggagcgatgtccaattcgcgtggaagcacctcctgtgtccagatgtctcttatcgccatcttggactcctgatcctggctttgttggctctgttgacccttctgggcgtggtgctcgcgctgacgtgcaggcggccacagtccgggccagggccagcaaggcctgtgcttctcctgcatgccgctgactccgaagcgcaacgaaggctggttggtgccctggcagaacttcttagagcagccttaggcggaggtagggatgtcattgtcgacttatgggaagggagacacgtggcacgggtaggaccactcccttggctgtgggccgctcgaacgagagtggctcgcgagcaaggaaccgtgctgctgctgtggtcaggcgctgatctacggcctgtgtcaggcccagaccccagggccgcaccactccttgccttgctccatgccgcacccaggccgcttctgctgctggcctatttttctcgactctgcgcgaaaggcgacattccaccccctctgagagcattgccgaggtatagactgctcagggacctacctcggctcctgcgggcattagacgccaggccctttgccgaagctaccagttggggacgactgggagcaaggcaacgtcgacagagtaggttggaactgtgctctcggctggaacgagaagcggctaggctggccgatcttgggtag

SEQ ID NO: 11364 - DNA, 816 bp, Artificial Sequence
  Description of Artificial Sequence: Synthetic coding sequence
atgggaatcgtgtgcgcccagtgttcgtttattctgttgcttagtattataagggccaggccgccacctttcctgttttgcccactttcaagtcaaagaaccgagagcccctacaaacccgtgcatctcggactggggcctaccgataaagtggcggctatcgctatggctcgcataatcgatctggtgccttgggatgatggatctacccacgtctacgcaagccctgcaatcctgctgccaatggagcgccaacgcaatcagctagccggagtgaaacaacaattgtatcaccccgcattaccgaccttaaggcacatggaccgcgatacggttaaggcatgtctgcccgatgagcactgccagagtaccacatattgccggaaggatgaattcgataatgcgcatttcacgctgcttggcgtgccaaataaacctttgcaatgtctggacatcactgctactggccagaagctcaggaatcgatatcatgaggggaagttagcacctattgccccaggtattaatcgcgtggactggccctgcttcactcgcgcaatagaagattggtcacactttgtaagctccgcaggtgaatttaaactgccctgcctcagaaagagggcagaaggactgtccggttatgcagtgcggtacttgaagcccgatgtaacccagacctggcgttattgcctatcacagaatccctcactagatcgctatggtcagaagccgctgccctttgactccctcaatacctttagatcttttggatcttcgtactctcgcgttaactatttaacaccatggcactag

SEQ ID NO: 11365 - DNA, 1743 bp, Artificial Sequence
  Description of Artificial Sequence: Synthetic coding sequence
atgcatctcagcgccgtcttcaacgcgctgctggtgtcggtgctggcagcggtcctgtggaaacacgtgagactgcgtgagcacgcggcaaccctcgaggaggaactggcgctgtcccggcaggcaaccgaacccgcaccagcccttagaatcgactaccctaaggcactccagatcctgatggagggaggcacccacatggtgtgcactggtagaacgcataccgaccgtatctgtcggtttaagtggctgtgctactccaatgaggcggaggagtttatcttttttcatggcaacacaagtgtcatgctgccaaatttaggctcacgacggttccaaccggctctgctggatctgtctaccgtggaggaccataatactcaatacttcaacttcgtggagttgcctgctgctgcactcaggtttatgcccaagcctgtgtttgtgcctgatgtggccttaatcgccaaccgcttcaaccctgacaatttaatgcacgtgttccatgatgacctgctgccacttttttatactctcagacaatttcctgggttagctcatgaagctcgcttgttcttcatggagggctggggggaaggagctcactttgatctatataagttactatcccctaagcaaccattactccgggctcagttaaaaactcttggtagactcctgtgtttctcccacgctttcgtgggattgtctaaaattacgacctggtatcagtatgggttcgtgcagccccaggggcctaaggctaacattctggtttcaggcaacgagatcagacagtttgcacgctttatgacagaaaagttgaatgtttcccacacaggggtacctctgggggaggaatacatcctggtctttagtcgtacccagaacaggctgatactgaacgaagcagagttgctgctggctttggcccaggagttccagatgaaaactgtaacagtttcactcgaggaccacacctttgccgacgtggtaagactcgtgagcaatgccagtatgctcgtgagtatgcacggggctcagctcgtgacgacgctgtttctcccacggggtgctacagtggtggagctgttcccgtacgcggtgaacccagatcattacacaccgtacaaaacgctcgccatgctacctggaatggatcttcagtatgtcgcctggcgaaacatgatgcctgaaaacactgtgacacaccccgagaggccctgggaccagggaggcatcacccacctggatcgtgcggagcaggcacgtattctccaatcaagggaggtgcccagacacctgtgctgtcgaaaccccgaatggctctttagaatataccaggacaccaaagtcgatattccttcgttgatccaaacaatccgccgtgtggtaaagggcagacccggacctagaaagcagaaatggaccgtgggcctttaccctggcaaagtcagagaagccagatgtcaggccagcgtgcacggtgctagcgaagccagattaactgtctcatggcagatcccctggaacctcaagtacctgaaagtgagagaggttaagtacgaggtgtggctgcaggagcagggagaaaatacctacgttccttacattttagctctccaaaatcacacttttacagaaaatattaagccattcactacatacctggtgtgggttagatgtatttttaacaagatccttttaggacccttcgcagacgtgctcgtttgtaatacttag

SEQ ID NO: 11366 - DNA, 513 bp, Artificial Sequence
  Description of Artificial Sequence: Synthetic coding sequence
atggaattcgttgatgtgacagaatcgaacgctcggtgggtgcaggacttcagattaaaagcttatgctagccccgcaaagttagagagtattgacggggctaggtaccacgccctgctaatccctagctgccccggagccttaactgatctcgcctccagtgggtcgctggccaggatactgcagcatttccactcggagtcaaagccaatctgcgccgtaggacatggtgtcgcagccctatgctgcgctacgaacgaggatcggtcttgggtgtttgatagttacagccttacgggcccaagcgtgtgtgagctagtgcgcgctccaggatttgcaaggctgcctctcgtggtggaggatttcgtgaaggactcaggagcgtgcttttcagcctcagagcctgacgccgtccatgtggtgttagatcgtcacctcgtaactggccaaaacgcgtcctcgaccgtcccagccgtgcaaaatttgctgtttctttgcggtagtcgcaagtag

SEQ ID NO: 11367 - DNA, 1041 bp, Artificial Sequence
  Description of Artificial Sequence: Synthetic coding sequence
atgcgcctgctgttcttagccgtgcttaggccacatacaggcaacgcggtcaccgcccaacgggtgcgggctcatctggaggccgcaggccacgtgtgtgtgctcaaggacgcatttgacttcgaaagtcgctccgaaatcgctaatctgattctggccgaaaattgtgaggctgcccttgctcttcacctctaccgcggaggcaggttgctgcaaggccaccggatccctttcggtgttatcttcgggggtaccgacgtcaacgaagacgccaatcaggccgagaagaatactgtcatggggagagtattagaagaagccaggtttgcggtggccttcacagaaagcatgaaagaaatggctcaagctcaatggcctcatgctaaggggaaggtctatgtgcagtcacagggtattgccacgactccaaacgctgcctttaactggaacacttttttacagagatccgagattaaccagtcagcagataacctccacatctttttgcttatatgcggattgcggcaggttaaagaccccctttatctggtggacgccttttccgcgtggcatcaagaggaaccaaatgttcatctcgtgatagtggggccagaggtggatccagtgttcactagggaggtcaaagccaaagttaaaagggccgcaggggtgcgactcatcggtgagatgccccaggaagatctgcacgccgtggtgaagaattgctttgctgtagtgaattccagtgtgtcggaaggaatgtccgccgcaatcttggaagcaatggacctggaagtgccagtgctcgccagaaatatccccggtaatgccgctgtggtcaaacatgaggttactggtctgctattcagtaacccgcaggagttcgtccatctggccaaacgattagtcagtgatcccgcacttgaaaaagagatcgtggtaaatggaagagagtacgtgcggatgtatcacagttggcaggttgagagagatacttatcaacagctgattcggaaactggaagggagcaccgaggattag

SEQ ID NO: 11368 - DNA, 1482 bp, Artificial Sequence
  Description of Artificial Sequence: Synthetic coding sequence
tcagaggccgtgtacctgaatgacagtacatatgacggacatacagtggggggtctccagtacggaggcttaggccagctggccgacggtgttgtcggcctggatgatttccgaaagtctcaggagttgagggtctggccgggttacgactatgtgggctggtccaatcacagcttctctagtggatacgtggagatggagtttgagtttgaccggctgcgggcattccaagcaatgcaggtccattgcaacaacatgcacaccctgggcgcacgactacccggtggggtggagtgccggtttcgacgcggtcccgctatggcttgggaaggcgaaccaatgaggcacaacctaggcggaaaccttggcgacccccgagctcgggcagtctcagtgccccttggcggaagggtggcccgtttccttcagtgtcggttcctgtttgctgggccatggctgctgttctccgaaatcagcttcatctcagacgtggtgaataattccagcccggcattaggtggtacttttccccctgccccttggtggcctccgggaccgcctccaacaaactttagctctttggagctcgagcccagaggacaacaacctgtcgccaaagctgagggaagtcctaccgctatcctgatcgggtgcctcgttgccattatcctcctcctgctgttaataattgcacttatgctctggagacttcactggcgacgactgctgagcaaggtgctcgaaagccacccaagaacacgctctcccggtctcgtgggcataaggcccactccccttccagtctctcctatggcccttcgctgttgctctccgatccagcctactgccagcttttggccactgactcccgtacctttggaggcccgagccccaccacaccctccagggccaaatcccccaacccccagaggtgtgaccggtgggaatacatacgctgtccctgctctgccacccggagctgtcggcgatggtccaccccgagtggatttccctcgttcaagactccgctttaaagaaaagctgggcgaaggtcagtttggcgaagtccatctctgcgaggtggactctccccaggacctcgtgagtttagactttccccttaacgtgcggaagggacacccattactggtggccgtaaagattctgagacccgacgctacgaaaaacgccaggaatgacttcttgaaagaggtcaaaattatgagtaggctaaaggaccccaacatcattcgcctgctgggcgtgtgcgtccaggatgacccactctgtatgattacggattacatggaaaacggggaccttaaccagttcttaagcgcccatcaactggaggacaaggcggctgaaggcgctccgggagacgggcaggcggctcagggacccaccatttcctaccccatgctccttcatgtcgccgcacaaatcgcgagcggcatgcgctatctggcaaccctgaattag

SEQ ID NO: 11369 - DNA, 354 bp, Artificial Sequence
  Description of Artificial Sequence: Synthetic coding sequence
atgctgatcttttggacaatcacactgtttttactgggggctgctaagggtaaagaagtgtgttacgaagatctaggttgtttcagtgacacagagccatgggggggtaccgctatcagaccgctgaaaatcctgccctggtcccccgaaaaaatagggaccaggttcctgctctacaccaacgaaaatccaaataacttccagatcctcctgctgtccgatccatccaccatcgaagcaagtaattttcagatggatagaaaaactagattcatcattcacggtttcatcgacaaaggggatgagagctgggtcactgacatgtgtaagccaggggcttcccccagggcttag

SEQ ID NO: 11370 - DNA, 1581 bp, Artificial Sequence
  Description of Artificial Sequence: Synthetic coding sequence
atgcaaggacctctcctgctgcccggactgtgctttctgttgagcctattcggagccgtgactcagaaaactaagacctcctgcgccaagtgcccacccaatgcttcatgcgtgaataacacccattgcacttgtaatcatggctacacatctggcagcggccaaaaactgttcactttccccctcgaaacctgcaacgctatcgaaactcaggctataactgacaattgctccgaggagcgtaagaccttcaacctaaatgtccagatgaattcgatggatattcgctgcagcgatattattcagggtgatacacaaggaccctccgctatcgcctttatatcctacagctcgctcggcaatattataaatgcgaccttcttcgaggagatggataagaaagaccaggtctacctcaacagtcaggttgttagcgccgctattggtcccaagcgcaacgtttcactatctaagagtgtcacccttacgtttcagcacgtcaagatgacaccttctaccaagaaagtgttttgcgtctactggaaatccaccgggcaaggttcccagtggagtcgcgacggatgcttcttgattcatgttaacaagagtcacactatgtgtaactgctcccatctcagtagtttcgcagtactcatggccctgacatcacaggaggaggaccccgttttaacagtgatcacgtacgtaggcctttccgtttccctactgtgcttactccttgcagccctgactttccttctgtgcaaggccatccgaaacaccagtactagcctccacctgcagctatcactatgcctgtttctcgcccatctgctcttcctcgtgggcattgatcggaccgaacctaaagtcctgtgcagtattattgccggtgctctccactacctgtacctcgctgcattcacatggatgcttctcgaaggagtacacctgtttttaacggctcggaacctgactgtagtcaactactcttcgatcaacagactgatgaagtggattatgtttcccgtgggctacggagtgcctgcagtgacagtagctatttccgccgcttcatggccccacttatacggtacagcggatcggtgctggttacatttggaccagggctttatgtggagcttccttggcccagtctgtgccattttctcagcaaacttggtgttgttcatccttgttttttggatcctgaaacgcaaacttagctctctgaactctgaagtgagcactattcagaacacaagaatgctcgccttcaaagccacagcccaattattcatcctaggttgtacctggtgtctcgggttactccaagtgggccctgccgctcaggtcatggcatacctgttcacgatcattaatagtctgcaggggtttttcatttttctggtctactgtttgctaagtcagcaggtgcagaagcaataccagaaatggtttcgcgagatcgtcaagtctaaatcagaatctgagacctatacacttagcagtaagatgggcccagattctaagccaagcgagggagatgtgttcccaggccaggtcaaacggaagtattag

SEQ ID NO: 11371 - DNA, 5832 bp, Artificial Sequence
  Description of Artificial Sequence: Synthetic coding sequence
taaccctccttggcgggacgtggggcagggaggatggcacctggtgccttgagaggtggctgtgaacaacgcgcacctgggggtggcgcaaggaccgctgctttggggccatggccttggccttcccccggtccagcaccaagtcccggagctgctcctcccagatctcgcaaaatgtctggcgctctactgtggccattgttgcctctgctgcttctactgctcagtgctcgtgatggagttagagccgctcagccacaggcaccaggctacctaatcgcagctccatccgtgttcagggctggcgttgaagaggttatctctgtgactatcttcaattctcccagggaggtgactgtccaggcgcaactggtagcccagggggagcctgttgtgcaatcacaaggagcaattctcgataagggaacaatcaagctgaaggtgccaaccggtctccgtggacaggcactgctgaaagtttgggggagaggctggcaagccgaggagggccctctctttcataatcaaaccagtgtgactgtagatgggaggggagcttccgtctttatccagaccgataagcctgtttataggcctcagcatagggtgctgatatccatattcacagtgtccccgaacctccggccagtgaacgagaagctcgaggcctacatactcgaccccagaggcagccgtatgattgaatggaggcatctgaagccattctgctgcgggataacaaacatgtcctttccactgtcagatcaacccgtcttgggcgaatggttcatatttgtggagatgcaaggtcatgcctacaataagtcatttgaggtgcagaagtatgtcttgcctaagtttgagctcctcattgatccacctcgctacattcaagatttagacgcctgtgaaacaggaaccgtaagagccagatacacattcgggaaaccagtcgctggcgctttaatgataaatatgacggtgaacggcgtaggatattactcacacgaggtgggcagacccgtccttaggactacaaagattcttggctccagagattttgacatatgcgtgcgcgacatgatcccggctgatgtgccagaacacttcaggggtcgcgtgagtatctgggctatggtgaccagtgttgatgggagccagcaagtggcctttgatgactctactcccgttcagagacagctggtagacatacgatactctaaagacacccgaaagcagtttaagccgggactggcttatgtgggcaaggtcgagttatcttaccccgacggctcaccagcagaaggagtgaccgtgcaaatcaaagccgagctgacacccaaggacaatatttatacttcagaagtggtgagccagagggggttagttggcttcgagatcccaagtatacccacctccgcccagcacgtctggctcgaaacaaaagtcatggctttaaatggaaagccagtaggggcacagtatctgccatcttatctgtcactcggtagttggtactccccatcccaatgttacctccagttgcagccgccttcccatcccttacaggtaggagaagaggcctacttctcggtgaaaagtacttgtccatgtaacttcaccctgtattacgaagtcgcggctcgcggaaacatagtcctatccgggcaacagcctgcgcacaccacacagcagagatctaagagagcagcacctgccctcgaaaaacccattaggctcactcacctgtcggagaccgaacccccacctgcgcctgaagctgaggtggatgtgtgcgtaacaagcctgcacctggcggttacacccagcatggtgccactgggcaggctgttagtcttctatgtccgagagaacggggaaggtgtcgcggacagcctccaattcgccgtggaaacttttttcgaaaaccaggtgagcgtgacatactccgcaaatgagacacagcctggcgaagtggttgatctgagaatccgcgcagctcggggatcctgtgtatgcgtcgcggcagtggacaagagtgtgtacctactgcgctctggctttaggctgacaccggctcaggtgtttcaggaacttgaagattacgatgtttccgatagtttcggggtctctcgggaagacggaccattttggtgggcagggttgaccgcgcagcgtcgccgacgaagctcagttttcccatggccctggggtatcacaaaggactccgggttcgcatttaccgagactgggctggttgtgatgactgacagggtgagccttaatcaccggcaggacggcggtttgtacacagacgaggcggtcccagcctttcaaccccatactgggtcattagtcgccgtggccccttctaggcaccctccaaggacagaaaaacgaaagcgcacttttttccccgagacctggatttggcattgcttgaacatatctgatccaagcggcgagggaacccttagtgttaaggtccccgactcgattacctcctgggtgggggaggcagttgccctgtcaacaagtcaaggccttggaattgccgaacccagtctgctgaagacattcaagcctttctttgtcgacttcatgctgcccgctcttatcatccgcggtgagcaagttaaaataccgctgtcagtctacaactatatggggacctgcgccgaagtttacatgaaactgtctgtgcctaagggaattcaatttgtgggtcatccaggcaaacgtcatgtgacaaaaaagatgtgtgtcgccccaggggaagcggaacctatttgggtcgtgctgagtttcagtgacctaggactgaataatatcacagcaaaggctcttgcctacggggataccaactgttgtagagatgggaggtctagcaagcatcccgaggaaaatcacgccgacaggcgagtgccaatcggggtggatcatgtgcgcagatccgtaatggtggaggcagagggggtaccgagagcttacacatacagtgccttcttttgtccttccgagcgtgttcacatctctaccccgaacaaatacgaattccaatacgtgcaacgtcctctgaggctaacacggttcgacgttgccgtccgcgctcataacgacgcacgggtagctctcagcagtgggcctcaggataccgcaggcatgatagaaatagttctaggcggtcaccagaacacccgtagttggatttcaacaagtaaaatgggggagccggtcgcatccgcacacacagccaagatcttgtcctgggacgaatttcgcactttctggatctcttggcggggtggattaatccaagtaggacatgggccagagccatctaacgagagtgtgattgtggcgtggacactacccaggccaccggaggtccagtttattggattctcaactggctggggatccatgggagaatttcgtatttggcgcaaaatggaagttgatgaaagctacagcgaagcctttaccctgggagtgccccacggagctatccccggttctgagcgggcaactgccagtattattggcgatgtcatgggccctactctcaaccacttgaataacctgctgagactgcctttcgggtgcggagaacagaacatgatccacttcgcccctaatgtgttcgtcctgaagtatttacagaagacacagcagttgtccccggaggtggagcgcgaaaccacagactatctggtgcagggttatcagagacagctcacatataaaaggcaggacggatcttactccgctttcggcgaacgggacgcctcaggctccatgtggcttacagcatttgtgctcaaaagctttgcgcaggccagatctttcatttttgtagacccgagggagctcgccgcagcaaagtcctggatcatccaacagcaacaggccgatggaagtttccttgctgttggtagagtgctgaacaaggacatccagggaggaatccacggtactgtgccacttaccgcttacgtggtagtcgccttactggagactgggactgccagtgaagaggagcggggttcaacggacaaggctcgccatttcctggaatcggccgcaccattagcaatggatccttattcctgtgcactgaccacttatgctctgacgctgttgaggtctcctgcagccccagaagcactgagaaagttgaggtccctagcaatcatgagagatggggttacacactggtcactgagcaatagctgggacgtggataagggcacctttctgtcattcagtgaccgtgtgagccagtctgtggtgtccgcagaggtggaaatgactgcttacgccctgctgacctataccttgcttggggacgtggcagccgctctgcctgtagtcaagtggctgtcacagcagcggaatgccttaggcggattctccagtacacaagacacctgcgttgctctccaggcattagctgaatatgcaatcttgtcctacgctggcggaattaatttgactgtgtcgcttgcatcaactaatctcgactaccaggaaacatttgagcttcacaggactaaccagaaagtcctccagaccgccgctatcccctcgctaccaaccggcctcttcgtgagcgccaaaggagacggatgttgcctgatgcaaattgatgtcacttacaatgtgcccgatcctgtggcaaagcctgcattccagctgctggtgtccctgcaggagcccgaggctcaaggaagacctccaccaatgcccgcaagcgctgctgaagggtcacgcggagactggccaccagccgatgatgacgatccagctgcagaccaacatcatcaggaatacaaagtgatgctggaggtctgcaccagatggctgcatgccggttcctccaatatggcagtcctggaagtgcctctattgtctgggttccgcgcagatattgaaagcttagagcagctgctactggataaacacatgggaatgaaacggtacgaagttgccggacggagagtactcttttacttcgacgagattccgagtcggtgtctgacttgtgttaggtttcgggcactgcgggagtgcgtagtgggtcggaccagtgccttacctgtcagtgtttacgattactacgagccagccttcgaggctacaagattctataatgtgagcacccatagccccttagctcgagagctgtgtgccggtcctgcatgtaacgaggtggagagagcacctgctcggggacccggttggttcccaggagagagcggccctgctgtcgctccggaggagggcgctgccatcgctcggtgtggctgcgatcatgattgtggagcccaggggaacccagtctgcgggtccgatggcgtggtctatgcttctgcatgcaggttgagggaggctgcgtgtcggcaggctgctccattagaacctgccccacctagctgttgcgctcttgagcagcgcctacccgctagcagctcttcaacatacggagacgacttagcctctgtcgctcccggaccattgcaacaggacgttaagctgaacggcgctggcctggaagttgaagatagcgatccagagcccgagggtgaggccgaagatcgcgttactgccggaccccgtccacccgtgagttccgggaaccttgaatcctccactcaaagtgcctcacctttccataggtggggtcagacacctgcacctcaacggcattcgggcagggtggttggagcccacagacctggactgttatctcccgttttcgtgtatagcccggctttccaaagcggtggggaagaaggcctgtggatgtctaacacatgcactcttcgataa

SEQ ID NO: 11372 - DNA, 456 bp, Artificial Sequence
  Description of Artificial Sequence: Synthetic coding sequence
atggaggcaacaggtactgacgaagttgataagttgaaaactaagttcatttcggcctggaataacatgaaatacagctgggtgctgaaaaccaagacatacttctctcgcaattctcccgttcttctgctggggaagtgctatcattttaagtatgaagacgaagacaaaaccctaccagcagaaagcggctgtactattgaggaccacgtcattgcaggcaacgtggaagagtttagaaaggattttatttcccggatttggctgacgtatagggaagagttccctcagatcgagggaagcgcattgacaaccgactgtggatggggctgcaccctcagaacagggcagatgctgctggctcaggggttgatcttacactttttgggaagagcctggacttggccggatgctctgaacatcgaaaattcagattctgagagttggacttcttag

SEQ ID NO: 11373 - DNA, 2616 bp, Artificial Sequence
  Description of Artificial Sequence: Synthetic coding sequence
atgagaaaacctcgtcgcaagtcccggcagaacgccgaaggaaggaggagccccagcccctacagtcttaagtgcagtccgacacgggaaaccctgacgtatgcgcaggcacagaggatcgttgaggtggatatagacgggaggcttcatagaatctctatctatgatcctctaaagatcattactgaggacgagcttacggcgcaagacattacggagtgcaattccaataaggagaactccgaacaacctcagtttccaggaaagtctaaaaaaccgagcagtaagggaaagaaaaaagaaagctgttcaaaacacgcttcgggaactagtttccacctcccccaaccttcgtttcgcatggtggactccggaattcagccagaggctcccccactgcccgctgcttattaccgctacatagagaaacccccagaagacctcgatgcggaagttgagtatgatatggacgaagaggatctggcatggttggatatggtgaacgagaagcggagggtggatggccactccctggtgtccgcagatacattcgagctgctcgtcgacagactggagaaagagtcatacctggagtccagatcatccggagcgcagcagagcttgatcgacgaggacgcgttttgttgcgtgtgtctggatgacgaatgtcacaactccaacgttatcttgttttgtgatatatgtaacctggccgtgcaccaggagtgttacggagtgccctacatccccgagggacagtggctgtgccggtgttgcctacaaagcccatcccgacctgttgattgtatcctttgcccaaacaaagggggagcatttaagcagacatcggatgggcactgggcacacgtggtgtgtgctatctggatccccgaggtgtgcttcgcaaacacggtgtttctagagcccattgaaggaatcgacaatatccctcctgctcggtggaaactgacatgctacatatgcaagcaaaagggcctaggagctgccatccagtgtcacaaggtgaattgttatacggcatttcatgtgacctgtgctcagcgggcaggcctgtttatgaaaatagaaccaatgcgagagacttccttaaatgggacaattttcacagtcaggaagactgcttattgcgaggctcactcacctcctggtgcggctacagcccgaaggaagggtgattcccctaggtccatatcggagactggagacgaggaaggtttaaaagagggcgatggggaggaggaagaggaggaagaagttgaagaggaggaacaggaggcacaaggcggagtatccggatcactgaagggagtgccaaaaaaaagtaagatgagcctaaagcagaaaatcaaaaaagaacccgaggaagctgggcaggacactccctcgacattgcctatgctagctgtcccccagatcccttcttaccggctgaacaaaatttgcagtggcttgagctttcaacgtaaaaatcagttcatgcagcgtctccacaattactggctcctgaagagacaggccaggaatggggtccccttaattcgccgtctccatagccatctccagtcacagcgcaacgcggagcagcgggagcaggacgaaaagaccagtgctgtgaaagaggaactgaagtactggcagaagcttcggcacgaccttgaaagagcgcgtctgcttatcgaattgattcgcaaaagagagaagctgaaaagggaacaagttaaggtacagcaggcagcgatggagttggagcttatgcccttcaatgttctgctacggacaaccctcgatcttctgcaggagaaggaccccgcacacatatttgccgagcccgtaaacttatcggaggtgcccgattatctcgagtttatctcaaaacctatggactttagcactatgagacggaagctggaatctcatttatacagaaccctggaagaattcgaagaagatttcaacctgattgtcacaaattgtatgaaatacaatgctaaggacacaatttttcacagagcagccgtgagactgcgggatctagggggtgctatattaagacacgcacggcgacaggctgaaaatatcggctatgatccagagcgagggactcaccttcctgaaagccctaaacttgaggacttctaccggttttcctgggaggacggcaggtccttgttgttgccctttgaggatcggggtgaccttgagcccctggagcttgtctgggccaagtgccgcggttacccttcctatcctgcccttatcatcgatcccaagatgcctagggagggactgctgcacaatggagtccctattccagtgccccctctcgatgtgctaaagctaggcgaacaaaagcaggccgaggcaggagaaaagctcttcctggtgctgttctttgataacaaacggacgtggcagtggctgccacgagacaaggtgcttcctctcggggttgaagacacggttgataagctcaagatgcttgagggtaggaaaacaagtatacggaagagcgtgcaagttgcctacgaccgagccatgattcatcttagccgcgtgagaggaccccacagcttcgtaacttcctcctacctgtag

SEQ ID NO: 11374 - DNA, 2700 bp, Artificial Sequence
  Description of Artificial Sequence: Synthetic coding sequence
atgctcctgcttctcctactggccccattgttcctgcgcccacccggtgcaggcggagctcagaccccaaacgcgacatccgagggctgccagattatacaccccccatgggaaggcggaattcggtacaggggcctcactcgggatcaggtgaaagcaatcaatttcttgccagtggactatgaaattgagtacgtgtgccgcggagagcgagaggtggtgggcccaaaagtgcggaaatgcctggccaacgggtcatggaccgatatggacaccccaagcaggtgcgtaaataggaccccccattcagagagacgcgctgtgtacatcggcgcactcttccccatgagcgggggatggcccggaggacaggcctgccaacccgctgtagaaatggctttagaagatgttaactcccgcagagatattctgcctgattatgagctcaagctgattcatcacgacagtaaatgtgatccaggccaggccactaagtatttatacgagcttctgtacaatgatccaatcaagattatcctcatgcccggttgcagtagtgtcagtactctggtggcggaggccgcaagaatgtggaacctgattgtcctttcttacggctcaagtagtcccgctctctctaaccggcagagattccccacattctttagaacccatccttccgccactctgcacaatccaaccagagtgaaactatttgagaagtgggggtggaagaaaattgcaacaattcagcagactacagaggtctttaccagtactctcgacgacttggaggaacgagtcaaagaggccggtatcgaaataacattccggcaatccttcttcagtgatcctgctgtccccgttaagaatctcaagaggcaggatgctcggattatcgtcggacttttctacgaaactgaagcgcgtaaggtgttctgcgaggtgtataaagaacggctgttcggcaagaagtacgtttggtttctgatcggttggtatgcggataactggttcaaaatctatgaccctagcattaattgcaccgtggatgagatgacagaagcagtggagggacacatcacaacggaaatcgtcatgctgaaccccgctaataccaggagtattagcaacatgactagccaggaattcgtcgagaagctcacaaagcgtctcaagcggcatcccgaagaaacggggggattccaggaggcacccctggcttacgacgccatttgggcgctggcgctggccctgaacaaaaccagtggaggcggaggcaggagtggtgtacgcctggaggattttaactataacaatcagaccattactgatcagatttacagggccatgaactcatcttcttttgaaggtgtgagtggacacgtcgtgttcgatgccagcggttcgcggatggcctggaccctcatcgagcaactgcagggtgggtcctacaaaaagattggctattacgactccaccaaggatgacctcagttggagcaagacagataaatggataggcggaagtcctcccgcagaccagacactggtgattaaaaccttcagattccttagccagaagctttttatctccgtgagtgtgctgagcagcctcggcattgttctggctgttgtttgtctctcctttaacatatacaacagccacgttagatatattcaaaactcacaacccaatctgaacaacttgacggcggtaggctgctccctcgcactggccgctgtctttcccctgggcctagatggctaccatattggacgcaatcagtttcctttcgtgtgccaggcacgtctgtggctgctaggccttgggttcagtctgggttatggttccatgttcactaagatttggtgggttcacacggtgtttactaaaaaagaagagaagaaagagtggcgaaagaccctggaaccctggaagctatacgccacagtgggtcttctggtagggatggatgtgctgactctggctatttggcagatcgtggacccgcttcacaggaccatcgagacgtttgcaaaagaagagccaaaagaggacattgatgtgagtattctgcctcaactggaacattgttcatcacgcaaaatgaacacatggctgggcatattttacggatataaggggctgctgctgctgttgggaatcttcctggcttatgagacaaagtccgtctctaccgaaaaaatcaatgatcaccgcgctgtggggatggccatttacaacgtggctgtgctgtgtctaattactgcacccgtaacaatgattctctcttctcagcaagatgctgcattcgcttttgcctcgctggcgatcgtgttctcatcttacattaccctggtggtgctgtttgtgccaaagatgaggcgcctcataacccgaggggagtggcagagcgaggcacaggacacaatgaagacgggctcaagcaccaacaataatgaagaggagaagtcgagactcctggagaaggaaaacagggagctagaaaagatcatcgcagaaaaagaagaacgtgtctctgagctacggcaccaactgcagtctcgacagcagttacgctctaggagacacccgcctactccacctgagccctccgggggtctaccgaggggaccgccagagcctcccgaccgactgtcctgtgacggatctcgcgtccacctgctctacaagtag

SEQ ID NO: 11375 - DNA, 537 bp, Artificial Sequence
  Description of Artificial Sequence: Synthetic coding sequence
atggagaccttcccactactgctcttgtccttaggactcgtgctggccgaggcctcagagagtacaatgaagattatcaaggaagagttcactgatgaagaaatgcagtatgatatggcaaagtcgggccaggaaaaacaaacgattgagattttgatgaaccctattctgctggttaagaacactagtctgtccatgtctaaagatgatatgtcatcaacgcttctaacattccgttcattgcattacaacgatcccaagggcaacagcagcggtaatgacaaagaatgctgtaatgatatgaccgtgtggaggaaagtgagcgaggccaacggaagttgtaaatggagcaacaattttatccgctcttctactgaggtgatgagacgggtccaccgggctccgagctgtaaattcgtgcaaaatccagggatttcttgttgtgaaagtctagaattggagaataccgtctgccaattcactacaggaaagcagtttcctcgatgccaatatcatagcgtcacatcgttggagtag

SEQ ID NO: 11376 - DNA, 2184 bp, Artificial Sequence
  Description of Artificial Sequence: Synthetic coding sequence
atgatactgagtctactctttagcctcggaggtcctctcggctggggccttcttggggcatgggcccaggcctcttctacgagtctcagcgatctccagtcttcacgaacacctggcgtttggaaagcagaggctgaagacactgggaaagatccagtgggtcggaactggtgcccataccccatgagtaagttagtgaccctgctggccctgtgtaagaccgaaaagtttctcatacattcacagcagccctgccctcagggtgcccctgactgtcagaaggtcaaggtgatgtacaggatggcgcacaaacctgtttaccaggtgaaacagaaagtcttgacctccttagcatggcgatgttgtccagggtacacaggcccaaactgcgagcatcatggtccgatggcagtttggtgttggccagaacccgattctctgcaggcaagactggggcagctccagcgaaatctcagcgaactgcacatgacaactgcacggcgagaggaggagctccagtataccctggaagacatgcgggctacccttacccggcatgtggatgaaataaaggagctgtactctgagtccgatgagacctttgaccaaatctccaaggtcgagcgacaggtggaagagcttcaggtcaaccacaccgcactgcgcgaactgagagtcatcctgatggagaagagcctgataatggaggagaacaaggaggaagtcgaacggcagctgctggagctcaacctgaccctccagcatcttcagggcggacatgcagacttaataaagtatgtgaaggactgtaactgccagaagctctatttggatctcgatgtcatccgtgaaggccagagagatgccaccagagcattggaggaaactcaggtgtctcttgatgaacgacggcagctagatggttcctctctgcaggctctccaaaatgcagttgacgccgtcagcttagctgttgatgctcataaagccgagggagaaagggctcgcgctgcaacttctcgcctcagatcccaagtgcaggccttggatgacgaggtgggcgcacttaaagccgctgcagcagaggccagacacgaggttcggcagctgcattctgctttcgcggctctgctggaggatgccctccgccatgaggccgtccttgccgctttattcggtgaggaggtactggaagaaatgtccgagcagacacccggtccacttcccctcagttatgaacaaatccgagtggccttgcaagacgcagcatcagggttacaggagcaggctctcggctgggatgagttggccgctcgtgtgaccgccctcgaacaggcgtctgaaccaccacggcctgccgagcacctggagccttcccacgacgcaggtagggaagaggccgcaactaccgctcttgctggtctggcacgtgaattacagagcttgtcaaacgacgtgaaaaacgtgggcagatgctgcgaagcagaggcaggcgcaggtgccgcatccctgaacgcaagtctccacggtctgcacaatgccctattcgcaacccagcgttcgttagagcagcaccaacgactgtttcatagtctcttcggaaacttccagggcctcatggaagctaacgttagtctcgatctcggcaaactgcagactatgctgtccaggaaaggcaagaaacagcagaaagatctggaagctcctcgcaagcgagataaaaaagaggcagagccactggtggacataagagtgacggggccagtgcccggtgctttaggcgctgctttgtgggaggcaggatccccagtggcattttacgcaagcttttctgagggcacagctgctttacagaccgtgaagttcaatacaacatacatcaacattgggtcttcctacttcccagagcatggatattttagggcccctgagagaggggtctacctttttgcagtcagtgtggaattcgggcctggtcccggaaccggccagttggtcttcggaggtcatcacaggacgccagtgtgtactactggacaggggtccggctctacagccacggtattcgccatggccgaactgcagaaaggcgagcgagtgtggttcgagttaacacaagggtcaattacgaagcggagtctttcagggactgcttttggaggcttcttaatgtttaaaacctag

SEQ ID NO: 11377 - DNA, 828 bp, Artificial Sequence
  Description of Artificial Sequence: Synthetic coding sequence
atgggaagcgctccatgggcaccggtcctgctgctcgccctcggactgagaggcctgcaggctggtggcgagtggcgtcggcctccagcccattcacccgttcccgcaccaccccttcgctttgcttcaccacactcccctcagggcccaggtccgaggctccccggtgcattgctgccagccgctagtgggcctctacaattgagggcactgcggcagcaggatctgccgtcagcccttcctggcgttggccaggttttaggtcctggtcggggtgctcaccttctgttgcattgggagcggggtcggagggtcgggctgagacaacagttgggcctccgcagaggagcaggaggcagagctggtggctctaccgggttaagaggggctcctttgttaagggaggtggccgctgtaaggtgcgcagtgcacgccgctagggcccatggcgcagccgacggtggggctggaccaggacggttacgcagagctgccccaagagcaaccactagaccccgaggccctggttgtcccagacacaggttgcgttggaaactttggggtgacgcgcagtgtctcccggaagatgaggtcagccccccaggtggtggcggagctggcggtcagcgcgctcggtcctcctgcggcagacccaggcgccttcagcccgttttacctggccgtcatggcggaagtctgcggcatggcccactgggagtgcgccacctacctgctgccgtaaggcgcgagggcccagaccctgcactgcacgttagacccgaatgcttgcacagagccggacacgacggactgcctctgccacattag

SEQ ID NO: 11378 - DNA, 351 bp, Artificial Sequence
  Description of Artificial Sequence: Synthetic coding sequence
atggccgctggctctgcccctatgcaacttcatttgcgggctacaattagaatgaaagacgggctgtgcgtaccacgtaagtggatctaccatcttaccgagggaagcacagacctaagaactgaaggacgtccagacatgaaaacagagctgttcagttcctcctgtcccggaggcataatgctaaatgagacaggccaaggctaccagcgctttcttctctataatcgctctccacaccccccagaaaagtgcgtggaagaatttaaatcattgacctcgtgtctcgatagcaaggcattcctgcttaccccacggaatcaggaagcatgtgagctatccaataattag

SEQ ID NO: 11379 - DNA, 522 bp, Artificial Sequence
  Description of Artificial Sequence: Synthetic coding sequence
atgcattggaagatgctgctcctgctactcctctactacaacgcagaggcttcaatgtgccaccggtggagtcgtgcagtgctctttcctgccgcacaccgaccaaagcgtagctccagtctcccactcaatccggtacttcagacctctctggaggaagtggaattgttatacgaattcttactggccgagctggaaatctctccggacctccagatttcaatcaaggacgaggagctagcttccttacgcaaagcatccgatttccgaactgtttgtaataatgtaatccccaagagtatccccgacattaggaggttgtccgctagcctgagctctcatccaggaatactgaaaaaggaggattttgagcgtacagtgcttaccctcgcttacaccgcttacagaactgctctgtcacatggccaccagaaggacatttgggcccagagtttagtgagcctttttcaggcattgcggcatgatctgatgcgaagttctcagccaggcgtccctccctag

SEQ ID NO: 11380 - DNA, 1482 bp, Artificial Sequence
  Description of Artificial Sequence: Synthetic coding sequence
tctgaggccgtctacttaaatgattctacatatgacggtcatacggttggagggctccagtacggtggcttaggccagctggctgacggagttgtgggcctggacgactttcggaagagccaggaactgagagtgtggcctggctatgactatgtgggctggtccaaccactctttttctagcgggtacgtagagatggagttcgagtttgaccgactgagagcctttcaggccatgcaagtccactgtaataacatgcatacactgggagcgcgactgccagggggtgttgaatgcagatttcgccgagggccagctatggcatgggaaggggagcccatgaggcataatctgggcggaaatctgggagatcctagagccagggccgtctccgtgccccttggcggtcgggtggctcggttcctacaatgtagatttcttttcgctggtccgtggctgttgttctccgaaatttcctttatctccgacgtggttaataattcttctccagcgttggggggtaccttccctccggcaccctggtggcctcctggtcccccaccaaccaacttttcctctttagaacttgagccccgtggacagcagcctgtggctaaggccgaaggctcccctacggctatactcatcggctgccttgtcgccattattttgctgttgcttttgatcatagcccttatgctctggcggctgcattggcgccgtctgctaagtaaagtgctggaaagccacccccgaaccagaagccctgggctcgtcggcatcaggccaaccttgcttcccgtgagcccaatggcactcagatgctgctctcccatccagcccactgcgtcattctggcccttgacgcccgtgcccctggaagcgcgagcccctcctcacccacccggtccaaatcctcccacccccagaggagttactggcggaaatacgtacgcggtccccgctctaccgcctggggctgtgggagacggcccacctcgggtggatttccctcgctctaggctcaggtttaaggagaagctgggcgaaggacagtttggcgaagttcatttatgcgaggttgactctcctcaggacctagtctctttagattttccactgaatgtgagaaaagggcatcccctcctggttgccgtgaagatcctccgacccgatgccactaaaaatgcaagaaacgacttcctgaaagaggtcaagatcatgtccagattgaaggacccaaacatcatccggctgctgggagtgtgcgtgcaggatgacccgctttgcatgattacggattatatggaaaatggagatctcaaccagttcctttctgcacatcaactggaggataaggctgcagagggagccccaggcgacgggcaggcagctcaaggcccaaccatcagttacccaatgttgttgcacgtagccgcacagatagcatctgggatgcgataccttgcaaccctgaactag

SEQ ID NO: 11381 - DNA, 639 bp, Artificial Sequence
  Description of Artificial Sequence: Synthetic coding sequence
atgggcctgcaccttcgcccttacagagtagggctcttgccagatggcctgctattccttcttctcttacttatgctgctggccgaccccgcacttcctgcaggtaggcaccctcccgtggtgttgggagataataaccggatcccagttattggacctcttaagatcagagaacagcaaagaagcgcagtgtcaacatcctggttgcttccgtataattatacatggtcacccgagaaagtcttcgtccagactccaactatcaattataccctgcgtgattatcgcaagttctttcaggacatcggattcgaggatggatggctcatgcgtcaggacacagagggactggtcgaggcaactatgcctcctggtgtccagctgcactgtctctatgggaccggggtgccgaccccggactccttctattatgaatcttttcctgaccgtgacccgaagatctgctttggtgacggcgatggaacagtaaaccttaaatccgcattacaatgccaggcctggcagagccggcaggaacaccaggtgctactgcaggagttacctggctctgagcatatcgagatgctcgccaatgccacaactttggcctatctaaaacgagtgcttctgggcccttag

SEQ ID NO: 11382 - DNA, 654 bp, Artificial Sequence
  Description of Artificial Sequence: Synthetic coding sequence
atgagcgacctgctgctgctgggcttgattgggggactgactcttctcctgcttctcacacttctcgctttcgcaggatatagcgggctgctggctggggtggaggtcagcgccggttcccctcctatccgcaacgttactgtggcctacaaattccacatggggttatatggcgagactggcaggctcttcaccgaaagctgtagcatttctcccaaattacgatccatcgccgtatattacgacaacccacacatggtaccgccagacaaatgcaggtgtgctgtcggcagcatactttctgagggggaggaatctccatcccctgaattgattgacttatatcaaaaattcggttttaaggtgttttccttccccgcaccttcacacgttgtaactgccacattcccttacaccaccattttaagtatttggctagcgaccagacgagtgcaccctgccctcgatacctacatcaaagaaagaaagctgtgtgcctatcccagactcgagatctaccaggaagaccagatccacttcatgtgccctctggcgaggcagggcgacttttacgtgcctgaaatgaaggagacagaatggaaatggagagggctggtagaggctatagacactcaggtagatggcacagggtag

SEQ ID NO: 11383 - DNA, 345 bp, Artificial Sequence
  Description of Artificial Sequence: Synthetic coding sequence
atgaaaacgtttacctggactctaggagtgctgttctttctgctcgtggataccgggcactgtcgcggtggccaatttaaaatcaagaagatcaatcagcgccgatacccccgagctactgatggaaaggaggaggctaaaaaatgcgcctacacgttcctcgtgcctgaacagaggatcaccggcccaatatgcgttaatacaaaaggtcaggacgcatccacaataaaggacatgattactagaatggatctcgaaaacctgaaagacgtactaagtagacaaaaacgcgagatagatgtccttcagctggtggttgacgtagatggcaacatcgtgaactag

SEQ ID NO: 11384 - DNA, 870 bp, Artificial Sequence
  Description of Artificial Sequence: Synthetic coding sequence
atgtttgttttgctgtatgtgacatcattcgctatctgtgcttccgggcagccacgcggaaaccagctcaagggcgagaactactctccgagatacatttgtagcattcctggtttgccaggaccaccagggcctccaggagccaatggaagtcctggacctcatggtcggattggactgcccggacgggacggcagagacgggagaaagggggagaaaggtgagaaaggaactgcgggattacgcggaaagacgggcccacttggcttggctggcgaaaaaggtgaccagggcgagacaggaaaaaagggcccaattggaccggaaggagagaaaggcgaagtgggcccaatcgggcctcccggaccaaaaggcgatcgcggtgaacagggcgaccctggcctacctggtgtgtgccggtgtggcagtatagtgctgaagtccgccttttccgtggggattactacctcttacccggaggagcggctccccataatcttcaataaagtcctgttcaacgagggagaacactacaatcctgcaacgggcaagttcatttgcgcgttccctggcatatattacttcagctacgatatcacattggccaacaagcacctggctatcggcctcgtgcacaacgggcagtaccggattaagacttttgacgcaaataccggaaaccatgatgttgccagtggctcgaccgtcatatatcttcagcccgaggacgaggtgtggctggagatcttttttacagatcagaatgggctcttctccgatcctggatgggccgacagcctcttctctgggttcctactctatgtggatactgactatctagattctatctctgaagatgacgagctgtag

SEQ ID NO: 11385 - DNA, 1002 bp, Artificial Sequence
  Description of Artificial Sequence: Synthetic coding sequence
atggtgtccaaaagccgttggaaactgctcgccatgctcgctctagtgttagtggtgatggtctggtacagcattagccgcgaggacagatatattgagctgttctattttccaattccggaaaagaaggagccttgccttcaaggagaagcagaaagtaaggcaagtaagctgtttggtaactattctcgggaccaacccatctttctgaggctagaagattacttttgggtgaagaccccctccgcttacgagttaccgtatggaacaaaggggagcgaggacctgctgctccgtgtcctggccattacctcttcatctattcccaagaacattcaatctcttcgctgtcggaggtgcgtggtagtgggcaatgggcaccgtctaagaaacagcagtctaggggatgcgatcaacaaatacgatgtggtgatcagactcaataatgccccagttgctggttacgaaggcgatgttggctccaagacgacaatgcgcctcttttacccagagagtgcacactttgaccccaaggttgagaacaaccccgacacactacttgtgctcgtcgccttcaaagcaatggactttcactggattgagacaatcctgtccgacaagaagcgagtgcggaaaggtttctggaaacagcctcctctgatctgggacgtgaatcctaaacaaatcagaatcctgaacccatttttcatggagatcgccgctgataaactgctatccctaccaatgcagcagccaagaaaaattaaacaaaaaccgactacgggtctccttgctattacccttgctttgcacctctgcgacttagttcatattgcaggattcggctaccccgacgcctacaacaagaaacagacgattcactactacgaacagataacactgaaaagtatggccggatccgggcataatgtctcacaggaggccctcgctataaaaaggatgctcgaaatgggcgctatcaagaacctgactagtttctag

SEQ ID NO: 11386 - DNA, 531 bp, Artificial Sequence
  Description of Artificial Sequence: Synthetic coding sequence
atgagactactgattctaacctgtctcgtggccgtagcactcgcaaggccgaagttaccactgcggtacccagaaaggttgcagaatccctctgagtcctcggagcccattccacttgagagccgcgaagagtatatgaatggcatgaacagacggaacatccttcgggagaagcagactgatgaaatcaaggatacaagaaatgagtccacgcaaaactgtgtcgtggctgaacccgaaaagatggagtcttcaatttcctcgagctcagaggagcagttctgtcgccttaatgagtacaaccagctgcagctgcaagccgcacatgcgcaggaacaaataaggagaatgaatgagaattcccatgtgcaggtgccatttcaacagctgaaccaattagccgcttacccttatgctgtgtggtactacccccagataatgcagtacgttccttttccccctttttccgacataagtaatcccaccgcacacgagaattatgaaaagaataatgtgatgctgcagtggtag

SEQ ID NO: 11387 - DNA, 279 bp, Artificial Sequence
  Description of Artificial Sequence: Synthetic coding sequence
atgaagttatgcgttaccgtgttaagcctgctggtgctggtggcagccttttgcagtctggccctgtccgcgcctatgggatcagacccacctacagcctgctgctttagttacactgccagaaagctgccacgcaacttcgtggtggattactatgaaacttcaagtttgtgctcccagcctgccgtagtgttccagaccaagcgaggcaagcaggtctgcgctgatcctagcgagagttgggtgcaggagtatgtgtacgacctggaactcaattag

SEQ ID NO: 11388 - DNA, 1656 bp, Artificial Sequence
  Description of Artificial Sequence: Synthetic coding sequence
atgacgtggaggatggggcctagattcacaatgctgctggccatgtggctagtctgcggatctgaaccccacccacacgccaccatccggggttcccatggcggacgcaaagttccactggtatcacccgatagctccaggccagccaggtttctgagacatacaggcagatcaaggggaatcgagcgctcaaccttggaggagccaaacctgcaaccactgcagagaagacggtctgtcccagtgctgaggttagccaggccgtctagattcagagacaatcgaatggatagacgagagcacggtcatagggaccctaacgtcgtgcccggtcctccaaagcctgccaaagagaaacctcccaagaagaaagcccaggacaagattctgagtaatgagtatgaggaaaagtacgatttgtctaggcctaccgcctcacagcttgaggacgagctacaagtggggaacgttcccctaaaaaaagccaaggagtcaaagaagcacgagaaactcgagaagccagagaaagagaagaaaaagaagatgaaaaacgaaaacgcagacaaactacttaagtccgagaaacaaatgaagaaatctgaaaaaaagtccaagcaggagaaagagaagagcaaaaagaaaaaggggggtaagacagagcaagacgggtaccaaaagcctaccaataaacatttcactcagtctcctaagaagagtgttgcagacctcctgggaagttttgaagggaagcggaggctactcctgatcactgcgccaaaagcggagaacaacatgtacgtgcagcagcgcgacgagtaccttgagagcttctgcaagatggctactcggaaaatctccgtgatcaccatcttcggtccagtcaacaacagtacgatgaagattgaccattttcaacttgataatgaaaagcccatgcgagtggtggatgacgaggacctggtggatcaaagactaatcagtgaactccggaaggagtatggaatgacttacaacgacttctttatggtgctcaccgatgtggaccttcgcgtaaaacagtattatgaggtgcccatcacgatgaaatccgtgtttgacctcatcgacacattccagtccaggattaaggacatggagaaacagaaaaaagagggcattgtctgtaaggaggacaagaagcagtcactcgaaaatttcctatcaaggttccgctggaggagacggcttcttgtgatatcggcccctaacgatgaagattgggcctattcccagcagttatccgcgctgtctggacaagcatgtaatttcgggagctctgtggtggaaagggaagatgtgcccgctcacctggttaaagacataagaaattatttccaggttagccctgagtacttttccatgttgttggtgggaaaggacggaaatgttaagagttggtaccccagtcccatgtggagcatggtgattgtgtatgatttgattgactctatgcagttgcgcagacaggagatggcaatacagcagagtctgggtatgagatgtcctgaggacgagtacgcaggctatgggtaccactcatatcatcagggataccaggacggttaccaagatgattatcggcatcacgagagttatcatcatggctatccatactag

SEQ ID NO: 11389 - DNA, 1245 bp, Artificial Sequence
  Description of Artificial Sequence: Synthetic coding sequence
atgggggtgagcaaactagatatcctttaccggagactgctgctgaccaaactgtttattcgcggttgggggagacccgaagacctgaagcgcctgttcgagttcagaaagatgatcggcaatagggagcggtgtcagaatctggtctcctccgattatcccgtccacattgacaaaattgaggagcagtccgattgcaaaatactagacggccatttcgtgtcaccgatggctcattacgttcctgatatcatgccaattgagtctgtcattgccagattccagtttatcgtccctaaagagtggaacagtaagtatcggcctgtgtgcatccacctggcaggcacaggtgatcatcactactggagaagacgaactctgatggcccgaccgatgattaaggaggccagaatggccagcctgctgctcgaaaatccttattatggatgtagaaagcccaaggaccaggtccggtccagcctcaagaatgtatctgatctttttgtgatgggaggggcattagtgttggagtcagctgcacttctgcactggctggagcgggagggttatgggccacttggaatgaccgggatttcaatggggggacacatggccagcctggcggttagtaattggcccaagcctatgcccttaataccatgtttgagttggagcaccgctagtggggtgttcacaacaaccgattcatttaagatggggcaggaatttgtgaagcacttcacctctagtgctgataaactaacaaacctgaatctggtcagtagaacactaaatctggacatatccaatcaagtggtgagtcagaagcccgctgattgtcacaacagctctaagaccagcgtgagcgcaacctccgaggggttgcttcttcaggatacgagtaagatgaaaaggttcaaccaaacgctatctactaataagtctggctacacctccaggaatccccagagttaccacctactgtcaaaagagcagtcgaggaatagtcttcgcaaagaatccttgatttttatgaaaggtgttatggacgagtgcacccacgtcgccaatttttcagtgccggtggacccatccctgattattgtcgtgcaggcaaaagaagacgcgtacataccacgtaccggagtcagatcactccaggagatttggccagggtgtgagattagatacttggaagggggacatatcagtgcctatctgtttaaacagggtctttttcgttag

SEQ ID NO: 11390 - DNA, 300 bp, Artificial Sequence
  Description of Artificial Sequence: Synthetic coding sequence
atggagcggatatccgccttcttttcttcaatctgggacaccatccttacaaaacaccaggaaggaatatacaatactatatgcctcggcgttctgttagggctgcctcttctcgtaattattaccctactgtttatctgttgccactgctgctggtcccctccaggcaaaagaggccagcagccagaaaagaacaagaagaagaagaagaagaagaagaagaaagacgaggaggacttatggatctctgcacagccaaaactgctccagatggagaaacgcccatcactccctgtctag

SEQ ID NO: 11391 - DNA, 912 bp, Artificial Sequence
  Description of Artificial Sequence: Synthetic coding sequence
atgagtgagcctcagccagacctggagccgcctcagcacgggctttacatgctgttcctgctcgtgcttgtctttttcctaatgggcctggtaggcttcatgatctgccacgtcttaaaaaagaagggctacaggtgcagaacttcacgtgggagcgagcctgatgatgcccagcttcagccgccagaggatgacgatatgaacgaagacaccgttgagcgcatcgttcgttgcattatccagaacgaggcaaatgctgaagccctgaaagagatgctaggcgactctgagggagagggcacagtgcagctgagctcagtggacgctacgtcgtcattgcaagacggcgctcctagccaccatcacactgttcatttaggcagcgccgcaccctgcctgcactgcagccgttcgaagagacccccactggtgcgccaaggcagaagtaaagagggaaagagccgccctaggacaggcgagacaacagttttctccgtggggagattccgagtgacacatatcgaaaagcgttacggcctacacgagcatcgcgatggcagtcctacagaccgctcgtggggttccggcggagggcaagaccccggagggggacagggatcaggtggcggacagcccaaggccggaatgccagctatggaacgcctgccgccagagagaccacaacctcaggttctggcttctccccctgtgcagaacggtggcttacgggacagcagcctaacgccacgcgctcttgaaggcaatccaagagccagtgcagaacccactctgcgcgcaggaggcagagggccaagcccaggactgcctactcaggaagcaaacggccagccttccaagcccgacacttctgatcaccaggtgtccctcccccagggcgctggtagcatgtag

SEQ ID NO: 11392 - DNA, 444 bp, Artificial Sequence
  Description of Artificial Sequence: Synthetic coding sequence
atgggcccagaagccttgagctcccttctgctgctgctgcttgtcgcctctggggatgccgacatgaaggggcatttcgatcccgcaaagtgcagatacgcgttgggcatgcaagacagaacgatccctgattccgatatttcagccagctcctcttggtcagatagtacagcggcacgccactcccggttggagagcagcgacggtgacggtgcatggtgccccgctggaagtgtattcccaaaagaagaagagtatctgcaagtggatctccagcgacttcacctagttgcattagtgggaacccagggacgacatgctggagggctagggaaggagttcagccgttcctataggctcagatactccagggatggtaggagatggatgggctggaaagatcggtggggacaggaggtaatcagcggaaatgaggacccctag

SEQ ID NO: 11393 - DNA, 1173 bp, Artificial Sequence
  Description of Artificial Sequence: Synthetic coding sequence
atgggagctacaactatggaccagaagtctttatgggcaggagtcgtcgtgttgctgttattgcagggtggtagcgcctacaaactggtgtgttactttacgaactggagccaagatcgtcaagagccagggaagtttactccggagaacatagacccattcttatgttcacaccttatctacagcttcgcctcaatcgaaaataacaaggtaatcatcaaagacaagagcgaagtgatgctgtaccagactattaacagcctgaaaacgaagaaccctaagctgaagatcctactgagcataggcggttacctgttcgggtctaagggcttccatccgatggtagactcttccaccagcagattggagttcataaactccatcattttgtttctccggaaccataatttcgacggtctggacgtgtcctggatttatcctgaccaaaaggagaacacacattttaccgtccttattcacgaactggccgaggccttccagaaagatttcaccaagagtaccaaagagagattgctgctgacagctggggtctccgctggacgccagatgatcgataactcctaccaggtcgaaaagctcgcaaaggatctggatttcataaatctcctgtcttttgatttccacggcagttgggagaagccattaatcactggccataactcgcctcttagcaaaggttggcaagaccgtggcccatcctcttactataacgtggaatacgctgtgggttactggatacacaagggcatgccaagtgagaaggtggtgatgggaattccaacctatggacacagcttcaccctagcgtctgccgaaactaccgtgggcgctcccgcatctggccctggcgctgctggcccaattacggagagctcgggctttctagcctattacgaaatttgccagtttcttaaaggggcaaaaatcaccaggttgcaagaccagcaagtgccctatgctgtgaaaggaaatcaatgggtgggctacgatgatgttaagtccatggaaactaaagttcagtttttaaagaatctgaacctgggcggagcgatgatatggtctatcgacatggatgatttcactgggaaatcctgcaatcagggtccttaccccctggtacaggccgtaaagcgatctctcgggtctctgtag

SEQ ID NO: 11394 - DNA, 297 bp, Artificial Sequence
  Description of Artificial Sequence: Synthetic coding sequence
atgaataaacattttctctttttgtttcttctttattgtctaatcgtagctgttactagtttgcagtgcattacgtgccacctgcgaacccgcactgatcgctgccgccgaggcttcggagtctgtacagcgcagaagggtgaggcctgcatgctcctgaggatataccaaagaaataccctccagatctcctatatggtttgccaaaaattttgcagggacatgacgtttgatttacgtaacaggacatacgtccatacatgttgtaactataactattgtaacttcaagctttag

SEQ ID NO: 11395 - DNA, 600 bp, Artificial Sequence
  Description of Artificial Sequence: Synthetic coding sequence
atggcgtggggcggagttcatacctgctgttttcatctctgctgttgttgtagttggccacagggagctgtgccagaagagctgcacaagcatcctggccagaccttgcttctccagtgtcagtactcacctaaacggggaccctaccagcccaaaagttggtgtcagcagacatctccgtccagatgcacactactcgttacctcaagtaagccctggacagcagtgcagaagagccattacaccatttgggacaagcccaacgctggctttttcaacattactatgatccagttgacgcagaatgacagcggtttttactggtgtggcatttataatgctagcgagaatatcattactgtgctcagaaatattagcctcgtagtctcccccgctccaactacatcgccaatgtggacactgccctggctgccgacaagtaccgcatgggagcctcaaattcaggaaatcaagttccgcgcaccaaccgactccaccctctggaagtccagggcacctgcttgtcttgggagtggcggtcctcggttcctggtcttagtcctctgcggtcttctgctggcaaagggactgatgttgtag

SEQ ID NO: 11396 - DNA, 2025 bp, Artificial Sequence
  Description of Artificial Sequence: Synthetic coding sequence
atgaccactgacgatactgaggtgcctgccatgaccttggcaccgggtcatgcagcactggaaacccagacgctgtctgctgagacatcctcacgcgcttccaccccggcagggcctatacccgaagccgaaactagaggggctaagcgaatctccccagccagagagacccgctcatttactaagacttcccccaacttcatggtgctcatagcaacatccgtagagacatccgcagcatccggatcccctgaaggagctggaatgaccacagtgcagaccatcacaggcagcgatccacgggaagctatcttcgataccctttgcactgacgacagcagcgaagaagcgaagaccctgaccatggacatcctcaccctggctcacacatccacggaagccaagggtttgtcttctgaatcctcggcctcttctgactcaccccaccctgtcataactccaagccgcgcttcagagtctagcgcgtcctctgatggcccacatcccgtcattactccgtcacgggcaagtgaaagtagcgcctcgtccgacggcccacaccctgtgatcactccatctcgggcaagcgaatcaagcgcctctagtgacggccctcatccggtcattactccttcgagagcaagcgaaagctccgctagttctgatgggcctcacccagtcatcacaccttcccgcgcttcagaatcttctgctagcagcgatggaccgcaccctgtgattactcctagcagggctagcgagtcttcagcaagctccgacggcccacatccagtgattaccccctcccgtgcgagcgagagctccgcctcctctgatgggccacatcctgttatcaccccttcccgcgcaagtgaatcctcagcatcctcagacggccctcatcccgtgattactccatctcgagcgagcgagagctcagcaagttctgacggccttcaccctgtgatcacccccagcagggctagcgagtcctccgcctccagcgacgggccacacccggttatcacaccatcgcgcgcttctgaaagctcagcaagcagtgacggcccacacccagtgataacccccagttggtctccaggttccgacgtcaccctgctcgccgaggctctggtcaccgtgactaacatcgaagttatcaattgcagtatcacagaaattgagactaccacctcaagcattcccggagcttctgacacagacctgatacccacagaaggggtgaaggcatcttcaacttccgatccgccagcgctgcctgatagcactgaagccaagccccacattacggaggtgactgcctcagccgagaccctgagtaccgcaggcaccactgagagcgctgcaccagacgctacagtgggcacgcctctacccactaatagtgccacggaaagggaagtaaccgctcccggagccaccactctgtccggagccctcgtgaccgtgtccaggaacccccttgaggagacctcagccttgagcgtcgagacgccttcctacgtcaaggtttccggtgctgctcccgtgtcaatcgaggcaggttccgctgtgggcaagaccaccagcttcgccggtagcagcgcatcatcttactctccctcggaagctgctctgaaaaacttcacaccgagtgaaaccccaacaatggatattgccactaagggaccattcccaacctcgcgggaccccctgcccagcgtgccaccgacaaccaccaactcctcacgtgggacaaactcgacactggctaagattactacatcggccaagactacgatgaaaccaccaacggccaccccgaccacagctcgcacacgaccaactacagatgtctccgccggagaaaacgggggttttctgttgcttaggttgagcgtcgcaagcccagaagacctgaccgatcctagggtggcggagaggttgatgcagcagttgcaccgggagttacacgcgcacgcaccccatttccaggtttccttacttcgcgtacgcagaggatag

SEQ ID NO: 11397 - DNA, 738 bp, Artificial Sequence
  Description of Artificial Sequence: Synthetic coding sequence
atgcaggccgcttggctgctcggagccttagtggtgccacaactcctcggattcggtcatggggctcgtggcgcagaacgtgagtgggagggagggtggggcggagcccaggaggaggagcgagaaagagaggctctgatgctcaagcatctccaggaggcactgggactccccgctgggaggggcgacgaaaatcccgctgggaccgtggaaggcaaggaggactgggagatggaggaagaccagggagaagaagaagaagaggaggctactccaacccctagcagcggcccaagcccaagcccaacccccgaggacatagtgacctacatcctcggacgattggcgggactcgatgccggacttcatcagctgcacgtccggctgcatgccctggatacacgtgtggtggaactcacgcaaggcttaaggcagctcagaaacgctgccggagacacccgtgacgctgtgcaagcgttacaggaagcacaaggcagggcagagagggaacacgggcgacttgagggatgtcttaagggactgcggctcgggcacaaatgttttctgctgagtcgagatttcgaagctcagcccagcgcgtcaccccatccgctcagccctgatcagcccaatgggggaaccctggaaaattgcgtggctcaggcaagcgacgacggatcctggtgggaccatgattgtcaacgccgactgtactatgtctgcgaattccctttctag

SEQ ID NO: 11398 - DNA, 279 bp, Artificial Sequence
  Description of Artificial Sequence: Synthetic coding sequence
atgatctggcggtcacgtgctggcgcagaactgttttctctgatggctctgtgggagtggattgccctgtcactgcattgctgggtccttgcagtggcagccgtgtccgaccaacacgctacttcccctttcgattggctactgagcgacaaagggccattccatcggtctcaggaatataccgactttgtggatcggtccaggcagggattttctacacgctacaagatttaccgcaacatgggtcacatcagttgttatttactcctgtgggagtag

SEQ ID NO: 11399 - DNA, 177 bp, Artificial Sequence
  Description of Artificial Sequence: Synthetic coding sequence
atggcagacatgcagaatctcgttgaacggcttgaacgcgctgtgggtcgtttggaagccgtctcgcatacgtcagatatgcacagagggtatgctgattctccctccaaagccggagcggctccgtacgtgcaggcgttcgattctcttctcgctggtcccgtggccgaatattag

SEQ ID NO: 11400 - DNA, 732 bp, Artificial Sequence
  Description of Artificial Sequence: Synthetic coding sequence
atgggacccgaggccttgtccagccttttgctcttgctattagtggcctctggtgacgccgatatgaagggccattttgaccccgctaaatgccggtatgctcttggtatgcaggatcggaccatcccggattctgatatttccgcttcctctagttggtcagatagcactgcagcgaggcattctcgcctggaatcttccgacggcgacggcgcatggtgcccagccggatcggtgttcccaaaggaggaggagtacttacaggttgacctccagagattacacctggtggcacttgtcggcacacagggtagacacgccggaggtctgggcaaagaattctctcggtcttaccgtctgaggtacagccgagacggcaggcgttggatgggctggaaggataggtgggggcaggaagttatttccgggaacgaagatcccgagggagtagtgctgaaggatctcgggcctccgatggtcgcacgacttgtacgattctaccctcgagcggacagagtgatgagtgtgtgcctccgagttgagctatatgggtgtttgtggagggattgctccatgggggtgtgggcgtcttggcaaatggtgtggtggggctggatgactctggggagggtacggagttgcggcagtggacaggcaatgactatgtgggatggcgcaacaacggccagccccgttgctatgtggcgctggtccctcagtctgactgggtag

SEQ ID NO: 11401 - DNA, 2535 bp, Artificial Sequence
  Description of Artificial Sequence: Synthetic coding sequence
atgggacctggcgctcctttcgccagagtcgggtggcctcttccactactcgttgtgatggcagctggtgttgcccctgtgtgggcgtcacacagcccacacctgccccgacctcacagtcgagtccctcctcatccttcctcggagcgaagagccgtgtatattggggctctcttccctatgtcaggcggatggccgggagggcaagcctgtcagcctgccgtggagatggccttggaggacgtgaattcacgcagagacattctgccggattacgaattgaaactaatacaccacgactccaagtgcgatccaggccaggccacaaagtatttatatgagctgttgtacaatgacccgataaagatcatattgatgccgggatgcagcagcgttagtactctggtggcggaggcggcacgaatgtggaacctcatcgtgctaagttatgggtcgagctcccctgccttgagcaatcgccaacgatttccaaccttcttcaggacgcacccaagcgccactttacacaatcctacaagggtgaaactttttgaaaaatggggatggaaaaaaatcgccaccatccagcagacaactgaggtgttcacttctactctggatgacctggaagagcgtgttaaggaagccggaattgaaataactttcaggcagagcttctttagcgatccagcagtgcctgtaaagaatctcaagcgtcaagacgcaagaattatagtgggactattctatgagactgaagctagaaaggtgttttgtgaggtgtataaggagcgattgttcgggaagaagtacgtatggtttttaattgggtggtatgctgacaactggttcaagatctacgatcctagtattaactgcacagttgatgagatgactgaagctgtagagggacatatcactacagagatcgtgatgttaaaccccgctaatacacggtccatctctaacatgacgtcccaagagttcgtggaaaagctaacaaagagactgaaacgacacccagaagaaaccggtggcttccaggaggcgccactggcctacgatgcaatttgggcactggcactcgccctcaacaaaacctccggcggtggcggtaggtccggcgtgcgcctggaggacttcaactataataaccagacgatcaccgaccaaatctacagggctatgaatagctcctccttcgagggcgtaagtggacacgtcgtgtttgacgcaagtggttcccggatggcatggacactgattgagcaactccaggggggatcatacaagaagattggatattatgactcaaccaaagatgatctctcatggagcaagactgataaatggatcgggggttctccccctgcagatcagactctggttataaagacgtttagatttctgagccagaaactgtttatatcagtgagcgtgttgagcagccttgggattgtactcgccgtcgtgtgcttgtcttttaatatatacaatagtcacgtgcgctatatccaaaacagccagcccaaccttaacaacctcactgcggtaggctgttctcttgccctggcagcggtttttccgctggggttggacggctaccacattggacgaaatcagttccctttcgtctgccaggcaaggctgtggcttcttggtctggggttctccctgggctacggctccatgtttacgaagatctggtgggtgcataccgtcttcactaagaaggaagaaaaaaaggaatggagaaagacactggagccctggaaactgtatgccacggtaggactccttgtcgggatggatgtgctgaccttggccatctggcagatcgtcgaccctctacatagaactattgaaacgttcgctaaggaagaacccaaggaagacattgacgtgagtatcctgccccaattggaacactgcagctccagaaagatgaacacctggcttggcattttttatggatataaaggcctcttgttactgctggggatattcctggcatacgaaacaaaaagcgtttccaccgaaaagattaatgatcacagagcggtcggaatggccatctacaatgtggccgtgctttgcctaattacagctcccgtgaccatgattctcagctcccaacaggatgcagcctttgcttttgctagcctagcaattgttttcagctcatatattactctggtcgtactcttcgtgcccaagatgcgtcggctgataacccgcggagagtggcagtccgaggcccaggacaccatgaaaacaggatctagtaccaacaataacgaggaggagaagtcgaggttactcgagaaagaaaaccgcgaattggagaagataattgccgagaaggaggaacgggtaagcgagctgcggcatcagctgcagtctcggcagcaactgcgctccaggcggcatccccctacccccccagagccttccggcggtttgcctaggggaccccctgaaccccctgatagactgagttgcgacgggagcagggtgcacctgctgtataaatag

SEQ ID NO: 11402 - DNA, 921 bp, Artificial Sequence
  Description of Artificial Sequence: Synthetic coding sequence
aggagaacctgcgctgggccaggtcgggctgggggagccaggagcgctagttggatgtcccggctccgggctctgttgggacttgggctgctcgtggccggtagccgggtgccgaggatcaaaagccaaactatcgcatgccgctcagggcctacctggtggggccctcagcggcttaacagcgggggtaggtgggactctgaggtgatggccagtactgtcgtcaagtatctttcccaggaagaggcgcaggcagttgaccaagaactgtttaatgagtaccagtttagtgtagatcagctgatggagctggccggattaagctgtgcaacagccatcgccaaagcttaccctcccaccagtatgagcagatctcccccaaccgtactcgtcatctgtggacccggaaataatgggggagacggcctggtgtgtgctcgtcacctgaagctcttcgggtatgagcccacaatttactaccccaagcgacccaacaaacctctgtttaccgccctggtgacacagtgtcagaaaatggatatcccatttctgggcgaaatgcctgccgaacctatgacaatcgacgagctttatgaattagtcgtcgacgccatcttcggtttttctttcaaaggagacgtccgggagccttttcactccatccttagtgttcttaaaggactgactgtcccaatcgcctcgattgatatcccttctgggtgggatgtggagaagggtaatgccggaggcattcagcccgacctccttatctccctgacagcccctaagaaatctgcgacacaattcaccgggaggtatcactacctcggcggaaggtttgtgcccccagcattagagaagaagtatcagcttaacctgccaccgtaccctgacacggaatgtgtataccgccttcaatag

SEQ ID NO: 11403 - DNA, 1137 bp, Artificial Sequence
  Description of Artificial Sequence: Synthetic coding sequence
tagtactccggcgattatatggaacccgaaaaacccggtgctcccctgttgcccccacctcctcaaaatagcgtccctcactacgccgaggctgacatagtcaccctgcaaggcgtcacaggcggtaacacctacgccgttcccgctttgcctcctggcgcagtcggcgacggacctccccgagtcgattttccacggagtcgactccggttcaaggaaaaactgggagaagggcagtttggggaggtccatctgtgcgaggtggattctccgcaggacctcgtgagtttagatttcccattaaatgtgagaaagggacatcccctgctagttgctgtcaagatcctgcggcctgacgccacaaagaacgccagtttttctctcttttccagaaacgatttcttaaaagaggtcaaaataatgtctcggctgaaggatcctaacatcatccgactgctgggagtgtgcgtccaggatgatcccctttgtatgatcacagattacatggaaaacggggatctcaatcaattcctgagcgcccaccagctggaggataaagccgctgagggagcccctggcgacggccaggctgcccagggcccaaccatctcctatcctatgctcctgcatgtggctgcacagattgcctctggcatgcgctacttagccacattgaatttcgtgcatagggacctggcaacaaggaactgcctcgtgggagaaaactttacaataaaaattgccgattttggcatgagtcggaatttgtacgcaggagactattacagggttcaaggcagagcagttctgccgatccgctggatggcatgggagtgcatcctgatgggaaaattcactactgctagtgacgtttgggcctttggggtcactttgtgggaagtactgatgctctgtcgcgcacagcctttcggacagctcacagacgagcaggtgatcgagaatgcgggtgagtttttccgcgaccagggaagacaggtgtacctgtcccggcctcccgcttgtccccagggactgtatgagttgatgttaaggtgctggtctcgggaatctgaacagaggcccccatttagtcagctgcaccggttcctggctgaggacgcactgaacacagtgtag

SEQ ID NO: 11404 - DNA, 762 bp, Artificial Sequence
  Description of Artificial Sequence: Synthetic coding sequence
atggccccttggtctcaccccagcgctcagctccagcctgttggaggcgacgccgttagtccggctctgatggtactgctgtgcttaggaaacctgagtaaagccaccctctgggcggagcccggatccgtgatctcgcggggaaactctgtgaccattagatgtcagggaactctggaagcccaggaatataggcttgtgaaggagggcagccccgagccatgggatactcagaatcccctggagccaaaaaacaaggccaggttttcgattccaagcatgactgagcatcacgctgggagataccggtgctactattatagtcccgctggatggagtgagcctagcgaccccttggagctggtggtgaccgggttctataacaagcctacactgtctgctctcccatctccggttgtgaccagcggcgaaaacgtcaccctccagtgcgggtcccggctaagatttgacagatttatcctaacagaagagggcgatcataagcttagctggactctcgatagccagttgaccccctcggggcagtttcaggctcttttccctgtgggacctgttactccttcacataggtggatgctgcggtgttacggctctaggcgccacatccttcaggtgtggagcgaaccctctgacctgttggaaatccccgttagtggagaggaggcgaccgtcttttcaagtaccatccaaggaagccagacagggtgcggcgagctgtacagacagggtagcccttgctag

SEQ ID NO: 11405 - DNA, 288 bp, Artificial Sequence
  Description of Artificial Sequence: Synthetic coding sequence
atgcggaaaccaaggagaaaatcaagacaaaacgccgaggggagacgtagcccctctccatattcgctcaaatgttctccgacgagggagactctcacatacgcacaggcccagcggatcgtggaagtcgatatcgacggacgcctccaccgtattagcatctacgacccgcttaagatcattaccgaagatgaactgactgcccaagacatcacagaatgcaattcaaacaaagaaaattccgagcagccacagttccccggaaaatcaaagaaaccatcatcttag

SEQ ID NO: 11406 - DNA, 1311 bp, Artificial Sequence
  Description of Artificial Sequence: Synthetic coding sequence
atgaagttccagggaccattggcatgtctcctcttggcgctttgcctcggatccggggaagcgggtcccctgcagtcaggggaagagtctacagggaccaatatcggcgaggctctgggacacggcctgggggatgctctgtcggaaggggtcgggaaggccatcgggaaagaagctggcggagccgcagggtcaaaagttagtgaggctctgggacagggtacgcgagaggcggtgggcacaggagtcaggcaggtgcctgggtttggggtcgccgatgccttgggcaatcgggtcggagaagctgcacatgccctgggcaacactggacatgaaattgggagacaggccgaggatgtgatacgccacggagccgacgccgtccgtggatcctggcaaggcgtgccaggccacaacggagcctgggaaacctctgggggacatggtatctttggtagtcagggcggactggggggacaggggcagggaaaccccggtgggctgggtacaccctgggtccatggatatcctggaaattccgccggtagcttcggcatgaacccacagggtgccccatggggtcagggcggaaatgggggtccaccaaactttggcaccaacacgcagggcgctgtggcccaaccaggctatggttccgtgcgtgcatcaaatcaaaacgagggttgcaccaatccccctccctccgggagtggagggggtagtagcaattcaggcggaggaagcggaagtcagagcgggtcttctgggtctggctccaacggggataacaacaacgggtcaagctcagggggatccagttctggcagttctagcgggggaagcagcggagggtctagcggcggaagctctggcaattccgggggatcaagaggtgattcgggctcggagagtagctgggggtctagcaccggctctagctcaggaaaccacgggggaagtgggggaggaaatggccataagccgggatgtgaaaaacccggtaacgaggctagaggttccggagaaagcgggatccaaggattccgaggtcagggcgtcagttctaatatgagagaaatttcgaaggaaggcaacaggcttctcgggggtagtggagacaactaccggggacagggctcctcgtgggggagtggaggcggagacgccgttggcggagtgaataccgtgaactcggaaacgtcacctggaatgtttaatttcgacactttctggaaaaacttcaaatccaagctgggattcatcaattgggacgccataaacaaagatcagcgttcatcccgaatcccctag

SEQ ID NO: 11407 - DNA, 240 bp, Artificial Sequence
  Description of Artificial Sequence: Synthetic coding sequence
atgcctgcctgccggctgggacccctagctgcggcactcctgctgtccctgctgcttttcggtttcaccctggtgtcaggtacgggggctgagaagacaggggtctgtcctgagttgcaagcggaccagaattgtacacaagagtgtgtttccgattccgaatgcgccgacaatctgaaatgctgctccgccggttgcgcaactttctgcagtctgcccaacggacagctggccgagtag

SEQ ID NO: 11408 - DNA, 2130 bp, Artificial Sequence
  Description of Artificial Sequence: Synthetic coding sequence
atggggtgcctgtgggggctagctctgcccctcttcttcttctgctgggaggttggagtctcagggagcagcgctggtccatctactcgtagggcagatacagcaatgacgaccgacgataccgaagtgccagccatgaccttggctcctgggcacgcagcgctggaaacacagaccttaagcgcggagacttcctctcgtgcctccacccccgcaggaccaatccccgaggccgaaaccagaggagcgaaacgcatctctccagctcgggaaactaggtcctttaccaagaccagcccaaatttcatggtcctgatcgccacttcagtggagacaagcgctgcctcaggaagcccagagggggctggaatgacaacagtgcaaacaattacaggctccgacccccgtgaggccatctttgacactctgtgcaccgatgacagcagtgaggaggcgaagacactgaccatggacatcctgactctcgcccatacttcaaccgaggccaaaggtctttctagtgagtcttccgcgagctcagacagtccacatcctgtaataacccccagccgagctagcgagtcctcggcgtccagcgatgggccacaccccgtgattaccccctctcgggcttccgagtcctccgcttcctctgatgggcctcaccctgtgatcacaccatctcgggcatccgagtcaagtgcgtccagcgatggaccgcacccagttatcactccaagccgagcctccgaatcttctgccagttccgacggtccacaccccgtgataactccctcacgcgctagcgagtcatccgcatcttccgatgggcctcatccggttatcaccccttcgagagcatctgagagctctgcatctagtgatgggcctcatccagtgataacacctagtagggccagtgaaagcagtgcctcttcagatggtccccatcctgtcatcacaccatcaagagcctcagaatcttctgcttcatcggacggccctcacccagtcattacacctagccgcgctagcgaatcaagtgcctcgagcgatggcttgcacccagtaattaccccatctagagctagcgagtcatctgcaagctcagacgggcctcacccagtaatcaccccatctagagccagtgagtccagcgcatcttctgatggacctcaccctgtgatcactccttcttggtccccaggttcggatgtgaccttgctagccgaggctctggtaacggttacaaatatcgaggtcataaactgttcaattacagagatagagacaacaaccagttccattcctggggcttccgacacagacttgatccctacagaaggcgtgaaggctagttccactagtgatcctcccgctctccctgactctacagaggccaagcctcacataaccgaagtcacagcaagcgcagaaacactgtcaactgccggtacaaccgaaagtgccgctcccgacgccaccgtgggcacgcccctccctacgaattctgcaacagaacgcgaggtgaccgctcccggtgcgacaaccctttcaggagcacttgttacagtcagcaggaatccgctggaggagactagcgccctgtccgtagaaaccccaagctacgtcaaggtgagcggggctgctccagtgagcatcgaagccggaagcgctgtcggaaagacaacttcctttgccggatcttcagcttcttcttattctccctcagaggccgctctgaagaattttacaccaagtgagacacccaccatggacatagctacaaagggaccctttcccaccagcagagacccactgcctagcgtccccccaactactaccaactcttcacggggaactaactcaactctcgcaaaaattacaacttccgccaagactacaatgaagccaccaaccgcaacacctactacagccaggaccaggccaacaacggacgtgtcagcgggagaaaacgggggattcctgcttcttaggttatcggtcgcgagccccgaggacctgaccgaccctcgggtcgcagagaggttgatgcagcagttgcaccgggaactgcacgcgcacgctccccattttcaggtgagcctgctgcgagtgaggcgcggatag

SEQ ID NO: 11409 - DNA, 2067 bp, Artificial Sequence
  Description of Artificial Sequence: Synthetic coding sequence
atgctgccaactgaggtgccacagtcccatcccggaccgagcgccctgctgcttttacagctgctgttaccgcctactagcgctttcttcccaaacatctggtcactgttggctgcacctggctctattacacaccaagatctgacagaggaggccgcattgaatgtcaccctgcaactgttcttagaacagccccctccaggcagaccccctttgaggctggaagatttcctggggaggaccctcctcgctgacgacctatttgccgcttatttcgggcctggatcaagccggagatttagagctgctctcggagaagtgtccagggctaacgcagcccaggattttctacccacgtcccgcaacgatccagacttgcacttcgacgccgagaggttgggccagggcagagcaaggctcgtcggcgctttgcgagagaccgtcgttgctgcccgagcactggatcatacacttgccaggcaacgccttggagcggctcttcacgccctgcaagacttctatagccacagcaactgggtggagctcggcgagcaacagccccatccacacttactgtggccccgacaagagctgcagaacctagcgcaggttgcggaccccacttgtagcgattgtgaggagctgtcctgccccaggaactggctggggttcaccctcctcaccagcggatacttcggcactcaccctcctaagccaccgggaaagtgctctcacgggggtcactttgacaggagttcgagccaacccccaagaggtggcattaataaagacagcacgtctcccggattctccccccatcacatgttgcacttacaggccgctaagctcgctcttctggcttcaatccaggccttctctctgctgaggagcaggctgggagatagagattttagccgcctcctcgacatcacacccgcatcaagcctgtccttcgtgttggacaccaccgggagcatgggtgaagagatcaatgcagcaaagattcaggccagacatctagtggagcagaggcggggaagtccaatggagcctgtacattacgtgctggtaccgtttcacgatcctggttttggaccagtgtttactacctctgaccctgattctttttggcagcagctgaacgaaattcacgcccttgggggaggagacgaaccagaaatgtgtttatcagcccttcagcttgcactgttgcacaccccacctcttagtgatatctttgtatttaccgatgcctcccctaaggatgccttcctgacaaatcaggtagagtccctgacgcaggagcggaggtgtcgagtgacttttctagttacagaagacacaagccgcgtacaaggccgagcacggcgagaaattctaagtcccctcaggttcgaaccatataaagccgtagctctggcttctggcggagaagtcatatttacaaaagaccaacacattcgagacgtagctgccatcgtgggcgaatccatggccgcacttgttaccctgcccctggaccccccagttgtggtccctggccaaccactggttttttcagtcgacggactcctgcagaaaatcaccgtcagaattcatggagatatttcgagtttctggatcaagaatcctgctggtgtgtctcaggggcaagaggagggaggtgggccactgggccatactcggaggttcggccaattctggatggttaccatggatgaccccccacaaactggtacttgggagattcaggtaactgcagaagacacacccggagtccgggtccaagcccagacatcactcgactttctatttcacttcggtatcccaatggaggatgggccacaccccggactgtatcctcttacccagcccgttgccggactgcaaacccaattgttagtggaaagccagtcatggggttcctctgctgcttttttgccacgccacccctcacgcggacctcgcggatgtcgcacaagacctggtgcactgggtgctaggggaaccagtggtgctcgttcccccagatcactggccgttgctcacgccgctgttcatccgtag

SEQ ID NO: 11410 - DNA, 1257 bp, Artificial Sequence
  Description of Artificial Sequence: Synthetic coding sequence
aataatctgaatgttggtagcgacaccacaagcgagacctctttcagcctgtccaaagaagcaccgagggaacatctcgatcatcaagccgctcatcagccattcccaagacctaggtttcgacaggaaactggtcatccgagtctccagagagattttcctcggagctttctcttagacctgcccaactttccagatttaagcaaggccgacatcaacggccaaaatcccaatatccaggttaccattgaggtggtcgacgggcctgactccgaagcagataaagaccagcatcctgagaacaaaccatcttggagtgtgcctagtcctgattggagagcatggtggcagcgttcattatccctggcaagagctaattcaggagaccaagattacaaatatgacagtacaagtgatgactctaattttctgaaccctccacggggttgggatcatacagcccctggacaccggacgttcgagaccaaggaccaaccggagtatgactctactgacggcgagggcgactggtccctttggtcagtatgcagcgtgacatgcggtaacgggaaccagaagaggaccaggtcatgtggatatgcctgtactgcaactgagtcaaggacatgcgacaggcccaattgtcccggaattgaagatacatttcgaactgccgctaccgaagtcagcctccttgctggtagcgaagagttcaacgccacaaagctttttgaagttgataccgactcctgtgaacgctggatgtcttgtaagagtgaattcttaaagaagtacatgcacaaagtgatgaacgacttgccttcttgcccgtgttcttatccaaccgaggtcgcctactctacggcagacattttcgatcgcattaagcgcaaggacttcagatggaaagacgcctccggcccaaaggaaaaattagagatttataagccaacagctaggtattgtatccgaagtatgctgtccctggaatctaccacactggctgcccaacattgctgctacggggataacatgcagttaatcacacgcggtaaaggagcaggcactcccaacctgatcagtaccgagttcagtgcggagcttcactacaaggtagatgtgctcccatggatcatctgtaagggtgattggtctaggtataatgaggcccgtccaccgaacaatggccaaaagtgcaccgaatcaccgtcagatgaggactatataaagcagttccaggaagcaagggagtattag

SEQ ID NO: 11411 - DNA, 693 bp, Artificial Sequence
  Description of Artificial Sequence: Synthetic coding sequence
atgaggcttgcagggccactccgcattgtagtgctggtggtgagtgtaggagtgacatggatcgttgtaagtatcctgctcggaggcccaggctctggcttccccaggatccaacagctgtttacatccccggaaagttccgtcactgccgcacccagggctagaaaatacaagtgcggcctgccacaaccatgtccagaggaacatctggccttcagggtggttagcggcgctgccaacgttatcggaccgaaaatctgcctggaggataagatgttgatgagttctgtgaaggataatgtcggacgcggattgaatattgcactcgtgaatggggtgagtggtgaactaattgaggccagggcattcgacatgtgggccggagacgtgaacgacctgctaaagttcatccggccactgcacgagggcactcttgttttcgtagcatcttacgacgaccccgcaaccaagatgaatgaggaaaccagaaaattgttctctgaactggggtctagaaacgccaaggaactcgccttcagagactcctgggttttcgtgggtgccaagggcgttcagaataaatccccatttgagcagcatgtgaagaattctaaacacagcaataagtacgaggggtggccagaggctttggaaatggaggggtgcatcccaaggcgctctaccgcatcctag

SEQ ID NO: 11412 - DNA, 192 bp, Artificial Sequence
  Description of Artificial Sequence: Synthetic coding sequence
atgggacccgaggcgctaagcagtcttcttctgttgctgcttgtggcttccggggacgccgacatgaaggggcatttcgacccagccaaatgccggtacgctctcggtatgcaggaccggacaatccctgactccgacatctctgcctcaagcagctggtctgatagcacagctgctagacatagccggtag

SEQ ID NO: 11413 - DNA, 1014 bp, Artificial Sequence
  Description of Artificial Sequence: Synthetic coding sequence
atgttgagcctcggtgctcatagtgtgaccaagacccagatcctgcagggactgggcttcaacttgacccacacccccgaatcagctatccaccaggggttccagcacctggtgcacagcctgactgtgccatcaaaagaccttactttaaaaatgggctccgccctcttcgtaaaaaaggaattgcaacttcaggccaattttctggggaatgtgaaacgtctgtatgaagctgaggttttcagcacagactttagcaatccgtctatcgctcaagctcgaatcaatagccacgtcaagaaaaaaacgcaaggtaaggtggtggacatcattcagggtttagacttgctgacagctatggtcctcgtaaatcatatctttttcaaggccaagtgggaaaaacctttccaccccgaatacacgaggaagaacttcccgtttctggtgggggaacaggttacggtacatgttcccatgatgcaccagaaggaacagttcgcctttggtgtggatactgagcttaattgcttcgtgttacagatggattacaaaggcgacgccgtggcttttttcgttctgccaagcaaagggaagatgcggcaactggaacaggcgctcagtgctaggactctgcggaaatggtcgcacagcctgcagaagcggtggattgaggtgtttatacccagattttctatttcggcaagctacaatcttgagaccatcttacctaaaatggggatacaaaacgtttttgacaagaatgcggacttttccggcatagccaagcgagactcgcttcaggtatctaaggccacccacaaggccgtgctggatgtgtctgaagaagggactgaagcaaccgctgccactaccacgaaatttatcgtgagaagcaaggacgggccaagctactttacagtgtcattcaatcggacgtttttgatgatgatcactaacaaagccaccgatggaatcctgttcctcggaaaggtggaaaatcccactaagagctag

SEQ ID NO: 11414 - DNA, 336 bp, Artificial Sequence
  Description of Artificial Sequence: Synthetic coding sequence
atgtttttcaccatctctcgcaagaacatgtcccagaaactctcgctgctgctgcttgtgtttggactgatctggggactgatgttgctgcactacacgttccaacagcccaggcaccagagcagcgtgaaactcagggagcaaatcctggatctaagtaagaggtatgtcaaagcactggctgaggaaaataaaaacaccgtcgatgtagaaaacggcgctagcatggccggatatgccgatctgaaaaggaccatagccgtcctgctggatgacattctgcagcgactagttaagctggagaataaggtcgattatatagttgtgaacgggtag

SEQ ID NO: 11415 - DNA, 498 bp, Artificial Sequence
  Description of Artificial Sequence: Synthetic coding sequence
atggagatgttccagggtctgctgctgctcctgcttctcagcatgggtggtacctgggcttctaaagagccactcaggccacggtgtaggcctattaacgcgactttggccgtggagaaagaaggttgtccagtgtgtatcactgtgaacaccaccatctgcgccggatattgtcccaccatgacgcgggttctgcagggggtcctacctgctctgccacaggtcgtttgcaactacagggacgtgcggtttgaatccataaggcttcctggctgtccgcgtggtgtgaacccagtcgtcagttacgctgtcgccctgtcatgccagtgtgccctgtgccggaggagcaccacggattgcggtggccctaaggatcatccccttacctgtgacgatcctcggtttcaggattcctcaagctccaaggccccaccgccaagcctgcctagcccatctcggctcccagggccatctgacactcccattctgcctcagtag

SEQ ID NO: 11416 - DNA, 699 bp, Artificial Sequence
  Description of Artificial Sequence: Synthetic coding sequence
atggtactgttgctcgtgattctcatccctgtgcttgtgtctagcgccggaacgtccgcgcactacgaaatgctggggacatgcagaatggtctgcgacccctatggcggtacgaaagctccatctacagctgcaacaccagatcgtggcctcatgcaaagtttgccaaccttcattcagggcccaccaatgggcccacccggtgagaaaggcgagccgggaagacagggattgccagggcctcccggagccccagggctgaatgcagctggcgctattagtgccgctacatattctaccgtgcctaaaatcgcattttatgctggtctgaagaggcagcacgagggatatgaagtgctgaagttcgatgacgtcgttaccaatctgggtaaccactatgaccctacgactggaaagttcacatgctctatcccaggtatttacttttttacctatcatgtgctaatgagaggaggagacggcaccagcatgtgggccgacctctgcaagaacaaccaggtgcgcgcaagtgcaatcgcacaggatgctgatcaaaattacgactatgcaagcaactccgtcgttctacacttagagcctggcgatgaggtttatattaaattggacggtggcaaagcacacggcggtaacaataataagtatagcactttcagcgggttcatcatctacgccgattag

SEQ ID NO: 11417 - DNA, 501 bp, Artificial Sequence
  Description of Artificial Sequence: Synthetic coding sequence
atgggccctgaggccctgtccagcttattgttgctactcctcgtggcttccggggacgccgatatgaaggggcacttcgacccagctaagtgccgttacgcactcgggatgcaggacagaaccatccctgactctgacatttcggcctccagctcatggtcagacagcacagccgctcgccattcaagactggaaagctccgacggggatggagcatggtgtccagctggatctgtgtttcccaaggaggaggagtatttgcaggttgatcttcaacggctgcatctcgtagcacttgtaggaacccagggaagacacgccggtggactgggtaaagagttctctcgctcctacagactgaggtacagtagagacggacgccgttggatgggatggaaagatcgttggggccaggaggtgatcagtggtaacgaagatcccgagggcgtagtgctgaaggatcttggcccaccaatggtggcgagactagtgagattttag

SEQ ID NO: 11418 - DNA, 627 bp, Artificial Sequence
  Description of Artificial Sequence: Synthetic coding sequence
atgattataaaacacttttttggaactgtgctcgtcctcctggccagcaccaccatttttagtctggatcttaagctgattattttccagcagagacaggtgaaccaggagtcgttaaagctgctgaacaaactgcagaccctgagcattcaacaatgtctgccacatcggaagaactttctcctacctcagaagagcctgtctccccaacagtaccagaaagggcacacacttgctatactgcacgaaatgcttcagcagattttcagtctctttagagcaaatatttctcttgacggttgggaggaaaaccatacggagaagttcctgatccagcttcaccagcagttagagtacctggaggcccttatgggactggaggcggagaagctgagtgggactctggggtcagacaacctcagactccaagtgaagatgtattttcggaggatacatgactatctggaaaaccaggactacagtacttgcgcatgggcgattgtacaagttgagatctcccgatgtctctttttcgtattcagcttaaccgaaaagttatctaagcagggtcgcccactcaatgacatgaagcaggaattaaccaccgaattcaggagtcccaggtag

SEQ ID NO: 11419 - DNA, 2241 bp, Artificial Sequence
  Description of Artificial Sequence: Synthetic coding sequence
atgccttttagacataaacctgggagcgtcttttctgttgaaggagaaaatttagacctggccatgtccaaagaggaggttgtggcgatgatcggggacggtccatgcgtggttaagactctgacccgccatcacctctattgtgagccacccgtggaacagcctctgccacgacatcatgcgttaagggaggcacctgacagtttacctgaattcaccgtgcaaatgggcaacctgagattttcacttggtcatgttcaatatgatggagaatcacccggtgccttcccagttgctgctcaggtcggtctgggcgttggcactagtctcctggccctgggggtcatcatcatcgtgttgatgtaccgacgcaagtcaaagcaggcccttcgggattataagaaagttcagattcagctcgagaatctcgagtcgtcagtgagggaccgttgtaaaaaggagtttactgatttaatgacggagatgaccgatttgacttcggacctgctgggctctgggatcccttttttagactacaaggtgtacgccgaaaggatcttcttcccagggcatcgagaaagcccgctgcacagagatctcggcgtgcccgagagccgtcggcctacagtggaacagggtctgggtcagttatcgaacctcctcaatagtaaactttttttgaccaaattcatccacacactggagtcgcagaggacattttctgcccgtgaccgggcatacgtcgcaagtctcttgactgtggccctccatggcaagctggagtacttcactgacatcctgaggacactcttgtcagatttagtggcccagtacgtggctaaaaaccccaaactcatgctgcggagaactgaaacggtagtggagaagctgttaacaaattggatgagtatttgtctgtataccttcgtcagggatagtgtcggggaacctctgtatatgctgtttagaggaatcaagcatcaggtggataaaggaccagtcgactccgtgaccggaaaagctaaatatacactaaatgacaaccgcttgctgagggaagatgtggagtaccggcctctgaccctgaatgccctactagcagtagggcctggcgcaggcgaggctcaaggagttcctgttaaagtccttgattgtgatacaatcagccaggcaaaggagaagatgctggaccagttgtacaagggggttccacttactcagcggcctgatcctagaactctagacgtggagtggaggtctggcgtcgccggacacctgatcttgagcgacgaagatgtcactagtgaggtacaaggattgtggaggagactcaatactctgcagcattacaaagtaccggacggagccaccgtagccttagtgccatgcctgacaaagcatgtcttgcgggagaatcaggattacgtcccaggcgaacgtacccccatgctggaagacgtggatgaggggggaatccgtccatggcatctggtcaagccatcggacgagccagaacccccaagacccaggcggggaagcctccggggaggcgagcgggagagagccaaggccatcccagagatataccttacacgcctgctgtcgatgaagggaacactccagaaatttgtagatgacctcttccaggtgatcctgagtacaagccggcctgtcccactggccgttaagtatttcttcgatctgttagatgaacaggctcagcagcatggcatctcagatcaggatactattcatatttggaagactaattctctgccacttaggttttggatcaacattattaagaacccccaattcgtgttcgatgtgcagacatcggataatatggatgcagttctgttggtgatcgcacagacgttcatggatgcgtgcaccctggccgaccataaattgggccgagatagcccgatcaataagttgctgtacgcccgtgatattcctagatacaagcgtatggtcgagcgctattatgctgacattagacaaactgtgccagcttctgatcaagagatgaattcggttctggctgagctctcctggaattactcaggggatttaggggctcgcgtggctcttcatgagttgtacaagtatataaacaagtactatgatcaaattattacagcactcgaggaagatggcacagcccaaaaaatgcagctgggatatcgtctgcagcaaattgcagctgcagtagagaacaaggtcactgacctctag

SEQ ID NO: 11420 - DNA, 603 bp, Artificial Sequence
  Description of Artificial Sequence: Synthetic coding sequence
atggcgtgggggggtgtccatacctgttgcttccacctctgttgctgttgctcctggccccagggtgctgtccccgaggaactgcataagcatcctgggcagacactgcttttacagtgccaatatagtcccaaacgtggaccctaccagccgaaaagctggtgccagcagacatccccaagccggtgcactctgctggtgacctcaagcaaaccatggaccgccgtacagaagtcccattacaccatatgggacaagccaaatgctggcttcttcaacatcactatgatccagctaacccagaacgatagcggcttttactggtgtggcatctataatgcgtccgagaacatcattacggtccttagaaacatatctcttgtggtgtctcctgcccctaccacatctccaatgtggaccctaccatggcttcccacttccacagtgcttattacatcgccggagggaacttctggacatccatcaatcaatggcagtgagacccggaagagtcgcgcacctgcctgcctggggtctggaggaccgcgatttctggtcctcgtcctctgcgggttgctgctcgcgaaggggctaatgttgtag

SEQ ID NO: 11421 - DNA, 114 bp, Artificial Sequence
  Description of Artificial Sequence: Synthetic coding sequence
atggggtggctgactcggattgtgtgcctcttttggggggtcctcctgacagctagggcaaactaccaaaatggaaagaataatgttccgagattaaaactgtcttacaaatag

SEQ ID NO: 11422 - DNA, 525 bp, Artificial Sequence
  Description of Artificial Sequence: Synthetic coding sequence
atgcggctcctcgccttcctctcactcctcgccctcgttcttcaggagaccgggaccgcatctcttcccaggaaagagcggaaacgacgcgaggagcagatgcctcgagagggggattcttttgaggtgctgccgttgagaaatgatgtgttgaacccggataattacggtgaagttattgatctcagtaattatgaggaactgactgattatggagatcagctgcccgaagtgaaggtgacttctcttgcaccagcaacctcaatcagccccgctaagagcactactgccccaggaacccctagctccaatcccacgatgacacgccctacaaccgctgggttgttactgagctcccagccgaatcatgaagatataccccctctccccaggcgaactgcctatctctatgcccgttttaacaggatcagtcggattagggcagaagactttaaaggccttactaaactgaagcgcattgacctttccaacaacctaatcagctctattgacaatgacgcatag

SEQ ID NO: 11423 - DNA, 657 bp, Artificial Sequence
  Description of Artificial Sequence: Synthetic coding sequence
atggggagggttttcctcaccggtgaaaaggccaattccattttgaagcgctacccgagagcaaacggtttctttgaggagatcagacagggaaacatagagcgcgagtgtaaggaggagttttgcactttcgaggaagcaagagaagcattcgaaaataacgaaaaaaccaaagagttctggagcacttataccaaggcccagcagggggaaagtaaccggggaagcgactggttccagttttacctcacgtttccacttatatttggattatttatcattctgctggtgatcttcctgatatggaggtgtttcctgaggaataaaacccgtcggcagaccgtgaccgagggacatatcccttttcctcagcacctcaatattatcacacctccaccgccaccagatgaggtgttcgatagttccgggctttcaccaggcttcttaggctacgttgtgggcagaagcgactcagtctcaactcgtctgtccaactgcgaccctcctccgacatacgaggaggctacaggtcaggtgaatctgcagcgctctgaaaccgagccacacctggacccacccccagagtacgaggatatagtaaacagtaactccgccagcgcaatccctatggtgcctgtagtgactaccatcaagtag

SEQ ID NO: 11424 - DNA, 2535 bp, Artificial Sequence
  Description of Artificial Sequence: Synthetic coding sequence
atggggccaggggctcccttcgctagggtcggctggccactgcccctgctggttgttatggcagcgggagtggcccctgtgtgggctagccatagtccacatcttccaagacctcatagccgagtacctccgcatccgagctctgaacggagagctgtatatataggggcactgttcccaatgtccgggggatggccaggtgggcaagcctgtcagccggcagtagaaatggcactggaggacgtaaattctcggagggacatactgcctgactacgaactaaagctgattcaccatgacagtaaatgcgaccctggtcaggcgactaaatatttgtacgagttgttgtacaacgaccccattaagatcattttaatgcctgggtgcagttcagtgtctaccctggtcgcagaagccgcacggatgtggaacctgattgtgctgtcatacggatcttcctctcccgctctgtcaaatcgccaaaggtttccaacattttttcgcacacatccttcggcaacgttgcacaatccaactcgtgtgaagctgttcgaaaaatggggatggaagaaaatagctactatccaacagacaactgaggtgttcaccagtactctagatgatttggaggagcgtgtaaaagaggctgggatcgaaataacctttaggcagtcctttttcagtgatcctgccgtccctgttaaaaacctcaaaagacaagacgctagaataatcgttggactgttctatgagactgaagcgagaaaggtattctgtgaggtctataaggaacggctgtttgggaaaaaatatgtttggtttctaattgggtggtatgccgacaattggtttaaaatctacgacccatctattaactgtacagtagacgagatgaccgaggcagtggagggacacattactactgagattgtaatgctgaatcccgcaaacacgaggagtatctctaatatgacctctcaggaatttgtggagaagctgaccaaacggctaaagagacaccctgaggagactggcggtttccaagaggccccattggcgtatgacgcaatctgggccctcgcacttgctctcaacaaaacctctgggggaggcggtcgatctggggtccgactggaggattttaactacaataaccaaacgatcactgaccaaatctatcgtgcgatgaactcgagctcctttgaaggggtatcaggccatgtagtcttcgatgctagcggaagccgtatggcatggacgcttattgagcaattgcaagggggatcctataaaaaaattgggtactatgacagtactaaggacgacctttcttggtcaaagacggacaaatggatcggcggaagcccacctgcagaccagactctcgtcataaagaccttccgcttcctgtcccagaaactgttcataagcgtgagcgtgttgagcagcctggggattgtgctggcagtggtgtgtctgtcctttaacatttataattcgcacgtgcgttacatccagaactcgcaaccgaaccttaacaatttaactgcagtgggctgcagccttgcactcgccgctgtatttcctctgggtttggacggataccatattggacgaaaccagttcccttttgtctgccaggccagactgtggctccttggactggggttctcgctcggttatggctccatgttcaccaagatatggtgggtgcacactgtctttacgaagaaagaagaaaagaaggaatggcgcaaaacccttgaaccatggaaactgtatgcaactgtggggctccttgtcgggatggacgtgcttacgttagccatctggcagatagtggaccctctgcacaggactatcgagacattcgccaaggaggagccaaaagaggatatcgacgtttccattcttccccagctggagcattgcagctcccgaaagatgaacacttggctggggattttttacggatacaaaggcttactgctgctcctgggaatttttctcgcgtatgagacaaaaagcgttagtacagagaaaattaatgatcaccgtgccgtgggcatggcgatctacaatgtggccgtactatgcttgataaccgcacctgtcacaatgatcctgtcgagccagcaggacgcagcctttgcctttgcttcactggccatcgttttttcctcctacataacgctggttgtgttgttcgtgccgaaaatgagaaggctcatcacacgcggagagtggcagagcgaagcccaggacactatgaaaaccggctcaagtaccaacaacaacgaggaggagaaatcccgcctattagagaaagagaatcgcgagctcgaaaagataattgccgagaaagaagagcgtgtatccgagctacggcaccagctgcagagtaggcagcagctgcggtcacggaggcatcctcctaccccacctgagccatctggcggtctgcctagaggaccacccgagcctccagacagactgtcttgtgacggatcgagggtacatctcttatacaagtag

SEQ ID NO: 11425 - DNA, 2007 bp, Artificial Sequence
  Description of Artificial Sequence: Synthetic coding sequence
atggacctggtgttgaagcggtgtttgctccacctggccgtgattggagccttgctcgcagttggagccactaaggtccccaggaaccaggactggctgggagtgtcccgccagctccgcaccaaggcctggaaccggcagctgtatcccgagtggacggaagctcagaggctggattgttggcgcggtggacaggtgtcgctgaaggtgtctaacgatggaccgaccttgatcggagctaacgcctcgttcagcatcgcactgaatttccctgggtcccagaaagtgctgccggatggccaggttatatgggtgaataacacaatcatcaacgggagccaggtttggggaggtcagcctgtgtaccctcaagaaaccgacgatgcctgtatatttccagatggtggaccatgcccctccggaagttggtcccagaagagatcgttcgtatacgtgtggaaaacctgggggcagtattggcaagtactaggtggcccagtcagtggtttatcgatcggaaccgggcgagcaatgctcggaacacacacgatggaggtgaccgtctaccaccggagaggatctcgcagctacgtcccgctcgctcacagcagcagtgccttcaccataacagaccaggttcccttcagcgtctctgtcagccaactgcgagcccttgatggaggaaataagcactttctgcgcaatcagcccctcacctttgctctgcagttgcacgacccatctgggtatctcgcggaagcagatctctcctatacgtgggatttcggtgacagtagcggaaccctcataagtcgagccctagtagtgactcacacttacctggagcccggacccgttacagcccaggtggtgctgcaggctgctattcccttaacttcttgtgggtcatcaccagtgcccggtaccaccgatggacaccgccctaccgccgaagccccaaatacgactgccggtcaagtgcccacaactgaagtcgtgggaaccaccccaggccaggcacccacagcggagccaagtggaaccacatctgtgcaggtcccgaccaccgaggtgatctcaaccgctccggtccagatgcccactgccgaatccactggtatgactcccgaaaaggtgcctgtgagtgaggttatgggaaccaccctggctgaaatgagcacgcctgaagcaacaggcatgacacccgcagaggtatctattgtggttctgtcaggcactaccgccgcacaggtcaccaccacggaatgggtagaaactacggccagggagcttcctatccccgagccggagggcccagacgcttcttccattatgtctaccgaaagcatcacaggctccctgggaccgctccttgacggtaccgccactctaaggctggtcaagcggcaggtgcctttagattgtgtactgtaccggtacgggtccttctccgtgaccttggatatcgtgcaggggatagagtccgccgagatcctgcaggcagtgccgtccggagagggtgacgcctttgagctcacagtgagttgtcagggaggtttgcccaaggaagcctgcatggagatctctagcccaggttgccagccaccggctcagcgcctgtgtcagcccgtgctcccttcccccgcatgtcagttagtcctgcaccagatcttaaaaggagggagtggaacctactgtttgaacgtgtcgctggccgacacaaatagtctggcagtcgtctcgactcagctgatcatgcctgtgccgggtatcctcctcactggacaggaagccggtctgggtcaagtgccgctgatagtgggcatcctcttagttctgatggccgtggtgttggctagtctgatctaccggaggcggctaatgaagcaggatttctcagtgccacagctgccccattcatcgagtcactggcttagacttccgcgaatcttttgcagttgcccaatcggagaaaactctcccttactcagtggtcagcaagtatag

SEQ ID NO: 11426 - DNA, 525 bp, Artificial Sequence
  Description of Artificial Sequence: Synthetic coding sequence
atggcagacatgcagaaccttgttgagcgcttggaaagagccgtaggtcgcctggaggccgtgtcgcatactagcgacatgcatcgaggctatgccgattctccatctaaggctggcgctgccccttatgtccaggctttcgattccctgcttgccggtccagtcgctgagtacctaaagatctccaaagaaatcggcggagatgttcaaaagcacgctgagatggtgcataccggactcaagttggagagggcccttctggtaacagcctcacaatgtcagcagcctgccgagaacaagctatctgatctcctcgccccaatcagtgagcagatcaaggaagtgatcaccttccgtgaaaaaaatagagggtccaaactctttaatcacctgtccgctgtgtccgagagcattcaggctctcggatgggtcgccatggctcccaaacccggaccctatgtgaaggagatgaacgacgctgcaatgttttatactaaccgcgtgctgaaggagtacaaggactag

SEQ ID NO: 11427 - DNA, 1368 bp, Artificial Sequence
  Description of Artificial Sequence: Synthetic coding sequence
atgctacaccctgagacctccccaggtcgtgggcaccttttagccgttctccttgccctgctcggtacggcatgggccgaagtgtggccgcctcagcttcaggagcaggcacccatggctggggctttgaatagaaaagagtctttcctcctgctgtcactgcataaccgcctccggtcttgggtccagcccccagctgccgacatgaggcgactggattggagtgatagtctcgctcagctcgcccaggcccgagctgccctgtgcgggacgcccacccctagtctcgcttccggactgtggagaaccctgcaggtcggctggaacatgcaactgctccctgcgggactagtgtcattcgttgaggtcgtgtcactgtggtttgccgaaggacagcggtactctcacgccgcaggagagtgcgccagaaacgctacatgtacccattacacccagcttgtctgggcaacaagctcccagcttggctgtggacgacacctgtgttctgctgggcaggccgcaattgaggccttcgtctgcgcctactcccctcgagggaattgggaggttaatggtaaaaccattgtgccgtataagaagggagcttggtgtagcctatgcaccgcttccgtgtctgggtgtttcaaggcctgggaccatgccggtggcctgtgcgaggtgcctaggaacccttgtcgcatgagctgccagaatcacggacggttaaacatttctacctgccattgccactgcccgcctggatatactgggcgatactgccaggtgcggtgctccctacagtgcgtgcatggtcggtttagagaggaggaatgttcttgtgtatgtgacatcggctatgggggtgcgcagtgtgcgacaaaagtgcacttcccattccacacttgcgatttacgaatcgatggggattgctttatggtgagcagcgaagccgatacatactatcgagcaagaatgaaatgccagaggaaaggtggggtccttgcccagataaaatcacagaaggtgcaggatattctcgctttttacttaggacggcttgagacaactaacgaggtaatcgattcggattttgaaactcgcaacttctggataggtctcacctataaaacggccaaagatagttttcgatgggccacaggcgagcaccaggccttcaccagctttgccttcggacagccggacaatcatggactcgtgtggctgtcagctgccatgggatttggaaactgcgtggaactgcaggccagcgctgccttcaactggaatgaccagcgttgcaagacacgaaatcgttatatttgccagtttgcgcaggagcatatttcacgatggggccctgggtcttag

SEQ ID NO: 11428 - DNA, 297 bp, Artificial Sequence
  Description of Artificial Sequence: Synthetic coding sequence
atggttctggccatgctcggagccttacatccaagagcaggcttgagcttgttcctccatcttatcctcgctgtggctttgctacgttctcagcctctacgcagccagagatctgtgcctgaagctttcagcgctccgctggaacttagccaacccttgtccgggctggtggatgactacggtatattacccaaacaccccagacccagagggcctaggccacttctctcacgagcacagcagcgtaaacgggacggaccggacctggcagagtattattacgatgcccacctgtag

SEQ ID NO: 11429 - DNA, 2742 bp, Artificial Sequence
  Description of Artificial Sequence: Synthetic coding sequence
atggggcctgaggccctgtcaagcctcctcctgctgttgcttgttgccagtggtgatgctgatatgaaaggacacttcgatccagcaaagtgtcgttacgctttgggcatgcaggataggactattccggactctgacatctctgctagtagcagttggtctgactccaccgctgcccgacactcgcgtttggagtcctctgatggcgatggtgcctggtgccctgcaggcagtgtattccctaaggaagaagagtatctacaggtggatctgcagaggctccaccttgtcgcgctcgtaggtacccaaggacgtcacgccggtggcttgggcaaagagttctctagatcctacagactgcggtacagccgcgacggacgacgctggatgggctggaaagataggtggggccaggaagttatcagtggaaacgaggaccctgagggggtggtactcaaggatctgggcccaccgatggtcgcaaggttggttcggttttatccgagggccgaccgggttatgtccgtgtgtcttcgtgtcgaactgtacggatgtttgtggcgggacggtctccttagctatactgctcccgtggggcaaaccatgtatctgagcgaagccgtctatctgaatgattcaacatatgatggacacacggtcgggggattgcaatatggcggtctcggacaactggcagatggggtggtgggcctggatgatttccgaaagagtcaggaactgagggtgtggccaggatatgactacgttgggtggtccaaccattctttctctagcggatatgttgagatggagtttgagtttgatcggctccgcgctttccaggccatgcaagtgcactgcaacaatatgcataccctcggtgcgcgactgcctggaggggtggagtgcaggtttcgacgaggacccgcaatggcctgggagggggaacctatgcggcataatctgggcggtaatctgggcgaccctcgggctcgagccgtctccgtgcctctcggcggacgcgttgcacgtttcctccagtgtcggttcctctttgcgggaccatggctcctgttttcggaaattagttttatttccgatgtcgtgaataactctagtccggcattgggcggtacatttcctccagccccttggtggcccccaggcccaccacccactaatttctcatccctggagctggaaccaaggggacaacagccagtggcaaaggctgaagggtccccaacagccattcttatcgggtgcctagtggccatcatccttttactgcttcttataattgccctcatgctatggaggctccattggaggcgactgctgtcaaaggccgagaggagggttttggaagaagagctcactgttcacctgagcgtccccggtgacactattctcattaacaaccggccagggcctagagaaccacccccatatcaggagcctaggccacggggtaatccacctcacagcgccccatgcgtccctaatggtagcgccttgctgctgagtaatcctgcctacagactgctgctggcaacatatgctcgtcccccaagagggccaggccctccaacgcccgcatgggccaagcccacgaacacacaggcttacagcggcgattacatggaacctgaaaaacctggggcacctctactccccccacccccacaaaatagcgtgccccactatgccgaagcggacattgttacgctgcagggcgtcaccggcggtaatacatatgccgtccctgctttacccccaggagcagtaggtgatggtcccccacgcgtggattttccgcgttcccggctgagattcaaggagaaactgggcgagggtcagttcggggaggtgcacctctgtgaggtggactcaccacaggacctagtgtccttggattttccgctcaacgtacgcaagggacatcctttgctcgttgcagttaaaattcttaggcccgacgcgaccaaaaacgccagaaacgacttccttaaagaggttaagatcatgagccgcctgaaggaccctaatatcatcagactcctgggtgtttgtgtgcaggacgacccactgtgtatgatcacagactatatggagaatggagatctcaatcagtttctgtcggcccatcagttggaagataaggcagcagagggcgctcccggtgatggccaggctgcacaagggccaactatctcttaccctatgctgttgcatgtggctgctcagatcgcaagtgggatgcgttacttagccactctgaactttgtgcatcgagatctagcaactcggaactgcctcgtgggcgaaaatttcaccataaaaatagctgattttggaatgtctcgaaatttatacgctggtgattactaccgcgtccagggtcgagcagtactcccaatacggtggatggcctgggaatgcattctgatggggaagttcactactgcttccgacgtgtgggcattcggagtgacattatgggaagtgttgatgctctgcagggctcagcccttcggacagttaaccgacgaacaggtcattgagaatgctggggagtttttcagggatcagggacgacaggtctatctgtctcgacccccagcctgcccgcagggactttacgagcttatgctgcggtgctggagcagggaatcagagcagcgacctcctttcagccagcttcataggttcctggccgaggacgctcttaacaccgtgtag

SEQ ID NO: 11430 - DNA, 678 bp, Artificial Sequence
  Description of Artificial Sequence: Synthetic coding sequence
tgagccgatctcccatcctgctggggtgctggaccctgctacactggtcacaaggtaggagccctcaggcgggataccgtgatttgctgttgcagacacggagactactctaccccatgcctgtttaccccaggaaagcccagtaggaacccgtctccctggaaacgaactctgtggacactttcggccccttgggcagggccagcaggatggaccggagaggagcagaacgccacaaagaccggactaataacccgcagacccaggcctttgcgcagaagacctcaccccgctccagcgagtcccctaccagaaattatcaggggcaatataccacgaatgttagggaaattcgtgcccgttaactgggaacctccccagccccttcccttccccaagtaccttagatgttaccgttgtctattggagacaaaagagttaggctgcctcctcgggagcgacatatgccttactccagcaggctcgtcgtgtataaccctgcacaagaaaaactccagcgggtcagacgtgatggtcagtgactgtcgctcaaaagagcagatgtcggattgcagcaatacaagaaccagtccagtttctggcttttggatattctcacagtactgcttcctggatttctgtaatgatccccagaatcgaggtctgtatactccgtag

SEQ ID NO: 11431 - DNA, 405 bp, Artificial Sequence
  Description of Artificial Sequence: Synthetic coding sequence
atgccacgatgtcgctggttaagtttaatcctgctgaccatccctctggcgctcgtggccagaaaagaccctaagaagaacgagacaggcgttctgaggaaactcaagcctgtgaacgcatccaatgccaacgtgaagcagtgtctgtggttcgctatgcaggagtacaacaaggagtcagaggataagtatgtatttctagtcgtgaaaacactgcaggcacagctccaggtcactaatctcctcgagtatctgattgatgttgagattgctaggtccgattgccgtaaacccctaagcacaaatgagatttgcgctattcaggagaattcaaaactgaaacgaaaattgtcttgcagtttccttgtgggcgctctaccatggaacggagagtttacggtctag

SEQ ID NO: 11432 - DNA, 1182 bp, Artificial Sequence
  Description of Artificial Sequence: Synthetic coding sequence
atgcgaactctgtttaatctcctctggctggccctcgcctgtagtcccgtgcacactaccctttccaaaagcgatgccaagaaggctgcgagcaaaaccctgctggaaaagagtcaattcagtgacaagcccgttcaggacagaggcctggtggtcacagacctgaaagctgagtcggtcgttctagagcaccgcagttattgtagcgccaaagcacgggaccgacatttcgccggagatgttttaggctacgttactccctggaacagtcacgggtatgatgttaccaaagttttcggatcaaagttcactcaaattagtccggtgtggctgcagctgaagaggagaggccgtgagatgtttgaggtgacaggactgcatgacgtagatcagggatggatgagagccgtaagaaagcacgcgaaaggcttgcatattgtgcctcggttgctcttcgaggattggacatacgacgatttccgcaatgtcctcgattccgaggatgaaattgaagagttatccaagacagtggtgcaggtcgccaagaaccaacactttgacggttttgtggtcgaggtatggaatcagcttctttcacagaaacgtgtaggcctgattcacatgcttacacacttggctgaagcactacaccaggcccgattattggcactgctagtgatccctcctgctatcacaccgggaaccgatcagctgggcatgttcactcacaaagagtttgagcaactggctcccgtgttggatgggttcagcctgatgacatacgattacagcactgcccatcagcccggacctaacgctcctttaagctgggttcgggcttgcgttcaagtccttgatcctaaatccaaatggcggagcaagattctgctgggcctgaatttttatggcatggactacgctacctccaaggatgctagggagccagtggtgggggctcggtacatccagacactaaaagatcatagaccaagaatggtatgggacagccaggcctcagagcacttttttgaatacaagaagagtcgctccggccgtcacgttgtcttctatcccactctcaagtccttacaggttagattagagctggccagagaactgggagtgggtgtgtccatctgggagctgggccagggccttgattatttttacgacctgttatag

SEQ ID NO: 11433 - DNA, 678 bp, Artificial Sequence
  Description of Artificial Sequence: Synthetic coding sequence
tgagcagatcttccttcctgttggggcgctgggccatgttacactggacacaaagtgggtgcattgcgacgcgacacagtaatttgctgctgtcgccacggggactatagtacaccttgtctctttacgcccggaaaacccagtcggaatcctagtccttggaaaaggaccctgtggactctgtcagccccttgggctggcccagccggatggacaggtgaagagcagaacgccacaaaaactggactgatcacccggagacccaggcctcttcgcaggagacctcaccccgcacctgccagtcccctgccagagatcatcagaggcaacatccctagaatgcttgggaagttcgtcccagtaaattgggaacctcctcaaccattgccgttccccaaatacctccgctgttatcgatgccttctggaaactaaggagttaggttgtctgctcggcagtgatatctgcctcactcccgctggcagctcttgtattacattgcacaaaaagaattcctctggatctgacgttatggtaagcgactgtcgcagcaaggagcaaatgagcgactgttctaatacaagaaccagccctgtgtccggattctggatcttctcgcaatactgcttcctcgacttctgtaacgatccacagaatagaggtctctatacaccttag

SEQ ID NO: 11434 - DNA, 1410 bp, Artificial Sequence
  Description of Artificial Sequence: Synthetic coding sequence
atgatgcgcttgggtggacgcttggttctcaatacgaaagaagaactcgctaacgaaaggctgatgactctcaaaatagccgagatgaaagaagctatgcgtacgctgatcttccctcccagcatgcacttcttccaggctaagcacttaatcgagcggagccaggtttttaatattctgagaatgatgccaaagggcgctgctctgcacctccacgatattgggattgtgacaatggactggctggttcgaaatgtcacctataggccacactgtcatatctgttttacccctcgaggaattatgcagttcaggttcgcacaccctactccaaggccttccgaaaagtgtagtaaatggattctgttagaagactacagaaagagagtccaaaatgtgaccgagttcgacgactctctgcttcggaattttacactggtgacgcagcaccccgaagtcatatacactaatcagaatgtggtatggtctaagttcgagaccatttttttcaccatatctggtctgatccactacgctcctgttttcagagactacgtttttaggtcaatgcaagagttctatgaggataacgtcctttatatggaaattagagcaaggctgttgccagtgtacgaactctcaggtgaacatcacgatgaggaatggagcgtgaagacataccaggaggtggcgcaaaagttcgtggagacccacccagagtttatcgggataaagatcatctactccgaccacagaagtaaagacgtcgcagtgatcgccgaatctatccgaatggcaatgggattgcgcatcaaatttccaacagttgtcgccggattcgatctcgtcggtcatgaggacactggacattctctccacgattataaagaggccctgatgatccccgctaaagatggggtgaagctgccatactttttccacgcgggagagacggactggcagggtacatccattgaccgcaacattctggatgccctgatgttgaatacaactcggatcggtcacggattcgcactttccaagcacccagctgttcgaacctactcctggaagaaggacatccccatagaagtctgtcctatcagcaatcaagtcctcaagctggtgagtgacctccgcaatcacccggttgctacacttatggccacaggacatcctatggtgatctcatcagatgacccagctatgtttggcgcaaaaggactctcctacgatttctacgaggtgttcatgggaatcggtggaatgaaggcggacctgcgcactctgaagcagttggctatgaatagtatcaagtacagtaccctgctggagtccgagaagaacactttcatggaaatttggaaaaagcgctgggataagtttattgctgatgtggctacgaaatag

SEQ ID NO: 11435 - DNA, 1137 bp, Artificial Sequence
  Description of Artificial Sequence: Synthetic coding sequence
tgatactccggcgattacatggaacctgagaagcccggagccccactgctgcctccgccacctcaaaacagtgtaccacactacgctgaggccgatatcgttaccctgcagggcgtcaccggagggaacacgtacgccgtgccggcactgcctcctggcgctgttggtgacggcccacctcgggtggacttccctcgcagcagattgcggttcaaagagaagctgggagaaggccaatttggggaagtgcatttgtgcgaggtggactcgccccaggatctggttagcctggacttcccactcaatgtgcgcaaagggcaccccttgcttgtggccgtgaagatactacgtcccgatgctacaaaaaatgcctcgttctctctgttcagccggaatgacttcttgaaagaagtaaagatcatgagcagactcaaggatcccaatattattcggctgctcggagtgtgcgtccaggacgaccctctgtgtatgatcacggattacatggaaaacggagacctcaaccagttcctgtcagcacatcagctggaggataaggctgcagaaggtgctccaggtgatggccaggcggcacagggaccgaccatctcataccctatgcttcttcatgttgctgcgcagatcgctagcggaatgagatacctagccacactgaactttgtgcatagggacttagccacacgtaattgtctggtcggcgagaactttacaattaaaatcgctgactttggcatgagcagaaatttgtatgccggtgattattaccgcgtccaggggagggccgtcctgcctattcgctggatggcttgggagtgtattcttatgggaaaatttactaccgcatccgacgtatgggcattcggggtgaccttgtgggaggtcctcatgctttgccgcgctcaaccattcgggcagttgacagatgagcaggtgatcgagaacgccggtgaattttttagggaccaaggtaggcaagtgtatctgagtcgtccgccagcatgcccccagggtttatacgagctgatgctacgttgctggagccgggagagcgaacagagacccccattttcacagttgcataggttcctcgcagaggatgcactgaataccgtgtag

SEQ ID NO: 11436 - DNA, 678 bp, Artificial Sequence
  Description of Artificial Sequence: Synthetic coding sequence
taggctgacttaccttcttgctggggtgccggtccatgttatacaggtcataaggtcggtgcattgcgccgagataccgtaatttgctgctgtcgccatggcgactactcaaccccttgtctcttcacacctgggaagccttctcgcaatccaagcccctggaagcgcactctgtggaccctcagtgccccatgggccggacccgcagggtggactggcgaggaacaaaacgcaacaaaaacgggcctgataacaagacgccctcggccactgcgccgacggcctcatcctgctcctgcatcaccactccccgaaataatcagaggcaatataccgcgaatgctcggaaagttcgtgcctgttaattgggagccaccacagcccctacccttcccaaaatatctccgttgttatcggtgtttgctagagactaaagagctgggatgtctgctcgggagcgatatttgtcttacaccggctggctcctcatgcatcacactccataaaaaaaactctagtggctctgatgtcatggtgtcagattgtaggtctaaagaacagatgtctgactgcagtaacaccaggacaagccccgttagtggcttctggattttcagtcagtactgcttccttgacttttgtaatgatccacaaaacagaggtctatataccccctag

SEQ ID NO: 11437 - DNA, 846 bp, Artificial Sequence
  Description of Artificial Sequence: Synthetic coding sequence
atgcttcctaaatcgagaagggcgttaacaattcaggagattgctgccctagcccgatcaagtttacacggaatcagccaagtggttaaagaccacgtgacaaagccaaccgcgatggcccagggcagggtagcgcacttgatcgaatggaaagggtggtctaagccgagcgactctccagctgccctggagagtgccttttctagctacagcgacctttccgagggcgaacaggaagccagatttgcagctggcgtcgctgagcaattcgcaatagccgaagctaagttgagagcatggagtagtgttgatggcgaagatagtacggatgacagctatgacgaagacttcgcgggtgggatggataccgatatggctggacagctccccttggggccacatctgcaggatctttttacagggcaccgcttctccaggccagttagacagggcagtgtcgagcccgagtccgactgctctcagacagtaagcccagataccctgtgtagcagcctttgttctctggaagatgggcttctcggcagccctgctcggctggcctcgcagctgctgggagatgaactactactggcaaagctccctccatccagagagagcgctttccgcagtctggggcctttggaggctcaggatagcctgtacaattcccctctgacggagagctgtctttcacccgctgaggaggagcccgctccatgcaaggattgccaaccattatgtcctcccttgaccggctcatgggaacgccagaggcaagccagtgacctggccagttctggcgtggttagtttggatgaggacgaagcagaacccgaagagcaatag

SEQ ID NO: 11438 - DNA, 1110 bp, Artificial Sequence
  Description of Artificial Sequence: Synthetic coding sequence
atgaaatttcagggtccactggcctgcttgctcttggctctgtgcctcggcagcggggaggccggtccgctgcagtcaggagaagagtctacgggaaccaatataggcgaggcactgggtcacggcctgggagacgccctatcagaaggagttggcaaggctataggcaaagaagcgggaggagcagctggctccaaagtctctgaggctctgggtcaggggacacgtgaagcagtgggtaccggggttcgccaggtgcctggcttcggagtggccgacgccttggggaatcgcgtaggcgaggctgcgcatgcacttggcaataccggacatgagattggcagacaagccgaagatgtcattcgtcacggggctgacgccgtgcgcggaagctggcagggtgtaccagggcataacggggcatgggagacttctgggggtcacggaatcttcgggagtcagggcggactcggcggacaggggcaggggaacccaggaggactgggcacgccatgggtgcatggataccctggtaactcagctggctctttcggtatgaacccccagggagccccatggggacagggaggaaacggtggacctcccaatttcggtaccaacactcagggagccgtggcccagcctggttacggctccgtgagagcaagcaatcaaaacgaagggtgcacgaatccgcctccttctggatccggaggcggaagctcaaacagtgggggaggcagtgggagtcagagcggaagctccggttccggctctaatggagacaataacaatgggagctcatccgggggtagcagttcaggctccagctcgggagggagcagcggagggtcctcaggcggatcctccggaaatagcggcggttctagaggggactcggggtcagagtcatcatggggatcctcaactgggagctcatcaggaaatcatggcggaagcgggggaggaaatggccacaagccagggaactcagagacctcacccggaatgtttaacttcgacactttttggaagaattttaagagcaagctcggcttcattaactgggacgcgattaataaagaccagagaagctccagaataccctag

SEQ ID NO: 11439 - DNA, 420 bp, Artificial Sequence
  Description of Artificial Sequence: Synthetic coding sequence
atgggtccagaagcattatccagtctcttgctgctgctgctggtagcttccggggatgctgatatgaaggggcattttgatccggctaaatgccgttatgcccttgggatgcaggatcgcaccatccccgactctgatattagcgcttcctctagctggtccgactctaccgcagctcggcactcacgactcgagtcaagcgatggcgatggagcctggtgtcccgctggatctgtgttccccaaagaagaggaatatctccaggtggatctccagcgtctccatctggttgccctagttgggacgcaggggaggcatgcgggaggactggggaaagaattcagtcgcagttaccgcctcagatattccagagatggtcggcgatggatggggtggaaagacaggtgggggcaggaatag

SEQ ID NO: 11440 - DNA, 516 bp, Artificial Sequence
  Description of Artificial Sequence: Synthetic coding sequence
atgcgccataacctgggcggaaatctcggggatccgagagctcgggctgttagcgtcccattaggaggcagggtggcccgttttcttcagtgtcggtttctgtttgccggaccttggctgctattctctgagattagcttcattagcgatgtagtgaataacagcagtcctgcgctggggggtaccttcccaccagctccttggtggccacccggtccaccccctacaaacttctcaagtctggaattagagcctcgaggtcagcagccggtggctaaggccgaaggatcccctacagctattctcattggctgcctcgtagcgattatcctcctactgctcctgatcatcgctttgatgctgtggagactgcactggcggagactcctcagtaaggtgcttgaaagccaccctcgtacgcgctctccaggactggtggggatccgaccaacaccactgcccgtgtcaccgatggccctggtgcacctgtgtgaggtagacagtccccaagactag

SEQ ID NO: 11441 - DNA, 192 bp, Artificial Sequence
  Description of Artificial Sequence: Synthetic coding sequence
atgggacccgaggctctgagctccttgctcttgctgctgctcgtggcgtctggcgacgctgatatgaaaggccatttcgacccggcaaaatgccggtacgcactggggatgcaggacagaaccatacccgatagcgatatatcagcttcgtcttcgtggtcagattcgaccgccgctcgtcattctcgatag

SEQ ID NO: 11442 - DNA, 1137 bp, Artificial Sequence
  Description of Artificial Sequence: Synthetic coding sequence
tgatactccggggattacatggagcccgagaagcccggtgcccctctcctgcctccccctccacaaaactcagtgccccactatgcagaagctgatatcgttacactgcaaggcgtgacaggaggcaacacttacgccgtccccgcactgccccctggcgcagtaggtgacggaccaccgcgtgtggacttcccaaggagcaggctacgatttaaggaaaaactaggcgagggacagttcggggaggtccacctttgtgaggttgactcaccacaagatctggtctcccttgactttcctctgaatgtacgcaaaggtcatcccctgctggttgctgtgaagatcctaaggccagacgctaccaagaatgcctccttttcactttttagcaggaacgacttcctgaaggaagtcaaaatcatgtccagactgaaggaccccaatattatccgattactgggagtgtgtgttcaggatgatcccctgtgcatgatcactgactacatggaaaatggcgacctcaatcaatttctgagtgcacaccagctggaggacaaagcggcagagggagcccctggtgacggtcaggctgctcaggggccaacaattagctacccaatgttgctgcacgtcgcagcccagattgcatccgggatgcgctacctagccaccttgaacttcgtccaccgggatctagcaactcggaattgtctggtgggagaaaactttactatcaagattgcggatttcggcatgtctaggaatctctatgctggagactactaccgagtgcagggaagagccgtactgcccatccggtggatggcttgggagtgcatcctgatgggtaaatttacaaccgccagtgacgtctgggcattcggcgtgactttatgggaagtcctgatgctctgcagggctcagcctttcggtcagcttacagacgaacaggtaattgaaaacgctggagagtttttccgagatcagggaaggcaggtgtatctttctagaccccctgcctgtccacagggactgtatgagctgatgttgaggtgctggtcacgcgagagtgaacagaggcccccattttctcagctacatagatttcttgctgaggacgccctgaatactgtttag

SEQ ID NO: 11443 - DNA, 2535 bp, Artificial Sequence
  Description of Artificial Sequence: Synthetic coding sequence
atggggccaggcgcaccattcgccagggtaggatggccactccctttattagtcgtaatggcggcaggtgtggcacctgtgtgggccagtcattctccccacttgcccaggccccacagtcgtgttcctccgcatccttccagcgaaaggcgggctgtgtacatcggagccctgtttcccatgagcggcggttggcctggtggacaggcttgccagcccgcagtcgagatggccctggaggatgtgaacagccggagggatatcctccctgattatgagctgaaactcattcatcatgactcaaagtgtgaccccggacaggccacaaagtatctctatgagctattatacaacgatccaatcaaaatcatactaatgcctggatgctcgagcgtctccactctggtggctgaggcggctaggatgtggaacctgattgtgctgtcatacgggagctcttctcctgccctttctaatcggcaaaggtttccgacattttttcgcacccatcctagcgccactctccacaacccaacacgggtcaagctatttgagaaatggggctggaagaagatagctaccatccagcagacaacggaagtgtttacctccactcttgacgacctggaggaaagagtcaaggaggccggaatcgaaatcaccttcaggcagagcttcttctctgacccagcagtgccagtgaagaatcttaagcggcaggatgccagaatcatcgtcgggctgttctacgagaccgaggccaggaaagtgttctgtgaagtttacaaggaaaggctgtttggtaagaaatacgtatggttcttaatcggttggtatgccgataactggttcaagatttacgatccctccattaattgtacagtggatgaaatgacagaggctgtggagggccacattactactgagatagttatgctaaatcctgctaatacacggtccatatcaaacatgacgagccaggagttcgtcgagaaactgacaaagcgcctcaagcggcatcccgaagagactgggggattccaagaggcacctctggcttatgacgccatctgggctcttgcactcgctcttaacaagacatctggaggcggtggtcgatctggcgttcgactcgaagacttcaactataacaaccagacaattacagatcagatctatagggccatgaacagcagctcatttgaaggcgtttccggacacgtagtgttcgatgcatctggctctaggatggcctggacactgatcgaacagttgcagggagggtcctataagaagatcgggtactacgacagcacgaaagacgacttatcctggagtaaaactgataagtggatcggagggtccccaccagcagaccagaccttagtcatcaagacgttcagatttctgagtcagaaactgtttatttccgtgtctgtactttcatcgctgggtatagtgctggcagtagtgtgcctgtcattcaacatttataattcccatgtccgctacatacaaaatagccagccaaacctgaacaatctaactgccgtcggctgcagcctggccttggcagctgttttccctttaggactcgatggctatcacattggtcgcaaccagtttccatttgtgtgccaagcacgactttggcttttggggctagggttctctttgggatatggttcaatgttcaccaagatttggtgggtgcataccgtgttcactaaaaaggaggagaaaaaagagtggcggaagaccctggagccctggaagctttatgcgaccgtgggcctgctcgtggggatggacgtccttactctggctatttggcaaatcgtagaccctctgcatcgaacaatcgaaaccttcgccaaagaggagcccaaagaggatatcgatgtgtctatccttcctcaactcgagcattgctcctcaaggaagatgaacacctggctggggatcttttatgggtacaaaggcttattgttgctgctgggtatttttcttgcatatgagacaaagtcagtgagcactgaaaaaatcaatgaccaccgggcagtcggcatggccatatataacgtcgctgttctgtgccttatcactgcccctgtgacaatgattctttcttcccagcaggatgccgctttcgcctttgcatcattggcaatcgtttttagctcttatattaccctagtggtcctgtttgtgcctaaaatgcgccgactgataactcgtggagaatggcagtccgaggcacaagataccatgaaaaccggatcatcaaccaataacaatgaagaggaaaagtcccgcttgttagagaaggaaaaccgagaattagagaagattatcgccgagaaggaggaacgcgtgagtgaactcaggcatcagctgcaaagtagacaacagcttagatctaggagacatccgccaactccgcctgaaccttcagggggattacccagaggtccgcctgagccgccagatcgcctgtcctgtgacggatcaagagtacacttactttacaaatag

SEQ ID NO: 11444 - DNA, 339 bp, Artificial Sequence
  Description of Artificial Sequence: Synthetic coding sequence
atgctcactgccgcactcgctcctggcgcagctaattcaccaacgaccaatccggtgattctaattgtggacaaggtactcgaaacccaagaccttaatggcgacgggctaatgacgccagctgaactgatcaatttcccaggagtggccctgagaccgtaccccccttacatcggagtggggcctaacagcaatatgtgttcccgctcggacctgccagaggatagcaatacgctctaccccggttctcacctatggttacggcacgctctgaattcaaagggcaacctcgatgcgagactggacggaggcgagaaagccatgcagccacagtggtag

SEQ ID NO: 11445 - DNA, 2676 bp, Artificial Sequence
  Description of Artificial Sequence: Synthetic coding sequence
atgctccctaccgaagtcccgcaatctcatcccggaccctctgcgcttcttctacttcaactgctgctgcccccaacgtccgccttctttcctaatatttggtctctcctggctgctcccggttcaatcacccatcaggacctgaccgaggaggccgcactgaacgtgaccctacagcttttcctggagcagcctccgccaggaagaccccctctgaggctggaagactttctcgggagaactctgctggcagatgatcttttcgccgcttacttcggcccagggagctctcgtagatttcgggctgcactcggtgaggtttctagggctaatgctgcccaagatttcctccctacctctagaaacgatcccgaccttcactttgatgccgaacgactggggcaaggccgtgctagactagtgggagcattgcgggagacggtcgtggcggctagagccttagaccacactctcgcacgccagcgactgggggcagcgcttcacgctctgcaggatttctattcccactccaattgggtggagttgggcgagcagcagccacacccccatctcctctggcccaggcaggaattacaaaacttggctcaggtcgccgaccccacctgttccgactgcgaagagttatcctgcccacggaattggcttgggttcacactgctgacatccggttattttggcactcacccccctaagcctccgggaaaatgctcccatggaggtcacttcgataggtccagcagtcagccacctagaggagggattaacaaggactctaccagcccagggtttagcccacaccacatgctacatctccaggccgcaaaattggcactgctggcctccattcaggccttttctctgctcagaagtaggctgggagatcgcgatttttcgaggttgctggatattacacctgcttcctctttatcatttgtgctcgacaccactggtagtatgggagaagagatcaacgcagcaaaaattcaagctcgccatctggtcgagcagagacgagggagtcccatggagccagtgcattacgttcttgtgccctttcacgatccaggattcggacccgtgtttactacaagcgaccctgattcgttctggcagcagctgaatgagattcacgcactgggaggaggagacgagcccgaaatgtgtctttccgcccttcaactcgcacttctgcatactccccctctcagtgacatcttcgtcttcacagacgcctcgcctaaggacgccttcctgaccaaccaagtggagagcttaactcaggaacggcgatgcagagttacctttctggtcaccgaagatacttcacgggtccagggaagagcccgtcgggagatcctgtcacccctacgttttgaaccctacaaagctgtggccttagcctctggaggcgaggtcatttttactaaggaccagcatatcagggacgtggctgccatcgttggcgaaagtatggcagcacttgtaactctgccactagatcctccggtggtggtgcctggccagcctctggtattctccgtagatgggctcctgcagaagatcactgtgagaatccatggtgatattagctcattctggataaaaaatcctgccggagtgagccaaggccaagaggagggtggtggaccccttgggcatacccgtcgatttgggcagttttggatggtcactatggatgatcctccacaaacaggcacatgggagatccaggtcactgctgaggacacacccggagtgcgtgtgcaagctcagacttccctcgactttctctttcatttcggtatcccgatggaagatggacctcaccccggactgtatcccctgacccaaccagtcgctggactacagacacaactgttggtcgaggtgaccggcttggggtcgcgggctaatcctggcgatccgcagcctcacttttcacacgtaattctccgcggagtgccagagggcgctgaactcggtcaggtgcccctggagcccgttggcccaccggagcgagggttgcttgccgctagcctgtcacctactctcctctcaacaccccgacctttcagcctggaactgataggccaggatgctgcgggacggaggctccatcgcgcagctcctcagccatctacagtagtgcccgtcctcctagagctctctggtcctagtggctttctggcgccagggtcaaaggtgcctttgagcctgcgtattgcctccttttcaggaccacaggaccttgatctgcgcacttttgtgaatcccagtttttcactcacgagtaacctgtctcgcgctcacctagagttgaacgagagtgcttggggaaggctctggctggaggtgccagacagtgctgcacctgacagcgtggtaatggtcaccgtcacagcgggaggtagggaggctaacccagtgcctccaacccatgctttcctgcgtctgctggtttccgccccagcccctcaggatagacacactacaccgaccggttcctcagaccccatcctgaccacagccacccctgcgttttccccttttacactggtgacccaggggagagccggagccggactagcggctgggtctccatggtggggaacagtgggaggcgtgcttcttctgctgggcttggcctcctggtag

SEQ ID NO: 11446 - DNA, 2742 bp, Artificial Sequence
  Description of Artificial Sequence: Synthetic coding sequence
atggggcctgaggctctgagttctcttctgctgctgctgctggtcgcctccggcgatgcagatatgaaagggcacttcgatcccgcaaagtgcaggtatgctcttggcatgcaggacagaactattcccgactctgacatctcggcctcgagctcctggagcgactccacagccgcacggcactcgagacttgagagctccgatggggatggcgcttggtgtcccgcagggtcagtctttcccaaggaggaagaatatctccaggtcgacctgcagaggttgcacttggtggcattggtgggcactcaaggcagacacgccggaggcctgggtaaagagttctctcgctcttacagattgagatatagccgggatggcagacgatggatggggtggaaggacagatggggccaggaggtcatcagtggcaatgaagatcccgaaggcgtcgtacttaaggaccttggtccacctatggtggcaaggctcgtgcggttctatccaagagccgaccgggttatgagcgtctgtctgagggtagagctgtatggctgcctttggagagacggactcctgagctatacggctccagtggggcagacaatgtatctatctgaagctgtctacctcaatgacagcacatatgacgggcataccgtgggaggcctccagtatgggggtttgggacaactggcagatggagtagtggggctcgacgactttcgcaagtcccaagagttgcgggtgtggcctggatatgactatgtgggttggtccaaccactcattcagcagcggttatgtggaaatggagtttgagttcgaccgtctcagggcatttcaggccatgcaggtccactgtaacaatatgcatacattaggcgctcgactgcctggcggtgtggagtgcagattcagacggggacccgctatggcttgggaaggagagccaatgcggcacaatctcggtggcaatctgggcgaccccagagcgagagcggtgtcggtacccctcgggggtcgagttgcacgcttcttgcagtgtcgctttctgttcgccggaccatggctgctgttctccgaaatatctttcatctcagatgtagttaacaattcaagccccgcactcggcggaacgttccccccagccccttggtggcctccaggcccacctcccaccaattttagcagtcttgagttggaaccacggggacagcaacccgtggcaaaggccgagggctctccaactgcaatcctgattgggtgcctcgtggctattattctgctgctactgctcatcatagcattgatgctgtggcggctgcattggcgtaggttactctccaaggcggagaggagagtgcttgaagaggaacttactgtgcatcttagcgttcctggcgataccatcctgatcaacaataggcccggtcctcgggagcctccaccttaccaggagcctagaccccgtggcaatccgccacatagcgctccttgcgttcccaacggctccgccctcctgctctcaaatccagcctatcggcttttgctcgccacgtacgccagaccccctcgcggacccggaccacctaccccggcatgggctaaacctactaatactcaggcttatagcggagactacatggaacctgaaaagcccggagcccctcttctgcctccaccccctcagaacagcgtcccacattatgccgaggccgatatagtcactctccaaggtgtgacaggcggaaacacctatgccgtcccagctctgccacctggtgctgtcggagacgggcctccacgggtcgacttcccccgatcccgccttcggttcaaagaaaaattaggcgagggacagttcggtgaggtgcatctttgtgaagtggacagtccacaggaccttgtgtcccttgactttcctctgaatgtgcgcaaaggacacccattgttggtcgctgtaaaaattctacggccagatgcaactaaaaatgcacgaaacgacttcctgaaggaggtcaagataatgtcccgtctgaaagaccccaatataataagattactgggcgtttgcgttcaggatgaccctttgtgtatgatcactgattacatggaaaatggagacctgaatcagtttctaagtgcccatcaattggaggataaggcagctgagggagcaccaggagatgggcaggctgcacagggcccaaccatctcttaccctatgctactccacgtggccgctcagattgcttccgggatgcggtacctagccaccttgaacttcgtgcatcgggacctggctacgagaaattgcttagtgggcgagaattttaccattaagattgccgacttcggcatgtctagaaacctttacgcaggggattactacagggtgcagggtcgcgctgtgctacccatcagatggatggcctgggaatgtattctcatggggaagttcaccaccgcgtctgatgtgtgggcgttcggagtgacactgtgggaggtccttatgctatgtcgggcacagccttttggacagctcactgacgagcaggttattgagaatgctggcgagtttttccgggaccaaggacgccaagtgtacctcagcaggcctcccgcatgcccccaaggcttatacgagcttatgctgcgctgctggagtcgggagagtgaacagagaccccctttttcccagttgcataggttcttagcagaggacgccctgaacactgtttag

SEQ ID NO: 11447 - DNA, 390 bp, Artificial Sequence
  Description of Artificial Sequence: Synthetic coding sequence
atggccgctggctcggccccaatgcagttgcacctaagagccaccatcaggatgaaagacgggctgtgcgtgcccaggaagtggatctaccatctgaccgagggatctactgatcttcggactgaagggagacctgacatgaaaacagaactctttagcagctcatgtcccggagggattatgctcaacgaaacaggacagggataccagcgctttctcctctacaatagatctcctcacccgccagaaaaatgcgtggaggagtttaaatcgctcactagttgcctcgatagcaaagccttcctcctgacgcctagaaaccaggggaaaggactgaaatctcacaagacaggtttgggactcaccaaatcttctggggttaccggttag

SEQ ID NO: 11448 - DNA, 846 bp, Artificial Sequence
  Description of Artificial Sequence: Synthetic coding sequence
atgcttccaaaaagtaggcgagctcttactatccaggagattgccgctcttgcgagatcgtcccttcacggaatcagccaggtcgttaaagaccatgtcacaaaacctaccgcaatggcacagggtcgagtagcgcacctgatcgaatggaaaggctggtctaagccttccgattctcctgccgctcttgaaagtgcttttagcagttatagtgatctctctgaaggcgagcaggaggcacggtttgctgccggagtcgcagaacagtttgccattgcagaggctaaacttcgcgcttggtcctctgtggacggggaggacagcacggatgacagctacgacgaggacttcgctgggggtatggacaccgacatggccggacagttgccattgggcccacaccttcaggacttgtttaccggccaccgcttctccagacccgtccgacaggggagcgttgagcccgagtcagattgcagccaaaccgtttctcccgacaccttgtgctcctctctgtgctcactagaggacgggctcctcggatctcccgctagacttgcttcacagctgttaggggacgaacttctgcttgccaaactgcccccttcacgcgagtccgccttccgttccctcggaccactcgaggctcaggacagtctgtataattcccctctgactgagtcatgcctgtcgcccgctgaggaggaacctgcaccatgcaaggattgccagccgctctgcccgcctctcaccggaagttgggaacgccagaggcaggcttccgaccttgcaagcagtggcgtggtttccttggacgaggatgaggccgagccagaggaacagtag

SEQ ID NO: 11449 - DNA, 444 bp, Artificial Sequence
  Description of Artificial Sequence: Synthetic coding sequence
atgggcccagaagctcttagctctctcctacttcttctgctggtcgcgtctggtgatgccgacatgaaagggcattttgaccccgctaaatgtcgctatgccttaggtatgcaggaccggactatcccggattcagatatctccgcctctagtagctggagcgacagcaccgcagctcggcatagcaggctggaatctagcgatggtgacggagcctggtgtccagctggctctgtgttccccaaggaagaagagtacttgcaggtcgatctgcagcgcctgcatctagtggcgttggtggggacacagggacgacacgctggaggtctcggcaaagaattttctagatcttacaggctgcgctattcacgcgatggccgtagatggatgggctggaaggaccggtggggccaagaggtgatcagcgggaatgaagacccatag

SEQ ID NO: 11450 - DNA, 2631 bp, Artificial Sequence
  Description of Artificial Sequence: Synthetic coding sequence
atgggacctgaagcgctgagctctctgcttctgttactgcttgtcgcgagcggcgatgcagatatgaagggccattttgaccctgcaaagtgcagatacgcgttgggaatgcaggatcggactatccccgatagcgacatttcagcgagttcatcctggagtgacagcaccgctgctagacattccagactagagtcctccgatggagacggagcttggtgtccagccggatcggtctttccaaaagaagaagaatatctccaggtggatctccagcgactgcatctggtggcactggtcggtacccagggcagacacgccggtggtctcggaaaggagttctccagatcttaccgcttgagatacagtcgagacggtcggagatggatgggttggaaagacaggtgggggcaggaagtgattagtgggaatgaagatcctgagggagtggtacttaaggatctcggtccgcctatggtggcccgattggtgcggttttatccacgtgccgacagagtgatgagcgtatgtttgcgagtggagctgtatggctgcctgtggcgcgatggactgctgagctataccgctcccgtcggacaaactatgtatctgtcggaggccgtgtatctgaacgactcaacctacgatggccataccgtgggtggacttcaatatggcggacttgggcaactggccgacggcgtggtgggattagatgatttcaggaagtctcaggagctgcgggtgtggcctggatacgactacgtagggtggtccaatcatagctttagctcagggtatgtagaaatggagttcgaatttgaccgcctgagggccttccaagccatgcaggttcattgtaacaacatgcacactctcggcgctcggctgccaggcggagttgagtgcaggttccgtcgcggtcctgcaatggcctgggagggcgagcccatgagacacaatctgggtggaaatctgggagacccgagggctagggccgtgtccgttcctctgggagggagagtggccaggttcctccaatgcagattcttgtttgccggaccatggttacttttcagtgaaataagttttataagcgacgttgtgaacaacagctctccagcactgggtgggacctttccacccgcaccctggtggccccctggccctccccctactaacttctcgtcccttgagctcgagcccagaggccagcagccggtcgctaaagctgaaggcagtcctacagcgatcctgattggatgtctggtcgctatcattctgctactgctcctcattatcgctctgatgctgtggcggctccactggagaaggctgctgtctaaagctgagaggagagtgctggaggaggaactgacagttcacctgagcgttcccggtgacactatactgataaacaatcggccaggtccccgtgagcctcccccttatcaagaacccaggccaaggggaaatccccctcacagcgcaccatgtgtgccaaacgggtcagcatattccggcgactatatggaacccgagaaacctggagcgccactgctgccccctcctccgcagaactctgtcccacactatgccgaagcggacatagtaactctgcagggggttacaggcggaaatacctatgctgtgcccgctctgcctccaggcgcagtaggtgatggcccaccccgtgtggactttccacggtctcgactgcgcttcaaagagaaattaggcgagggacaatttggtgaagtgcatttatgcgaagtagactcgccccaggaccttgtttccctggattttcctttgaacgtgcgaaaaggtcatcctctgctcgtcgctgtaaagatacttcgacccgacgcaaccaagaacgcccgaaatgatttcctcaaagaagtgaagatcatgtccagactcaaagatccaaatatcattcgcctgctgggtgtttgtgtgcaagacgaccccctgtgtatgattaccgattacatggaaaacggcgatctcaatcagtttctgagtgcccaccaactggaggataaagcggcagagggggctcccggtgacgggcaggctgcacagggccctactatcagctaccctatgctgctgcatgtggccgcacagatagcctcaggcatgagatacctagcgaccctcaatttcgttcacagggacctcgctaccagaaattgtctggtcggcgagaattttactataaaaatcgccgattttggcatgagcaggaacttatatgccggagactactacagagtacagggacgggctgttctccctataagatggatggcttgggaatgtatcctgatgggcaagtttaccacagccagcgatgtgtgggcatttggggtcactctctgggaggtgctgatgctttgtcgtgcacaaccgtttggtcaactcacagatgagcaggtgattgaaaatgcaggggagttctttagggaccagggacggcaggtgtatctctcacggcctccagcctgtccacagggcctctacgagcttatgctgagatgttggtctcgagagagcgaacagaggcccccattctctcaactccataggtttctcgctgaagatgccctcaatacggtgtag

SEQ ID NO: 11451 - DNA, 1749 bp, Artificial Sequence
  Description of Artificial Sequence: Synthetic coding sequence
atggactttcttctggctctggtgctggtctcttccctgtacctacaggctgcggctgagtttgacggccgttggccgagacagattgttagctcaattggcctgtgccggtatggaggaagaatcgactgttgttgggggtgggcccgacaaagttggggacagtgccagcccttctatgttttgcggcagcgcatcgcccgaatccgctgccaattgaaagccgtgtgtcagccgcgatgtaaacacggtgaatgtatcgggccaaataaatgtaagtgccaccccggatatgccggaaaaacttgcaatcaggatctgaacgagtgtggcctcaaaccaaggccgtgtaagcacaggtgcatgaacacatatggcagctataaatgctattgcctgaatggctatatgctcatgcccgatggaagttgtagctctgctctgacttgtagcatggccaactgccagtatggctgcgatgtcgtcaagggacagataaggtgtcagtgcccatccccaggactgcagctagcccctgatgggaggacatgcgtcgacgtagatgagtgcgctacagggagggcttcctgcccaaggttcaggcagtgcgtgaatacgtttggatcgtatatttgtaagtgccataagggctttgacctcatgtatatcggtggcaaatatcagtgtcatgatatcgacgaatgctcactgggccagtaccagtgttcttcatttgcccgttgttataatatcagaggcagctataagtgcaaatgcaaagagggataccagggggatggactgacatgtgtttacatccccaaggtcatgattgagccaagcgggcctatccacgtcccaaaaggaaacggcactatactcaaaggtgatactggtaataataattggatacccgatgtcggttctacttggtggccaccaaaaacaccgtatataccgcctatcatcaccaacagaccaacctctaaacccactacacgcccaacgcctaaaccaactcctatccccacccctccaccaccaccgcctctgcccaccgagcttcgaacgcctctgcccccaaccactccagagaggccaaccacgggtttgactaccattgctccggcagcctctaccccccctggtgggattaccgtggacaaccgggtgcagaccgacccccaaaaaccacgtggggacgtcttcattcccagacaaccaagtaacgatttgtttgagattttcgaaatcgaacgtggtgtcagcgctgacgacgaagccaaagacgaccctggcgttctagtgcatagttgtaatttcgaccacgggctgtgcggatggattcgggagaaggacaacgacctgcattgggagccaattcgtgatccggcaggaggacaataccttacagtgagtgccgctaaggcacccggtggcaaggcagccaggcttgtcttgcccctcggacgactcatgcattccggggacctctgtttgagcttcagacacaaggtcaccggcctgcactccggaaccctccaggtgtttgtaagaaaacacggcgcacacggcgcagccctgtgggggaggaacggtggtcacggctggcgccagacccagatcaccctaaggggagcagacattaagagcgttgtttttaagggcgaaaaacgaagggggcacaccggagagatcggacttgatgatgtgagcctgaagaaaggacattgcagcgaagagagatag

SEQ ID NO: 11452 - DNA, 1602 bp, Artificial Sequence
  Description of Artificial Sequence: Synthetic coding sequence
atgggaagttcccgattggccgcattactattgccactgttgcttatcgtaattgatctgtcagattcggccggtatcgggtttaggcatctgcctcactggaacacaagatgcccactagcgagccataccgatgatagctttactggatccagtgcgtatattccctgccggacgtggtgggcactcttcagcaccaagccttggtgcgtgcgagtgtggcactgttccagatgtctctgccagcacctgctgtccggcggatccgggctgcaacgcggactttttcacttattggtgcagaagtccaaaaaatcttccacattcaaattttatcgcagacataaaatgccggcacctgctcaacgcaaacttctccctcgccgtcacctttccgaaaaatcccaccatatctctatccctagccccgatatttcccacaaaggcttacgtagtaaacgaacacagccttctgaccctgaaacttgggaaagcctgcccagattggattctcaaaggcatggtggcccagaatttagttttgatctgctccccgaagcgcgtgccattcgagtgacgataagctctggccctgaagtgagcgtgcgactgtgccaccaatgggccttggagtgtgaagagctctcatctccctatgacgttcagaaaatcgtttctggaggacacaccgttgaattgccttatgagtttctcctgccatgcttgtgtattgaagcttcctacctgcaggaggacacggtgaggcgcaagaaatgccccttccagtcttggcccgaggcctacggaagcgacttctggaagagcgtccatttcacggactacagccaacatactcagatggtcatggcgctgacactgagatgcccactgaagttggaagctgctctctgccagaggcacgactggcacaccttatgcaaagacctccctaatgccactgccagagagtctgatggctggtatgtgctggagaaagtagacttacatccccagctgtgcttcaagtttagcttcggaaattcttcacatgtcgaatgccctcatcaaactggttctttgacttcttggaatgtgtccatggacacgcaggctcagcagttgatccttcacttctctagccgcatgcatgccacctttagtgccgcatggagtttgcctgggctgggccaggacacccttgtgccccctgtgtacacagttagccaggcaagaggaagttcacccgttagcttagatctgatcatccccttcctgaggccaggatgctgtgtcttgctccacgcaagtctgtctagccctggcggagaggacgcttggctgattggtgtgggaggatctgttcccagcggcgtggcggtccggtgccccgtgtgcctggaagccccacttgtcagcggatgcctccttcaaacacccggagcgttggacccgggtaccgctgggcctcctcacccaactggatgctgttctggccctcatctgccagctcccactgtcaggcctggaccctcagctgcatctgcacctcccgctaggggtggtctgggaggagcagcagcgccaggcggaagtgcaggctag

SEQ ID NO: 11453 - DNA, 1293 bp, Artificial Sequence
  Description of Artificial Sequence: Synthetic coding sequence
atgggagtcagtaagctggatattctctaccgacgtctcctgctgaccaaactatttataaggggatggggcaggcccgaggaccttaagagactatttgagttccggaagatgattggcaacagagaaagatgtcaaaacctggtgagcagcgactaccccgtgcatattgacaagatagaagaacagtctgattgtaagatcttggacggacactttgtgtccccaatggcccactatgtgcctgatataatgccgattgaatctgtcattgcacggtttcagttcattgtacctaaggagtggaactctaagtaccggccagtctgtattcatttagctgggacaggtgatcaccattactggcggaggagaacattgatggcaaggcccatgattaaggaagccaggatggccagcttgctcctggagaatccatattatggctgcagaaagccaaaggatcaggttcgttcatcacttaagaatgtctcagatctgtttgtaatgggcggtgctctggtgctcgagagcgctgcgcttctgcactggctggagcgagagggctacggcccactggggatgactgggatttctatgggtggccatatggctagtttagccgtgtctaactggccaaagccaatgcctctgatcccgtgcctgtcatggtctaccgcctcaggagtgtttactaccacagacagcttcaaaatggggcaggagtttgtaaagcatttcacgtcatcggccgacaaactcaccaatctgaaccttgtttcccgtactctgaatttagatataagcaatcaggtggtatcacagaagcccgctgactgccacaattctagcaagacatcggtctcagccacatccgagggcctgctgttgcaggacactagtaaaatgaaacggttcaaccagacactgtcaaccaacaagtctggatataccagccgaaaccctcagagttatcacctgctgagcaaggagcagtcacggaactccctgagaaaagagtcgttaatcttcatgaagggtgtaatggacgagtgcacccacgtcgccaacttcagtgtgccggtggacccgagcttgatcattgtagtgcaggctaaggaggacgcgtatatcccacgaaccggcgtacgctctctgcaagaaatttggccgggttgtgagatccgttacctggaaggaggccacatcagtgcctatctgttcaagcagggactgtttaggcaggccatttatgatgcattcgatcgctttctgcataagtatgccaactag

SEQ ID NO: 11454 - DNA, 2631 bp, Artificial Sequence
  Description of Artificial Sequence: Synthetic coding sequence
atgggccctgaagcactttcctcccttctgctactgttattggttgcctcgggtgatgccgacatgaaggggcatttcgacccagctaagtgcaggtacgccctgggaatgcaagaccggacaataccagacagcgatatctccgcttcaagttcatggagcgatagcactgccgctcgacactcacggctggaaagttccgatggcgacggcgcttggtgtccagctgggagcgtctttcccaaggaggaagagtatcttcaggtggacctgcagaggctgcacttggtggccctagttggaactcaaggaagacacgccggtgggctgggcaaagagttcagcaggtcatataggttacgttacagccgtgacggcaggcggtggatggggtggaaggatagatggggccaggaggtgatctctggtaacgaggatccggagggtgtagtgctcaaagatctgggaccacccatggtggcgcgtttggtgagattctatccacgcgctgaccgggtgatgagcgtgtgtctgagggtggaactctatggctgcttgtggagagatggtcttctttcatacacagcacctgttggacagactatgtacctgtccgaggcagtctacctcaacgatagcacctatgacggccacaccgtggggggacttcagtacggcggacttgggcaattggccgacggtgtagtggggctggatgatttccgcaaaagtcaggaactaagagtgtggcccggatacgactatgtagggtggagcaaccactctttcagctcaggttatgtggaaatggaattcgagttcgatagactccgggcatttcaggccatgcaggtgcattgcaataacatgcatacgttgggcgcacggttaccaggaggtgttgaatgtcgtttcaggcgcggaccagccatggcttgggagggggagcccatgcgtcacaacctgggcggtaacctgggtgatccaagggcgcgtgccgtatccgtgcccctcggcggaagggtggctagattcctgcagtgtagattcctgtttgcagggccatggttattgttttcagagatctcctttattagtgatgtggtaaataactcttcacctgcgctgggcggaacatttccaccggcaccatggtggccacccggtcccccacccaccaacttcagctctcttgagctcgaaccaaggggccagcagccagttgcaaaggcagaaggatctccgactgccatactcataggctgcttagtcgcaatcatcctactgctccttctcatcattgcactgatgctgtggagacttcactggcggcgtcttttgtcaaaggcagaaagacgggttctggaagaggaactgacagttcatctgagtgtcccaggggataccatcctaattaacaataggcctgggccacgagaaccccctccctaccaggaaccacgtccccgaggtaatcctccacattccgccccatgcgtacccaatgggtcagcctatagtggggattatatggaacccgaaaagcctggcgcacctctgctgcctccacccccacagaactcggtaccacactacgctgaggctgatatcgttacgctccaaggcgtgaccgggggtaatacatacgctgtgcctgctttaccgccaggtgccgttggagatggaccaccccgtgtggacttcccacgctcacgtctgcggtttaaagagaagctcggcgagggtcagttcggagaggtacatttgtgtgaggttgactctccccaggatctagtctctctcgacttccctctaaacgtgaggaagggtcacccgctccttgtcgctgtcaaaatactgcgtcctgacgcaactaagaacgctagaaacgactttcttaaggaggtcaagattatgtcccggctcaaagatcctaacatcataaggctcctgggggtgtgcgtgcaggacgaccccctgtgcatgattacagactacatggaaaatggagatctaaatcaatttctcagcgcccatcagttagaggataaggccgctgagggagctccaggtgatggacaggctgcacaggggcctaccatatcatatcctatgctcctccatgtcgcagcacagatagcctctggaatgcggtatctcgccacgctgaactttgtgcacagagacttggccacacggaattgtctggtgggagagaacttcaccatcaaaattgcagatttcggcatgtctcggaatttgtatgctggtgactattacagggtacagggccgtgcggttcttcctattcgatggatggcatgggagtgtatcttgatgggcaaattcactactgcaagtgatgtatgggcatttggcgtgacattgtgggaagtcctgatgctgtgtagggcccagcctttcgggcaactgaccgacgagcaggtgatcgagaacgctggagagttcttccgcgatcaaggccgacaggtctatctgtcccggccaccagcctgtccgcaggggctgtacgaattaatgctgcggtgttggtctagagaatccgaacagaggccaccttttagtcagcttcatagatttctcgcggaggacgcacttaacaccgtgtag

SEQ ID NO: 11455 - DNA, 237 bp, Artificial Sequence
  Description of Artificial Sequence: Synthetic coding sequence
atgggttcgggcttaccccttgttctactcctcaccttgctcggttccagtcacggtacggggccaggcatgacccttcagctgaaactcaaagaatccttcttgacaaacagttcctacgagtcctccttcctcgaactgctggagaagctctgcttgctgctgcatttgccttcagggaccagcgtaacattgcatcacgcgaggtcacagcaccatgttgtttgcaacacatag

SEQ ID NO: 11456 - DNA, 2631 bp, Artificial Sequence
  Description of Artificial Sequence: Synthetic coding sequence
atggggccagaagccttgtctagcttactcctcctgctgctcgtagcgtcaggggacgccgatatgaaagggcatttcgatccagctaagtgcagatatgccttgggaatgcaggatcgtacgatcccagactccgacataagcgctagctcctcttggtctgattcaactgctgcacgccactcacggctggagagcagcgatggcgacggagcttggtgtcccgcaggtagtgtgttccccaaagaggaggagtatctgcaggtggatctgcagcgtcttcacctcgtagccttggtgggtacacagggcagacatgccggtggcctcggaaaggagtttagtagaagttataggctcagatactcccgggatgggaggcgatggatgggatggaaggaccgctggggacaggaagtcatttcaggcaacgaagacccagaaggagtcgtgttaaaagatctcggtccacctatggttgccaggctggtgagattttatcccagagcagaccgcgtgatgtctgtgtgcttgagagtggagctgtacgggtgtctatggagggacgggctgctctcatataccgctcctgtgggccaaacaatgtacctgtccgaggctgtgtacctcaatgatagcacatatgacggccacacggttggaggcttacaatacggaggactgggtcagctcgctgacggcgttgtgggacttgatgactttcggaagagccaggagttgcgtgtttggccaggatacgattacgtaggctggagtaaccactcgttcagcagcggttatgtagaaatggagttcgaatttgaccggctgagggcctttcaggcaatgcaagtgcactgtaataacatgcatactcttggagcgcgtctgcctggtggcgttgagtgtcgcttcaggagggggccagctatggcatgggagggggagcccatgcgtcacaacctgggcggaaacctaggggatcccagggcaagggcagtctctgtgccgttgggcggtagggtcgcaaggttcctgcagtgtcgtttcctgttcgctggaccttggctgctcttctcagagattagtttcatctcagacgtagtaaataattcttcacccgctctgggagggactttccctcctgctccctggtggccaccaggcccaccgcctaccaattttagtagcctggagctggagccacgtgggcaacagccagttgcaaaagcagagggctcacctaccgcaattctcatcgggtgcctggtcgccatcattttattgttgctactcattattgctctgatgctatggcgcctacactggagacggcttctttcgaaagcagagagacgcgtgctagaggaggagctcacagttcatctttccgtccccggagacacaatcctgattaataatcggcctgggcctagggaaccacctccttaccaggagcctaggccgaggggcaatcctccacactccgctccttgtgtcccaaatggttcagcatacagcggagactatatggagcctgagaagcccggagcacccctcctgcccccacctccccaaaatagcgttccgcactatgccgaggcagacattgtcaccctccagggagtaaccggaggaaatacttacgccgtccctgccctgccaccaggtgcagtgggggatggccctcctcgtgtggattttcctcgatcacggttacgcttcaaagaaaaactgggtgaaggtcagttcggtgaagtccacctttgcgaagtggactcgccacaggatctggtcagcctggacttcccactgaacgtgagaaaggggcaccctctactggtagcagtgaagatcctgcgcccagacgcaactaaaaatgcaaggaacgacttcctcaaagaagttaaaatcatgagtcgactgaaagaccccaatatcatcagattattgggcgtgtgcgttcaggacgatccactgtgtatgatcacggactatatggaaaatggtgacttaaaccagttcttgtccgcacatcaactggaggacaaagccgcagaaggggctccaggcgacgggcaggcagcacagggtcctacgatcagctaccccatgttgcttcacgttgcggctcagatagcctcaggaatgcgctatcttgccacgctcaatttcgtgcacagagatcttgcaactaggaactgtctggtaggtgagaactttaccataaagattgcagacttcgggatgtctagaaatctctatgcaggcgactattacagggtgcaggggcgtgcagtgctgccaattcgctggatggcgtgggagtgtattctgatgggcaagttcaccaccgcctctgacgtctgggcgtttggtgtcactctatgggaggtgttgatgctgtgtcgagcccagcctttcggacagctgaccgatgagcaggtcatcgaaaacgctggcgagttctttcgtgaccagggaagacaggtctacttgtcccgtccacccgcatgtccccagggcctgtatgaactcatgctgagatgctggtccagggagtcagagcagcggccacccttttctcagctgcatcgctttctcgccgaagacgccctgaataccgtgtag

SEQ ID NO: 11457 - DNA, 1257 bp, Artificial Sequence
  Description of Artificial Sequence: Synthetic coding sequence
atgcgtactctgttcaatttgctctggcttgctctcgcatgctctcccgttcatacaacactttccaaatctgatgcgaaaaaggctgcctccaagactctgctcgaaaaggtgaaattctgttcatgctgcccaggatggtcagctatggctagatcctggctgactgcaacttctgccacccagtctcaattttccgacaaacccgtgcaagacagaggcctcgtcgtaactgacctcaaagctgaatctgtggtgctggagcaccgctcgtactgttctgctaaagcacgcgacaggcactttgcaggagatgtgctcggctacgtgacgccatggaactcccacggctacgatgttacgaaagtctttggaagcaagttcacccagatcagccccgtatggttacagctgaagagacgcggacgcgaaatgttcgaggttacagggctgcatgacgtggatcagggttggatgcgcgctgtgagaaagcatgccaagggtctgcacattgtccctagactgctcttcgaagattggacctacgatgacttcagaaatgtattagactctgaagatgagatcgaagagttatcaaaaaccgttgttcaggtggcgaaaaaccagcactttgacggttttgtcgttgaagtatggaaccaacttcttagccagaagcgggtgggcctcatccacatgctaacgcatctggccgaggccctgcatcaagcgaggcttttggcactgctggtaatcccacccgcaataacccctggcaccgaccagttggggatgttcacacataaggagtttgaacagcttgcacctgtactggacggatttagtctgatgacatacgattactctacagctcatcaaccaggcccaaatgcacccctctcatgggtgcgtgcttgcgtgcaagtgctggacccgaagtccaagtggagatcaaaaatcctgttgggtctgaatttttatgggatggattatgcaactagcaaagacgccagggagccagtcgtaggagctcgctacatccagactctcaaagaccaccggccacgcatggtttgggatagtcaagcctctgaacattttttcgagtataagaagtctagatctggcagacatgtggtcttttatcctacattgaagagtctccaggtcagactggaactggccagagagctgggagtgggcgtgtctatatgggaactcggtcagggtctggactatttttatgatctgctgtag

SEQ ID NO: 11458 - DNA, 390 bp, Artificial Sequence
  Description of Artificial Sequence: Synthetic coding sequence
atgaggaagcccaggcgcaagagtaggcagaacgcagaagggaggcgatcaccctccccatactctcttaagtgcagccctacacgagagacccttacgtacgcccaagctcagcggatagtggaagtggacatcgatggacgattgcaccgaatcagtatctatgaccccctgaaaatcatcacagaagatgagctgacagctcaggatattaccgaatgtaactccaataaggaaaactccgagcagccccagtttcccggaaagagcaagaaacctagcagcaagggaaagaaaaaggaatcctgcagcaagcatgcctctgggacgagcttccacctgcctcagccatcatttcggatggtcgacagcggtatacaaccggagtag

SEQ ID NO: 11459 - DNA, 315 bp, Artificial Sequence
  Description of Artificial Sequence: Synthetic coding sequence
atgcgtgtcgtgaccatcgtgatcctcctgtgtttttgcaaagccgcagagttgaggaaagcttctcctgggagtgttagaagcagggtgaaccacggacgcgctgggggaggaagaaggggatctaacccagttaaacggtacgctcccggacttccatgcgatgtgtatacgtacctgcacgaaaagtatttggattgtcaggaaaggaagctcgtatacgtcctaccgggttggccccaagatttactacacatgctcctggccaggaataaaataaggactctgaaaaataatatgttctccaagttctag

SEQ ID NO: 11460 - DNA, 639 bp, Artificial Sequence
  Description of Artificial Sequence: Synthetic coding sequence
gactttgggtactgtcccagagtgtattgcgagaatcagcccatgttgccgatcggggttcttgttatggtcggcttcacagtcggaaaagtgccggtgcctgacattagaacctgtcatttttgcctggttgaggacccaagcgtggggtgcatctccggaagcgagaaatgcacaattagtagcagcagcctgtgcatggtgatcactatctattacgacgtcaaggtgcgctttatcgtgcggggttgcgggcagtacattagctacagatgccaagaaaaaaggaatacttatttcgcagaatattggtaccaggcccagtgttgtcaatacgattactgtaatagctggagctccccccagctgcagtccagtctccctgagcctcacgaccggcctttagccctgccactttctgattcacaaatccagtggttttatcaggctctgaacctctcgctgcctctgcctaactttcatgcaggaacagaacctgacggtctcgatccgatggtgaccctaagccttaacctggggctctcatttgccgaactgcgcagaatgtatctgttcttgaattcctccggacttctggtcctgccgcaggcagggctgcttaccccccatcctagttag

SEQ ID NO: 11461 - DNA, 1005 bp, Artificial Sequence
  Description of Artificial Sequence: Synthetic coding sequence
atgttagcactggccaaaattttacttatttccaccctgttttattctctgctctcaggatctcacggcaaagaaaaccaggacattaacactacccagaatatcgcagaggtattcaagaccatggaaaacaaaccgatttccctcgaatccgaagccaacctgaattccgacaaagagaatattaccacgagcaatttgaaggcctcccacagcccaccactcaatctgccgaacaattcacacggaatcaccgacttcagcagcaacagctccgcagagcattcacttgggtcactgaaacccacgagtacgattagcactagtcccccacttattcacagctttgtgtccaaggttccttggaatgccccaatcgccgatgaggatctattgcctatttctgctcatcccaacgccactccagccctcagctctgagaactttacgtggtccctggtgaacgacactgtcaaaacgcctgacaatagctctatcacagtttcaatactgagcagtgagcctacatctccatctgtcacaccgttgatcgtggagccaagcgggtggctgacgacaaactctgattccttcactggcttcacaccataccaggagaaaactactcttcaaccgacgctgaagttcaccaataatagtaaacttttcccaaatacaagcgatccccaaaaggaaaatagaaacactggtatcgtgttcggtgcaattctgggcgcaattctcggcgtttctttactaaccctcgtgggttacctcctgtgcggaaaacgaaaaaccgattcattctcacacaggcgcctctacgacgaccgcaacgagcccgtcctgagactggacaatgctccggaaccatatgatgtttctttcggtaatagctcgtattataatccgacactgaacgacagtgcaatgcctgagtcggaggaaaatgcccgtgatggcatacccatggacgacatccccccactgcgtacatctgtgtag

SEQ ID NO: 11462 - DNA, 987 bp, Artificial Sequence
  Description of Artificial Sequence: Synthetic coding sequence
atgggcccagctggctgcgcatttacgctgttgctcttactcggcatctcggtgtgcggacagccagtatatagctctcgcgttgtgggaggccaagatgccgctgctggacggtggccctggcaagtctcccttcactttgatcacaacttcatctgtggtgggtctttggtcagcgagaggttgattctcacggctgcgcactgcatccagcctacctggactaccttcagctacaccgtgtggcttgggagcattacagtcggagattctagaaagcgggtgaaatactacgtatctaagattgtgatacacccaaagtatcaagatacgaccgctgatgtggccctgctgaagctgagcagtcaagtgacatttaccagtgcaattctgcccatttgtctgccctcggtgacaaagcagctcgcaattccacccttctgctgggtgacaggatgggggaaagtcaaggagtctagcgacagagattaccactcagctctccaggaagccgaagtgccaataatagacaggcaggcttgcgagcagctgtacaaccctattgggatcttcctgccggctctggagcccgtgatcaaggaggacaagatttgcgctggggatacccagaatatgaaagattcctgtaaaggtgactcagggggaccactgagctgtcacatagacggggtctggatacaaacaggcgttgtctcctggggcctggaatgcggcaaatccctgccaggagtgtacactaatgtgatatattatcagaagtggattaacgccacgattagccgcgcaaataacctggatttcagtgacttcctctttccaattgtcttgctcagtctcgccctgcttagacccagctgtgccttcggacccaacaccatccatagagtaggaaccgtagccgaagcggtggcctgtatccagggctgggaagaaaacgcatggcgcttcagtccccgagggagatag

SEQ ID NO: 11463 - DNA, 453 bp, Artificial Sequence
  Description of Artificial Sequence: Synthetic coding sequence
atgaggttcatggccggtcctgctgggtcccaatccttaggtcccctttgctttcacagctctccacaagctctctatacagtgctgctgatcgttcttgtcatgatgtctcttgtcttcggcaagttcgtgcctgtgaactgggagccccctcagcctctgcctttccccaaatatcttaggtgttatagatgccttctggaaacaaaggagctgggttgtctcttggggtcggatatttgtcttacaccagcagggagctcatgtattacactgcacaaaaagaattccagtggttccgatgtgatggtgtcagactgtagatctaaggagcagatgagcgattgcagcaacacgagaacgtcccccgtgtccgggttttggatcttttcacagtattgcttcctggacttttgtaacgacccccagaacaggggcctgtatactccctag

SEQ ID NO: 11464 - DNA, 234 bp, Artificial Sequence
  Description of Artificial Sequence: Synthetic coding sequence
atgagagtagcaggtgcagccaagctggtggtggcagttgccgtattcctcctgacattctatgtgatatctcaggtgtttgagatcaaaatggatgccagtctggggaacctgttcgcccgtagcgcgctggataccgctgctcgttccacaaagcctccacgatacaagtgtggtatcagcaaggcctgtcctgaaaagcactttgcgttcaagatggctagcggtgcttag

SEQ ID NO: 11465 - DNA, 1143 bp, Artificial Sequence
  Description of Artificial Sequence: Synthetic coding sequence
atggctctgacaccgggatggggatcatctgcaggcccagtaagacccgagctttggctgctgctgtgggccgctgcctggcgcttgggcgcatcagcatgccctgctctgtgcacatgtaccggcacgaccgtagattgccacggcacaggccttcaggccatccccaagaacataccgcgtaacaccgagcggctggaacttaacggcaacaacattaccagaattcacaaaaatgatttcgcagggcttaagcagttacgggtgctccagctcatggaaaatcaaatcggagcagtggagagaggcgcattcgatgacatgaaggaactggagcggctggatctgtccgagaatgccatccaagctataccgaggaaggccttccggggagccaccgatttaaaaaacctccagctagacaagaatcagattagctgtattgaagaaggagccttccgggctctgcgcggattggaggtgctgaccctcaataacaacaatatcaccacaatcccagtcagttcattcaaccatatgcccaagctgcggactttcaggctgcactccaatcacctcttttgtgattgccacctggcttggctgtcccagtggttgcgccagaggccaacgatcggtctgtttactcagtgctcaggacccgcatccctccgcggattgaatgtggccgaagtgcagaagtctgaattcagttgctctggtcagggagaagccggacgcgtccctacctgtaccctgtctagtgggtcatgccctgccatgtgcacctgcagcaatggcattgtggactgcaggggtaagggcctgactgccattcccgcaaacctcccagagaccatgaccgaaataagattagaactcaatgggattaagtccatcccacctggggcttttagtccatacagaaagttgcggaggatcgatctctccaataaccagatcgctgagatagccccagatgccttccaggggctgagatctctcaacagtttagtgctttatgggaacaagattaccgatcttcccaggggggtgtttggaggcctgtacaccctccagctcctactgctcaatgcaaacaaaattaattgcattcgaccggatgcctttcaggacttgtag

SEQ ID NO: 11466 - DNA, 558 bp, Artificial Sequence
  Description of Artificial Sequence: Synthetic coding sequence
atgccagggtggctcactctacccactctttgccgctttcttctgtgggcttttacaatattccacaaagcacagggggaccccgcttcacacccgggtccccactacctgctcccacccatccacgaagtgatccactcacaccggggtgccaccgccacccttccatgtgtcctgggcaccactccacccagctacaaggttaggtggagtaaagtagaaccaggcgagttaagagagacccttatccttatcactaacggactgcacgccaggggctatggtccattgggcggtcgcgcacggatgcgacgtggtcaccgcctagatgcgtcattggtgatcgctggtgtgaggcttgaggatgaaggccgatatcgctgcgagttaattaatggtatcgaagatgagagcgttgctctgacactttcgcttgaaggagtggtctttccgtatcaaccaagtcgcggtaggtaccagtttaactattacgaggccaaacaggcatgcgaagagcaggacgggcgtctcgccacatattcgcagctttaccagtag

SEQ ID NO: 11467 - DNA, 375 bp, Artificial Sequence
  Description of Artificial Sequence: Synthetic coding sequence
atgctcatgcttttcgtgttcggcgttctgctgcacgaagtgtcactgagtgggcagaatgaagcccctcccaacacacattccatccccggagagcccctgtacaattatgcctcaatccgactgcctgaggaacatatcccattttttctccacaataacaggcatattgccacagtttgcaggaaggattcactctgtccctataaaaaacacttggagaaactgaagtattgctggggctatgaaaagtcatgtaagccagagtttagattcgggtatccagtctgtagctacgtggacatggggtggaccgataccctcgagagtgccgaggacatcttctggaagcaagcagatttcggctacgcgtag

SEQ ID NO: 11468 - DNA, 5858 bp, Artificial Sequence
  Description of Artificial Sequence: Synthetic coding sequence
atgcctgccctgggccctgccctgctgcaggctttatgggccggatgggttctgacactgcagcctttacctccaaccgccttcaccccgaatggcacatatctacagcacctcgctagagacccaacctccgggacgctatatttgggcgctacaaatttcctttttcagttgtcacccggtttgcaactggaggccacagtaagcacaggccctgtgcttgacagtcgggactgtctccccccagtcatgcctgatgagtgtccacaggctcagcccactaacaatcccaaccagctcctcctcgtcagccccggtgcactcgtcgtgtgtggctcggttcatcagggcgtgtgcgaacagcgcaggttaggtcagctggagcagcttctgctgaggccagagcgcccaggagatactcagtacgtggccgcaaacgaccctgccgtgtccactgtcggtcttgtggcacagggactggctggggaacctctgctgtttgtaggaagaggttacacatcccgtggagttggagggggaattcctcccatcaccacccgggcactttggcctccagacccccaagccgcattctcctacgaggagacagcaaagctggccgttggcagattgtctgagtacagtcatcatttcgtgtcggctttcgctagaggagcctcagcgtacttcctcttcctccgcagagatttacaggcccaatctcgcgcattccgagcctacgtaagtcgggtgtgtctgcgcgaccagcactactatagttatgttgaactgcctctggcctgtgaagggggaaggtacggtctgatacaggctgcggcagtggctacgtccagggaggtggctcatggtgaagtgttatttgcagcattctcttccgccgctccccctacagtaggacgccctccaagtgccgctgcgggagctagcggagcgtctgccctttgtgcatttccactcgacgaggtggataggctggccaatcggacccgcgacgcctgttatactagagaaggtagggctgaggatggtacagaggtggcttatattgaatatgatgtgaattcagattgcgcacaattgcctgtggatacactggacgcatacccttgcggatctgatcatacacctagccccatggccagccgcgtccctctggaggcaacaccaattctggaatggcctggaatccaattgacggcagttgcggtgaccatggaagatggacacactatcgccttccttggagacagccagggacagctgcatcgcgtgtacctggggccagggtcagacggccacccctacagtactcagagcattcagcagggctcagcggtgtcccgggatctgacttttgatggaacctttgaacatctatacgtgatgacacaatccaccctgcttaaggtccccgttgcttcctgtgctcagcacttggactgtgccagttgtcttgcccaccgcgatccctactgcggttggtgtgttttgctgggtcgctgctctagacgatccgaatgttccagagggcagggccctgagcagtggctctggtcatttcagcctgagcttggctgtctgcaggtcgctgcgatgtctcctgccaatatatcccgggaggaaacaagggaagtgttcctgagcgtacctgacctcccaccactctggccgggagaatcttacagctgccactttggtgagcaccagtcccctgcgctcctgacagggtcaggagttatgtgcccaagtccagacccttcggaggcacctgttctgcccagaggagcggattatgtaagcgtgtccgtcgagctacggtttggcgctgtcgttatagctaaaacctcgctgtcattttacgattgcgtggccgtcaccgaactcagaccaagtgcccagtgtcaggcctgcgtctcgtccaggtggggttgtaactggtgcgtctggcagcacctgtgcactcacaaagcttcctgtgacgctggaccaatggtggcttcacaccagagcccccttgtctcccctgatcctcctgcgcgaggtgacggcgattccgctgaactcgaggggcctccggctccccttattctgcccagcagcctggactatcagtacgatacgcctggcctctgggaactggaagaggccaccctcggagctagctcctgtccctgtgtggagtctgtgcagggatcaaccctgatgccagtccacgtggaaagagagatcaggcttctggggagaaacctgcatctattccaggacggcccaggggataatgagtgcgtgatggaactcgaagggctggaggtagtggtggaggcaagggtcgagtgtgagcctccacccgacactcaatgccatgtcacttgtcagcaacaccagctgagctacgaggccctccaacctgaattgagggtggggttatttctacgtcgtgcaggtcgcctccgcgtcgatagtgccgagggactgcatgtagttttatatgattgttctgtgggccatggcgactgctccagatgtcagaccgccatgccacagtatggatgtgtctggtgtgagggcgagcgcccaagatgcgtgaccagagaggcgtgtggtgaggctgaggctgttgctacccagtgtccagctccgcttattcattcagtcgaacctctgaccgggccagtcgatggcggaacaagagtaactataagaggcagcaacctaggccaacacgtacaagacgttttgggtatggtcactgtggccggagtgccttgtgccgtggacgctcaggagtatgaggtgagtagcagtctggtttgtataaccggggcttcaggggaggaagtggcaggcgcaacagcagtggaagtgccaggacgaggccgtggcgtttctgagcacgacttcgcctaccaagatcccaaagtacactctatctttcccgcacggggtccaagagcaggaggtactagactgacgctgaatggcagcaagctcttgacaggcaggttggaggatatccgcgtggtggtgggggatcagccatgtcatcttctacccgaacagcagtccgagcagttgcggtgtgaaacgagccccaggcccactccagctacactgccagtggcagtctggttcggcgctaccgagaggcgtttgcagcggggtcagttcaaatataccttggatcccaatattacaagcgccggtcctacgaaatcttttctttcagggggaagggagatctgcgtccgaggacagaacctggatgtcgttcagacacctcggatacgggtgaccgtcgtatcccgaatgttacaaccttcccagggtttgggtcgcagacggcgagtcgttcctgagacggcgtgcagcctcggcccatcctgtagctctcagcagttcgaagagccttgtcatgtcaactcctcccaacttatcacctgtcgcaccccagccctgcccggtctgccagaggacccatgggttagggtcgagttcattctggacaatcttgtgttcgactttgctaccctgaaccccacaccttttagttatgaggctgaccccactctacagcctctgaaccccgaagaccccaccatgccttttaggcacaagccgggaagtgttttttccgtggagggtgaaaacctcgatctggccatgtctaaggaagaagttgtcgcaatgataggagacgggccatgtgtggtgaaaactctaacccgccaccatctgtactgtgaacctccagttgaacaacccctgcctcgccaccatgccttgagagaggcgcctgactccctgccggagttcacagtgcagatgggtaatctccggttcagccttgggcatgtgcagtacgatggtgagtccccaggagcttttccagtggcagcgcaagtggggctgggcgtcggcacctcacttcttgctcttggcgtcatcatcatcgtgctcatgtaccgacgcaaaagcaaacaggctttgcgtgattacaaaaaggtgcagattcagctggagaaccttgagtcaagcgttagagatcggtgcaagaaagagtttacagacttgatgaccgaaatgacagacctgactagcgacttgctgggtagcgggattccattcctggattacaaagtttatgcggagcgcatcttcttcccaggacaccgggagtctcctctgcacagagacttaggagtgcctgagtctcgcagacctactgtggagcagggcttgggccagctttcaaatttactgaatagcaaactattcctgaccaagtttatccacacgttggaatcccagcggactttcagtgccagagacagggcttatgtcgcctctctgttgaccgtggctctgcatgggaagttggagtactttaccgatattcttaggacgcttctgagcgatctggtcgctcagtatgtggcaaaaaatccgaagctaatgctgagaagaacagagacagttgtggagaagcttctcacaaattggatgagtatttgtctatacacattcgtaagggattccgtcggcgagcctctatatatgctcttccgaggaatcaagcatcaggtcgataaagggccagtagatagtgtaactggcaaggcaaagtacactttgaatgacaaccggcttttgagggaagatgtggaatacaggccactgacactgaatgcgctgttggccgtcggcccaggagctggtgaggcacagggcgtccctgtgaaggtacttgattgtgataccattagccaggctaaagaaaaaatgcttgatcagctgtataagggagtacccctgactcagcgccctgatccgcgaaccctagacgttgaatggcggtctggggttgcaggccatttgattttaagcgatgaagatgtgaccagcgaagtgcagggactgtggcgtagactcaatacactacaacattacaaggtgccagatggggcaacggtggcactcgtgccttgtctgacaaaacacgttctgcgggagaaccaggactatgtcccgggagagcgtactcccatgctggaggatgtggacgaggggggaatccggccttggcacctggtaaaacccagtgatgagcctgagcccccaagaccgagacgcggatcactaaggggcggagaaagagagcgcgcaaaagccattccggagatctacctcacccggctgctgtcaatgaaagggactctgcagaaattcgtggacgacttgttccaggtgattctatccacctcccgccctgtgcctttagcagtaaagtatttctttgatctccttgacgaacaagctcaacaacacggcatcagcgaccaagatactatccacatttggaagacaaattcgctgccactaaggttctggataaatataatcaaaaatcctcagtttgtgtttgatgttcagacctccgacaacatggatgctgtgctgctcgtgattgctcagacatttatggatgcttgcacgctcgctgaccacaagctaggtcgggattccccaatcaacaaactcctgtatgcacgcgacatcccgcgatataagaggatggtcgagcgctactatgccgacatcaggcaaaccgtgcctgcgagtgaccaggagatgaacagcgtgctggcagagctgtcatggaactattcgggcgatctgggggctcgggtggctttacacgagttgtataaatatatcaacaaatattacgatcagataattacggccctggaggaggatgggacagcccagaaaatgcaactcgggtacagactgcagcagatagcagccgctgtggagaacaaggtgacagatctgta

SEQ ID NO: 11469 - DNA, 612 bp, Artificial Sequence
  Description of Artificial Sequence: Synthetic coding sequence
atgagaacggtggtgctgaccatgaaggcttcagtgatcgaaatgttcttagtcctgctggtgactggagtgcatagcaacaaagagactgcgaaaaaaatcaaaaggcctaaattcacggttccacagatcaactgcgacgtcaaagctgggaaaataatcgatcccgagttcatcgtgaagtgcccagcaggatgtcaggatcccaagtaccacgtctatggaaccgatgtctacgcatcctatagcagtgtgtgtggtgcggcagtgcattccggtgtgctagataattccgggggaaagattctcgttaggaaggtggccggtcagagcgggtataaaggctcttattcaaacggtgtgcagtcccttagcctgccgaggtggagagagagcttcatcgtgttggagagcaagcccaagaaaggagtgacatatccctcagccctgacatattcctcctctaagagcccagccgcacaagccggtaaatgctcccgcgtgatcgaatctaaaccgtcggaatccatgaatactcgacgtgttttgggcgattctggagagatcaatatcctaactgggcaggccccactggccctagccattttttag

SEQ ID NO: 11470 - DNA, 2511 bp, Artificial Sequence
  Description of Artificial Sequence: Synthetic coding sequence
atggaaactcaggagctgcgaggagcactcgccctgctcctcctctgcttttttacgagcgctagtcaggatttacaggtgattgatctccttacagttggtgagtcaagacagatggtggcagtcgcagaaaaaattaggaccgccctcctcaccgcgggagacatctacctcctttccacattcaggcttcctcctaagcagggcggagtcctatttggattgtattcgaggcaagataacacccgatggttggaggcttcagtggtaggaaagatcaacaaggttactaatgcacttcacagcattttgggtgagcagactaaagctcttgtgacacagcttactctgtttaaccagattctcgtggagttgcgagatgatatcagggatcaggtcaaagaaatgagtctcattaggaacactattatggagtgccaggtttgcggttttcacgaacaacgctcccactgttcgccaaatccctgcttcagaggcgtggactgcatggaagtttatgagtatcccggttacaggtgtggcccttgcccccctggtctgcaaggcaatggtacacactgtagtgatatcaatgagtgtgcccacgccgacccatgcttcccgggttctagctgtatcaataccatgcccggttttcactgcgaggcatgcccacgcggatacaaaggcacacaggtgtccggggttggcatagactatgctagggccagtaagcaggtatgtaacgatatagacgaatgcaatgacgggaataacggaggttgtgatcctaatagcatttgtacaaacaccgttggctccttcaagtgcggcccttgtcggttgggcttcctcggaaatcagtcccagggttgtctccctgcccgtacttgtcatagcccggctcacagcccctgccacatccacgcccactgtttgtttgaacgaaatggcgcagtgtcttgccagtgtaacgtggggtgggctgggaatggaaacgtgtgtgggacggacacagacattgacggataccccgaccaggctctcccgtgtatggataacaacaaacactgtaaacaagacaattgtttactcacaccaaacagcggccaagaagatgcagacaatgacggggtgggggaccagtgtgacgacgatgcagatggcgatggcatcaagaatgtggaggacaattgccgcttgtttcctaacaaagaccaacagaactctgacactgattcattcggcgatgcctgtgacaattgcccaaacgtcccgaacaatgaccagaaggacaccgatggaaatggagaaggcgacgcctgtgataatgacgtggatggggatggaattcctaatggactcgataactgcccgaaggtccccaaccctctgcagaccgacagagacgaggatggagtcggcgatgcatgcgacagctgtccagaaatgtcaaacccgactcagactgatgcggacagcgaccttgtgggggatgtttgtgacacgaatgaggactctgacggagatggccaccaagacaccaaagacaactgccctcagctgcctaattcatcacagctggatagtgacaatgacggcctcggcgacgaatgcgatggcgacgacgacaatgacggcatcccagattatgtcccacccggtcccgataactgtaggctagtgcccaacccaaatcagaaagacagtgacgggaacggggtaggcgacgtatgcgaagatgactttgataacgatgctgtggtggacccgcttgacgtatgccctgagtcagctgaagtcactctaaccgacttcagggcgtaccaaacggtcgtgttggaccctgaaggagacgctcagatagacccgaactgggtggtgctgaaccagggcatggagatcgtgcagacaatgaactccgatccgggtttggctgtgggatataccgctttcaatggagtagacttcgaaggcacttttcatgtgaacaccgtgactgatgatgattatgctggcttcctgtttagttaccaagactcaggccgtttttatgtggttatgtggaaacagacagagcagacctattggcaggccacaccattccgggcagtggcccagccaggcctgcagttgaaggcggtgacaagtgtatccggcccaggggagcacctgaggaacgccctctggcacaccggacatacccctgaccaggtcaggctcctgtggacggaccctcgaaacgtggggtggcgggataagacatcctatcgttggcagctgctgcacaggccacaggttggatatatcagggtaaaactatatgagggcccacagcttgtggcagacagcggcgtgatcattgacactagcatgcgaggcggaagattaggggttttctgtttcagccaggaaaacattatttggagtaacctgcagtacaggtgcaatgataccgtccctgaggacttcgaaccttttcgcagacagttgcttcaggggcgtgtatag

SEQ ID NO: 11471 - DNA, 1311 bp, Artificial Sequence
  Description of Artificial Sequence: Synthetic coding sequence
atgtggagatgtcccttaggattactgctcttgctgcctctggctgggcatcttgcactgggcgctcaacagggtcgtggcagaagagagctggccccagggctgcatctgcggggaatcagagacgctggcggtagatactgccaggagcaggacctgtgctgtagaggcagagcagacgactgtgccctgccttacctgggtgccatctgctactgtgatctgttctgtaaccgtacagtaagtgactgctgccctgacttctgggatttctgtcttggggtgcctcctccctttccgcctattcagggctgcatgcacggaggaaggatttacccggttctgggcacctactgggataattgcaatagatgctggcaagcaggcaaccactctgccttctgggggatgactcttgatgagggcatcagataccgcctcggcacaattagaccctccagctctgtgatgaacatgcacgaaatctacaccgtgctgaacccgggagaggtactcccaacagcctttgaggcctcggaaaagtggcccaatctaatacacgagcctctcgatcaggggaattgtgctggctcctgggctttctcaaccgctgccgtcgccagtgatagggtctccatccacagtttaggacacatgactccagtgctctccccccaaaatctgctttcttgcgacactcaccagcagcagggttgtagggggggacgtctggacggagcatggtggtttcttcgtcgcagaggcgtggtcagcgatcactgttacccattcagtgggagagagcgggacgaggccggaccagctccaccttgcatgatgcactctcgagcaatgggacgcggtaagcgtcaggcaactgcccactgtcctaacagttacgtcaataataacgatatctatcaggtgacccctgtgtaccgtctcggcagcaacgacaaggagatcatgaaagaactcatggagaatggtcctgttcaggccctgatggaggtccatgaagacttctttctgtacaagggaggcatttactcacacacaccggtgagcctggggagacccgagaggtacaggcgccatggcactcacagcgtgaagattactgggtggggcgaagaaacattacctgatggacgtaccttgaagtactggacagccgctaattcctgggggcctgcgtggggggagcggggacactttcggattgtacgcggagtcaacgaatgcgatattgagagctttgtcctgggcgtgtggggtagggttggcatggaggacatgggtcaccattag

SEQ ID NO: 11472 - DNA, 942 bp, Artificial Sequence
  Description of Artificial Sequence: Synthetic coding sequence
atgtcggacctacttctcctgggcctgatcgggggactgactctcctccttcttctgaccttgttggcttttgctggctactctggtctcctggctggcgttgaagtctcagcgggttccccccctattcgtaacgtaaccgtcgcttataagttccatatgggcttgtacggtgagaccggacgtctgtttaccgagagctgtagcataagtcctaaactgaggagtatcgctgtttactatgataacccacacatggtgccaccggataaatgtagatgtgctgtggggtccatcctcagcgagggggaggagtccccttccccggagctcattgatctttatcaaaaattcggtttcaaggttttctccttccctgctccttcccacgtggtgaccgctacgttcccctacacaaccatcctgtcaatctggcttgcaacccggagggtgcatcccgcactcgacacatatatcaaggaacgaaaattatgtgcgtatccccgactcgagatctaccaggaggaccaaattcatttcatgtgtcctctcgcacggcagggcgatttctacgtccctgagatgaaggagactgagtggaagtggcggggtttggtggaggcaatcgacactcaagtggatgggaccggagctgacacaatgtccgatacatcatccgtctcgctggaagtaagccctgggtccagagagaccagcgctgcaaccctgagtccaggggcttccagtagaggctgggacgacggggacaccaggtccgagcatagctactctgagtctggagcatcagggtctagctttgaagaactggaccttgagggagagggccctctgggcgagtctaggcttgaccctggaacagagcctttgggaaccaccaaatggttgtgggagcccacagccccagagaaagggaaagaatag

SEQ ID NO: 11473 - DNA, 213 bp, Artificial Sequence
  Description of Artificial Sequence: Synthetic coding sequence
atggttgccccagccgcacgtgtgttcttaagggcagtccgggctgctctgacctctactgtacctgatctgctctgtctcctggccagaggtagtccacgcggattagcatccgggcgtctgccccttgccgtgcacagcgctcagcatggacccggttctggggcaccatggctgcggattgccagacgagcactctcccagcgtatctag

SEQ ID NO: 11474 - DNA, 642 bp, Artificial Sequence
  Description of Artificial Sequence: Synthetic coding sequence
atggcccaactgttccttccactactcgccgcactggttctggcccaagccccagctgccctcgccgacgttttagagggcgatagctcggaagaccgagcgttccgtgtgagaatcgcaggagacgcaccactgcagggagttctgggtggggcactaaccatcccttgtcacgtccactacctcagacctcccccttcgcggagggctgttctggggtccccaagggttaagtggacctttctgagcagggggcgagaagctgaagtgctcgtggccaggggtgtgcgagttaaggtgaatgaagcgtatcgttttcgggtcgccctgcccgcatatccagcgagtctgactgacgtgtcactggcattgtctgaattgcggccaaatgactctgggatctaccgctgcgaagtccaacacgggatagacgacagttcagatgctgtggaagtgaaggtaaaaggggtcgtgttcctttatcgcgaaggctcagcgaggtatgccttttcatttagtggtgcccaagaagcgtgtgcaaggatcggggcacatatagcaacccccgagcagctgtacgcggcttatctaggtggctatgagcaatgcgatgcgggatggctgtcagaccaaactgtgtag

SEQ ID NO: 11475 - DNA, 237 bp, Artificial Sequence
  Description of Artificial Sequence: Synthetic coding sequence
atgggatctggactgcccctggtgcttcttttgaccctcttaggatctagtcatggaactggccctgggatgacactgcaactaaaattgaaagagtctttcctgactaacagttcttacgagtcatcattcttggagctcctggagaaactgtgtttactcctccatctgcctagcgggacatccgtgaccttacatcatgccaggtcacagcaccatgtcgtgtgtaatacctag

SEQ ID NO: 11476 - DNA, 651 bp, Artificial Sequence
  Description of Artificial Sequence: Synthetic coding sequence
atgagcgatctacttctgctcggtcttatcggtggactgaccttgctgttgctattaactctgcttgcctttgcaggatacagcggcttacttgccggagttgaagtctcggccggttcgcctcccataaggaacgtaaccgtcgcctacaaatttcatatgggactctacggggaaaccggccgactgttcactgaatcttgtagcatctcacctaaattaaggtccatcgccgtgtactatgacaatccccatatggtgccccctgataagtgtcgatgtgccgttggttcaattcttagcgagggagaggagagtcccagtccagaactgattgatttatatcaaaagttcggatttaaggtgttctctttcccggcaccgagccatgtggtgactgcaactttcccttataccacaatactgagcatctggctggccaccaggagagttcaccccgcacttgatacatacattaaggagagaaaactatgtgcctatcccaggttggaaatctaccaggaagaccagattcatttcatgtgtccacttgctcgccagggggacttttatgttccagagatgaaggaaaccgaatggaagtggcgaggcctagtggaggccattgatacccaggtggacggaacctag

SEQ ID NO: 11477 - DNA, 453 bp, Artificial Sequence
  Description of Artificial Sequence: Synthetic coding sequence
atgcgatttatggccggtccggctggatctcagtctttggggccactgtgcttccactctagtccacaggccctgtataccgttctgctgatagtactggtcatgatgtccctcgtgttcggtaaattcgttcctgtgaattgggagcccccacagcctttgcccttcccgaaatatctaaggtgttaccgatgtcttcttgagacaaaggagttagggtgtctgttgggatcggacatctgtctcacccccgcaggatcatcctgtatcactctgcacaaaaaaaatagcagtggctccgacgtgatggtttccgattgccggtccaaagagcagatgagcgattgtagcaatacccgtacaagtcctgtctcaggcttttggatattttctcaatactgcttcttagacttttgtaatgacccccaaaataggggtttgtatacaccctag

SEQ ID NO: 11478 - DNA, 171 bp, Artificial Sequence
  Description of Artificial Sequence: Synthetic coding sequence
atgaaaacaggcttattctttctgtgcctcctggggaccgcggcagcaatcccaaccaacgccaggcttctctctgaccacagcaaaccaaccgctgaaacagtggccccagacaacacagcgatcccatcgcttcgggcagaggccgaagagaatgagaaagagacatag

SEQ ID NO: 11479 - DNA, 2346 bp, Artificial Sequence
  Description of Artificial Sequence: Synthetic coding sequence
atggccgttgcagaagtcagccgcacttgcctccttacagtgcgggtcctgcaggcccaccgattgccaagtaaggatctggtcaccccttcagactgttacgtgaccttatggcttccaactgcatgtagtcataggctgcagacgagaacggtgaaaaactcgtctagtcctgtctggaatcagtccttccacttccggatccaccgacagctcaaaaacgttatggagctcaaagtattcgaccaggacctggttactggagacgatcccgtgctctcagtcctcttcgatgccggaaccctgcgagccggtgagtttcgccgagagtcattttctttgagccctcagggagagggccgtctcgaggtggagtttcgcttacagtccttggccgaccggggagaatggctagtgtcaaacggagtactggtggcaagggaattgtcgtgcctccatgtccagctcgaggaaactggcgaccagaagtcgagcgaacaccgggttcaactggtggtgcctgggagttgtgaaggcccacaggaggcctctgtgggaacggggaccttccggtttcactgtcctgcatgctgggagcaggagctatcaatcagattgcaggatgcgcctgaagaacagctgaaagcccctctcagcgccctaccgtctgggcaagtcgtcagactggtcttccccacctcccaagagcccttgatgcgagttgaactgaaaaaggaggctggattgagggaactcgcggtgcggcttgggtttggaccatgtgcagaggagcaagcatttctctcccggaggaagcaagttgtggctgcagctctgaggcaagccttgcagttggacggggaccttcaagaggatgaaattccagtggtggctattatggccacggggggagggattagagcaatgacaagtctgtatggacagcttgcaggccttaaagagctgggattactggattgcgtgtcatacataacgggggcatctggcagtacttgggcactagcaaacctgtatgaagaccctgaatggtctcagaaggaccttgccggtcccacagaactgttgaaaacccaggtcacgaaaaataagctcggcgtgctcgccccatcgcagctgcagcgctataggcaagagcttgctgagcgagcacgcttaggctacccatcatgcttcacaaacctgtgggctctcattaacgaggcccttctgcatgatgagccacatgatcacaagcttagcgatcagcgagaggccctctcccacggacaaaatccccttcccatctactgtgcactgaataccaagggacagtctctcactacttttgaatttggcgaatggtgcgagttcagtccatatgaagtgggcttccccaaatatggcgcatttatcccttccgaactcttcggtagcgagttctttatggggcagctgatgaaaaggcttcctgaaagtcgcatatgctttttggagggtatttggtccaatttgtacgctgccaatctccaggactccctatattgggcttcagagccttcccagttctgggaccgctgggtaaggaaccaggccaatctggataaggagcaggtccctctcctgaagattgaggaaccaccgtccactgccggacggatagccgaattcttcactgaccttttgacttggagacccctcgctcaggcaacgcacaactttctgagaggtcttcactttcacaaagactatttccagcatccacatttctccacctggaaagctaccaccctggatggcctacccaaccagctgaccccatcagaaccccatctgtgtttacttgatgtgggctacttaattaacacatcatgcctcccccttctgcagcccaccagagacgtagacctcattttaagcctggactataatctgcatggtgccttccaacagcttcagctcttgggcagattctgtcaggagcaggggatcccatttcctcctatctcaccctcccccgaggagcagcttcagcctagagaatgtcacaccttctccgatccaacatgccccggtgcacccgcagtgctgcatttccctctggtatccgactcattccgggagtattcggctccaggggtacggaggaccccagaggaggccgctgccggtgaagtgaatctgtcctcatcggatagcccttaccattacacgaaagttacctacagccaagaggatgtggataaactacttcacctaacccactacaatgtgtgcaacaaccaggagcagctgttggaagctctgaggcaggctgtccagcgcagacgccagagaagaccgcactag

SEQ ID NO: 11480 - DNA, 219 bp, Artificial Sequence
  Description of Artificial Sequence: Synthetic coding sequence
atggcagcagccacacgtggctgcaggccttggggctcccttctcggccttctggggctagtgagcgccgcagcagccgcttgggatctggcgagcctcaggtgtacgctgggagcattctgtgaatgtgacttcagacccgatctgccagagggttccgaggagttgggacctcgcgaaccccactgtctgtggcccttgccactgcccctccgttag

SEQ ID NO: 11481 - DNA, 243 bp, Artificial Sequence
  Description of Artificial Sequence: Synthetic coding sequence
atgaaagttttcttcctctttgccgttctcttttgtctggtccagacaaacagtggagacgtgcccccaggaattcgcaataccatttgccacatgcagcagggaatttgtaggctgtttttctgtcattccggggagaagaagcgtgatatctgtagcgatccatggaatcggtgttgcgttagcaacactgatgaagaagggaaggagaagccagaaatggacgggagaagcgggatttag

SEQ ID NO: 11482 - DNA, 861 bp, Artificial Sequence
  Description of Artificial Sequence: Synthetic coding sequence
atgggtccagaagccctcagctctctgcttctgttactcctagtggcctctggggacgccgacatgaaaggccattttgatccagcaaaatgtcgctacgctttaggaatgcaagatagaaccattcctgacagtgacatcagcgcgtcttcgtcttggtcagactcgactgccgcacgtcacagtcgcctcgaatcaagcgatggagacggggcatggtgcccggctggctccgtgtttcctaaggaagaagaatacctccaggtggatctgcagcgactacacttggttgcactggtgggaacccaaggacgtcacgctgggggtctggggaaagaattctccagaagttaccgccttcgctactcccgggatggacgcaggtggatgggctggaaagaccggtggggccaggaggtcatatcgggtaacgaggacccagagggcgtggtgcttaaggacctcggtcccccaatggttgcccgattggtaaggttctatccacgggcagacagagtgatgagtgtgtgcctccgcgttgagctgtatggatgcctgtggcgggatggcctcctgtcttataccgcgccagtaggacagacaatgtacctctccgaagccgtgtatctcaatgactccacttacgacggccacacagtgggaggattacagtatggcggactgggccaactggccgatggagtagttggtctggatgatttccggaagagccaagagctgcgtgtttggcctggctacgattatgtgggctggtccaatcactcgttcagcagcgggtatgtggagatggaattcgagttcgatcggctaagggcctttcaggccatgcaggttcactag

SEQ ID NO: 11483 - DNA, 858 bp, Artificial Sequence
  Description of Artificial Sequence: Synthetic coding sequence
atgcgaggacaggggaggaaggaatccctcagcgacagtagggatctcgacggctcatacgatcaactgaccggacatcctccaggccctaccaagaaggccctgaagcagcggtttttgaagctgttgccgtgctgcggccctcaggctcttccctctgtgagcgaaatcggacgcgtcttccggtttctgggcgattcttctttgcctagtgccctggccgctcctgccagcctgaggccccacaggcccaggcttttggaccctgattccgtggacgacgaatttgaactgtccaccgtttgtcatcgaccagaaggcctcgagcaattacaggaacagaccaagttcacgaggaaagagctgcaggtcctttataggggatttaaaaacgaatgtccaagcggcattgtaaacgaagagaattttaagcaaatctactctcagttcttccctcagggagatagctccacatacgctacgttcctgttcaatgcattcgatacaaaccatgatgggtctgtgagcttcgaagatttcgtcgcagggctgagtgtaattctgcgagggacagtcgatgaccgccttaattgggctttcaacctgtacgacctgaacaaggatggatgtattacaaaggaggagatgttggacataatgaaaagcatatacgatatgatgggcaaatacacctatccagctctccgcgaggaagccccacgagaacacgtggagtccttcttccagaagatggaccggaataaggatggcgtcgttaccatagaagagttcatcgagtcatgtcagaaggacgaaaacatcatgcggtcaatgcagttattcgataacgtcatttag

SEQ ID NO: 11484 - DNA, 1311 bp, Artificial Sequence
  Description of Artificial Sequence: Synthetic coding sequence
atgcaaggtacccctggtgggggtacgcgcccagggccttctcccgtcgaccgcaggacactgctggtgttctcgttcatactggctgcagctctagggcagatgaacttcaccggggatcaggttctacgtgtccttgccaaagacgagaaacagttatcccttctgggagatcttgaggggctgaagccgcaaaaagtcgacttctggaggggccctgcaagaccctccctcccggtcgatatgcgcgttcccttctcagagttgaaagatataaaggcatacctggaatcccatggacttgcatatagtataatgatcaaggacatccaggttctgctggatgaggagcgacaggcaatggccaaaagcagacgtctggaaaggagcaccaactctttctcttattcttcttaccacaccttagaagaaatctatagttggattgataactttgtgatggagcattccgatattgtttctaagatccagatcggaaacagttttgagaaccagtccatactggtgctcaagttcagcacaggtggttccagacaccccgcaatttggatcgacaccggaatccactcacgcgagtggataactcatgccacaggaatctggactgccaataagatcgtttccgattatggaaaggatcgagtgcttacagatatcctgaatgcaatggatatttttattgaacttgttacaaatccagacgggttcgcctttactcattccatgaatcgtctgtggagaaaaaacaagtcaatcaggccaggcatcttttgcattggcgtggatctgaatcgcaattggaagagtggcttcggaggcaatggctctaatagtaacccctgtagcgagacttaccacgggcctagcccacagtccgagcccgaggtggccgctatcgtgaacttcatcaccgctcacggcaattttaaagctcttatctctatccactcttactcccagatgctcatgtacccatacgggagactgcttgaacctgtgtcaaaccagcgggagctttacgatctggcaaaagatgcggtcgaagcgctctataaagtgcacgggatagaatatattttcgggagcatttccaccaccctgtatgtcgcctctggaattacagttgactgggcttatgactcaggcatcaagtatgcatttagctttgagctgcgggacaccgggcagtatggattcctgctccctgcaacacagattattccgactgcacaggagacatggatggcgctgcgcaccattatggagcataccttaaatcatccctattag

SEQ ID NO: 11485 - DNA, 1218 bp, Artificial Sequence
  Description of Artificial Sequence: Synthetic coding sequence
atggacacaatatttctgtggtctttgctgctacttttcttcgggtctcaggcttcaagatgttctgcccagaaaaacaccgaatttgccgtggacctgtatcaggaagtgagcctttcacataaggacaatatcatcttctcacctcttggaattacgctggtcctggagatggtccagctcggcgctaaaggtaaggctcaacagcagatcaggcagaccttaaagcagcaagagacctcagctggtgaggagttcttcgtgctgaagagcttttttagcgcaatctccgagaagaagcaggaatttacgttcaatctggccaatgctctgtacctccaggagggatttacagttaaggaacagtatctgcacgggaataaagaattcttccagtcagctatcaaactcgtggactttcaggacgccaaggcttgcgcagagatgataagcacatgggtcgagcgcaagaccgacgggaaaatcaaagatatgttctctggcgaagagtttgggcctcttaccagactcgtcctggttaatgcaatttacttcaaaggagactggaaacaaaagtttagaaaagaggacacccagctcataaattttacaaaaaaaaatggcagcaccgtcaagatccctatgatgaaggccctcttacgaacaaagtacgggtatttctctgaatcgtctttgaactaccaggtcctggagcttagctacaagggagacgaattctctctgattatcatccttcccgcagagggaatggatatcgaggaggtggagaagctgataaccgcacaacagattctgaagtggctgtccgaaatgcaggaagaagaagtggagatttctctgcccagattcaaagtggagcagaaggttgacttcaaagatgtgctgtacagtttaaatattaccgagattttcagcggcggatgcgaccttagtgggatcaccgattcctccgaagtgtacgtcagtcaagtgacccagaaggtgttttttgagattaacgaagacggatcagaagcggcaactagtacaggcatccatatacccgtcatcatgagcctggcccaatctcaatttattgcgaaccacccatttctgtttatcatgaagcacaacccaactgagtccatcctgttcatgggaagggtaaccaatcccgatacgcaggaaattaaagggagagacctagattctctctag

SEQ ID NO: 11486 - DNA, 300 bp, Artificial Sequence
  Description of Artificial Sequence: Synthetic coding sequence
atgctagcactgcttgtcctagtgaccgtggcgctggctagcgcccaccacggtggagaacactttgagggggagaaggtgttccgggtaaatgttgaggatgaaaaccatatcaacattatccgagaactggcttcaactacccagattgatttctggaagccagattctgtaacccagatcaagcctcattctaccgtcgatttccgtgtgaaggcggaagacaccgtaaccgtggagaacgtgctgaagcagaacgaactccaatataaagttcttatcagtaacctccgaaattag

SEQ ID NO: 11487 - DNA, 471 bp, Artificial Sequence
  Description of Artificial Sequence: Synthetic coding sequence
atgctgcttttgctcttgctcgctcctttattcttacggccacctggcgctggaggagctcagacccctaatgcaacttcggaaggatgtcagatcatccaccctccttgggaaggcggaatacgctaccggggactcacaagggatcaggtgaaagccattaactttctgccagtagattatgaaatcgaatacgtgtgcaggggcgagagggaagttgtggggcctaaggttcggaagtgtctggccaacgggagttggaccgatatggacacgccgagccgatgcgtcaggatatgctccaagtcctatctgaccctggaaaatggtaaggtcttcttaacaggtggtgacctacccgctctggacggcgcaagagtcgattttcggtgtgacccagatttccacttggttggctcatcccgcagcatctgctcccaaggacagtggtcaacccctaaacctcactag

SEQ ID NO: 11488 - DNA, 249 bp, Artificial Sequence
  Description of Artificial Sequence: Synthetic coding sequence
atgggaagagtttttttaaccggtgaaaaggcgaatagtattctgaagcggtaccctagagcaaacgggttcttcgaggaaattcgccagggaaacattgagcgagagtgtaaggaggaattttgcacctttgaagaagcaagggaggctttcgaaaacaatgagaaaacgggcctagtactcctgccgcgactggagtgcagctgtgagcacggaagcctgcagcctcagctcccagtgcccaagtag

SEQ ID NO: 11489 - DNA, 372 bp, Artificial Sequence
  Description of Artificial Sequence: Synthetic coding sequence
atgcagggaacacccggaggtggcacaagacccggtccttcccccgtggataggcggaccctactggtgttctccttcatcctcgctgccgctctcggccagatgaacttcacaggggaccaagtccttagagtgctggccaaagatgagaaacaactcagcctcttaggcgaccttgagggcctgaaaccacaaaaagtggacttttggaggggccctgccaggcctagcttacctgtggatatgcgcgtgccattcagcgagctaaaagacatcaaggcatatttggagtctcacggtctcgcctacagcatcatgattaaggatatccaggtgctcttagatgaggagcgtcaagctatggccaagtag

SEQ ID NO: 11490 - DNA, 840 bp, Artificial Sequence
  Description of Artificial Sequence: Synthetic coding sequence
atggggcgagtgttcctgactggagagaaggccaattcaattctgaagaggtaccctagggcaaacggcttcttcgaagaaatccggcaagggaatatagagcgggaatgcaaagaagagttttgtactttcgaggaagcccgagaggccttcgagaacaacgaaaagacaatcactggagtgatcctgctcgccgtcggcgtgtggggaaaattaactctcgggacctatatatcattaattgcagagaactctaccaacgctccatacgtcctgatcgggacagggaccacgatcgtggtgtttggcctattcggatgctttgccacctgccgcggatccccatggatgctgaagctgtatgctatgtttctctcacttgtcttcctggcagagctcgtggctgggatatctggattcgttttccgccacgaaattaaggacacattcttgcgaacctatacggacgcaatgcagacttacaacggcaacgatgagcggtctagggctgttgatcatgttcaaagaagcctcagctgctgtggggtgcagaattacactaactggtcaacctccccatacttcttagagcacggtataccccctagctgctgtatgaatgagacagattgcaacccccaggacttgcataatctgaccgtggcagcaacgaaagtgaaccagaagggatgctacgacctggtgaccagtttcatggagactaatatgggaattattgccggtgtcgcattcgggatcgctttcagccaactgattggcatgctgctggcctgttgtttatcccggtttatcaccgctaaccagtacgagatggtgtag

SEQ ID NO: 11491 - DNA, 564 bp, Artificial Sequence
  Description of Artificial Sequence: Synthetic coding sequence
atgtggtgtgctagtcctgtggctgtggtggcgttttgcgcgggtctgttagtgtctcaccctgttttaactcaggggcaagaagccggtgggaggccaggcgcagactgcgaggtgtgtaaagagttcctgaaccgattctataaatcgttgatcgaccgcggagttaacttcagtctggacacgattgaaaaggagctgatttccttctgcctggatacaaagggaaaagagaaccggctgtgctactaccttggagccaccaaggacgcagccaccaagatcctatctgaggttacaaggcctatgagcgtccacatgccagctatgaagatctgcgaaaagctgaagaagctcgactctcaaatttgtgagcttaagtatgagaaaactctggatttagcatctgttgatctgaggaaaatgagggtggcagaattaaagcaaatcctccattcctggggagaggagtgtagggcttgcgccgagaaaaccgattatgtcaatctcatccaggaactcgcacccaaatatgccgcaacccacccaaaaacagaactgtag

SEQ ID NO: 11492 - DNA, 1311 bp, Artificial Sequence
  Description of Artificial Sequence: Synthetic coding sequence
atgcagggcacacctggaggagggacacgaccaggcccaagccctgtcgaccgcaggactttgctggtgttctcattcatactggcggctgccctcgggcagatgaattttacgggtgatcaggtcttaagagtgctagccaaggatgaaaaacagctgagcctcctgggggacctggaagggctgaaaccacagaaagtggacttttggcgtggacccgcaagaccctcactgccagtggacatgcgtgttccctttagcgaactcaaggatatcaaggcctatctggagtcccacggccttgcctattccattatgattaaggacattcaggtgctgttggatgaagagcgacaggccatggctaaatcccgtagacttgaacgaagcaccaacagcttctcctacagtagctatcacacgttggaggaaatatatagctggatcgacaattttgtgatggagcattctgatatcgtgtccaagattcagattggcaactcttttgagaatcagagtatactggtgttgaaattcagcactgggggaagccgacatcctgcaatctggatcgacaccggcatccactctcgggagtggataactcacgccactgggatttggaccgccaacaagattgtgagtgattacgggaaggatcgcgttctgaccgacattcttaatgccatggacatcttcatcgagctggtcacaaacccggatggtttcgccttcactcatagcatgaatcgcttgtggcgaaagaataaatctatcaggcccggaatcttctgcatcggagtcgacctgaacaggaattggaagagcggatttggcggaaatggcagcaattcaaacccatgttcagaaacgtatcacggtcccagtcctcagtcagagcctgaggtggcagcaatagtgaactttatcactgcccacggcaactttaaggcccttatatccatacattcctactcccaaatgctcatgtacccctatgggaggctgctcgaacccgtcagtaaccagagggaactttatgatttagccaaagatgcggtggaggctctgtacaaagttcacgggatcgagtacattttcggctcaatctctacgaccctgtatgtcgcttctgggatcactgttgattgggcctacgacagcggaataaagtatgcattctccttcgagctgcgcgatacaggtcagtacgggtttctcctgccagccacccaaatcatcccaaccgcccaagaaacttggatggcactccggaccattatggagcacacactgaaccacccatactag

SEQ ID NO: 11493 - DNA, 450 bp, Artificial Sequence
  Description of Artificial Sequence: Synthetic coding sequence
atgggaagagtctttctgacaggggagaaggcaaactcaatcttgaagcgatacccacgtgccaacgggttcttcgaagaaatccgccaaggtaatatcgagcgcgaatgcaaggaggaattctgcacgttcgaggaagccagggaggcctttgagaacaatgaaaagactaaggagttttggagcacatataccaaggcacagcaaggtgaatccaaccggggaagcgactggtttcaattttacctcacattccctctcatattcggtcttttcatcatcttactggttattttcctaatctggagatgttttctccgtaacaaaacccgccgtcagaccgtgacagaaggccacatccctttcccacagcatttaaacattattactccacctccacccccagacgaagtgtttgatagtagtggactgtccccaggcttcctctag

SEQ ID NO: 11494 - DNA, 936 bp, Artificial Sequence
  Description of Artificial Sequence: Synthetic coding sequence
atgttgtatcaaactatcaactcactgaaaacaaagaatcctaagctgaaaatcctgctgtctattggaggctacctgtttggatcgaaaggcttccaccccatggtggattcttcgacctcacgattagagttcatcaacagcatcattctattccttcgcaaccacaattttgatggtctggatgtctcctggatctaccccgatcagaaagagaatacacacttcacggtcctgatccatgagcttgcggaagccttccagaaggactttacgaagagtacaaaagaaagactactactgactgccggagtctccgctggtcgccagatgattgacaacagttaccaggttgagaaactggccaaggacttagacttcataaacctgctaagttttgactttcacggctcgtgggagaaacctctaatcacaggccataacagtcctttatccaagggctggcaagatcgcggtccttcatcttactataacgttgagtacgccgtgggatattggatccacaagggaatgccttccgaaaaagtggtgatggggattcccacatacggccatagtttcacgttggcctcagcggaaacaacagtgggagccccagcctccggccctggggcagccggtcccattacggagagctccgggtttttggcttattatgagatatgtcagttccttaagggcgctaaaatcaccagattgcaagatcagcaggtgccctacgccgtaaagggcaatcaatgggtggggtacgacgatgtaaagagcatggagacaaaggtgcagttcctcaaaaatcttaacctgggtggcgctatgatctggtcaattgatatggatgacttcactggaaagagctgtaaccagggcccttacccgctcgtgcaggctgtaaagaggagtctcggttccctctag

SEQ ID NO: 11495 - DNA, 621 bp, Artificial Sequence
  Description of Artificial Sequence: Synthetic coding sequence
atggacacgatcttcctctggagcctgctgcttctgttctttggttctcaggcatctcgttgctcagcccagaaaaatactgagtttgcggttgacctctaccaggaggtgagtctttcccataaggacaacatcatcttttctccactgggtattactctggtgttagaaatggtgcaacttggcgcaaagggaaaagctcagcagcaaatccgacagacgttgaaacagcaggagacatctgccggagaggaattcttcgtactcaaatcatttttcagcgctatcagcgagaagaaacaagagttcacttttaacctggctaatgcgctgtaccttcaggaagggtttaccgtgaaagagcagtaccttcacggcaacaaggagttcttccagtcagcgattaagctcgttgatttccaggatgccaaagcctgcgccgagatgatctcaacgtgggtcgagaggaaaaccgacggtaaaattaaggacatgttttccggagaggagttcgggcctctgacccgactggtgttagtgaacgccatttactttaagggtgactggaaacagaaattccgaaaggaggacacccagctcattaacttcacaaagaagtag

SEQ ID NO: 11496 - DNA, 1218 bp, Artificial Sequence
  Description of Artificial Sequence: Synthetic coding sequence
atggacactatcttcttgtggagcctgctgttactgttttttggttctcaagcctcccgctgctcagctcaaaagaacactgaatttgccgtggatctttatcaggaggtgtcactgtcccacaaagacaatataatcttctccccgcttggaataacgttggtccttgagatggtgcagctgggcgcaaaaggaaaagctcagcagcagattcgccagacactgaagcaacaagagacctcagccggtgaagagtttttcgtgctgaagtcttttttctctgcaatctcagaaaaaaagcaggagtttacattcaatctggccaatgctctgtacctgcaggagggcttcaccgtcaaagagcaatatttgcacggcaataaggagttctttcagtctgcaattaagctcgtggacttccaagatgccaaggcttgtgccgagatgataagcacttgggtcgaacgaaagactgacggtaaaattaaagacatgtttagtggtgaagaatttggacccctcacccgcctggtgcttgtgaatgcaatttactttaagggagactggaagcagaagttccgcaaagaagatactcaactaatcaactttactaaaaaaaatggctcaacagtgaagattcccatgatgaaagccctgcttcgcacgaaatacggttacttcagcgagtcaagcttgaactaccaggttctggagctgtcatacaaaggcgacgaattttcgcttattatcattctccctgcagagggaatggacattgaagaggtcgaaaagttgattacggcccagcagatcctgaaatggctgtctgagatgcaggaggaggaggtggagatctctctgcctaggttcaaggtcgaacaaaaggtggactttaaagacgtgttatatagtctgaacatcaccgagattttttccggaggttgtgacctctcaggcatcacagacagttccgaggtgtatgttagtcaagtgacccagaaggtgtttttcgaaatcaacgaggacgggagtgaggctgctaccagcacaggtattcatatccccgtgataatgagcctggctcagtcacagttcatcgcaaatcacccattcctgttcatcatgaaacataaccccaccgagtcgattctgttcatgggacgagtgactaacccggatacacaggagataaagggccgagacttggattccctctag

SEQ ID NO: 11497 - DNA, 399 bp, Artificial Sequence
  Description of Artificial Sequence: Synthetic coding sequence
atgctgattttctggacaattacgttgtttctcttaggcgcagcaaagggaaaggaagtatgttacgaagacttaggttgcttctctgacacagaaccatggggtggtaccgccatccggccactgaagattctgccctggtcccctgagaagattggcactagatttctcctgtacactaacgagaacccgaacaattttcaaatcttattgctgagcgaccctagtaccattgaggctagcaatttccaaatggatcgcaaaacccggttcataatccatgggtttatcgataagggcgatgagagctgggttacagacatgtgcaaaaagctctttgaagtggaggaagtgaactgcatttgcgtggactggaaaaagggatcccaagctacgtag

SEQ ID NO: 11498 - DNA, 606 bp, Artificial Sequence
  Description of Artificial Sequence: Synthetic coding sequence
atgaaagtccatatgctggtgggggtgctggtgatggtggggtttaccgtcggtaaagttcctgtgcccgacattaggacctgtcatttctgcttagtggaggatcccagtgtagggtgcatcagtggttccgagaagtgcacaatttcatcatcctccctatgtatggttattaccatttattacgatgtgaaggtgcggtttatcgttagagggtgtggccagtatatcagttacagatgccaggaaaagagaaatacgtattttgctgaatattggtaccaggctcagtgttgccagtacgattactgcaacagctggagtagccctcagctgcagagcagcctaccggagcctcacgaccggcctttggcactgcccctatccgatagccagatacagtggttctaccaggccctaaatctgtcactccccttgccgaatttccacgccggtactgaacctgacggattggatccaatggtaaccctttctcttaatctcggcctaagcttcgccgagctgcgaagaatgtatttgttcttgaacagctctggactgctggttctacctcaggccggtctcctcacaccacacccctcttag

SEQ ID NO: 11499 - DNA, 1086 bp, Artificial Sequence
  Description of Artificial Sequence: Synthetic coding sequence
atggcaagcttgggtcttctactcctgttactgctgacggccctcccaccactgtggtcaagtagtttgccagggctggacacggctgaatccaaggcaaccattgctgatctcattctgagcgctctggagagagctacagtgttccttgagcagcggctacctgagattaaccttgacggaatggtaggcgtacgggtcttagaggagcagctcaaaagcgtaagggaaaaatgggcccaggagccactgctgcaaccactgagtctgagggtcgggatgcttggggagaagttagaagctgccatccagcgaagtttgcactatctaaagctgagcgacccgaaatacctgcgcgaattccagcttactctccagcccggtttttggaaactgcctcacgcatggatccacacagatgcctccctggtgtacccgacctttggccctcaagattcattctccgaagaacggtccgacgtttgtctggtccagttgctcgggaccggcacggattcaagtgaaccctgtggcctgagtgatctctgtaggtccctcatgacaaagccaggttgttccgggtactgtctatcgcaccagcttctcttcttcctgtgggctcgcatgagggggtgtacacaggggcctttacaacagtctcaggactatataaatctgttctgcgccaatatgatggaccttaatcggagagccgaagcgatcgggtacgcgtaccctacacgggatattttcatggaaaatattatgttctgtggtatgggtgggttctctgacttttacaaactgaggtggctggaggccatactgtcgtggcagaagcagcaggaaggatgcttcggagagcctgacgcagaggatgaggagctgtccaaggccattcagtaccaacagcacttcagtaggcgcgtgaaacggagagaaaaacagtttcccgatgggtgctcatcgcataacacagccaccgcagtggcggcactgggaggcttcttgtacatcctggccgaatatccacccgctaatcgagaacctcatcccagcacaccacctccccctagctcaaggtag

SEQ ID NO: 11500 - DNA, 162 bp, Artificial Sequence
  Description of Artificial Sequence: Synthetic coding sequence
atgtggacaaattttttcaaactgcgactcttctgttgtctcctggccgtcctcatggtcgtggttttagtcattaatgtgacccaggtcgagtacctcgaccatgagacggtctctgcaactttcattgattcttctggacagttcgtgagcagtcaatag

SEQ ID NO: 11501 - DNA, 1305 bp, Artificial Sequence
  Description of Artificial Sequence: Synthetic coding sequence
atggcctctctgggtctgctgcttttactcctcttgaccgccttaccacccctctggtcaagttctctgcccggattagacactgccgagtcaaaagcgactatagccgatctaatactatcagccctagagagggccactgtttttctcgagcagcgccttcccgagatcaacctggacggcatggtgggtgttagggtgctggaggaacaattgaagtcggtgagggagaagtgggcccaggagcccttactgcagccattgagcctcagagtgggaatgctgggggagaaactcgaggccgctattcagagatcgcttcactatttaaagctatcagatccaaagtatttgcgcgaatttcaactgaccctgcagccagggttctggaagctgccgcatgcctggatccacaccgatgcatctctggtatacccaacattcggaccccaggacagctttagcgaggagcgaagcgacgtttgccttgtccagttgttgggcacggggacagactcctctgagccatgtgggctgagtgatctgtgtaggtccctgatgactaagccaggctgcagcgggtattgcctatctcaccagctgctctttttcctttgggcgcgaatgcgcggatgtacacagggtcccctgcagcagtctcaggattatatcaacctgttttgcgcgaacatgatggatttgaatcggagggccgaggccatcggttatgcttacccgacccgggacattttcatggaaaacagcgtaaccggccaccccgttttttatctgcccctgtgcgattcctttctcccaccgaaagcagcccctgtcactgagctctataccgacggaccagtcatgttttgtggcatgggcggattttctgacttctacaagctgcgctggctggaagcgattctgtcttggcagaagcagcaagaaggttgtttcggagagcccgatgccgaggatgaggagctatccaaggccatccaatatcagcagcacttctcacgcagagtgaagcgcagagagaaacagtttccagacagtcgctccgtggcccaggcgggagtccagtggagaaatctgggctccctccaaccactgccaccaggcttcaagcaattctcctgcttgatcctccccagcagctgggattaccgatccgttcccccatatctggccaacttctacatttttttggtggagacggggtttcaccacgtggcccatgctgggctggagcttctgatcagccgagacccacccacaagtggctcacagtctgtcggactctag

SEQ ID NO: 11502 - DNA, 1311 bp, Artificial Sequence
  Description of Artificial Sequence: Synthetic coding sequence
atgcaggggaccccaggcggaggaaccaggcccggaccatctccagttgataggaggactctgctggtgtttagctttatcctggctgcagccctgggacagatgaactttactggggatcaggtgctacgggtcttggccaaggatgagaaacagctttccttgcttggtgacttggaggggctcaagccgcagaaggtggacttttggcgcggacctgctcggccttccctgcctgtggatatgcgggttccattctctgagctcaaagatatcaaagcatacttggaatcccacggtctggcatatagtatcatgatcaaagatatacaggtgctgctggatgaggagaggcaggcaatggctaagtcgagacggttggaaagatcgactaactcattctcttactcctcctaccatacacttgaagagatttacagctggatcgataatttcgtgatggagcactcagatattgtctccaagattcagattggcaacagcttcgagaaccaatccattctggtactgaaattttccaccggagggagtcggcaccccgctatttggatcgacactggaatccacagtagagagtggataacacatgccaccggcatatggactgccaataaaatcgtcagtgactatgggaaagatcgggtcctgacggacatccttaatgctatggacatatttatcgagctggtcacaaaccctgatggttttgccttcacacatagcatgaaccgactctggcgcaagaataaaagcattcggcctggcattttttgcattggcgtggacttaaataggaattggaagtccggcttcggtgggaacgggagcaactcgaacccctgtagcgaaacttatcacgggccttctcctcaatcggaacccgaagtggctgcaattgttaacttcatcacagcgcacggaaatttcaaggcgctgatctccatacacagttatagccagatgctgatgtacccgtatggcaggctgctggagcccgtaagtaatcaacgcgaactctatgacctagccaaagatgcagtggaagccctgtataaggtgcatggtatcgagtacatctttggaagcatttcaactactctgtatgtggcctctggcatcactgtggactgggcatacgactccgggatcaagtacgccttcagcttcgagttgcgcgacacgggccagtacggattcctgttgcccgctactcagatcatacccaccgcacaggagacatggatggcactacggacgattatggagcacacactcaatcatccttactag

SEQ ID NO: 11503 - DNA, 1218 bp, Artificial Sequence
  Description of Artificial Sequence: Synthetic coding sequence
atggatactatcttcctgtggagtctcctgctcctgttcttcggttctcaggcctctcgctgctccgcacagaaaaatacggaatttgcagtagatttgtaccaggaggtaagcctcagccacaaggataacataatctttagccctttaggaattactctggttctggaaatggtacagttgggtgctaagggaaaagcacagcaacagatccggcagactcttaagcagcaggagacttccgccggagaagagtttttcgtacttaagtctttcttttcagctatatctgagaagaaacaggaatttacattcaacttagccaacgcattgtacttgcaggagggcttcactgtgaaggaacagtacttacacgggaacaaggaattctttcaaagcgccataaaactggtggactttcaagatgcgaaagcttgcgcagagatgatctccacttgggtagaaagaaagacagatgggaaaatcaaagatatgttttcaggcgaagagttcgggcctctgacaaggctggtactggttaacgctatatacttcaaaggtgactggaagcagaagttcaggaaagaagacacccagttgataaactttacaaagaaaaatggatctaccgtgaagattcctatgatgaaggcgttgcttagaaccaagtacggatacttctccgagtctagcttgaattatcaggttctggagctctcttataagggggacgagttctccctgataattatactcccggcagaggggatggacattgaggaggttgagaagctcatcaccgcccagcagatcttaaagtggctctcagaaatgcaggaggaggaggtagagatatcactccccaggttcaaggtggaacagaaagttgacttcaaggatgtgctgtactctctcaacatcaccgagattttttctggtggctgcgacctatccgggataacagactcctccgaggtctacgtctcacaggtcacccaaaaggtcttctttgaaattaatgaggacggcagcgaggccgctacaagcaccgggatccacatacctgtgattatgagtctagcccaatcacagttcatcgctaatcatcccttccttttcatcatgaaacataacccaaccgagtctattctgtttatgggaagagttacgaaccctgatacccaggaaataaagggtcgggacctggattccctgtag

SEQ ID NO: 11504 - DNA, 510 bp, Artificial Sequence
  Description of Artificial Sequence: Synthetic coding sequence
atgttgtatcagacaattaactccctcaagactaaaaatcctaagctgaagatcttgctgtcaatagggggatatctgttcggctcgaaagggtttcaccctatggtcgattccagcacatcccggctagagttcatcaactctatcatcctgttcttgcgaaaccacaacttcgatggactggacgtaagctggatataccccgatcagaaagaaaatactcacttcactgtcctcattcatgagctcgccgaagcttttcagaaggacttcactaaatccaccaaggagcgccttttacttaccgcgggtgtgtcagcaggcagacagatgatcgacaattcctatcaggtcgagaaactggccaaagatctggacttcattaatttgttatccttcgatttccacgggtcatgggagaagccgcttatcacaggacataacagccctctgtcgaagggctggcaggaccgtgggcctagcagctattataatgtggagtatgcttag

SEQ ID NO: 11505 - DNA, 1209 bp, Artificial Sequence
  Description of Artificial Sequence: Synthetic coding sequence
atggcatctctcggcctgctcttgttgttacttctcactgccttgcctcccctctggagctccagcttgccgggtctggacacagcagagtcaaaggccaccattgcagatctcatcctcagcgctctggaaagagcaaccgtgtttctggaacagcggctgcccgagatcaacctggacgggatggtgggtgtgcgcgtgctggaggagcagttaaagtctgtgagggagaaatgggctcaggaacccctgctgcaaccattaagtctgagggtggggatgctcggggagaaactggaagctgcaatccagcgtagtctccactatttgaaactgagcgatcctaagtatctgagagaattccagctgactctccagcctggattttggaagctgccccatgcatggatccacaccgacgctagtcttgtgtatcctacctttggaccacaggattcattttcagaggaacgatccgacgtgtgcctggtgcaactgctcggaactggcacagacagctcagagccttgtggtttaagcgatttgtgccggtcacttatgactaagccagggtgctctggttattgtctcagccatcagctgctcttcttcttgtgggctcggatgcgcggttgcactcagggaccgctgcagcaatctcaagactacataaatttgttctgcgctaatatgatggacctaaatcggcgagcagaagccatcgggtatgcttatcccactcgggatatttttatggagaatattatgttttgcgggatgggtggatttagtgatttctataagctcaggtggttagaagctatactcagctggcagaaacaacaggagggctgctttggggagcctgacgccgaagatgaggaactgagcaaggcaatccagtatcagcagcatttttccagacgggttaagaggcgggaaaagcagtttccagacagtcggagtgtcgcacaagccggagtacaatggcggaatctcgggagcctgcagcccttgcccccaggttttaaacagttctcttgcctgatcctgccctccagctgggactaccgctccgtcccgccttacctagccaacttctacattttccttgttgagacgggattccatcacgtggcccacgctggactggagcttcttataagtcgggaccccccaacgtcaggctcccagtccgttggactttag

SEQ ID NO: 11506 - DNA, 1680 bp, Artificial Sequence
  Description of Artificial Sequence: Synthetic coding sequence
atgtggacaaactttttcaagctgcggttattttgctgccttctggccgtcctgatggtggtggtgctggtcattaatgtcacacaggtcgaataccttgatcacgagactgtcagcgcaacatttatagacagctccggccagtttgtgtctagccaagttacaggaatctcaagaaacccatattgcggctatgatcaacaaaccctgtcttcacaggaacggatggaggaagattcactcctggccgcattgcatcgacaggtaccagatgtgggcccagtacctttcgtaaagtctacggatccctcatctagttacttcgttattttgaacagcgcagcttttttcaaggttggttctcaactggaggtcctggtgcacgttcaggacttccagcgcaaacccaaaaagtatggcggtgactatctgcaagcacgtatacattcccttaaattgcaggccggagcagtaggacgtgtcgtcgattatcagaatgggttctacaaagtgtttttcacactgttgtggcctggtaaggtcaaggtgagtgtgtctctggtgcatccctcagaggggatccgggtcctacagcggcttcaggaggacaagcccgatcgggtgtacttcaaatcgctctttcggtctggtaggatcagtgaaaccactgagtgcaatgtgtgtttacccggaaatttgcctctgtgtaattttacagacttgtatacgggagagccttggttctgcttcaagcccaaaaaattgccctgtagtagcagaatcacccacttcaagggtggatacctgaagggactgttgaccgcagcagagtctgctttcttccaatcaggcgtgaatattaaaatgcctgtcaactccagcggaccagattgggtgactgtcatccccagaaggatcaaagaaacaaactccctcgagctctctcagggatctggtaccttcccctccggctactactataaagaccagtggagacctcggaaatttaagatgaggcaattcaacgatccagataacattactgagtgtctgcagcgcaaggttgtccacctcttcggggacagcaccatccgacagtggtttgagtacttgactaccttcgtgcccgaccttgtggagtttaacttagggtctcccaagaatgtcggccctttcttggccgtggatcagaaacataacatcctgcttaagtaccgctgccatggccctccaatacgcttcacaacagtgttttccaatgagcttcattatgtggcgaacgagctgaatggaatagtggggggaaagaacaccgtcgtggctatagctgtctggagtcacttctcgaccttccctctagaggtgtatataaggcgattgcggaacatccgtcgagcagtggtcagattgctggatcggtctccaaaaacagtggttgttattcgcaccgcgaatgcacaagaactgggccctgaagtgtcactgttcaactcagattggtataactttcaactggacaccatactccggaggatgtttagtggagttggagtatacctcgtcgacgcctgggaaatgacgctggcacactatctgcctcataagcttcacccggacgaagtgatcgtaaaaaaccaactcgatatgtttctgtcattcgtttgcccattggaaacatag

SEQ ID NO: 11507 - DNA, 402 bp, Artificial Sequence
  Description of Artificial Sequence: Synthetic coding sequence
atggctatggtgtccgcaatgtcctgggtgttgtacctgtggatatcagcatgtgccatgctcctttgccacggatcactccagcacaccttccagcaacatcacctccataggcccgaaggcggtacctgtgaggtgatagctgcccacagatgttgtaacaagaaccgaatcgaggaacgaagtcaaacagtgaagtgtagttgcctccctggaaaggtggcgggaactactagaaataggccctcatgcgttgacgccagcatcgttatcggcaagtggtggtgtgagatggaaccctgcctggaaggcgaggaatgcaaaaccctgcccgacaatagcggttggatgtgtgcaactggcaacaagatcaagactacccgcattcatcccaggacgtag

SEQ ID NO: 11508 - DNA, 606 bp, Artificial Sequence
  Description of Artificial Sequence: Synthetic coding sequence
atgaaagtccacatgctggtgggcgtgctggtgatggtcgggtttaccgtgggaaaagttcccgtgcctgatatccgcacgtgtcacttttgcctggtggaagacccttcagtcggctgtatctctggatctgagaaatgtactataagcagcagctccttatgtatggtgatcactatctattatgacgtaaaagtgcgctttatcgtacgtggttgcggacagtacattagctatcggtgccaggaaaaaaggaacacgtatttcgctgaatactggtaccaggcacaatgctgccagtacgactattgcaactcgtggtcaagtcctcagctgcaaagcagccttccagaaccccatgaccggcctctggcattgcctctgtctgacagtcaaattcaatggttctaccaggctcttaatctgagccttcccctccctaatttccatgccggaacagaaccagatggtctcgacccgatggtgaccctcagccttaatctcggccttagtttcgcagagctccgacggatgtatctctttctgaattcaagcgggttactggttttgccccaggcaggtctgctcactccccacccatcttag

SEQ ID NO: 11509 - DNA, 606 bp, Artificial Sequence
  Description of Artificial Sequence: Synthetic coding sequence
atgaaggtgcacatgctcgtgggcgtgctggtgatggtgggattcacagtcggcaaggtgcctgtccccgatattcgtacttgccacttctgtctggtggaggatccctctgttggttgcatatctgggagtgagaaatgcacaatcagtagcagcagcctctgtatggttatcaccatctactatgatgttaaagtgagattcatcgtgcggggatgtggacagtacattagttatcgctgccaggagaaacggaacacatatttcgcagagtactggtaccaagcccagtgttgccagtacgactactgcaattcttggtcctctccacaactgcagtcttctttgcctgaacctcatgacaggccgttagcccttcccctgagtgatagtcagatccagtggttctatcaggcactgaacttgtcactgcctctgcccaactttcatgccggtacagagcccgacggcctagacccaatggtgaccttgagcttgaatcttggcctatctttcgccgagctgagacggatgtatctctttttgaacagcagtggactgttggtcctgccgcaagccggtctgctaacacctcacccttcatag

SEQ ID NO: 11510 - DNA, 732 bp, Artificial Sequence
  Description of Artificial Sequence: Synthetic coding sequence
atgggcccagaggccctttccagtttgctgctgctgctcctggtagcttctggagatgctgatatgaaaggacatttcgaccctgcaaaatgcaggtacgcccttggtatgcaagatcgcacaatacccgacagcgacatttccgctagtagctcatggtctgactctaccgccgctcgccactctcgcttagaatcatcagacggggatggagcgtggtgtcccgcaggctctgttttccctaaggaagaggagtacctgcaggtggatctgcagaggctgcacttggtggctttggtgggcacccagggcagacacgccggaggcttaggtaaagagttctcacgaagctaccgccttcggtactctcgggacggccgtcgctggatgggatggaaagacaggtggggacaagaagttatttctggaaacgaggatccagaaggagtggtcctaaaagaccttgggcctccaatggttgctcgcttggtgcggttttatccccgtgctgaccgcgtgatgagcgtgtgccttagggtcgaattgtacggctgtctgtggcgggattgtagcatgggtgtgtgggcgtcctggcagatggtttggtggggatggatgaccctgggtcgagtacgcagctgcgggagtgggcaggcaatgacaatgtgggatggcgcaactaccgcctcccctgtggccatgtggcggtggtctttgtccctgactggctag

SEQ ID NO: 11511 - DNA, 258 bp, Artificial Sequence
  Description of Artificial Sequence: Synthetic coding sequence
atgaaaattccagtgctccccgcagttgtcctgctctcattgctcgtccttcacagcgcacaaggggctactctgggagggccagaggaagaatctaccattgaaaactatgcgagtcggccagaggcgtttaaagccgacgaatttctgaactggcacgcattgttcgaatcgattaaacgaaaactgccctttttgaactgggacgcctttcccaagcttaagggcttgcggtcggccacccccgacgctcagtag

SEQ ID NO: 11512 - DNA, 348 bp, Artificial Sequence
  Description of Artificial Sequence: Synthetic coding sequence
atgggccgtgtgtttctgactggagaaaaagctaacagcattctgaagcgttatcccagagccaacggcttttttgaagaaattcgtcagggtaatatcgaacgagagtgtaaagaggaattctgtactttcgaagaagctagggaagccttcgaaaataacgagaagactaaggaattttggagcacgtacaccaaggctcaacagggggaaagcaatcgtggctcagactggttccagttttacttgaccttccctcttatctttggtctgttcataatactgctggtgatttttctgatatggaggtgtttcctgcgtaacaaaactcgcagacagaccgtgtag

SEQ ID NO: 11513 - DNA, 606 bp, Artificial Sequence
  Description of Artificial Sequence: Synthetic coding sequence
atgaaagtgcatatgctggtgggtgtcctggttatggtgggcttcactgtcggcaaggtgcctgttccggacatccgtacatgccacttttgtctggtggaggacccaagcgtgggctgtattagtggcagcgaaaagtgcaccatctctagtagcagcttatgtatggtcatcacaatctattacgacgtaaaggtacgcttcattgtccgagggtgtgggcaatatatttcctataggtgtcaggagaaacgcaacacctacttcgctgagtactggtatcaggcacagtgctgccagtacgactactgtaactcctggagctctccccagctgcaaagcagcctgcctgagcctcatgatcgacctctggcgttgcccctgtccgactcccaaatccaatggttctaccaggctctcaatctgtcgcttcctttgcccaacttccacgccggaactgaaccagacggcttagaccctatggtcaccctgtcgcttaatttaggtctgtcctttgccgagcttcgcaggatgtatctttttctcaactcttcaggtttgctggtccttccgcaggcgggactgctgacaccacatccaagttag

SEQ ID NO: 11514 - DNA, 1311 bp, Artificial Sequence
  Description of Artificial Sequence: Synthetic coding sequence
atgcaggggacaccaggaggcggaacccggccagggccatcacccgtagacagacgaacactgctcgtttttagctttattctggcagctgcattaggccagatgaacttcaccggggaccaagtgctccgagtgctggcaaaggatgagaagcagctgagtctgctaggagacttagaggggctgaagcctcagaaagtggacttttggagaggaccagctcgccctagtcttcccgtcgatatgcgagtccccttttccgagttgaaggatatcaaagcgtacctcgagtctcacggtctggcctattcaatcatgattaaggatatccaggttttgctggacgaggaaaggcaggccatggcaaagagtcggcgacttgaaagatccactaattcttttagctatagcagttatcatactctagaggagatttattcttggattgacaatttcgtgatggagcatagtgacatagtctcgaagatccagattggcaatagctttgagaatcaatccattctcgtcctcaaattcagtacaggcggtagccggcatccggcaatttggatcgacacggggatccattctcgggaatggatcactcatgccacgggcatctggacagctaacaagatagtgtcagactacggtaaggaccgagtgcttaccgacatcctgaatgcaatggacatctttatcgagctcgtgaccaaccccgacggctttgcattcacccactctatgaaccggttgtggagaaaaaataagtccattcgcccaggcatattttgtatcggagttgatcttaaccgaaactggaagtctgggttcgggggaaacgggtccaattcaaatccttgcagtgaaacctaccacggcccttctccacagtccgagccagaggtcgctgccatagtaaatttcattacggcccatgggaattttaaggcccttattagcattcactcatacagtcagatgctcatgtacccttatgggagactcctcgagccagtaagcaatcagcgtgaactctatgacctcgctaaggatgctgtggaagcgttgtacaaggtccacggaatcgagtacatcttcggatcaatctccacaactctctacgtcgcttctggtataacggttgattgggcctatgactcaggaatcaagtacgctttctctttcgagctgagagatacaggccagtatggctttttacttcctgccactcagattatccctacagcacaggagacttggatggcactccgcaccataatggagcacacactcaaccatccctactag

SEQ ID NO: 11515 - DNA, 606 bp, Artificial Sequence
  Description of Artificial Sequence: Synthetic coding sequence
atgggggctactaccatggaccaaaagagcctctgggccggtgttgtggtgctccttctcttgcagggcggatcagcatacaagctggtctgctacttcacaaactggagccaagataggcaggaaccaggaaaattcacaccggagaacattgacccgttcttgtgttctcatttgatttattccttcgcctcaatcgaaaataataaagttataatcaaggataaatcggaggtgatgctctatcagaccattaattcgttaaagaccaaaaaccctaaactcaaaattctccttagtatcggtgggtatctgtttggtagcaaagggttccaccccatggtagattcgagcaccagccggctggaattcataaatagcataatcttgtttctgcgcaatcacaattttgacggcctggatgtctcttggatctaccctgaccagaaagagaatactcatttcacagtgctgatccacgagctggccgaagcatttcagaaagacttcactaagtctacaaaagagcggctgctgttgacagccggagtgtcagccggtcgccaaatgatcgataactcatatcaggtggagaaattagcatag

SEQ ID NO: 11516 - DNA, 75 bp, Artificial Sequence
  Description of Artificial Sequence: Synthetic coding sequence
atgctagtggatggcccttccgagcgccctgccctgtgcttcttgctcctcgccgtcgccatgtccttcttctag

SEQ ID NO: 11517 - DNA, 252 bp, Artificial Sequence
  Description of Artificial Sequence: Synthetic coding sequence
atgagacccaggggcctgcctccacttctggtggttctgctcggctgctgggcgtctgtttccgcacagaccgatgccacccccgctgtaacaaccgaaggcctcaatagcacagaagccgcactggcaacttttggcacgtttccctccactagacctccgggaacaccgcgagctcccggtcccagcagcgggcctaggccaacccccgtcaccgacggtagccacagtgtgacccaagctggagtatag

SEQ ID NO: 11518 - DNA, 1254 bp, Artificial Sequence
  Description of Artificial Sequence: Synthetic coding sequence
atgttggccctattagtgctcgtaactgtggcattggcctcagctcatcacggtggggagcatttcgagggcgaaaaagtgtttagagtgaacgtggaagacgagaaccatattaatatcattcgggagctcgcttccactacgcaaatcgacttctggaaaccagacagtgtaacccaaatcaagccacacagtactgtggacttcagagtcaaagcggaagataccgtgacagtggagaatgtgttgaagcagaacgagctgcaatacaaggtgctaatttctaacttgcgcaatgtcgtggaggcacagttcgactctcgcgtccgggctactggacattcgtatgaaaaatacaacaagtgggagaccatcgaggcctggacacagcaggtggcgactgaaaatcccgctctcattagccggagcgttatagggactaccttcgaaggaagagccatctatttactcaaagttgggaaagccggtcagaataagcctgccatttttatggactgtggcttccacgctagggaatggatcagcccagctttttgccaatggttcgtgcgagaagccgtgcggacgtacgggagggagatccaggttactgagctgctagataagttagatttctacgtcctccctgtgttgaacatagacgggtacatctatacttggaccaagagtaggttttggcgcaaaacaagaagcacccatacaggatcctcatgtataggcaccgaccccaaccggaatttcgatgctggttggtgcgaaatcggggcttctaggaacccatgtgatgagacctactgcgggccagcagctgagagcgaaaaagagacaaaagcacttgccgattttatccggaataaactgagcagtatcaaagcttacctaactattcacagctattctcagatgatgatctacccatacagttatgcatataagctgggggagaacaacgctgaactgaacgcccttgcaaaagccacagtgaaggaactcgcgagtctgcatgggaccaagtacacatacggacccggagctacaactatctatcccgctgcgggtgggagtgatgactgggcctacgaccagggcatacggtactcctttacttttgagctgagggacacaggcagatatggcttcctgcttcctgagtctcagattcgcgctacctgtgaggaaacgttcttggctatcaagtacgtcgcatcatacgtactcgagcacctgtactag

SEQ ID NO: 11519 - DNA, 1680 bp, Artificial Sequence
  Description of Artificial Sequence: Synthetic coding sequence
atgtggacaaatttttttaagttgaggctgttctgctgcttgctagctgtgctcatggttgtggtgttagtaattaacgtcactcaagtcgaatacctggaccacgaaaccgtcagtgctacttttatcgattcatcaggacagttcgtgtcatcccaggtgaccggcattagccgcaacccctattgtggctatgaccagcagaccctttccagccaggagagaatggaagaggatagcctcctcgccgcacttcatcgccaggtcccggacgtgggacccgtgccttttgtcaaatctacagacccctcttcatcttattttgtgatcctcaacagcgccgctttttttaaggtagggtcccaattggaggtgttagtccacgttcaggatttccagagaaagcctaaaaaatatggaggagattatttgcaggctcgcatccactcgctcaaactgcaggcaggagctgtggggagggtggtggattaccaaaatggattttataaagtgttctttacccttctctggccaggcaaggtaaaggtttctgtgagcctggtccacccctccgaaggcatcagagttctccagcgcttgcaggaggataagcccgaccgggtgtactttaagtcactatttaggtcaggtaggatatctgagaccacagagtgcaatgtatgcctccctgggaatctgccactatgcaactttactgacctgtataccggggagccctggttttgctttaaacccaagaaactcccctgcagctcacgcatcacgcatttcaaaggcggatatctgaaaggcctgctcactgccgcagaatccgctttcttccagtcgggagtgaacattaaaatgcctgttaattccagcggccctgattgggtcactgtgatacctcgcaggatcaaagaaaccaattccctggagctctcccagggcagcggtacatttccgtcggggtactactataaggatcaatggaggcctagaaaattcaagatgcgccagttcaacgaccctgacaacatcaccgagtgcttacagaggaaagtagtccatctgttcggcgattcgacaataagacagtggttcgagtacctgaccacgtttgtaccagacctagtggaatttaacctgggctccccaaagaatgtaggaccattcctagccgttgaccagaagcataacatcctgctgaagtatcgttgccatggccctcctatcagattcaccaccgtgtttagtaacgagcttcactacgttgccaatgagttgaacggcatcgtgggcggaaaaaatacggtcgtcgctatcgccgtctggtctcatttttctacgtttccactggaggtgtacatccgcagattaagaaacataaggcgggcagtggtcaggttactcgacaggagccctaaaacagttgtggtcatcagaacagctaacgcgcaggagttgggtcctgaagtttccctgttcaactccgactggtataactttcaattggacacaatcctgcggaggatgttcagcggagtgggagtgtacctggtcgatgcctgggaaatgacactggcccattatttaccccacaagcttcatccagacgaagtgatagtgaaaaatcagcttgacatgttcctgtcctttgtgtgtccattagaaacatag

SEQ ID NO: 11520 - DNA, 99 bp, Artificial Sequence
  Description of Artificial Sequence: Synthetic coding sequence
atgcaaggcacgccaggaggagggaccagacccggtcccagtccggttgaccgcagaacgctactcgtattttccttcattctggccgctgcactttag

SEQ ID NO: 11521 - DNA, 180 bp, Artificial Sequence
  Description of Artificial Sequence: Synthetic coding sequence
atgctcgccctattggtcctggtgacagtggctctcgcttcagcacatcatgggggagaacactttgagggggagaaggtctttagagtgaacgtggaggacgaaaatcacataaacattatcagagagctggctagcacaacccaaatcgatttttggaaacccgactccgttacatag

SEQ ID NO: 11522 - DNA, 303 bp, Artificial Sequence
  Description of Artificial Sequence: Synthetic coding sequence
atgcggcctcgaggtcttcccccactgctagtagtcctgcttggatgttgggcttctgtttccgcacagactgacgccacaccagctgtcacgaccgaggggctcaacagcactgaggcagccctagctacattcgggaccttcccctcaacacgaccaccaggcacccctcgcgcaccagggcctagttctggccctcgccctacaccagtgactgacggtggctaccatgtgcctgcacctggcgtgcactctgatcctactagccggggacagccacggtgttgctctctgtgcctctag

SEQ ID NO: 11523 - DNA, 234 bp, Artificial Sequence
  Description of Artificial Sequence: Synthetic coding sequence
atgaggtctccaagaatgagagtttgcgcgaagtcagtgctcctctcccattggctgtttctagcttacgtgctgatggtgtgctgtaaattgatgagcgcatctagccagcacctgaggggacacgctgggcaccaccagatcaagcagggcacatgtgaggtggtagctgtgcacaggtgctgtaacaaaaatcgcattgaagaacggtctcaaaccgtcaagtgctcgtag

SEQ ID NO: 11524 - DNA, 12 bp, Artificial Sequence
  Description of Artificial Sequence: Synthetic coding sequence
atgtggacatag

SEQ ID NO: 11525 - DNA, 402 bp, Artificial Sequence
  Description of Artificial Sequence: Synthetic coding sequence
atggctatggtgtccgcaatgagttgggtattgtacctctggatcagcgcttgtgctatgctgctgtgccacggctccctgcaacacacattccagcagcaccatctgcaccggccagagggagggacatgcgaggtgatagcggctcatcgttgctgtaacaagaatcggatcgaagagcgctcacagactgttaaatgctcctgcttgcccggtaaggttgcaggtacaaccagaaatcgacctagttgtgttgacgcgagcatcgtgatcggtaagtggtggtgcgagatggagccatgcttggagggtgaagaatgcaaaaccctgccggacaattccggttggatgtgcgccactgggaacaagattaagaccacacggatccatcctcggacatag

SEQ ID NO: 11526 - DNA, 600 bp, Artificial Sequence
  Description of Artificial Sequence: Synthetic coding sequence
atgaccatgcggcataattggactccagaccttagcccactctgggtgttactactctgtgcccatgtcgtcaccctgctagtccgggctacaccagtgtcacagaccacaactgcagcaaccgcttccgtcaggtctaccaaagatccctgtccgtcccagcctcccgtgttccccgcagctaagcagtgccctgcgctggaggtcacttggcctgaagtggaagtacctctgaatgggactctgagcctgagttgcgtcgcctgctcccgcttccctaatttttcaatcctgtactggttgggaaacggctccttcattgaacaccttcccggaagactttgggaggggtcaacctcaagggaacgtgggtctaccggaacccaactgtgcaaagcgctggtgctggaacagttgacaccagccctgcatagcaccaacttctcctgcgttctggtggatcccgagcaggttgtacagcgacatgtcgttctcgctcagctgtgggtgagatcccccagacgcggattgcaggaacaggaggagctttgttttcacatgtggggcggaaaagggggactgtgtcagtcttcgctctag

SEQ ID NO: 11527 - DNA, 1044 bp, Artificial Sequence
  Description of Artificial Sequence: Synthetic coding sequence
atgggtgtggtgcagtacggggacaatcccgctacccatttcaatttgaagacacacactaactcacgggacctcaaaaccgctatagagaagattacgcagcgcggagggctctctaatgtgggccgagctatttcctttgtcactaaaaactttttctctaaggctaacggcaacaggagcggcgctccaaacgttgtcgtcgtgatggtggatggttggccaaccgataaggtggaggaggccagccgcttggcccgagaaagcgggatcaatatttttttcatcaccatcgaaggcgcagctgaaaacgagaagcagtatgtggtggagcctaactttgcgaataaagctgtgtgtcgaactaacggcttctactccttacatgtgcagtcttggttcgggttgcacaagacactacagccgctggtgaaacgggtctgcgatactgatagactagcttgcagtaagacctgcctgaatagcgccgacatcggtttcgtgattgacggttcttctagcgtaggcaccgggaattttaggacagtgctgcagttcgtcacaaatctaaccaaagaattcgaaatatcagatacagacacccgcatcggggcagttcaatacacctacgaacagagactggaattcggatttgacaagtattcctctaaacctgatatcctgaatgctatcaaacgcgtcggatattggtccgggggaacctcgacgggagccgctatcaactttgctctggagcaactcttcaaaaagagtaaacccaacaagagaaagcttatgatcctgatcacagacggtagaagctatgacgatgtaaggatccccgcaatggcagcccacctaaagggcgtgatcacttacgccatcggcgtggcttgggccgctcaggaggagctggaagtgattgcaacacatcccgctcgcgatcacagtttctttgtggacgaatttgataacctgcaccagtatgtgcccaggatcatacagaacatctgtactgagtttaactcacagccccgaaattag

SEQ ID NO: 11528 - DNA, 27 bp, Artificial Sequence
  Description of Artificial Sequence: Synthetic coding sequence
atgcagggcaccccaggaggcggttag

SEQ ID NO: 11529 - DNA, 369 bp, Artificial Sequence
  Description of Artificial Sequence: Synthetic coding sequence
atgctgtatcagacaatcaatagcctgaagacaaaaaaccccaaactcaagatcctactcagtatcggcggatacctgttcggcagcaaaggcttccaccccatggtggattcatctactagccgtctggaatttattaatagcatcatcttgtttctacggaaccataacttcgatggtctggacgtcagttggatctaccctgatcagaaggaaaacacccattttaccgtgttgatccatgagctcgctgaggcctttcaaaaagactttacaaaaagcactaaggagcgcttattgcttactgcaggcgtgagcgccggtagacagatgatcgacaattcataccaggttgaaaagttggcctag

SEQ ID NO: 11530 - DNA, 309 bp, Artificial Sequence
  Description of Artificial Sequence: Synthetic coding sequence
atgcgggtgagcggggtactacgtctgctcgctctcatttttgctatcgttacaacctggatgttcatccgatcctatatgtccttttccatgaaaaccattaggctgccccgttggctggctgccagtcccaccaaggagatccaggtgaagaaatacaagtgcggcctgatcaagccatgtccagccaattacttcgcctttaagatctgttcaggcgctgcgaacgtggtcggtcctacaatgtgttttgaggatcgtatgatcatgtcgcccgtgaagaataatgtgggcaggggcctgaactag

SEQ ID NO: 11531 - DNA, 660 bp, Artificial Sequence
  Description of Artificial Sequence: Synthetic coding sequence
atgaaacttctgctgtgggcgtgtatcgtctgcgttgccttcgcaagaaaaagaagatttccattcatcggggaagacgataacgacgatggccatccactgcacccttccctgaatattccatatggaatccggaatctgccccctcccctctactataggcctgtgaataccgtcccatcctaccctgggaacacttatacggatactgggttgccaagctacccttggatcctcacctctcctggtttcccatacgtgtaccacattagagggttccctttagcaacacagcttaatgtgccaccgctcccgccacgaggtttccctttcgttccaccctcccgattcttctctgcagccgctgctcccgctgctcctcctattgccgctgagcccgctgccgctgcaccattgacggctactcccgtcgctgcggaacctgccgctggtgctcctgtggctgccgaaccagccgctgaggctcctgtgggggcagagccagccgctgaagcccctgtggccgcagagcctgccgctgaggccccagtgggagtcgagccagctgctgaggaaccatccccggcagagcctgcaactgccaaacccgcagctccggagccccatccgtctcctagcttagagcaggcaaatcagtag

SEQ ID NO: 11532 - DNA, 1869 bp, Artificial Sequence
  Description of Artificial Sequence: Synthetic coding sequence
atgggtaaatctgagggaccagtggggatggtggagagcgccggaagagcgggacagaagaggccaggtttcctcgagggcggtcttctcctgctcctccttctggtaaccgctgctctcgtggctctgggagtcctctatgccgaccgtagagggaagcagttacctagacttgccagtaggctgtgcttcctacaggaggagagaactttcgtgaaacggaaaccgcgaggcataccagaagctcaagaggtgagcgaggtgtgtaccacgcctggctgcgtgatagcggctgccagaattttgcaaaacatggaccccacaacagaaccttgcgacgatttctatcagttcgcctgtggcggatggctgcggaggcacgtgattccagagaccaattccagatattccatatttgacgtattgagagacgagctggaagttattctgaaagcggtgttggaaaacagtaccgccaaagctactgtgccccaggaagagagacacgacgtaatcgccttgtatcatcgtatgggcttggaggagctgcaaagccaattcggccttaagggatttaactggaccctgttcatccagaccgttctgtccagcgtgaaaatcaaactgcttccagacgaagaggttgtagtgtacggaattccataccttcaaaatctcgaaaacatcatcgacacgtatagtgcccgtactatccaaaattacctggtatggagactcgtgctggatagaattggctctttgtcgcagcggttcaaagacacccgtgttaactaccggaaagctctgttcggcacaatggtggaagaggtgagatggagagaatgtgtggggtatgtaaactctaacatggaaaacgctgtgggaagcctttacgtgagagaagcattcccaggggatagcaagtctatggtacgggagctaatcgacaaagttcgtaccgtatttgtagaaacacttgatgagttaggttggatggacgaggagagtaagaagaaagcccaggaaaaagccatgtccatcagggagcagatcgggcatccggattatatccttgaagagatgaatagacgtctggacgaagaatattctaacctgaactttagtgaggatctttacttcgaaaatagcttacaaaatttaaaagtgggcgctcaaaggagtctgaggaagctgagagagaaggtggacccaaatctgtggattatcggcgctgcagtggtgaacgcattttactcacccaacagaaaccaaatagtctttcccgcaggtattctccaacctccgtttttcagtaaggaacagccccaggctctgaactttggcggtattggtatggtcatcggccacgagattacacatgggttcgatgataatggacggaacttcgataaaaatggcaatatgatggactggtggtctaatttttctactcagcattttagggagcaatccgagtgcatgatatatcagtatggcaactattcgtgggacctggccgatgagcagaatgtaaacggatttaatactctgggggagaatatcgccgataatggaggcgtcagacaggcctataaggcatacctgaagtggatggccgaggggggaaaggaccaacaactgccgggactagacctgacgcacgaacaattattctttattaactatgcacaggtgtggtgtggcagctatcgtcctgagtttgcaatccagtctataaagactgacgtgcatagtcccctaaaatatagggtgctgggttcactgcaaaaccttgcagccttcgcggatacgtttcactgcgccagaggaacgccaatgcaccccaaggaacggtgcagggtgtggtag

SEQ ID NO: 11533 - DNA, 168 bp, Artificial Sequence
  Description of Artificial Sequence: Synthetic coding sequence
atgggaccagaggctctgtcgagtctcttgttacttttgttggtggcttcaggtgatgctgacatgaaagggcattttgatccggctaagtgcagatacgcactgggcatgcaggaccgcacaattcctgacagtgatataagcgccagctccagttggagcgactag

SEQ ID NO: 11534 - DNA, 156 bp, Artificial Sequence
  Description of Artificial Sequence: Synthetic coding sequence
atgggtccagaggcactgtcctcactgctcctgttgctactggttgcatccggggatgccgatatgaaaggccactttgacccggctaagtgtcgctacgccctggggatgcaggatagaaccattcctgacagcgacatatcggcaagcagctag

SEQ ID NO: 11535 - DNA, 1620 bp, Artificial Sequence
  Description of Artificial Sequence: Synthetic coding sequence
atgtccgagccacaagagaagaaactctccgagaacacagacttcctagcaccgggtgtgtcttctttcacggattccaatcagcaggagagcattactaagcgggaagagaaccaggagcagcccagaaattacagtcaccaccagctgaatcgaagcagcaaacacagccagggccttagggatcaggggaaccaggaacaggaccctaatatcagcaacggagaggaggaggaagaaaaggaacctggagaagtcgggacccataatgataatcaagagaggaaaaccgagctgcccagagaacatgcgaacagcaaacaggaggaggacaatactcagagcgacgacatattagaggagagtgaccaaccaacacaagttagtaagatgcaggaggatgagtttgaccaggggaaccaagaacaggaggacaacagtaacgcagagatggaggaggaaaatgcctccaacgtcaataagcacatccaggaaacagagtggcagtcccaagagggtaagacaggactggaagccattagcaaccataaagaaaccgaggagaagacagtgtctgaagccctcttaatggaacctaccgacgacgggaacacaacccctcggaatcacggggtcgatgatgacggagacgatgacggagatgacggcggtactgatggtcccagacatagtgctagtgacgactactttataccaagtcaagcattcctggaggctgagcgcgcacagtctattgcgtatcacttgaagattgaggagcagcgcgagaaggttcatgaaaatgaaaatatcggcaccaccgagcctggcgaacaccaagaggcaaagaaggcggagaatagttctaatgaggaagagacatcttctgagggcaacatgagagtccacgcagtggacagttgtatgagctttcaatgtaagcgcggtcatatatgtaaagctgatcagcaggggaaaccacattgcgtgtgccaggatcccgtcacctgcccacctaccaagccactggaccaggtctgtggtactgataaccagacctatgcgagctcctgccatctgtttgctaccaaatgtagactggaggggactaaaaagggccatcagctgcaactggattatttcggcgcttgtaagtctatccctacatgcaccgatttcgaggttatacagtttccattgagaatgagagattggctgaaaaacatattgatgcagctctatgaggccaatagtgagcacgccggttacctcaacgagaagcaacggaataaggtgaagaaaatttatttggacgagaagcgcctcctggccggtgatcacccaatcgacttgctgctccgtgacttcaagaaaaactaccacatgtatgtgtacccagtccactggcagttttcagagttagaccagcaccctatggatcgggtgctgactcacagtgagctggcaccactgagagcctccctggtcccgatggagcattgtataacccgtttttttgaagaatgtgacccaaataaagataagcacatcaccctgaaggagtgggggcactgctttggcatcaaggaggaggatatcgatgagaatctgctgttctag

SEQ ID NO: 11536 - DNA, 591 bp, Artificial Sequence
  Description of Artificial Sequence: Synthetic coding sequence
atgccgcatctggcttctctgtttacggcgagtagtaggtgctgccctcatcccctgaggcctgagggcagtggtgctatgggaccagaagctcttagcagtctcctgcttctattgctggtcgctagtggcgacgcagatatgaaaggccatttcgatcctgccaaatgccggtatgcccttggcatgcaagaccggactatcccggactccgatatctcagcctctagctcatggtccgattcaacagccgctcgccactctaggctggagtccagcgatggggatggcgcatggtgtccagccggatctgtgttcccgaaggaagaagaatatctccaggtggaccttcagagactgcacctagtggctcttgtaggcacacaaggaaggcacgccggaggtctgggcaaggagttctcgagatcgtatcgcttacgctactctcgtgatggcagaagatggatggggtggaaagacagatggggtcaggaagtgataagcgggaatgaggacccagagggcgtagtcctgaaggacctgggccctcctatggtcgccaggctggttagattttatcctcgagcctag

SEQ ID NO: 11537 - DNA, 162 bp, Artificial Sequence
  Description of Artificial Sequence: Synthetic coding sequence
atgcttccttgcctagcgctactgctgttgatggaactgtcagtgtgcacagtagcgggtgacggtggggaagagcagacactgtctactgaagcagagacctgggttatcgtcgctctggaggtactgcttggcagaggatcagacgaaggtcgaggctag

SEQ ID NO: 11538 - DNA, 126 bp, Artificial Sequence
  Description of Artificial Sequence: Synthetic coding sequence
atggggccagaggctctgagcagtctcctgctgctcctactcgttgcgtcgggggacgctgacatgaaaggccattttgatcccgctaaatgccgctacgctttgggtatgcaggacagaacatag

SEQ ID NO: 11539 - DNA, 222 bp, Artificial Sequence
  Description of Artificial Sequence: Synthetic coding sequence
atggggccagaggcgctctcctccctgctgttattgctacttgtagcctccggtgacgcggacatgaaaggacatttcgatcctgccaagtgccgctatgcccttggaatgcaggataggaccattcctgacagcgacatctcggcctccagttcatggtccgattctaccgccgctcggcactctcgcctggagtccagcgatggcgatggagcatggtag

SEQ ID NO: 11540 - DNA, 369 bp, Artificial Sequence
  Description of Artificial Sequence: Synthetic coding sequence
atgggtccagaggccctgagtagtctgttgttattactgttggttgcctccggggatgctgatatgaaggggcacttcgaccctgccaagtgccggtacgccctcggcatgcaggatagaactatccctgatagcgacatttcagccagcagctcctggagcgactctacagcagctcgccattcccggcttgaatcttctgacggtgacggcgcttggtgccctgccggatctgttttccccaaagaagaagagtacctccaggtggatctgcagcgactgcacctggtggccctcgtcggaactcaaggacgtcacgccggtggcctgggcaaggagttcagccgctcgtataggctgcgctattag

SEQ ID NO: 11541 - DNA, 483 bp, Artificial Sequence
  Description of Artificial Sequence: Synthetic coding sequence
atgggcccagaggccctgagctcactgctgttgttgttactggtcgcctcgggagacgcagacatgaagggccactttgatccagccaagtgtagatacgctctgggaatgcaggacaggaccattcccgattctgacataagcgcttcaagcagctggtctgactcaacagcagcacgccacagtaggctggaatcttcagatggagacggcgcttggtgcccagccggaagtgtgtttcctaaggaggaagagtacctccaagtcgacctgcagagacttcacctcgttgccctagtggggacgcaggggcgtcacgccggaggattggggaaggaattctcgcggtcatacagactgaggtattcccgggatgggaggaggtggatggggtggaaggatcggtggggacaggaagtaatcagcgggaacgaggaccctgaaggggtggttctgaaggacttaggcccaccaatggtgtag

SEQ ID NO: 11542 - DNA, 540 bp, Artificial Sequence
  Description of Artificial Sequence: Synthetic coding sequence
atgggctcatccggattgctgtcgctgttggtgctgtttgtgcttttagctaacgtccagggacctggcctcacagactggctgtttccccgtcggtgccctaaaattcgcgaggagtgcgaattccaggaacgtgatgtgtgtacgaaagaccgccagtgtcaggacaataagaaatgctgcgtgttcagctgcggcaagaagtgtttggacctcaagcaagacgtctgcgagatgccaaaagaaacaggcccttgcttggcttactttttgcactggtggtatgacaagaaggacaacacgtgttccatgttcgtttacggcggatgtcagggcaacaataacaacttccaatccaaagctaattgcctgaacacttgcaagaacaaacaaccttgccccaaaataaaggttgagtgcgaggtggaagaaatagaccaatgcactaaaccacgtgattgcccagagaatatgaagtgctgtcctttttcccgtggtaagaaatgtctggactttagaaaggcctctctctcgacatag

SEQ ID NO: 11543 - DNA, 438 bp, Artificial Sequence
  Description of Artificial Sequence: Synthetic coding sequence
atgctattccgcaaccggttccttctactgctagcccttgcagcgttgctggccttcgtaagcctctccctacagttctttcacctcatccctgtgtcaacccccaaaaacggcatgagcagtaaaagtagaaaacgtatcatgcctgaccccgtcacagaaccaccagttacagaccctgtgtacgaagccttgttatactgcaatatcccttctgtcgcagagcgatcaatggagggccacgcccctcatcactttaagctcgtgtccgtgcatgtcttcatccggcatggcgatcggtacccgctgtacgtgatcccaaaaaccaagaggcccgaaatcgattgtactctcgtggcaaaccgcaaaccttatcaccccaagcttgaggcattcattagtcatatgtctaagggttcaggtgcctctttcgaatag

SEQ ID NO: 11544 - DNA, 399 bp, Artificial Sequence
  Description of Artificial Sequence: Synthetic coding sequence
atgggcccagaggcactgagctctcttctgctactcctgctggtcgcctcaggagacgccgacatgaagggccattttgacccagccaagtgcagatacgccctgggcatgcaggataggaccatacctgactctgacattagtgcgtcaagcagctggtcggacagcacagccgctcggcatagtaggttggaatccagtgatggggatggcgcttggtgccctgccggatctgtgtttcctaaagaagaagaatatctgcaagtcgacctccaacgccttcaccttgtagccttagtggggactcaaggtcgacatgctggtggactgggaaaagagttcagtagatcttatagattgagatattccagggacggacggaggtggatgggatggtag

SEQ ID NO: 11545 - DNA, 306 bp, Artificial Sequence
  Description of Artificial Sequence: Synthetic coding sequence
atgggccctgaggccctgtctagcctactgttgctgctcttggtcgcctctggcgacgccgacatgaagggccactttgatccggctaaatgtagatatgctctggggatgcaagaccgtaccattcccgattccgatatttccgctagtagctcgtggagcgatagcacagcagcaaggcactcacgcctcgaatcaagcgacggggacggggcttggtgtcctgctgggagcgttttcccaaaagaggaagagtacctccaggtggacctgcagagattacacctggtggccctggtaggctag

SEQ ID NO: 11546 - DNA, 393 bp, Artificial Sequence
  Description of Artificial Sequence: Synthetic coding sequence
atgcttgcccctctgtttctttgctgcctgcgaaatctctttaggaagctgatttccttccaacctccccaactaggacgcaccaacatgcactacagcaagctgcccagaacagccatcgagactgagttcaagcagaatgtggggccaccaccaaaggaccttacagccgaagtgtatttcccgtctattaagagccggagccatctcccagcagtgttttacaatcagtactttaagcatccaaagtgcgtcggtgagtatggcccaaaaaatggcgctgagagacagattgaagagaggaaggtgctgccgacaacaatgatgtttagcatgctggcagattgtgttcttaaaagcacacccatccctatactgggagtcgctatgtag

SEQ ID NO: 11547 - DNA, 420 bp, Artificial Sequence
  Description of Artificial Sequence: Synthetic coding sequence
atgccagctatcgctgtgctagctgcggcagccgctgcctggtgttttctccaagtggagtccagacacttggatgcactggctgggggtgctggaccaaatcacggaaactttctagataatgatcagtggctatcaacagtcagtcagtacgaccgggacaaatactggaatagatttagggatgacgattacttccggaattggaatccaaacaagccattcgaccaggcactggatccctccaaggacccgtgtttgaaggtaaaatgcagccctcacaaagtctgcgtaacccaggactatcagaccgccctgtgcgtgtcccggaaacacttgctccctcgccagaagaaggggaatgtcgctcagaaacactgggtgggaccaagcaatctggtgaagtgtaaaccgtgctag

SEQ ID NO: 11548 - DNA, 510 bp, Artificial Sequence
  Description of Artificial Sequence: Synthetic coding sequence
atgagattgcttattctgacctgtcttgtcgcagtcgccctcgccagaccgaaactgccacttcgataccccgagagactgcagaatccctctgagtcatcggagcccattcctcttgagtcgcgggaggaatacatgaacgggatgaatcggcagcgcaatatcctgagggagaagcagacggatgagatcaaaaactgtgtggtagctgagccagaaaaaatggagagctcgatctcatcaagctcggaggagcagttctgtagattgaacgaatacaaccagctgcagctccaagccgctcacgcacaagagcagatccgtcggatgaacgagaatagtcatgttcaggttccgtttcagcagctaaatcagctcgccgcatatccatatgcagtgtggtattacccccaaatcatgcagtatgtgcctttccctcctttcagcgacatcagtaatcctaccgcccatgaaaactacgagaagaacaacgtaatgttacagtggtag

SEQ ID NO: 11549 - DNA, 921 bp, Artificial Sequence
  Description of Artificial Sequence: Synthetic coding sequence
atgaaaaaggatgagccacctctagacttcccagatacactcgagggtttcgaatacgcatttaacgagaagggtcagctacgccacatcaagactggcgaaccattcgtattcaattacagggaggatctgcacagatggaatcaaaaaaggtatgaagcgttaggagagatcattaccaagtacgtgtatgagctcctggagaaagactgcaacctcaagaaggtgtcaatccccgaaggctatggtgtcatcgtactcaaccccaacgaaaactacatcgaagtggaaaaacccaaaatccacgtgcagtctagttcagacagcagcgacgaaccagctgagaaacgggaacggaaggataaagtgtctaaggaaactaaaaagagaagggacttttatgaaaagtatcgaaatccacagcgggagaaggagatgatgcagctgtacattagagaaaatggatctcctgaggaacatgccatctatgtatgggaccatttcatcgcacaagcagccgctgagaacgtctttttcgttgctcatagctatggaggtctggcatttgtcgaactaatgattcagagagaagcagatgtgaagaataaggtcaccgccgtggccctgactgattccgtgcacaacgtgtggcaccaggaggcagggaaaaccattagggaatggatgcgcgaaaactgctgcaactgggtgagtagctcagaaccccttgacacatctgttgaatctatgttgcctgactgtcctcgggtatccgcgggaactgatagacatgagctgaccagctggaaatccttcccatcaattttcaaattcttcacggaagcatctgaggcgaagacgtcttctctcaagcctgctgtaacgcgtcgttcccacaggatcaaacatgaagagttgtag
